United States Patent 9,061,059 (MODIFIED POLYNUCLEOTIDES FOR TREATING PROTEIN DEFICIENCY) - sequence listing, part 95

SEQ ID NO: 186047 - DNA, 13365 bp, Artificial Sequence
  Description of Artificial Sequence: Synthetic coding sequence
atgatgaagctgtacatcgacaacgccgcccccgacaagctgaagggactgtgtatcttcttcgtgagatgtcggaatgacgtcgctatcaacgtaaagactattcaggaggaggccctcttcacagtgctggacgctagtaaaggtctactaaatgggatcagagacatgctggccaacatttttcttcccgctgtgttggccaccaataactggggagctctgaaccagtccaaacagggcgagagtgaaaagcacattttcactgagaccattaaccgatacctgtcattcctggacggggcaagaatatccatcgaggggacggtgaagctgaagactattgataatgtgaatttcagtaagctgcatacatttgaggaggtaaccgccgccgcctcaaactccgagaccgtgcatcagctagaggaggtcctgatggtgtggtataagcagattgagcaggtgcttatcgagtcggagcagatgagaaaggaggctggtgactcgggaccgcttactgagctggagcactggaaacgaatgagcgccaagtttaactacatcatcgaacagatcaaaggaccttcttgtaaagccgtgatcaacgtactcaacgtggcccactctaagctcctcaaaaactggagagacctcgatgctaggataaccgataccgcgaatgagtcaaaagacaacgtccgttatctctataccttggaaaaggtgtgtcagcccctgtacaaccatgacctggtttctatggcacacggtattcagaacctgatcaatgctatcaggatgatccacggcgttagccggtactataacacctctgagcgcatgacatctctcttcatcaaggtaacaaatcagatggttactgcttgtaaagcgtatatcactgatggtggcctgaatcacgtgtgggaccaggagacaccagtagtacttaaaaagatccaggattgtatctttttattcaaagaatatcaggccagcttccacaaaactcggaaactcataagcgaatcatctggggagaagagtttcgaagtgagcgagatgtacatcttcggcaagttcgaagcattttgcaaacgcctcgagaagattacagagatgatcaccgtggtgcagacatacagtacactgtccaattcaaccattgaaggaattgacattatggccataaaattcagaaacatttatcagggggtaaaaaaaaaacagtatgatattctggatccccggaggaccgagtttgacaccgattttcttgactttatgaccaagataaacggtttggaggtgcagatccaggccttcatgaactccagctttggaaagatcttatcttctcaacaggccctgcagctgctgcaacgttttcagaagctgaacattccatgtcttggcctggaaataaaccacaccatcgagcggatcctccagtattatgtcgccgaactggatgcaaccaaaaaactgtaccatagccagaaggacgacccacctctggcccgtaatatgcccccaattgctggcaagatcctctgggttagacagctctaccggagaatctctgagccaatcaactatttctttaagaatagcgacatcctgagcagtccggacggtaaagccgtcatcagacagtacaacaagatcagttatgtcttagtggaattcgaagtcgtctaccatacagcttggatccgtgaaatcagccagctgcattacgccctccaggcaaccttatttgtgcgtcatcccgagaccggcaaactactggtgaactttgaccccaagatcctggaagtggtaagagaaacaaagtgtatgattaagatgaagctggacgtcccagagcaggccaaaaggctgctgaaattggaatcgaaattgaaggcagataaattgtatcttcagggcctcctgcaatattatgacgagctgtgtcaggaggtccccagcgtttttgtgaatctgatgacccccaaaatgaagaaggtcgagtccgttttgcggcagggtctcacagtgttgacatggagctccctgaccttggagtccttcttccaggaagtagaattggtcctggacatgttcaaccagttgcttaagaagatcagtgacttgtgcgagatgcacattgacaccgtcttaaaggaaatcgccaaaaccgtcttaatctcattaccagagagcggggcgaccaaagtagaggatatgctgactctcaacgagacctacaccaaggaatgggccgatatccttaaccacaaaagtaagcacgtcgaggaggccgtgcgagagcttatttcaatattcgagcagatttatgaggtgaagtacactgggaaggtgggcaagcaatccgaacaacgaaagcacgtagtctttgggagcgaaaccggcgaaggcgaaaacaatgactacgaagctaatattgtgaacgaatttgatacgcatgacaaggaggatgaatttaaaaaggagtgtaaggaggtgttcgcgtttttcagccatcagctgctagactctctgcaaaaagctacccgattgtccctggacaccatgaagcggcgcatctttgtagcatcactctatggcagaaaacagagtgaggacatcatctcctttatcaaaagcgaagtgcacctagctattccaaacgtcgtgatgatcccctcactcgatgatatccaacaggcaataaatcgtatgatacagctgaccctggaagtatcacgaggggtggctcactgggggcagcagcagatccgtcctattaagagcgtgattccctcccctaccacaaccgacgtgacccaccaaaacaccggaaagctgttgaagaaggaagagaggagtttcgaagaagctattcctgcgcggaaactgaaaaacttctacccgggagtcgctgaacacaaggatattagcaaactcgtgctgctcctgagctcaagcgttaactctctgcggaaggccgcacatgaggcgctacaggatttccagaaatacaagactttgtggaccgaggatcgtgacgtgaaagtcaaagagttcctggctaataacccgagcttaacagagattcggtccgagatcctgcactacgcaaccttcgaacaagaaatagacgagctgaaacccatcatcgtggtgggcgctctcgaactccacacagaacccatgaaactggcgctgagcatcgaggccaaggcctggaagatgctactgtgccggtatcttaacgaagagtataagaaaaagatgagctatatgatagcatttattaacgaatacctgaagaagctctctaggccgatcagagacctggatgatgttcgctttgcaatggaggcgctgtcttgcattagagacaacgagatacaaatggatatgactctgggcccaattgaggaggcgtacgcgatcctgaatcgttttgaggtggaggtcactaaagaggagtccgaagcagtggacaccctgcggtattcttttaataagctgcagtctaaggcagtgtccgtccaggaggaccttgtgcaggtacagcccaaatttaaatcaaatttgctggaatccgtggaagtgtttagggaggatgtcattaactttgccgaggcctatgaattggaaggcccaatggttcctaatattcctcctcaggaagctagtaaccggctgcagatattccaggccagcttcgatgatttgtggagaaagtttgtgacatacagcagtggggaacagctttttgggctacccgtgaccgattatgaggtgctccacaaaacccggaaggaactgaatctgctgcaaaaactctacggactctacgatactgtaatgtcctcaatctccggatattacgaaatcctgtggggcgacgtggatatagaaaaaatcaatgccgagctcctagaattccagaatcggtgcagaaagttgccaaaaggacttaaggactggcaggcctttttggacttgaagaagcggattgacgacttctctgaatcttgcccgctgttggagatgatgacaaacaaggccatgaagcagagacattgggatcgcatttctgagctcaccggcaccccattcgacgtagagtctgatagtttctgcctgagaaacataatggaggctccactgctcaaacacaaggacgacatcgaggacatatgcatctcagccattaaggagaaagacattgaggcaaaacttacacaggtgatcgaaaattggacaaatcaaaacctgtcctttgcagcttttaaggggaaaggcgaacttctgctgaaaggcaccgagtctggggagatcatcactctaatggaagacagcctgatggtgctcgggtccttattatcaaacaggtataatgcaccctttaaaaaaaacatccagaattgggtctataagctctccacatcatcagacattatcgaggagtggctggtggtgcagaacctctgggtgtacctcgaagcagtcttcgttggaggggatatcgccaagcagctcccacaggaagccaaacggtttcagaacatagataaatcctggattaagataatgcaaagagcccacgagaaccctaacgtcattaattgttgtgtcggagatgaaacgatgggtcagctcttgcctcacctccacgaacagctggaggtttgtcagaagtcactcactggatacctggagaagaagaggctgttgttcccacgattcttctttgtgtctgacccggtgttgctcgaaatactcggtcaggccagcgactcccatacaatacagccccatcttcccgctgtgagcgataatatcaacgaagtgacatttcatgctaaagactatgaccggatcatggcagtcatctctcgcgaaggggagaagattgttctggacaactccgtgatggcaaaagggcccgttgagatctggctgcttgacctattaaagatgcaaatgtctagccttcacaatattattaggagcgctttctatcaaatctcagattcgggctttcagctcctgcctttcctctctcacttccccgcccaggtcggtctgctagggatacagatgctttggacacatgattcagaggaggccctacgcaatgcgaaagatgaccgtaagattatgcaggtgaccaatcagaagttcttggacatcctgaataccctgatttcccagacaactcacgacctttctaaattcgatcgggtaaaattcgaaaccctcattaccatccatgtccatcagagggatatctttgatgacttggtgaaaatgcacataaagtctcctactgatttcgaatggctaaagcagagtcgcttctacttcaaggaagatctcgatcaaaccgtggtttctatcactgatgtcgattttatttaccagaatgaatttctcggatgcaccgatcggttggttattacccctctcacagataggtgctacatcacactggcacaggctctcggaatgaacatggggggtgcgccagctggcccagccggtacagggaaaacagaaacaacaaaagacatggggaggtgcctgggaaagtatgtggtggttttcaattgcagtgatcaaatggattttcggggcctgggacggatctttaagggccttgcccagagtgggagttggggatgtttcgatgaatttaataggatcgagcttcccgtgctgtcagtagcagcccagcagatctatattgtcctgacagctagaaaggagcgcaagaagcagttcatcttctcggatggcgactgtgtcgatctgaatccagagttcggcattttcctgacaatgaatccagggtacgcggggaggcaggaattaccagaaaacctgaagattcagtttcgaaccgtcgccatgatggtccccgataggcaggttcactacgacttcggcctgcgcaacatcctgtccgtgctccggacactcggcagtcagaagagggcccggccagaggatagcgagttgagtattgtgatgcgggggcttcgcgacatgaatctgtcaaaactagtggatgaggacgagccactttttctgtctctcattaatgatcttttccctggactgcagctggattccaacacctacgcggaattgcagaacgctgttgcccatcaggtgcagatcgaaggcttgataaaccacccaccttggaacctgaagctcgtgcagctctatgaaacctcactggtaaggcatgggctcatgaccctcgggcccagcggctcagggaaaactacagtcatcaccatcctcatgaaggcacagactgagtgcggtagaccacatagggaaatgaggatgaatccgaaggcgatcaccgcaccccaaatgtttgggaggttggacaccgcaaccaatgactggacagacggcatcttctcaacactgtggcgaaagacacttaaagccaaaaaaggggagaatatttttctgatcttggacggcccagtggacgccatttggattgagaatctgaactcagtgttagacgacaataaaactctgacgcttgcgaatggagatcgcatacccatggcaccatcctgcaaacttttatttgaggtgcacaacattgaaaacgcttccccagccacagtgagcagaatgggcatggtgtacatctcttccagcgcactgtcttggagacccatccttcaagcttggctcaagaagaggacagcgcaggaagccgccgtgttcctcaccctttacgaaaaggtgtttgaagacacctacacgtacatgaaactgaatctgaatcccaaaatgcaactgcttgagtgtaattatatcgtacagtctctgaacctgctcgaaggactgattccgtctaaggaggaagggggagtgagctgcgttgagcatctgcataaacttttcgtgtttggcctcatgtggagtctgggtgcactgttggagttagagtccagagagaagctggaagcttttcttaggcagcatgaaagcaaactcgacctacccgagatccctaagggtagcaaccagaccatgtacgagttctacgtaaccgattacggggactgggaacactggaacaaaaaactgcagccctattattatcctaccgactcaattcctgaatatagcagcatactggtccccaacgtggacaatatccgtaccaacttcctcatagatactattgcgaaacagcataaagctgttctactgactggtgagcaggggacagccaagaccgtgatggtgaaagcttaccttaaaaagtatgaccccgaggtgcaactatccaagtccttgaactttagtagtgccaccgaaccaatgatgtttcagcggacaatcgagagttacgtcgacaagcgcataggctcgacatacgggccaccggggggccggaaaatgaccgtgtttattgacgacatcaatatgcccgtcattaatgaatggggagaccagattaccaatgaaattgttcgacagatgatggagatggagggcatgtacagcctggataaaccaggggatttcaccactattgtggacgttcagctcattgctgctatgattcacccaggtggtggtcggaatgatattccacagcggttgaagcggcagtttacggtttttaactgtactctccccagcaatgcctctattgacaaaattttcggaatcataggctgtggttatttcgacccgtgccgctcttttaagccccagatctgcgaaatgatcgttaacctcgtgagcgtaggaagagtgctgtggcaatggaccaaggtgaaaatgctgcccaccccctctaaattccattatatatttaatcttagagatttgtcccggatctggcagggcatgctcaccataaaggccgaagagtgcgccagtattcctactctgctgtccctcttcaaacatgagtgctcccgggtcatagctgaccggttcatcacacccgaagatgaacagtggtttaacgctcacttaacgagggcagtcgaggagaacatcggttccgacgccgcttcctgtatcttaccagaaccatatttcgtggacttcctacgcgaaatgcccgagcctactggcgacgaacccgaagatagcgtgtttgaagtccctaagatttatgaactcatgcctagttttgacttcctggctgagaaattgcagttctaccagaggcagttcaatgagattatccgcgggacaagtttggacctggtgtttttcaaggatgccatgactcacttaatcaagatatcccgaatcatcagaaccagttgcggaaatgccctattagttggcgttgggggctctggcaagcagagcctcagtagactcgcaagcttcattgctggttaccagatttttcagataaccttaacacgctcttataacgtgactaacctcaccgacgatcttaaggccctgtataaggttgctggagcggacggcaaaggcataacctttatatttactgactccgagatcaaggatgaggccttcctggagtatttgaataatcttcttagttcaggggagattagcaatttattcgcaagagacgagatggacgagatcacgcaaggcctgattagcgtgatgaagcgggagctgcctcgtcatcccccgacctttgataatttatatgaatatttcatctcccgttctaggaaaaatttacacgttgttctgtgcttttccccagtgggtgaaaagtttagggcgcgctcactgaagttccccggcttgatatctggttgcactatggactggttttctcggtggccaagagaggccctgatcgctgtggccagttacttcttgagcgactacaatatcgtgtgcagctcagaaattaagcgacaggtcgtcgaaacaatggggttgtttcatgacatggtttcggagtcttgtgagagctactttcagaggtatcggcgtagagcacacgtgacaccgaaatcatatttatctttcattaacggatataagaacatctatgccgaaaaagtaaaatttatcaacgagcaggctgagcgaatgaatattggcctcgacaagctgatggaggccagcgaatcagtcgcgaaactctctcaggacctcgctgttaaggagaaagagctcgccgttgcttctattaaagcggatgaggttcttgcagaggttacggtcagtgcacaggccagcgctaagatcaaaaacgaagtgcaagaggtgaaggacaaggcccagaaaatcgtggacgaaatcgactcagagaaggtgaaggcagagtcaaagctggaggcagctaagccggcactggaagaagcagaggctgccctcaacacaatcaagccgaatgacattgccaccgtgaggaaactggccaaaccaccacatctgatcatgaggatcatggactgtgtgctgcttctgtttcagaaaaaaatcgatcctgtgactatggaccccgaaaaatcttgttgcaagccttcgtggggtgagagcctgaagctaatgtcggccaccggattcctatggtctttacagcagttccctaaagacacaatcaatgaagaaactgtggaattgctccagccgtacttcaacatggacgattatactttcgagagcgccaagaaggtgtgcggcaacgtggctgggctcctcagttggactctggctatggctatattctatggaattaatagggaggtactacctctgaaggccaatttggctaaacaagaggggcgtctggcagtggccaatgctgaactggggaaggcccaagccctgctcgacgaaaagcaagccgagttggacaaggtccaggccaaattcgatgcggccatgaatgaaaagatggatcttctcaatgacgctgatacatgcaggaagaaaatgcaggctgccagcaccctaattgacggtctgtccggagagaaaattagatggacccagcagtcaaaagagttcaaagcccagataaatcgcttagtgggcgacatacttttgtgtaccgggttcctgtcttaccttggcccattcaatcagattttcaggaattacctgctgaaggatcagtgggaaatggagctcagagcacgcaagattccattcaccgagaatctcaatttaatttccatgctcgttgacccgcccaccataggagagtgggggctccaaggtctccccggagacgatctttcaatccagaacggaataatcgtgactaaagcaacacgctaccccctgttgatcgatccccaaacacaagggaaaacctggatcaaatcaaaggagaaggagaacgatctacaggtgacatcattgaatcacaagtactttagaacccatctggaggattccctcagcctggggcgccccttgctaattgaagatattcatgaggagctggatcccgcgttggacaacgtgctggagaagaacttcataaaatcgggcaccacatttaaggtgaaagtgggggacaaggaatgcgatatcatggacacattcaaactatacattaccacaaagctgcctaaccccgcattcacccccgagattaatgccaaaacaagtgtgattgatttcaccgttaccatgaagggtctcgaaaatcaactcctaagaagggttattctgacggaaaaacaggagttagaggccgagcgggtgaagctgctggaagacgttacttttaacaagagaaaaatgaaggaattggaggataatcttctgtacaaattaagcgccactaaggggagcttggtggatgatgagtctctgattggggtcttgcgcactacaaagcagacggccgctgaagtgtcagagaaattgcatgtggccgctgagaccgagatcaagattaatgccgcccaggaagagtttcgacccgccgcaacacgtggctctatcctgtattttctgattactgaaatgtccatggttaacattatgtaccagaccagtctcgctcagttcttgaaattatttgaccagagtatggcacgttccgaaaaatctcctctcccccaaaagcggatcaccaatatcattgagtatctgacgtacgaggttttcacttactccgtccgaggtctgtacgagaaccacaagtttctgttcgtcctgctgatgactctgaaaatcgacctgcaacgcggaacggtgaaacaccgtgagtttcaggccctgatcaaagggggcgccgctcttgacctgaaggcctgtccacctaaaccctatcgttggatactagatatgacgtggttaaatctggtagagctgtctaaattgccgcagtttgctgagatcatgaaccaaattagccgtaatgagaagggctggaagtcatggttcgataaggatgcccccgaggaggagatcatccctgatgggtataacgattctctggacacatgtcacaagcttctccttattaggagctggtgcccagaccgcacagtattccaagcacgaaaatatatcgccgactctctggaggagaagtacacagagcccgtcatcttgaacctcgagaagacctgggaagagagcgataccaggaccccactgatttgtttcttgtccatgggctccgaccccacaaatcagattgatgctttggctaagaagctgaagttagagtgtcgaaccatttccatggggcaagggcaggaagtccacgctcggaagctcatccagatgagcatgcagcagggcggctgggtgctcctccaaaactgtcacctcggcctggaatttatggaggagcttctagaaacactcataacgactgaggcttctgacgattcatttagggtttggatcacaactgaacctcatgataggttccccatcacacttttgcagacttcactgaaattcactaatgaaccaccacaaggcgtgcgcgctggcctgaaacggaccttcgccgggataaatcaggacttactcgacatttccaatctgccgatgtggaaacccatgctttatactgttgctttcctgcacagcacagtgcaggagcggcgtaaattcgggccattaggctggaatattccctatgaatttaactccgccgattttagtgcatcagtgcagtttatccagaaccacttggacgaatgtgatataaagaaaggggtgtcatggaatacggtgaggtatatgatcggcgaggtgcagtatggaggtagagtgaccgatgacttcgacaaacgcctcctgaattgcttcgcccgtgtgtggttctctgaaaagatgtttgaacccagtttttgtttttacacaggctacaagatacccttgtgcaagacgttggatcaatactttgaatatattcagtcactgccatccctagacaaccctgaggtgtttgggctccatccgaatgcagacattacctaccaatctaatacagccagcgccgtcctcgagactattaccaacatacaacccaaagagtccggcggcggcgtgggggaaaccagagaggctatcgtctaccgtctttcagaggacatgcttagcaagctgcctcccgactacatcccgcacgaagttaagtctaggttaattaaaatgggccatctgaactccatgaacatattccttcgacaggagatcgataggatgcagcgggtgattagtattcttaggtcctcccttagcgacctgaagttagccattgagggcacaataatcatgagtgaaaacctgagagacgctctagataatatgtacgatgcaagaattccccagttgtggaagcgggtaagttgggattcatcgacccttgggttttggtttactgagctccttgagcggaatgcccagttctctacttggattttcgaggggcgaccaaatgttttctggatgacgggtttctttaacccccagggcttcctgactgccatgcgtcaggaagttacacgcgcccacaaggggtgggccctggatacggtaacaatccataacgaagtattaaggcaaaccaaggaggagatcacttcccccccaggggaaggtgtctacatctacggcctttatatggatggggctgcctgggatagacggaacggaaagctcatggagtctacacccaaggtcctgtttactcagcttcccgtgctgcacatttttgccataaattctactgcgccgaaagatcccaagctgtatgtatgtcccatctataaaaaacccagacgaaccgacctcacattcattaccgtggtgtatctgagaacggtgctgtcacctgaccactggatcctgcgcggagtcgcgctcttgtgcgacatcaaatag

SEQ ID NO: 186048 - DNA, 12567 bp, Artificial Sequence
  Description of Artificial Sequence: Synthetic coding sequence
atggagaaggacgccgaggacggcgcccccagcgagggcgccgaggctcccccctctacggaggaagctgcccccccacgcagcgaagaggaagaggcaccaaggccccccacagtggaggccccggccgaggacggattctcaccgagtgccgaggacgcagtatctagtgtggtcgactatcgtgatctgattccttcagaggaaggcatcgtgctgcccgacgatcacgaagcagatttgaaccgggtcaggcagcgcttagctcctaggcccgtacaatccgtaatctctgaggtgctgtcactaccgtcaagcagaagatcatcccggtacagacgctcgatgtccggattacccaatctccaggagaccctgaaggagagacaggctcggtttcgggaggccagggagtcacgacgcctcaagatcgacccaagttacaaatatatcttcgagatccttgcagagaaccttggactggacattgttactgtggaggagctcatcctggattgcccgagtctagaggctttcacgaattttttcgcaaaagacgggtgcaagactctgaagtttctctatcaagagggcgacgtgcccggcattgaatgtggtcggacaatcgctggtgctacgaaaggcgcaaagatgatgaaactgtacattgacaacgcagcccctgacaaactgaagggcctttgcatatttttcgtgcggtgtagaaatgacgtggccatcaatgttaaaaccatacaggaggaagccttattcacagtgttagatgcatcaaaaggcctgcttaatgggattcgggatatgttggctaatatttttctgcccgctgtcctcgccaccaacaattggggagccctcaatcaaagcaaacagggagagtctgaaaagcacatatttactgaaaccattaaccgctatcttagttttcttgacggggcgcggatctcaatcgagggaactgtgaagctcaaaactatcgacaatgtcaattttagtaaattacacacgttcgaggaggtgactgccgccgcctcaaactctgagaccgtccatcaactggaggaggttctgatggtgtggtataaacagattgaacaggtgttgattgaaagcgaacagatgaggaaagaagctggcgactccggcccacttacagagctggaacattggaagaggatgagtgctaaattcaattacattatcgagcaaatcaaagggccatcctgcaaagccgtaattaatgtccttaatgtggcacatagcaagctcctcaagaattggcgcgaccttgatgcccgaataaccgacacagcaaacgagtcgaaagacaatgttcggtacctgtacacgctggagaaggtgtgtcagccactgtacaaccatgatttggtaagcatggctcatggcattcagaacctcataaatgccatcaggatgattcacggggtttctagatactataacacttccgagcgaatgacatctctgtttattaaggtcactaatcaaatggttacagcatgtaaggcttacatcacagatggaggactgaatcacgtgtgggaccaggagacgccggtggtcttaaaaaaaattcaggactgcatcttcttgttcaaggagtatcaggcctcctttcataagacccggaagttgattagcgaatcgagcggggagaagtccttcgaagtgtcagagatgtatatcttcggaaaatttgaagctttctgtaagaggttggaaaaaattacagaaatgattacagtggtgcagacatattccactctctccaacagcacgatcgaggggatagacattatggccataaaatttcggaatatttatcagggcgtgaagaagaaacaatacgacattcttgacccccgcagaacagagttcgatacagattttctggacttcatgacaaagattaacggactggaagttcagatccaggctttcatgaatagttccttcgggaagatcttatcttctcagcaggccctgcagttgttgcagagattccagaagctgaatattccttgtctgggtctggagattaaccataccattgagagaatcctccagtattacgtggcggaactcgatgccactaaaaaactgtaccattcacaaaaagacgaccctccgttggcccgcaacatgccgcctatagctggcaaaatcctatgggtccgtcagctttacagaaggatttcagagcccataaactactttttcaaaaattctgatattctttcgtccccagacgggaaggcggtcattagacaatataacaaaattagctacgttctcgtggaattcgaagtagtctaccacactgcctggatccgtgaaatatctcagctccactacgcgttgcaggctaccctctttgtgagacatccagagaccggaaaactgctcgtgaattttgatccaaaaattctcgaggtggtgagagaaacaaaatgcatgatcaaaatgaagctggacgtgcccgagcaagccaaaagattgttgaaattggagtcaaaactgaaagctgataaactttatctccaaggactgctacagtattacgatgagttgtgtcaggaagtcccaagtgtctttgtgaatttaatgaccccgaagatgaagaaggtagaatccgttctccgccagggcctgaccgtgttgacctggagctctttgacgctggagtccttctttcaggaggtcgaactggtgcttgatatgttcaaccaactcctgaagaaaattagtgatctgtgtgagatgcacatcgacactgtgctgaaggaaattgccaagaccgttctgatctctctgccagaaagcggagcaactaaggttgaggacatgctcaccttgaatgagacatacactaaagagtgggccgacatcctcaaccataagtccaagcacgtggaggaggccgttcgggagctgatctcaattttcgagcagatctatgaggtcaagtacaccggcaaggttggcaagcagagtgaacagaggaaacatgtcgttttcggttccgaaacgggcgaaggcgaaaacaatgactacgaggcaaacattgttaatgaattcgacacacacgacaaggaagacgaatttaagaaagagtgtaaggaggttttcgcattctttagccatcagctgctggatagtcttcagaaagctactagactgagcctcgacaccatgaagcgtaggatcttcgtggcttctctatacggccgaaagcaaagcgaggacataatttcatttattaaatccgaggttcacctcgctatacctaacgttgtgatgattccaagtctcgatgatattcaacaggctatcaaccggatgatccagctgaccttggaggtctcccgaggcgtggcccattggggccaacaacaaattaggccgataaagagcgtaattcccagccctaccacaacagatgtcacccaccagaacactggaaagctcctcaagaaagaagagcgaagttttgaggaggctattccagctcgcaagctaaagaatttttaccccggcgtggctgagcacaaagacatttcgaaacttgtgttgctgcttagcagcagcgttaacagcctgcgcaaggccgcccatgaggcgctgcaagactttcagaagtacaagactctgtggaccgaggaccgggacgtgaaagtgaaagagtttttggcaaataatccatcactgacagagataagatcagagatcctccattacgcgactttcgaacaggagattgacgagctgaagccaatcatcgttgtaggagccctggagctccacacggagcccatgaagctcgcactaagcatcgaagccaaggcgtggaaaatgctgctgtgcaggtatctgaacgaagagtacaagaaaaagatgagttacatgatcgccttcattaacgagtatttgaaaaagctgagccgccctatcagggacctggacgacgtgcgcttcgccatggaggccctgtcttgcattagggacaatgagatccagatggacatgacccttgggcccatcgaggaagcctatgccatactgaataggttcgaggttgaagtcacaaaggaagaatccgaagcagtggataccctgaggtatagctttaataagctgcagagcaaggctgtgtccgtccaggaggatctcgttcaggtacagcccaaattcaagagcaatctgttagaatctgttgaggtcttcagggaggatgtcattaacttcgccgaggcatatgaattagagggtccaatggtccccaacatcccgccgcaagaagcctccaatagattgcaaatcttccaagcttctttcgacgacctgtggagaaagttcgtcacatactctagcggggaacagctattcggtctacccgttaccgattacgaagtgctgcacaaaacaagaaaggagcttaacttattacagaagctgtacgggttatacgacacagtgatgagctccatctctggttactatgagatcttgtggggcgacgtcgatattgaaaaaatcaatgctgaactgctggagttccagaatcggtgtcgcaagctgccaaagggtttgaaggactggcaggctttccttgacctgaagaaaagaatagacgatttttccgagagttgccctttattggagatgatgaccaacaaggcaatgaagcagcgccactgggaccgcatatcagagctcaccggcacaccttttgacgtcgagtcggactccttctgtttgcgcaatattatggaggcccccctgttgaaacacaaggacgatattgaggatatttgtatcagtgctataaaggaaaaggacatcgaagcgaagctcacccaagtgatagaaaactggacgaatcagaatctgagctttgcagcatttaagggcaaaggagaactgctgttgaaaggaacagagagtggcgagatcatcacactgatggaggattctctcatggttctgggaagtctattgagcaaccggtataatgccccatttaagaagaatatccaaaattgggtctacaagctcagcactagcagcgacatcattgaggagtggctggttgttcagaacctttgggtatacctcgaagcggtctttgtgggaggggatatagccaaacagctgcctcaggaggccaagagattccagaatatcgataagagctggattaagatcatgcaacgggcccacgagaaccctaacgtgatcaactgctgtgtgggcgacgagaccatggggcagctgctcccccacctccacgagcagctcgaagtctgccagaagtctttgactgggtacctggagaagaaacggctattgttcccccggtttttttttgtgagtgatcctgtgcttttagaaatcttaggtcaggcaagcgatagccatacaatacaaccccatctgcccgctgtatcagataacataaacgaggtgacctttcacgccaaggactacgaccgaattatggccgtgatttccagggaaggcgagaagattgttctggataactccgtgatggccaaagggccagtggagatttggcttctggacctgctcaagatgcagatgagttccctccacaacatcatacgcagcgccttctaccagatcagcgacagcgggttccagctgttgccctttctctctcacttcccggctcaggtgggtctcctcggcatccagatgttgtggacacacgactcagaagaagccctgagaaacgctaaggacgatagaaagattatgcaggtgaccaaccagaaatttttggatattctcaacacgctgatttctcagacaacgcatgacctaagcaagttcgatcgggtcaagtttgagaccctgataacaatacacgtacatcagagagacattttcgatgatttagtcaaaatgcacattaagtctcccaccgactttgaatggctgaaacaatcccggttctattttaaggaggaccttgaccagactgttgtaagtatcaccgatgtagactttatttaccaaaacgagttcctgggctgtacagaccgactggtgatcacacccctgaccgatagatgctatatcacactggcccaggctctgggtatgaatatgggcggcgctccggcaggtccagctggcacaggcaaaactgagaccactaaagacatgggccggtgtctcgggaagtacgtcgtggttttcaactgttcagaccagatggattttcgtggtctggggcgaattttcaaggggctggcgcagtcaggctcatggggttgtttcgacgagtttaatagaattgaactccccgtgcttagcgtggccgcccaacagatctatatcgtgttgactgctcggaaagagcgcaagaagcagttcattttttccgacggagactgtgtggacctgaaccccgaatttgggattttccttacaatgaatcccgggtacgccggcaggcaggagctgccggagaacctgaagattcagtttcggacggtggcaatgatggtcccggaccgacagattatcatgagggtgaagttggcgtcttgcggattcctcgaaaacgtaatcctggctcagaaattctacgtgttgtacaaactgtgcgaggagcagttaacaaagcaggtgcattacgatttcggcctgcgcaacatcctttctgtgctacgcacactggggtcccagaaacgagccaggcccgaggactcagaactgagcattgtcatgaggggactgcgtgatatgaacctcagcaaactcgtggatgaggacgaacccctctttctgtctctcatcaatgacctctttcccgggctgcagctcgatagcaacacttatgccgagttacagaatgctgtcgctcatcaggtgcagattgaaggcctgatcaatcacccaccttggaacctgaaactggtgcagctctatgaaacctcactggtgagacatgggttgatgacactgggcccatcaggttcaggaaagaccactgttatcactattctcatgaaagcacagactgagtgtggacgacctcatcgcgaaatgcgaatgaatcccaaggcaattacagcacctcagatgttcggcagattagacacagcaaccaacgactggacagacgggattttttcaaccctgtggcggaagaccctgaaggctaagaagggggagaatatctttttgattcttgacggacctgttgatgccatctggatagagaaccttaactctgtgctggacgacaataagaccctgacactcgcaaatggcgacaggatccctatggcgcccagctgtaagcttctctttgaagtgcataacatcgagaacgcaagtccagccactgtgtccaggatgggaatggtttacatctcatccagcgcgctaagctggcggcctatcctccaggcctggttaaagaagcgaacggcacaggaagctgccgtgttccttaccttgtatgagaaggtgttcgaggatacctatacatatatgaaactaaacttaaatccaaaaatgcagctcctggagtgtaactacatcgtgcagtccctgaatctgctagagggacttattccaagcaaagaggaagggggcgtgtcgtgcgtagagcaccttcataaactgtttgtgttcgggcttatgtggagcctcggcgcacttctggaactggagtctcgagaaaagctggaggcctttctgcgacagcacgaaagcaagctggacttgcccgagattcctaagggcagcaaccagaccatgtacgaattttacgtgacagattacggagactgggagcactggaataaaaagctccagccatattactaccctacagactccattcccgaatacagtagcattctagtgcctaacgtagataatatccgcaccaactttcttatcgataccattgccaaacagcataaagctgtactcctcacaggagaacaaggcactgctaaaacagtcatggtgaaagcctacctgaagaagtacgacccagaagtgcagctgagcaagtctctgaatttttcttcagcgacggagccaatgatgttccaaagaacaatcgaaagctacgtggataagcgtattggctcgacttacggaccacctggcggcagaaaaatgaccgtttttatagacgacattaatatgcccgtaattaacgagtggggcgaccagattacgaatgagatcgtgagacaaatgatggagatggagggcatgtattccctagataagcctggcgacttcacaacgattgtggatgtgcagctgattgctgcaatgatccatcccggaggaggcaggaacgatattccccagcggctgaagcgccagtttaccgtctttaactgcactcttccttctaacgcatccattgacaagatctttggaattattggctgcggatacttcgacccttgtcgtagttttaagccccagatatgcgaaatgattgtgaacctggtctccgttggccgtgttttgtggcagtggacaaaggtcaagatgctgcccaccccctctaagtttcattatatcttcaatctcagggacctatcccgtatctggcagggaatgttgaccattaaggctgaggagtgcgcttcaatcccgaccctgctttctctgtttaagcacgaatgtagtcgtgtgatagccgaccgctttattaccccagaggacgaacagtggtttaacgcccatctgacgagagccgtggaagagaacataggaagcgacgcagcctcctgtatattgcccgaaccctacttcgtggacttcttacgcgagatgcccgagccaactggcgatgagcctgaggacagcgtgttcgaagtgccaaaaatctatgagctgatgccgtccttcgattttctcgccgagaagctgcaattctaccagaggcagtttaacgagatcatcaggggcacatctctagacctcgtattcttcaaagacgccatgacccacttgattaagatctcccgcatcatcaggaccagctgcggtaacgcccttctggtcggcgtcggcggctctgggaagcagtcactgtccagattggcctctttcatcgctggctaccagattttccagatcacactaacccgctcttacaatgtaaccaatctgaccgacgatctgaaggcactgtataaggtggctggcgccgatggcaagggcattaccttcatttttacagacagtgagattaaagacgaggcgtttctggaatatctgaacaaccttctcagctctggtgagataagcaatctattcgctcgcgatgaaatggatgagattacccaggggttgattagcgtgatgaaaagagaactgccaaggcatccgcctacatttgacaatctctacgagtatttcatctctcgcagccgaaagaatttgcacgtggtgctgtgtttttctcctgtcggcgagaagtttcgagcacggtcgctcaaatttcccggattaatatctgggtgcacaatggattggtttagccgatggcctagggaagccctgattgctgtggcttcctattttcttagcgactacaatatcgtgtgttccagtgaaatcaagcgtcaggttgtggaaacgatgggactttttcacgacatggtcagcgaaagttgtgagagctattttcaaagatatcgaagacgagctcacgtaacacctaagagttacctgtcattcatcaacggttataagaacatctatgccgagaaggtgaaatttatcaatgaacaggccgagcggatgaacatcgggctggataagctgatggaggcctcagagtcggtggccaagctgagtcaggacctggctgtgaaagagaaggaactggcagttgctagtattaaggccgacgaagttcttgcagaagttacagtgtctgcgcaggcaagcgcaaagatcaaaaacgaggtgcaggaagtgaaggacaaagcccagaagatcgtggacgagatcgattctgagaaagtcaaggccgagtccaaactggaggcagctaaacccgctctggaagaggccgaggccgcgctcaacaccattaagcccaatgacatcgctactgtcagaaaacttgccaaaccacctcaccttatcatgcgcattatggattgcgtgttgctgctctttcagaaaaagattgaccctgttaccatggatcctgaaaagtcatgttgcaagcccagctggggggagtctttaaagttaatgtccgccaccgggttcctgtggtctctgcagcaattcccgaaggatactatcaatgaggagaccgtcgagttgctacagccttacttcaacatggatgattacacctttgagagtgccaaaaaagtttgtggaaatgtagcgggcctgttgtcctggaccctggctatggccatcttttacggcatcaaccgggaggtgctgccccttaaggccaatttggctaagcaggaggggcgcctcgccgttgcaaatgccgaactaggtaaagcacaggccctgctcgacgagaagcaggccgaactagacaaggtgcaagctaagttcgacgccgcgatgaatgagaaaatggacctgctcaatgatgccgacacttgtcgcaagaaaatgcaagcggctagcacgctgatcgatggattaagcggggaaaaaattaggtggacacaacaatcaaaagaattcaaggctcagattaatcgattggtgggcgatatcctcctttgcaccggctttctctcctatctagggccattcaatcaaatctttcggaattaccttctgaaggatcagtgggaaatggagctccgtgccagaaagattccatttactgaaaatttaaatttgattagtatgcttgtcgacccccctacgattggagagtggggcctgcagggcttgcccggggatgatctatcaatccaaaatggcataattgttacgaaagccacccgttaccccctccttatcgatccccagacacagggcaagacctggatcaaaagcaaggagaaagagaatgacctgcaggtcacatcgctgaatcataagtacttccgcactcacctcgaggattccctgagtctgggtcgcccattgttgatagaggatatccatgaggagctggaccctgccttggacaatgtgctagaaaaaaatttcatcaagtctggtaccacattcaaagttaaagtgggggataaagagtgcgacattatggacacttttaagttatacattaccaccaagctgcctaacccggcttttacccctgaaataaacgctaagacatccgtcattgattttaccgttaccatgaagggcctggagaatcaattactcaggagagtcatccttaccgaaaaacaggagcttgaggccgagcgcgttaaactgctcgaggatgtgacttttaataagcgtaaaatgaaagagcttgaggacaatcttctgtataaactctccgctactaagggttctctagtcgatgatgagtctctcattggcgtgctccgcacgactaagcagacagccgcagaggtgtcggagaagcttcacgttgcggccgagaccgaaatcaagatcaacgccgcccaggaagagtttcgcccagctgccacccgggggtccatcctctacttcttgatcaccgaaatgagcatggtcaacatcatgtaccagacatccctcgcccagttcctgaaactttttgatcagtctatggccaggtctgaaaagagcccgctgccacaaaaaagaatcacaaatattatcgaatatctaacttacgaggtgttcacatattctgtccgagggctatacgagaaccataaatttcttttcgttcttcttatgacactgaagattgacctgcagagaggcaccgtaaaacacagggaatttcaggccctgattaaggggggcgctgcactagatctgaaagcctgtccaccaaaaccatataggtggattctagacatgacatggctgaatctcgttgagcttagtaaactgccacaattcgctgaaatcatgaaccagatctccaggaatgaaaaaggttggaaaagttggtttgacaaggacgctcccgaggaggaaataattccagatggatacaatgacagcctggatacatgtcacaagctgctgcttatcaggtcatggtgcccagaccggaccgtgtttcaggctagaaaatatattgctgattctctggaggagaaatataccgagcccgttattttgaacctggaaaagacttgggaggaatctgatacgcgaacaccccttatttgctttctgagcatggggagcgatcccacgaatcagatcgacgcccttgccaagaaactgaagctggaatgtaggaccataagtatgggacaggggcaggaggtgcacgcccgcaaattaattcagatgagcatgcagcaggtgtgcgataagcggctactcttactccaacattactgttag

SEQ ID NO: 186049 - DNA, 13461 bp, Artificial Sequence
  Description of Artificial Sequence: Synthetic coding sequence
atgcggctggccgaggagcgggccgccctggccgccgagaacgccgacggggaaccaggggcggacaggcgattgcgcctgttaggtacctatgtggctatgagcctgcgtcccgcggctggcgcgtgggaacggtgcgccggctcagcggaggccgagcagttgttgcaggctttcctggggcgggacgctgctgagggccctcgcccactactcgtggtgcgccctgggcctcgaggactggccatccgcccaggattggaggtcggtcctgaatccggtctggctggcgctaaagccctcttcttcctcagaaccgggcccgaacctcctggaccggattccttcagaggcgcagttgtctgcggtgacctgccagctgcccccctggaacacctcgccgccttattcagtgaagttgtactgcccgttctggccaacgagaagaatcgtctgaattggccccatatgatttgtgaggacgtgaggaggcacgcccacagcttacaatgtgacctctcggtgattctggagcaggttaagggaaagaccctgctgcccctgccagccggcagcgagaagatggaattcgctgacagtaagtctgaaacagtcctggattcaatcgacaaatctgtgatctatgccatcgagtccgctgttataaagtggtcataccaggtgcaggtggtccttaaacgggaaagcagccaacctctgctccagggggaaaatcctacacctaaggtggaactcgagttctggaaaagtagatatgaggacctgaaatacatttataaccaactcagaacaattacagtccgcggaatggccaaacttttagacaagctgcagagctcatactttccagccttcaaggctatgtatagggatgtggtggcagcactggcggaagcgcaagacattcacgttcatttgatccctctacagaggcatctggaggcgcttgagaatgctgaattcccggaggtgaagccacagctacggccgctgctccatgtggtgtgcctaatttgggccacctgcaagtcttaccggtcgccaggacgacttacagtgcttcttcaggagatctgtaatctgcttatacaacaggcatccaactacctttccccagaagacctcctaagaagcgaagtggaggaatcccaacgtaaactacaggtcgtgtccgacacacttagcttttttaagcaagagttccaggacagacgcgagaacttgcatacctattttaaagaaaaccaagaagttaaggaatgggacttccagagctcactcgtctttgtccgccttgacggattcctcggtcagctgcacgtggtggagggcctcctgaagaccgcccttgactttcacaagctggggaaagtcgagttctcaggcgtgcgggggaatgccctgtcgcagcaggtgcagcagatgcacgaagagtttcaggagatgtacagattactgtccggcagttcaagtgactgtctttaccttcaatctaccgattttgaaaacgacgtgtcggagttcaatcagaaggttgaggaccttgaccgaaggctaggaactatttttattcaagcttttgacgatgccccaggcctggagcacgccttcaagcttttagacatcgccggaaacctcctggagcgcccgttagttgcacgcgatacaagtgataagtaccttgttttgattcagatgtttaataaggaccttgacgccgttcgaatgatttactcacagcacgtgcaggaagaggctgagctggggttttctcctgttcacaaaaatatgcccacagtcgcaggaggactgcgatgggcacaggagctccgtcagcgcatccagggacctttttccaacttcggtcgcattactcacccttgcatggagagcgcggaggggaagcgaatgcagcagaaatacgaggacatgctctcacttcttgagaaatacgagaccaggctgtatgaggactggtgtcgaaccgtgagcgagaagtctcagtacaacctgagtcagccattactgaagagggacccagaaactaaggagatcactattaatttcaacccccagctgatatccgtactgaaagaaatgagttacctggagccacgtgaaatgaagcacatgcccgagaccgccgctgccatgtttagttctagagatttttaccgacaattagttgctaatctggagctaatggctaactggtacaacaaggtcatgaaaaccctcctggaggtcgagttcccccttgtggaggaggaattgcagaatatcgacctgcgactgagggctgctgaggaaaccttgaactggaaaacagaaggcatctgcgactacgtcactgaaatcaccagttcgattcacgacctcgaacagagaattcagaagacaaaggacaatgtcgaggagattcagaatataatgaaaacctgggttacaccaatcttcaagacgaaagacggcaagagagagtccttattatccctggacgatcggcatgaccgcatggagaagtattacaaccttatcaaagagagcggcctgaagatccatgcgctcgtgcaggaaaatctgggcctgttctctgctgaccctacaagtaatatatggaaaacatacgtgaacagcattgacaacttattgcttaacggctttttcttagctatcgaatgtagtctgaagtacctgctggagaatacagagtgtaaggctggcctcacgcctatattcgaggcacagttatcgttggccatccccgaactagttttctatccctctctcgaaagcggtgtgaaagggggcttctgcgatatcgtggaaggcctcatcactagtattttcagaatccctagcttggtaccaagactgtccccccaaaatggatctccacactaccaagtcgatctcgatggtatacccgacctggctaacatgagacgtacactcatggagagagttcagcgtatgatgggtttatgctgtggttatcagtccactttttctcaatactcttacctgtacgttgaggaccggaaggaagtcctgggtcagttcctgctgtacggccatattctgactccagaggagattgaagatcatgtagaggatggaatccccgagaatccaccattgcttagtcagttcaaggtgcagatcgactcgtatgagaccctttacgaggaagtttgtaggttggagccgatcaaggtctttgatggatggatgaagatagatatccggcccttcaaggcatccctgctgaacattattaaacgttggtcccttttgtttaagcagcacctggtggatcacgtaacccactccctggctaacctggatgcctttatcaaaaagtccgaatccggtctgctcaagaaggtcgaaaagggcgatttccagggcctggtcgagatcatgggacatctcatggctgtgaaggagaggcagagtaacacagatgaaatgttcgagcccctgaagcagactatcgaattgcttaagacatacgagcaggaactgcccgagacagtgtttaagcaattagaggagctgccggagaagtggaacaacattaagaaggtagctatcactgttaagcagcaggtcgctccattacaggccaacgaggtgactttgctgaggcagaggtgcacggcattcgatgccgaacaacaacagttctgggaacaattccacaaagaagccccgttccgatttgatagtatccatccacatcagatgttggacgccaggcacatcgagatccaacagatggagagtacaatggcgtctatctcagaaagcgcctccctgtttgaggtgaacgtccctgattataaacaacttaggcagtgtaggaaagaggtgtgccagctgaaggagctttgggacaccattggcatggtgaccagcagcatccacgcctgggagacaaccccgtggcggaatattaacgtggaagcaatggagctcgagtgtaagcagttcgctcgtcacataagaaacctcgataaggaggtccgagcatgggacgcattcacgggcctcgagtctactgtgtggaacaccctcagcagtcttagggccgtagctgagctacagaatcctgcgattcgcgagagacattggagacagctaatgcaggctacgggcgtgagttttaccatggatcaagataccacactggcacacctcttacaactgcagctgcaccactacgaggatgaagtgagaggaatcgtcgacaaagcagccaaagagatgggaatggagaagacactcaaagaactccagactacctgggccggcatggagttccagtatgaacctcaccctcgtactaatgtcccactgctttgcagcgacgaggacctgattgaggtgctcgaggataatcaggtgcaactgcaaaatttggtgatgtccaaatacgtcgccttttttcttgaagaagtttcagggtggcagaaaaagttgagcactgtcgacgctgtgatcagcatttggtttgaagttcagcgtacttggacacacctggagtccatcttcacagggtccgaagacatcagggcccaactgccccaggattctaagcgcttcgaagggatagacattgatttcaaagaattagcctatgacgcacagaaaatccccaatgtcgtgcagactactaataaacctggtctgtacgagaagttggaggatatacagggtcggctctgtctgtgcgaaaaggccctggccgagtacctggacacaaagcggcttgccttccccagattctactttctgtcttctagcgacctgcttgacattcttagcaatggtactgcgccgcagcaggttcaacggcacttgtcaaagttgtttgacaacatggctaagatgcggttccagctggatgcctcaggcgagccaaccaaaacgagcttaggaatgtatagcaaggaagaggagtatgtcgcctttagcgaaccctgtgattgcagtggtcaggtcgagatctggctgaaccacgttttgggccatatgaaagcaacagtgcgacacgagatgacggaaggcgtgacagcatatgaggaaaagccgagagagcagtggcttttcgaccacccagctcaggtcgccctcacatgtacccagatttggtggaccactgaggtcggcatggcgtttgccaggctggaagagggctatgaatcagccatgaaggattactataaaaaacaggtcgcccagctgaagactctcattaccatgttaatcggccagctgagcaagggagacaggcaaaagattatgaccatctgcactatcgatgtccacgcgcgggatgttgttgccaaaatgattgctcagaaggtcgataacgcacaggctttcctgtggctgtcccagcttcgccatcgctgggatgacgaagtcaagcactgttttgctaatatttgcgacgcgcagttcctttacagctacgagtatcttgggaacacgcctcggctggttatcactccactaaccgaccggtgctatatcaccctaacccagagcctgcacttgactatgagtggcgctcctgcaggaccagctggaaccgggaaaaccgagacaaccaaggatttgggccgggcgcttggaatcctcgtgtacgtgttcaactgctctgagcagatggactacaagtcctgcggcaacatctacaagggcttggcccagacaggcgcatgggggtgcttcgatgagtttaacaggatttctgtggaagtcctgagtgtggtggctgtgcaggtgaagtcgatccaggatgccatacgggacaaaaaacagtggttcagcttcctcggagaggagatttctctcaatccctcggtgggtatattcatcactatgaatcccggatatgcgggtaggacggaactccctgaaaatctgaagtcactttttcgcccctgtgctatggtggtgcccgattttgaactgatatgcgagattatgcttgtggctgagggctttatcgaagcccaaagtcttgccagaaaatttattacactgtatcaactgtgtaaggagctgctcagtaaacaggaccattacgattgggggctgagagctatcaagtccgtgctagtggtagccgggagcctcaagcggggggatccagatcggccggaggatcaggtcttaatgaggtctctgcgcgatttcaatatccccaaaatcgtgactgacgatatgccaatctttatgggcctgatcggcgacttatttcccgctcttgatgtccccaggaggcgagatccaaatttcgaggcgctggtgcgcaaagcaattgttgacttgaagctgcaggccgaagataatttcgtcctcaaggtggtgcagttagaggaactgctcgccgttcgtcatagcgtatttgtagtgggcggagctgggacgggcaagtcgcaggtcctgagatcactacataagacctatcaaatcatgaagcggaggccagtgtggaccgatctgaatccgaaggctgtaactaacgacgagctgtttgggattattaatcccgccaccggggagtggaaagacggcttgttcagcagcataatgcgcgagctggccaacatcacacacgatggcccaaaatggatcctccttgacggcgatatcgaccctatgtggatagagagtcttaatactgtgatggatgataataaagtccttaccttggcctccaacgaaaggattcccttgaacccaactatgaagctgttgtttgagatctctcatcttaggactgccacccctgctactgtgagcagggccggaattctctatatcaacccagcagatctcgggtggaatcctccagtgtcatcatggatcgaaaaaagagaaatccagaccgagcgggcaaacctcacaattttgtttgacaagtatctgccaacctgcctagataccctaagaactcgatttaaaaagattatacctattcctgaacagtctatggtccagatggtctgccatttgctcgaatgtctcctgaccacagaagatattcctgccgactgcccaaaggaaatatacgagcattacttcgttttcgcggctatatgggcgttcggaggtgccatggtccaggaccagttggttgattatcgggcggaattctctaaatggtggttaaccgaattcaagaccgttaagttcccttcccaaggtaccattttcgactactatatcgaccctgaaaccaagaagttcgagccctggagcaaacttgtgcctcagttcgagttcgaccctgagatgcccctgcaggcgtgcctggtgcacacgagcgaaaccatccgggtttgctatttcatggagaggttgatggcgcggcagagaccagtcatgttggtcggtacagctggcacgggaaagtccgtcctggtgggggctaagttggcctccctggatccagaggcctatttagtgaaaaatgttcccttcaactactacacaacaagcgcaatgctgcaggccgtgctcgagaagccactggaaaagaaggctggccgaaactacggcccgcccggaaacaagaaattgatttatttcatcgacgacatgaacatgcctgaggttgacgcctacggcaccgtgcagccccataccataattcggcagcacttagactacggccactggtatgacaggagcaaactgtctctcaaggagattactaatgtgcagtatgtgagttgtatgaaccccacagcaggttccttcactatcaatccccgcctgcaacgccacttctccgtcttcgtgctgagtttcccaggtgcagacgctctttccagtatttattctataattctcactcagcatctcaagcttggaaactttcctgcttccttgcagaagtccatcccacccctcatcgatttggctcttgcttttcaccagaaaatcgcgaccactttcctgcccaccggaatcaagtttcattatatatttaacttgcgcgactttgcaaacatattccagggcattctgttttccagtgtggagtgcgtcaaatccacttgggatctgatcaggctctatttgcatgagagtaatcgcgtctatagagacaaaatggtggaggaaaaagattttgacctattcgacaagatccagacggaggtactcaagaagaccttcgatgatatagaagaccccgttgaacaaacgcagagccctaatctgtactgtcactttgccaatgggatcggagagccgaaatacatgcccgtccagtcatgggaattgctgacccagaccctagtagaagcactcgagaatcacaatgaggtgaatacggttatggacctcgttctgttcgaggacgctatgcggcacgtttgtcatattaaccggatcctggagagtccccgggggaatgctctcctcgtgggggtgggtggaagcggcaagcagtcactcactcgtttagcagcgtttatatcgagtatggatgtgttccaaattaccctgagaaaggggtatcagatccaagattttaagatggatctggcaagtctgtgcttaaaagcaggcgttaaaaatctgaacacagtgttccttatgaccgatgcccaggtggccgacgagagatttcttgtactcatcaacgacctcctggcctctggagagatccctgatctctatagcgacgacgaagtggagaacataattagcaatgttcggaacgaggtgaagtcccaaggtctggtagataaccgggagaattgctggaagttttttatagatcgcatcaggcgtcaattgaaagtcaccttgtgcttttcacccgtcggaaacaaactgcgggtcaggtctcgcaaattccccgcaattgttaactgtactgctatccattggttccatgagtggcctcagcaagccctcgagtcagtgtcattgcgatttctgcagaacacagagggcattgagcccaccgtgaaacagagtatcagcaagtttatggccttcgtgcacacctccgtaaaccagacatcgcagtcatacctaagcaacgaacagcgttataattataccactcccaagtcgtttcttgaattcatcagactgtatcagtccttactgcaccgccaccggaaggagctgaagtgcaagacagaacgtctggagaacggcctcctcaagctgcacagtacttcagctcaggtcgacgacctgaaggcgaaactagccgcccaggaggttgaactcaagcagaaaaacgaagatgctgacaagctgatacaggtggtgggcgtggagacagataaggtcagcagagaaaaggctatggccgatgaagaagaacagaaggtcgcagtgatcatgctcgaggtcaagcagaagcagaaggactgtgaggaggatctcgcgaaagcagaacctgctctgacagctgcacaggctgctcttaataccctgaataagacaaacttgactgagctgaaatccttcggaagtccccctttggccgtgtctaacgtcagtgcagctgtaatggtgttgatggccccacggggccgtgtgccgaaggacagaagttggaaagcagccaaggttacaatggccaaggtagacggcttccttgattcccttattaatttcaataaggagaacatccatgagaattgtctaaaggccatccggccatatttacaggatcccgaattcaatccggagtttgtggccacaaagtcctacgctgcagcgggcctgtgctcctgggtaattaatatagttagattctacgaagttttttgcgatgtagaacctaaacgccaagccctgaataaggcgaccgccgatctgactgccgcccaggaaaagctggcagcaatcaaagcaaaaattgctcacctaaatgagaacctcgctaagttaaccgcaagatttgaaaaagccaccgctgacaagcttaagtgtcagcaagaggctgaggtgacggctgtaacgatatccttagccaatagattggtcggcggactcgcctcggaaaatgttcgctgggcagacgctgtgcaaaacttcaagcagcaggaaaggaccttgtgcggagacattctgcttatcacagcattcatttcataccttggcttttttacaaagaagtaccgccaaagtctgctggatagaacctggaggccctatctctcccaacttaagaccccaatccctgtgaccccagcactggatcccttgcggatgctgatggacgacgccgacgttgcggcatggcagaacgaggggctgccagccgatcggatgagcgtggagaatgcaacaattcttatcaattgcgagagatggccattgatggtagacccccaattgcagggcataaagtggatcaaaaataaatacggggaggacctcagggtaacgcagattggacagaagggctacctgcaaattatcgagcaggctctagaagccggcgcagtcgtgctgatagagaacttagaggaatcaatcgatcctgtgctgggacccctgttaggtagggaggttatcaagaagggcaggttcataaaaatcggtgacaaggagtgtgagtacaaccccaagttccgcttgatactgcacactaagcttgccaacccccattatcaaccggaactccaagcccaggctacactaatcaatttcaccgtgacacgcgatggtttggaagaccagctgttagctgccgtcgtctctatggaacgacccgacttagaacagctgaagtccgacctgaccaagcaacagaatggcttcaagatcacacttaaaacactcgaagattcattgttgtcccggctttcttcggcttcaggtaattttttaggtgagaccgtactggtggagaacctggagataactaaacagacagctgccgaagtggagaaaaaagtgcaggaggctaaagtcacggaagtgaagatcaatgaagctcgcgagcattaccggccggcagctgcgagggcatcgctcctgtacttcattatgaacgacctctctaagatccaccccatgtatcagttcagcctgaaagcatttagtatcgtattccagaaagcagtcgaacgggctgcacccgacgagtcgctgcgcgagagagtggcgaacctgatcgatagcattaccttcagtgtttaccaatataccattagaggcttattcgaatgtgataagttaacatacctggcccaactgacctttcaaatcctactgatgaatcgggaagtgaacgccgtagagttggattttttactgcggagtcctgttcagaccggcaccgcaagcccagtcgagtttttatctcaccaagcatggggcgcagtcaaggtgctgagctccatggaagagttttcaaatctggacagagatatcgaaggttctgccaagtcctggaagaagtttgttgagtcagagtgccccgagaaggaaaagcttccacaggagtggaaaaacaagaccgctctgcaacgcttgtgtatgctccgcgccatgcgccctgatcgcatgacctatgcactcagagactttgttgaagaaaaattaggtagcaaatatgtggttggccgcgccctggatttcgccacctctttcgaagaaagtggacctgccaccccaatgttttttattctgagtccgggggtggaccccctgaaagacgtggagtctcagggccggaagctcggctacacctttaacaatcagaactttcacaatgtgtcacttggccagggacaggaggtggtggctgaagccgcgctggacctggcagccaagaaagggcactgggtcattttgcagaacattcacttggtcgctaagtggctgtccactctggagaaaaagctggaggagcattcagagaactcccacccagagttccgagttttcatgtctgccgagcctgctcctagccccgagggacacatcatcccgcaaggcatacttgaaaatagcatcaagattactaatgagccgccaacaggcatgcacgccaatttacataaggccctggacaattttacccaggatactttagagatgtgttccagagaaacggagttcaaatcgatcctgtttgccctgtgctatttccacgcggtcgtggccgagaggcgcaaattcggacctcaaggctggaatcgatcgtacccattcaacaccggggatcttaccattagcgtgaacgtgttatacaactttctcgaagccaacgcaaaagtgccatatgacgatctccgctatctgttcggggaaattatgtacggcggtcacatcacagatgattgggaccggcgcctttgccgtacctacttgggggaattcatccgcccagagatgttggagggggagctgagcctcgcaccagggttccccctccccggcaacatggattataatggctaccaccaatacatagatgctgaactccctccagagtctccttacttatacggcttgcaccctaacgccgagatcggatttctgactcaaacatcggaaaagcttttccgaacagtcctggaactgcagccccgggactcccaggcaagggatggagccggggccactcgcgaggaaaaggtgaaggctttactggaggaaattctggaacgggttacagacgagtttaacataccagaacttatggccaaggtagaagagagaacaccctatatcgtcgtggcgttccaggagtgcggtcgcatgaatatcctgaccagagagatccaaaggtcccttcgggaattggagcttggactgaagggggagctgaccatgactagccacatggaaaatctgcagaatgccttgtattttgacatggttcctgagtcttgggcccgccgtgcatacccgtccactgcaggtctggctgcatggtttccggatttgctcaacaggatcaaagaactggaggcatggactggggatttcactatgccctctacagtgtggcttacaggattcttcaatccccagtcctttcttacggctatcatgcaatccacagcccgcaagaatgagtggcccctagaccaaatggccctccagtgtgacatgacaaagaaaaatcgcgaggagtttagatcacctcctcgggaaggggcgtatatccacggcctcttcatggaaggagcgtgctgggatactcaagcaggtatcattaccgaggctaaacttaaagatctgacacctccaatgcccgttatgtttattaaagccattcccgcggataagcaggactgcaggtctgtatactcttgtcccgtttataagacttcccaacgcgggccgacatacgtctggactttcaacctgaaaacaaaagagaacccaagcaaatgggtgctcgctggagtcgctctgctcctacagatttag

SEQ ID NO: 186050 - DNA, 1002 bp, Artificial Sequence
  Description of Artificial Sequence: Synthetic coding sequence
atgaaggacttcgtgctgggccgggacaaggtgcaggaggccaaggtgaccgaggtgaagatcaacgaggcgcgggaacactaccgaccagctgcagctcgcgcgtccctcctgtattttattatgaatgacctgtccaaaatccaccccatgtaccagttctcgttaaaggcgttttctatcgtctttcagaaagcggttgaacgggcagcacccgatgagtcattgcgagaaagggttgccaatctgatagattctataaccttctccgtctatcagtacaccatacgcggcctattcgaatgtgataagctgacatatctggctcagctgacattccagatcctcctgatgaatcgcgaggtcaatgctgtggaactggattttctccttcgctcccctgtgcagactggtactgccagtccagtggaattcctatcccaccaagcctggggcgctgtcaaagtactgtctagtatggaggaattcagcaacctggaccgagacatagaaggaagcgctaagtcttggaaaaagttcgtggaaagtgagtgccccgagaaggagaaactgccccaggagtggaaaaataagaccgcactccagcggctgtgtatgctgagggccatgaggcctgatcgaatgacctatgcccttagagacttcgtggaagagaagctgggatcaaagtacgtggttggtagagccctggattttgcgacgtctttcgaggagtcaggacctgccaccccaatgttctttatcctgagtccgggagttgacccactgaaggatgtggagagccagggcagaaaactcggttacacttttaataatcaaaatttccataacgtttcgctcggtcaggggcaagaggtggttgctgaagcggccctggatctcgctgccaaaaagggtcactgggtcattcttcaagtgaagcgctgtagcttctttacattctatcaccccgcccattgcttggaacactctcgtcactag

SEQ ID NO: 186051 - DNA, 2397 bp, Artificial Sequence
  Description of Artificial Sequence: Synthetic coding sequence
atgaacgacctgagcaagatccaccccatgtaccagttcagcctgaaggctttcagtattgttttccaaaaagccgtggaacgggcagcccccgacgagtctctaagggaaagggtggcaaatctgatagatagtatcaccttctccgtgtatcagtacaccatcagaggcctcttcgaatgtgacaagctgacttatctggcccaacttacattccaaatacttctaatgaacagagaagtgaatgccgttgagctggactttcttctgcgatctccagtacagactggcactgcgagcccggtggaatttttatcacaccaagcatggggagcagtcaaggtattgagtagcatggaagaattctcaaatctggatcgtgatatcgaaggcagtgccaagagctggaaaaaatttgtggaatccgaatgtcctgaaaaggaaaaattaccacaggagtggaagaataagacagcactgcagcgcctgtgcatgctgcgcgctatgagaccagaccggatgacatatgcccttagagattttgttgaagagaagctaggcagtaaatatgtggtgggccgcgcactggacttcgccacctctttcgaagagagtggcccagctacccccatgttctttatactctcgccaggggtggatccactgaaggacgtggagtcccaaggaaggaagctgggatatactttcaacaatcagaactttcataatgtctctctgggacagggccaagaagttgtggccgaggctgcgctcgatctggccgcaaaaaagggacattgggtaatcctgcagaatatccatctggttgccaagtggcttagcacacttgagaagaaactcgaagagcacagcgagaacagtcatcccgagtttcgcgtctttatgtctgcagagcctgcaccaagccccgaagggcatataatccctcaagggatcctggagaacagcataaagattaccaacgagccacctacagggatgcacgccaacctgcataaggcgcttgacaattttactcaggacactttagagatgtgtagcagggagaccgagttcaaatctattcttttcgctctgtgctactttcatgcagtcgtcgccgagcgacgcaagtttgggccgcagggatggaaccgtagctatcccttcaacacgggtgacctgaccattagtgttaatgtgttgtacaattttttggaagctaacgcaaaggtaccatatgacgatttgagatatctctttggggaaatcatgtacggggggcacattacggatgactgggatagaaggctgtgccgcacatatctgggcgagtttatcagaccagagatgctggagggtgaattgtcactggccccagggttcccattacccggcaacatggattataacggataccaccagtacattgacgctgagttacctccggaaagcccatacctctacggcctgcaccctaacgcagagattggctttctcacccaaacaagcgaaaaactgtttagaacagtgctcgaactgcagcccagggattcccaggcgcgcgatggggcaggcgccaccagagaagagaaggtgaaagccctgctagaggagatcttggagagagtgacagacgagtttaacattcctgagctaatggcaaaggttgaggagcggaccccctatatcgtcgtcgcatttcaggaatgcggaaggatgaacattctgaccagagagatacagagatcactgcgggagctggagctgggattaaaaggagagctaacaatgacaagccacatggaaaatcttcagaatgctctgtatttcgatatggttccggagagttgggcaagacgagcctatccaagtacagccggtctagcagcgtggttccctgatctcctcaatcgcattaaggaacttgaggcctggactggcgactttaccatgccgagcacagtctggctgaccggttttttcaacccccaatctttcctgacagccatcatgcagtctacagccaggaagaatgaatggcctttggaccagatggcccttcaatgcgacatgactaagaagaaccgggaagaatttcggtccccccctcgagagggtgcctacattcacggcctgttcatggaaggggcttgttgggacacacaggccggcattattaccgaagccaagctgaaggacctgactccgccaatgcccgtcatgtttatcaaagctatcccggccgataaacaagactgtaggtctgtatacagctgtcccgtatacaagacatctcagcgcgggcccacatacgtgtggacctttaacctaaagaccaaggagaatcccagtaagtgggtgttggctggtgtggcactgctgctgcagatctag

SEQ ID NO: 186052 - DNA, 8979 bp, Artificial Sequence
  Description of Artificial Sequence: Synthetic coding sequence
gaggtgcggggcatcgtggacaaggccgccaaggagatgggcatggagaaaactctcaaggagctacagacaacctgggccggtatggaattccagtacgaacctcatccccgcaccaatgtccctctactctgttctgacgaggacctgatcgaggtcctcgaggacaaccaggttcagttgcagaatttggtgatgtccaagtatgttgcctttttcttagaagaagtttctggctggcaaaaaaagctgagcactgttgacgccgtaatttctatctggttcgaggttcagcgcacctggacccatctagagtctattttcaccggaagtgaggacatcagggctcagctgccccaggattcaaaacgtttcgaagggattgatatcgatttcaaagagcttgcatatgatgcccaaaaaattccaaatgtcgttcagaccacgaacaagcccggtctctatgaaaaactggaggatattcagggtcgtctctgcctgtgcgaaaaagcacttgctgaatatctggatacaaagcgtctggcgtttcctaggttttatttcctctcaagcagtgacttgttggatatcttgagcaacggcaccgctccgcagcaggtccagaggcatttaagcaaactgtttgacaatatggcaaagatgagatttcagcttgatgcatccggcgaacctacgaagaccagcttgggtatgtactcgaaggaggaggagtacgtcgcttttagcgagccctgtgattgttcgggccaggtggagatatggctgaatcacgtgctgggtcacatgaaggccacggttcgtcacgagatgacagaaggtgttactgcttacgaagagaagccgagagaacagtggctctttgatcacccggctcaggtcgccctgacatgtactcagatttggtggaccaccgaggttggcatggcctttgcaaggctcgaagaaggatacgagagtgcaatgaaggattactataaaaagcaggtggcccagttaaagacactgatcaccatgcttattggacagttgagcaagggagaccgacagaagatcatgaccatttgcacaatagacgtccatgcccgggatgtagtagcgaagatgatagcccaaaaggtcgacaacgctcaagccttcttatggctatcccagctcaggcatagatgggatgatgaggtgaaacattgttttgccaatatctgcgacgctcagtttttatacagttacgaataccttggcaacactcctagacttgtgatcactcccctgacagataggtgttacattactctcacacaatcactgcacctaaccatgtcaggcgccccggccgggcccgccgggacgggaaagaccgaaacgaccaaagacctgggacgagctctcgggattctggtatacgttttcaactgttccgagcagatggactataagtcctgcgggaatatttacaaggggttggcccaaaccggggcctgggggtgcttcgacgagtttaatagaatatccgtggaggtcttgtccgtggtggccgtccaggtgaagtcgattcaagacgcaatccgagacaaaaagcaatggttctcctttttgggcgaggaaattagtctcaatccgtccgttggcatcttcatcactatgaatccaggatacgctggccggactgagctgcccgagaatctgaagagtttgtttcgaccatgcgcaatggtcgtccccgactttgagctcatctgtgagattatgttggtggctgagggcttcatcgaagcacagagcttggcccgcaagtttataaccctctatcagctctgcaaagaactgctatcaaagcaggaccactacgactggggcctgagggcaataaagagtgttttggtcgttgctgggtctctgaaaagaggtgatccggataggcctgaggaccaggtcctgatgagaagcctacgcgactttaacataccgaagatcgtaactgacgacatgcccatctttatgggccttatcggcgacctgttcccggccctggacgtgccacgccgcagagacccaaacttcgaggcccttgtccgcaaagcaatcgtggacctaaagcttcaggccgaagacaacttcgtcctgaaggttgtgcagctcgaagagctcttagccgtccgccactcagtgtttgttgtagggggagccggaacgggtaaaagtcaagttctccgcagtctacataaaacgtaccagattatgaagcgccgcccagtgtggacagatctgaatccaaaggctgtgacaaacgacgaactcttcgggatcataaatcccgcgactggtgagtggaaagatggcctcttttcgtcaatcatgcgtgaacttgcaaatatcacgcatgatgggccaaagtggatcctgcttgacggggacattgacccgatgtggatagaatccctaaacactgtgatggacgacaataaggtcttgacgttagctagtaacgaacgcattccactgaatcccactatgaagctcttattcgaaatctcccatcttcgcaccgccacacccgccaccgtgagccgcgccggcatcctgtatattaaccctgctgatctgggttggaacccacctgtgtcatcatggattgaaaagagggagattcagaccgaacgcgcgaatttgaccattctgttcgacaagtatttacccacctgtctggatacactgaggactcggttcaaaaagatcatccctatccccgaacagagcatggtgcagatggtgtgccacctgctggaatgtctcctgacaaccgaagacatcccagcagattgccctaaggagatctacgagcactatttcgtgtttgccgccatctgggctttcggcggcgctatggtgcaagatcaattggtggactatagggccgagttttcgaaatggtggcttacagaattcaagactgtcaagtttccctcgcagggcactatctttgattattatatcgatcccgagacgaagaagttcgagccatggagtaaattagtgcctcaatttgaattcgaccctgagatgcctctccaagcttgtctggtccacacgagcgaaactattagggtatgctactttatggaaaggctcatggcccgtcaacgtcccgtgatgctggtgggcactgccggcacagggaaaagcgttctggttggggctaagttggcctcactcgaccctgaagcttatttggtcaagaacgtacccttcaattactacacaaccagcgcaatgctccaggctgtcctcgaaaaacccttggagaaaaaggccggtcgcaactacggcccccccgggaataaaaagttaatttattttatcgatgacatgaacatgcctgaggttgatgcttacggtacagtccagccccacacaatcatacgccaacatctggattatggacattggtatgacaggtccaaactttctctcaaggagataacaaacgtgcagtatgtgtcctgtatgaaccccacagcagggagtttcactataaatccccgacttcagcgacacttcagcgtgtttgtgctttccttccccggcgccgacgcgctcagctccatctattccatcatattaacccagcatctcaagctgggaaacttccctgcatcactgcagaaaagcattccacctttaatagaccttgccttggcattccatcagaaaattgccacaaccttcttgcccaccgggattaagttccattacatttttaacctgagagattttgcgaacatttttcagggtatactgttttctagcgtggaatgtgtgaagagcacctgggatctcattcggttatatctgcatgaatcaaatcgggtgtatcgggataaaatggtagaggagaaggatttcgacttgttcgacaagatacagactgaggtgctgaagaaaacttttgatgacattgaggacccggtcgagcaaacccaaagtccgaacttatactgccacttcgctaatggcatcggcgaaccaaaatacatgccagtgcagtcctgggagctgctgacccaaacactggtagaagcgttagagaatcataatgaggttaatacggtgatggacttagttctctttgaggatgcaatgaggcatgtgtgtcacatcaacaggatcctggagtctcctcggggcaacgcactattagtgggagtgggaggctcaggaaagcagtcactgacacggctggcagcctttatctcctccatggatgtgttccagataaccctgaggaaaggataccaaattcaggattttaagatggacttagctagcttgtgtctaaaagcgggcgtgaaaaacttgaacactgtcttcctaatgactgatgcccaggtggcagacgaacgctttctggtgttgatcaacgatctgctcgcgagtggagagattccagacctgtattccgacgacgaggtggagaacatcatctctaacgtccgcaacgaggtgaagagtcaaggcctagtcgataaccgcgaaaactgctggaagttttttattgatcggatacgacgccagcttaaggttactctgtgcttctctcctgtgggaaacaaactcagagtgcggagtagaaagttcccagcaatcgtgaactgtactgccattcactggtttcacgaatggcctcaacaggccttggagtctgtcagtctgcgatttcttcaaaataccgagggaatagaaccgaccgtgaagcaatctattagcaagttcatggcctttgtccacaccagtgtgaatcagacctcgcagtcatatttaagcaatgaacaaagatacaattacacaaccccgaagtcttttctcgaattcatccggctgtatcaaagtcttctccacaggcaccgtaaagagctgaaatgtaaaacagagaggctagagaacggcctcttgaaactccattccacaagcgcccaggtggatgacttgaaagccaaactggccgcccaggaagtcgagttgaaacagaaaaatgaagatgctgacaaactgatccaggttgtgggtgtggagaccgataaggtgagccgggaaaaggccatggcagatgaggaggagcaaaaagtggcagttataatgttagaggtgaaacagaagcagaaggattgtgaggaagatctggccaaagctgaacctgctttgactgccgcccaggccgctcttaatacactcaacaagactaatctaaccgagctcaaatcatttggatctcctccactggcagtcagtaacgtatctgccgccgttatggtgctgatggccccccgcgggagggttcccaaagaccgcagttggaaagcggccaaggttactatggctaaggtggatgggttccttgattcattaattaatttcaataaagagaatatacacgagaactgccttaaggcgataagaccttacctgcaggaccctgaattcaaccctgaatttgtagccaccaagtcctatgctgctgccggactgtgcagctgggttataaatattgtgaggttttacgaagttttctgcgatgtggagccaaaacgacaagccttgaacaaggccacagctgacctgaccgcagcccaagaaaaactggctgctattaaagctaagattgcgcatttaaacgaaaacttagctaagctgacagcgcgcttcgaaaaagcaacagccgacaaactgaaatgccaacaggaggctgaagttacggccgtcaccatcagtctggcaaatcgccttgttggcgggttggcgagtgagaacgtgaggtgggccgatgccgtgcagaatttcaagcagcaggaaaggactctctgtggagacattcttctgatcactgctttcatctcctacctgggattcttcacaaagaagtacagacaatccctgctggacagaacatggaggccatatctgagccagcttaaaactccaatccccgtgactcctgccttagacccacttcgcatgctcatggacgatgctgacgtggccgcatggcagaatgaaggtctgcccgctgaccggatgtctgtcgagaatgcaaccatcctgatcaactgcgagcgctggccactcatggtggatccacagctgcaggggatcaaatggattaagaacaaatacggtgaggatctccgggtcacccaaatcgggcagaagggttatctacagatcatcgagcaggctctggaggcaggggctgtcgtgctgatagagaacctcgaggagtccattgacccagttctgggacccctgctgggccgagaggtcataaaaaaagggcgatttataaagatcggcgataaggaatgcgagtataacccaaagttcagactcatcctgcacaccaagcttgctaacccccactatcagcccgaactgcaggctcaggcaacactcatcaacttcaccgtaacccgtgacggactggaggaccaactgctggcagcggtggttagtatggaaagaccagacttggagcaacttaagagtgacctgacaaagcagcagaatggctttaaaataactttaaaaaccctggaggattcactgcttagcaggttaagctctgcttcagggaattttttaggggagaccgtgctggtcgagaatctggagattactaagcaaacagctgcagaggtggagaagaaggtgcaggaagccaaagtgactgaagtgaagattaatgaagccagggagcattatcgtccagctgctgccagggcttccttgttgtacttcattatgaatgatctctccaaaattcaccccatgtaccagttcagtctgaaagcgttttctatcgtctttcagaaagcggtggaacgcgctgcccccgacgaaagcttgcgtgaacgggttgccaacctcatagacagcatcacattcagtgtctaccagtataccattcggggattattcgaatgtgacaaactgacatatctagcccagttaacatttcagattcttctgatgaatcgggaagtgaatgctgtggagctggatttcttgctgaggtcaccagtgcagaccggtactgccagccctgtagagttcctcagccaccaggcttggggcgccgtgaaagtcctctccagtatggaggagttcagcaacctagatcgggatatcgaaggatcggctaagagttggaaaaagttcgtcgagagcgagtgtcctgagaaggagaaactcccccaggaatggaaaaataaaaccgctttacaacggttgtgcatgctgcgcgccatgcgccctgatcgcatgacgtacgccctaagggacttcgtggaagaaaaattaggctccaagtatgtcgtgggtcgagccttggattttgccaccagctttgaagagtccgggcctgcgactccaatgttctttatcctatctcccggcgtagatccgctcaaggacgtcgaatcgcagggccggaaacttgggtacaccttcaacaatcaaaacttccacaacgtctctctggggcagggccaggaagtcgtagcagaggccgcgttagacttggctgccaagaaaggacattgggtcattttgcaggatacactagaaatgtgtagccgcgagacggagtttaagagtatcctcttcgcgctgtgctattttcatgcagtagtagctgagaggcggaagttcggcccacagggatggaaccgctcttatcccttcaacaccggggaccttactattagtgtcaatgtgttatataattttctggaggctaacgcgaaggtgccctacgatgacctaagatacctgttcggggaaatcatgtacggggggcacataactgacgactgggaccggcgtctatgccgcacctatttgggcgagtttatcaggcccgaaatgcttgagggcgaactgagcttggccccgggcttcccgctgcctgggaacatggattataatggttatcaccagtacattgacgcagaactgcctcccgagagtccatacctgtacggcctccatcctaacgccgaaatcggtttccttacccagacatcagagaagttgttcaggacagtcctggaactgcagcccagggactcccaggctagggacggagctggggccacacgcgaggagaaagtcaaggccttgctggaagagatcctcgaacgtgtgacggatgaatttaacattcccgagctgatggcaaaagtcgaggagagaactccttatatagttgtcgcgtttcaagagtgtggtagaatgaatattctgacccgggagattcagagatcactccgcgaattggagctgggcctcaagggagagctgacaatgacatcacatatggaaaatcttcagaacgccctgtattttgacatggtgcctgaatcatgggcgagacgtgcttatccaagcacagcaggactcgcagcgtggttcccggatctgttaaatcggatcaaagaactggaagcctggacgggcgattttaccatgccctccaccgtatggttaactgggtttttcaatcctcagtctttcctgacagcaatcatgcagagtactgccaggaaaaatgaatggccactggatcagatggccctgcaatgcgacatgaccaaaaaaaaccgcgaagagtttcgctctccccctagggaaggagcgtacattcatggtctcttcatggaaggggcctgctgggacacacaggcaggaattataacagaagccaagctgaaagatctcaccccgccgatgcctgtgatgtttattaaagctataccagcggacaaacaagactgcaggtccgtctacagctgtcctgtttataaaacttcacaacggggacccacgtacgtttggaccttcaatttaaagaccaaagagaatccctccaaatgggtactggcaggagtggcactcttgttacagatttag

SEQ ID NO: 186053 - DNA, 13233 bp, Artificial Sequence
  Description of Artificial Sequence: Synthetic coding sequence
atgcggctggccgaggagcgggccgccctggccgccgagaacgccgatggggagcccggagctgacaggaggctgagactgctcggtacctacgttgccatgagtctgcgccctgctgcaggggcttgggagagatgtgccggaagtgctgaggcagaacagctgctgcaggcgtttctgggcagagatgccgccgagggacctcggccccttcttgtggtgcggcctgggccaagaggtctggcaattcgccccgggctcgaagtcggtcctgagtcaggcctggcgggcgctaaagctctgttctttctgcgaactgggccagagccgcccggacccgactctttccgaggcgccgtggtctgtggagacctccctgcagccccattagaacaccttgcggctcttttctcagaggtggtacttcctgttctggccaacgagaagaatcggttgaattggccccacatgatttgcgaggatgtgagaaggcacgcacattcactgcaatgcgacttgtcagtcatcctcgagcaggtgaaaggaaaaactctgctcccactgcccgctggatctgagaaaatggagttcgccgattctaagtctgagaccgtgctcgactctatagacaagtcagttatatatgccatcgagagcgctgtgataaagtggtcctaccaagttcaagtcgtactgaaacgtgagagttctcaaccattgctgcagggcgaaaatccaacgcccaaagtggaactggaattctggaaatctcggtacgaagatttgaagtacatctacaaccagctccgcacgatcaccgtccgcggaatggctaagttgctcgataagttgcaaagcagttattttcctgccttcaaggccatgtatcgcgatgttgtcgccgcactggccgaggcacaggatattcatgtgcacctcatcccccttcagaggcacctagaggcacttgagaatgccgagtttccagaggtaaagccacaactgcggcctcttcttcatgttgtttgcctgatttgggccacatgcaagagctaccggtcaccaggtaggctcacagtcttgctccaggagatttgtaatctgctgattcagcaggcgagcaattatctgtcacccgaagatctgctgcgttctgaagtcgaggaaagtcaacgcaagcttcaagttgtttctgacacactatccttttttaagcaggaatttcaagaccggagagaaaatctgcatacctacttcaaagaaaatcaggaagtgaaagagtgggactttcagtcctctctcgtctttgtgcgcttagatggcttcctgggccagcttcacgtggtggaagggctgctgaagactgcgttagatttccataaacttggtaaggtggagttttcaggggtgcgtggcaatgcactgtcacagcaggtccaacagatgcacgaggagttccaggagatgtatcggctgcttagcggctctagcagtgactgtctctacttgcaatctaccgacttcgagaacgacgtcagcgagttcaaccagaaagttgaagacctggacaggagactcgggacgatcttcattcaggcctttgatgatgcccctgggttggaacatgccttcaagctcctcgacattgctggcaacctgctcgagagacctttagtggcaagagacacctctgataagtaccttgtcttgatccagatgttcaataaagacctggatgctgtcagaatgatttactcccagcacgtgcaggaggaagctgagttagggttcagcccggtgcacaagaacatgccaacagtcgcaggggggctcaggtgggctcaggaacttcgccaacgcatccagggccctttctcaaactttggacgaattacacatccttgtatggagtcagccgagggaaagcgcatgcagcaaaagtatgaagatatgctcagtcttctggagaagtatgagacccgcctttacgaggactggtgtcggactgtttcagaaaaatctcaatataacctttctcagcctctgcttaagcgcgatccagagactaaggagataactattaatttcaatccgcagcttatttctgttctgaaggagatgtcctacctggaacctcgggagatgaagcatatgcccgagaccgctgccgctatgttcagctctagagacttttatcggcagcttgtggctaacctggagctgatggctaactggtataataaagtcatgaaaacgctgttagaagtggagttccctctggttgaggaggagcttcagaacattgacttgagactgagggcggccgaggagacactgaattggaagacagagggaatctgtgattatgtcacggaaatcaccagcagcatccatgaccttgaacaaagaattcagaagaccaaggataatgtcgaagaaatacagaacatcatgaaaacatgggtcacacccatttttaaaaccaaggatggcaaacgagaatccctgctgagcctggatgatcgccatgataggatggagaagtactacaacctgatcaaggaaagcggattgaaaatccatgccctggttcaggagaatctagggctgtttagcgcagacccgacctctaatatttggaaaacctacgtgaactcgattgataatttactgttgaatggcttcttcctcgcgatcgaatgcagtctcaaatacttgctggagaacactgaatgcaaagccggcctgactcccattttcgaagcacagcttagcctggccatccctgagctcgtattttatcccagtctcgagagcggcgttaaagggggattttgcgatatagtggagggcttaatcacttctatcttccggatcccctctctggttccaagactctccccacagaatggttccccccattaccaggtggacctggatgggatcccagatctcgctaacatgcgtcgtactttgatggagagggtccagcgcatgatgggcctatgctgtggctaccagtctactttcagtcaatacagctacctctacgtggaagatagaaaggaggtactggggcaatttttgttatacggccacattctgaccccagaagaaatcgaggaccacgtggaggatgggattcccgagaatcctcctctgctgagccagttcaaggtgcagatcgacagttacgagaccctgtacgaagaagtctgcagattagagccgattaaagtgttcgatggatggatgaagatcgacattcgccctttcaaggccagtctcctcaatatcatcaagcgctggtctttgctgttcaagcagcatttggtggaccatgtgactcacagtctcgccaacctggatgccttcattaagaagtctgagtctggattgcttaaaaaggtggagaaaggcgactttcaagggctcgtcgagatcatgggccatctgatggctgtgaaggaacgtcaaagtaatacagatgagatgttcgagcccttgaagcagacaatagaactgctgaagacttatgagcaggagttaccggaaacagtctttaagcagctggaagagctgccggagaaatggaataatatcaagaaggtagccattaccgttaagcagcaagtcgctcctttacaggcgaacgaagtgacgctgctcaggcaacggtgcaccgccttcgacgccgagcagcaacagttttgggaacaattccataaggaagctccattcagatttgactcaatccaccctcaccaaatgctggacgcccgccatattgagatccagcagatggagtccacaatggcctcgatctctgagtccgctagtttattcgaggttaatgtgcccgattacaaacagttgagacagtgccgcaaagaggtttgtcaactgaaggagctatgggacacgattgggatggttacttccagtatccacgcgtgggaaaccaccccatggagaaatataaacgttgaagccatggagctggaatgcaaacagtttgccaggcatattaggaacctggataaggaggtccgggcctgggacgccttcacaggcctagaaagcactgtgtggaatacgctttcatctctcagggctgtggcagaattgcagaatcctgcaatcagggaacggcactggcggcaactcatgcaggcaacaggagtgagcttcacaatggaccaggataccaccctcgcccatctgctgcagctgcagctacaccactatgaggatgaagtgcggggcatcgttgacaaagccgccaaggaaatgggaatggaaaaaaccctgaaagaactgcaaaccacatgggccggaatggaatttcaatatgagcctcacccaagaacaaacgtgccactgctgtgtagcgacgaggacctgatagaagtcttggaagataaccaggtgcagttacagaatctggtgatgtccaagtacgtggcatttttcctagaggaggtgtccggctggcagaagaaactgtcaactgtggatgctgtaatctcgatctggttcgaagttcagcggacttggacccacttagagtcaatcttcacaggctcagaagacattagagctcagcttcctcaggattcgaagcgcttcgaagggattgatattgattttaaggaactggcatacgatgcacagaaaataccgaacgtggtccagaccaccaataagccaggcctttacgaaaagttggaggatattcaggggaggctgtgtttgtgtgaaaaagccctggctgaatacttagataccaagagactggctttccctcgattctactttctgagctcaagtgacctccttgatatccttagtaacggaacggccccgcaacaagtgcaacggcatctgtcaaagctttttgacaacatggcaaagatgcgctttcagctcgatgcttccggggaacccacaaagacaagcctgggtatgtatagcaaggaggaagagtatgtggcatttagcgaaccctgcgactgttctggacaggtggaaatctggttaaatcatgttctgggtcacatgaaggccacggtgcgacacgaaatgactgagggggtcactgcttacgaagagaagccgcgtgagcagtggttatttgatcaccccgcacaggtggcccttacctgcacacaaatctggtggactaccgaggtggggatggcctttgcgaggctcgaggaggggtatgagagcgccatgaaagattattacaagaaacaagtggcgcaactgaaaactcttatcaccatgcttatcggacaactgagcaaaggcgacagacagaagatcatgaccatttgcaccatcgacgttcacgcacgcgatgtcgttgccaaaatgattgcacagaaggtcgacaatgcccaggctttcctgtggctctcacagctccgtcatagatgggacgacgaagtgaagcattgtttcgccaacatttgtgatgcccagtttctatatagctacgagtaccttggtaacaccccccgattggttatcactcctttgactgaccgctgctatatcaccttgacacagtcattacaccttactatgagcggtgccccggcgggcccggctggcacaggcaaaactgagactacgaaagatctgggacgcgccttaggtatccttgtgtatgtgtttaactgttctgagcaaatggattataagagctgcgggaatatctacaaaggtttagcacagaccggtgcctggggctgtttcgacgagtttaaccggatcagtgtggaagttcttagcgtcgtggctgttcaagtcaagtccatccaggacgctatacgggataagaagcagtggttctccttcctgggagaggaaatctcactgaacccgtccgtggggatctttatcactatgaaccctggctacgccggccgaactgagctgcccgaaaacctcaagagtctgtttagaccctgcgcaatggtggtacccgactttgaactgatctgcgagattatgctggtcgctgaggggttcatagaggcacagtcactggccagaaaatttataacgctttatcagctttgcaaggagctgttgagcaagcaggatcactacgactggggccttcgcgctattaagagcgtgcttgtcgttgccggctccctgaaacggggggatcccgacagacccgaagatcaggtgttgatgcgcagtttaagagatttcaacattccgaagatcgtgacagatgacatgcctattttcatgggtttgattggcgatctcttccccgcactcgacgttccaagaagacgcgaccctaactttgaggccctcgttagaaaggcaatcgtcgacttgaaacttcaggctgaagataacttcgtgctgaaggtcgttcagctagaggagcttctcgctgttcgacattctgtgttcgtggtgggcggagctggcacaggcaaaagtcaggtgcttagatccctgcataagacgtaccaaattatgaagagacgcccagtttggacagatctaaacccgaaagccgtcaccaatgacgagctgttcgggattatcaatccagccacaggggaatggaaggacggactgttctcatctatcatgagagaactggctaatatcactcacgatgggccgaagtggatcttgcttgacggtgacattgaccctatgtggatcgaatctctaaacaccgttatggacgataacaaggttctgaccttagcctctaacgaaaggatacctctgaacccgactatgaagctgctgtttgaaatctctcatctgagaactgccactccggcaacagtgagcagggcaggaatcctgtatattaatcccgccgacttagggtggaaccctcccgttagttcttggatcgaaaaacgagaaatccagactgagcgagcaaatttgaccatcctgttcgacaagtacctgccgacttgccttgatacgcttcggacaagatttaagaagattatacccattcccgaacagagcatggtgcagatggtgtgtcatttgcttgaatgcctgctgacaaccgaagatattccagccgactgtccgaaagagatctatgagcattactttgtctttgcagcgatctgggcatttggaggagctatggtgcaggaccagctcgtcgattacagggcagaattcagcaaatggtggttgaccgaattcaagaccgtgaagttccctagccaaggtacgatctttgactattacattgatccagagaccaaaaagtttgagccctggtctaaactcgtcccacagtttgagttcgaccctgaaatgccgctgcaagcttgcctcgtgcacacttctgagaccatccgagtgtgttactttatggagaggctcatggccaggcagcgacccgtgatgctggtcggaacggccgggaccggaaaaagcgttctggtcggggccaaactggcatcacttgatcccgaggcgtacttggtgaagaatgtgccgtttaattactacaccactagcgcgatgcttcaggcggttttggagaaacctctcgagaagaaggcgggcaggaactatggccccccaggaaataagaagctgatttatttcattgacgacatgaacatgcctgaggtggacgcctacggtacggtacagccacatactataatcagacaacatttggactacggccattggtacgacaggtctaagctgagcctgaaggagatcacaaatgtgcagtatgtttcctgtatgaaccctaccgccggctctttcactatcaaccccagactacaaagacacttttcagtcttcgttctgagcttccccggcgcagatgctctatctagcatatactctataatcctgactcagcacctgaaactgggcaacttcccggcctcacttcaaaaatccattccacctctgattgaccttgccctcgcatttcatcagaagatcgcgacaacattcctcccaaccgggatcaagttccattatatctttaatctgagggacttcgcaaatatctttcagggaatcctgttcagcagtgtggagtgtgtgaaaagtacttgggaccttatccgcctctacttgcatgagtccaaccgggtttaccgtgacaagatggtggaagaaaaagacttcgacttgttcgacaaaatccagaccgaagtcctcaaaaaaacgtttgatgacattgaagaccccgtagagcaaacccagtcacccaacctgtactgccactttgcaaatgggatcggtgaacctaaatatatgccagtccagtcctgggaattattaacacaaacactggtggaagcactggagaaccataacgaggtaaacacagtgatggacctggtcttattcgaagacgccatgaggcatgtatgccacatcaatcggattctggaaagccctcgcgggaacgcattgctggtgggagttggtggttcaggtaaacagtctctcactcgcctggctgcgttcattagcagcatggatgtttttcaaattaccctgaggaaaggctatcagatccaggattttaagatggacctcgcctcactctgtctgaaggctggcgtgaagaatcttaacacggtgttcctcatgacggatgctcaagtggccgacgaaaggtttttggtgctgattaatgatttgctagcctcaggagaaatacctgatttgtattctgatgacgaagtggagaacatcattagcaacgtgaggaacgaagtgaagtctcagggcctcgtggataatagggaaaattgctggaaattcttcatcgacaggatccggcggcagcttaaagttaccttatgtttcagcccagtcggaaacaagctgagggtgcgctcgcgaaaatttcctgccattgtaaactgtaccgcaatccattggtttcacgaatggccacagcaagccttggagagcgtgtcgttacgcttcctgcagaatacagagggcatcgagcctacagtgaagcagagtatctccaaattcatggccttcgtgcatacgtccgtcaatcaaactagccagtcgtaccttagcaacgaacaacgatataactatactacccctaaatctttcctggaattcatccgtctgtatcagtccctgcttcaccgacacagaaaagagttgaagtgtaagacagaacgtctagaaaatgggttactgaagctgcactctacatcagcacaagtcgacgatctgaaggcaaagctggctgctcaagaagtggaactgaagcagaaaaatgaggacgctgacaagctgatacaggtggttggagttgaaacagataaggttagtcgcgaaaaagctatggcggacgaggaggaacagaaggtggcagtgatcatgctcgaggtgaaacagaagcagaaggactgcgaagaagatctcgctaaggcagagccagcactaaccgccgcacaggctgccttaaatactctgaataaaaccaatttaacagagctaaaatcctttgggtcacctcccctggcagtgtcaaacgtctccgcagccgtgatggttttaatggcacccagaggacgagttccaaaggaccgttcttggaaggccgccaaggtcacgatggcaaaggtagatggtttcctggattcactgattaactttaataaggagaacatccatgaaaactgtttgaaggcaatccgcccctatctccaagatccagaattcaaccctgagtttgtcgcgaccaagagctatgcagccgctgggctgtgtagctgggtaattaatattgtccggttttatgaggtcttttgtgatgtggagcctaaacggcaggcgctcaataaagcaaccgccgaccttaccgctgcgcaggagaaactggccgccatcaaggctaagatagcgcatttaaacgagaatttagccaagctgaccgcccgattcgagaaggctacagctgacaaactgaagtgccagcaggaggcggaggtcacggctgtgactatctcacttgctaataggcttgtgggcggactcgcaagtgaaaacgtgcggtgggcagatgccgtccagaattttaagcagcaggaacgcacactgtgcggggacatacttttaatcacagcattcatatcttacctgggcttttttactaagaagtaccgccagtcgttactggatagaacatggcgcccatatttatctcagcttaagacacccatccctgttacgccagctctggatccccttaggatgctgatggatgatgccgacgtagctgcctggcaaaacgaggggttgcctgctgacaggatgagtgtcgaaaatgctacgatccttattaattgtgagaggtggcccttgatggtcgatccccagctgcaaggcattaagtggatcaaaaataaatatggtgaagacctgcgagtaacacagatcggccagaaggggtatttacaaatcatcgagcaggccctggaagctggcgccgtggtgctgattgagaatctagaagaatctattgaccccgtgctggggccgctgttaggtcgggaggtgatcaagaagggacggtttatcaaaattggcgacaaggagtgcgaatacaacccaaaattccggttgatacttcatacaaaactggctaaccctcactaccagcccgagctgcaggcccaagccactctgatcaatttcaccgtcacccgagatgggctggaggaccagttgctcgcagccgtcgtgagtatggagaggcctgaccttgaacagttaaagtcagatctcactaaacagcaaaacggctttaagatcacactgaagactctggaggactccctgctgtcccgtctgagctccgccagcgggaacttcctgggcgagacagtactggtcgaaaacctggaaatcacgaaacagactgcggccgaggtcgagaagaaggttcaggaggcaaaggtaacagaggtcaagatcaacgaagcgcgcgagcattatcgtcctgctgctgcacgagcctcgttgttgtatttcattatgaacgatctcagcaagatccatcccatgtatcaattctctctgaaagctttttctattgtttttcagaaggcagtagagcgggctgctcccgacgaatctttacgagagcgcgtggccaacctcatcgacagcattaccttctctgtgtatcagtataccattcgtggactgttcgagtgtgataaactcacctacctggctcaactcacttttcagattctgctgatgaatcgggaggttaacgccgtcgagctcgactttctcttgcggtctccagtccagacaggaacggcctctcctgtggaatttctttcacaccaagcctggggggctgtgaaggtcctgtcaagcatggaggaattctctaatcttgacagagacatcgagggctccgccaaaagctggaaaaagtttgttgagtctgagtgccctgagaaagagaaattgccacaggaatggaagaataaaactgccttgcaacgcctttgcatgctgcgggctatgaggcccgatcggatgacatatgccctccgcgactttgtcgaggaaaagctgggctccaagtatgtggtgggaagagcacttgactttgctacctccttcgaagagtcgggaccggcaactccaatgttctttatcttatcccccggagtagacccacttaaggatgtagagtctcagggaagaaagctgggctacactttcaataatcagaacttccataacgtatctctgggccaggggcaggaggtagtcgccgaggctgcactagacctggctgctaagaaggggcattgggtgatccttcaagacacgctggagatgtgcagtcgggaaactgagttcaagtcgatccttttcgctttgtgttattttcacgcggttgtcgctgaacggcggaagttcggacctcaaggatggaatcgctcataccccttcaacacaggggacctgactatctcagtgaatgtgttgtacaactttctcgaagccaacgctaaggtgccttatgatgatctccgttatctgtttggggagataatgtacggaggacatattactgacgactgggaccggcgtctgtgccgcacttacctgggggaatttattagacctgaaatgctggaaggcgaacttagcctggcgcccgggttcccacttcccggtaatatggattacaatgggtatcaccaatacattgacgcagaactccctccggaatccccttacctatatgggctgcatccaaacgcagagatcggttttctgacacagaccagcgagaagctgttcagaacggtgttggaactgcagccccgagactcccaggcccgggacggcgccggcgccacgagagaagaaaaggtgaaggccctcttggaggaaattttagagcgggttaccgacgagttcaatataccagaactcatggcaaaggttgaggagaggaccccttatatcgtcgtggcttttcaggaatgtggccgcatgaacatcttaacccgtgagatacagaggtccctgcgagagctggaactgggcctaaaaggagagttaaccatgacttctcacatggaaaatctgcagaatgccttgtattttgatatggtgcccgaatcgtgggctcgtagggcctatccgtccacagccggccttgctgcttggttccctgatcttctgaatcggattaaagaactggaagcctggaccggagatttcacaatgcccagtaccgtctggctgaccggcttcttcaacccccagtcattcttaacggccattatgcaatcaaccgcaaggaagaatgagtggcctctggaccagatggcacttcagtgcgatatgacaaaaaagaatagggaagagtttcggtcccccccccgcgagggggcgtatatccacgggctgttcatggaaggggcttgttgggatactcaggccggcattatcactgaggctaagctgaaggacttaacgccccctatgccagtgatgtttattaaagcgattcccgccgacaaacaggattgccgcagcgtatactcttgtcccgtgtataaaacatcacagcgaggtccaacttacgtgtggacatttaacttgaagacaaaagagaacccttccaaatgggtgctcgccggggtcgccctcctgctccagatctag

SEQ ID NO: 186054 - DNA, 2100 bp, Artificial Sequence
  Description of Artificial Sequence: Synthetic coding sequence
atgatccccgccagcgccaaggccccccacaagcagccccacaagcagagcatcagcatcgggagagggacacgtaagagagacgaagattcagggactgaagttggggagggcactgacgaatgggctcagagcaaagcaaccgtgcggccccctgatcagttggaattgaccgacgccgaattgaaagaagaattcacaagaatattgacagctaataatccccacgccccccaaaacatagtccggtactcctttaaggaaggaacttataagcctattggctttgtcaatcagcttgctgtccattacacccaagtggggaacctcattccgaaagattctgatgaaggacgacgacaacattacagagatgagctggtcgccggctcccaagaaagcgtcaaggtcatttctgaaaccggtaacctcgaagaagatgaggaacccaaggaactggagactgagccagggtcacagactgatgttccagcggcaggagccgccgagaaagttaccgaagaggagctgatgacaccgaagcagcctaaggagcggaagctgactaatcagttcaatttttctgaacgggcgtcccagacctacaataaccccgttagagatcgggaatgccaaacagagcctcctcccaggactaacttctctgccactgctaatcaatgggagatctacgacgcgtacgtcgaagagctggagaaacaggaaaaaactaaggaaaaggaaaaggccaaaacgcctgttgccaaaaaatccggcaaaatggctatgaggaagctgacctcaatggagtcccaaacggatgacctgatcaagctttcgcaggccgcgaagataatggaacggatggtcaaccagaacacctatgacgacatcgcgcaggactttaagtactacgatgacgccgctgatgagtacagagaccaggtgggcaccctcctgcccctgtggaaattccaaaacgacaaggcaaaacggctttcagttactgcattgtgctggaaccctaaatatcgagatttgtttgccgtgggctatggatcttatgacttcatgaagcaaagcaggggcatgttgctcctgtattctctgaaaaatccctccttccccgagtacatgtttagctcaaatagcggcgttatgtgtctggacatccatgtagaccatccatacctggttgcagtgggtcattacgatggaaatgtagccatctacaatctgaagaagccgcacagtcaaccctccttttgctcatctgccaagtcagggaagcatagtgaccccgtttggcaggttaagtggcagaaggacgacatggatcagaacctgaacttttttagcgtgtcatctgacggtagaatcgtaagctggacattagtgaagaggaaactggtacatattgacgtaattaagcttaaagtggagggatctaccacagaggtgcccgagggacttcagttgcaccccgttggttgcggcacagctttcgacttccataaggagatcgactacatgttccttgtcggcactgaggaggggaaaatctataagtgctccaagtcctattcatctcagttcctggatacttatgatgctcacaacatgtccgtcgataccgtctcctggaacccttaccacacaaaagtgtttatgagctgttcaagcgattggaccgttaaaatctgggaccacaccatcaagacccccatgttcatatacgacctcaactccgccgtgggcgacgtggcctgggccccttattcttctacagtctttgccgccgtgaccactgatggtaaggcgcacatctttgacttggccataaataagtacgaggctatctgtaatcagcctgtagcagccaagaagaaccggctgacccacgtccagttcaacttgatccaccccataatcattgttggcgatgatcgggggcacatcattagcctgaagttgtcgcctaatctgcgcaaaatgccgaaggaaaagaaaggacaggaggtgcagaagggccctgcagtagaaatagctaaactggacaaactcctgaacctcgtgagggaagtgaaaatcaaaacttag

SEQ ID NO: 186055 - DNA, 585 bp, Artificial Sequence
  Description of Artificial Sequence: Synthetic coding sequence
atggaccagaacctgaacttcttcagcgtgagcagcgacggccggattgtctcctggacgttagtcaagcgaaaactcgtccatatagacgttattaagctcaaggtcgaggggtcaactacagaggtgcctgagggactgcagctgcatccagtgggctgcggaactgcctttgatttccataaagagatcgactacatgtttctcgtaggaaccgaggaggggaagatttacaaatgcagcaaaagctacagcagccagtttctcgatacctacgacgcgcacaacatgagcgtggacaccgtgtcctggaatccctaccacaccaaagtgtttatgtcgtgtagctctgattggacggtgaaaatttgggaccacactatcaagactcctatgttcatatacgatcttaattcggccgttggcgacgtagcatgggctccctactcctctacagtcttcgccgcagttacaaccgacggaaaagagaagaaaggccaagaagtgcagaagggacccgcggtcgagattgctaagctggataagctgttgaatcttgttcgggaggtaaaaattaaaacatag

SEQ ID NO: 186056 - DNA, 870 bp, Artificial Sequence
  Description of Artificial Sequence: Synthetic coding sequence
atgatccccgccagcgccaaggccccccacaagcagccccacaagcaggacgaagatagtgggaccgaggtgggggagggcacagatgaatgggctcagagtaaagccaccgtgcggcccccggaccaactggagcttacggacgctgagcttaaggaagagttcaccaggattctgactgcaaacaacccccatgctcctcagaatatcgtgaggtattcctttaaggaagggacatacaaacccataggtttcgttaaccagttggcggtgcactacactcaagtcggtaatttgattcctaaggatagcgacgagggccgcagacagcattaccgggatgaactggttgccggctctcaggaatccgtgaaggtgatctccgagaccggaaatcttgaagaagatgaagaacctaaagagctcgagacagaacccggatcccagacggacgtacccgctgccggagccgccgaaaaggtgaccgaagaggagttaatgacgcccaaacagcccaaagaacgcaagctaactaatcagttcaatttctcagaacgcgctagtcaaacatacaataaccccgtaagagaccgcgagtgccagacagagccgccccctcgtacaaactttagtgcaactgccaatcagtgggaaatctacgatgcctatgtggaagagctagaaaaacaggaaaaaaccaaagagaaagagaaggctaaaacacctgtggcaaagaagtccggcaaaatggcgatgagaaaactcacgtcgatggaatcccagactgacgaccttataaaactctcccaggcagcaaagattatggaaagaatggtcaatcagaatacctatgacgatatcgctcagtag

SEQ ID NO: 186057 - DNA, 870 bp, Artificial Sequence
  Description of Artificial Sequence: Synthetic coding sequence
atgatccccgccagcgccaaggccccccacaagcagccccacaagcaggatgaagacagcgggactgaggtaggcgaaggaactgacgagtgggcgcagtccaaagccacagtgcggccccctgaccagctggaactcaccgacgcagaactaaaggaggaatttactcgcatcctgaccgcgaataacccacatgctccacaaaacattgtgcggtactcattcaaggaaggaacctacaaacctattggcttcgtgaaccagctggccgtgcattatactcaggtcggaaaccttattcccaaggacagcgatgaggggcggcgccagcattatcgcgacgagctggttgccgggtcacaggagagtgtgaaagtaattagcgaaacagggaacctagaagaagatgaggaacccaaggagctggaaactgagccgggatcacagactgatgttcccgccgcaggcgccgctgagaaagtcaccgaagaggagctgatgacccctaaacagcccaaagagcggaagttgaccaaccagttcaatttctccgagcgcgccagccagacctataacaatccggtcagagatcgggaatgtcagaccgagccacctcctaggaccaacttctccgccacagctaaccagtgggaaatttacgatgcctacgtggaggaacttgaaaagcaggagaagactaaggagaaagagaaggccaagactccagttgccaaaaagtcagggaagatggccatgagaaagctgactagcatggagagccagactgacgacctgatcaagcttagtcaggcagccaaaatcatggagcggatggtgaaccaaaatacatacgatgatatagcccagtag

SEQ ID NO: 186058 - DNA, 429 bp, Artificial Sequence
  Description of Artificial Sequence: Synthetic coding sequence
tgatgcggcaccgccttcgacttccacaaggagatcgactacatgttcttagtcggcacggaggaagggaaaatctacaagtgtagtaagtcttactcatctcagtttctcgatacctacgatgcacacaacatgtccgtggacactgtttcgtggaacccgtaccacaccaaggtgtttatgtcgtgcagttccgactggacagtgaagatatgggatcatacaataaagacaccaatgttcatttatgacttgaactccgcggtgggcgatgtggcctgggctccatatagtagtacggtgttcgccgctgtgactactgacggtaaagagaagaaggggcaagaggtgcaaaagggaccagctgtggaaatagcaaaactcgataagctgttaaacctagtgagggaggtgaagattaaaacctag

SEQ ID NO: 186059 - DNA, 507 bp, Artificial Sequence
  Description of Artificial Sequence: Synthetic coding sequence
atgatccccgccagcgccaaggccccccacaagcagccccacaagcagagcataagcattggccgcggaacgcgcaagagggacgaggactcagggaccgaagtgggagaagggaccgatgaatgggctcaatccaaggccacggtgcgcccccctgatcaactcgaactcactgatgccgaattgaaggaggaattcacgaggattctgactgcaaataacccacatgccccacagaacatcgtccgctattccttcaagaagcagtggtcactgggatttatcccgaagctgaaaagaaagatccccgtcaattactgggggcaggatgaaggggagatctcaaatgagaccgttcgcgttatctatagcctggggatctttattatgaaaattgtcaccatactgttgaacatcaatatagagcacctcctatgcgtgcgacattgcgtcaatcgcttattcctcctgttcctcatcctgataatcatcatgcagatccgctag

SEQ ID NO: 186060 - DNA, 1209 bp, Artificial Sequence
  Description of Artificial Sequence: Synthetic coding sequence
atgcggaccaccctgacccccagctgcagcagcgccctggacccccaggaaatcaaaagggcggccacccacctctcttggcaccctgacggcaacagaaagctcgccgtggcgtactcttgtctggattttcagagagcccccgtcggcatgtcatctgactcctatatttgggaccttgagaatccaaacaagccggagctggcattaaaacccagctctcctctcgtcacactggaattcaatcccaaggacagccacgtcctactcggagggtgttacaacgggcagattgcctgctgggacaccagaaaggggtctttggttgcggaactttccacgatcgaaagtagccatagggaccctgtgtacggaactatttggcttcagtcaaagacagggactgagtgttttagcgcttctacggacggtcaggtgatgtggtgggacattagaaagatgagcgaacctactgaggtggttattctggatatcactaaaaaggagcagctcgaaaatgcgctgggggctatttctctggagttcgagtcaaccttgcccactaaattcatggtaggcactgaacagggcatcgttatcagctgcaacagaaaagccaagaccagcgccgaaaaaatcgtgtgcaccttcccaggacatcacgggcctatctatgctttgcaacgtaatcctttttatcccaagaactttctgacagtaggggactggacagcccgcatttggtctgaagattcccgcgagtccagcatcatgtggaccaaatatcacatggcctacctgacggacgccgcttggagccctgtaaggcccactgttttcttcactacacggatggacgggacgctggacatatgggattttatgttcgaacagtgcgaccccactctttcccttaaagtatgtgatgaggccttattttgcctgagagtacaggacaacggatgcctgattgcgtgcggttcgcagctcggaactacaaccctgctggaggtcagtcccggactatccactcttcagagaaacgagaagaacgtggcttcgtccatgttcgagcgtgaaactcggagggaaaaaattctggaggctaggcacagggagatgcggctgaaggaaaaagccgcaacaaaatctcggcggcggcctggggggggcggggggagaggatcaagcgggggtcgtagaggctag

SEQ ID NO: 186061 - DNA, 1818 bp, Artificial Sequence
  Description of Artificial Sequence: Synthetic coding sequence
atggagatcgtgtacgtgtacgtgaagaagcggagcgagttcggcaagcaatgcaatttttctgaccgacaggcggaattgaacatcgacatcatgccaaatcccgagctcgctgagcaattcgtcgagagaaatcccgtggacacgggtatacagtgcagcatcagtatgtcagagcatgaggccaactccgaaaggtttgagatggagacacggggagtaaaccacgtagaaggagggtggccgaaggatgtgaatccgctggagctcgagcaaaccatccgttttcggaaaaaggtcgaaaaagacgaaaactacgtaaacgctatcatgcagctgggttccatcatggagcattgtattaaacaaaataacgctatcgacatttacgaagaatacttcaacgacgaggaggcaatggaagttatggaggaggacccctcagccaaaaccatcaacgtgttccgggatccgcaggaaattaaacgtgcggccacccacctgtcttggcaccctgatggaaacagaaaactggcagttgcttattcctgcctagacttccagcgcgcacccgtggggatgagcagtgatagctatatttgggacctggagaatccaaacaagccggagttagccctcaagccctccagtcccctggtcaccctggaattcaacccaaaggattctcatgtcctgttgggcgggtgctataacggacagattgcctgctgggacaccaggaagggctccctagtagcagaactgtcaacaattgaatcttcccaccgggaccctgtctatgggaccatctggctgcagagcaagacaggtaccgaatgcttcagtgcctctacagatggccaagttatgtggtgggacatcaggaagatgtcagagcccacagaagtagtcatattggacattacaaagaaggaacagctggagaatgctctgggtgcgatctctctggagtttgaatcgactctgccgactaagtttatggtcgggactgaacaggggatcgtgatatcatgtaaccggaaggccaaaacaagcgctgaaaagattgtctgtactttcccaggccaccacggcccaatctacgcactccagcggaaccccttttaccccaagaactttctgacagtgggtgattggacagcaagaatatggagtgaggacagtcgggagagcagtatcatgtggaccaagtaccatatggcctatctcactgacgccgcatggtccccagtccggcctacagtgtttttcacaactcgaatggacgggacactagacatatgggatttcatgtttgaacaatgtgacccaactttatctttaaaggtgtgcgacgaggcactcttttgcctgcgggtgcaggacaatggctgcctaatagcctgtgggtctcagctgggtaccaccacactcctcgaggtcagtcctggcttgtctactttgcagagaaacgagaagaatgtggcctcatcaatgttcgagcgggagactcgtagggaaaagatcctggaggcaagacatagggagatgcgtctcaaggaaaaggggaaggccgaaggcagggacgaggagcagaccgatgaggaactggcggtggaccttgaggcactcgtttctaaggccgaggaggagtttttcgatataatcttcgccgagttgaagaagaaagaggctgatgcaattaagctgacacccgttccccagcagccgagccccgaggaggaccaggtggttgaagaaggtgaggaggctgctggagaggagggggacgaggaggtagaagaagacttggcctag

SEQ ID NO: 186062 - DNA, 1818 bp, Artificial Sequence
  Description of Artificial Sequence: Synthetic coding sequence
atggagatcgtgtacgtgtacgtgaagaagcggagcgagttcggcaaacagtgcaatttctcagataggcaagccgagttaaacattgatatcatgcccaatccagagctcgctgaacaattcgtggagaggaatccagttgatactggcattcagtgctccatatccatgagcgagcacgaagctaatagtgagcgttttgaaatggagactcggggtgtgaaccatgtggagggtggttggcctaaggacgtgaaccctctcgaactggagcagacaatccgctttcgtaagaaagtcgaaaaggacgagaattacgttaacgccattatgcagctagggagcattatggagcattgcataaaacagaacaacgccattgatatttatgaagaatactttaacgatgaggaggcgatggaagttatggaagaggacccttccgccaagacaattaacgtgttcagggatccccaagaaataaagcgggcagcgacccacctgtcctggcatccagatgggaaccgtaaactcgctgtggcttactcttgcctggacttccagagagcaccggtcggtatgtcctcagactcgtatatatgggacctggaaaacccaaacaagccagaactcgccctgaagcctagcagcccactggtgaccctcgagttcaatcctaaagattctcacgtgcttctgggcggatgttacaacggacagattgcctgctgggataccaggaaaggcagtctggtagctgagctgtcaaccattgaatcgtcgcaccgtgacccagtgtacgggacgatctggttgcagagtaaaacaggcactgaatgcttcagcgcctcgactgatggtcaggtcatgtggtgggacattcgaaagatgagtgagcccaccgaagtcgtaattttggatatcaccaagaaagagcagttagaaaatgctttaggcgcaatcagcctggaattcgagagtacattgcctaccaaatttatggtgggcacagagcaagggatcgtcataagttgcaaccgaaaggccaaaacctctgccgagaagattgtgtgtacctttcccgggcaccacggccctatctacgcgttgcaacgaaatccattttaccccaagaacttcctgaccgtgggagattggaccgcaagaatttggtccgaggacagtcgcgagtcaagcattatgtggaccaagtaccacatggcctacttaacagatgcagcatggtcaccagtccggccaacggtcttcttcaccacccgaatggatggaacactcgatatttgggattttatgttcgagcagtgcgacccaaccctcagcctcaaggtttgtgatgaggctttgttctgtttgcgggtgcaggataacggctgcttgatcgcctgtggctcccaattgggaactacgaccctgttggaggtgagcccaggactctccactctacagcgaaatgaaaaaaatgtggcaagcagcatgtttgaaagggagacccgtcgggaaaagattttagaagctcgccaccgtgagatgcgtctgaaagagaagggcaaagctgaaggacgagatgaagagcagacggatgaagaactggctgtggatttagaagccctggtgagcaaggcagaggaggaattctttgacattatcttcgcagagttgaaaaagaaagaggcagatgcaatcaaacttacccccgtccctcagcaaccctcaccagaagaggaccaggttgtggaagagggcgaggaagccgctggcgaagagggagatgaagaagttgaagaggacctcgcttag

SEQ ID NO: 186063 - DNA, 234 bp, Artificial Sequence
  Description of Artificial Sequence: Synthetic coding sequence
atgaagaagctgaagatcctgtacatgagcaacaacctggtgaaggattgggccgagttcgtgaagctggccgaactgccttgccttgaggatttagtgtttgtggggaacccattagaagagaagcactcggccgaaaataactggatcgaagaagctacaaaacgcgtgcccaagctcaaaaagctcgacggcacgccggtaatcaaaggggacgaagaggaggataattag

SEQ ID NO: 186064 - DNA, 456 bp, Artificial Sequence
  Description of Artificial Sequence: Synthetic coding sequence
atggacgccagcctgagcatgctggccaactgcgagaagctgagcttatcgacaaactgcattgagaaaattgccaatttgaacggactgaagaacctaaggatcctgtctctgggtaggaacaatatcaaaaatctgaacgggttggaggcagttggggacacactggaagaactctggatttcgtacaactttatcgagaagttgaagggtatacacatcatgaaaaagctcaaaattctttacatgagcaataacttagttaaagactgggccgagtttgtcaagctggcagaattgccttgtctcgaggacttagttttcgtgggtaaccccttagaagaaaagcactctgcggagaataactggatagaggaggccactaaacgcgtgccaaagctgaagaagctggacgggacaccagtgatcaaaggcgacgaggaagaagataattag

SEQ ID NO: 186065 - DNA, 573 bp, Artificial Sequence
  Description of Artificial Sequence: Synthetic coding sequence
atggccaaggccaccaccatcaaggaggccctggcccggtgggaggagaagacagggcagaggccctctgaggccaaggagatcaaactatacgcacagattcctcccatagaaaagatggatgcttcactttcaatgctcgctaattgcgagaagttgagcctgtccaccaactgtattgagaagatagcaaacctgaatggccttaagaacctgagaatcctctccctcggtcgcaataacattaagaacctgaacggactggaggctgttggtgacaccctcgaggagttatggataagttataattttatagaaaagctgaaggggattcacattatgaagaagctcaaaatactctatatgtctaataatttggtgaaggattgggctgagttcgttaaactcgctgagctgccctgcctggaggaccttgtgtttgttggcaatcccttggaagaaaaacattccgccgagaataattggatcgaagaagccactaagagggtgcctaaactcaagaagttggacgggactccagtgatcaaaggggatgaagaggaggacaattag

SEQ ID NO: 186066 - DNA, 174 bp, Artificial Sequence
  Description of Artificial Sequence: Synthetic coding sequence
atgaagaagctgaagatcctgtacatgagcaacaacctggtgaaggactgggccgaatttgtgaagctggcagagctcccttgtctggaggatctcgtctttgtgggcaatcctttggaggaaaagcattccgcagaaaacaactggatcgaagaggcaaccaagcgcgtgtag

SEQ ID NO: 186067 - DNA, 456 bp, Artificial Sequence
  Description of Artificial Sequence: Synthetic coding sequence
atggacgccagcctgagcatgctggccaactgcgagaagctgagcctgtctacaaactgcatcgaaaaaattgctaatctgaatgggctaaagaacctgaggatactctccttggggcggaacaacattaagaatctaaatggtcttgaagctgtaggggacacacttgaagagctttggataagctataactttattgaaaaactgaaaggaattcacatcatgaagaaacttaagatactgtacatgtccaataacctggtgaaggattgggccgagtttgtaaaactcgcggaactcccatgcctcgaagacttggtgttcgtaggcaaccctctcgaggagaagcacagcgccgaaaacaactggatcgaggaagccactaagagagtccctaagctgaagaaattagacggcacgccagtcatcaagggagacgaggaggaggataactag

SEQ ID NO: 186068 - DNA, 195 bp, Artificial Sequence
  Description of Artificial Sequence: Synthetic coding sequence
atgaagaagctgaagatcctgtacatgagcaacaacctggtgaaggattgggcagaattcgtgaagttggccgaactgccatgtctcgaagatctagtcttcgtagggaatccactcgaggagaagcacagcgctgaaaataactggatcgaggaagcaaccaaaagagtgccaaagctcaagaaactggactag

SEQ ID NO: 186069 - DNA, 159 bp, Artificial Sequence
  Description of Artificial Sequence: Synthetic coding sequence
atggacgccagcctgagcatgctggccaactgcgagaagctgagcctgtcgacaaattgcattgaaaaaatagccaatcttaatggcttaaaaaacctcagaattttgagcttgggtcgcaataacattaaaaacctcaacggactggaggcagtctag

SEQ ID NO: 186070 - DNA, 198 bp, Artificial Sequence
  Description of Artificial Sequence: Synthetic coding sequence
atgaagaagctgaagatcctgtacatgagcaacaacctggtgaaggactgggccgaatttgtcaagttggctgagctgccctgcctggaggacctggtcttcgttggcaatcccctcgaggaaaagcactcagccgaaaataactggattgaagaagctacaaagagggtgcccaaattgaagaagctcgacggatag

SEQ ID NO: 186071 - DNA, 843 bp, Artificial Sequence
  Description of Artificial Sequence: Synthetic coding sequence
atggtgaccgccaacaaggcccacaccggccagggcagctgctgggtggcaacactggcgagcgcaatgatccctcctgctgatagcctgcttaaatacgacactccagtcctggtgagccggaacacagagaagcggtcacccaaagcgagactgctgaaggtgtccccgcagcagcccgggccctctggctcagctcctcagcccccgaagaccaagctccctagcacaccatgtgtcccagacccaacaaagcaggccgaagagatcttgaatgccatacttccacctagagaatgggtcgaagatacacagttatggattcagcaggtgtccagtacccccagtacaaggatggacgtggtgcacttgcaagagcaactagatctgaaactgcagcagcgccaagcccgtgaaactggcatatgtcccgtccggagggaactgtattctcagtgcttcgatgagcttatcagggaagttacgattaactgcgctgagagaggcttgctgttgctgagggtacgcgatgagatccgtatgacaatcgccgcctatcaaacgttatacgagtcctcagtcgccttcggcatgcggaaggccctgcaggctgaacagggaaagagtgacatggagcgtaaaatcgctgagttggaaacagaaaaaagagatttggagagacaagtgaacgaacaaaaagcaaaatgcgaggccaccgagaagcgggagtcagaacgtaggcaggtcgaagagaaaaaacacaacgaagaaatccaatttctcaaaagaacaaatcaacagcttaaagctcagctggaaggtatcattgccccgaaaaagtag

SEQ ID NO: 186072 - DNA, 399 bp, Artificial Sequence
  Description of Artificial Sequence: Synthetic coding sequence
atgccctactacccccaggacgagctgatccgggaggtgaccatcaactgtgctgaaaggggcctgttgcttctgagggtgcgcgatgagatccgaatgaccattgcagcttatcagacactgtacgagagttccgtggccttcggaatgcgtaaggctctccaggctgaacagggtaaatcagatatggaaaggaagatcgcagagctggaaacggaaaaacgcgacctggagcggcaggtaaatgagcagaaagccaaatgcgaggcgaccgaaaagagagagagcgaacggcgccaggtcgaagagaagaagcacaatgaggaaattcagttccttaaaagaacaaaccagcaactcaaggcacagcttgaaggcattatcgctccaaaaaagtag

SEQ ID NO: 186073 - DNA, 13941 bp, Artificial Sequence
  Description of Artificial Sequence: Synthetic coding sequence
atgagcgagcccggcggcggcggcggcgaggacggcagcgccggccttgaagtctccgctgtacagaacgttgcggacgtctccgtgctacagaagcacttaagaaaattggtaccccttttgctggaagacgggggcgaagcccctgcggccctagaggcagcactcgaggagaaatctgcgttagagcagatgaggaaattcttgagtgacccacaagtccatacggtgcttgtggagcgctctacacttaaggaggacgtcggggatgaaggcgaagaagagaaggaattcatctcatacaacataaacattgacatccattacggcgtcaaaagtaattctttggcctttattaagcgcacaccggtcatagacgctgataagcctgttagctcccagcttcgagtgctgactctctctgaggacagcccctacgagacactccatagttttataagcaatgctgtggctcctttttttaaatcttatattagagagtctgggaaggcggaccgggacggtgacaagatggcccctagtgtggaaaagaagattgctgagctggaaatgggcctgctacatctccaacagaacatcgaaattccagagatctcactgcctatccaccctatgatcacgaatgttgccaaacaatgctatgagaggggtgagaaacccaaggttaccgatttcggcgacaaggtagaggaccccacatttcttaatcaactgcagtctggagtgaaccggtggatccgcgagatacagaaggtgaccaaactcgatagagatcctgcaagcggcaccgccctgcaggaaatatcattttggctgaatttagaacgggctttgtacagaatccaggaaaagagggagtcccctgaggttcttctgacgctggacatcttgaaacacggtaagcggttccacgccacagtcagcttcgacaccgacaccggtctgaagcaagcactggagacagttaatgattacaatccgctcatgaaagatttcccactgaatgaccttttaagtgcaacagagctagataaaattcgtcaggcactggtggctatttttactcacctcagaaagatcagaaacacgaagtacccaatccaacgggctctgaggctcgtcgaagcaattagtcgggatctttcctctcaactgttgaaggtgctaggaacaaggaagctcatgcacgtagcatacgaggagtttgaaaaggtcatggtggcctgcttcgaggtgtttcagacatgggatgacgaatatgaaaagttgcaagtgcttttacgtgacattgtaaaacgtaaacgggaggagaaccttaagatggtttggagaattaaccctgcccaccgcaagctccaggctcggctggatcagatgcggaagtttcggcgccaacacgagcagctgcgtgctgtaatcgtacgcgtgctccggccccaggttaccgccgttgcccagcagaaccagggggaggtgccagagccgcaagacatgaaagtggcagaggtcctgttcgacgctgctgacgccaacgcgatcgaagaggttaatttggcatacgaaaacgttaaggaggtggatggcttagatgtctccaaggaggggactgaagcatgggaagccgcaatgaagcggtacgacgagcgcattgaccgggtcgagactcgcatcactgccaggctgagggaccaacttggtactgccaaaaatgcaaacgagatgttcagaatatttagcagattcaacgccctgttcgtgcgaccacacatcagaggggcaatcagagaataccagacacaattgatccagcgggtgaaagacgacatcgagtcccttcacgataaatttaaggtgcagtatccccagtcacaggcctgtaaaatgtcacacgttcgcgacctgccacctgtgtctggaagcattatctgggcgaagcagatcgatagacagctcaccgcctacatgaaacgggtggaggatgtcttggggaaagggtgggagaaccacgtggaggggcaaaagctgaagcaggacggagactcttttcgaatgaagctaaacactcaagagatttttgacgattgggcacggaaggttcagcagaggaacctgggtgtgtccggccggatatttaccatcgagagcaccagagtcaggggtaggaccggaaacgtcttgaaactgaaagtaaattttctgcccgaaatcatcacactgagtaaggaggtgcgtaatctgaagtggctgggtttcagggtccccctggccattgtgaataaggctcaccaggctaatcagttgtatccttttgccatctccttaatcgaatctgtccgtacttatgagcgcacttgtgagaaggtggaggagcggaacactattagcctcctcgtcgccggattaaagaaggaggtccaggcgttgatcgctgagggtattgcattggtgtgggagtcatacaagctggatccctatgtgcagaggctcgcggaaaccgttttcaatttccaggagaaagtcgatgacctcctcatcattgaggaaaagattgacctggaggtgagaagcctggagacgtgtatgtacgaccataagacattctctgagattttgaatagagtccagaaagccgtcgacgacctgaatcttcattcttatagcaatcttccaatttgggtgaataagctggatatggagatcgagaggatcctgggagtccgactgcaagcgggcttgagagcttggacacaagtcctgctcgggcaagccgaagacaaagctgaggtggacatggatacagacgccccccaggtcagccacaagcccggcggggagcccaagatcaagaatgtggtccatgagctacggattaccaaccaggttatttacctgaacccacccatcgaggaatgtcggtataagctgtaccaggagatgttcgcatggaagatggtcgtgctatctttgcctcggatccaatcccaacggtaccaagtcggggtgcactacgagcttactgaagaagagaagttctacagaaatgctctgacacggatgcctgatggacccgtcgctcttgaagaaagctattccgcagtgatgggtatcgtctcagaagtggagcagtatgtgaaggtctggttgcaatatcagtgcctatgggacatgcaggcagagaatatttataaccgtttaggggaggatctgaacaagtggcaagccctgcttgttcagattcggaaggccagaggtactttcgataacgccgagactaaaaaggaattcggaccagtggtgattgattatggcaaagtgcagtccaaggtgaatctgaaatatgattcgtggcataaggaggtgctttcgaaatttggacaaatgctcggatctaatatgacagaatttcattcccagatcagcaaatcccggcaagaactggagcagcatagcgtggataccgcgtctacaagtgacgccgtgacttttattacctacgttcagtcgttgaaacgaaagatcaaacaattcgaaaaacaagtcgagttgtaccgtaatggtcagcgcctgctcgagaaacagcgcttccaatttcccccttcttggctgtacattgataatatcgagggggaatggggggcgttcaacgatatcatgaggcgcaaagattctgccatccaacagcaggtcgccaacctgcagatgaagattgtccaggaagatcgggccgtggagagtcgaaccaccgaccttctcacagactgggaaaagacgaagccagtgactggcaatctacggccagaagaagccctgcaggcactgacaatatacgagggaaagttcggaaggcttaaagatgacagagagaaatgtgccaaggcaaaggaagctttagagctgactgatacaggcctgctcagcggcagcgaagagagagtgcaggtcgccctcgaggagctgcaggatctcaagggcgtgtggtcggaacttagcaaagtatgggaacagatagatcagatgaaagagcagccatgggtgtccgtgcagccccgcaagcttaggcagaacttggacgcccttctgaaccagctgaaatccttccctgctagactgaggcaatacgcgagctacgagtttgtccaacgtctgttgaaggggtatatgaaaatcaatatgcttgtgatcgagctgaaaagtgaagccctaaaagatcggcattggaaacaattaatgaagcggttgcacgtgaactgggtggtcagcgagctcactctcgggcagatttgggacgtcgacctgcagaaaaatgaagccatcgtgaaggacgtgctgctcgtggcccaaggcgagatggctctggaggaatttctgaaacaaattagggaggtgtggaatacctatgaactggacttagtgaattatcaaaacaagtgtcgcttgatcagggggtgggacgacctgttcaataaagttaaagagcacatcaactccgtgtccgccatgaagctgagcccatattataaagttttcgaagaggacgctctcagctgggaggacaagctcaatagaatcatggcactcttcgatgtctggattgatgtgcagcgacggtgggtgtatcttgagggcattttcacaggaagtgcggacattaaacacttactgcccgtcgaaacacaaaggtttcagagcatctcaaccgaatttttagctctgatgaagaaagtttcaaagtcacctctggtaatggatgtcctaaatatccagggagtgcagaggtcgcttgaacgtctggccgacctcttgggaaaaatacaaaaggccttgggcgagtacctcgaacgggagaggtcttcctttcctaggttctatttcgtcggagacgaggatctgctggaaatcattgggaacagcaaaaacgtggctaaactgcaaaaacactttaaaaagatgtttgctggcgtcagctcaatcatcctgaacgaggataatagcgtggtcctcggcatttcaagcagggaaggcgaggaagttatgttcaagacccctgtgtcgataactgaacacccaaagattaacgagtggctcaccttagtggagaaagagatgcgtgtgacgctcgcaaagctattagcagagagtgtgactgaggtggaaatcttcgggaaggctacttctattgaccctaatacctacatcacctggatcgacaaataccaagctcagctggtagtgctgtccgcccaaattgcatggtccgagaacgttgagacggcactctcaagcatgggagggggaggcgacgccgctccactgcatagcgtgctcagtaatgtggaggtgactctcaacgtgcttgccgactctgtgctcatggagcagcctcctctgcgcagacgaaagctggagcacctgatcactgagctcgtccaccagcgggatgtgactaggtctttaatcaagtctaagattgataacgctaaatctttcgagtggctttcgcagatgcgattctacttcgatcctaaacaaaccgacgtcttgcaacagctgtcaattcagatggctaatgccaaatttaattatggctttgagtacctgggggtccaggacaagctagtccagactccccttacagatcgatgttatctgacaatgacccaggcactcgaagctcgccttggggggtctccatttggaccggccgggacaggaaagacagaaagtgtcaaagctctcggacatcagctgggtagattcgtgctagtcttcaactgcgatgaaaccttcgatttccaggctatggggcgcattttcgtgggcctgtgccaggtgggcgcgtgggggtgcttcgacgagtttaatagactggaggagcgtatgctgtctgccgtgagccagcaagtacagtgtattcaagaggcactacgcgagcattccaaccctaactacgacaaaactagcgcacccatcacctgcgagctgctaaataaacaggtgaaagtgagccctgacatggccatcttcataaccatgaaccccggatacgccggccggtcaaatctgcctgacaacctgaagaaactctttcgtagcctggccatgaccaaacccgaccggcagctgatcgctcaggtgatgctgtactctcaggggtttcgcaccgcggaagtgcttgccaataaaatagtcccttttttcaaactctgcgatgaacaactttccagtcaaagtcattacgattttggattgagagccctcaaatctgtgcttgtgtccgcgggcaacgtaaagagggaacgaatccagaagattaagcgggaaaaggaggaaaggggggaggcagttgatgagggcgaaattgccgagaatctgccggagcaggaaatcctgattcagagtgtgtgtgaaacaatggtgccgaagctggtagcagaagacataccactcctttttagcctactgagcgatgttttcccaggagtacagtatcatcgcggggagatgacagccctgagagaggagctgaaaaaagtgtgccaggaaatgtacctcacatatggcgatggcgaagaggtcggtggcatgtgggtagagaaggtgctgcaactgtaccagatcacccagatcaaccatggcctgatgatggtcggaccctcggggtccggtaagtccatggcttggagagtgctgctgaaagctttggagagactagaaggggtggaaggcgtcgcccacattatcgatccgaaggcaataagcaaagaccatctctatggcactctggatcccaacacccgcgagtggacggacggactctttacccatgtcctgcgcaaaatcatcgactccgttagaggtgagcttcagaagcgccagtggatcgtgttcgacggagatgtggacccagagtgggttgagaatttaaacagcgtcttggacgacaacaagctcttgaccctcccaaacggggaacgtctgtcgctgccacccaacgtccgtattatgttcgaagtgcaagatctcaagtacgccaccctggctacagttagcagatgcggcatggtatggttctcagaggacgttctgtccacagacatgatcttcaataatttcctagcgcggttgcggtctattccattagatgagggggaggacgaggctcagcgaagacgtaaaggcaaagaagacgagggggaggaggccgcctcaccaatgctccagatacaacgggacgccgcaactatcatgcagccctacttcacgagcaacgggctggtgaccaaggctctcgaacacgccttccaactcgagcacatcatggatttaacacggctgcgctgcctggggagcctattctctatgctccatcaggcctgcaggaatgtggcacagtacaatgcaaaccaccccgatttcccaatgcagatagaacaactcgaaagatatatacagagatacctcgtatatgcaatactctggagcctgtcaggggactctcgcctcaaaatgagggccgagttgggagaatacattagacgcatcactacagttcccctaccgaccgctcctaacattcctattattgactacgaggtgagcattagtggagagtggtccccgtggcaggcgaaagttcctcagatcgaggtagagacccacaaggtcgctgcgccagatgtcgtagttcccaccctggacacggtcaggcacgaagcgttactgtacacttggcttgctgaacacaagccgctcgtcctttgtggcccgccagggtccggtaagacgatgacactgttctccgccctgcgagccctgccagacatggaggtcgtcggtcttaacttctccagtgcaaccacgcctgaactgctactcaaaacctttgatcattattgtgagtaccgtaggacccctaatggagtggttcttgcgcccgtccaactggggaagtggctcgtgctattttgcgacgagattaacctgcctgatatggataaatatggcacccaacgcgttatatcctttattcggcagatggtcgagcatggcggtttttacagaacctcagaccagacctgggtcaagcttgagcggatacaatttgtcggcgcttgcaaccctcccacagatcccggaaggaagccgttatctcaccgattcctgaggcacgttcctgtagtctacgtggattatcccggtcccgcttcactgacccagatatatggaaccttcaaccgagcaatgcttagacttatcccatctctgagaacatatgctgagccactaaccgccgcaatggtcgagttctatacaatgagtcaggaacgttttacccaagacacccagccgcattatatttacagtcccagggagatgactcggtgggtacggggaatcttcgaagcactgcgaccgctcgaaacccttccagtcgagggtctcatcaggatttgggctcacgaggcactgcgtctttttcaggacaggttggttgaagatgaagaacgccgatggaccgacgagaatatagataccgtcgcgttgaagcacttcccaaatatcgatagggaaaaagcgatgtcccgcccaattctctacagtaactggctttccaaagattacatacctgtggaccaggaagaattacgagattacgtaaaagcccgtctcaaagtattttatgaggaggaactggacgtgcccttagtgctgtttaacgaggttctggatcacgtactcaggattgacaggatctttagacagcctcaaggacatctccttcttattggcgtgagtggcgccggaaaaactactttgtcccgctttgtggcctggatgaacggactgtctgtctaccagatcaaggtgcataggaaatatactggcgaggacttcgacgaggatttgaggactgttttgagaaggagcggatgtaagaatgagaagatcgcattcatcatggatgagagcaacgtgctcgatagcggcttccttgaacgcatgaatactctgcttgcaaacggagaggtgccaggtctattcgagggagacgagtacgctactctgatgacccagtgtaaggagggcgcacagaaggagggactaatgcttgactcccatgaggaactgtataagtggtttaccagccaggtgataagaaacttgcatgtagttttcaccatgaacccttcaagtgagggcctcaaggatcgagcagccacctcccctgctttgttcaacagatgcgttttgaactggttcggagattggtccactgaggccctctaccaagttggcaaggaattcacatctaagatggatttagagaagcccaattacatcgtcccagactacatgcctgtcgtttatgataagttaccccagcccccttctcatcgcgaagctatcgtcaattcttgcgtgtttgttcaccaaacactacatcaggccaatgcccggctggctaaacgcggaggccggacgatggctattacccccagacactatctcgacttcatcaaccactacgccaacctcttccacgagaagcgatctgaactggaggagcagcaaatgcacctgaacgtcggactccggaaaattaaggaaacagttgatcaggtagaggaactgcggagagatctaaggatcaagtcacaagaactggaggtcaaaaatgcagccgctaatgataagctgaaaaagatggtcaaagaccagcaggaagccgaaaagaagaaagtgatgagccaggaaattcaggaacaattgcataaacagcaggaagtaattgccgataagcagatgtccgtcaaagaggacctggacaaggtggaaccagccgtcattgaagcgcagaacgctgtgaaaagtatcaagaagcagcatctggtcgaggtgaggagtatggcaaatccccccgccgcggtgaagcttgcccttgagagcatttgcctcctcttgggggagtcaacaactgactggaaacagatccgcagtatcattatgagggaaaactttattcccaccattgtgaatttctctgctgaggaaatttccgatgccatccgggaaaagatgaaaaagaattatatgagcaatcccagctataattacgagatcgtgaatagagcttccctggcctgtggtcctatggttaaatgggccatcgctcagctaaattatgctgatatgctgaagcgcgtggagccgcttaggaatgagctacagaagttagaggacgacgcaaaggataaccagcagaaggcaaacgaggtagagcagatgatcagagacctggaggctagtatcgccagatataaagaggaatatgcagtcctgatcagtgaggcacaggccataaaggccgatctcgctgctgtcgaggccaaggtcaaccggagcacggcccttctaaaaagcctctcagctgaacgtgaaagatgggaaaaaacctccgaaacatttaagaaccagatgagcaccatcgccggagattgcctgctttcagccgctttcattgcatacgcagggtactttgatcaacagatgaggcagaatctgtttacaacgtggagtcaccatctgcagcaagctaatattcagttccggaccgacatagcaaggaccgagtacctgtctaacgctgacgaaagattaaggtggcaggcttcatccctgccggctgatgacctctgtaccgaaaatgctatcatgctcaagcgcttcaatcgctatccactgattatagacccctcaggccaggccacggaatttattatgaacgaatacaaggaccggaagatcacccgtacgtcattcctggatgacgcattccggaaaaacctggaatccgccttacgatttgggaacccacttctcgttcaggatgtggagtcctatgacccggtgttgaatccggtacttaaccgagaggtccggcgtactggcggaagagtgctcattaccctcggcgaccaagacatagatttatccccatctttcgtaatcttcttatctacaagagatcccacagtggagttcccacccgatctctgtagtagagtgacattcgtcaatttcaccgtgactcggtctagccttcagagccaatgtctgaatgaggtcctcaaagctgagcggcccgatgtggacgaaaagagaagcgatttactcaagctgcagggagagtttcagctcagattgcgccaacttgagaaatctctcctgcaggcactgaatgaagtgaaaggacggattcttgacgatgacaccattattactacactcgagaatttgaaaagagaagccgctgaagtgacaaggaaagtggaagagaccgatatagttatgcaggaagtggagacggtatcacagcaatatctgcctttgtccaccgcctgttcaagcatttactttacaatggagagcctgaagcagattcacttcctgtatcaatactcactgcaattctttctggacatataccataacgtgctgtatgaaaaccccaatctgaagggcgtgaccgaccacacgcagaggctgtccattattaccaaagatctgtttcaggtggcattcaacagggttgctcggggtatgctgcatcaagaccacattaccttcgcaatgctgctagctcggatcaaattgaaagggaccgttggcgagcctacatatgacgccgagtttcagcacttccttagaggcaatgagatcgtcctcagcgccggcagcacccctcgaattcagggccttaccgtagagcaggcagaagcggtcgtgcgcctcagctgtctccctgcttttaaggacttaattgccaaggttcaggccgatgagcaatttgggatttggctcgattctagcagtcctgagcagaccgttccctacttatggagcgaggaaacccccgccacccccattggacaggcaatccatcgtctcttactaatccaagcttttagacccgaccgactcctggccatggcccatatgtttgtttcgacaaatcttggagagagcttcatgtcaattatggaacagcctttggacctgacacatatcgtaggcaccgaggttaaacccaataccccagtcctgatgtgcagcgttcctgggtacgatgcctctggccacgtagaagacttggctgcggagcagaacacccaaattaccagtattgccattggtagtgctgaagggtttaatcaggcggataaagctatcaatactgccgtgaagtcaggaaggtgggtaatgctcaaaaacgtccaccttgcgccaggctggctgatgcaacttgagaagaagctgcactctctgcagccccacgcctgttttaggctgtttcttacaatggagatcaaccctaaagtcccggtgaacctgcttagggctggcaggatattcgtgtttgagccacctccaggtgtcaaggccaatatgttacgcacattctctagcatccccgtttccagaatctgtaaaagccccaatgagagggctcggttatatttcctcttagcctggtttcacgccatcattcaggagaggctcagatatgctcctctcgggtggtccaagaaatacgagtttggcgagtccgatttgcgatccgcgtgcgacacagtggacacctggctcgatgatactgccaaaggcagacagaacatctcacctgataagatcccttggtccgctcttaagaccctgatggctcagagcatttatggtggccgcgtggacaacgaattcgatcaacgcttacttaacaccttcctggagcggcttttcacgactcgcagctttgactctgagttcaaactagcatgtaaagtggacggccacaaggatatccagatgcctgatgggataagaagagaagagtttgtccagtgggtggagctgttgcccgacacccaaacgccgagctggctcggactccccaataacgcagagcgcgtactgttaactactcagggcgttgatatgattagtaagatgctgaagatgcagatgctcgaggatgaggatgacttagcgtatgcagagaccgagaagaagacccggactgatagtactagtgacggcagaccagcgtggatgcgaactttgcacactacagcttccaattggttgcatctgatccctcagaccttaagccaccttaaacgaactgtagagaatattaaagaccccctgtttaggtttttcgagcgcgaggtgaaaatgggcgctaagctcctacaggacgttcggcaagatttagcagatgtggtccaggtttgcgaaggcaaaaagaaacagactaattatctgcgcaccctgatcaacgagttggtcaagggcatcctgccacgttcttggtcccactacactgtccctgctggtatgacagtgatccaatgggtttccgatttctcagagcgcattaagcagcttcaaaatattagtttggctgcagccagtggtggcgccaaggagttaaagaacatacacgtgtgcttggggggacttttcgtccccgaggcttacattacagccaccagacagtatgtcgcacaggctaatagttggtccctggaagaactgtgtctggaggtgaacgtgacaactagccagggcgctactttggacgcatgctctttcggggttacaggtctgaaactgcagggcgccacttgtaataataataaattatctttaagcaacgcaatctcaactgccctacccctcacacagctccgatgggtgaaacaaaccaatactgaaaagaaagcctcggtcgtgaccctaccagtgtacttaaatttcacccgagccgaccttatttttacagtggattttgaaatcgctaccaaggaagaccccaggtctttttacgaacgaggagttgcggtcctttgcacagagtag

SEQ ID NO: 186074 - DNA, 1899 bp, Artificial Sequence
  Description of Artificial Sequence: Synthetic coding sequence
atgagcgacaagagcgagctgaaggccgagctggagcggaagaagcagcgccttgctcagattagagaagaaaaaaagagaaaagaagaagagcgtaagaagaaagagactgatcagaaaaaggaagctgtggccccagtgcaggaggaatctgacctggaaaagaagcgcagagaggccgaggcacttttgcagagcatggggttgacaccggagtctcctatcgtgccgccccccatgtccccgtcttcgaagagcgtctccactcccagcgaggccggcagtcaggattcaggcgatggtgcagtaggttctcgaactttacactgggacaccgacccgtctgtgctccagctacattccgatagtgacctggggcgcggccctataaaactggggatggctaagatcacacaagttgactttccaccacgagaaatagtgacctacaccaaagaaactcagactccagttatggcgcagccaaaggaagatgaggaagaggacgacgacgttgttgcccctaagccccctatcgaaccagaagaagagaagacattgaaaaaggacgaggagaacgactccaaggccccaccccacgagctgaccgaggaggagaagcaacagattctgcattcggaggaattcctgtctttcttcgaccacagcaccaggatagttgaaagagctctgtcagaacagattaatatcttcttcgactacagcggccgcgaccttgaggataaagaaggcgaaattcaggcaggcgccaaactgagtctgaatcgccagttttttgacgaaagatggtccaagcatcgggtggttagttgtctggactggagttctcaataccctgagttactggtggcttcatacaacaataacgaggatgccccccacgaacccgatggagtggcactagtttggaacatgaaatataaaaaaaccacacccgagtacgtcttccactgccagagtgctgtcatgtctgcaaccttcgccaaatttcatccaaaccttgtggtgggaggtacatactctgggcaaattgttctatgggacaacaggtccaacaaacggaccccggtacagcggacccccctgagtgcagccgcgcatacacacccagtatactgcgtaaatgttgtcggtacacagaacgcccataacttgatcagcataagtacagacggcaagatctgtagctggtccttagatatgctctcacatccccaggatagcatggaactcgtccacaagcaaagcaaagccgtcgctgtaacgagcatgagtttccccgttggtgatgtgaataattttgttgtgggcagtgaagagggtagcgtctacaccgcttgtcggcacggatccaaagctggcatatccgaaatgtttgaaggtcatcagggacctatcactggtatccattgtcatgctgctgtgggagctgtggacttttcccacctgtttgtgacctcatcattcgattggaccgtaaagctgtggacaactaagaacaataaaccactatattctttcgaggataatgcggattacgtgtacgacgtcatgtggtctcctactcatcccgccctcttcgcctgcgtggatggcatggggaggctggacctgtggaacctcaataatgatacggaggtgcccaccgccagcattagtgtcgaaggcaacccagcattgaaccgcgtgcggtggacacacagcggccgggagattgcagtgggcgactcggagggacagatagtgatctacgacgtgggcgagcagatcgctgtgccaagaaacgacgagtgggcaagatttgggagaaccctcgctgagattaacgccaacagagccgatgccgaggaggaggccgccaccaggatccctgcatag

SEQ ID NO: 186075 - DNA, 1839 bp, Artificial Sequence
  Description of Artificial Sequence: Synthetic coding sequence
atgagcgacaagagcgagctgaaggccgagctggagcggaagaagcaaagattggcacagatcagagaggagaaaaaacgaaaagaagaagagcggaagaagaaagaaacggatcagaagaaagaagcagttgcgccagtgcaggaggagtcagacttagagaagaagcggagggaggctgaggccctcctccaatccatgggcctgacgccagaaagtcccatcgtccccccccctatgtcacccagttcaaagtcagtcagcactccatcggaggctggaagtcaagatagtggcgatggcgccgtgggcagtcgcagaggccccatcaaactgggtatggccaagattacccaagtcgactttcccccacgggaaattgtcacctacacgaaagagactcagaccccagttatggcacaacccaaagaagatgaggaggaggatgacgacgtggtggcccccaagccccctatcgaacctgaagaggagaaaacactgaagaaggatgaggagaacgattctaaggcgccaccacatgaacttaccgaggaggagaagcagcaaattttgcactccgaggaatttcttagcttcttcgaccatagcacccggatcgttgaaagagctctaagtgagcagattaacattttcttcgattatagcgggagagatctcgaggataaggaaggagagatccaggcaggagcaaaactgtcccttaatcgccaatttttcgacgaacgctggtcaaagcaccgggtcgtcagctgcctggattggtcttctcagtaccccgagttacttgtggccagttacaataacaacgaggacgctccccacgaacccgacggggtggccctcgtgtggaatatgaaatacaagaagaccacccccgaatacgtcttccattgccagtcagctgtgatgtccgccacgtttgccaagttccacccgaaccttgtagtgggaggcacttacagcggacagatcgtattatgggataatagatccaacaagcggacccccgtgcagcgaactccactttctgcagctgcacacacccatccagtgtactgcgttaatgttgttggcacacaaaacgctcataatctgatttcaatctctacagatgggaaaatctgtagctggtcactggacatgctttcacatccacaggacagcatggagctggttcacaaacagagtaaggcagtggcggtgaccagcatgtcgttccccgtgggggatgtcaataattttgtggttggaagcgaagagggcagcgtctacaccgcatgtaggcacggatcgaaggcagggatcagcgagatgtttgaagggcaccaggggccgatcacagggatccactgccacgccgccgtgggggccgtggatttttctcacctgtttgttacctcatcgtttgattggaccgtcaaactttggaccactaaaaataacaaacccttgtacagcttcgaggataatgcggactacgtgtatgacgtcatgtggtcaccaactcaccccgccctatttgcatgtgtcgacgggatggggagactggatctctggaatctgaataacgacacagaagtgcccacggcaagtatttcagtggagggaaatccagccctgaaccgagtgcgctggacacactctgggcgggagatcgcagtgggtgattctgaggggcagatcgtgatatacgacgtgggcgaacagattgccgttcctcggaatgacgagtgggccaggtttggcaggaccctcgcagaaattaacgcaaaccgagctgacgccgaggaggaagccgccacccgcatccctgcctag

SEQ ID NO: 186076 - DNA, 1893 bp, Artificial Sequence
  Description of Artificial Sequence: Synthetic coding sequence
atgagcgacaagagcgagctgaaggccgagctggagcggaagaagcaacggctcgcacagatccgagaggaaaaaaaacgcaaggaagaggaaagaaagaaaaaggagacagaccagaagaaagaggccgtggcgcctgtgcaggaggaatcagatttagagaaaaaacgccgggaggccgaagctttgctgcagtcaatgggcctcacacctgagtcccccatagcagagcagcctctgcgcgtagttaccgcggacacctgcctttttcattatctggtgccaccccccatgagcccatcttccaaaagcgtgagcaccccttcggaggcggggagtcaggactccggagacggcgccgttgggagtcgtcgaggccctattaagttgggcatggccaagattacccaggtcgatttccctccacgcgagattgtgacgtacacaaaagaaacacagacaccagttatggcccagcctaaggaagatgaggaagaagacgacgacgtggtcgcccccaaacctcctatcgagcctgaggaagagaaaacactgaagaaagacgaagagaatgactccaaggcaccgcctcacgaactgacggaggaggaaaagcaacagatcctgcactcagaggaatttttgtccttctttgatcattcaaccaggattgtggagagagctctcagcgagcagatcaacatcttcttcgattactcaggtagggatctggaggacaaggagggtgaaatccaggcgggtgccaaactgtcactgaatcgccaattttttgatgaacgctggagcaaacacagagtcgtgtcgtgtctcgattggagcagtcagtacccagaattgctcgtggcctcttacaacaacaacgaggatgcccctcacgagcccgacggtgtcgcccttgtgtggaacatgaagtacaagaaaacgacccctgagtacgtctttcactgtcagagcgctgtgatgagcgccactttcgccaaatttcatccaaacctggttgttgggggcacctacagtggccagattgtgttgtgggataataggtctaacaagcgcacgcccgtgcaaaggacgcccctcagcgctgctgcccatacccaccccgtctactgtgtaaacgtcgtcggaacacaaaatgcccataacctgatctctatctccaccgacggtaaaatctgttcttggtctctggacatgctctcccacccgcaggattccatggaactcgtgcacaagcagagtaaagctgttgcagtaaccagcatgagctttcctgtgggagacgtgaacaactttgtcgtgggcagcgaggagggatctgtgtatacagcttgccgccacggctccaaggctggcatttcagaaatgttcgaaggacaccagggaccgatcacaggaatccattgtcacgcagctgtgggagctgtagacttttcacacctcttcgtcacctccagcttcgactggaccgtcaaactgtggaccaccaaaaacaataagcctctatactcgttcgaagataatgctgactacgtgtatgatgtcatgtggtctcctacacaccccgctctattcgcttgtgtagatggaatgggcaggctcgatctatggaatctgaacaatgacaccgaagtaccaacagcttccatatctgtagagggcaacccagcccttaatagggtgcgttggactcatagcgggcgcgaaatagcggtgggagatagcgaaggacagatcgtgatttatgatgtaggtgaacaaatcgccgtaccaaggaacgatgaatgggctcgatttgggaggaccctcgctgaaatcaatgctaatcgcgccgatgccgaagaagaagcagccactcgcattccagcctag

SEQ ID NO: 186077 - DNA, 1917 bp, Artificial Sequence
  Description of Artificial Sequence: Synthetic coding sequence
atgagcgacaagagcgagctgaaggccgagctggagcggaagaagcaacgattagctcagattcgggaagagaagaagaggaaggaggaagagaggaaaaaaaaggagacagaccagaaaaaagaggctgtagccccagttcaggaagagagtgatctggagaagaaaagacgagaagccgaggcactgctgcagtctatgggcctgaccccggaaagcccaatagtcttttcagaatactgggtaccacctccaatgtctcccagtagtaagtctgtgagcacaccttctgaagccggttcccaggattctggtgacggagccgttggatcaagaacattgcactgggacaccgatcctagcgtcttgcaactgcattcagattccgaccttggtcggggccctattaaactcggcatggccaaaatcacccaagttgactttccacctagagagattgtcacttatacgaaagagacacagactccggtcatggcccagcccaaagaagatgaggaggaggatgacgacgtggtggctcccaaaccacccatcgaaccagaagaagagaagaccctgaagaaagatgaggagaacgattctaaggccccaccccatgagcttacagaagaggaaaaacaacaaattttgcatagtgaggagttcctgtctttcttcgatcattctacaagaatcgtcgaacgtgccctctccgaacagattaacatcttttttgattactccggcagagatctggaagacaaggagggtgaaatccaggcaggagccaagctgtcccttaatcgacaattttttgatgagcgatggtctaaacatagagtagtgtcctgcctggattggtcttcccagtaccctgagctactagtggcctcctacaataacaacgaggatgccccgcacgagcctgatggcgtcgcactagtgtggaacatgaagtataagaaaaccacaccggaatacgtgtttcactgccagtccgcagtgatgtcggccacatttgctaagttccatcctaacctggtcgtgggcggtacgtactccggccagatcgttctgtgggataatcgctcaaacaaacggacccctgtgcagcgaactccgctgtcagctgctgcgcacactcacccagtctactgtgtcaacgttgttggcacccagaacgcacataacctgatatctatttcgactgatggtaaaatatgctcttggtccctggatatgttatcacaccctcaagacagtatggagctggttcacaaacagtcaaaggctgtggccgtcacatcaatgtcgttccccgtgggggacgtgaataattttgtcgtggggtccgaagaaggttctgtgtacactgcttgtagacacggaagtaaagccggaatcagtgagatgtttgaaggccaccaaggacctatcacaggcatccactgccatgcagccgtcggagctgtggacttcagtcacctgtttgtgacctcaagcttcgattggaccgtgaagctgtggactaccaaaaataataagcccttatacagttttgaagataatgctgactacgtatatgacgttatgtggagccctacccaccccgcactttttgcctgtgtggacgggatgggcagactggacctgtggaatctgaacaatgacacagaagtacctaccgcatccatatcagttgagggcaaccccgcccttaaccgtgtcaggtggacacatagcggccgagagattgcagtgggagactcagaggggcaaatcgtgatctatgatgttggggagcagatcgccgtccccaggaacgatgagtgggcccgctttgggcgcactctggccgagatcaacgccaaccgggccgacgccgaagaggaggctgccacaaggatccccgcttag

SEQ ID NO: 186078 - DNA, 1839 bp, Artificial Sequence
  Description of Artificial Sequence: Synthetic coding sequence
atgagcgacaagagcgagctgaaggccgagctggagcggaagaagcaacggctcgcacaaattcgcgaggagaagaagagaaaagaggaggaacgaaagaagaaggagaccgaccaaaaaaaagaggccgtcgcccccgtccaggaggaatctgacctggaaaaaaaacgccgagaagccgaagcactgctgcagtctatgggactgacacctgagtcccccattgtgcccccccccatgtcccctagcagtaaatcagtgtctactccgtcagaggctggctctcaggatagtggcgatggcgccgttggttctagacgcgggccgattaaattgggcatggcaaagattacacaggttgacttccctccacgcgagatcgtgacatataccaaggaaacccaaacccctgtgatggctcaaccaaaagaggatgaggaagaggatgacgacgtggttgctcctaagccaccaatagaacccgaggaagagaaaaccctgaaaaaggacgaggagaatgattccaaggcacccccccatgaactaaccgaggaagagaagcagcagattctgcattctgaggagtttctctcctttttcgatcactcgaccaggattgtcgagcgggctctatccgaacagatcaacatctttttcgactatagcggaagagatcttgaagataaggagggagaaattcaggcaggcgccaaactcagcctgaaccgtcaattttttgatgagcgctggagcaaacacagggtggtgagctgtcttgattggagctctcaatacccagagctgttagtggctagctacaacaacaacgaagatgctcctcacgaaccggacggggtggccctcgtctggaatatgaagtataaaaagaccacccctgaatacgtcttccactgccagtccgctgttatgtcagccacattcgcaaagttccacccaaatctcgttgtgggcggcacctactccggtcaaatcgtcctctgggataatcgttctaataagcgcactcccgtccaacgcacccccctgtccgctgctgctcacacacacccagtgtactgcgtgaacgttgtgggcacccaaaatgctcacaaccttatctcaatcagcacagacgggaagatctgctcctggagcttagacatgctgtcccatccgcaggattctatggaacttgtacacaagcaatctaaggctgtagccgtaacaagtatgagtttccccgtcggagatgtcaataactttgtagtggggagtgaggaaggatctgtctatactgcgtgtagacacgggtctaaggcagggatttctgaaatgttcgaaggtcaccagggccctattaccggaatccattgtcacgccgccgtaggtgccgtggacttcagccacctgttcgtgacgtcttcattcgattggacagtgaagctgtggactaccaagaacaataaacctctgtacagcttcgaggacaacgccgactacgtctacgatgttatgtggtctcctacccatccggctctgtttgcatgtgtggacggcatgggccgccttgatctctggaacctaaacaacgacaccgaggttccgaccgcctctatctcagtagaagggaaccccgcactaaatcgtgtgcggtggacgcactctgggagagaaattgcggtgggcgattctgaagggcagattgttatttatgacgttggcgaacagatcgccgtgcccagaaatgatgagtgggctcgtttcggacggactctggccgagataaatgctaatagagctgatgctgaggaggaggccgccacaaggataccagcatag

SEQ ID NO: 186079 - DNA, 1899 bp, Artificial Sequence
  Description of Artificial Sequence: Synthetic coding sequence
atgagcgacaagagcgagctgaaggccgagctggagcggaagaagcagcggctcgcccaaattcgtgaagaaaagaaacgcaaggaggaagaacgaaagaagaaggagacggaccagaaaaaagaggcagtggcccccgtacaggaggaaagcgacctggagaagaagcgtcgagaggccgaagctctgctgcagagcatgggcctgactccggagtcacccatcgtgcctccacctatgtctccttcctcaaagtctgtgtcaactccttcggaagctggctcccaagactctggcgatggtgcagtgggaagtaggactctgcattgggacacagacccctccgtgctgcagctgcattccgactctgacttaggacgcggtcccattaaactcggaatggcgaagatcacacaagtggactttccaccccgcgaaattgtcacatacaccaaggaaacccaaaccccagttatggcccaaccaaaggaggacgaagaggaagatgatgatgttgtggcacctaaaccccccattgaacctgaagaagaaaaaacccttaagaaggatgaagaaaatgatagcaaagcgcctccccacgaactgacggaagaagagaagcaacagatcctgcacagtgaggagttcttgtctttttttgatcattcaacacgcattgtggagcgcgctttaagcgagcagatcaatatcttcttcgactactctggacgtgacctcgaagataaagaaggcgagattcaggccggggccaagctatcactcaatcgccaattcttcgacgagaggtggtcaaaacaccgggtggtcagttgcttagattggtcttctcaatatcccgagctcttagttgctagctataataataatgaggacgcaccccatgaacctgatggcgtggcgctggtgtggaatatgaaatataagaagaccacccccgagtatgtcttccactgccagtccgccgtgatgagcgctaccttcgcaaagtttcaccctaacctggttgttggcgggacctattccggtcagatcgtgttgtgggacaaccgctccaataaacggactccagtgcagagaacaccactttccgctgccgcacatacacaccccgtgtattgcgtgaacgtcgtaggcacacagaacgcccataacctgatatccataagcaccgacggcaaaatttgcagctggagcctggacatgctgtcccatccccaggattccatggagctcgtgcacaagcaaagcaaggcagttgccgtgacatcaatgtctttccctgtaggtgacgtcaacaatttcgtcgtcggttccgaagagggctccgtgtacaccgcttgtcgtcacggatctaaggctggcatcagcgaaatgttcgagggtcaccagggtcctattacgggaattcattgccacgctgcagttggagccgttgatttttcccacctgttcgtgacgtcctcattcgattggaccgtcaaactgtggacaactaagaacaacaagcctctatactcttttgaagataatgccgactatgtctacgatgtcatgtggagtccgacacacccagccttatttgcctgcgtggacggcatggggcgactggacctctggaatctaaataacgacacagaggtgcctactgcttctatatctgtggaaggtaatcccgccctgaatcgcgtccggtggacacacagcggtagagagatcgcagtcggcgacagcgagggccagattgtgatctatgatgtaggagagcagatcgccgtgccacggaacgacgaatgggctcggtttggaagaactctcgctgaaatcaacgcgaaccgagctgacgccgaggaggaggccgcgacgagaatccctgcctag

SEQ ID NO: 186080 - DNA, 1914 bp, Artificial Sequence
  Description of Artificial Sequence: Synthetic coding sequence
atgagcgacaagagcgagctgaaggccgagctggagcggaagaagcagaggctggctcagatccgcgaggaaaaaaagcgaaaggaagaagagaggaaaaaaaaggagacagatcaaaaaaaagaagcggttgcccctgtccaggaggaaagcgatctcgagaagaaacggcgggaggccgaggcactgctacagtcaatggggctgacccccgagtcacccatcgttttctccgaatactgggttcccccccctatgagtcctagctcaaagtccgtctccacaccatcagaggccggatcccaggacagcggcgacggggcagtgggctcgcggactctccactgggataccgatccctctgtcctgcaactacacagtgattccgacttgggccgaggaccaataaagcttggaatggccaaaatcacccaggtggactttccacccagggagatagtgacatacacaaaagagacccagacgcccgtaatggctcagcccaaggaggatgaagaggaggatgatgatgtagttgcccctaagccgcccatcgagccggaggaagagaaaaccctcaaaaaagacgaagaaaatgatagcaaagcccccccgcacgagcttactgaggaagaaaagcagcaaatcctacattccgaggagttcctgagctttttcgaccatagcacaagaatcgttgagagagcactctcagaacagataaacattttcttcgactactcgggccgcgatctggaggacaaagagggggagattcaagctggagcaaaactgagcctgaatcgccagtttttcgatgaacgttggagcaaacaccgcgttgtctcatgcctcgactggagctctcaataccccgaactgttggttgccagctataacaacaatgaagatgctccccacgagcccgatggcgtcgccttagtatggaacatgaagtacaagaaaacaaccccagagtacgttttccattgtcaatccgccgttatgagtgctaccttcgcgaagttccacccaaatctggtggttggcgggacgtattctggccagatcgtgctctgggataatagatcgaacaaacgcactccagtacagaggacacctttgtctgccgctgcccacacccatccggtgtactgcgttaacgtggttgggacccagaatgcacacaatctgatcagtatatctacagatggcaaaatttgcagttggagcctggacatgttatcacatccgcaggacagtatggagttggtgcataagcagagtaaagccgtcgccgttacatcaatgtccttccccgtgggggatgtcaacaacttcgtcgtgggtagtgaggagggatctgtctataccgcctgtagacacggctctaaggctggcatctccgagatgttcgaggggcaccagggacccatcaccggtatccactgtcacgcagccgtgggtgctgtcgacttctcccatttgttcgtcacctcatcattcgactggacagtaaagctgtggactacgaagaacaataagccactgtattccttcgaggataacgctgactatgtctacgatgtgatgtggagccccactcatccagcgctgttcgcgtgcgtcgatggaatgggacgacttgatctttggaatttaaacaacgatactgaagtgccgacagcctcaatatcagtggagggtaaccccgcattaaacagggtgagatggactcactctgggcgcgagatcgcggttggtgactcagaaggacagatagtgatctacgacgtcggcgaaattgctgtgccgaggaacgacgagtgggcccgtttcggtaggacgctggccgaaatcaacgccaatcgcgctgacgccgaagaggaagctgccacccggattcccgcttag

SEQ ID NO: 186081 - DNA, 1917 bp, Artificial Sequence
  Description of Artificial Sequence: Synthetic coding sequence
atgagcgacaagagcgagctgaaggccgagctggagcggaagaagcagcggctggctcagatccgggaagagaagaaaaggaaggaggaggagcggaagaaaaaagaaactgatcagaagaaagaggcggttgccccagtccaggaggagtccgatctggagaagaagaggagagaggccgaagccctgctgcaaagcatgggattaacgcccgaatccccgatcgtcttcagcgaatactgggtgcctccccccatgtctccgtccagcaaaagtgtgtctacaccctcagaggctgggtcacaggactctggtgatggcgcagttggcagccgaacactgcactgggataccgacccaagtgtccttcaactgcatagtgactcagatctcggcagagggccgattaaattaggcatggcaaaaattacgcaggtagacttccctccaagggagatcgtgacgtacacaaaggagacacagacacctgttatggcacagcctaaagaagatgaagaggaggacgatgacgtcgtcgctccaaagccacctatcgagcctgaagaggaaaagactctgaaaaaagatgaagaaaacgacagcaaagcgccaccgcatgaactcaccgaggaggagaagcaacagattcttcactctgaagagtttctgtcatttttcgaccactccacacggatcgttgagagagctttgagtgagcagattaacatctttttcgattactcaggccgggacctcgaggataaggagggggaaatccaggccggggcaaagctgtctttgaatagacagttctttgatgagaggtggagtaagcaccgcgtggtgagctgtctcgattggagctcccaatacccagagctgctcgtggcttcctacaacaacaacgaagacgctcctcatgaacctgacggggttgcgctggtatggaacatgaaatataaaaagactacgcccgagtacgtgttccattgccagagcgctgttatgagtgcgaccttcgcaaaatttcaccccaatctcgtggttggcggcacctatagcgggcagattgtgctctgggataataggtcaaataaacgtactcctgtacagagaacaccgctgagtgcagctgcccacacgcaccctgtctactgtgtcaacgtggtaggcacacaaaatgcccacaatctgatctcaataagcacagatgggaaaatctgctcctggtccctagacatgctgagtcaccctcaggacagcatggaactggtgcacaaacagagcaaggcagtggccgtaaccagcatgagttttccagtcggggatgtgaataactttgtcgtggggtctgaagagggatctgtgtacaccgcttgtagacatgggtctaaggccgggatatcagagatgtttgagggacaccaaggcccgatcacagggattcattgccatgctgccgtcggtgctgtcgatttttctcatctgttcgtcacctcatcattcgactggactgtcaagctgtggaccactaagaacaacaagccgttgtatagcttcgaagataatgcggactatgtttatgatgtcatgtggagccctacacatcccgccctcttcgcatgcgtggacggcatgggacgactggatttgtggaacctgaataatgacacagaggtacctactgcctctatctcagtggaaggcaatccagctttgaatagggtgcgttggacccactccggacgcgagattgcagtaggggattctgagggtcaaattgtcatatacgatgtcggtgaacagatcgcagtacctcgaaacgacgaatgggcccgtttcggcaggaccttggccgagatcaacgcaaacagagcagacgcagaggaagaggccgcaaccagaattccagcctag

SEQ ID NO: 186082 - DNA, 1836 bp, Artificial Sequence
  Description of Artificial Sequence: Synthetic coding sequence
atgagcgacaagagcgagctgaaggccgagctggagcggaagaagcaaaggctcgcccagatacgtgaagagaaaaagaggaaagaggaggagaggaagaaaaaggaaactgatcagaagaaggaagcggtagcccccgtacaggaagagtccgatctggaaaagaagcgcagagaggccgaagctttgctccagagcatgggactgaccccggaaagtccaatagtgccaccccctatgtcacccagcagtaagtctgtgtccaccccttccgaggccggatcccaggattcaggagacggcgcggtaggcagccggagaggtccaatcaagctggggatggctaagataacacaggtcgattttcctccccgggagatcgtgacttacaccaaagagactcagacacctgtaatggcccagcctaaggaggacgaggaggaggacgacgatgtagttgcccctaagccgcctatcgagcctgaagaggagaagaccttaaagaaggatgaggagaatgattccaaggcgcctcctcacgagctcactgaggaggaaaaacagcagatcctccatagcgaagagtttctgtcatttttcgaccatagtacacgaatagtcgaacgcgctctcagcgagcagattaacatctttttcgattattccggcagggatttagaggataaagagggtgagattcaggccggagccaaattgagcctcaaccggcagtttttcgacgagcgctggtcaaaacatagggtggtgagttgcctggactggtctagccaatatccggaactgctcgtggcgtcatataataataatgaggatgccccccacgaacctgacggagtcgcactcgtgtggaacatgaaatataagaaaactacaccggagtacgtgttccattgccagagcgctgtgatgagtgccaccttcgcaaaatttcatccaaacctggttgttggcgggacatactccggacagattgtgctttgggacaacagatccaataaacgaacaccagtgcaacggactccgctctctgccgctgcacatacacacccagtttattgtgtgaatgtggtcggtacgcagaacgcacataatctaattagtatctcaaccgatgggaaaatttgctcttggagcttggatatgttatcccacccgcaagattctatggagctggtccataagcagtcaaaagccgtggccgtgaccagcatgtccttcccagttggagatgttaacaactttgtggtaggttccgaggaaggcagcgtgtacaccgcttgtaggcatgggagcaaggcaggcatctcagaaatgttcgagggacatcagggccccattacaggcatccattgtcacgccgctgtcggtgcagttgattttagccatctgtttgtcacaagtagctttgactggaccgtcaagttgtggacaacgaagaataataaaccactgtattcattcgaagataatgccgattacgtttatgatgtaatgtggagccctacacacccggccttattcgcctgcgtagacgggatgggaagactggacctgtggaatttgaataatgacaccgaggtcccaacggcctctattagcgtcgagggaaaccccgccctgaaccgcgttcggtggacgcacagcggtcgggaaatcgccgttggggattctgaagggcagattgtaatctacgacgtcggcgagattgccgtgccccgcaacgatgagtgggcgagattcggcagaaccttggctgaaataaacgccaatcgagccgatgctgaagaggaagcagcgacaagaatccccgcgtag

SEQ ID NO: 186083 - DNA, 1917 bp, Artificial Sequence
  Description of Artificial Sequence: Synthetic coding sequence
atgagcgacaagagcgagctgaaggccgagctggagcggaagaagcaacggcttgctcaaattagggaagaaaaaaagcggaaggaagaggagaggaagaaaaaggaaaccgatcagaagaaggaggcagtggcacccgtgcaggaagagtccgacttggaaaaaaagaggagagaggctgaggctcttctgcagtccatgggcctgacccccgagagcccaatcgatatcgctgaataccttgtcccccctccgatgtcacccagcagtaagtctgtgagtactccgtccgaggctggttctcaggattcaggggacggggccgtgggatctcgcacactgcattgggatacagacccttccgttttacagttacactcggatagcgacctgggaaggggcccaatcaagctgggaatggctaagataacacaggtggattttccaccaagagagatagtgacctacacaaaagaaactcagacccctgttatggctcagccgaaagaggacgaagaagaagatgatgatgtggttgcacctaagccccccatcgagccggaggaagaaaagacactaaaaaaggacgaagagaacgactcgaaagctcctcctcatgaactaaccgaggaggagaaacagcagatcctgcactcggaggaatttttgtcattcttcgaccactccacacggattgtggaacgcgccctctcggaacagattaatatatttttcgactactctggtcgggacttagaagacaaagagggcgaaatccaggctggcgccaagctatccctcaacaggcagttcttcgacgagcggtggtctaagcaccgagttgtgagctgtttggattggtccagtcagtatccagagctattggtggccagttataacaataacgaggatgcacctcatgaacccgatggagtggcgctggtgtggaatatgaaatataagaagaccacgcccgaatacgtatttcactgtcagtccgccgtaatgtccgcaacctttgctaagttccaccctaacttagttgtaggcggcacctattcaggacagattgtgctctgggataataggagcaataaacgaacaccagttcagagaacccctctcagcgccgctgcccatactcatccagtttattgcgtcaatgttgtgggcacacagaatgctcacaacctgatatcaatttctacagatggcaaaatctgtagttggagcctggacatgctaagccaccctcaggactctatggagctcgttcacaaacagagcaaagcagtcgctgtgacctccatgtcgttcccagtgggcgatgtgaataatttcgtcgtagggagcgaggagggctctgtctatacagcctgtcggcacggttcaaaggccggcatttcagagatgtttgaaggccatcaaggacccatcactggaattcattgccacgccgctgtgggggccgtggattttagccatctgttcgtgacatcctcattcgattggacagtcaaactttggactacaaagaacaataagccgctgtattccttcgaggataatgcagattatgtttacgacgtcatgtggtcgccaacacacccagctctgtttgcttgtgtggacggaatgggtaggctcgacctgtggaatctgaataatgatacggaggtccccactgctagcatctcagttgagggaaatcctgccctgaaccgagtccgctggactcattctgggcgcgagattgcagtgggcgactctgagggccagatcgtaatctacgatgtgggagagcagatagcggtgccgagaaacgatgaatgggcccgttttggaagaaccctagcggagataaacgccaatagggccgatgctgaggaggaggcagctacaagaataccagcctag

SEQ ID NO: 186084 - DNA, 2763 bp, Artificial Sequence
  Description of Artificial Sequence: Synthetic coding sequence
atggccaacggcaccgccgacgtgcggaagctgttcatcttcaccactacccagaactacttcggcttgatgagcgaactttgggatcagccactgctttgtaattgcctggaaattaataactttcttgacgatggcaatcagatgcttctcagagtgcaaaggtccgacgcggggatatccttttctaacaccattgaattcggcgacactaaggacaaagtcttagtgttctttaagctacggccggaagttattacagatgagaatctgcatgacaacattctcgtcagctcaatgctggagtccccaattagcagcctttaccaggccgtgaggcaggtctttgcaccaatgctcttgaaagatcaggagtggagcagaaacttcgaccctaaactccaaaaccttctctctgaattggaagccggcctaggaatcgtgctgaggagaagtgatacaaacctcaccaagctgaaatttaaggaggacgacaccagagggatactgacaccttctgatgagttccaattctggattgaacaggcccatcgcgggaacaagcagatctctaaagaaagggcaaattattttaaagagcttttcgagactatagcccgcgagttttataacttggattccctgagcctgttggaggtggtggaccttgtggagacaactcaggatgtggtggacgatgtgtggcggcagaccgaacacgatcactatcctgaatcccgcatgctgcatctactggatatcatcgggggctccttcggtcgtttcgtgcagaagaagctcgggactctgaatctttgggaggatccttactaccttgtcaaggaaagcctgaaggcaggtataagtatatgcgagcagtgggtaatagtttgcaatcatctgactgggcaagtgtggcaacgctacgttcctcacccatggaagaatgaaaagtattttcccgagacactcgataagctgggcaaaaggctggaagaggttctcgctattcgcactattcacgagaagtttctgtactttctgcccgcaagcgaggagaaaattatctgcttaacccgagtcttcgaaccatttacggggctgaatccagtacaatacaatccctacaccgagcccctctggaaggctgccgttagccagtatgagaaaatcatcgcccctgccgaacagaagattgcaggcaaactgaaaaactacattagcgagatccaagattcaccacaacagttgctgcaggcttttctgaagtacaaagaactggtgaagagacccacaattagtaaggaactgatgcttgagagggaaaccctgctagctaggctagtagactcaatcaaagactttcggctggattttgaaaaccgctgtcgaggtatcccaggggacgcatcaggtcccttatcgggaaaaaacctatctgaggtggtgaattctatagtgtgggtgcgccagctcgagttgaaagtcgatgacactattaagatcgccgaagctctgctgagcgacctgcctgggttccggtgttttcatcaaagcgctaaagacctactggaccagctcaagctgtatgaacaggagcagttcgacgactggtcacgggacatacagtccggcttgagcgatagtcgcagcggattgtgcattgaggcatccagcaggatcatggaactggatagcaatgacggactcctgaaagtgcactatagcgatcggctcgttattctcctgcgggaagttagacaactgtctgcattggggttcgtcattcccgccaaaatacagcaggtcgccaatatagcacagaaattttgcaaacaggctatcattctgaaacaggtggcccatttctacaacagcatagaccagcagatgatccaatcccagcggcctatgatgttacagtcagccctagcattcgaacagatcattaagaatagtaaagccggctccggtggtaaatcccagatcacctgggacaacccaaaggaactggagggctacatccagaagctgcagaacgcagcggaacgcctggcaaccgagaaccggaagcttcggaagtggcacaccacgttctgtgagaaggtcgtggttctcatgaacatcgacctcctgcgacagcagcagcgctggaaggatggtctgcaggagctgaggacaggccttgctacggtggaagcccagtgccctcttgcatggcaaagcaagtgggagggacctgaagaccctctgcagtacctccggggtctggtggcaagggcattggcaattcaaaattgggttgataaagccgaaaagcaggcactcctgagtgaaacactcgatctcagtgagctcttccacccagacacgttcctgaacgcgctcagacaggaaactgcacgcgccgtcggccgcagtgtggactccctgaaattcgttgcatcttggaaaggcaggcttcaagaggccaaactgcagataaagattagtggcttactgctggagggctgtagttttgatggcaaccagctgtctgagaaccagctcgattctccaagtgtaagttccgtgcttccttgtttcatggggtggatcccccaggacgcctgcggtccatactctccagatgagtgcatcagcctgcccgtgtacaccagcgccgagcgggacagggtagtgactaacatcgatgtcccctgcgggggaaaccaggatcagtggattcagtgcggcgccgccctcttcttgaaaaaccagtag

SEQ ID NO: 186085 - DNA, 12924 bp, Artificial Sequence
  Description of Artificial Sequence: Synthetic coding sequence
atggccaacggcaccgccgacgtgcggaagctgttcatcttcaccactacccaaaactatttcgggctgatgtccgagttgtgggaccagccacttttgtgcaattgtcttgaaataaataatttcttagacgatggtaatcagatgctcctgagagttcaacggtcggacgcaggcatttctttctcaaacactattgagtttggagatacaaaggataaagtgttagtattctttaaactccgcccagaagtgataaccgatgagaacctacatgataacattctagtgtctagcatgctggagagcccgatttcaagcttgtatcaggcagttagacaggtcttcgctcctatgctgctgaaagatcaggagtggtcacgtaactttgaccccaaattgcagaacttgctctctgagctagaagctggactcggcatcgtgctgagaagatctgatactaacctgaccaaacttaaatttaaagaggacgatactcgtggaattctcaccccatccgatgaatttcagttctggattgaacaggcacaccggggtaacaagcagatctccaaggaaagagctaactactttaaggaactctttgaaaccatcgccagggagttttacaacctggactcgctgagcctgctggaagtggtagacctcgtggaaacgacccaggatgtcgtcgacgacgtctggagacagaccgagcacgaccactacccagagtcgcgaatgcttcatctgctagacatcattggcggctcctttgggcgctttgtgcagaagaagttggggaccctgaatctttgggaagacccgtactacctggtcaaagagtctctgaaggccggaatcagcatttgtgaacaatgggtaatagtgtgcaaccacctgactggccaggtgtggcagaggtatgttccgcacccatggaaaaacgaaaaatattttcccgagactctggacaagttagggaaaagactggaagaggtcctggctatccgaacgatacacgaaaagtttctgtacttcttgccagcctccgaggagaagatcatctgcctgacgcgagttttcgagcctttcactggacttaatccagtacagtacaacccttacactgagccactttggaaagcagccgtgagccagtacgaaaagatcatagcccccgctgaacaaaagatagccggcaaactgaagaattatatcagtgagattcaggactctccccagcagttacttcaggccttcctgaagtataaggagctagtcaagcggcctaccataagtaaagagttgatgctggagagggaaacactgctggcccgcttggtagactcaatcaaggatttccgtctggactttgagaatagatgcagaggtatcccgggcgatgcttcgggccctttgtctggaaaaaacctgagcgaagtggtgaactctattgtgtgggtaagacaattggagctgaaggtggatgacaccatcaaaatcgcggaggcactcctcagtgacttgcccggctttaggtgttttcaccagagtgctaaggacctactggaccagctgaagctgtacgagcaagagcagttcgacgattggagcagagacattcaatctggcttaagcgacagtagatcagggctttgtattgaggccagctcgaggatcatggagctcgattccaacgatgggctgctcaaggtgcactatagtgaccgactggtgattctcctgcgcgaggtgcgccaactgagcgccttgggcttcgtgatacccgccaaaattcagcaggtggctaacatcgctcaaaaattctgcaaacaggcaattatactgaagcaagtcgcacatttctataacagcatcgaccaacaaatgatccaatctcagcggccaatgatgcttcagtccgctctggcgttcgagcagattatcaagaactctaaggcaggcagcggtggaaaaagccagatcacttgggataaccccaaggagttagaaggctacattcagaaactgcagaatgcagcagaacgccttgctaccgaaaacaggaaattgagaaagtggcatacaactttctgcgagaaggtcgttgttctgatgaacatagacctcctgcgtcagcagcagagatggaaggacggtttgcaggagctccggaccggcttggcaacagtggaagcccagggattccaggcctcggacatgcacgcatggaaacagcactggaaccatcagctctataaggccctggaacaccagtaccagatgggcctggaagctctcaacgagaacctgcctgagataaatatcgacttgacgtacaagcagggcagactgcagttccgcccacccttcgaagagatcagggcaaaatactaccgtgagatgaagagatttattggaattcccaaccagtttaaaggcgtaggagaggccggggacgagtccattttttcaataatgatagatcggaatgcctctggtttcttgacaatcttttccaaagccgaagacctgtttcgccggcttagtgcagtgctgcatcaacacaaagagtggatagtgatcggacaggtggatatggaggccttagtggaaaaacacttgttcaccgtacacgattgggagaagaattttaaggctttgaaaattaaggggaaggaggtggaaagacttcctagcgccgttaaggttgactgtctgaacatcaattgcaatccggtaaagaccgtcattgacgaccttatccagaagctgtttgaccttctggtcctgagcctgaagaagtcaatccaagcccatctgcatgaaatagacacgttcgttactgaagcaatggaagtcctaactataatgcctcagagtgtggaggagatcggggacgcaaatctgcaatactcaaagctccaagaacgtaagcccgaaatattgcccctatttcaggaggctgaggataagaacaggctgttgagaaccgtggccggcgggggcctcgaaaccattagtaacttgaaggccaaatgggacaagtttgagctgatgatggagtcccaccagctgatgataaaggaccaaatagaggtcatgaaagggaacgtgaaatctcggctgcagatatactaccaagaactggaaaagtttaaggcaagatgggatcagttgaaacctggcgacgatgtcatagagactggccagcataacacgcttgataaatcagccaagctgataaaggaaaagaagatagaatttgacgacctggaagtgacccgtaagaagctggtggacgattgccaccacttccggcttgaagaacccaatttcagtctggcatccagcattagtaaggatatcgagtcttgcgcgcaaatatgggcgttctatgaggaattccagcaagggtttcaggagatggccaacgaagattggataaccttccgaaccaaaacatacctgttcgaggagtttttgatgaactggcatgatagattacgcaaggtcgaagagcacagcgtgatgactgtaaaattgcagtcagaagtagataagtataagatcgtgataccaatccttaagtacgtgcgcggagagcacctctcgccagaccattggctggatctttttcggctgctggggcttccgcgcggaacctcactggagaagctcctgttcggagatctgctccgggtggctgatacaatcgtcgccaaggcggccgatctaaaggacctgaacagcagggcacagggtgaagtgaccatacgggaggcactgcgggagctagatctgtggggggtcggtgctgtctttactttaattgactatgaagatagtcagtccaggaccatgaagttgatcaaagactggaaagacattgttaaccaggtaggagacaaccggtgcctgctccagagtctcaaggacagcccttattataagggcttcgaggataaagtgagcatctgggagagaaaattggccgaactcgacgagtatttacaaaatttgaaccacatacagagaaagtgggtgtatctggaaccgatatttggcagaggagcattaccgaaggagcagacccgctttaatcgggtcgatgaggacttcagatcaataatgaccgatataaaaaaggacaaccgggtaaccacactcaccactcacgccggtattcgcaatagcttgctgactatcctggatcagcttcagcgatgtcagaaatcccttaatgagtttctggaagagaagagatccgcattcccgagattctatttcatcggagatgacgatctgctggaaatccttggtcagagtacaaatccttccgtcatacagtctcacctcaagaaacttttcgccggaataaactcagtctgttttgacgaaaagagtaaacatatcaccgcgatgaaatcacttgaaggagaagtggtcccattcaagaacaaagtgccactgtcaaataacgtggaaacgtggttgaatgacttagccctcgagatgaaaaagaccctagagcagctgttgaaagagtgcgtgacgacgggacgatcttcacaaggagctgttgacccgagcctattcccaagccagatactgtgcctggcagaacagatcaaatttacagaggatgtcgaaaacgctattaaagaccatagcctgcaccagatagagactcagctcgtgaacaagctcgagcagtacaccaatattgatacgtcttccgaagatcctggaaataccgaatcgggtattctggaacttaagctgaaggccctcatccttgacataattcataatatcgacgtggtgaagcagctgaaccagatccaggtacataccaccgaagactgggcctggaagaagcaactgaggttttatatgaagagcgaccacacctgttgcgtgcagatggtagattcagaatttcaatacacttacgaataccagggcaacgcgtcaaagctggtgtatacacccctaaccgataagtgctatctgacattgacgcaggctatgaagatgggactcggtggaaacccgtatgggcccgccgggaccgggaagactgaaagcgtcaaggccctgggcgggctgcttggccggcaggtcctggtgttcaactgtgacgagggcattgatgtgaagtcaatgggacgaatatttgttgggctggttaagtgtggcgcttgggggtgctttgatgagttcaaccgcctcgaagaatcagttctgagcgcagtttccatgcaaattcaaacgatccaggatgccctgaaaaaccatagaaccgtttgcgaactactgggaaaagaagtggaggtgaactctaactctggtattttcattaccatgaacccagcaggaaagggatatggcgggcgacagaagctgccagataatctgaagcagctgtttagacccgttgctatgtcacatcccgacaatgaattgatcgccgaagtgatactgtattctgaaggcttcaaagatgccaaagtgctgtctcggaaactggtggccatttttaatctgtcaagggagcttctgacaccgcagcagcactatgactgggggctaagagccctaaaaaccgtgctacgggggagcggaaatctgctgcgacaactgaataagagtggaacaacccagaacgctaacgagagccacattgtggtccaagccctgagactcaacaccatgtctaagttcacctttaccgactgtacgcgtttcgacgctctcatcaaagacgtgttccctggaatcgaactaaaggaggttgagtacgatgagctctccgccgctcttaagcaggtgttcgaggaagcgaattacgagattattccaaaccagattaaaaaggcacttgaactctatgaacaactttgccagcgcatgggcgtagtgatagtagggccctccggcgcaggcaaatctactctctggcggatgctgcgtgctgcattgtgtaagacgggtaaagtggtgaagcagtatactatgaacccaaaggccatgcccaggtatcaacttctgggccacatcgatatggacacacgtgaatggagcgatggcgttctgacaaacagcgccaggcaggttgtgagggaaccccaggacgtctcatcttggattatatgtgacggtgatatcgatccggaatggattgaatcactgaacagtgtgctggacgacaataggctgctaaccatgccttccggggagaggatccaattcggccccaacgttaactttgtctttgaaacacacgacctcagttgcgcgtcccccgccaccattagccggatggggatgatttttctatctgatgaggagactgacctgaactcccttataaagtcttggttgaggaaccaaccggctgagtatcgcaacaacctggaaaactggatcggcgactatttcgagaaggctctgcaatgggtgctgaaacagaatgattatgtggtggagacctctttagttggaacagtaatgaacggcctgagccatctgcatgggtgcagggaccatgatgagtttataattaacctgattcgaggactcgggggcaatctcaacatgaagagtcgcctcgagtttaccaaggaggtgttccactgggcgagggaaagtccaccggattttcataagccaatggatacatactacgactcaacgagaggccgacttgctacctatgtgcttaaaaagcccgaagacttgacagccgacgatttttcaaacggccttacactgcccgtaatacaaacacctgatatgcagcggggacttgactacttcaaaccatggctatcgtccgacacaaagcaaccatttatactggttggaccggaggggtgtggaaagggtatgctgttgcgctatgcgtttagtcagctgagaagtactcagatcgcaactgtccattgctccgcccaaaccactagtaggcatttgctgcagaagctgagccagacctgcatggtgatctctacaaatacgggccgcgtgtacagacccaaagattgcgagcgtcttgttttgtatctcaaggacatcaacttacccaagctcgataagtggggcacttctacccttgtggcttttttgcaacaggtgctgacataccaaggcttttatgatgaaaatctcgagtgggtagggctggaaaacattcaaatcgtggcatccatgagtgcaggaggtcgcctcggcagacataaacttaccacccgatttacttccattgtgaggctttgctcgatcgactaccccgaaagggaacagctgcaaacaatctacggcgcttacctggagccagtactccacaagaaccttaagaaccattcaatctgggggagttctagcaaaatttatttgttagcaggcagcatggtccaggtctacgaacaggtgagggctaaattcactgtggatgactattctcactactttttcacaccttgcatcctgacacagtgggtcctaggcctctttaggtatgaccttgaaggtggaagctcaaaccatccacttgactacgtccttgaaatagtagcctatgaagcacgaaggctgttccgggacaagattgtgggcgctaaggaattgcatttgttcgatatcatcctcacctccgtgtttcagggcgattggggttccgatatcctcgacaacatgagcgactctttctatgtgacttggggagcgcgccacaacagtggggcccgggctgcccctggtcagcctcttcccccacatggcaagcctttgggaaagctgaattctaccgatctgaaggacgttataaagaagggcttaatccactacggccgggataatcagaacctggacatcttactgttccacgaggtgttagagtatatgagcaggatcgatagggtcttgagctttcccggaggaagtctgctgttagccggacggagtggagtcggccggcgaaccatcactagcctcgtcagtcacatgcacggcgcggtgctgttctcaccaaagatcagccgcggctatgaactgaagcagtttaagaacgacttaaagcacgtcctgcaactggctggtatcgaggcccagcaggtggtcctactgctggaagactatcagtttgtgcatccaacattcctggagatgattaatagtctgcttagctcaggggaggtgcccggtttatacacattggaggagctggagcccctgctgttaccccttaaagaccaggcttctcaagacggctttttcggaccggtgtttaattatttcacgtatcgcatccaacagaatctccatatagtgctgatcatggattctgcaaatagcaattttatgattaactgcgagagtaacccagctttgcacaaaaagtgccaggtactttggatggaaggctggagcaactcatcaatgaaaaagataccagagatgctgtttagtgaaacaggggggggcgaaaaatacaatgacaagaagagaaaggaggagaaaaagaagaactccgtcgaccctgacttccttaagtcctttcttctaatccatgagtcctgcaaagcttatggggcaactccctcaagatatatgaccttcttgcacgtgtatagtgccattagcagcagcaaaaagaaagagttgctgaagagacaatcacacttgcaggcaggagtttccaagctgaacgaagccaaagctctggtggatgagctaaatcgaaaggcaggagagcagtctgtgctgcttaaaactaagcaggatgaggcagacgccgcactgcaaatgatcactgtttccatgcaggatgcgagcgagcagaagactgagcttgagcggctgaagcacaggatcgccgaggaagtcgttaagattgaagaacgtaaaaacaaaatcgatgacgaactcaaggaggtccagcctcttgtgaacgaggccaagctggctgtcgggaacataaaaccagagtcgctgtcggagattagatccctccggatgcctccggacgtgataagggatatcctggaaggtgttctccgcttaatgggaatttttgataccagttgggtgagcatgaaaagctttttggctaaacgtggagtgagggaggatattgccacgttcgatgccaggaatatttccaaggagattcgcgagagcgttgaagaacttctattcaaaaataaaggcagcttcgaccctaagaacgcaaaaagggcctccaccgcagcggcacctctggctgcctgggtgaaggcgaacatccagtattcccatgtgttggagaggatccatcctctggagacagagcaggcgggcctcgagagcaacttaaagaagacggaggaccgcaagagaaaactcgaggaactcctgaattccgtgggtcagaaggtttctgagctgaaagagaagtttcaaagtaggacgtcagaggccgcaaaactcgaggccgaggtctcaaaggcccaggaaaccatcaaggcagctgaggtactgatcaaccagctggatcgggaacacaaaagatggaacgcacaggtggtggagattactgaggagctcgcaactttgcctaagagggcccagcttgccgccgccttcatcacctacctgagcgctgcccccgaatcacttcggaagacctgtctcgaggaatggactaaaagtgctgggctagaaaaattcgacctaagacgcttcctttgcacagagagcgaacaattgatttggaagtcagagggccttccaagcgatgacctgtctatagaaaatgcacttgtcatcctacagagccgtgtatgtccctttcttattgatcctagtagtcaggccactgagtggctgaagacccacctcaaggactcaagattggaagtcatcaaccagcaggattcaaattttatcactgcactggaactcgctgttaggttcggcaagactcttatcatccaggagatggacggagtcgagcctgtcttatatccactcctgaggagagatctagtggcacagggaccccgctacgtggtgcagatcggtgacaagattatagactacaatgaagaattcaggctgttcctatctaccaggaaccctaaccccttcattccgcccgatgctgccagcattgttacagaggtcaatttcaccaccacacgatccggcttaaggggccagttgctcgctctgacaatccagcatgagaagccagatctcgaagaacagaaaactaagttgctgcagcaggaggaagacaagaagatccagttggcaaagttggaggaatccctgctggagacactggccacttcccaggggaacatacttgagaacaaggatctgatcgaatctctgaatcagactaaggcttcatctgccctgatccaagagtctttaaaagagtcgtacaaactacagatctcactcgaccaagagagagatgcctatctgcccctggccgagtctgcaagcaaaatgtatttcattatctctgacctctcgaaaatcaataacatgtatagattttccctcgctgccttccttaggctgttccagcgcgcactgcagaacaagcaggattccgaaaacaccgagcagcgaatacagtccttgatctcatcactccaacacatggtttacgaatatatttgccgttgcctctttaaagcggatcagcttatgttcgccctgcactttgtgcggggcatgcatcccgagctttttcaggagaacgaatgggacacttttacaggtgtggtggtaggcgacatgctccgtaaggcagactcacagcagaagatccgagatcaattgcccagctggattgatcaggagaggagttgggctgtcgcgaccttgaagatagccctgccgtcgctatatcaaacattatgcttcgaagacgccgcactgtggaggacctactacaacaactctatgtgcgaacaagagtttccctctatccttgctaagaaggtgtccctgtttcagcagatactggtcgtgcaggccttgagaccggataggctgcagagcgccatggcactttttgcctgtaagacactcgggcttaaggaggtctctcctctgcccctgaacctcaagaggctctacaaagagacactcgagatcgagcccatccttattatcatctccccaggcgcagacccttcgcaggaactgcaggaactcgccaacgctgagcgtagtggcgaatgctatcaccaagtggctatgggccaagggcaggccgatcttgcgatccagatgttaaaggagtgcgcccgcaacggcgactggctgtgtctgaagaacctacatctggtcgtaagctggctaccggtcctggaaaaagaacttaacaccttgcagcccaaggacacgtttaggctctggctgacagcagaggttcaccctaacttcacgccaattttgctgcaatcatctcttaaaattacctacgaatcccccccgggtctgaaaaaaaatctgatgagaacgtatgaatcctggactcctgaacagatttccaagaaagacaacacacatcgcgcccacgctctgttctcgctagcttggtttcacgcagcctgtcaggagcggcgtaattatatccctcaggggtggactaagttttacgaattttccctgtcagatttaagggccggctacaacattatcgacaggctgttcgatggggcaaaggacgtgcagtgggagtttgttcatggacttttggagaatgctatctatgggggccgtattgacaactattttgacttacgggtactgcaatcatatctgaagcagttctttaattcttcagttatcgatgtgttcaatcagcggaataagaaaagtatattcccttattcagttagtctacctcagagttgtagtattcttgattaccgtgccgttatcgagaagatacctgaagatgacaagccttccttttttggtttgccagcaaacatcgcccgttcatcacagcgcatgatttcgtctcaagtcatctctcaattgagaattttaggccgatctattacagcaggctctaaattcgatcgggagatatggtccaacgagttatcccccgtactaaatctctggaagaagctgaatcaaaactctaatctgattcatcagaaggtacctcctcccaacgacagacagggatcaccaatactgtcttttattatcctcgagcaattcaacgccatccgcctagtgcaatccgtgcatcaatctcttgctgcactgtctaaagtcatccgcgggacgacgctcctgtctagcgaggtgcagaagctggcctcagccctgctgaaccaaaagtgccctctggcttggcaatccaagtgggaggggccagaagatccactgcaatatctcagggggctggttgcccgagcgctggctatccagaactgggtcgacaaggccgaaaaacaggccctccttagtgagacactcgatctctcggagctgttccatccagacacattcctcaatgcccttcggcaggagaccgctcgagctgtgggcagatctgtggattcactgaaatttgtggccagctggaagggcaggttgcaggaagccaagttgcagattaaaataagcggactgctgctagaaggttgctcttttgacggtaatcagctttctgagaaccaactcgatagtccatccgtgtcctcagttctcccatgctttatgggctggattccacaagacgcctgtggaccatactcgcccgatgagtgtattagtctcccggtgtacacgagcgcagaacgggatcgcgtagttactaatatagacgtgccttgtgggggtaatcaagaccagtggattcagtgtggtgctgctctgttcttgaaaaaccagtag

SEQ ID NO: 186086 - DNA, 12945 bp, Artificial Sequence
  Description of Artificial Sequence: Synthetic coding sequence
atggccaacggcaccgccgacgtgcggaagctgttcatcttcaccacaacccagaactacttcggactaatgtccgaattatgggaccagccattgctgtgcaactgcttagagattaacaatttcctggatgatggaaatcaaatgttgctgcgcgttcagcggtccgatgcgggcatctcgtttagcaatactatcgagttcggagacactaaagataaggtgctggttttcttcaagttgcgccccgaggtcatcaccgatgagaacctgcacgacaacatcctggtttcatccatgcttgagtctcccatctcttcactgtaccaggccgtgaggcaggtgtttgctccgatgctcctcaaagatcaggagtggagcagaaactttgaccctaaacttcagaatttgctttccgagctcgaagccggactgggaatcgtgctcaggaggtccgacacgaatctgactaagctgaagtttaaggaggatgatacgaggggaatactcacgccgtcagatgagttccagttttggattgagcaagctcacagagggaataagcaaattagtaaggagagagctaactattttaaagaattgtttgaaacaattgcccgcgaattctataatcttgactctctctctttgctggaagtggtggatttggtggagactactcaggatgtggtagatgatgtctggaggcagactgagcacgaccattaccctgagtcgcgcatgctgcacctgctggacatcatcgggggctcgttcggacgttttgtgcaaaaaaaactgggtacactaaacttgtgggaggacccatattacctcgtaaaggagagccttaaggctggaatcagtatctgcgagcaatgggttattgtttgtaaccacctgactggacaagtatggcaaaggtatgtgcctcacccatggaagaacgagaagtatttccccgaaacattggataagctcgggaagcgactggaggaggttctcgcgatccgcaccatacatgagaagtttctgtacttcctgccagccagcgaggaaaaaataatttgtttgacacgagttttcgaaccttttacgggcctcaaccccgtgcaatacaatccatatactgaaccattgtggaaagccgcagtgagccagtacgaaaaaatcatcgccccagctgagcaaaagatcgccggcaagctgaagaactatatttccgagatccaggattccccgcagcagttactgcaggccttcctgaagtacaaagagctggtgaaacggcctaccatctcaaaagagctgatgctcgagagggaaacactacttgctagattagtggacagcattaaggacttccgacttgactttgaaaatcgttgcaggggaatccctggggacgcctctgggcccctcagtggtaaaaacctttctgaagtggttaacagcatagtctgggtgcggcagctcgagctgaaagttgacgacacaatcaaaatcgccgaagccctcctctctgaccttccaggatttcgctgttttcaccagtccgccaaggaccttctggaccagcttaagctttatgagcaggaacagtttgacgactggtctcgagacattcagagcgggctgtccgatagcaggagcgggttatgtattgaggcctcatcccgcatcatggaactagactcgaatgacgggttgctcaaggtgcattatagtgaccgacttgtcattttactccgcgaagtccggcagctttcagcactgggatttgttatccccgcaaagatccagcaagttgccaacatagcccagaaattttgtaagcaggccattatcctcaagcaggtggcccacttctataacagtattgaccaacagatgatccagagtcagcgcccaatgatgctccaatctgctttggcattcgaacagattatcaagaacagcaaggccggaagtggcggaaagtctcagataacttgggataatccgaaggagttggaaggctatatccaaaaattgcagaatgcagccgaacgcctcgctacagagaaccggaaactgagaaagtggcataccacattttgcgaaaaggtggtcgtgctgatgaacattgatctgctgcgtcagcagcaacgatggaaagacggactacaggagctgcgcacgggcttagccactgtggaggcgcaaggttttcaagctagcgatatgcatgcgtggaagcagcactggaaccatcagctttataaggccctggaacatcagtaccagatgggcctggaggcgctgaacgagaacttgccagaaattaatatcgatctgacctacaaacagggtcggctgcagttcagacctccattcgaggagatacgcgcaaagtattaccgggaaatgaaaaggttcatcggcataccaaatcaatttaaaggcgtgggcgaggccggagacgagtccatcttctctatcatgattgaccggaatgcctctggatttctgacaatcttctcaaaggccgaggacttgttccggaggctctccgccgtgctccaccagcataaggagtggatagtgattggtcaggtcgacatggaggcactggtcgaaaaacacctgttcaccgtgcacgattgggaaaagaattttaaggcactgaagattaagggcaaggaagtggagagactgccttcagccgtgaaggtcgactgcctcaatatcaattgcaatccggtcaagacggtgatagatgatctcatccagaaactgttcgatctgctagtcttgtcactgaagaaatccatccaggcgcatctgcatgagattgatacatttgtgaccgaggcaatggaggtgctgaccataatgccacagagcgtagaggagataggcgacgccaatctccaatacagcaagttgcaagaacgcaaaccggagatcctgcctctcttccaagaagccgaggacaagaaccgcctgctgcgaaccgttgctggtggcggcctcgagacaatcagcaatttgaaggctaagtgggacaagtttgagctgatgatggagtcacaccagttaatgattaaagaccagatagaggtcatgaagggaaatgttaaatctcgcttgcaaatttactaccaggaattagaaaaattcaaggcccgctgggaccagctgaagccaggagacgatgtcattgagaccgggcagcacaataccctagataaatctgcgaaactgatcaaagaaaagaagatagagttcgacgatctcgaagtaacgcgaaagaagctggtggatgattgccaccacttccggctcgaggagccaaatttcagcctcgcctcctcgatttccaaggatatcgagagctgcgcccagatctgggccttctatgaggagttccagcaggggtttcaggagatggcaaacgaagactggatcacattccgtaccaaaacctatttgtttgaagaatttttgatgaattggcacgataggctgcgtaaggtcgaggaacactccgtgatgacagttaaacttcagagcgaggtggacaagtacaaaatcgtgatcccgattcttaaatatgttcggggagagcacctgtcccccgaccattggctggatctttttcgactgctcggactcccacggggtacctctctcgagaaactcttgttcggtgatctccttagggttgccgatacaatagtggccaaagcagctgatttgaaggacctgaactctagggcccagggggaggttacaattcgcgaggccctgcgagaactggacctatggggcgttggtgcagtgttcacgctgatcgattatgaggatagccagtcaaggacaatgaaactaataaaggattggaaggatatcgtgaaccaagtcggcgacaaccggtgccttcttcagtctctcaaagacagtccttactataaaggattcgaggacaaagttagcatctgggagcgcaaacttgccgaactagacgaatatctgcaaaacttaaaccatattcaacgcaaatgggtctacctggaaccaatctttggcagaggtgccctgccgaaggaacagacgcggttcaacagggttgatgaagatttccggtcaatcatgacagacattaagaaggacaacagggtcacaaccttaacaacacatgctgggatccggaacagtcttctgacaattctcgaccagctccaaaggtgccagaaaagcttgaacgaatttttggaggaaaagagaagcgcattccctagattctacttcatcggcgacgacgatttgctagagattctgggacagtccacaaacccaagcgttattcaaagtcaccttaagaagctgtttgccgggatcaattcagtatgttttgatgagaagtcaaagcacattacagcgatgaagagccttgagggagaagtagtcccctttaaaaacaaggtgcctctttctaacaacgtggagacttggctgaacgaccttgcgctcgagatgaagaagacgcttgagcagctgcttaaagaatgtgtgactacagggaggtcctcacagggagctgtcgacccttctctgttccccagccagatcctttgcctggccgaacaaatcaagtttaccgaagatgttgaaaatgctatcaaggatcatagcctccatcagattgaaacccagctagttaacaagttggaacagtacacgaatatagatacgagttcagaggaccctgggaatacagaatctgggattcttgaactcaaactcaaagctctcatcctggacatcattcataatattgatgtcgtgaagcagctgaaccagatccaagtgcataccacggaagactgggcttggaaaaaacagctccgcttttacatgaaaagcgatcacacctgctgcgtgcagatggtggactcagagtttcaatacacatatgagtaccagggcaacgcctcaaagcttgtgtacactcctctcacggacaaatgttacctcactctcacccaggcaatgaaaatgggattaggcggaaacccttatggacctgccgggactggcaaaacggagagcgtcaaggcacttggtggcctactcgggcggcaggtcctggtcttcaattgcgatgaggggatcgatgtgaagagcatgggcagaatcttcgtgggactggtgaaatgtggagcctgggggtgttttgatgagtttaatcggctggaggagagcgttctgtccgccgtgtcaatgcagatccagactatccaggacgccctgaaaaaccatcggacagtttgcgaattgctgggtaaagaggtggaggtaaacagtaacagcggtatctttatcaccatgaaccctgctgggaagggctatgggggccgccagaagttgcccgataacctgaaacagctgttcaggcctgtggcaatgagtcacccggacaatgaattgattgcagaagtaattctatattctgagggattcaaggatgccaaagtgctgagtagaaagctggtggcaatctttaatctgagccgggagctgctcacaccccaacaacactatgattggggactcagggcccttaagaccgtactgcgcggttctggcaatctgctgcgccagttaaataaatctggcacaactcagaacgccaatgagtcacacatcgttgtgcaggcactcaggctgaatacaatgagtaagttcacttttactgattgcactagattcgacgcgctgatcaaggacgtatttcctggcatcgaactcaaagaagtcgaatatgatgagctcagcgccgctctgaaacaggtcttcgaggaagcaaactacgagatcatcccaaaccagattaaaaaagcacttgagttgtatgaacaattgtgtcagcggatgggggttgtgatcgtgggcccttcaggagctggcaagtcaactctatggaggatgctgcgtgcagctctgtgcaagacgggcaaggtggtgaaacaatataccatgaatccaaaggcgatgcctaggtaccagcttctgggccatatcgatatggacactcgggagtggagcgacggggtcctgacaaacagcgctcgtcaggttgtgcgggaaccacaagatgtaagttcttggataatctgcgacggcgacatcgatccagagtggatcgaaagtttgaacagcgtgctggacgacaacaggcttctcactatgccatctggggaacgtattcagttcggcccgaacgtcaacttcgtgttcgaaacccatgatctcagctgcgcctcccctgctactatatccagaatgggaatgatcttccttagcgatgaagagaccgatttgaactcactcatcaagtcttggctccgcaaccagcctgccgagtacagaaataatctcgaaaactggatcggagactattttgaaaaagcactgcagtgggtcttgaagcagaatgactacgtggttgagacctctctggtgggcactgtcatgaacggtctgtcgcatctccatggatgtcgggaccacgacgagtttatcatcaatctgatccgcggactgggtggcaacctgaatatgaagtccagattggaattcaccaaagaagttttccactgggcccgcgagagccctcctgatttccataagcccatggacacctattacgacagcacccgcggtcgcttggcaacctacgtactgaagaagcctgaggatctcactgctgatgactttagtaacggactgaccctccccgtaatacagaccccggacatgcagcgcgggcttgattattttaagccttggctgtcttccgacaccaagcagcccttcatcctggtaggtccggagggttgtggcaaggggatgctgttgcgctacgctttctcgcagctcaggagtacccagatagctaccgtgcactgctcagcgcaaactacctcacggcatctgttgcaaaaacttagccaaacatgcatggtgataagtaccaacacaggacgtgtgtaccgccctaaggactgcgagcggctcgtgctctatttgaaggatatcaatctgccgaagctggacaagtggggcacctctacactggtggctttccttcagcaagtcctcacttatcaggggttttatgacgagaacctggaatgggtggggttagagaatatacagatagtagcttccatgtcggccggaggccggctcggccgtcacaaactcacaactagattcacgagcatcgtacgactttgtagcatcgattatccagagagagagcagctgcaaacaatctacggtgcttacctggaacccgtccttcacaagaatctcaagaatcattccatctggggcagcagtagcaagatttacctgctcgccggcagcatggtccaggtgtacgagcaagtcagagctaagtttacggtggacgattatagtcactatttcttcaccccgtgcattcttacgcagtgggtcctggggttgtttcgctacgatctcgaagggggctctagcaaccaccccttagactacgttcttgaaattgttgcttacgaggcccgccgcctgttccgagacaaaatagtaggtgctaaggaactgcacctgttcgatatcattctaaccagcgtatttcagggtgattgggggtccgatattctggataatatgagcgactccttttacgtgacttggggcgctcgtcacaacagtggcgcccgggccgcccccgggcaaccactcccaccccatgggaagccgttaggaaaactcaactcaacggacctcaaggacgtgattaagaagggcctaatccactacggaagggataaccagaatttggatattcttctgttccatgaggtccttgaatatatgagccgtatagatagagtgctgtcctttccgggcggcagtttactgctcgccgggcgaagcggcgtcgggcggaggacgattacatccctggtctcccacatgcatggggctgtgttattctctccaaagataagcaggggttatgaactgaaacagtttaaaaacgacctgaagcatgtgttgcagctggcggggatcgaggctcagcaggttgtcctccttctcgaagactaccagttcgtgcatccaacatttctggagatgatcaactccctccttagtagcggggaagtcccaggactctatacgctggaggagttagagcccttgcttctcccattgaaggatcaggctagtcaggatgggttttttggaccggtgttcaactacttcacctaccggattcaacagaatctgcatatcgtactgatcatggatagtgctaattccaatttcatgatcaattgtgagtcaaatccagccctgcataagaagtgtcaagttctttggatggaaggctggtctaacagctctatgaagaaaattcctgaaatgctgttctccgagacgggcggcggcgagaaatataatgataaaaagagaaaggaggagaaaaaaaagaactcagtggacccagatttccttaagtcgtttttgctcattcatgaatcatgcaaggcctacggcgcgaccccttctaggtacatgaccttcctgcatgtatattccgccatttctagttctaagaagaaggagctcctgaagcgacagtcacacttgcaggccggtgtgtcaaagctgaacgaagctaaagccctcgtagatgagctgaatagaaaagcaggcgagcaatcagttctcctcaagactaagcaggatgaggccgatgctgcattacaaatgattactgtttcaatgcaggacgcctctgagcagaaaactgagctggaacggctaaaacaccgtattgcggaggaggttgttaaaatcgaggagcgcaaaaacaaaatcgatgatgagcttaaggaagtacagcccctggtgaatgaagccaaactcgctgttgggaatataaagcccgagagcctgtctgagattaggagtcttcggatgcctccagacgtgattagagacattctcgagggcgtcctgaggttgatgggaatttttgatacatcgtgggtgtccatgaaatccttcttggcaaagcgaggggttagagaagatatcgccacctttgatgcaagaaatatttccaaagaaattcgagagtctgttgaggagctgcttttcaagaacaagggaagttttgatcccaaaaacgcaaaacgcgcttcaacagcggccgctccactcgccgcttgggtcaaagcaaatatccagtatagtcacgtgcttgagcggatccatccactagaaactgagcaggccggattggagagtaatctgaaaaaaacagaagatcggaagcgcaaactcgaagaactgttaaactccgtgggccagaaagtttccgagctgaaggagaaattccagtctaggactagtgaggccgctaagcttgaggccgaagtttctaaggctcaggaaacgattaaagcggccgaagtgttaattaatcaattggatcgggaacacaagaggtggaatgcgcaggttgttgaaatcacggaggagctggccaccctgccaaagagggcccaactcgcagcagccttcataacatatctgtctgccgccccagaatcactccgcaagacttgtctggaggaatggacaaaatcggccggcttagaaaaattcgaccttcgccgcttcctgtgcacagaatcagaacaattaatttggaagagcgaaggactgcccagcgacgacttgagcatagagaatgccctggttatcctgcagatcatcggattgaaaagttggtcacgggtgtgtcccttcttgatcgatccttcaagtcaggcaacggagtggcttaaaactcacctgaaggactcgcggctagaagtgatcaaccagcaagactccaatttcatcaccgcactcgagcttgcagtgcgctttggcaagactctcattattcaggaaatggacggggtggagcctgtactctaccccctgctccggcgcgaccttgtggcccagggccctcggtacgtggtgcagattggagataaaattattgattacaacgaagagtttcgtctgtttctgtcaacgcgaaacccaaacccattcatcccaccagacgcagcgagcattgttacagaggtgaatttcactactacacgctcaggcctgaggggacagctcctcgccctgaccattcagcacgaaaaacctgaccttgaagagcagaaaactaagctccttcagcaggaagaagataagaagattcagttagcaaagctggaagagtctctgttggagacattggcaaccagccaggggaacatcctggagaataaagatctcatcgaatccctgaaccagacaaaagctagcagcgctttaattcaggaatctttgaaggagtcctacaagctgcaaatcagcctggatcaggagcgtgatgcatacttgcctctggctgagagtgcctccaaaatgtactttatcatcagcgacctctcaaagattaataatatgtacaggttctccctggccgccttcttacggctgtttcagagagccttgcagaacaagcaggattccgagaacactgaacagcgcatccaatccttgatctcttcacttcagcatatggtgtacgagtatatttgtcggtgcttattcaaggccgaccagctgatgttcgctttgcacttcgttagaggaatgcaccccgagctctttcaggaaaatgagtgggacactttcacaggcgtggtggttggcgacatgctgcggaaggccgactcccagcagaagatacgggaccagttgccctcatggatcgaccaggaacggtcctgggccgtcgcaacccttaagatcgccctgccgagtctgtatcagactctgtgtttcgaggacgcggcactctggcgcacgtactacaacaattctatgtgcgaacaggagttcccatctattctggcaaagaaggtttccctcttccagcaaattctagtcgtgcaggccctgcggcccgaccgacttcagtcggccatggccctgttcgcctgtaaaactctgggcctgaaggaggtgtcccctcttcccctaaacttgaagcgactgtacaaggagaccctcgagatcgagcccattttgatcattatctcacccggcgctgacccctcgcaggagctccaggaattggctaacgccgaaagaagcggagaatgttaccaccaggttgctatggggcaggggcaggcagatctggccattcagatgctgaaagaatgtgcccggaacggagactggttgtgtctgaagaacctgcacttagtggtcagttggttacctgtgctcgaaaaggagttgaatacgctgcagcccaaggacactttcagactttggctgactgccgaagtacatccaaactttacaccgatactcttacaaagctccctcaaaattacctatgagagcccaccaggcctgaaaaagaacctgatgagaacttacgaatcttggacccctgagcagatcagcaagaaggacaatactcatagagctcatgcactgttcagcttggcctggttccatgcagcttgccaagaacgcaggaactacatcccacagggctggacaaagttttacgagttttcactgtccgatctacgggcaggctacaacataattgaccgactctttgacggggcaaaggacgtgcaatgggagtttgtgcatggcctactggagaatgcaatatacggaggcaggatcgataactattttgacctcagagtcctgcagtcatacctcaaacaatttttcaactcaagtgtgatcgatgtctttaatcagcggaataaaaaaagtatttttccttattctgtgtcgctgccgcagagctgcagtatactggattaccgcgccgtcattgaaaagataccagaagatgacaagccgagctttttcggtctgcccgcaaatatcgcccgaagttcccagcgtatgatcagtagtcaggtgattagtcagctgcgaattctggggcgatctatcactgccgggtccaagttcgatcgggagatctggtcaaatgaactctcgcctgtgctgaatctctggaaaaagttgaaccagaatagtaatctcattcaccaaaaagtcccaccccctaacgaccggcaggggtcccctatcctgtcttttattatactggaacagtttaatgctataagactggttcagagtgtgcatcagtccctggctgccctgagtaaggtaattagggggaccaccctcttgagtagtgaggtgcagaagctggcaagcgcattgctgaatcagaaatgcccgctcgcctggcagtccaagtgggaaggccccgaagaccctctccaatatctccggggcctggtggctcgtgccctggctatccagaattgggtagacaaggctgagaagcaggctttgctgagcgagacactcgacctaagcgagctattccatcctgacaccttcctgaatgctctgaggcaggaaactgctagggcggtaggcaggtccgtcgatagcctgaagttcgttgctagttggaaaggaagattacaagaagccaagctgcagataaagatctctggtctgctgctcgaagggtgtagcttcgacggcaatcaattgagcgaaaatcagctggacagcccctcagtcagctcagtgctcccctgtttcatgggctggatccctcaggatgcctgtggaccctacagcccggatgagtgcatctcgctgcctgtgtatacaagcgcggagagggaccgggtggtgactaatattgatgttccatgtgggggcaatcaggaccaatggatccagtgcggcgccgctttgtttttaaagaaccagtag

SEQ ID NO: 186087 - DNA, 1515 bp, Artificial Sequence
  Description of Artificial Sequence: Synthetic coding sequence
atgggccagggccaggccgacctggccatccagatgctgaaggagtgcgcacgaaacggtgactggttatgtctgaaaaacctgcatcttgtggtttcttggctcccagttcttgagaaagagctgaacaccttgcaacccaaagacaccttccgcttgtggttgaccgccgaagtccaccctaacttcacgccaattctcctgcagtcatctctcaagatcacgtacgaatccccaccaggcttaaagaaaaacctgatgcgcacctacgagtcttggacccctgagcagattagtaagaaagataacactcacagagctcacgctttgttttcactggcatggttccacgcagcctgtcaagagcgtcgaaattacattccacaggggtggaccaaattctacgagttttcactgtcggacttgagggcgggctataacattatcgatcggctcttcgatggcgccaaggacgtccaatgggaattcgtccatggtctcctggagaatgccatctatggaggacggatagacaattatttcgacctgcgtgtgctacagtcctacctaaagcagttcttcaacagtagcgtgatcgacgtgttcaatcaacggaacaaaaaaagcatttttccatattcggtcagcctgccgcagtcttgttctattctggactatcgagccgtcattgagaagattcctgaagatgacaagccctcatttttcggactaccagcgaatatcgcgcggagttcccagagaatgatttcaagccaggttatctcacaattaaggatcctggggcggtccattacagctggatctaaatttgaccgggagatctggtcaaacgagctctccccggtgttgaacctgtggaaaaagctcaatcagaactccaacctgattcaccaaaaagtacccccgccgaacgaccggcaagggtccccgattttgagttttataattctggagcagtttaacgccatccggctcgtgcaaagtgtccaccagtccctagccgctctgagcaaggtcattagaggtaccactctcttgagttctgaggttcaaaaacttgcttctgccctgctcaaccagaagtgcccactggcttggcagtccaagtgggagggcccagaggacccactccaataccttaggggactcgtggccagagccctggcaattcagaattgggtggataaagccgaaaagcaagctctgctaagcgaaacactagatcttagtgagctgttccaccccgacacatttctgaacgcactccgccaggagacagcccgcgcagtcgggcgctccgttgactcacttaaatttgttgcttcctggaaggggcgattacaggaggccaaactgcagatcaagatttccggcctactcctggagggatgctcattcgacggtaatcagttgtctgagaaccagctggacagccctagtgtttccagtgttctcccatgcttcatggggtggatcccacaggacctgctctag

SEQ ID NO: 186088 - DNA, 270 bp, Artificial Sequence
  Description of Artificial Sequence: Synthetic coding sequence
atgtgcgaccggaaggccgtgatcaagaacgccgacatgagcgaggagatgcagcaagacagcgtggaatgcgcaactcaggcccttgagaagtataatatcgaaaaggacattgccgctcacattaaaaaagaattcgacaaaaaatacaacccgacatggcattgcattgtcggtcgcaacttcggctcatacgtgactcatgaaaccaagcattttatctatttttacttgggccaggtcgctatcctattgtttaaaagcggatag

SEQ ID NO: 186089 - DNA, 270 bp, Artificial Sequence
  Description of Artificial Sequence: Synthetic coding sequence
atgtgcgaccggaaggccgtgatcaagaacgccgacatgagcgaggaaatgcagcaagattcagtggaatgtgccacccaggctctggagaagtataacatcgaaaaagacatcgcagcgcacatcaagaaagagttcgacaaaaagtacaaccctacgtggcattgcatcgtgggcagaaatttcggttcctatgtgacacatgaaaccaagcactttatctacttctatttgggacaggtagctatcctgctgttcaaatctggctag

SEQ ID NO: 186090 - DNA, 270 bp, Artificial Sequence
  Description of Artificial Sequence: Synthetic coding sequence
atgtgcgaccggaaggccgtgatcaagaacgccgacatgagcgaggagatgcagcaggatagtgtggagtgcgctacacaggcactagagaaatataacatcgagaaagacattgcagctcatattaagaaagaattcgacaagaagtataatccaacctggcactgcatcgtcggacggaattttggttcctatgttactcacgagaccaaacacttcatctacttctacctgggccaggtggctattctgttgtttaagtccggttag

SEQ ID NO: 186091 - DNA, 270 bp, Artificial Sequence
  Description of Artificial Sequence: Synthetic coding sequence
atgtgcgaccggaaggccgtgatcaagaacgccgacatgagcgaggaaatgcagcaggactccgtcgaatgtgccacccaggctctggaaaagtacaacattgaaaaagacattgcagcgcacatcaaaaaagagtttgataagaagtacaaccctacctggcactgtatcgtgggtcgcaactttgggtcctacgtaacccacgagaccaagcacttcatttacttctacttaggccaggtcgccatcctgctgttcaaatctggctag

SEQ ID NO: 186092 - DNA, 129 bp, Artificial Sequence
  Description of Artificial Sequence: Synthetic coding sequence
atgtgcgaccggaaggccgtgatcaagaacgccgacatgagcgaggaaatgcagcaagatagcgtcgaatgcgcaactcaggccctagaaaaatacaacattgaaaaggatatcgcggctcacatctag

SEQ ID NO: 186093 - DNA, 270 bp, Artificial Sequence
  Description of Artificial Sequence: Synthetic coding sequence
atgtgcgaccggaaggccgtgatcaagaacgccgacatgagcgaggaaatgcagcaagatagcgtcgagtgcgccactcaggctctcgagaagtacaacatagaaaaagacatagccgcacacattaaaaaagaattcgataagaaatacaatccaacctggcattgcatcgttggccgaaactttggctcatatgtgactcacgagaccaagcactttatatacttttatctggggcaggtggccatcctcctgtttaagagcggctag

SEQ ID NO: 186094 - DNA, 270 bp, Artificial Sequence
  Description of Artificial Sequence: Synthetic coding sequence
atgagcgaccggaaggccgtgatcaagaacgccgacatgagcgaggacatgcaacaggacgcggtggattgtgcaacccaggccatggagaagtataatattgaaaaagatatcgctgcctatatcaagaaagagttcgacaagaaatataatcccacctggcactgtatcgtaggccgaaactttggtagctacgttacgcatgaaacgaagcactttatttacttttatttgggacaagtcgcaattctgttgtttaagtcaggttag

SEQ ID NO: 186095 - DNA, 144 bp, Artificial Sequence
  Description of Artificial Sequence: Synthetic coding sequence
atggccgaggtggaggagaccctgaagcggctgcagagccagaagggggtacagggcattattgtggtcaataccgaaggaggatgggaacccctgggccactgcggcgacaggtcgagacccccagcgcagggctgtccttag

SEQ ID NO: 186096 - DNA, 291 bp, Artificial Sequence
  Description of Artificial Sequence: Synthetic coding sequence
atggccgaggtggaggagaccctgaagcggctgcagagccagaagggggtccagggcatcatagtggttaacactgagggtatccccataaaaagtaccatggacaaccctaccacgacacagtatgcatctctgatgcacagcttcatactgaaagcgagaagtacagtgcgcgatattgaccctcaaaacgatctgacgttcctcaggattcggtctaaaaaaaatgagatcatggtcgcccctgacaaggactacttcctgatcgtgatccagaaccctactgaatag

SEQ ID NO: 186097 - DNA, 366 bp, Artificial Sequence
  Description of Artificial Sequence: Synthetic coding sequence
atggccgaggtggaggagaccctgaagcggctgcagagccagaagggggtacagggtattattgtggttaacacagaaggaatcccaatcaagagtactatggataacccaacaaccacacagtatgcttctttaatgcacagtttcatactgaaagcccgatccaccgtgcgcgatatcgacccacagaacgacttgacctttcttcgtattcggagcaaaaaaaatgagatcatggtggctcctggcaagggttcgtccacaagtccatgtagaaaccgtcctcacggtaccttctcagttgcacaccaggaatcttggcactccggggtttcccgcggctccaaacagggaccaagaagctag

SEQ ID NO: 186098 - DNA, 291 bp, Artificial Sequence
  Description of Artificial Sequence: Synthetic coding sequence
atggccgaggtggaggagaccctgaagcggatccagagccacaagggagttattggcaccatggtagtgaatgccgaggggatccctatcagaacaaccttggacaatagcacgactgttcagtacgcgggactactgcaccatcttacaatgaaagccaagtccaccgtgcgggacattgatccccagaacgatttgaccttcctgagaatccgaagcaaaaaacatgagatcatggtcgctcccgacaaagagtacctactcattgttatccagaacccctgtgagtag

SEQ ID NO: 186099 - DNA, 165 bp, Artificial Sequence
  Description of Artificial Sequence: Synthetic coding sequence
atggccgaggtggaggagaccctgaagcggatccagagccacaagggagtgattggcacaatggtagtgaacgcagaggatccgcgatttgtgacctttaagtatgcaagacagctgaccgcattccaaaggaagagcggccagcagatcacaatcaaagattag

SEQ ID NO: 186100 - DNA, 486 bp, Artificial Sequence
  Description of Artificial Sequence: Synthetic coding sequence
atggaccccaacccccgggccgccctggagcggcagcagctgcggctgcgagagagacaaaaattcttcgaagatattctgcagcccgagaccgaatttgtgttccccctttcccacctgcatctggaatcccaacgcccacccatcgggtccattagcagtatggaggtgaatgtcgatactctggaacaagtggagctgatagacctgggtgatccagacgccgcagatgtgtttctcccctgtgaggatcctcccccgaccccacagtctagcggcatggacaaccacctagaagaactcagcttaccagtccccacaagcgatcgcacaacctcgagaacctcatcatcttcctccagcgactcaagcaccaatctccactcaccaaatccctcagacgatggtgccgacacacccctggcccagtcggatgaagaagaagagaggggtgacggaggggctgagccaggcgcatgtagctag

SEQ ID NO: 186101 - DNA, 486 bp, Artificial Sequence
  Description of Artificial Sequence: Synthetic coding sequence
atggaccccaacccccgggccgccctggagcggcagcagctgcggttgcgtgaacgccagaaatttttcgaagacatactccagcccgagacagagttcgtctttccgctgtcgcatctccaccttgaaagtcagaggcctcctatcggatcaatatcgtctatggaggtaaatgtcgacaccctggagcaggtggagttaatcgacttgggagaccctgacgccgccgacgtcttcctgccgtgcgaagatccccctcctacacctcagtccagcggaatggataaccatctagaggaactgtccctccccgtgccaacatccgacagaaccacgtcacggaccagttcatctagttcctcagacagttccacaaatcttcacagccccaacccaagtgatgacggcgcagatactccactcgcgcagtccgacgaagaagaagagaggggagacggaggcgctgaacctggtgcctgttcatag

SEQ ID NO: 186102 - DNA, 792 bp, Artificial Sequence
  Description of Artificial Sequence: Synthetic coding sequence
atggagagctgggccctggccgtgttccccgagtaccgggtgagcctcctttggtgtctggaacttgctagtcccctgtggagcctgggacaggcaccgcccctgcatgaaacttggtttgtggggcacacttggttccaagggcggggcaaacgtagccccagggcagaagtgtctcgtcctgaaccgggcgcaccactattaggatgctggttgcagtggggcgcgccaagtcccggacccctgtgcttactatttcgcttgtgttcctgcacttgctttgccccactgcctgccggggccgacatggacccgaatccacgcgctgcgcttgagcgacaacagctaagactgcgagaaaggcaaaagttttttgaggacatcttacaacccgagactgagtttgtcttccctctgagccacctccatctggagagccaacggccaccaatcggctcgatcagttccatggaggtgaacgtcgataccctcgagcaagtggagttgatcgacctaggggaccccgatgccgccgatgtgttcctgccatgtgaagatccaccacctaccccacagtcttcgggaatggacaatcatttagaagagctctcactgcccgtccctacaagcgataggaccacatctcgtacctctagcagctctagctctgatagctcaactaaccttcattctcccaatccatcagacgatggcgccgacacacccttggcacagtcggatgaagaggaggagaggggtgatgggggcgcagagcctggtgcttgctcttag

SEQ ID NO: 186103 - DNA, 486 bp, Artificial Sequence
  Description of Artificial Sequence: Synthetic coding sequence
atggaccccaacccccgggccgccctggagcggcagcagctgcggcttagggagaggcagaagtttttcgaagatatcctccaaccagagaccgagtttgtgtttccactctcgcacctgcatctcgaaagtcagcgcccccccattggaagcatctcttctatggaagtgaatgtcgatactttggaacaggtcgagctgatcgacttgggtgacccagacgcagcagacgtgtttctcccttgcgaggatcctcctccaacaccgcagagcagcggtatggataaccacttggaggaattgtccttgcctgtgccaactagcgaccggacgacctcaagaacttcgtcgtccagttcatctgactcaagtacaaatctgcactctcccaacccctcagatgacggcgcagatacgcccctcgcgcaatccgatgaggaagaagagagaggagatgggggggctgagcccggcgcatgttcttag

SEQ ID NO: 186104 - DNA, 339 bp, Artificial Sequence
  Description of Artificial Sequence: Synthetic coding sequence
atggaccccaacccccgggccgccctggagcggcagcagctgcggctacgcgaaagacaaaaattttttgaggacattctgcagccagagacagaattcgtatttcccctcagccacctgcacctggagtctcaacgccctccaatcgggtctatttcctccatggaagtgaatgtcgacaccctagaacaggtcgaactcattgacctgggagacccagatgctgccgacgtatttctcccttgtgaggaccccccaccaaccccgcagtcgagtggcatgccactgtgctttggggactttagcgccagccagccagaacctgatgttcggctgtag

SEQ ID NO: 186105 - DNA, 780 bp, Artificial Sequence
  Description of Artificial Sequence: Synthetic coding sequence
atgggcgccggcaacttcctgaccgccctggaggtgcccgtggccgcgctagccggtgcagcaagcgaccggagagcctcttgtgagagggtgtctcccccaccaccactcccacacttccgccttccaccgctcccgcggagtaggttgcccggtccggttagccgccctgaacccggtgcaccactgctggggtgctggctgcagtggggcgcaccgagtcctggacctctatgtcttctatttagactctgcagttgcacatgtttcgcgccgctccccgctggggcagacatggatccgaatcctagggccgcacttgaaagacaacagctgcgcttgcgtgaaaggcagaagttctttgaggatatattacagccagaaaccgagtttgtttttcctctgagccacttgcatctggagtcacaacgtcccccaataggtagcatttcctctatggaggtgaacgttgatactctggaacaagtggagcttattgatttgggagacccggatgctgccgatgtgttcctcccctgtgaggaccccccacctacgccacagtcatccgggatggataaccacttggaggaattgtccctgcccgtccctacgagcgatcgcaccacatctaggaccagctcaagctcgtccagcgactcttcgaccaatcttcactcacctaacccaagtgatgacggtgcagacaccccacttgcccagagcgatgaggaagaagagcgcggcgacggaggggccgagcccggcgcttgctcttag

SEQ ID NO: 186106 - DNA, 339 bp, Artificial Sequence
  Description of Artificial Sequence: Synthetic coding sequence
atggaccccaacccccgggccgccctggagcggcagcagctgcggctcagggagaggcagaagttttttgaggacatactgcagccggagaccgagttcgttttccccctgagccacctccatctcgaatcacagcggccaccaatcggctctattagcagcatggaggtgaatgtggacaccctggagcaggtggaacttattgaccttggagacccggacgccgcagacgtgttccttccatgcgaggacccccctccgacacctcaatcctccggaatgcccctctgttttggggacttctcggcatcacagcccgagccagacgtcagactttag

SEQ ID NO: 186107 - DNA, 486 bp, Artificial Sequence
  Description of Artificial Sequence: Synthetic coding sequence
atggaccccaacccccgggccgccctggagcggcagcagctgcggctaagagaacgccagaaattcttcgaagatattctgcagcccgaaaccgagttcgtgtttccactgtcccacctgcaccttgaaagccagcgaccccctatcggtagcatctccagcatggaggtgaacgtggatactctagaacaggtggagctgattgacctcggcgaccccgacgctgcggatgtattcctaccatgcgaggatccacctcccactcctcagtcctccggtatggacaaccatctggaagagctgtcactgccagtacctaccagcgataggactacttcgcggacttcatcgtcgtcctctagcgattcctccaccaacctgcattctcccaaccccagcgacgacggtgccgataccccactggcccagagtgatgaggaggaggagcgcggggatggaggggctgagcccggagcatgcagctag

SEQ ID NO: 186108 - DNA, 519 bp, Artificial Sequence
  Description of Artificial Sequence: Synthetic coding sequence
tgaacctggttccagggccggggcaagcggagcccccgggccgaggtgtcccgtcctgaacctggcgcaccactactcggttgctggctccaatggggggctccctctccagggccattatgtctactgttccgcctttgtagttgtacctgtttcgcccctctgcctgcaggagcggatatggacccaaatccacgagccgccctggagcgtcagcaacttcggttgagagaacgacagaagtttttcgaggatatcctccaacctgaaacagaatttgtcttccctctgtcccatcttcatcttgaatctcagcggcctccgattggctccatctccagtatggaggttaatgtggatacattggagcaagtggaactgatcgatctcggcgatcccgacgcagccgacgttttcctgccatgcgaagacccaccccccacaccccagagcagcggcatgcccttatgtttcggcgatttcagcgcctcccagccagagcctgacgtgaggctctag

SEQ ID NO: 186109 - DNA, 15516 bp, Artificial Sequence
  Description of Artificial Sequence: Synthetic coding sequence
atgcacagcagcagctacagctaccggagcagcgacagcgtgttcagtaataccacctctacgcggacaagcctcgactcgaatgaaaaccttctgcttgttcactgcgggccaacactgatcaactcctgtatcagctttgggtctgagagttttgacggacaccgcttggaaatgctgcagcagatcgcaaaccgggtccagagggattctgttatttgcgaagacaagttaattcttgccgggaacgctctccagtccgactctaagagactggagagcggcgtccaattccagaacgaggctgaaatcgccggttacatcctcgagtgtgaaaaccttctcaggcagcacgtcatcgacgtgcagattctgatcgatggcaagtattaccaggcggatcagttagtccaaagggttgcgaagctgcgcgatgaaattatggccctcagaaacgagtgctccagcgtttacagcaagggccgcatactcaccactgaacagacgaagttgatgatctcagggatcacacagagcctcaacagcggattcgctcagaccctccacccgagtctaactagcggccttacacagagcctaaccccgtccctcacctcctcgagtatgactagcggtctgtcatctgggatgacttcccggttgactccctctgtaacgccggcttacacaccagggtttccttccggcctggttccaaacttctcctccggggtcgagcctaactcactacagacattgaagcttatgcagattcgaaaacctttgttaaagagtagcctactcgaccaaaacttgaccgaggaagagattaatatgaaatttgtgcaggatcttctcaattgggtggatgaaatgcaagtccagctagataggacggagtggggctccgacttacccagcgtggaatcccacctggagaaccacaagaatgtccacagagctattgaagaatttgaatcatcactcaaggaggccaagatcagtgagatacagatgactgccccattgaagctgacgtacgctgagaaactgcacaggcttgagtcacaatacgcaaagcttctgaataccagccgcaatcaagagagacacctagatacactgcacaacttcgttagccgtgcgactaacgaacttatctggctgaatgagaaagaggaggaagaggtcgcatatgattggagtgagagaaacacaaacatcgctcggaagaaagattaccacgccgaacttatgagagagctggatcaaaaggaagaaaacattaagtccgtgcaggagatagctgagcagctccttctagagaatcatcccgcccgtcttaccattgaagcttaccgggccgcgatgcaaacacagtggagctggatcttacagctttgccagtgtgtcgaacagcatatcaaagaaaacacggcgtactttgaattcttcaatgatgccaaagaagcgaccgactatcttagaaatttgaaggacgctattcagagaaagtattcgtgtgatcgatctagtagcatccataagctcgaagacctggtccaggagagtatggaagaaaaggaagagctgctgcagtataagtctacaattgccaatctgatggggaaggccaaaaccattatccagctgaaacctcggaatagcgactgtccattgaagacctcgattcctatcaaggctatttgtgattatcgtcagattgaaataaccatctacaaagacgacgaatgcgtactcgctaacaattctcatcgggccaagtggaaagtcattagcccaacaggaaatgaggcaatggttccaagcgtgtgttttactgtgcccccaccgaacaaagaagccgtggaccttgcaaatagaattgagcagcaataccagaatgtcctgaccctgtggcatgaatcgcacatcaacatgaaatctgtcgtaagttggcactacctgatcaatgagattgatagaatccgtgcctctaatgtcgcctccataaagaccatgctgcctggcgagcaccagcaagttctgtcgaacctgcagtctaggtttgaagacttcctggaggactcccaggagtcacaggtgttcagtgggtccgatataacccaactggagaaggaggtcaatgtatgtaaacagtactatcaagagctgttgaaatccgccgagcgcgaggaacaggaagagtctgtgtataacttgtacatttcagaggttcggaacattaggcttcgcttagagaattgtgaagataggttgatacgacaaatacggacacccctggaaagggacgatttgcatgagtccgtgtttaggataaccgagcaggagaaactcaagaaagagctggaacgccttaaggacgacttagggacgatcaccaacaaatgcgaggagttcttcagtcaggccgcagcctcctcctctgtcccaacattgaggtccgagctgaacgtcgtactacaaaacatgaatcaggtttatagcatgtcatccacatacatcgacaagctgaagaccgtcaacctcgttctgaagaatacccaggccgccgaggcactggtgaaactttatgagactaagctgtgcgaggaggaggccgtcattgctgataagaataacattgagaatctcattagcacactcaaacagtggcggtccgaggtcgacgagaaacggcaggtgtttcatgctctggaagacgagctgcaaaaggccaaggcaatcagcgatgaaatgtttaagacatataaggaacgggacctcgattttgattggcataaagagaaggcagaccagctagtggagcgctggcaaaatgtgcacgtacagattgacaatcgtctgagggacttagaaggcatcgggaagtcacttaaatattaccgggatacttaccaccccctcgacgactggatccagcaggtggagacaacccagcggaagattcaggagaaccagccagagaactctaaaactttagccacccagctgaaccagcagaagatgctggtcagcgaaattgagatgaaacagagcaaaatggatgaatgccagaaatacgccgaacaatacagcgcaactgttaaggactatgagcttcagacaatgacctacagggctatggtggactcacaacagaagagcccggtgaagcgcagacgcatgcagagctcggccgacctgattatccaggaatttatggatctgcggactcgctacacagctctggtcactctgatgacccagtatatcaagttcgctggggactcactgaagcgcctggaagaagaggaaaagtccctcgaggaagagaagaaagagcacgtcgagaaagccaaagagctgcagaagtgggtgtccaatatcagcaagaccctgaaagatgccgaaaaagcggggaagcctccttttagcaaacagaaaattagctccgaggaaatttccaccaagaaagagcagctgtccgaagcactccagacaattcagctgtttctggccaaacacggggataagatgactgatgaggaaaggaatgaattggaaaaacaggtcaaaaccttacaggagtcatacaatctgctgttctctgagtccctgaaacagctgcaggaaagccagacatctggggatgtaaaggtggaggaaaagatagtagctgaacggcagcaagagtataaagaaaagctgcaggggatctgtgatttgttgacccagacggagaacagactgataggacatcaggaggccttcatgatcggcgatgggacagttgagctgaagaagtaccagtccaaacaagaagagctccagaaggatatgcaaggctccgcgcaggccctggccgaagtagtgaagaacaccgagaatttccttaaagagaatggtgaaaaactgtcacaggaggacaaagcactgattgaacagaagttgaacgaggcaaagatcaagtgcgagcagctgaatctgaaagctgaacagagtaaaaaagagttggataaagttgtcactaccgcgatcaaggaggagaccgaaaaagtggcagctgtcaaacagctggaggagagcaagactaagattgagaaccttctggattggttatctaacgtggacaaggacagcgaacgagccggcacaaagcacaaacaggtcatcgagcagaacggaactcacttccaggaaggtgatggaaaatcagctattggcgaagaagatgaagtcaatggtaatcttctggagactgatgttgacgggcaggtggggactacccaagagaacctgaaccagcagtaccaaaaagtcaaggcccagcacgaaaagattatctcccagcaccaggcggttataattgctacccagagtgctcaagtgttgttggagaagcaaggtcagtatctgtctccggaagagaaagaaaagctgcagaaaaatatgaaggaacttaaggtgcattacgagactgcccttgctgaaagcgaaaagaagatgaaattgactcacagtctacaggaagaactggagaaatttgatgcggactacaccgaatttgagcactggcttcagcagagcgagcaggagctggaaaacctggaggccggagcagacgacattaacgggctgatgacaaagttgaaacggcaaaaaagctttagtgaggatgtgatcagtcacaaaggcgatctcagatacattaccatcagtggcaacagagtcctcgaagcagcaaaatcctgctctaaacgtgatggtggaaaggtggatacctccgccactcatagggaagttcagcgaaagctagaccatgctacggaccggtttcgttccttgtacagtaaatgcaatgttctgggcaataacttaaaagacctggtggataagtaccagcactacgaggatgcatcctgcggcctgttggctggtctccaggcttgtgaggccaccgctagcaaacacttgtcagagcctattgccgtggatccgaaaaaccttcaaagacagctggaggagactaaagctttgcagggtcagatctccagccagcaggtcgctgttgagaaactaaagaaaaccgcagaggtgctcttagatgcgagggggtcactgctgcctgctaaaaatgacattcagaaaaccctcgacgatatcgtgggccgctacgaagatctctctaaaagtgtgaacgagagaaacgagaagctgcaaatcaccttaactaggagtctgagcgtgcaagacggactggatgagatgttggactggatgggcaatgtcgagagctccctgaaggaacagggtcaggtgcctctcaactccacagcgctgcaggacatcatcagtaagaatatcatgttggagcaggacattgcaggtcgccagagttctattaatgctatgaacgagaaggtcaaaaaattcatggagacaacagacccctctacagccagttctctccaggctaagatgaaagacctgtccgcacgattctccgaggcgagccataagcacaaggagactttggcgaagatggaggagctgaaaactaaagtggagttatttgaaaacttatccgaaaaactgcagacctttctggagaccaagacacaggccctaaccgaggtggatgttcccggaaaggatgtgaccgagttatctcagtacatgcaggagtctacttcagagtttctcgaacataaaaagcacctcgaggttctccactccctcctgaaggaaatttcatctcatgggttgccttcagataaggccttggtgttggaaaagacaaataatctgagcaagaaatttaaggagatggaagacaccataaaggaaaagaaagaggctgtgacaagctgccaagagcaattggatgccttccaagtgctcgtgaaatctcttaagtcctggataaaagagaccacaaaaaaggttccgatcgtgcagccctcttttggcgctgaagatctcgggaagtcactggaagacaccaagaagctccaagaaaagtggtcattaaagaccccagagattcagaaagttaataatagtggtatttctttgtgcaatttaatttctgctgttactactcccgccaaggccatcgccgcagtaaagtctggcggggcggtgttgaacggggagggcaccgccaccaacacagaagagttctgggccaacaaaggtttaacctctatcaagaaggacatgaccgacatatcacacgggtatgaagacctgggccttcttttgaaggacaaaatcgcggagttgaacaccaagctgagcaagctgcagaaagcacaggaagagtcctcggccatgatgcagtggctgcagaaaatgaacaaaactgccactaaatggcagcaaacacccgctcccaccgataccgaggccgtgaagacccaagtggaacagaataaaagctttgaggccgagctgaagcagaatgtgaacaaggtccaagaactgaaggataaactgaccgagcttcttgaagaaaatcccgatacacccgaggctccgcgatggaagcagatgcttacggagatcgatagcaaatggcaagagctgaaccagttaacgatagatcgccagcagaagctggaggaatcttcaaataacctgactcagtttcaaaccgtggaggcccagcttaagcagtggttagtcgaaaaggagctaatggtgtccgtgttgggtccactgagcatcgatccaaatatgttgaacactcagagacagcaggtccagattcttctgcaggagtttgcaacacgtaaacctcagtatgagcagctgaccgctgccggccaggggatcctgtcccggccaggcgaggatccatctctgaggggaatcgtcaaagaacaactggcagccgtaacgcagaagtgggacagcctgacgggccagcttagtgataggtgcgattggatcgatcaagccattgttaaatcgacccagtatcagagcttgctccgctccttgtccgacaaactgtcagaccttgataacaagctctcaagctctcttgctgttagcactcacccagacgcgatgaatcagcaactcgagaccgctcagaaaatgaaacaagagatacagcaagaaaaaaaacagattaaggttgctcaagccctttgcgaggacttgagcgccctggtcaaagaagagtatctgaaggcagaactttcaaggcaactggaggggatactcaaaagctttaaggatgttgaacaaaaagctgagaaccatgtccagcatctgcagagtgcctgcgcgtcatctcaccagtttcaacaaatgagtcgagacttccaggcatggttggacactaagaaggaggagcagaacaagagccatcctatctcggccaaactagacgtgctcgaatccctcatcaaagatcataaggactttagcaaaaccttgaccgcacagagccacatgtacgagaaaactattgccgagggagagaatctgctgcttaagactcagggctcggagaaggctgcactgcaactccagctgaatactattaagaccaattgggacaccttcaataagcaggtgaaggaacgggagaacaaactcaaggaatctctggaaaaagctctgaaatacaaggagcaagtcgaaactctatggccttggattgataagtgccagaataatttggaggaaatcaagttctgcctggatccggctgagggcgagaatagcattgccaagctgaagtcactgcagaaggaaatggatcagcacttcggcatggttgaacttctcaacaataccgcaaatagcctgctctccgtctgcgagatagacaaagaggttgtaaccgatgagaataagagcttgatccagaaagtagacatggtgacagaacaactgcactcgaagaagttctgtctggagaatatgactcagaagtttaaagagttccaagaagtttcaaaagagtcaaaacgtcagctgcagtgcgccaaagagcagctggacattcacgatagtctggggagccaagcgtactccaacaagtatctcactatgcttcagacccagcagaaatcactgcaagcgttaaaacaccaggtggacttagctaagcggcttgcccaggacctggtcgtggaagcttcagattctaagggcacctcagatgtgctgctccaggtggaaactattgcgcaggaacacagtactctgagtcagcaggtggatgagaagtgttcattcctagagactaagcttcagggaatcggtcattttcagaacactattagggagatgttctctcagttcgccgagttcgacgacgaactggacagtatggcccctgtgggtcgcgacgctgagaccttgcaaaagcagaaggagacaattaaagcatttctgaagaagcttgaggccctgatggcatccaatgataatgctaataaaacctgtaagatgatgttggccacagaggagacatcccccgacttagtgggcatcaaaagggatttggaggctctgagtaagcagtgcaataaactgcttgatagagctcaggcccgggaggaacaggtcgagggaaccatcaaaaggcttgaagagttttactcaaaactgaaggagttcagtatcctgctccagaaagccgaagagcatgaagaatcacagggacccgtgggaatggaaaccgagactattaatcagcagctcaatatgtttaaagtgtttcagaaggaagagatagaaccactgcaggggaagcagcaggatgtcaactggctcggtcagggccttatccaaagcgctgctaagtccacttctacgcaaggtcttgagcacgatctggacgatgtcaatgccaggtggaaaacacttaacaaaaaagtggcccagagggccgctcagctgcaggaggcactgctgcactgcgggcgctttcaagatgctttggagagtctcctgtcctggatggtagacaccgaggagctagtcgcgaaccagaagcctccatctgccgaattcaaggtggtcaaggcccaaatacaggagcaaaagctcctccagcggttgctcgacgatcgaaagagcacagtggaggtcataaagagggagggcgagaaaatcgccaccacagctgagccagccgataaggtgaagatccttaaacagctctcacttttagattctaggtgggaggccctgttgaataaggctgagactcggaacagacagcttgagggaattagtgtcgttgcgcaacagttccatgagactcttgagccgctaaacgaatggctaaccactatcgaaaagcggttagtcaactgcgagcccatcggaactcaggcatcaaaacttgaggaacagatagctcagcataaagccttggaggacgacatcatcaaccacaataaacatttacaccaggctgtgtcaattggccaatcattgaaggtactgtctagcagggaagacaaggacatggtccagagcaaactagactttagtcaggtgtggtacatcgaaatccaggagaaaagccactctcgttcggagttgttgcagcaggccctctgtaacgccaaaatcttcggtgaagatgaggtcgaactgatgaattggctgaatgaggtgcatgataagctatccaaactcagcgtgcaggactattctacagaaggtttgtggaagcaacaaagcgaacttagagtgctccaggaggacatcctcctcagaaagcagaacgtcgatcaggctcttctgaatggacttgagctgttaaaacagacaaccggggatgaagtcctgattattcaggacaaactcgaggctatcaaggccagatataaagatattactaagctatcgacagacgtggccaaaacattggagcaagctctgcagctggctagaaggctccactccacccacgaggaactctgtacctggctcgataaggtcgaggtggaactgctcagttacgagacccaagtgctcaagggcgaagaggcctcacaggcccagatgcggcccaaggagctgaaaaaggaagccaagaacaacaaggcgttgttggactccctgaacgaagtttccagcgccctgctggagctagttccatggcgcgctcgtgaaggtctggagaagatggtggcggaagacaacgaacgataccggctcgtatccgatacaattacccagaaggtagaagagatcgatgccgcgattctcaggtctcagcagtttgaccaggccgcagacgccgaactgtcttggattaccgaaacagaaaaaaagctcatgagtctgggcgacatccggctggagcaggatcaaaccagcgctcagcttcaggttcagaaaacttttactatggaaattctgcggcataaagacatcatcgacgatttagtcaaatctgggcacaaaatcatgaccgcttgcagcgaagaagaaaaacagtccatgaagaagaagctggacaaagtgttgaagaattacgacactatctgtcagatcaattctgaacgataccttcagctggaacgagcccagagcctggtcaaccagttctgggaaacgtacgaggaattgtggccctggctcacagaaacacagagcattatttcacagcttccagctcccgctctggaatatgagaccctgcggcagcagcaggaagaacatagacagctccgagaactgatcgctgaacataaacctcatatcgacaaaatgaacaaaacaggccctcagttgttagaactgtcacctggagaaggattcagtatacaagaaaaatacgtagcagctgatactctgtactcacagatcaaggaagacgtgaaaaagcgcgccgtagctctagatgaagctatatcccagtcaacccagtttcatgacaaaatcgatcagatactggagtccctggaacgcattgtagagagacttaggcagcccccctctatctcagccgaggtcgaaaagataaaggaacagatctccgaaaacaagaatgtaagcgtcgacatggagaagctgcagccgctgtacgagacgctcaagcagagaggcgaggaaatgatcgcccgctctggcggcactgataaggatatttcagctaaagccgtgcaggacaaactggatcaaatggtcttcatttgggaaaatatccacaccctggtggaggaaagagaagcgaaacttctagatgtcatggaactggccgagaagttctggtgtgatcacatgtctctcatcgtgaccattaaagatacccaagacttcattcgggatctggaagaccctggcatcgaccccagcgtggtcaagcaacagcaggaagccgccgagaccatcagggaagagatcgacgggctgcaggaagaactggacatcgtgattaatctcgggagtgaacttattgcggcatgtggcgagccggataagcccatcgtgaagaaatcaatcgacgagcttaattcggcgtgggattcattgaataaagcttggaaggataggattgacaaattggaagaagcgatgcaggcggccgtgcagtaccaggatggtctgcaggccgtctttgactgggtggatattgccgggggaaagctcgcctccatgtcccctataggcaccgatctggagaccgtgaaacagcaaatcgaagagctcaaacaatttaaatcagaagcatatcagcaacagattgaaatggaacgcctcaatcaccaagccgaattgctgctcaagaaggtgaccgaggaaagtgacaagcatacagtacaggatccgctgatggagttaaagttaatctgggacagcttggaggagcgtattatcaatcgacaacataaacttgagggggctctcctggcattaggtcagtttcaacacgctctagatgagctcctggcctggctaactcacaccgaaggactcctgtccgaacagaaaccagtcggcggggatccaaaagccatcgaaatcgagctggccaagcatcacgtgctgcagaacgatgtcctggcccaccagagcaccgtggaggcggttaataaggctggcaacgatctcatagaatcgagcgccggggaggaagcttctaatcttcaaaacaaactggaggttctgaaccagaggtggcagaatgtgctggagaaaaccgaacagcgcaagcagcagttagacggggccttgcgccaggcaaaaggctttcatggcgagatagaggatttacagcagtggcttactgacacagagcggcacctgctggcaagtaagcctctgggagggttgccggaaactgcaaaggaacaactgaatgttcatatggaggtgtgtgccgcattcgaagcaaaggaggagacatataagagtctaatgcaaaagggccagcagatgctcgccagatgtcctaaatccgccgagacaaacattgatcaagatataaataacctcaaggagaagtgggaaagtgtggaaaccaagctcaatgagagaaagacaaagctggaggaggctctgaacttagccatggagtttcataacagtttgcaggacttcatcaattggcttactcaggcagagcagacactgaacgtggcatcccggccatcccttatcctggacacagttcttttccaaattgatgaacacaaagtgtttgcgaacgaagtcaattcacacagggaacagatcatcgagctggacaagactgggacgcacctgaagtatttcagccagaaacaagatgtcgttctgataaagaacctccttattagcgtacagtcacgttgggaaaaagtggtgcagcggctggttgaacgcgggcgatcactggatgacgcaagaaagagggccaaacagtttcacgaagcctggtccaaattaatggagtggctggaagagtccgaaaaatccttggatagtgaattggagatcgccaacgacccagacaaaattaagacccagctggcacagcacaaggagttccagaagtcgctcggtgcaaaacacagcgtgtatgatacaactaatcggacaggtcggtctctcaaagaaaagacgtccctcgcagacgacaatctgaaactagacgatatgctgagtgagttgagagacaaatgggataccatctgcggtaaatcagtagaaaggcagaacaaattggaagaagctcttctcttcagcgggcagtttaccgacgccctgcaggccctgattgattggttatacagggtggagccgcagcttgccgaagatcagccggttcacggggacattgaccttgtgatgaatctgatagacaatcataaggcgttccagaaagaacttggtaagcgtaccagcagtgttcaggctttgaagcggtcagccagagagctaattgaagggagtcgggacgatagcagctgggtgaaggttcagatgcaggaactgtcgacgaggtgggaaacagtgtgcgcgctgtcaattagcaaacagactcgactggaggcagcactcaggcaagccgaggagtttcacagcgtggtgcacgcattgttagaatggctagcagaggcggaacagacactcaggttccacggcgtcctccctgacgatgaagacgccttgaggaccctcatcgatcagcataaggagtttatgaaaaagttggaagagaaaagggccgaactaaacaaggccactactatgggggacactgtactggctatttgccacccagactctataaccacgattaagcattggatcactatcatacgggctcgtttcgaggaagtgctcgcttgggctaagcaacatcagcagcgattagcatccgcactggcaggcctgattgctaagcaggagctgctggaagctctcctagcttggctgcagtgggcggaaactacgttgacagacaaagataaggaggtcataccgcaggagatcgaagaggtcaaggccctcattgcagaacaccagacatttatggaagagatgacacggaagcagcctgatgtagacaaagtcactaaaacctacaagcgacgcgcggctgacccaagctctctacagtcacacatcccggtccttgacaaaggcagggctgggcggaagagatttcctgcctcctcattatatccctcagggtcccagacccagatcgaaacaaagaatcctagagtgaatctgctcgtgtccaagtggcagcaggtgtggctactcgccctggaacgcagacggaaattaaacgacgcccttgataggcttgaggaactgcgggaatttgccaactttgacttcgatatctggaggaaaaagtatatgcgctggatgaaccataagaaatcgcgagtgatggacttttttagacggattgacaaggaccaggatggaaagattactcggcaagagtttatagacggcattctctcttcaaagtttccaacttcaaggctagaaatgagcgccgttgcagacatattcgatagggatggggacgggtacattgattattatgagtttgtagcagcactccaccctaataaggacgcctataagcctattacagatgccgacaaaatagaagatgaggtcactagacaggttgctaaatgtaaatgtgccaaaagatttcaggtggaacagataggcgataacaagtataggttttttctcggcaatcagtttggggacagccagcaactcagattagtgaggattttgaggagtaccgtgatggtacgggtgggcggagggtggatggcactcgacgagtttctcgtcaagaacgacccctgtcgggccaaaggacgaacgaatatggagttaagagagaagttcatattggccgatggtgcaagccagggaatggctgccttccgacctaggggacgtcggtcgcggccatccagtcggggagcttccccgaaccggtccacctccgtgagcagccaagcagcccaggccgcttcgccacaggttccagctacgaccacacctaaaattctccatcctctcacacgtaattacgggaagccttggttaactaactctaagatgagcaccccttgcaaggccgccgagtgttccgatttccccgtccctagcgctgaaggtacccctattcagggttccaaactgcgcctcccagggtatctcagcggcaaaggatttcatagcggtgaagactccggtctaatcactaccgccgcggccagagtccgcacccagttcgcagattctaaaaagaccccgagcaggcccgggtctagagccggctccaaggcaggctcacgagcttcctctaggcgaggaagtgatgccagtgattttgacatctcagagattcagtctgtctgcagcgatgtagagacagttccgcaaactcaccgcccaaccccaagggcaggaagccgccccagtaccgccaaacctagtaaaatcccaactccccagcggaaaagccccgcaagcaagttggacaagtccagcaaaagatag

SEQ ID NO: 186110 - DNA, 12603 bp, Artificial Sequence
  Description of Artificial Sequence: Synthetic coding sequence
atggccggctacctgagccccgccgcctacctgtacgtggaggagcaggagtacctccaggcttatgaagatgttttggaaaggtacaaggatgagagggataaagtccagaagaagaccttcactaagtggatcaatcaacatctgatgaaggtgagaaaacacgttaatgacctgtatgaggatctccgggacggtcacaatctaatctcacttttagaggtcctgtcaggagatacgctcccccgggagaaggggcgaatgcgctttcatcgcctgcagaatgtccagatcgcattggactacttgaagagacgacaggtgaagttggttaacattagaaacgatgatatcacagatggtaaccctaaactcacgctcggacttatctggactatcatcctccatttccagatttctgatatccatgtgacaggcgagagcgaagacatgtcagccaaggagagattgcttctgtggacacagcaggcaacagagggttacgcaggcatccgctgcgaaaatttcaccacctgctggcgcgatggtaagttatttaatgccattattcacaagtacaggcctgaccttatcgatatgaatactgttgccgtgcagagtaatctcgcgaaccttgaacatgcattttacgtcgccgagaagattggtgtgattcgtctgctggaccctgaagatgtcgatgtcagcagcccggatgaaaaaagtgtgattacttacgtctcttctctgtacgacgcctttcctaaggtgccagaggggggcgaaggcatcggcgccaacgacgtggaagtgaagtggatcgaataccagaacatggtcaactatctcatccaatggatccgccaccatgtcactaccatgtccgagcgaactttcccaaacaatcccgtagagctgaaggcattatataaccagtacctgcagttcaaagagactgaaattccaccaaaggagacagagaagtccaaaattaaaagactctacaaactgttggaaatctggatcgaattcggccggatcaagttactccagggctaccacccaaacgacatcgaaaaagagtggggtaagctaatcattgccatgttagagcgcgaaaaagccctgcgtcccgaagttgaaagactcgagatgctgcaacagattgctaatcgggtgcagagggatagcgttatctgtgaagacaaacttattctggccggtaacgccctgcagagtgactccaaacgactcgaatcaggtgtccagttccaaaatgaggccgaaatcgcagggtatatccttgagtgcgagaatctcctgcgacaacatgtcatcgatgtacagattctgatagatggcaaatactatcaggcagatcagttagttcaacgggtggctaaactgagggacgagattatggcccttcggaatgaatgttccagtgtgtactcaaagggacggattttaactacagaacagacaaagctcatgatcagtggcatcactcaatccttaaattcaggctttgcccagacattgcatccctccctgacaagtggcttaacccaatcgcttacaccttcactgacaagttcgtccatgacaagtggactgtcttcaggcatgacatcccgactgacaccatctgtgacacctgcctacacacctgggtttcccagcggactggtccccaatttttcaagcggcgtggagccgaactcgcttcagaccctgaaattgatgcagatcagaaagcctttgctcaaaagcagcttattggaccagaatctgaccgaggaagagattaatatgaaattcgtgcaggaccttttgaactgggtggatgaaatgcaggtgcaactcgaccggacagaatggggcagcgacctgccctcagtggagtcacacctcgagaaccacaagaacgttcacagagctattgaggagtttgaatcaagcctaaaggaggccaagatatctgagatacagatgaccgcacctctgaagctcacgtacgctgagaaactgcacagactcgaatcacagtacgctaagcttctgaacacatctcggaatcaagagcggcacctagacactctccacaattttgtcagtcgggctactaacgaacttatttggctgaacgagaaggaagaggaggaggttgcctatgactggtctgaaaggaacacaaacatcgcccggaaaaaagattatcatgccgagctcatgagagagctggaccagaaggaagagaacatcaaatcggtgcaggaaatcgccgagcaactgctgctggaaaatcaccccgctcgcttgaccatcgaggcctatagggccgcaatgcagactcagtggtcttggatccttcagctgtgccaatgtgtggaacagcacatcaaggaaaatacggcctactttgagttttttaacgacgcaaaggaagctactgactacctacggaaccttaaggatgcaatccagcgtaagtacagttgtgatcggtcctcttctattcacaagctggaggacttagtccaggaaagtatggaagagaaggaggagctgttgcagtacaagtctactatcgccaacttgatggggaaggcgaagactatcatacaactcaagcctcgtaactcagattgtcccctgaaaacctcaattcctatcaaggctatatgtgattaccgccaaatagaaatcacgatttataaggacgatgaatgcgttctcgccaataattcgcaccgggccaaatggaaggttatcagccccactgggaatgaagcaatggtcccctctgtgtgttttactgtaccacctcctaataaggaagctgttgatttggcgaaccgcatagagcagcagtaccagaatgtgctaaccctctggcacgagtctcacattaatatgaaatctgtcgtgtcatggcactatcttatcaacgagatagatcggattagagccagcaacgtggcgtccatcaaaactatgcttccgggggagcaccagcaggtgctctcaaatctgcagtccaggttcgaggatttcttggaggattctcaggaatcccaggttttcagcgggtcagacatcactcagttggagaaggaggtcaacgtgtgcaagcagtattaccaagaactgctgaaatccgcggaaagggaggaacaagaggagtccgtgtacaacttatacatatcagaggtgcgaaatatcagactgagactagaaaattgcgaagatcgactcattagacagattcggacaccactggagagggacgacttacacgaatccgttttccgcataaccgagcaggagaaattaaagaaggagttagaacgtttgaaggatgatttgggcactatcactaacaagtgcgaggagttcttctcacaggctgctgcctcatcatccgtccctacgttgcggtcagaactgaacgtagtgctccagaacatgaatcaagtctacagcatgtcaagcacatacatcgataagcttaaaaccgtcaatctcgtccttaaaaacactcaggccgcggaggcgctggtgaagctgtacgaaactaaactgtgtgaggaggaagcagttatcgccgacaagaataacattgagaatctgatcagcaccctgaaacagtggaggagtgaggtcgacgaaaagagacaggtctttcatgctttggaggacgaactccagaaggccaaagcaatctccgatgagatgttcaagacatataaggagcgggatctggatttcgactggcacaaggaaaaggcggaccagctcgtggagcgatggcaaaacgtgcacgtacagattgacaatcgcttaagggaccttgagggtattggaaaaagtctcaagtactatcgcgacacctaccatcctctggatgattggatccagcaggtcgagacaactcaacgcaagatacaggaaaaccagccggagaatagtaaaactctggctactcaattaaatcagcagaaaatgctagtcagcgagatcgaaatgaagcagtcaaaaatggacgaatgtcagaaatacgcagagcagtacagcgccaccgtgaaagactacgagctccagaccatgacctacagagcaatggtagattctcaacagaaaagccctgtgaagcgaagacgcatgcagtcaagcgcagatctgattatccaggagttcatggatctacggacacgctacacggcccttgtgaccctgatgacccagtatataaagttcgctggagacagcctcaagaggctggaggaggaagagaaatctctcgaggaagaaaagaaagaacacgtagagaaagcgaaggaacttcagaagtgggttagcaacatatcaaaaactttgaaggatgccgaaaaagctggcaaaccaccctttagcaaacaaaagattagcagtgaggaaatctccaccaagaaagaacagctgtctgaggcactccaaacaatccagcttttcctggctaagcatggagacaagatgaccgatgaggagcggaacgagctggagaagcaggtaaagactctccaggaaagctataatcttttatttagcgagtccctcaagcagctccaggagtcacagaccagcggcgatgtgaaggtggaagaaaagctggataaagtaatcgcagggaccatcgaccaaacaaccggcgaagtgctcagcgtatttcaggccgtcctccggggtttgattgattacgacacgggcattcgactgctggagacgcagcttatgatttctggactgatctccccagaactgaggaagtgtttcgaccttaaggacgccaagagccacggactgattgacgaacagattctgtgccaactgaaggaactctccaaggcaaaagaaatcatttcggctgcgagccccacgacaatccccgtccttgacgccctggctcaaagcatgataacagagagcatggccatcaaagtactggagatcctgctttctaccgggagcttggtgatccctgcaacaggcgaacagctcacactccagaaggcttttcagcaaaatctagtgtcatcggccttgttttcaaaggtgttggaacggcaaaacatgtgtaaggacctcattgatccctgtaccagcgagaaggtttctctgattgacatggtgcagagaagtacactacaggagaacaccggaatgtggctcttgcccgtacgccctcaggaaggagggaggatcaccctgaaatgcgggaggaacatatccattctgagagcagctcacgaggggctgattgatcgagaaaccatgttccgcctgctctcggctcaactcttgagcgggggactcataaacagtaattccggccagcgcatgaccgtcgaagaggctgtgcgtgagggtgtcattgatagagacactgctagttcaatccttacataccaggtacaaactggtggcataattcagtcaaaccctgcaaagcgcctaaccgtggacgaggccgtgcagtgtgacctgattacttccagctcagccctcctggtgctggaagctcaacggggctatgtaggcttgatttggccccattccggcgaaatcttcccaacttcctcgtctctccagcaggaactgattacaaacgagcttgcttataaaattctgaatgggcgccagaagatagccgccctctatatcccagaatcatctcaggtaatcggcttggacgccgcaaagcagctggggatcatcgacaacaacactgcatctatcctcaagaacatcaccttgcctgataagatgcctgacttgggcgatttagaggcttgtaaaaacgctagacgttggctgtccttctgtaaatttcaaccgagcaccgttcacgactatcgtcaagaggaggacgttttcgatggcgaggaaccggttaccacacaaacctcagaggaaaccaaaaagctgttccttagctatctaatgataaactcttatatggacgctaacacaggccagagacttttactgtacgacggagacttagatgaagctgtgggaatgctgctcgaggggtgccacgccgaattcgatggtaacacagctatcaaggagtgcctcgatgtcctctccagctctggcgtgtttttgaataacgcctctggccgtgaaaaagatgagtgcactgccaccccgtcctcattcaacaaatgtcactgtggcgaacccgagcatgaggagacacctgagaataggaagtgtgctattgacgaagagtttaatgagatgagaaacaccgttatcaactcagaattcagccagtcggggaagctcgcttccacgataagtatcgacccaaaggtgaacagcagtccaagcgtgtgtgttccttccctgattagctacctcacacagactgagctcgccgatatcagtatgctgcggagcgacagcgagaatatcctgaccaactacgagaaccagagcagagtggagactaatgaaagagccaacgagtgtagccattctaagaacatacagaactttccgtcagatctgattgagaatcccattatgaagtcgaaaatgagtaaattctgtggcgtgaacgagacagagaatgaagataatactaacagggacagcccaatattcgactactccccacggttgagtgccctgctgtcccatgataagctgatgcacagccagggaagtttcaacgatacccacacccctgagagcaacggcaataaatgcgaagcgcccgccctgtctttctcggataagacaatgctcagcgggcagcggatcggggaaaaatttcaagatcagtttctgggtattgcagccattaacatctcattacccggggaacagtatgggcaaaaatccctcaatatgatttcaagtaatccacaggttcagtatcacaatgacaagtatatcagtaacacttcaggtgaggacgagaaaactcacccgggttttcaacagatgcctgaagacaaggaggatgagtccgaaatagaggagtactcctgtgcagtgacgcctgggggagatacagacaatgccatcgtgtcacttacctgcgctactcccctgctggatgagactatatccgcatccgattacgagacaagcttacttaacgatcagcagaataataccggaacggacactgatagtgatgacgacttttatgacacaccgttgttcgaggatgacgaccacgacagcctccttttggacggagatgaccgggattgcctccaccctgaggactacgacacactccaggaagagaatgacgaaaccgctagtcccgccgatgtcttctacgatgtgtctaaggagaacgagaatagcatggtaccccagggcgcaccagtcggtagcctcagcgtcaaaaataaagcgcactgcctgcaggattttctaatggacgttgagaaagacgaactggattccggtgaaaagatccacctgaatccagtaggctccgataaggtcaacgggcagtctctggagactggaagcgaacgcgagtgtaccaacatccttgaaggcgacgagagcgactcattaaccgattacgatattgtggggggcaaagagagcttcacagcaagcctaaagtttgatgatagcggatcatggcgcggccgcaaggaggaatacgtgaccggtcaggagtttcactctgacactgaccatcttgactccatgcagtccgaggagtcgtatggagactatatctacgactcgaatgatcaggacgatgatgacgatgatgggatcgacgaggagggagggggaatccgtgatgaaaatggcaaaccccgttgccaaaatgtcgccgaagacatggatatccaactgtgcgcttctatcctcaacgagaattccgacgagaacgagaacattaacacgatgattctgctcgacaagatgcattcatgcagttctttggagaagcagcagagggtgaacgtggtccagttggcctctccttccgagaacaaccttgttaccgagaaatccaacctcccggagtacaccacggaaatagccggcaagtcgaaggagaacttactcaaccacgagatggtgttgaaggatgtgctcccaccaataatcaaggataccgagagtgagaaaacatttggccccgcctccatctcacacgataacaataacattagctctactagtgagttaggtactgacctcgctaacacaaaagtaaaactaattcagggctccgaattaccggaactcactgactctgtcaaaggaaaagatgagtactttaagaatatgacccctaaagtcgattcctctcttgatcatatcatatgcacagagcccgatctaataggtaaacccgccgaggaatctcatcttagtctaatagccagtgtgaccgacaaagaccctcagggtaatggttctgatctgattaaagggcgagacggcaagagcgatatactcatagaagacgagacctcaatccagaaaatgtacctcggtgaaggagaagtcttggtagagggactcgtggaagaggagaaccgacaccttaaattactgcccggaaaaaatacaagagacagcttcaaactgatcaatagtcagtttcctttcccgcaaatcactaataacgaggaactaaaccagaagggctccctcaagaaagctacagtgaccttgaaggacgagccaaacaatttgcagataattgtgagcaagtcacccgtgcagttcgagaacctggaagagatattcgatacatccgtgagcaaagaaattagtgacgacatcacctccgatatcacgtcctgggaaggtaacacccacttcgaggaaagtttcaccgacggccccgagaaagagttagacctctttacatatctcaaacactgtgcaaaaaacatcaaggccaaggacgtggccaagcccaacgaagacgtccccagccatgtcctaataactgccccgcccatgaaggaacacctgcagctgggggtgaataacactaaggagaagtcgacctccacccagaaggactctcccctaaacgacatgatccaaagtaacgatctgtgttcaaaggaaagcattagcggtggcgggaccgagattagccagtttacacccgaatcaattgaggcgacgctatctatattatctaggaagcatgtagaggatgtgggaaaaaatgacttccttcagagcgagagatgcgctaatggcctgggcaacgacaattcgtccaatactctaaatactgattattccttcctcgagattaataataagaaagagcgtatcgagcagcagctccccaaggaacaggcactatctccacgttcacaggaaaaggaggtgcagatccccgagctgagccaggtgtttgtggaggatgttaaagacatcctgaaaagccgactgaaagagggccacatgaatccgcaggaagtagaagagcccagtgcctgcgcagataccaagattctcattcaaaatctgattaagcggattacaacaagccaactggtaaatgaagcttccactgttcccagtgacagtcagatgtcggacagcagtggcgtttcgcccatgaccaactccagcgaacttaagcctgaatcccgagatgaccctttttgtatcggaaacctcaaatccgagctgctacttaacattttgaagcaggatcagcactctcaaaagatcacgggagtctttgagctgatgagagagctgactcatatggaatatgatttggagaaaagaggaattaccagcaaggtgctccctctgcagttggaaaacatcttttacaaactgctggccgacggctattccgaaaaaatagaacacgtcggtgattttaaccagaaggcctgctccacttctgagatgatggaggagaaaccacacattttgggagacataaagtcaaaggagggcaactattactcaccaaacctggaaaccgttaaggaaataggcctggagagctctacagtgtgggcttccacgctccccagggatgagaagctaaaggacctctgtaatgacttcccatcgcatcttgagtgcacaagcggttccaaagaaatggcctccggcgactcaagcaccgaacaattcagcagcgaattgcagcaatgccttcagcatactgaaaaaatgcacgaatacctgacactgctgcaagacatgaagccgcccctagacaatcaggagtctttggacaataatcttgaagccctgaagaatcagctccgccagctggagaccttcgagctcgggctggccccgatcgccgtcattctaagaaaggacatgaaactggccgaggaattccttaagtcgctgccaagcgatttcccaaggggacacgtcgaggaactctctatttctcatcaatcactgaagacagcattctcctcgctgtcaaacgtgtctagtgagcgcacaaagcagattatgctcgcaatcgattctgaaatgagcaagctcgccgtgtctcatgaggaattcctgcacaagttaaagagcttctcagattgggtcagcgagaagagcaagtcggttaaggacatagagatcgttaacgttcaggattcggagtatgtgaagaaacgcctagagttcttgaagaatgtgttgaaggacctcggccacacgaagatgcaacttgaaaccactgccttcgacgttcaatttttcatctcagaatacgctcaggatttatcccctaatcagtctaagcaattattgaggctcctcaataccacccagaagtgtttcttggatgtacaggagagcgtgaccactcaggttgagagactggaaacccagctccacctcgagcaagatctcgacgaccaaaaaatcgtagccgaacgccagcaagaatacaaggagaaactgcaggggatttgcgatctcctcactcagaccgagaacagactgataggacatcaggaggcgtttatgatcggcgatgggaccgtcgagttgaaaaagtaccagagtaaacaggaagagctgcagaaggatatgcaggggtcggcccaggcacttgccgaggtggttaaaaacacagaaaactttctgaaggagaacggcgaaaaactcagccaggaagataaggccctcattgaacaaaaactgaacgaagctaaaatcaagtgtgagcagctgaatcttaaggctgagcagtctaagaaggagctcgataaggtcgttaccacagccattaaggaggagaccgagaaagtcgccgcagtaaaacagttggaagagtccaagaccaagatagagaacctgctggattggctctccaatgtagacaaagacagtgaaagagcaggtaccaaacacaagcaggtgatagaacagaacgggacgcattttcaggagggcgatgggaagtccgctatcggagaggaagacgaagtgaatggtaacctccttgaaaccgacgttgatggccaggtaggaacaacacaggaaaacttgaatcagcaataccagaaggtcaaagcccagcacgagaaaattatcagtcagcaccaggccgtgatcatcgcgacgcagtccgctcaggtgctcctcgagaagcagggacaatacctgtcacctgaagaaaaagaaaaactccaaaaaaatatgaaggagctgaaagtgcattacgagacagccctggccgaatctgaaaagaaaatgaagttgacacattcccttcaggaagaacttgagaaattcgacgcggactatacagagtttgaacactggctccaacagtccgagcaggaactggagaatctggaagccggagctgatgacattaacggcctgatgactaagctgaagcgccagaagagtttttcggaggatgtgatttcacacaagggagacctccgatatattaccattagtgggaaccgggtcttagaggccgccaagtcttgctcgaaaagggatggggggaaggttgacaccagcgccacgcacagagaagtgcaacgtaaactggaccatgccacagaccgctttcggtcgttgtacagcaagtgcaacgttcttggaaacaaccttaaagaccttgtggataagtatcagcactatgaagatgcttcttgtggattgcttgccggcctgcaagcttgcgaggcaactgcatcaaagcatcttagtgaaccaatcgctgtggacccaaagaacctccagagacaattggaggaaactaaggcgctgcaaggacaaatctcatcccagcaggtggctgtggagaaactgaagaagacggccgaggttctgttggacgcacgcggctccttattgccagccaaaaacgatatacagaagactctagatgacatcgtaggtagatatgaagatctgtcaaagtccgttaatgagcgcaatgaaaagttgcagatcaccctgacaaggtctcttagcgttcaggacggcctcgacgaaatgctcgattggatggggaacgtggagtcttctctgaaggagcaggatgtaggaacaggctattgtaggagcagcgagcagtataagtgtcacgaatag

SEQ ID NO: 186111 - DNA, 22386 bp, Artificial Sequence
  Description of Artificial Sequence: Synthetic coding sequence
atggccggctacctgagccccgccgcctacctgtacgtggaggagcaggagtatctgcaagcatatgaagacgtgctggagagatacaaggatgaacgagacaaggttcagaaaaagacgttcacgaagtggattaatcagcatctaatgaaagtgaggaaacatgttaatgatctctacgaagaccttagagacggacacaacttgatttccctgctcgaagttctcagcggagatactttgcccagggaaaaaggaaggatgaggtttcaccgcctgcagaatgttcaaatagcccttgattatctgaagagacgacaagtcaaactagtgaacatcaggaatgatgacatcaccgatgggaatccgaaactcacactgggacttatttggacgatcattctccatttccaaatttccgacatacatgtgactggtgaaagcgaagatatgagcgctaaggagcgcttactcttgtggacgcagcaggccactgaaggttacgcaggtattaggtgtgaaaatttcaccacgtgttggagagacggtaaacttttcaatgcaataattcacaagtacagaccagatctgatcgacatgaacaccgttgccgtacaaagcaacctagcgaacttggaacacgcattctacgtcgccgaaaagatcggcgtgattcggctccttgatcccgaagacgtggatgtctcctcaccagacgaaaagtcggtgattacctacgtgtctagcttgtatgacgcctttcccaaagtacccgaaggaggagaaggaatcggcgccaacgacgtcgaagtgaagtggatcgagtaccagaatatggtgaactatctcatccagtggattcgccaccacgttacaacaatgtctgaacgaacttttccaaacaaccccgtcgagctgaaagcgctctacaaccagtatctgcagtttaaggaaacagaaatcccccccaaagagaccgagaagtctaaaataaaacgactgtataagctgcttgaaatttggattgagtttgggcggatcaaactcctgcagggataccatcccaacgatatcgagaaagagtggggtaaactgataatagccatgttagagcgggagaaagccctgcggccggaggtggaacggttagagatgctacaacagatagcaaatagagtgcagcgcgactctgtcatatgtgaggacaaactcatcctcgccgggaatgccttgcagtcagattccaagcgcctggagtctggcgtgcaatttcagaatgaagctgagattgccggttacatactcgagtgtgagaacctactgagacaacacgtcatagatgtccagattctgattgatggcaaatattatcaggctgatcagctggtgcagagagttgccaaattacgggacgaaataatggcgctcagaaacgaatgcagtagcgtatatagcaagggccgaattcttacgaccgagcaaaccaagctcatgatttccggcatcacacagagcttgaactcaggctttgctcagacccttcacccatctctcacttctggactcacacagagtctgactccttcactcaccagctcatcgatgacctcaggattgtcgtccggcatgaccagtcggctaaccccctccgtgacgcctgcttacaccccagggtttcctagcggactcgtgcctaacttctctagcggcgtggagccaaactctcttcaaaccctcaaattgatgcagattagaaaaccgctcctaaaaagcagtctgctagaccaaaaccttaccgaggaggaaattaatatgaaatttgtccaggacctgctcaactgggttgacgaaatgcaggtacagctcgaccgcacggaatggggaagcgacctgccatccgtggaatctcatctggagaatcataaaaacgtgcacagggctatcgaggagttcgaatcgtctctgaaggaagcaaagatatctgagatacagatgacagcccctctgaagctgacatacgcagagaagcttcatagactcgaaagccagtatgccaagctgttaaacacctctcgcaatcaggagagacatctcgatacccttcataatttcgtgtcacgtgccaccaacgagcttatctggctaaacgagaaagaggaagaggaagtcgcttatgattggagtgagagaaacactaatattgcccgcaagaaggactaccacgctgagctgatgagagagttagatcagaaagaggaaaacattaaaagcgtgcaggaaattgctgaacagctacttcttgaaaatcatcctgcccggctaacaatcgaagcatacagagcagctatgcaaacacagtggagctggatcctccagctgtgccagtgtgtcgagcagcatatcaaagaaaataccgcatatttcgagttttttaacgatgccaaggaagctactgattacctgaggaacttaaaggacgctattcaacggaagtactcatgtgaccggtcgagctccatccacaagctcgaagacctcgtacaagaaagtatggaggaaaaggaagaattgctgcaatataagtctacgatagcgaatctcatgggcaaggccaagaccatcattcagctgaaacctagaaattccgattgtccacttaaaacaagcatacctatcaaagctatatgtgattacaggcagatagagatcaccatttacaaagacgacgagtgcgtccttgcaaataattctcatcgcgcaaagtggaaggtgattagccccaccgggaatgaagctatggtgcctagcgtctgctttacggtaccaccacccaataaagaggctgtggacctggcaaaccgtattgagcaacagtaccagaatgtactaaccctgtggcacgaatctcatattaatatgaagagtgtggtgtcatggcattaccttatcaatgagatagatcgcattcgggcttcgaatgtggcctccattaaaaccatgctccctggcgagcatcaacaggtccttagtaatctccagtcacggtttgaggactttctagaggactcacaggaatcccaggtattttctggatccgatattacacagctggagaaagaggtgaatgtctgtaagcagtactaccaagagctgttaaagagcgccgagagagaggaacaagaggagagcgtttataacctgtacataagcgaagtaagaaacatcagacttcggctggaaaactgcgaggatcggcttatacggcagatcaggactcctctcgaacgagacgacctgcacgagtcagtctttcgaataaccgagcaggaaaagctgaagaaagagctggaacgcttgaaggacgacctggggacaatcaccaacaaatgcgaggaattctttagtcaagctgccgcttcttcctccgttcctaccctaagaagcgaactgaacgttgttttgcagaacatgaaccaggtttacagtatgagtagcacctatatcgataaactcaaaacggtgaatctcgtgctgaagaatacccaagccgccgaggctttggtgaaattgtacgaaacaaagttatgcgaggaagaggcggtaatcgccgataagaataacatcgagaatctgatcagtacactcaaacagtggcgcagcgaggttgatgagaagcgccaggtttttcacgcactcgaggatgaactccagaaagctaaagccatatctgacgagatgttcaagacgtacaaggagcgagatctggattttgattggcacaaggaaaaggcagaccagctcgtcgagagatggcaaaatgttcacgtccaaatcgataaccggttgcgggatctggaaggtattgggaaatccttgaagtattatagggacacataccatcccttggatgactggatacagcaggtcgagactacccagcgaaagattcaggaaaatcaacctgagaattcaaaaacgctggccacccagctgaatcagcaaaagatgttggtgagcgagatcgagatgaagcagagtaagatggatgagtgtcagaagtacgcagaacagtactctgctacagtgaaggattatgaactgcagactatgacttatcgggctatggtagactcacaacaaaaaagcccggtgaagcggcgccgtatgcagagctccgccgacttgattattcaggagtttatggatctccgcactcggtacaccgctctggtgacactgatgacacaatacatcaaatttgcaggcgattcgcttaagagactggaggaggaagagaagtcactggaagaggaaaagaaagaacacgtcgaaaaggcgaaggagctgcagaaatgggtttccaatatttctaaaacactgaaggacgccgaaaaggctggaaaaccacccttttctaagcagaagatctcttcagaagaaatttccacgaagaaagagcagctgagtgaggcactgcagactatacagctgttccttgccaaacatggagacaagatgaccgacgaggagagaaatgagctggaaaaacaggtgaagactctgcaggagagctataatctcctcttctccgagtctttaaagcagctccaggaatcccagacatcaggcgatgttaaagtggaagaaaagctcgataaggtgatcgccgggacaattgaccagacaaccggagaagtactgagcgtgtttcaggccgttttgagggggttaatcgattatgacaccgggatccgccttctggagacgcagctgatgatctccggcctcattagccctgagcttcggaagtgctttgacttgaaggacgccaaaagccacggtttgatcgacgagcagattctgtgtcagctaaaggagctcagcaaagcaaaggagatcattagcgccgcttcccctactaccattccagtgctcgatgccctcgctcagagtatgatcacagaatccatggccatcaaagtgcttgagatactgctaagtacaggctccctcgtgatacctgctaccggtgagcagctgactctgcagaaagcatttcaacagaacttggtaagcagcgcacttttcagcaaagtccttgagcggcagaatatgtgcaaagacctcattgacccctgtacatcagaaaaagttagtctcatagacatggtgcaacggagcaccctccaggaaaataccggtatgtggctgctaccggtgagaccacaggaaggtgggcgcataactctaaagtgcggcagaaacattagcattctgcgggccgctcacgagggtctcattgatagggagacgatgttccgcctgctgtccgcacagcttctttcggggggcctgattaactctaattcaggacagcgcatgactgtggaggaggcagttcgagagggagtgattgatagggatactgcctcatcgattttgacatatcaggtccagaccggaggaatcatccagagtaatcccgcaaaaagactgactgtggatgaagctgtgcagtgtgacctgatcacctcgtccagtgccctgctggtgttagaggcccagcggggctatgttggactgatatggcctcattccggggagatctttcccactagctcatctctgcagcaggaattgatcaccaatgagctagcctacaagatactgaatggaaggcaaaaaatcgccgctctgtacatccctgagtctagccaggttatcggccttgatgccgcaaagcagctgggaattatcgacaacaacacggcaagcatcctgaagaatattacattgccggataagatgcccgacctgggagacctcgaggcgtgtaaaaacgctaggagatggctgtctttttgcaagtttcagccaagcaccgtgcacgactaccggcaggaggaggacgtgttcgatggcgaagagccagtgacaacacagacttccgaggaaacaaagaagctgttcctgtcgtaccttatgattaactcatatatggacgcgaatactggacagcgcctactgctttatgacggcgacctggatgaggctgtgggaatgctcctggaaggctgccacgccgagttcgacggaaacacagccattaaggagtgtctagacgttctgtccagctctggggtcttccttaataatgcgagcgggagagaaaaggacgaatgcacagccactcccagctcttttaacaaatgccactgcggcgaaccagagcacgaagagacacccgaaaacagaaagtgcgcaatcgacgaagaatttaacgagatgagaaacacagtaattaatagcgagttctctcaatcaggcaagctggccagtaccatctccattgaccccaaagtcaactcatccccaagtgtgtgcgtgccttctcttatcagttatctcacacagacagaactagctgacataagcatgctcaggtcagactctgagaacatcttaacaaattacgagaatcaaagtcgggtggagaccaatgagcgggccaatgagtgtagccattcaaaaaacatccagaattttcccagtgatcttatcgagaatccaatcatgaaatcgaagatgtccaagttttgcggggtgaacgagaccgaaaacgaagacaataccaatagagacagcccgatctttgactacagcccgaggctctctgcacttctgtcccacgataaactgatgcattctcaggggagcttcaatgacacacatactcccgagtccaatgggaataagtgcgaagccccagcattgtctttttcagacaagactatgctgagcggacaacggattggagaaaagttccaggatcaatttttgggaatcgccgccatcaacatatctctcccaggcgagcaatacggccagaagtctttgaatatgatctctagtaatccacaggttcagtaccataacgataaatacatatccaatactagtggcgaggacgagaagacacatcccgggtttcaacagatgcccgaggataaggaggatgaaagcgaaatagaggagtactcctgcgccgttacaccaggaggggacactgacaatgctattgtgagtctcacctgcgccacaccactcttggacgaaactatatctgccagtgattacgaaaccagcctgctcaacgatcagcagaataacactggaacggataccgattccgacgacgacttctatgacacacccctgtttgaggatgatgaccatgacagtcttctgctggacggagatgatagggactgtttgcaccccgaggattatgacacccttcaagaggagaacgacgagacagcatcacccgcagacgtcttttatgatgtgagtaaagagaacgaaaatagcatggtccctcagggcgctcccgtgggcagtctctcagtgaaaaacaaagcccattgcctgcaggacttcctgatggacgtcgaaaaagacgagctggactcgggtgagaaaatccatctaaaccccgtgggtagcgataaggtaaacgggcagtcactggagaccggtagtgaacgcgaatgtacgaatatccttgagggtgatgaaagtgatagccttaccgattatgacattgttggaggtaaggaaagcttcacagcgtcccttaagtttgatgacagcgggagttggcggggacgaaaggaagagtatgtgactggccaggaattccattctgacaccgaccaccttgactcaatgcagtctgaggaatcatatggcgactacatttatgattctaatgatcaggacgatgatgatgatgacgggatcgatgaggagggcggcgggatacgtgacgagaacggaaagcctaggtgtcagaacgtggcagaagacatggatatccagctatgtgctagcatcctgaatgaaaattcagatgaaaacgaaaacattaatactatgatcctgctggataaaatgcacagctgcagctccctcgaaaaacagcagcgggtgaacgtggttcaattggcaagtccatccgaaaataaccttgtcaccgaaaagtctaatctgccagaatatactaccgaaattgccggcaaatctaaggaaaacctccttaatcacgagatggtgctcaaggacgtgctgccccctatcattaaagataccgagagtgaaaagacattcggtccggcctccatctctcatgataataataacattagtagcacatccgagctgggaaccgacttagccaacacgaaagtgaaactaattcagggctccgagctccctgaattgacagatagcgtgaagggcaaggatgagtacttcaaaaatatgacacccaaggtggacagtagtctcgatcacatcatctgcactgagcccgacctgatcggcaagcctgcggaagagtctcacctgtctcttatcgcctccgtgacggataaggaccctcagggaaacggctcagatctgatcaaaggacgcgatggaaaaagtgatatccttatcgaggacgagacatccatccagaagatgtacctgggtgaaggagaagtcctggtggagggactggtggaagaagagaaccggcatttgaaactgctgcctggtaagaataccagggatagctttaagctaattaacagtcagttcccgttcccacagatcacaaacaatgaagagctgaatcagaaagggagcctgaagaaagcaaccgtcacattgaaagatgagccaaataatctccagattatagtgtccaagtcccctgtgcagttcgaaaatctggaggagatcttcgacacaagcgtgtccaaggagatttccgacgatatcactagcgacatcacctcctgggaggggaacacccatttcgaggagtccttcaccgatggacctgaaaaagagctagatctgtttacatatctaaagcactgcgcgaagaacatcaaagctaaagatgtggctaaaccgaacgaggacgtaccttcgcacgttctgattacggctcctcccatgaaggagcacctgcagctaggggtcaataatacaaaggaaaaaagtacctctacccagaaggatagccctctgaacgatatgatccagagtaatgacctttgctctaaagagtccatctctggcggagggactgaaatctctcagtttacacccgaaagcatcgaggccaccttatcgatcctaagccgcaagcatgtcgaggatgtgggaaaaaacgacttccttcaatccgaaaggtgcgctaacggcctgggcaacgacaactcctccaatactctgaacacagattattcgttcctggaaatcaacaataaaaaggaaagaattgagcagcagctgcccaaggagcaggccctttcaccaaggtcacaagaaaaggaggtccagatccctgaactctcccaggtgttcgttgaggatgtgaaagatattctgaagagcaggcttaaagaggggcacatgaatccccaggaagtggaagaaccctccgcgtgtgcggatacaaagatcctgatccaaaacttgatcaaaaggatcactacaagccaactggttaatgaggcctctactgtaccctcggattcacagatgtccgactcatccggggtctctcccatgactaatagctctgaattgaaacctgagtctcgagatgatcccttttgtattggcaacctgaagagcgagctacttttgaatatcttaaaacaagaccagcacagccagaagataacaggcgtcttcgaactgatgagggaactgacacatatggaatatgacctcgagaaaagagggataacttccaaggtcctcccactgcaacttgagaatattttctataagctgctggccgacggatacagcgagaaaatcgaacatgttggcgacttcaatcagaaggcctgcagcacaagtgaaatgatggaggaaaaaccacacatacttggagacattaagtctaaagaaggtaactattacagcccaaatctggagacagttaaggagatcggactagagagtagcacagtgtgggcttcaacgctccctagagatgagaaactgaaggacttgtgtaacgattttccatcccatttggaatgtaccagtgggtcaaaagaaatggcttccggcgatagctcgacagaacagttctctagcgaactacagcagtgcctgcagcacactgagaagatgcatgagtatcttaccttactgcaggacatgaagccgcctctggacaaccaagagagcctggataacaacctggaggctctgaaaaatcagcttaggcagctggagaccttcgagctgggactcgcacctattgcagtcatcctgaggaaggacatgaagttggccgaggagttcctcaagtccttgccatctgacttcccaagggggcacgtggaggaattaagtatttctcaccagtcactgaaaaccgcattctctagtctgagtaacgtgtcaagcgaaagaacaaagcaaatcatgctggctatcgatagcgagatgagtaagttggccgtaagccacgaggaattcttgcacaagcttaaatccttcagcgactgggtgagcgagaagagcaaaagcgtcaaagacatagaaatcgtgaacgttcaggacagcgaatacgtgaagaagcggctagaattcttgaaaaacgtactcaaagacctgggtcataccaagatgcagcttgagaccaccgctttcgacgtacagtttttcatctcagagtacgcacaggacctgagtccaaaccagagcaagcaactactgcggctcctaaatactactcagaaatgtttccttgacgtacaagaaagtgtgacaacccaggtagagagactcgagacacagctccaccttgaacaggacctcgacgatcagaaaatcgttgctgaacgccagcaggagtataaagaaaaactgcagggcatatgcgatctgctgacgcagacagagaaccgactcatcggccaccaggaggcatttatgatcggcgatggtaccgtggaactgaagaagtaccagtctaagcaagaggagctgcagaaagacatgcagggatctgcccaggccctggccgaagttgtaaaaaataccgagaacttcctcaaggagaatggggagaagctgtctcaggaggacaaggccttgatcgaacagaagctgaatgaagccaaaataaagtgtgagcaattaaacctcaaggcagaacagtccaaaaaggagctggacaaagttgtgaccacagcaattaaggaggaaacagaaaaggtagcggcagtcaaacaactagaagagtctaagaccaagatcgaaaacctactcgactggctctccaacgtggacaaggactcagaacgggctggcaccaagcacaagcaagtcatcgagcaaaacggaacacatttccaggaaggcgatggcaagtccgccatcggcgaggaggacgaagtaaatggtaatttactcgaaacagatgtggacggccaagttggcacaactcaggagaatctaaatcagcagtaccagaaggtcaaggcccagcatgaaaagataatcagtcagcaccaggccgtgattatagccacgcagtcagcacaggtgttgctcgaaaagcagggacaatacctgtcacctgaagagaaggaaaaactgcagaagaatatgaaagaattaaaggtgcactatgaaaccgccctggctgagagcgaaaagaaaatgaagctgactcactcacttcaggaggagctcgagaaatttgacgcagattatactgagttcgagcattggcttcaacagtcagaacaggagctcgaaaacctggaggctggagctgatgacatcaacgggttaatgactaaattaaagcgccagaaaagtttttccgaggatgttatatcccacaagggagatctgaggtatattaccatttcaggcaaccgagtgctggaagctgccaagagttgttctaaacgtgatggggggaaagtggacacttcagctacacaccgagaagtgcagaggaagctcgatcatgctactgatagatttcggagtctctactccaagtgcaacgtgttggggaataatctgaaggatctggttgacaagtaccagcattacgaggatgcatcttgtggactgctggccggcctgcaagcttgtgaggccacggcaagtaagcatctgtcagagccaatcgcagtcgatccaaagaacctgcagcgtcagcttgaggagacgaaagccctgcagggacagatctccagccaacaggtcgcagtcgagaagctgaagaaaacagccgaagtgcttttggatgccaggggcagccttctcccagccaagaacgacattcagaagactttggatgacatcgttggccggtacgaagacctaagcaagtccgtcaacgagcgtaacgagaaacttcagatcaccttgactagatctctgagcgtccaggatggtctcgacgagatgcttgactggatggggaatgtggagtcttccctgaaggagcaggggcaggtcccgttgaacagcactgcattacaggacataatatctaaaaacatcatgctggaacaggacattgccggcaggcaaagctcgattaacgcaatgaatgagaaggtcaaaaagttcatggaaacgacagatccaagcacagcaagttcacttcaggccaagatgaaggatctcagtgccaggttctctgaagcgtcacataaacataaggaaacactggctaagatggaggagttgaagactaaggttgagctattcgaaaatctgtctgagaaattacagacgtttcttgaaacaaagacccaggcattaactgaggtagatgttccagggaaagatgtcacagagctgtctcaatacatgcaggagtcaacctccgaattccttgagcataaaaaacacctcgaagtcctgcactccctgctcaaagaaattagctcccatggacttcccagcgacaaagcgctggtccttgagaaaacaaacaatctctcgaagaagttcaaggaaatggaggacaccataaaggaaaaaaaggaagcggttacgagctgccaggaacagttggacgccttccaggtgcttgtgaagagcttgaagtcatggattaaggagactacaaaaaaggttcccattgtccagcctagtttcggcgccgaagaccttggtaagagtctggaggacaccaaaaagctgcaggagaagtggtctctcaagaccccggaaatccaaaaagtaaacaactccggcattagtctgtgtaatctgatttctgccgtcacgacgccagcaaaggcaattgcagctgtcaagtccggtggggccgtactgaacggagaaggaaccgcaaccaataccgaggagttctgggccaacaagggactcactagtatcaaaaaggatatgactgacatctcgcacggctatgaagatcttggacttcttctcaaggacaaaatagcggaattaaatacgaagctttctaagcttcagaaagcccaggaggagtcatccgcaatgatgcaatggctccaaaaaatgaataagacggcaaccaaatggcagcagactcccgccccaaccgacactgaggccgtgaagacccaggtggagcagaacaagtcattcgaggctgagttaaagcagaatgtgaacaaagtccaggagctgaaagacaagctcacagaactgttggaggagaaccctgatacacctgaagcccctagatggaagcagatgcttaccgagattgactctaaatggcaagagctgaatcagcttacaattgatcgccagcaaaaactggaagagagtagcaacaaccttacgcagttccaaacagtggaggctcaactgaagcaatggcttgtggagaaggagctgatggtgagcgtgcttgggcctctttctatcgacccgaatatgcttaacacacaacgccagcaggtacagattctgctacaggaattcgcgacccgtaaaccccagtatgaacaactaacggcagctgggcagggcatcttgagccgccccggtgaggaccccagtctgcggggtattgtgaaggaacagttggctgccgttacacaaaaatgggatagtctcacaggtcagctgtcagatcggtgtgactggatagatcaggcgattgtgaaaagtacacagtaccagagcctgttgcgcagtttaagcgacaaactgtccgacctggataacaaactgtcttctagcctggccgtttctactcaccccgacgctatgaaccagcaactcgaaactgctcaaaaaatgaagcaggagatccagcaggagaagaagcagattaaggtggcccaagcattgtgtgaagacttgagcgccttggtgaaagaagaataccttaaggccgaactttcaagacaactcgagggcatcctaaaatctttcaaagacgtggagcaaaaggccgagaaccatgtgcaacatctccaatctgcatgtgcgtcgagtcaccagtttcagcagatgtccagggattttcaggcttggctggatactaaaaaagaagaacagaataaaagtcacccgattagtgcaaagttggatgttctggagagccttatcaaagaccataaggatttctccaagactctcactgcccaaagccatatgtacgaaaagaccattgcagaaggagaaaacctcttgcttaagacccagggctccgaaaaggccgcactgcaattacagctgaacaccattaagacaaattgggacaccttcaacaagcaagtgaaggaacgagagaacaagctgaaagaatccctcgaaaaagccctgaagtacaaagagcaagtagagactctctggccgtggatcgacaagtgccagaacaacctggaggaaatcaagttctgcttggatcccgctgagggcgaaaacagcattgctaagctgaaatcccttcagaaagagatggaccagcacttcggcatggtagagctccttaataatacagcgaacagtcttctgtccgtatgcgaaatcgacaaggaagtggtcacagacgaaaataagtctctgatccaaaaggtggatatggtcactgagcagctgcattccaaaaagttttgcctggagaatatgacgcagaaatttaaggaatttcaggaagtgtccaaggaatcaaaacgccagcttcagtgcgccaaggaacagctggatattcacgacagcctcggctctcaggcatactccaataaatacctgaccatgctacagacccagcaaaaaagcttgcaggccttgaaacaccaggtggacctcgctaaacggctggcacaggaccttgttgtggaggccagtgatagtaaagggacctccgatgtactgctccaggtagaaaccattgctcaggagcattcaacgctgtctcagcaggtcgacgagaaatgctctttcctggagaccaagttacaaggcattggacatttccagaacaccatccgtgagatgttttctcagttcgctgagtttgatgacgagctcgattccatggcccctgttggacgggacgctgaaacccttcagaagcaaaaagagaccatcaaagcttttttaaagaagctggaggcactcatggccagcaatgacaacgctaataaaacctgcaagatgatgttagctactgaggaaacctctcctgacctggtaggcatcaaacgcgacctcgaggctctttctaagcagtgcaataagttgttggatagagcccaggcccgtgaagaacaggtggaagggaccattaagaggttagaagaattctactccaagctcaaggagttctcaatccttctgcagaaagccgaagaacatgaagagagccagggacccgtcgggatggaaacagagaccattaaccagcagctcaacatgtttaaggtgttccagaaggaagaaatcgaacccctgcagggaaaacagcaagacgtgaattggctggggcaggggctcattcagtccgccgccaaaagtacttccacccaaggactcgagcacgacctcgatgacgtgaatgcacggtggaagacattgaataagaaggtggcccaacgagcagcccagttgcaggaagctctactgcactgcggtagatttcaagatgcactagaatcactgttatcttggatggtggacactgaggaactggtggccaaccagaaacccccttcagcagagttcaaagtggtcaaagcgcagatccaggaacaaaagttactgcagaggcttttagacgataggaaaagcacggtggaagtgataaagcgcgaaggtgaaaaaatcgccactacggccgaaccggcagacaaagtcaaaatactaaagcagttgtcattgttggactcccgctgggaggcactcctgaacaaagcagaaacccgcaacagacagctggagggcatctctgttgtcgcccagcagtttcatgagacactcgaacctttgaatgagtggctgacaaccattgaaaaaaggctggtcaattgcgaaccgattggcacacaggctagcaagcttgaggagcagattgctcagcacaaggtcctgcaggaggatattcttcttcggaaacaaaacgtcgatcaggcccttcttaacgggctggagctcctaaagcaaaccacgggagacgaagtactgataattcaggacaaactggaagccattaaggcccgatacaaggacattaccaagctgagcacagacgttgctaagaccttggaacaggcgctacagctcgcaaggcgactgcacagcacgcatgaggagctctgcacttggctggacaaggtcgaagtggaactgctaagctatgaaactcaggttcttaagggcgaagaggcttcacaggcccagatgcgtcctaaagaactcaagaaagaggccaagaataataaggctttattggacagcctgaatgaggtgagctcagccctcctggagttggtcccttggcgcgcaagagaaggtctcgaaaagatggtcgcggaggataatgaaaggtataggcttgtgtccgacaccatcacccagaaagtcgaagaaatcgacgccgcaatcctacggtctcagcagtttgaccaggcagccgacgccgaactcagttggatcactgagacagagaagaaactgatgagtctgggcgatatccgtctggagcaagatcagacatccgctcagctccaggtgcagaagacttttaccatggagatactgaggcataaggatatcatcgatgatctggtgaagagcgggcacaaaattatgacggcatgcagcgaggaggaaaaacagagtatgaaaaagaaactcgataaggttctaaagaattacgacactatttgtcagattaattcagaacggtatctccaattagaacgcgctcagtcactggtcaaccaattttgggaaacttatgaggagctttggccatggttgacggagacacagtcaatcatctctcagctgcccgcacctgcgcttgaatacgagacactgcgccaacagcaggaggagcataggcagctgagagagctgattgctgaacacaagccgcacatagacaaaatgaacaaaacgggaccccagctcctggaactttcccccggtgaaggctttagtatccaagaaaaatatgtggcagctgatactctctactctcaaattaaagaggacgtgaagaagagggccgtggctcttgacgaagctatctcccaatctacacagtttcatgacaaaatcgatcaaatactggagtctcttgagcgaatcgttgagcgactcagacaacccccttccatctctgcagaggtggagaagatcaaagaacagatttcagagaacaagaatgtctccgtagatatggagaaacttcagcctttgtacgagacgctgaaacagcggggagaggagatgatcgctcgtagcggcgggaccgacaaagatatctcggccaaggccgttcaagacaagttagatcagatggtgttcatttgggagaacatacataccctagtagaggaaagagaagctaagctgctggacgtgatggagcttgctgaaaagttttggtgcgaccacatgtctcttatcgttactattaaggatacccaggacttcatccgggacttggaggatcctggaatcgacccttccgtagtaaagcaacagcaggaagccgcagagactatcagagaagagatcgacggtctgcaggaggagctggacatcgtcataaatctggggtcggagctcatcgctgcttgcggcgagcctgataagcctatcgttaagaagtccatcgatgagttgaatagtgcctgggactccctcaataaggcctggaaggataggatagacaaactagaagaggctatgcaggccgccgtccaataccaggacggattgcaggccgtcttcgactgggtagacattgccggagggaagctggcttcgatgagtcctattggtactgacctggaaacggtgaagcagcagattgaggaattaaaacagttcaaatccgaggcctaccagcagcagatcgagatggagcgcctcaatcatcaggctgaattacttctgaagaaagtgactgaggagagcgacaagcacacggtccaggacccacttatggaactgaagctgatctgggacagcctagaggaaaggatcataaatagacagcacaaattagagggggccttgcttgcactgggccagtttcagcacgcgctggatgagctcctcgcttggttgacccatactgagggtttgctctctgagcaaaaaccagtggggggggatcccaaagctatagagatcgagttagctaagcaccacgtcctgcagaacgatgtacttgcacaccaatctaccgtggaagccgttaacaaggctggcaatgatctgattgaatcgtccgcaggggaggaggcttccaaccttcagaataagttagaagtgctgaaccagaggtggcaaaacgtgcttgagaaaactgagcagagaaagcaacagctggacggagctttgcgacaagccaagggcttccatggagagatcgaggacctacagcagtggctgactgacactgaacggcatcttctggcttcaaaacctcttggaggtctgcccgagacagcaaaggaacagctgaatgtccacatggaggtttgtgctgccttcgaagccaaggaggagacctacaagagcctgatgcagaagggtcagcagatgcttgcccggtgccccaagagcgctgaaacgaatattgaccaggatatcaacaacctgaaggaaaaatgggagagtgtggaaactaagttaaatgaaaggaagactaagctggaggaagctttaaatttggcaatggaattccataacagcttgcaggattttatcaactggctcacccaggcagagcagaccctaaatgtcgcaagtaggccgtcattgattttggatacagtgctcttccaaattgatgaacacaaggtgttcgccaacgaggtcaactctcaccgggaacagattatagaacttgacaagaccgggacacatttgaaatacttttcccaaaaacaggatgtggtactgattaagaatctgctgatatctgtgcagagccgctgggaaaaggtggtgcagcggctcgttgagagggggcgatcactggacgatgctagaaaaagggccaaacagtttcatgaagcatggtcaaaattgatggaatggttagaagaaagcgaaaaaagtctagattcagagctggagatagcaaatgaccccgacaaaataaagacacagctggcacagcataaggaattccaaaagagcctgggggccaaacacagcgtgtatgacacaactaaccgcactggacgatcactgaaggaaaaaacatcgcttgcggacgacaatctcaagctcgacgatatgctcagcgaactgagggataaatgggacactatttgcggcaagagtgtagagagacaaaacaagctcgaggaggcccttctttttagtggtcagttcacagacgcattgcaagctcttatcgattggttataccgcgttgagccacagctcgcagaggaccaaccagtacatggtgatatcgatctggtgatgaatctgattgacaatcacaaagcattccagaaggagctgggcaaacggacatcctcagttcaagccctgaaaaggagcgcaagggaactgatcgaaggctctcgcgatgacagtagctgggtaaaggtgcagatgcaggagctcagcacccggtgggaaactgtatgcgctctgtcaatcagcaaacagacacgcctggaggcagctttgcgccaagctgaggagttccactctgttgtgcatgcccttttagaatggctggcagaggccgagcagactttgagattccatggcgtgctaccggacgacgaggacgcgctccggactttgattgaccagcataaggagttcatgaaaaaactcgaagaaaagcgcgccgagctcaataaagccaccaccatgggggacaccgttctcgctatctgccacccagatagtataacaacaataaagcattggattaccattattagggcccggttcgaagaagtactggcttgggcaaagcagcaccagcagcgactggccagtgccctggctgggctaatagctaaacaggaactgctcgaagcgttgctagcatggctgcaatgggccgagactaccctcactgataaagataaagaggtcatccctcaggagattgaagaggttaaagccctcatagcagaacaccaaaccttcatggaggaaatgaccaggaagcaacctgacgtggataaagtgacgaaaacctacaagcgtcgcgctgctgatccatccagtctgcaaagccacattccagtcctggataagggccgcgctggacgcaagcggtttcccgcctcgtctttgtacccctctggctctcagacacagatcgaaactaaaaatccccgggtcaatctgttggtttccaagtggcagcaggtgtggctcctggccctggaacgacgacgcaagttgaatgacgctcttgatagactcgaggaattgcgtgagtttgcaaactttgactttgacatttggaggaagaaatacatgaggtggatgaaccacaagaaatcgagagttatggacttctttcgccggattgacaaggatcaagatggaaaaataactagacaggagtttatagatggtatcttatcctcaaaatttcccacatctagacttgagatgagcgccgtggcagatatcttcgatagggatggagacggctacatcgattactacgagtttgtagcggctctacacccgaataaagatgcttacaaaccgattactgacgctgacaaaattgaggacgaagtgacacggcaggtagcaaaatgtaagtgcgcaaagcgattccaagtagagcagattggtgacaataagtataggttctttctgggaaaccagttcggtgactcgcagcagttacggctggtgagaatactgcggagtactgtgatggtcagagtgggcgggggctggatggccctcgatgaattccttgtgaagaatgacccttgtagggttcatcaccacggctctaagatgctgaggagcgaatcaaattcctcaatcacaacaactcagcccactatagctaaggggaggactaacatggaattgagagagaaattcatcctggccgacggcgcttcgcagggaatggctgccttcaggccgcggggtcgccggtccagaccttccagccgaggcgctagtcccaacagatcaacttcagtcagcagccaagccgcccaagctgccagtccccaagtccctgcaactactacgcctaaagggactccaatccagggctcgaaactgaggttacctgggtatctctccgggaagggattccactccggcgaggactccgggcttattaccacagctgccgctagagtgaggacacagtttgccgacagtaagaagactccatcgaggcccggctctcgtgcagggtctaaggcagggtcccgggcaagttctagacggggttccgacgcctcagacttcgatattagtgagatccagtccgtttgcagcgacgttgaaaccgtcccacagacacatcgtccgaccccccgcgcaggatccagaccttccactgccaagcctagtaaaatccccaccccccaacgcaagtccccggccagtaaactggacaagtcgtccaaacggtag

SEQ ID NO: 186112 - DNA, 23253 bp, Artificial Sequence
  Description of Artificial Sequence: Synthetic coding sequence
atgatcgccgccgccttcctggtgctgctgcggccctacagcatccagtgcgctctgttcctgctgctccttctgctgggaaccatcgccacaatcgttttcttctgctgctggcaccgtaaattgcagaagggacgccatcccatgaaaagcgttttttcaggacgaagtcgaagccgcgacgcagtcctgaggtcccatcatttccgatccgagggctttcgggccagcccccgccacttgagaaggagagtcgcagcagcagctgccgcgaggcttgaggaagtcaagccagtcgttgaggtgcaccatcaaagtgaacaagagacctccgtgcgaaagagacgtatcaagaagtcatctagagtccagcctgaattttaccactccgtgcagggcgcttccatccgccgaccctcatcgggcaacgctagctatcggtgtagtatgagctcatcagcagatttctccgacgaagacgacttctctcaaaagagcggaagcgcttcccccgccccaggtgacacacttccatggaatcttcctaagcatgaaaggagcaaaaggaagattcaggggggctctgtcctggaccccgcggagcgcgccgtcctgaggatcgctgacgagagggacaaggtgcaaaagaagacctttaccaaatggatcaaccagcatttgatgaaagtgagaaaacacgtgaatgatctatatgaagacctcagagatggccacaatcttataagcctgttggaggtactctctggtgataccttaccccgggaaaaaggacgcatgagattccaccgcctgcagaatgtgcagatagccctcgactacctgaagaggcggcaggtaaaattagtgaatatccgcaacgacgatatcacagatggaaaccccaaactgaccttaggattgatctggacaatcattctccactttcagatctcagatatccacgtgacgggggagagtgaagatatgtccgctaaggagagactactgctgtggacacagcaggctactgagggttatgccggaatccgctgtgagaatttcaccacatgttggcgcgatggcaagctctttaacgccatcattcacaaatatagacccgacctaatcgacatgaacaccgtggcggtgcagtctaatctggctaacctcgagcacgcgttctacgtggcggagaagatcggggtgattaggctgctggatccagaagatgtggacgtgagcagcccagatgagaaatcagttataacttacgttagcagtctctacgatgcctttccgaaggttcctgagggaggtgagggcattggggccaatgacgtggaagtaaaatggatcgagtatcaaaatatggtcaactatcttatccaatggatcagacatcatgttaccacaatgtccgaacgtacctttcctaataatcccgtggagttgaaagctctgtataatcagtacttgcagttcaaggaaactgagatccccccaaaggagacagagaagtccaaaataaagcgcctatacaagcttttagagatttggatcgagttcgggagaatcaagcttctccaaggctaccacccaaacgacatcgaaaaagagtggggtaaactaatcattgccatgctggagcgtgagaaagctctgcgacctgaggtggaacggctcgagatgctccaacagatagcgaatagagtgcagagagatagtgtgatatgcgaagataagctcatcctagcaggcaacgctttacaatcagatagcaagcgtcttgaatctggagtgcaatttcagaacgaggcagagattgcaggatatatacttgagtgtgagaacctgctgcgccagcacgtcattgacgtgcaaatccttatcgatggcaaatactaccaggcagaccaactggtgcaacgagtcgccaagttgagggatgaaattatggcactcagaaatgagtgctcatccgtgtatagcaaagggcggattctgacaacagagcagaccaagctcatgataagtggtatcacacaaagcctgaacagcggctttgcccagacattgcatccatctttgacctcagggctgactcagtccctcactcctagcctcaccagctctagcatgacttccggactgagcagcggtatgaccagcaggctgactccctccgtgactccagcctacacaccagggtttccatctgggctagtccccaatttctcaagcggagtggagcccaattctctgcagactcttaagcttatgcaaattcgcaagccccttctcaagtcctcacttctggatcagaacctaacagaggaagaaatcaacatgaagttcgtccaggatcttctcaattgggttgacgagatgcaagtccagctagatcgtactgagtggggatctgatcttcccagtgtggagtcacacttggagaaccataaaaacgtgcaccgcgccattgaagagtttgagtctagtctgaaggaagccaaaataagtgaaatacagatgaccgctcccctgaaactgacttacgccgagaagctgcatcggctcgagagccagtacgccaagctgctgaataccagcagaaatcaggaacgacatcttgacaccctgcataatttcgtgagccgtgccacaaatgagctaatttggcttaacgaaaaggaagaggaggaggtggcctatgactggtcagagcgcaatactaacatagccagaaagaaggactatcacgccgagctgatgagagagctagatcagaaggaagagaacataaagtctgtccaagagatagccgagcaactgttgctggagaaccatccggccagattgacgatcgaagcctaccgcgcggcaatgcagacacagtggtcttggatcctgcagctgtgtcagtgtgtagaacagcatatcaaagagaacactgcatatttcgagttcttcaatgatgccaaagaggctacagattacctgagaaacctgaaggatgctattcagcgcaaatattcatgtgatcgctcctcttctatccacaagcttgaggatctggtgcaggaaagcatggaagaaaaggaggaacttttgcagtataaaagtacaatcgccaatcttatgggcaaggccaaaacaattatccaactgaagccccgcaactccgattgccccctaaaaactagcatacccatcaaagccatttgcgactatagacagattgaaatcaccatatataaagacgacgagtgcgtgttagctaacaacagccaccgagctaagtggaaggtcattagtcccactggtaacgaagccatggtcccttccgtgtgctttacagtcccacctcccaacaaagaagcggtggatcttgctaacaggattgagcagcagtaccagaacgtgctgactctctggcacgaatcacatatcaatatgaagtccgtggtgtcttggcactacctaatcaacgagatcgataggattcgggctagcaacgtggcaagtatcaagacaatgctgcctggcgagcaccagcaggtactcagtaacctgcagtctcggttcgaagattttttagaggattcacaggaatcccaggttttttcaggctctgacatcactcagctcgagaaggaagtgaacgtgtgcaagcagtactaccaggaactactgaagtccgcagaacgagaggaacaagaggagagtgtctacaacctgtacatcagcgaagttagaaacatcaggctcagacttgagaattgtgaggaccgtctaattagacagatcagaactcctctggagagggatgatttgcacgagtcggtctttaggatcacagagcaggagaagcttaagaaggagctggagcgactgaaggatgacctggggactattacaaataagtgtgaggagttcttttcgcaggctgcggccagctcttccgttcccacccttcgttctgaactgaatgtggtattgcagaatatgaatcaggtctatagtatgtcttccacttacatcgataagctgaaaaccgtgaacttagtcttgaagaatacccaagctgctgaagcgttggtcaagctgtatgaaaccaagctctgcgaagaggaagccgttatagcggacaaaaataacatcgagaatctgataagcactctgaagcaatggcggagcgaagtggacgagaaaagacaggtgtttcacgccctggaagatgagctacagaaggccaaagcaatttcagacgaaatgttcaagacctacaaggagcgtgacttagacttcgattggcataaagaaaaggccgatcagctcgtcgagaggtggcaaaatgtacacgtgcaaatagataacagactgcgcgatcttgaggggattggaaaatcgctgaaatactacagggacacttaccaccccctagacgactggatccagcaggtggagacaacacagagaaaaattcaagagaaccagccggagaattctaagacgctggctactcagctcaatcagcaaaaaatgttagtttccgagatcgaaatgaagcagagtaagatggatgagtgccagaagtacgcggaacaatactcagctactgtgaaagactacgagctgcaaacaatgacatacagagcgatggttgattcacaacagaaaagcccagtgaaaagaaggaggatgcagtccagtgctgaccttatcatacaggaattcatggatttacgcactcgatacaccgcacttgtcactctcatgacacagtacattaagtttgctggagactcgttaaaacgcctggaagaggaagaaaaaagcctggaagaggagaagaaagaacacgtggaaaaagcaaaggagctgcagaagtgggtgtccaatattagcaagacgttaaaggatgctgagaaagcaggaaaacctccattttctaagcagaaaataagtagcgaagaaatttccaccaagaaagagcagctgtccgaggcactgcaaacaatccagctgttcttggctaagcacggtgataaaatgacagatgaggagcgaaatgagttggaaaaacaggtgaagactctgcaggaatcatataatttacttttttcagaaagcctcaagcaactccaagaatcacagacaagtggcgacgtgaaagttgaagagaaactcgacaaggttattgcgggcacaattgatcagaccacaggtgaagtgctgtccgtgttccaggccgtgctgaggggattgatagattacgacaccggcattagattgttggaaacacaactgatgatctccggactcatctctcccgagctacggaaatgctttgacttgaaggatgcaaaatcccatggcctaattgatgaacagatcctctgccaattaaaggaactaagtaaagctaaagaaatcatctccgccgcctctccaaccacaattccggtcctggatgccttggctcagtctatgatcacagagtccatggcgattaaagtactcgagatactattgagcacgggcagtctggttataccagccactggagaacagctgacgctgcagaaagcctttcagcagaatctggtcagctcagccttattcagtaaagtgcttgaaaggcagaatatgtgtaaagatcttatcgatccttgtactagcgagaaagtgtccctcatagacatggtccaacgttctacactacaggagaatactggcatgtggctgctgccagtgaggcctcaggaggggggaagaatcactctgaaatgcggtaggaacatcagtatcttacgggccgcacacgagggacttatagatcgcgaaacgatgtttcgtcttctgtctgctcagctgctctccgggggactaataaactctaactccggccagagaatgactgtggaagaggcagtccgggaaggtgtcatcgatcgcgacaccgcttcatctatattgacataccaggtgcagacaggcggcattatacagtccaatccagccaagaggttaacggtggacgaggcagtccaatgcgacctgatcacatcgtcttcggctttacttgtgctagaagcccagagaggctacgtgggcctgatctggccccattccggcgaaatatttcccacaagtagtagcctccagcaagagctgattacaaatgaattggcttacaaaatcctgaacggtcgacaaaaaattgccgccctatacattcctgaatcctcacaggtgatagggctggatgcagctaaacagctgggcatcatagacaacaacactgcttctattctgaaaaatataacgttaccagataagatgccagacctgggggatctggaagcctgtaaaaacgcccgcagatggctatcattttgcaaattccagccaagcacagtccatgactatcgtcaggaggaggacgtgtttgacggagaggaacctgttacaacgcagactagtgaggagacgaaaaaattattcctttcgtacctcatgatcaatagctacatggacgccaacaccggccaacgattactcctctacgacggagatttggatgaagctgtcggcatgcttctggagggctgtcacgccgagtttgacggaaatacagccattaaagaatgtctggacgtactatcaagctctggcgtgttccttaacaacgcctctgggcgtgaaaaagacgaatgcacagccacgccttccagtttcaataaatgtcactgcggggagcccgagcacgaggaaactcctgaaaacaggaaatgtgctatcgatgaagagtttaatgagatgcgaaacacggtcatcaactctgagtttagtcaatcaggtaagctggcctcaacaatcagtattgaccccaaggttaacagttctcccagcgtgtgtgttccttctcttatatcgtacctaactcagaccgaacttgctgatatctctatgctgcgatcagacagcgagaacatactcaccaattacgagaatcaaagccgagtagaaacaaatgagcgagctaacgaatgcagtcatagtaagaatatccagaattttccttcagatctgatagaaaaccccatcatgaagtccaagatgtcaaaattttgtggggttaatgagaccgaaaatgaggataataccaatagggacagtccaatcttcgactattccccacgtctcagtgctctactgagccacgataaattaatgcactcccaagggtcttttaacgacacccataccccagagtctaatgggaataagtgcgaggcccctgccctgagcttttccgataagacgatgctctccggccaaaggataggtgaaaaatttcaggatcagttcctcgggatcgccgcaattaatatctcacttcctggcgaacagtatggccagaaatctcttaacatgataagtagtaatcctcaagtgcagtaccataacgacaaatacatcagtaacacgtcaggcgaagatgagaagacgcatccagggttccagcagatgcctgaggataaggaggatgagtcagagattgaagaatattcctgtgcagttacccccggaggtgacaccgacaatgccattgtgagtcttacatgcgccactcctctcctcgacgagaccatctctgccagtgactacgagacaagcctgctcaacgaccagcaaaacaacacaggaactgataccgattctgacgatgacttttacgatacacctctgttcgaggacgacgaccacgattctctgttactagacggagacgaccgcgattgcctccatcctgaggactacgacacattgcaagaagaaaacgatgagaccgcaagtccagcggatgtattttacgacgtttcgaaggagaatgagaactcaatggtaccccaaggggctccggtgggttctctgagcgtgaaaaataaggcccactgtctccaagacttcctgatggatgtggaaaaagacgagctggatagtggcgaaaagatccatctcaaccccgtgggttcagataaagtgaatgggcagtccctggaaacaggtagtgaacgcgagtgcacaaatatattggagggcgatgagtcggattccttgacggattacgatatagtggggggaaaagaatcctttacagccagtcttaagtttgacgattctggtagctggcggggcaggaaggaggaatatgtgactggccaggaattccacagcgacactgaccacctggattctatgcagtcggaggagagctacggtgactatatatacgatagtaatgaccaagatgatgatgacgatgatgggattgatgaggagggaggcggaattagggacgagaacggtaaacctagatgtcagaatgttgcggaagatatggacatccaattgtgtgcctccattctcaacgagaatagtgatgagaacgagaacatcaatactatgatcctcctggacaagatgcactcttgctccagtcttgaaaaacagcagcgcgtgaacgtggtgcagttggcttctccctcagagaacaatttagttactgaaaaatctaacctgcccgagtatacaaccgaaatagccggcaagtctaaagaaaacttgttaaatcacgaaatggtgctgaaggatgtgttgcctccaatcataaaggacacagagagcgaaaaaaccttcggtccagcatcgatctcccacgacaacaataacatatcttcaaccagcgagctgggtaccgatctcgccaacacgaaagttaagctcattcaggggagtgaactgcctgagctgacagattccgtgaagggaaaggatgagtatttcaagaatatgactcctaaggtcgattcatcgctggatcacatcatctgtactgagcccgacctgattgggaagccagcagaagagagccacctgagcttgatcgcgagcgtgaccgacaaagatccacagggcaacggaagtgatctgattaagggccgagacggtaagtccgacatcctcattgaggacgaaaccagcatccaaaagatgtaccttggggagggcgaggtcctagtggaaggattggtcgaggaggaaaaccgccacctgaagctgttgccaggcaagaatactcgcgattccttcaagctgattaatagccagttcccatttccccagatcacgaataacgaggagctgaatcagaagggatcactgaagaaggctacagtcacactgaaggatgagcccaataatttgcagatcatcgtgtcaaaaagtcccgttcagttcgaaaatctggaggagatattcgacaccagcgtaagcaaggagatctccgatgacattacatcagatatcactagttgggaggggaatacacactttgaggaaagcttcaccgacgggccagaaaaagagctggatctttttacatacctcaagcactgcgccaagaatataaaagcaaaagatgtcgccaagcccaatgaggacgttccttcccacgtgctgataacggctcccccgatgaaagaacacctgcagctgggagttaataatactaaggagaagagtacatcaacccagaaggacagccctctgaatgatatgattcagtccaacgatctctgttcaaaagagtctatttccggggggggcaccgaaatcagtcagtttactccagagtcaattgaagccacccttagcattctgtcccgcaagcatgtggaggatgttggaaaaaacgactttttgcaatcagagcggtgcgctaatggtctcgggaatgataactccagtaatacactgaatactgactacagttttctagagataaacaataaaaaggaacggatcgagcaacagcttccgaaggaacaggccttatctcctcggagccaggaaaaagaggtccaaattcccgaactctcacaggtgttcgtggaggacgttaaggacatcctcaaatcgaggcttaaggaggggcacatgaacccccaggaagtcgaagaaccgtccgcctgcgcggacacaaaaatcctcatacagaatctgattaaaaggatcacgacatctcagctggtgaatgaggcttcaactgtgccgagtgattcacaaatgtccgattcatcaggcgtcagtccaatgacgaattcaagcgaattaaagccagaatcaagagatgacccattttgtatcggcaatcttaaaagcgagctgcttctcaatattcttaagcaggatcagcactcgcaaaagattaccggagtatttgaactaatgagggaactaacacacatggaatacgaccttgagaaacgaggaatcactagtaaggttttacctttgcagcttgaaaacattttctataaactgctggctgatgggtactctgagaagatcgagcatgtaggcgactttaatcagaaggcctgcagcacctctgaaatgatggaggaaaaaccgcacatcctgggagatattaaatcaaaggaagggaactactattcccccaatttggaaacagtgaaagaaatcgggctggagtccagtacggtctgggcatctactctgcctcgagatgaaaagctgaaagatctgtgcaacgacttcccgtcccacctagagtgcacctcagggtctaaagagatggcatccggtgatagcagcaccgaacaattttcatctgaactacagcagtgtcttcaacacaccgaaaaaatgcacgaatacttgacactgttgcaggacatgaaacctccacttgataaccaggagagtttagacaacaaccttgaggccttaaagaatcaactcaggcagttggagacttttgagctaggtctggcaccaattgctgttattctcaggaaggacatgaagcttgccgaagaatttctgaaaagcctccctagtgatttccctagagggcacgtagaggaattatccatcagtcatcagagccttaagacggccttctccagtcttagcaacgttagctcagagaggactaagcagatcatgcttgcgatagacagtgagatgagcaagcttgctgtaagccatgaggagttcctccacaaactgaaatctttttccgattgggtgagtgagaagtccaagagcgttaaggacatcgagatcgtgaacgttcaagactcagagtatgtgaagaagagattagagtttctgaaagccaacaacgtgcttaaggatctaggacacacaaaaatgcagctggaaaccaccgcctttgacgtacagttttttatttctgagtatgctcaggacctctccccaaaccaaagcaaacagctactacgactactgaataccactcagaagtgttttttggacgtccaggagagcgtcaccacccaggtagagaggctggaaactcagttgcatcttgagcaggacctcgatgatcagaagatcgttgctgagcgccaacaggagtacaaggagaagctccagggaatatgcgacctgctgacccagaccgagaaccggcttatcggccaccaggaagccttcatgataggtgacggaaccgtggaattaaagaagtaccaaagtaaacaggaagagttgcagaaggatatgcagggatctgctcaggccctggctgaggttgtaaagaacacagagaactttttgaaggagaacggagaaaaactctctcaagaggacaaggctcttattgaacagaagctaaatgaggctaagattaaatgtgaacagctgaacctgaaggcagaacagagcaagaaggaactggacaaggtggtcactactgcaattaaggaggaaaccgaaaaggttgccgctgtgaagcagttggaagaatcgaagacaaaaattgagaatctacttgactggctgagtaacgtcgataaggacagtgaaagggccggcacaaagcacaagcaggtcattgagcagaacgggacacactttcaggaaggtgatggaaaaagcgccatcggtgaagaagacgaggtgaatgggaatttacttgagaccgacgtggacggtcaggtagggactacccaggagaacttgaaccagcagtaccagaaagtgaaggcccaacacgagaagatcatcagccagcatcaggccgttatcatcgcgactcaatctgcacaggtgctcctagagaagcagggtcagtacctgtcgcctgaagagaaggaaaagctccagaagaacatgaaggagctgaaggtccactatgaaactgctctagcggagtctgagaagaaaatgaagctaactcatagtctgcaggaggagctggaaaagttcgatgcggactataccgagtttgagcattggcttcagcagagcgaacaggagctcgagaatctcgaggccggggctgatgatattaacggcctgatgacaaagctcaagcgccaaaagtctttttccgaagatgtgatctcacataagggcgatctgcggtacatcaccatcagcggcaatcgggttctggaagctgcaaaaagctgttctaaaagagacggagggaaggtcgacacaagtgccactcatcgggaggtgcagcgcaaactggaccatgcgacagatcgtttccggagcctgtactctaaatgcaacgtcctgggaaataatctaaaagatctagttgataagtatcagcactatgaagacgcaagttgcgggctgcttgctggcttacaggcttgcgaggccaccgcctccaaacacctgtcagagccaatcgcagtagatccaaagaacctgcagaggcagctcgaggagacgaaagccctgcagggccagatatctagccagcaagtcgccgttgaaaagctgaagaaaactgcagaggttctactcgacgcccggggcagtttgctgcccgccaaaaatgacattcaaaaaacattggacgatatcgttggcagatacgaggacttatccaagagtgtcaatgagcgtaacgagaagcttcaaatcacactgactaggtcattaagcgttcaggatggcttagatgaaatgctggactggatgggtaacgtcgaaagctcactcaaggaacagggacaggttccactgaattcgaccgccttacaggacatcatatctaaaaatattatgctggagcaagacatcgccggcaggcagtcaagtatcaacgctatgaatgagaaagttaagaaattcatggagacgactgacccctctactgcttcctctctacaagcaaagatgaaagatctgtctgctcggttctcagaggcttcccacaagcacaaggagacactggcaaagatggaagaactgaaaactaaggtcgaactgtttgagaatctctcagaaaagctgcagacattcctggagacaaagacccaggctttgactgaggtcgacgtcccagggaaggacgtgacagagctgtcccagtatatgcaggaaagcacttctgagttcctcgaacacaagaagcacttagaggtgctgcactccctgcttaaagaaattagcagtcacggcctgccgagcgacaaggcgctagtgctggagaagaccaacaacctctcaaagaaattcaaggagatggaagacacaattaaggagaaaaaagaggccgtgactagctgtcaagagcagttagacgccttccaggtgctcgtgaaatccctcaaatcctggattaaggaaaccaccaaaaaagtaccaattgtgcagcctagctttggtgctgaagacctgggaaaatcactggaggatactaaaaagcttcaggagaaatggagtctaaagacacccgagattcaaaaggtgaacaattctggcatcagtttatgtaacctcattagtgccgttacgacgcctgcaaaggccattgctgcagtgaaaagcggcggggccgtcctgaatggcgagggcacagcaaccaatactgaagagttttgggccaacaaaggcctgacaagcattaaaaaagatatgaccgatatctcccacggatacgaggatctgggattgttgctcaaggacaagattgccgagctaaacacaaagctatctaagctgcagaaagcccaggaagagagctccgccatgatgcagtggctccaaaaaatgaacaaaaccgcgaccaagtggcagcaaacccccgcgccaaccgacaccgaagcagtgaagactcaagtcgagcagaataagtcatttgaggcagaactgaaacagaacgttaacaaggtccaggagctgaaggacaaactgacagagctcctcgaggagaatccagacacgcccgaggccccacgctggaaacagatgctcactgaaatagattctaagtggcaagagctgaaccagctaactattgatcgccagcaaaaacttgaagaaagctcaaacaacttgacacaattccagacagtggaagcgcagctgaaacagtggctggtcgagaaagagctgatggtatccgtcctcgggcctctttcgattgacccaaatatgctgaatacacagcggcagcaggtgcagatcttgctccaggagtttgcaactagaaagccacagtatgagcaattgacggcagccgggcagggtatactctccagacccggcgaggacccatctctgcggggtatcgttaaagagcagctggctgctgtcacacagaagtgggactctttgacaggacagctgagtgatagatgcgactggatcgaccaggccatcgtgaagtcaactcagtatcagtcccttctgcgttccctatctgacaagctgagcgacttggacaataaattgtcgagcagcctggcagtgtcaactcatcccgacgccatgaaccagcagttggagaccgctcagaaaatgaagcaggagatccagcaggagaagaaacagataaaggtcgctcaagctttatgcgaagacctttcagcactcgttaaagaagagtacctgaaggctgaactctctcgccagcttgagggtattttaaaatccttcaaagacgtagagcagaaggcggagaatcatgtgcaacacttgcagtctgcttgcgccagcagccatcaatttcagcagatgtcccgtgactttcaggcctggcttgatacaaagaaagaagaacagaacaaatctcaccctatcagcgctaaactcgatgtgctagagagcttgatcaaagaccacaaagacttttctaaaaccctaacagcccagtctcacatgtacgagaagacaattgctgagggcgaaaatctgctgctgaagacacagggatccgagaaagccgcgctccaactacagctgaacacaattaagactaactgggacaccttcaacaagcaggtcaaggaacgggaaaacaaactcaaagagagtctcgagaaagccctgaagtataaggagcaggtagaaaccctgtggccctggattgacaagtgccagaataatctcgaagaaattaaattctgtttggaccccgccgagggagaaaacagcattgccaagcttaaatctctacaaaaagagatggatcagcatttcggaatggtcgagcttctcaataataccgcaaattccttactgagcgtgtgcgagattgacaaggaggttgtgacagacgagaataagtcacttatacagaaggtggacatggtaaccgagcagctgcactctaaaaaattttgccttgagaatatgacacaaaagtttaaagaatttcaagaggtctcaaaggaatcaaaaaggcaacttcagtgcgccaaggagcaattggatattcacgacagcctggggtctcaggcttattccaataaatacttaacaatgctccagacccaacagaaatcactgcaggcccttaaacatcaggtggatctcgccaagagactggcccaagacctggtcgtggaagcatcagactcaaagggcacgtcggacgtgttactgcaggtggagactatcgcccaggaacacagcactctgagtcagcaggtagatgagaagtgtagttttctggagacaaagttgcaggggattggtcactttcagaatacaattcgggagatgttctcccagttcgctgaattcgacgacgagcttgactccatggccccagtcggacgcgatgcagaaactcttcagaaacagaaagaaacaatcaaagcgtttctgaagaagcttgaggcactgatggccagtaacgacaacgctaacaagacttgtaagatgatgctggccaccgaagaaacctcgcctgatctggtgggtattaagagagatctggaggctttgtcgaagcaatgcaataagctcctggatcgggcacaagctcgagaggaacaggtcgaaggaacaattaagcgcctggaagaattttactcaaagctgaaggaatttagcattctactgcaaaaggccgaggaacatgaggagagccaaggaccagtgggcatggaaaccgaaacaattaatcagcaactgaacatgtttaaagtgttccaaaaagaggagatagagcctctgcaggggaaacagcaggatgttaactggctggggcaaggtctcatccagtccgctgctaagtccactagtacgcaaggcctggagcatgacctcgatgacgtgaatgcccggtggaaaacgttgaacaaaaaagttgcgcagcgggctgcccaactgcaagaggcactgctgcactgtggtcgattccaagacgccctggaaagcttactaagctggatggtggatactgaagagcttgtggcaaatcagaagccaccctctgccgaattcaaggtggtgaaggcacagatccaggagcaaaagctcctgcaaaggctacttgacgatcgtaagtcgacagtcgaagttatcaaacgtgagggggagaaaatcgccacaacagcagaacccgcggataaggtgaagatccttaagcagcttagccttttagactcgcgctgggaagcgctgctgaacaaggctgagacccggaatcgccaattggagggcattagtgtggtagcacagcaatttcatgaaacactggaaccattaaacgaatggttaaccaccatcgaaaagcgactggtaaactgcgaacctatcgggacacaggcctctaaattggaggaacagatagcccagcataaggcgctggaagacgatattatcaaccacaataagcatctccaccaggcagtctcaatcgggcagagcttaaaggtgctgtctagtcgtgaagacaaggatatggtgcagtccaagctggacttctctcaggtctggtacatcgagattcaggagaagtcacacagtcgtagcgagctcctacaacaggccctctgtaacgccaagattttcggagaggacgaggtcgaattaatgaactggcttaacgaggtgcatgacaagctgagtaaactcagtgttcaggattatagcacagaagggctatggaagcagcagagcgaattgcgcgtgctacaggaagacatcctgctcagaaaacaaaacgttgaccaagctttgctaaacggactggagctgttaaaacagacgaccggagacgaggtgctgataattcaagacaagctggaggccattaaggctcggtataaagacattaccaaactctcaacggatgtcgcgaaaacgttggagcaagccttgcaacttgcccgccgcctgcactcaacacacgaagaactgtgtacctggttggacaaggttgaagtggaactgctgtcctatgaaacacaagtgttgaaaggggaagaagccagtcaggcccagatgagaccaaaggagttgaagaaggaagctaagaacaacaaagcactgctggacagcctcaacgaggttagttcagctctactcgaactggtcccttggcgggccagggagggtctggagaaaatggtcgccgaggataacgagcggtaccgtctggtcagcgacaccattactcagaaggtcgaagaaatcgatgccgctatcctccgctcacaacagtttgaccaggccgccgacgcagagctttcatggatcactgaaacagagaagaagctgatgagcttgggcgacattcgtctggagcaggaccaaacgagcgcccagttgcaggttcagaaaaccttcactatggaaatcttgcgccataaggatatcatcgacgacttagttaaatctggtcacaaaattatgacggcttgtagtgaagaagaaaaacagtccatgaaaaagaagcttgataaagttctgaaaaactacgatacaatctgtcagatcaatagtgaaaggtatctgcaactggagcgggcccagtctttggttaatcagttctgggaaacgtacgaggagctctggccatggttaacagagacccaaagtatcattagccagctcccggcccccgccctggagtacgaaaccctgagacagcagcaagaggagcaccggcagctgcgggaactgatcgccgagcacaagccgcacatagacaagatgaacaagacaggtcctcaattacttgagttatctcctggagaagggttcagtatacaagaaaaatatgtggccgctgatacactctactctcaaatcaaggaagatgtcaagaaaagagcggtggccttagacgaggctattagccagtccacccagtttcacgacaagatcgatcagatcctcgaatcactggaacggatcgtggagaggctccgccaacccccgtccatttctgcagaggtcgaaaaaattaaagagcagataagtgagaacaaaaacgtgagtgtggatatggagaagctccaacccctgtatgagacactgaaacagaggggagaggaaatgattgccaggagtggcggcacagacaaggatattagcgccaaggcggtgcaggacaagttggatcaaatggtgttcatctgggagaatatccatactctcgtggaagagcgagaggccaagcttctcgacgttatggagctggccgaaaagttctggtgcgaccatatgtcccttatcgtaactatcaaagacactcaggacttcatccgcgacctggaggacccgggcatagacccgtctgttgtgaagcagcagcaggaagctgctgagaccatcagggaagagatcgacggccttcaggaggagctcgacatcgttatcaatctgggatctgaactgatcgcagcttgtggagagcccgacaagccaattgttaaaaagagcatcgacgagctgaactcggcttgggatagccttaataaggcatggaaagatagaatcgataaattggaagaggcaatgcaggctgcagtccagtaccaggacggcctccaggctgtgttcgactgggtggacatagcgggcggcaaactcgctagcatgtcaccaatcggaacagatctcgagactgtgaaacagcagatcgaggagctcaagcagttcaagtcagaggcatatcagcagcagatcgagatggagcgcctgaaccaccaggccgagctattattgaaaaaggtaactgaggagagtgacaagcataccgttcaggatcccctcatggaactgaaactgatttgggatagtctggaagagcgcattattaataggcagcataaactggagggcgcattgctagctctaggccagttccagcacgctttggatgaactgctagcctggctcactcacactgagggcctgctgtcagaacagaaacccgtgggtggagacccaaaggccattgaaatcgaactggccaagcaccacgtgctccaaaacgatgtactcgcccaccagagtaccgtggaagcagtcaacaaggctggcaacgatttgatcgagtcttctgcaggagaggaagcatcgaacctgcagaataagcttgaggttctcaatcaaaggtggcagaatgtattggagaaaactgagcagcggaagcaacagctagacggcgctttacgccaagccaagggatttcacggcgagatcgaagacctccagcagtggctcacggacacagagcgacacctgctggcctctaagcctctgggagggctcccggagacagctaaggaacaattgaatgttcacatggaggtttgcgccgcttttgaagccaaggaagaaacttataaatctcttatgcagaagggtcagcagatgcttgccagatgtcctaagagtgctgaaacaaacattgaccaggatattaacaatctgaaagaaaaatgggagagtgtggagaccaaactaaatgagcgcaaaactaaattggaagaggctcttaaccttgccatggagttccacaacagtcttcaggacttcattaactggctgactcaggcagaacagacattgaatgtggccagccggcccagcctgatccttgatactgtgctgttccagatagacgaacataaagttttcgccaacgaagtcaatagccacagggaacagattatcgagctagataagactggcacacacttgaagtacttctcacagaaacaggatgtggttcttatcaaaaacctcttgattagcgtacagagtaggtgggagaaggtagtgcagaggctggttgaaagggggcggagtcttgatgacgcaagaaagagggcaaagcagttccatgaggcctggtccaagttaatggagtggctcgaggagtccgagaagtctttagacagtgagctcgaaatcgcgaacgaccccgacaaaattaagacacagctcgcacaacataaggaattccaaaagagcctgggcgctaaacactccgtgtacgatacaaccaatagaactggaaggagcctcaaggagaaaacatcacttgcagacgacaacctaaaactagatgatatgctgtcggagctgagagacaaatgggacacaatctgcgggaaaagcgtggagaggcaaaacaagctggaggaggctcttctgttttctggacaattcactgatgccctgcaagctttgattgactggctgtatagggtggaaccacaacttgcagaagaccaacccgttcacggagacattgatctagtgatgaatctcatagacaatcataaggcctttcagaaagaacttgggaagcggacgagctcggttcaagccctgaaacggagcgctcgcgaacttatagagggaagccgtgatgactccagttgggtaaaagtgcagatgcaggagttatctacacgctgggagacagtatgcgccctttcaatatccaaacagacccggctggaggccgcactgcgacaggccgaggagttccacagcgttgtgcatgctctcctggagtggctggctgaagcagaacagactttgcggttccacggcgttctgcccgatgacgaggatgccctccgcaccctcatagaccagcacaaggagtttatgaagaagcttgaagaaaagagagcagaattgaacaaggcaaccaccatgggcgatacagtgctcgccatctgtcatccagacagtatcactaccatcaagcactggatcactattatacgggcccggtttgaggaggttctggcttgggccaagcaacaccagcagcgactggccagcgcattagccgggctcatagcgaaacaggaattactcgaagcgctcctggcttggctgcaatgggcagagaccaccctcaccgacaaggataaggaggtaatccctcaggaaatcgaagaggtaaaggctcttatcgccgaacatcaaacatttatggaagagatgacacgaaagcagccagacgtcgataaagtgacaaagacatataaaagacgtgctgccgatccctctagtttgcaaagtcacatcccggtgcttgataaaggccgggccgggagaaagagattccctgcaagtagtctctatcccagtgggtcacaaacacagatagaaacgaagaaccctcgggtaaacctgttggtctcaaaatggcagcaggtctggctgcttgcactggagcgacggagaaagttgaacgacgcactggatagactcgaagagctgcgtgaattcgcaaacttcgacttcgatatctggaggaagaaatatatgcgctggatgaatcataaaaagagcagggtgatggatttctttagaaggatcgataaagaccaggacggtaagatcactcgacaggaatttatcgatgggatcctcagcagcaagttccccacctcccggctggagatgagcgcagtggcagacatcttcgatcgagatggcgatgggtacatcgactactatgagttcgtcgcagccctgcaccctaacaaagatgcctacaagcccatcaccgatgccgacaagatcgaggacgaggtgaccagacaggtggctaaatgcaagtgtgctaaacgcttccaagttgagcagattggcgacaataagtaccgggtgagctttcagagtaacttcggggacagtcagcagctgcgattagtacggatactgagatccaccgtaatggtacgtgtggggggtggatggatggcattagatgagttcctggtgaaaaatgacccgtgtcgcgtgcatcaccatggtagcaagatgctgcggtctgagtccaacagtagcatcactaccacccagcccacaattgcaaaaggccgtacgaatatggagctgcgagagaagtttatccttgcggacggcgctagtcaaggcatggccgccttccggcctcgcggaaggcggtctcgcccatcttcacgaggggcctcaccaaaccgaagcacgagcgtctccagccaggcagcccaggccgcatccccacaagtgccagctaccacaacgcccaagggcacacccatacagggatccaagttgaggctgcctggctacttgagtgggaaagggttccactcaggggaggattctgggctgatcaccacagccgctgcccgcgttcgtacccagttcgccgattccaaaaagacaccgtccaggccaggtagtagagctggaagcaaagctggctcccgggcatcatctcgaaggggcagtgacgcttcagattttgacattagcgagatccagagcgtgtgtagcgacgtagaaaccgtccctcagacacaccggcctaccccgcgtgcaggatctaggccaagcacggctaaaccctcaaagattccaacaccacagaggaagagcccggcttctaagcttgataaatctagtaaaagatag

SEQ ID NO: 186113 - DNA, 7950 bp, Artificial Sequence
  Description of Artificial Sequence: Synthetic coding sequence
atgcacagcagcagctacagctaccggagcagcgacagcgtgttctcgaacactacttcgacacgaacatccttggatagcaacgaaaacctgctcctcgtgcactgcgggcccacgcttatcaattcctgcatatcatttggatcagaaagctttgatggtcataggctggagatgctgcagcaaattgcaaacagagtgcaacgggacagcgttatctgtgaagacaagttgatcctggccggtaacgccttgcagtctgattctaagagactggagtccggtgttcagttccagaacgaggccgagatcgcgggctacatcctggaatgcgagaatctcttgagacaacacgttatcgacgttcagatcctgatcgacggcaagtattaccaggcagatcagctcgttcagagagtcgcaaagctccgcgatgaaattatggctcttagaaacgagtgtagtagcgtttatagcaagggacgaatactcacgacagagcaaactaaactcatgatttcaggcataacgcagtcgctcaatagtggtttcgcccagaccctccacccgagccttacatctgggctcacacagtccctgacccctagtctgacatccagctcaatgacttccggactgtcgtcagggatgacgagtcgactaaccccgtccgtcacccccgcatacactccaggatttcccagcggattggtgcctaatttttcaagtggggttgagcccaattcactgcaaacgctgaagttaatgcagatccgcaaacccctgttaaagtcctcccttctggatcagaacttgaccgaagaagagatcaacatgaagttcgttcaggacctccttaactgggtagatgagatgcaggtccagttagacaggaccgaatggggatccgacctcccatccgtggagtcccaccttgaaaaccacaaaaatgtacatcgcgccatcgaagagttcgaatcgagcctgaaggaagctaagattagcgaaatccaaatgactgcacctctaaaactgacctatgcagaaaaactccaccgtctggagtctcagtacgccaaacttttgaacacttcacgcaaccaggagaggcacctcgatactctccataatttcgtgtcgcgggcaacaaacgaattgatatggctcaacgagaaggaagaggaggaggtggcttacgactggagcgagcgtaacacaaatatagcgaggaaaaaggactaccacgctgagctgatgcgggagctggatcagaaggaagagaacatcaaatcagtgcaggaaattgcagaacaactgcttctggagaaccatccagcgaggcttaccatcgaggcttatcgagccgccatgcagacacagtggtcgtggatcctacagctgtgccagtgtgtggaacaacatataaaggagaatacggcatacttcgagttcttcaacgacgcaaaagaggctaccgattacctgcgcaacctaaaagatgcaatccagcggaaatatagctgcgatagatcttccagcattcataagttggaggatctggtccaagagtcgatggaggagaaagaagaactgcttcagtacaaatccacaatcgcaaatcttatgggaaaagccaaaaccattattcagttgaagccgagaaactctgattgtccgcttaaaacctccatccccattaaagcaatctgcgactaccgtcagatcgaaatcaccatctacaaggatgacgagtgtgtcttggccaataattcacacagagccaagtggaaagtgataagccctaccggcaatgaagcaatggttcctagtgtttgctttacagtgcctccccctaacaaggaggccgttgacctggctaaccgcattgagcaacagtatcaaaatgtccttaccctttggcatgagtcacacattaatatgaaatcggtggtcagctggcattacctgattaacgagattgacaggatccgagcctccaacgttgcatccataaaaaccatgttgccaggagagcaccagcaggtactctcaaatctgcaaagtcggttcgaagattttctcgaggactctcaggagagccaggtgttttccggcagcgacattacgcagctggaaaaggaagtgaacgtgtgcaaacagtattatcaggaactgctgaagtcagccgagcgagaagagcaggaggaaagtgtctataatctctatatttcggaagtgcgcaacataagactgcgtttagagaactgtgaagatcggttgattcggcagatcagaaccccactggagcgggacgacttgcatgagtccgtgtttcgcataacagagcaggagaagctgaagaaggagttagaacgcttaaaggatgatcttgggactataacaaacaaatgcgaagaatttttctcacaggcagctgcctcttcaagcgttcccacgctgagatcagaactcaacgtggtattgcagaatatgaaccaggtgtatagcatgagttccacttacatagacaaactgaagaccgtgaatctggttctcaagaacacacaggctgccgaggccctggtgaagctgtacgagaccaagctgtgcgaagaggaggcagttatcgccgacaagaataatatcgagaacttgatttcaacgctcaagcagtggagaagtgaagttgatgagaaaagacaggttttccacgccttggaagacgagttgcaaaaagcaaaagccattagcgatgaaatgtttaaaacctataaggaaagagatctagactttgactggcataaagagaaggccgatcagcttgttgaacgctggcagaatgtgcacgtccagatcgataaccggttacgagatctggaaggtattgggaaatcattgaagtactacagagacacctaccatcctctcgatgactggattcagcaggtcgagaccacgcaaagaaagatccaggaaaatcagccagagaacagcaaaaccctcgcaacgcagctgaaccagcagaagatgcttgtgtccgagattgaaatgaaacagtccaagatggatgagtgtcagaaatatgccgagcagtattctgccacagtgaaagactacgagttgcagaccatgacctacagagccatggtagactcacaacagaagtctccagtcaaaaggaggaggatgcagagctcagccgatttgataatccaggaattcatggatctgagaactaggtatacagctttggtgacactgatgacacagtacatcaagttcgcaggtgactcactgaagcgcctggaagaagaagagatcaaacggtgcaaggaaacatcagagcacggcgcttatagtgatctgctgcagagacagaaagccaccgtgctagagaatagcaagctgaccggtaagataagcgagcttgagcgaatggtggccgagcttaaaaaacagaagagtagagtcgaagaagaactgccaaaggtgcgggaagccgctgagaacgagctgcggaagcagcagaggaacgtggaggatatctctttgcaaaaaatacgagccgagtctgaagccaagcagtataggagagagcttgagacgattgtcagggaaaaggaggccgcggagcgggagctggaaagggttcgtcagcttactattgaggcagaagccaagcgcgccgcagttgaggagaacctgcttaacttccggaaccagctcgaagagaacacatttacacgccggactctggaggatcacctgaagcggaaggacctctctcttaatgacctggagcaacagaagaacaaacttatggaggagctacgtcggaagcgtgataacgaggaggagctactgaaactgattaaacagatggagaaggacctcgcattccagaagcaagtggccgaaaagcagctgaaggaaaagcaaaagatcgaactggaagctcggaggaagatcaccgaaattcagtatacgtgtcgcgaaaatgccttgcctgtttgcccgatcacacaggcgaccagctgtagggcagtcaccggcctgcagcaggaacacgacaagcagaaggcagaggaactgaaacagcaggtggacgaactcactgccgccaacaggaaagcagagcaggacatgcgggagttgacctacgagctgaacgcccttcaacttgaaaaaacatcaagtgaagagaaagccaggctcctgaaggataaactggacgaaacgaataacaccctgaggtgtttgaaactggagctcgagaggaaggaccaggcggaaaagggatattcccaacaactcagagagctgggtagacaactgaatcagacaacaggcaaggctgaggaggccatgcaggaagcctcagacttaaaaaagattaaaaggaactaccaactggagttggagagcctgaaccacgagaaaggtaagcttcagcgggaggtggatcgcataacaagggctcatgccgtcgctgagaagaatatccaacatctgaattcgcagattcacagtttcagggacgaaaaagagctcgaaagactgcagatctgtcagcgtaagtccgatcacctgaaggagcaattcgagaaatcccatgagcaattgctgcagaacatcaaggccgaaaaagagaacaacgacaaaatccaaagattaaatgaagagcttgagaaaagtaacgaatgcgccgaaatgctcaaacagaaagtggaggagctcacacgccagaacaatgaaactaagcttatgatgcagagaattcaggcggagtccgaaaacatcgtactcgaaaaacagacaatccagcagcggtgcgaagccctcaagattcaggctgacggctttaaggaccaactgcgaagtactaatgagcacctgcacaaacaaacaaagacagaacaggacttccagcgtaaaatcaaatgtctggaagaggatctggctaagtcccagaacctggtttccgaattcaaacaaaaatgcgatcaacaaaatataattattcagaatacgaagaaagaggtccggaacttgaacgccgagctgaacgcttctaaggaagagaaaagacggggcgagcagaaagttcagctgcagcaggcccaggttcaagagcttaataacagactgaagaaagtccaggacgagcttcacctgaaaacaattgaggagcagatgacacacagaaagatggtgttgttccaggaggagtctggaaaattcaaacaatcagctgaggagttccgcaagaaaatggagaaacttatggagtctaaggtgattactgagaatgatattagcggcattagactggattttgtgagcctccagcaggaaaacagcagagcgcaagagaatgccaagctgtgcgagacaaatattaaagaacttgaacggcagctgcagcagtatcgggagcagatgcaacagggacagcatatggaagctaaccactatcaaaagtgtcaaaagctggaagacgaactgatcgctcagaagagggaagtggagaacctgaagcagaaaatggaccagcagatcaaggagcatgagcaccagctcgtactcttgcagtgtgaaatccagaagaagagcacagctaaagactgtacattcaagcctgacttcgagatgactgtcaaggagtgtcaacattcaggagaattgtctagcaggaatacaggccacctgcatcccacacctcgaagccccctgctgaggtggacgcaggagccccagccacttgaggagaaatggcaacatcgggtcgtggagcagatccctaaagaagtgcagttccaaccgcccggcgccccattagagaaggaaaagagtcagcaatgctattcggaatacttttcacagacgtccaccgaactgcagattacttttgatgaaacaaatccaattacaaggcttagcgagatcgagaagattcgggaccaagcacttaacaacagcagacctcctgtccggtaccaggacaacgcctgtgagatggaactcgtgaaagtcctcacacctctggagattgctaagaataagcagtatgatatgcataccgaagtgaccaccctgaagcaagagaaaaatccggtgccttccgccgaagagtggatgctggagggctgtcgcgctagtggcgggttgaagaaaggcgatttcctcaaaaaaggcctggagcccgagacttttcagaactttgacggggaccatgcctgcagtgtgagggacgacgaattcaaatttcaaggtttaagacacaccgtcacggcccggcagctagtggaagcaaaacttctcgatatgcgaaccatcgagcagttgaggttgggcttaaaaacagtggaagaggttcaaaaaacactaaataagttcctgacgaaggctactagcattgcagggctgtatctggaaagtacgaaagagaagatctcttttgcttcagccgcagaaaggattattattgacaagatggtagctctcgcattcttggaagcccaggccgccacagggttcatcatagaccccatttccggccaaacttatagcgtggaggacgctgtgctgaagggagtggtggaccccgaatttcggatccggcttttagaggcagaaaaagccgctgtgggatatagctactcctccaagaccttaagtgtttttcaggcaatggaaaaccgaatgttggataggcagaaaggaaaacacatcctggaagcgcagatcgcatcagggggggtgattgaccctgtgagaggcatccgagtgccccccgagatcgctcttcaacagggcctgctcaacaacgcaatcctgcaatttctgcacgagcctagctcgaataccagagtgtttcccaatccaaataataaacaggccctctactattctgagcttctgcgcatgtgcgtttttgatgtcgagagccagtgctttcttttccctttcggagagcggaacatttctaatctcaatgttaaaaagacgcaccgaatcagtgtggtggacactaaaacagggtctgaactcacggtctacgaagccttccagcgtaatcttatcgagaaatccatatatctcgagctgtccggccagcagtaccagtggaaggaagcaatgttcttcgaaagctacgggcatagctcccacatgttaaccgatactaagacagggctgcattttaatattaatgaggcaatcgagcagggcaccatcgataaagctctcgtgaagaagtaccaggagggtctgattaccttgactgagctggctgattctctactgtctagactggtccccaagaaggacctgcactcaccagtggctggctattggttaaccgcaagtggagagagaattagcgtcctgaaagcctcccgaaggaatctggtcgacaggatcactgctctgagatgcctcgaagcccaggttagcactggaggcatcatcgaccccctgaccggcaagaagtacagagtcgctgaggcactgcacagagggctggtggatgagggctttgcccagcagttaaggcagtgtgagctagtgattacagggattggacacccgatcaccaataagatgatgagtgtggttgaggcagtaaatgccaacattataaacaaggagatgggtatcaggtgtctggaattccagtatctgacagggggcctcatcgaacctcaggttcattcccggctgtctatagaggaagccctgcaagttggcatcattgatgtgcttattgcaacgaagctaaaggatcagaagtcttacgtgagaaacattatttgtcctcaaaccaagagaaaactcacctacaaagaagctttagagaaagcggattttgacttccatacaggcctgaaactgctggaagtctctgagcccctgatgactggaatctccagcctgtattactcatcctag

SEQ ID NO: 186114 - DNA, 22719 bp, Artificial Sequence
  Description of Artificial Sequence: Synthetic coding sequence
atggccggctacctgagccccgccgcctacctgtacgtggaggagcaggaatatctacaggcttatgaagatgtgctggagcggtataaagatgagagagataaagtgcagaagaagaccttcaccaagtggataaatcagcacctgatgaaggtgcgcaagcacgttaatgatctgtacgaagaccttcgggatggacacaatctgatcagccttctggaggtgttgagtggcgacaccctcccacgcgagaaagggcggatgcgttttcacaggttacagaatgtgcagatcgccctagactacctgaaaagacggcaggtgaaactggtgaatatcagaaacgacgacatcactgatggcaacccaaaacttaccctcggcctgatctggactataattcttcacttccagatttctgacatccatgtgactggggaatctgaggacatgagcgccaaagagaggctgctgctgtggactcagcaggcaaccgaggggtacgctggcatccgctgtgaaaacttcactacttgttggcgggacggcaagttgtttaacgccattattcataaatatcggcccgacctcatcgacatgaatacagtagcagtgcagagcaacctggccaacttagagcacgcattttatgtggcagagaagataggcgtgatacggctgctggaccccgaggatgtagatgtctcaagtcctgatgaaaagtctgtgattacctatgtgagttcattatacgacgcattcccaaaggtgcccgagggaggagaaggtattggcgccaacgacgtcgaggtcaagtggattgagtaccagaacatggtgaactacctcatccaatggatccgacaccacgtgacaaccatgtccgaacgcacttttcccaataatcccgtggagcttaaagcactgtacaatcagtaccttcagttcaaggagacagagatcccaccgaaagaaactgaaaagtccaagataaagcgtctgtataagctgctggagatctggatcgagtttggacggatcaaactcctgcagggttatcaccccaacgatatcgagaaagaatggggtaagctgataattgccatgcttgaaagagagaaagcgcttagacccgaggtggagaggctggaaatgctccaacagatagccaaccgcgtccagcgggactccgtcatctgtgaggacaagctgattctggccggcaatgctctacagagtgactcaaagcgcttggaatccggggttcagtttcagaacgaagccgaaattgctggctacattctagagtgcgaaaacctgcttagacagcatgttattgatgtgcagatcctaattgatggaaaatattatcaggcagaccagctggtgcagcgtgtggccaaactgagggatgaaatcatggctctgcgaaacgaatgtagctcagtatatagcaagggccggatcttgacgaccgagcagactaagttgatgatctcaggcatcactcaaagcttaaattccgggtttgctcaaacgctccacccctccttaaccagcggcctaactcagtctctcaccccctctctcacgtcctctagtatgacgagcggcctgtccagcggcatgactagtagactcacaccctccgttacccccgcatatactcctgggttcccgtctgggctggtccccaatttttctagtggtgtggaacccaattctctacagaccctcaaactaatgcagattagaaagcccctgttgaagtcatcactcctggaccaaaatctgaccgaggaggaaattaacatgaaatttgtccaagacctgttgaattgggttgacgagatgcaggttcagctggatagaaccgagtgggggtccgatctcccttcagttgagtcgcatcttgagaatcataaaaacgtgcacagggccatagaagaattcgagagctcactcaaggaagctaaaatctcggaaatccagatgactgcgcctctgaagctgacgtacgctgagaaattacatcgccttgaaagccagtatgccaagcttcttaataccagcagaaaccaagaacggcatctggacacactgcacaactttgtaagccgtgctactaatgagttgatttggcttaacgaaaaagaggaggaggaggtcgcttacgattggtctgaacgaaacaccaacattgcccggaaaaaggattaccacgcagagctgatgcgtgagctggaccaaaaggaagaaaacattaaatccgtgcaggaaatcgcagaacaactcctgctggagaaccaccccgcaaggcttaccattgaggcctaccgggccgccatgcaaactcaatggtcatggatcctgcagctgtgtcaatgcgtggaacagcacatcaaagagaacaccgcctactttgaattcttcaatgatgctaaagaggcaactgactacctcaggaacctgaaggatgctatacagcgcaaatattcgtgcgaccgaagctcttctatccataagctagaggacctggttcaggaatctatggaagaaaaagaagaactgttgcaatataagagcaccatcgccaacctcatggggaaggccaagacgatcatccagctgaaaccacggaactccgactgcccattaaagaccagcattcccataaaagccatctgcgactataggcagatagagattactatctacaaggacgacgagtgcgtgctcgctaacaactcccacagggccaagtggaaggtaatctcgcctacaggcaatgaggcaatggtccccagtgtatgcttcacagtaccccctcctaacaaagaagcagttgatcttgccaaccggatcgagcaacagtatcagaacgtcctgaccttgtggcacgaaagccacattaatatgaagagtgtggtttcctggcattacctgatcaacgagatcgatagaattcgcgcaagtaatgtcgccagcattaagaccatgctgccaggtgaacaccagcaggtattaagcaatctgcagtctcggttcgaggactttttagaggactcacaagaaagccaggtgtttagtgggtctgacatcacccagttagagaaggaggtcaatgtgtgcaagcagtactaccaggagctgctgaagagcgcggaacgagaagagcaggaggagagcgtatataatctctatattagcgaggtacgcaatataaggctgcgcctggaaaactgtgaagataggctcatccgccagattaggactcccttagaaagggacgatctccacgagtccgtctttaggattaccgagcaagaaaagttgaagaaggaacttgagaggctgaaggatgatcttggaacgatcaccaacaagtgcgaggaatttttttcacaggcagccgcgtcctcctcggtacctacactgaggagtgagctgaatgttgtgttgcagaacatgaatcaggtgtattccatgagctctacatacattgacaagttaaagaccgtgaacctcgtgctgaagaacacccaggctgccgaggcccttgtcaagttgtacgagactaaactctgcgaagaggaggcggtgattgccgacaaaaacaacattgagaacctcatcagcacccttaaacagtggcggagcgaggttgacgagaagagacaggtgttccacgcattggaggatgagctacagaaagcaaaagcgatatccgatgagatgttcaaaacctataaggaacgtgacttggactttgactggcacaaagaaaaggcagaccagctggttgagcggtggcagaacgtacacgtacagattgacaaccgactccgtgacctggaagggattgggaagtcactgaagtattatcgcgatacgtatcacccgcttgacgactggatacagcaagtcgagaccactcagagaaagatccaggaaaaccagcctgagaattccaagactctggccacacaactcaaccaacagaaaatgctggtgagcgaaatcgaaatgaagcagagcaagatggatgagtgccagaaatatgcggagcagtatagcgctaccgtgaaggattatgagctgcagaccatgacctatcgggccatggtggatagtcaacagaagagccccgtcaagaggcgaagaatgcagagctcagcggacctgatcatccaagagttcatggacctgcgaacccgctatacggctttagtcactctgatgactcagtacattaagttcgccggggattccctgaagcggctcgaggaagaggagaagtcacttgaggaagagaaaaaggagcacgtcgagaaggcaaaggaactgcaaaaatgggtgagcaacatcagcaaaacacttaaggacgctgagaaggctggaaaaccgcccttcagcaaacagaaaattagttctgaagaaatatccactaagaaggagcagctgtcagaggcactgcagaccatccagctgtttctggcaaagcacggagataagatgaccgatgaggagagaaacgaattggagaagcaggttaagacgctgcaggaatcttataatctgttgttttctgaatcgctgaagcaattacaggagtctcagactagcggcgacgtgaaggtcgaggaaaagttggataaggtgatcgccggaacgatagatcaaactactggtgaggtcctgagtgtgttccaggccgttctgcggggtctaatcgattacgatacgggaattaggttgctggagactcaactgatgatttcaggcctgatctcacctgaattgcgaaaatgttttgacctgaaggatgcaaagagccatgggctgatcgacgagcagatcctctgccaactgaaggagctgagcaaggctaaggaaatcatctccgctgcttcaccaacaaccatccctgtcttggacgctctcgcacaatcaatgatcactgaatctatggccatcaaggtgctcgagatcctgctgagtaccgggagcctggtaatcccagcaactggggagcagctgaccctccagaaggcctttcagcagaatctggttagctcagcactgttttccaaggtgctggaacgccagaacatgtgtaaggacttgatcgacccttgtacctctgagaaagtcagcctgatcgacatggttcaaagatccacactgcaggagaacacagggatgtggctgctcccagtcaggccacaggagggaggtcgcatcacattaaagtgcggccgcaacattagcatcttacgcgctgcccacgagggactaatcgaccgggagactatgtttcgcctgttaagcgctcagctgctctccgggggcttaattaactccaactcgggtcaaaggatgactgtcgaggaagcggtgcgcgagggcgtgatcgaccgagacaccgcctcctccatcctcacataccaagtgcagaccgggggaatcattcaaagtaacccagccaaaagactgacagtggacgaggctgtccagtgcgatctgataactagcagttctgctctgctcgtgttggaggcccagagaggctatgtaggtctcatatggccacactccggtgagatcttccccacatcttcatccctccagcaggaactgattaccaacgagttggcatacaaaatccttaacggacgtcaaaagattgcagccctgtacattccggagagctcccaggtcatcggtctggacgctgccaaacagctggggatcatcgataacaataccgcgtccatcttaaaaaacattaccttacccgataagatgcccgatttgggggatctagaggcctgcaagaacgcccgcaggtggttgtccttctgcaaattccaaccttctacagtgcatgactacagacaggaggaagacgtgttcgatggagaggagcctgtgacaacccaaacaagcgaggagactaaaaagctgttcctgagttacctgatgattaactcctacatggacgcaaacaccgggcaacgactactgctatacgacggcgaccttgatgaggccgtgggtatgctgctcgagggctgtcacgcagaatttgatggcaatacagcaatcaaggagtgtctggatgtcctgtcatcctccggtgtcttcctgaataacgccagcggcagagaaaaggacgagtgcaccgccaccccgagttccttcaacaagtgccattgtggcgagcccgagcatgaggaaacacctgagaatcgcaaatgtgccatcgatgaggaatttaacgagatgaggaacactgtcatcaactccgagttcagccagtcagggaaattggctagtaccatttctatcgatccaaaggtgaactcatcccccagcgtttgcgtgccatcactgatttcatacctcactcagaccgaattagcagatatctcaatgttacgctccgactccgaaaacatcctgactaactacgaaaatcagtccagggttgaaacaaatgaaagagcgaacgaatgttctcattcaaaaaatatccagaacttcccaagcgacttgatcgaaaaccctatcatgaagagcaagatgtctaagttctgtggcgtcaacgagactgaaaacgaagacaatacaaatagggattccccaatttttgactactctcctcggctgagtgcccttttgagccacgacaagctcatgcactcgcagggctcttttaatgacactcatacaccagaatcaaacggaaataagtgtgaggccccagcactgtccttttctgataaaaccatgcttagtgggcagcggatcggggagaaattccaggaccagtttctgggcatcgcagccattaatatctctcttccgggcgagcagtacgggcaaaaatccctgaacatgatctcaagcaatccacaggtgcagtatcataatgacaaatacatctcgaacaccagcggcgaagatgagaaaacacatccagggtttcaacagatgcccgaggacaaggaggatgagagtgagattgaggagtattcatgcgctgtcacacccggcggtgataccgacaacgccatagtttctctgacctgtgcgacccctctgctcgacgagacaatatcagcatctgattacgagacctctcttttaaacgatcaacagaacaacacgggcacagatacagatagcgatgacgatttctatgatactcctttgttcgaggatgatgaccacgacagtctgcttctggacggagatgatagagactgcctgcatcccgaggactacgacacattacaggaggagaacgacgagactgccagtccagctgacgtcttttacgacgtgtcaaaggaaaacgagaatagcatggtgccacagggagcacctgtgggatctctttccgttaagaacaaggcacactgtttgcaagatttccttatggacgtcgagaaggacgagctggatagtggcgaaaagattcatttgaatcccgttgggtccgacaaagtaaacggccagtcgcttgaaaccggatccgagcgcgagtgcactaacattctggagggcgacgaatctgacagcctgaccgattacgacatagtgggcggaaaagaaagtttcacagctagcctgaagtttgatgatagcgggtcatggcgggggcgcaaagaagagtacgttactggccaggaattccactcggacacagatcacctggattctatgcagtctgaagaatcttatggtgactatatttacgacagcaacgaccaggatgatgacgatgacgatggaattgacgaggaaggaggcggcataagggacgaaaacggtaaaccacgatgccagaacgtggcggaggatatggacatacagctgtgcgccagtatacttaacgagaactccgatgaaaacgagaacattaatacaatgatactgctggataagatgcatagctgttcctctcttgagaagcagcagcgagttaacgttgtgcagttggcatccccatctgaaaacaacctggttacagagaaaagcaacctacccgaatacaccacggaaatcgccggcaaatctaaagaaaatttgctgaatcatgaaatggtgcttaaggacgttctgcctcccatcatcaaggatacagagtccgagaagacttttgggccagctagtatatcacatgacaataataacattagctccacatctgagctaggcactgacctagccaatacaaaggtcaaactgattcagggtagtgaactgcctgagctgacagattcagtcaaaggcaaagacgagtactttaagaacatgactccgaaggtggattcgagccttgatcacattatctgtaccgagcccgacctcattggtaaacccgcagaggaaagtcacctgagtttgatcgcctcggtgaccgacaaggacccccaaggtaatggctccgatctgatcaaaggacgtgacggaaagtccgacattctgatcgaggacgagacgtccatccaaaagatgtacctcggtgaaggcgaggtgctggtcgaggggcttgttgaagaggagaatcgtcatctcaagctgctgcctggcaagaacacgagagactcttttaaactgatcaattcccagtttccttttccacaaattacgaataacgaggagttaaaccagaagggttcactgaagaaggccacagtcactctcaaagacgagcctaataacctacagattattgttagtaagagccccgttcagtttgagaatctagaggagatttttgacacctccgtcagcaaagaaatatctgacgatattacatcagatattaccagctgggaaggtaacacccactttgaagaaagcttcaccgatggtcccgagaaagaactcgacctctttacttatctgaagcattgtgctaagaatattaaagcgaaagacgtggccaaaccaaacgaggatgttcccagtcacgtcctgatcacagccccacctatgaaggaacacttgcaactgggggtaaacaacactaaagagaaatcaacttcaactcagaaggactcaccattgaacgatatgatccagagcaacgatttatgcagtaaggaatctatatcaggcgggggcacggagatctcacagttcacacctgagtcaattgaggccacgctgagtatccttagccgtaaacatgtcgaagacgtgggtaagaacgatttcctgcaaagcgagcgctgcgcgaacggattaggcaatgataatagctctaatacattgaacaccgactatagctttttggagatcaacaataaaaaggagaggatcgagcagcagcttcctaaggaacaggcgctgagcccccgctctcaagagaaggaagtgcagatccccgagctatcacaggtcttcgtcgaggatgttaaggacattctcaaaagtagactgaaagagggacacatgaacccccaggaagtggaggaaccatcggcttgcgccgacacaaagattctgattcaaaatctcattaagagaatcaccacaagccagctggtgaatgaggcctccaccgtcccctctgactcgcagatgtcggactcctcaggggtgtcacccatgaccaattccagcgagttgaagccagagtcaagggatgaccctttttgtatagggaatctgaagtcggagctgcttctcaatatcctaaaacaggaccagcacagccagaaaatcactggagtgtttgaacttatgagagagttgacccacatggagtatgacctggagaaacggggcataaccagcaaagtgctcccactgcagctggaaaatattttctataaacttctggctgacgggtacagtgagaagatcgagcatgtgggtgatttcaatcagaaggcatgtagcacaagcgagatgatggaagagaagccgcatattcttggggatattaaatccaaggaaggtaattactactctcccaacctcgaaactgtcaaggagattggtctggaatccagcacggtatgggccagtacattgcctagggatgaaaagttgaaggatctgtgtaatgacttcccatcccatctcgagtgtacatccgggtcgaaagaaatggcctctggggattcatctactgagcaatttagcagcgagctgcagcaatgcttacagcacaccgaaaagatgcacgagtatctgacactgctacaggatatgaagccacctttggataaccaggaatcactggataacaacctggaggcattgaagaaccagctcaggcagcttgagacctttgagcttgggctcgctcccattgctgtaatactgagaaaggatatgaaactggctgaggaattcctgaagtctctccctagcgattttcccaggggacatgtcgaggaactgagcatcagccaccagtcccttaaaaccgccttttctagcctgtctaacgtctcctctgagcgcacaaaacagatcatgttagctatcgactctgaaatgtcaaaactggcagtgtcacacgaagagttcctgcataagctaaagagtttttccgactgggtatccgagaagtctaagagcgtgaaggatattgagattgtgaatgtgcaggatagcgagtatgttaaaaaacgtctcgaatttctgaaggctaataatgttcttaaggatctgggacatacaaagatgcagctcgaaaccactgccttcgatgtacagtttttcatttctgagtatgcacaggacctgtcacccaatcaaagtaagcagttattacggctgctcaatactacccaaaaatgtttcctggatgtgcaagagagcgtgactactcaggtcgagaggctggagacacagcttcacctggagcaggatctagacgatcagaagatagtcgccgaaaggcagcaggagtacaaggagaagttgcaggggatatgcgatcttttaacgcagacagaaaaccgcctgatcgggcatcaagaggcctttatgatcggtgatggaacagtcgaactgaaaaagtatcagagtaaacaggaggaactgcagaaagatatgcaggggtcagctcaggccctagctgaggtggtgaagaataccgaaaatttcctgaaagagaacggcgagaagttgagtcaagaggataaagccttaatagaacagaagctgaacgaggccaagattaagtgtgagcagttaaacctgaaagcagaacagtctaaaaaagagttagacaaggtcgtaaccacggctattaaggaagagaccgaaaaggtagccgcagtgaagcagctggaggaatcgaagacaaagattgagaacctgctcgattggttgtcaaacgtcgacaaggacagtgagcgagctggcacaaaacacaaacaagtcattgagcagaatggcacccacttccaggagggcgacggcaaatcagcaattggcgaggaagacgaggtgaatggaaacttactggagactgacgtggacgggcaggtaggaaccacccaggaaaatctcaaccaacaatatcagaaagtgaaagctcagcatgaaaagataatctctcagcatcaggcagtgattattgctacacagtccgctcaggtgcttctagaaaaacagggacagtacctttctccagaggagaaagaaaagctgcagaagaatatgaaggaattaaaggtgcactacgagaccgcccttgctgaaagtgaaaaaaaaatgaagctgacccattcacttcaggaagagctggaaaagtttgatgccgactataccgagttcgagcactggcttcaacagtccgaacaggagctggaaaacctggaagcgggcgccgatgacatcaatggcctgatgaccaaactgaaacgccaaaagagcttctctgaagatgtgataagccacaagggggatctcaggtacatcaccatctccggcaatagagtgctggaggcagccaagagttgtagcaagagagacgggggaaaggttgacaccagcgccactcaccgcgaagtgcaacggaagctcgaccatgctactgaccgctttcgcagcttgtattccaaatgtaatgttcttgggaataatcttaaagatctggttgataagtaccagcactatgaggatgctagctgtggtttgctggctggcctgcaagcatgtgaagcaactgccagcaaacacctgtccgaacccattgctgtagaccctaagaatctgcagaggcagttagaggaaactaaggccttacagggacagatctcaagccagcaggttgccgtcgaaaagttgaagaagacggccgaggtattgctcgatgctagaggctctctcctaccagctaagaatgatatccagaagaccctggacgacattgtgggccgctacgaggacttaagcaagtcagtgaatgagagaaacgagaaactccagatcacgctaacccgcagtctgtccgtgcaggatggtttggatgagatgctggactggatgggtaatgttgaatctagcctcaaagagcagggtcaggtgcccctgaatagtaccgcattgcaagacattatatccaagaacattatgctggagcaagacattgcaggccgtcaaagcagtatcaacgccatgaatgagaaagtgaagaaatttatggagaccaccgacccaagcacggcaagcagcctccaggccaagatgaaggatttaagcgcacgatttagtgaggcgagccacaagcataaagagacactggcaaaaatggaagagctcaagaccaaagttgagctcttcgagaatctgagcgaaaagcttcaaacttttttagagactaagacacaagctcttactgaagtggatgtgcccggcaaggacgtgaccgaactgagccagtacatgcaagagtcaacatctgaatttctggaacacaaaaaacatctagaagttttgcactcccttctgaaggaaatatcttctcatggactcccgagcgacaaggcattagttttagaaaaaacaaataacctgtcaaagaagtttaaagaaatggaagatactatcaaggagaaaaaagaggcagttacctcctgccaggagcagcttgacgctttccaggtgctggttaagtcgctgaaaagttggattaaagaaaccacaaagaaggtcccaattgtccagccgtccttcggcgcggaagatcttggaaagtccctcgaagacacaaaaaaactgcaggaaaagtggtcacttaaaacacccgaaatccagaaggtgaacaacagcggaattagcttatgcaacttgatttctgccgtgacaacgcctgcaaaggcaattgccgccgtgaagtccgggggagctgtgctaaacggagaggggaccgcgacaaatacagaggagttttgggctaacaagggccttacttccattaaaaaggatatgaccgacatctcccacgggtatgaggacctcggcttactgctgaaagacaaaattgcggaactaaatactaagctgagtaagctacagaaggctcaagaggaaagctccgcaatgatgcagtggctgcagaaaatgaacaagaccgcaacaaagtggcagcagacaccggcgccgacagataccgaagctgttaaaacccaggttgagcagaacaagagcttcgaggcagaattaaagcagaatgtgaacaaagtccaagagcttaaggacaagctaaccgagctactagaggagaacccagacaccccagaggcaccacgttggaaacagatgttaactgagatcgattccaagtggcaggagcttaatcagctgaccatcgataggcagcagaagctagaagaatcgtcaaacaaccttactcagtttcagaccgtggaggcacagttgaaacaatggttggtggagaaagaacttatggtttctgtgttgggtccattatcgatcgacccaaatatgttgaatactcagagacaacaggtacagattctgctacaggagtttgctacgcgaaagcctcagtacgaacaattaacagcagctggacaaggcatcctctcccgacccggcgaggacccatcgctcagaggtatcgtgaaggagcagctcgctgcggtgactcaaaagtgggacagtctgaccggtcagctaagcgatcgatgtgattggatagaccaagcaatcgtgaaatctacacagtaccagtctcttctgcgctcattgtctgataaactgtcagatttggacaacaagctctcttcatcccttgccgttagcactcatcctgatgccatgaaccagcaactggaaaccgctcagaagatgaaacaagagattcaacaagaaaagaaacagataaaagtcgcccaagcactctgtgaggatctttcggctctcgtgaaagaagagtacctaaaggcagaactttctcgccagttggagggaatacttaagtccttcaaagacgtggagcaaaaggccgagaaccatgttcagcacctacagtccgcctgcgcctctagtcaccaatttcagcagatgagccgagactttcaggcttggctggataccaagaaggaggagcagaacaagtctcacccaatatcagcaaaactggacgttttggagagcttgattaaggaccacaaggacttctcaaaaactctgaccgctcaaagtcacatgtacgagaagaccatcgctgagggagagaacctcttactgaagacccagggcagtgagaaagccgccttacaattacagctcaatactattaaaaccaactgggataccttcaataaacaagtgaaggaaagggaaaacaaactcaaggagtcattggagaaggcattgaagtacaaagagcaggttgagacactgtggccatggattgacaagtgccaaaacaacttggaagaaatcaagttctgtctggacccagctgagggcgagaactcgatcgcaaaactcaagtctctccagaaggagatggatcagcacttcggcatggttgagctgcttaataacaccgctaactctttgctctcagtgtgtgagatcgacaaggaggtggtaacagacgagaataagtccctcatccagaaagtggatatggtgacagaacagttacactcaaagaagttttgcttggaaaacatgactcagaagttcaaggagttccaggaggtgtcaaaggaaagtaagaggcagctccagtgcgccaaggaacagctagacattcatgacagcctcggatcacaggcctattcaaataaatacttgacaatgctgcagacccagcagaagtcgcttcaagctttaaagcaccaggtcgatttggcaaaacgactagctcaggacctcgtggtggaagctagtgacagcaagggtacaagcgacgtcctgctgcaggtggagaccatagcgcaagagcacagcacactctctcagcaagtcgatgagaagtgttccttcctcgaaactaagctccagggcatcggtcactttcaaaacacgattcgcgagatgttcagccagtttgccgagttcgacgacgaactagactctatggcgcccgtgggaagagatgcagagacactgcagaaacagaaggagacgatcaaagctttcctgaaaaaactggaggctctgatggccagtaacgataacgccaataagacgtgcaagatgatgctcgctactgaggagacatccccggatctggttggcattaagcgggacctagaggctctatccaagcagtgcaacaagttactcgatagagctcaagcccgcgaagagcaagttgaaggcacaattaaacgattggaggagttttatagcaagctgaaggaatttagcattctattgcagaaagcagaggagcatgaggaaagccaaggacccgtcggcatggaaacggaaaccattaaccagcagctgaatatgtttaaggtgtttcaaaaagaagaaatcgagcctctccagggcaaacagcaggatgtaaactggctgggtcaggggctcatccagtctgccgctaagtcaacctccacgcaaggccttgagcatgatttggatgacgtgaacgcaagatggaagactctaaacaagaaggtggcccaacgtgcagcacaactgcaagaagccctgctgcactgtgggagattccaagacgccctggagtcactgctcagctggatggtggatacagaagaactcgtggcaaatcagaagcccccttctgccgagttcaaagtcgttaaagcgcagatccaggagcagaaattgttacagcgactcctggacgacaggaagtccactgtggaggtcatcaaacgggaaggagaaaagatagcaacaactgctgagccagccgacaaagttaaaatcttgaagcagctttcccttctggatagtaggtgggaggcattgctgaataaagccgagacgcggaaccggcaacttgaaggaatttctgtggtggctcagcagtttcacgagactttagagcctctcaacgaatggttgacgacgattgagaagcggctggtaaactgcgagccaattgggacccaagcgagcaagctggaagagcagatcgctcagcataaagccctcgaagacgacataatcaatcataataaacacctgcatcaggctgtttctataggccagagcctgaaagtgcttagcagccgggaggacaaagatatggtccagagcaagctggatttctcacaggtgtggtatatcgaaatacaggagaagtcgcactcccggagtgagttactgcagcaggccctgtgcaatgcgaaaattttcggcgaggacgaagtggaactcatgaattggctgaacgaagtgcacgacaagctgagcaagctgtccgtgcaggactactcaacggagggactgtggaagcaacagagtgagctacgggtgctgcaggaggacattctgctgcggaaacagaacgtagatcaagctctgctaaacggtctggagctcctgaagcagacgactggagacgaagttctgatcatccaggacaagctggaagcaattaaagccaggtacaaagacatcaccaagctgagcaccgacgtggccaaaacactggaacaggcactccagctggcacgcagattacacagtactcatgaagaactgtgtacatggttggacaaggttgaggtggagctcctctcatacgagacccaagttttaaagggtgaggaagcttctcaagcacaaatgagacctaaggaactgaagaaggaggcgaagaataataaggcgctactagattctctgaacgaggtcagcagcgctctgctggagctggtgccatggcgagctcgggagggcctcgagaaaatggtggccgaggataatgaacgatatcgcctagtgtctgatactataacccagaaagtggaagagatcgacgccgccattctgcgaagtcagcagttcgatcaggctgcagacgcagaactgtcctggataactgaaaccgaaaaaaagctgatgagtctaggcgacatcaggttagagcaggatcaaacgagtgcccaactgcaggttcaaaagaccttcaccatggagatcctgcgacataaagacatcattgatgacttggtgaagagtggccacaaaataatgaccgcttgcagtgaggaagaaaaacagtcgatgaagaagaaattggataaagtgctaaagaattacgataccatctgccagatcaatagtgaacgatatcttcagctggagcgagcccaatcattagttaatcagttctgggaaacttacgaagaactatggccatggctcacagaaacgcagtctatcataagccagctgccggctcccgctctagaatatgaaacactgcgtcagcaacaggaggaacaccggcagctgcgcgagctcatagccgagcacaagccccacattgacaagatgaataagaccggccctcagctcctggagctgtccccaggcgagggcttttcaattcaggagaagtatgttgccgccgacaccctgtatagtcagattaaggaggacgtgaagaaaagggcggttgcactggatgaagctatcagccagtccactcaattccacgataagatagatcaaattcttgaaagcctggaacgcatcgtggagcgactgaggcagcctccttcaatttccgcggaggtggagaagattaaggaacagatttcggagaataaaaacgtatccgtagatatggaaaagttacagccactgtacgaaacgctgaagcagcgcggagaggaaatgatagcgcgttcgggagggacagacaaggacatatccgctaaagccgtccaggataagctggaccagatggtgtttatctgggaaaacatccacacccttgtggaggagcgcgaggcgaagcttctggatgtgatggaactggccgaaaaattttggtgtgaccacatgtcactcatcgtgacaattaaggacacacaggattttattagggacctcgaggaccctggcatcgacccatcggtggttaaacaacagcaggaagctgctgagaccattcgcgaggagattgacggtctgcaagaggagctggatattgttatcaatctggggtcagaactgatcgctgcatgcggagaacccgacaagcccatcgtcaaaaagtccatagatgagctgaactctgcctgggacagcttgaacaaagcatggaaggaccgcatcgacaagctggaggaggccatgcaagcagccgtccagtaccaggatgggctgcaggcagtgttcgactgggttgacatagcgggtggcaagcttgctagcatgtcccccatagggaccgacctcgaaactgtcaaacagcagattgaggagctcaagcagttcaagtccgaggcctaccagcagcagatcgaaatggagcgtctcaaccaccaggctgagctgctcctaaaaaaagtgaccgaggagtcagacaaacacacagtccaggatcctcttatggagctcaagttaatctgggactcactggaggagagaattatcaataggcagcacaagctggaaggcgcccttcttgctctgggtcagtttcagcacgcactcgatgagctcctggcgtggctgacccacaccgaggggcttcttagcgaacaaaaacctgtagggggagatccaaaggcaatcgagatcgagcttgcaaaacatcatgtgcttcagaacgacgttctggctcaccaaagcacagtggaggcagtgaacaaagctggcaacgacctgatcgagtcctctgccggagaggaggcatcaaatctgcagaataagttagaagtcctcaaccaaagatggcaaaacgtgttggagaaaactgagcagcgcaaacagcagctggatggggccctgaggcaagctaagggatttcacggagagatcgaggatctccagcagtggctgacggataccgaacggcatctgttagccagcaaacctctgggtggactgcccgaaactgcgaaggaacagttgaatgttcatatggaggtctgcgccgcttttgaggctaaggaggagacttataagagccttatgcagaaaggccaacagatgcttgcacgatgtccaaagtccgccgagactaatatcgatcaggatatcaataacctcaaggagaaatgggagtcggtggagaccaagctcaatgaacggaagacaaagctcgaagaggcccttaatctggctatggaattccacaacagtctgcaggattttatcaactggctgacacaagcagaacagaccttaaatgtggctagtagaccgagcctgattttggataccgtactgtttcaaattgacgaacacaaagtctttgccaacgaggtgaactcacaccgggaacagattatcgagcttgataaaacaggaacccatctgaaatatttctcccagaagcaggacgttgtgctcattaagaatctgctgataagtgtgcaatctcggtgggaaaaagtcgtgcagagattggtggagaggggtaggtctttggatgacgcccggaaaagagcaaaacagtttcacgaggcgtggagcaagctgatggaatggttagaagagtccgaaaaatccctggatagcgagctagagatcgccaatgatcctgataagataaagactcagcttgctcaacacaaggaatttcagaaatcccttggagctaaacactcagtctacgatacaacaaacaggaccggaagatcccttaaggaaaagacatctctagccgacgacaacctgaaacttgacgacatgctcagcgaactgagagacaagtgggataccatttgcgggaagtctgtggaacggcagaataaactcgaggaagcccttttattctctggacaatttactgatgcattacaggctttaatcgactggctttaccgcgtcgaaccccagctcgctgaagatcagccagtccacggcgacattgacttagtgatgaaccttatagataaccataaggcctttcagaaagaactggggaaacggaccagcagtgtccaggccctgaagcgcagcgcccgggagctcatagagggcagccgcgatgacagttcctgggtcaaggtgcagatgcaggagctgtccacccggtgggaaacagtgtgcgccctgagcatctctaagcagactagactggaagctgctctgaggcaagccgaagagttccattccgtggtccatgccctgctggagtggctggccgaagctgagcagacattacgcttccatggggtgctccccgatgatgaggatgctctgaggacactcatcgaccagcacaaggagtttatgaaaaaattggaggaaaagagagccgagctgaataaggccacaactatgggcgacaccgtcctggccatctgtcaccccgattctatcacaacgattaagcattggatcaccataattcgggccagattcgaagaagtcctcgcctgggctaagcagcaccagcagcgcctcgcatcggccctcgcaggtctaatcgctaaacaggaactactggaggcacttcttgcttggcttcagtgggcagagacaacactgaccgataaggacaaggaagtcataccccaagagatagaggaggttaaggccctgatagccgagcaccagaccttcatggaagaaatgacccgcaaacagcctgacgtggataaagttactaagacctacaagcggcgggccgctgatccatcctctctgcagtcccacattcctgtgctcgataaggggcgcgctgggcgaaagcgatttcctgcaagcagcctgtatccaagtggaagccagacgcaaattgagacaaaaaacccacgcgtcaatctactggtgtctaaatggcagcaggtctggctgctcgccctcgagagaaggcgaaaactcaatgacgcccttgatcggctcgaagaattgagagaattcgctaatttcgatttcgatatatggcgtaaaaagtacatgaggtggatgaatcacaagaagagccgcgtgatggactttttcagacgcatcgataaggaccaagacgggaagattaccagacaggagttcatcgatgggatcctttccagcaagttcccaaccagccggctcgagatgagtgctgtcgccgacattttcgatcgtgatggggacggatacattgactattatgagtttgtggctgcactgcaccctaataaggatgcctacaagccaattaccgacgccgacaagatcgaagacgaagttactcgccaggtggctaaatgtaaatgcgcgaaaagatttcaggtggagcaaatcggtgacaataagtacagagtgtccttccagagtaattttggtgactcccagcagctccgactagtgcgcatcctcagatcaacagtaatggttagggtgggaggagggtggatggccctcgatgaatttcttgtcaaaaatgatccttgtcgcgtacaccatcacggaagtaagatgcttagaagtgagtcaaactcgagtattaccacaactcagcctaccatcgcgaaggggcgcaccaatatggagctaagagaaaagttcatcctcgccgatggcgcgagccaaggcatggcagccttccggcccagagggcgccgctcccgcccaagctccaggggcgcctcaccaaacagaagtacttcggtgagctctcaggctgcccaggccgcttctccacaggtgcccgctacaacaactccgaagggtactccgatacagggctctaagcttcgccttccggggtacctgagcggcaagggcttccattcaggtgaagattcggggttgattaccacagctgcagcccgcgttaggacgcagttcgcggactcaaagaagaccccctcaagaccaggctcgcgcgctggctcaaaagccggaagccgcgcaagctcacgaagaggcagcgacgcaagcgattttgacatctccgaaatccagtccgtgtgtagcgacgtcgagactgtcccacaaacccaccggcctactccaagggccgggagccggccatcaaccgccaagccctccaagattcctacccctcagcgcaaatcccccgccagcaagctcgacaaatcttctaagcggtag

SEQ ID NO: 186115 - DNA, 16374 bp, Artificial Sequence
  Description of Artificial Sequence: Synthetic coding sequence
atggccggctacctgagccccgccgcctacctgtacgtggaggagcaggagtatctccaggcttacgaagatgtgctggagagatataaggacgaacgtgacaaagtacagaaaaagacattcactaaatggatcaaccagcatctaatgaaagttaggaagcacgtcaacgatctgtacgaagatcttagagatggccacaacctcatatcactcttagaagtactgagcggcgatactttaccgcgtgagaagggcagaatgcgtttccaccggctccagaacgttcagattgctctggattatctgaaaagacggcaagtcaagctagtgaacatccgtaatgacgacattaccgatggaaaccctaaattaactctcggactgatctggactattattttacattttcagatcagcgatatccatgtcactggagaatccgaggatatgtcggctaaggaacgcctcctactgtggactcaacaggccactgagggttatgctgggatccgctgcgagaatttcactacttgttggagggacggcaaactgttcaatgccatcatccataagtaccgcccagatctgattgacatgaatacagttgccgtgcagtcaaacctggcaaatctggaacacgctttctacgtggctgagaagatcggcgtaattcgactgctggatccagaagatgtagacgtttcttcacctgatgaaaagagtgttataacttacgtgagtagcttgtacgatgccttcccaaaggtgccagagggcggggagggcataggagcaaacgacgtagaggtcaagtggatcgagtaccagaacatggtcaattacctcatacagtggattcgccatcatgtaacgaccatgtcagaacggaccttcccaaataaccctgtggagctgaaggctttgtacaaccagtaccttcagtttaaagaaacggagattcctcctaaagagaccgaaaagagtaagatcaagaggttgtataaactgctggaaatatggattgagtttggacgcatcaagttactccagggctatcaccccaatgatatcgagaaggaatggggtaagctaatcatcgccatgctggagcgcgagaaggctctaaggcccgaggtcgagcgactggagatgctgcagcagatagccaatcgcgtgcaaagggatagcgtgatttgcgaggataaattaattctagccggcaacgctctgcagagtgacagtaagcggctcgaatccggtgtgcaattccagaatgaagccgagattgctgggtacattctcgaatgcgaaaacctcctaagacagcatgtaatagatgtgcagattcttatcgacgggaagtactatcaggcagatcagctggtgcaacgtgtagctaaactcagggatgagatcatggcccttagaaatgaatgctcctctgtgtattctaagggcagaatccttaccacagaacagacgaaacttatgatttctggcattacccaatctcttaatagcggcttcgcccagaccttgcatccatcactcaccagcggactgacgcaaagcctgacacccagtcttacttcctccagtatgacgtcgggactcagcagtggaatgacaagccggcttacaccatccgtgacgccagcatacactcctggattcccctctggattggtaccgaacttttcaagtggagtagaacctaactcactacaaaccttgaagcttatgcagattaggaaaccgctcctgaaaagcagcctgctcgaccagaatctgacagaggaggaaatcaatatgaagtttgtgcaggatttgctgaactgggtcgatgaaatgcaagtgcagttggaccgaacggagtgggggtcggatctacccagtgtggaaagtcatctagagaatcacaaaaacgtgcatcgagcgatcgaagaattcgaatcctctctgaaggaagctaagatcagtgaaattcagatgaccgccccattgaagttgacatatgccgagaaactgcaccggctggagtcccaatacgccaaactccttaacacctctcgaaaccaggagcgccacctggatacactgcataactttgtgtcccgtgccaccaatgaactgatctggttaaatgagaaagaagaagaagaagtggcctacgattggagcgagcggaatacgaatattgcccgaaagaaggactatcatgcggaacttatgcgcgagctggaccagaaagaggagaacataaaatccgtgcaagagattgctgaacagttactgctcgagaaccatcccgcaaggctgactatagaggcctaccgagccgccatgcaaacccagtggagttggatcttgcagctgtgccaatgcgtagaacaacacatcaaagagaatactgcttattttgaatttttcaatgatgcaaaagaggcaactgattacctgcggaacctcaaggacgcaattcagcgtaaatactcttgtgaccgaagctcaagcattcacaaactggaggatcttgttcaggaatccatggaggagaaggaggaactgttgcagtacaaatctaccatagctaatctgatgggaaaagccaagactataattcagttgaagccgagaaatagcgattgccccctcaagacttcgatcccaattaaggcaatttgcgattatcgtcagattgagattaccatctacaaggatgatgaatgtgttcttgcaaataacagccaccgggccaagtggaaagttatatcgcctaccggcaacgaggctatggtgccctccgtctgtttcactgtacctcctccaaataaagaagccgtggacctggctaaccgaattgagcagcaataccagaatgtgctcacattatggcatgaatcgcatattaacatgaagtctgtggtgtcatggcattacttaattaacgaaattgacagaatcagagcctccaacgtagctagcatcaagacgatgcttcccggcgaacaccagcaggtactatcaaacttgcagtctaggttcgaggacttcttggaggacagccaagaatctcaggttttcagcggcagtgacataacccagctcgagaaggaagtgaatgtgtgtaaacagtattatcaggagcttctcaagagcgctgagagggaggaacaagaagagtccgtctataacctgtacatcagcgaggtccggaatatccgccttaggcttgaaaattgcgaagatcgtctgatcaggcagattagaacccctctcgaaagagacgacttgcatgagtccgtgtttcggatcaccgagcaagaaaaactgaagaaggagctggagagactgaaagacgatctggggacaattaccaataagtgtgaggagtttttctctcaggccgctgcctctagcagcgtcccgacgctgagaagcgagctgaatgtggtcctacagaatatgaatcaggtttattctatgagcagcacctatatcgacaagctaaagaccgtaaacctcgttctcaagaacactcaggctgcagaggctctggtcaagctgtatgagaccaaactgtgcgaagaggaagcagtgatcgcagataaaaacaatatcgaaaatcttatctctacactgaagcaatggcgcagtgaggtcgatgagaagaggcaagttttccacgcactggaggacgagctgcaaaaggcgaaggctatttcggatgagatgtttaagacctataaggagcgagacctggatttcgactggcataaggaaaaagccgaccagctcgtggagcgttggcaaaacgtgcatgtgcagatcgacaacaggctgcgcgatctcgagggaatagggaaaagcttgaaatactaccgtgacacataccatcccctggatgactggattcaacaggtggagacaacccaacgaaagatccaggaaaaccaacccgagaactcaaaaaccctggcgacacagctcaaccaacagaagatgctagtttcggagatcgagatgaaacagtccaagatggatgagtgtcagaaatacgccgagcagtactccgcaaccgtgaaggattacgagctccaaaccatgacgtaccgggctatggtggattcccagcagaagagccccgtgaagagaagacgcatgcaaagctctgctgatctgatcatccaggagttcatggacctgagaacaagatacacagctctggtcaccttaatgacccaatatataaaattcgccggcgattcactcaaaaggcttgaagaagaagagaaatcactggaggaggagaaaaaggaacatgtcgagaaggctaaagaactgcagaaatgggtctccaacatctcaaagactctcaaggacgcagagaaggctggcaagccaccatttagtaagcaaaaaatctccagcgaggagataagtacaaagaaggagcaacttagtgaggccctccagacaatccagcttttccttgctaagcatggggataagatgacggatgaggagcgtaacgaactggaaaaacaggtgaaaacactccaggaatcttacaacctgctgttctctgaatctctcaaacagttacaggaaagccaaacctcaggggatgtcaaggtggaggagaagattgtcgcagaacggcagcaggagtacaaggaaaaattacagggaatctgtgatctcctgactcaaaccgagaatcggttaataggccatcaagaagcctttatgattggggacggaaccgtcgagctgaagaaatatcagagtaagcaggaagaactgcagaaggatatgcagggctcagcccaggctctggcagaagtggtgaagaatacagagaacttcttaaaagaaaatggcgagaagctgtctcaggaggacaaagctctcattgaacaaaagctgaacgaggctaagatcaaatgtgaacagctgaacttgaaggccgagcagagtaagaaggagttagacaaggtggtcacaactgcaatcaaggaagagacagagaaggtcgccgcagtgaagcagctggaagagagtaaaacgaagatagagaatctcttggattggttatcgaacgtcgacaaagactccgagcgagcaggcacaaagcataagcaggtgatcgagcagaacggaacccactttcaggagggggacggaaaatccgctattggggaggaagacgaagtgaacggcaatctgttagaaaccgatgttgacgggcaggtcgggaccacacaagagaatttgaatcagcaatatcagaaggtgaaagctcagcatgaaaaaattatcagtcagcaccaagctgtgatcattgctactcaaagtgcccaggtcctgttagaaaagcagggccagtacctttcacccgaggaaaaagaaaagttgcagaagaacatgaaagagctgaaagtgcattatgagacagcactggccgaatccgagaagaagatgaagctgacacattccctgcaagaggagcttgagaagtttgatgctgattacaccgaattcgagcactggcttcagcagagtgaacaagagcttgaaaacctggaagcaggggcagatgatataaatggccttatgaccaaacttaaacggcagaaatcattcagtgaagatgtcattagccacaagggcgacctcagatacataactatcagtgggaaccgcgtactcgaggcagctaagtcttgttccaaacgcgatggagggaaagtggatacgagtgcgactcatcgggaggtccagcgaaagctggatcacgcaaccgaccgctttagatcactttattccaagtgtaatgttctggggaacaacctcaaggacctggttgataaataccagcattatgaggatgcgtcgtgtggtctcctcgcagggcttcaggcctgtgaggccacagcctccaagcatctctctgaaccgattgccgtcgatcctaaaaacctgcagcgtcagcttgaagagactaaggccctgcaggggcagatttccagtcagcaggtggccgtggagaagctcaagaaaacggctgaagtcttgctggatgccagaggctcgctacttccggcaaagaacgatatacagaaaactcttgacgatatcgtgggcagatacgaggatttatctaagtctgtcaatgaacggaatgaaaaattgcagatcaccctcactcggagcctctccgtccaggacggactcgacgagatgctggactggatgggcaatgtggaatcgagcctcaaggaacaagggcaggtccctctgaacagtaccgcccttcaggacattatctccaaaaacatcatgctggaacaggacattgctggacggcaatcatctattaacgccatgaatgagaaggtgaagaagttcatggagacaaccgaccctagcactgcctcaagcttacaggccaaaatgaaggaccttagtgcccgcttcagtgaagcatcccataaacacaaagagacactggccaagatggaggaactgaagacaaaagtggagctcttcgagaacctgtctgagaaactccagacattcttggagacgaaaacacaggcacttacggaggtggatgttcctggcaaagacgtcaccgagcttagtcagtatatgcaagaatcaacctccgagttcttagagcataagaaacacctggaggtcctccacagcctcctgaaagaaatcagcagccacggacttccttccgacaaggccctggttctggagaagaccaacaatctgagtaaaaagttcaaagagatggaagacacgatcaaggagaaaaaggaagccgtgacatcctgccaggagcagctcgacgccttccaagtcttggtaaagtcccttaaatcatggattaaggagacgaccaaaaaggtgcctattgtccagccatccttcggcgccgaagaccttggaaagagtcttgaggatactaaaaaattacaggagaagtggtctctgaagactcccgagatacagaaggtcaacaactcgggtatctctctgtgtaacctgattagtgctgtgactacgcccgcaaaagcgattgctgccgtcaagtccgggggggctgtcctgaacggagaaggcaccgccaccaacacagaggagttctgggcgaataaaggcctgacatccattaaaaaagatatgaccgacatctcccacggctacgaagacctggggttgctcctcaaggataaaatcgctgaacttaacaccaagttgagtaagctgcagaaagctcaggaagagagttcagctatgatgcagtggctccagaaaatgaataaaactgctaccaagtggcagcaaacgcccgcccccactgacactgaagccgtgaagacgcaagtcgaacagaacaaatctttcgaagccgagctgaagcagaatgtgaacaaagttcaagaactgaaggacaagctcacagaactcctcgaggagaatcctgacacccctgaagcgccgaggtggaagcagatgctcaccgagatcgactcaaaatggcaagaactgaatcagctcactattgacagacaacagaagctcgaggaatcttccaacaacttgactcagttccaaaccgtggaggctcagctgaagcagtggttggtggagaaggagttgatggtttccgtcctgggacccctatcaatcgacccaaacatgctgaatacacagagacagcaggtgcagatcttactgcaggagttcgccaccagaaagccacaatatgagcaacttaccgctgccggccagggaatcctgagtcggccaggcgaagacccttctctgcgcggaatagtgaaagaacaactcgccgctgtcacacaaaaatgggacagtctgaccggccagctttctgatagatgcgactggattgaccaggccatcgtgaagtctacccagtaccagagtctgctgcggtccctcagcgacaagctttccgatttagacaacaagcttagctcctctctggcagttagcacgcatccagatgccatgaatcagcagctagagaccgcacagaagatgaaacaggagatccaacaggagaaaaaacaaatcaaagtggcacaggctctctgcgaagatttatccgctctggtaaaggaggagtatctcaaggccgagctgagtcgccagctggaggggattctgaagtcattcaaagacgtggaacagaaagccgaaaaccacgtgcagcacttgcaatctgcctgtgccagttctcatcaatttcaacaaatgagtcgggacttccaggcctggctggataccaagaaggaggaacagaataagagtcatcccatctccgctaaactggacgttcttgagagtctgattaaggatcacaaggactttagtaagacactgacagcccaatcacatatgtatgaaaaaactatcgctgagggtgagaacctcctgctaaagacgcaggggagcgagaaagcggcccttcagctccagctaaataccataaagactaattgggacaccttcaataagcaggtaaaggagcgggagaataagcttaaagaaagcctcgaaaaagcccttaaatacaaagaacaggtggagacgctgtggccatggatcgacaaatgtcaaaacaatcttgaggagataaagttctgtcttgatccagcagaaggagagaattcaatagccaagctgaaatcccttcagaaagagatggatcagcattttggtatggtggagttgctcaacaacacagctaactccttgctgtcggtctgcgagattgacaaggaagtggtcactgatgagaataaatccctgatccaaaaagtagatatggtcactgaacaattacatagcaagaagttttgcctcgagaatatgacgcagaagtttaaggagttccaagaggtctctaaagagtccaaacgccaactccagtgcgctaaggaacaactggacatccacgatagcctgggaagtcaggcctacagtaacaaatacctgacgatgctgcagactcaacaaaaaagcctccaggccctaaagcaccaggtggatcttgctaaacgtctggcacaggacctcgtcgttgaggcatctgattctaaggggacctccgacgtcttactccaagtggaaacaattgcacaagagcacagtacactgtcacagcaagtggacgaaaaatgcagtttcctggagaccaaactccagggaattggtcattttcaaaatactattcgggaaatgttcagccagtttgcggaattcgacgacgagctggactccatggcacccgttggcagagatgcggagacactgcaaaagcaaaaagaaacaattaaagcgtttctgaaaaagctggaagccttaatggcatccaatgataatgccaataaaacttgcaagatgatgttagctactgaggaaacgtctccagacttggttggtatcaagcgggatctagaagccctgagcaagcaatgcaataaacttctggatcgggcccaagccagggaagaacaggtggagggcaccatcaagagactggaagaattttacagcaagctgaaggaattcagcatcctgctgcagaaagccgaggaacacgaagaaagccagggacccgtgggtatggagactgaaacaataaaccagcagctgaatatgttcaaggtctttcagaaagaagaaatcgaaccgctgcaaggcaaacagcaggacgttaattggttgggccagggccttattcaatccgcagcaaagtctacaagcacacagggtctcgagcacgatcttgacgacgtgaatgcccgctggaagacattaaacaaaaaagttgcccagcgcgcagctcaactgcaggaggcgcttctgcactgcgggcggtttcaggacgcccttgagtcacttctttcatggatggttgacacagaggagctggtagctaatcaaaaaccccccagcgccgagttcaaggtggtgaaagctcagatccaggagcaaaagcttttgcaaagactcctggatgataggaaatctactgtcgaggttataaaacgggaaggagagaagattgctaccacggcggaacccgctgacaaggtgaagattcttaagcagttatctcttctggactctagatgggaagcgcttcttaataaggccgagacccggaatcggcagctcgaaggtatttccgtggtggctcagcagtttcatgagacattggaaccactgaatgagtggcttaccacaatcgaaaagaggctggtgaattgtgagccaataggcacgcaggcttcaaagttagaggaacagattgctcaacataaggccctagaggacgacatcatcaatcataacaaacacttgcatcaagccgtctcgattggtcaatcgctgaaagtcctttcctctagggaggataaagacatggttcagtctaagctggatttctctcaggtgtggtacattgagatccaggaaaaatcacactcgaggtccgagctgcttcaacaagccctctgcaacgctaaaatctttggggaggatgaggttgaactgatgaactggctcaatgaagtgcatgataagctctctaaactgagcgtacaagactatagtactgaggggctttggaaacaacagtccgagctccgcgtattacaggaagatatccttctgaggaagcagaacgttgaccaggcattgctgaacgggttggagttgctgaagcagaccacaggggacgaagtacttattattcaggacaagctggaggcgattaaggcccggtacaaagacatcaccaagctgtctaccgatgtcgccaaaactttagagcaggctcttcagctagcccggcgcttgcacagcacccatgaagaactctgcacgtggctggacaaagtggaggtggagcttttatcatatgagactcaagtactgaaaggggaggaggcaagtcaggcgcagatgagaccaaaggagttaaagaaagaagctaagaacaacaaggccctcctcgactccctcaatgaggtttcaagtgctctgctcgaactggtgccatggcgcgccagagagggcctcgagaagatggtcgccgaggacaacgagcgctacagactcgtatcggacaccatcacacagaaggtggaggagattgatgccgccatattacgatctcagcagtttgaccaggcagcagacgctgagctttcctggataaccgagaccgaaaagaaactgatgtcgcttggggacatccgactcgaacaggaccagacttcagctcaactccaggtgcagaagaccttcacaatggagattttacgacacaaagacatcatagacgatttagtgaagtctggccataagatcatgacggcttgctctgaggaggaaaaacaaagtatgaagaagaagctcgataaagtccttaaaaattacgatactatttgtcaaataaattctgagcggtacctacaactcgagagggctcagtctttagtgaatcagttttgggaaacctatgaggagctttggccctggctgacggagacgcagagcatcataagccagcttcccgcccccgcgctggaatacgaaaccctgcgtcaacaacaggaggagcaccggcagctgagggaactaatagctgaacacaaacctcacatcgacaaaatgaataagacaggcccccagctgttagagctttcccccggcgagggcttttccattcaggagaagtacgtggctgccgacacactgtacagtcagataaaggaagacgtgaagaagagggctgttgcactcgacgaggcgatcagccagtctacccagtttcatgacaaaatagaccagattcttgagtccctcgaacgtatagttgagcgcctgcgacaaccaccaagcatctccgcagaagtggagaagattaaagaacagatatctgagaacaagaacgtgagcgtggatatggagaagctgcagcccctctatgagactttgaaacagcgcggagaagagatgatcgcccgtagcggtggcaccgacaaagacatctcagccaaggccgttcaggacaagctcgatcagatggtttttatatgggagaacattcacacgctggtggaggaaagggaggctaaacttttggacgtgatggaactcgccgagaagttttggtgcgaccacatgtctctcatagtgactataaaagatacacaagatttcattcgcgatctagaagacccgggaattgatccatccgtggtcaagcagcagcaagaagccgctgagaccatccgggaagaaatagatggacttcaggaggagcttgacattgtaattaatctggggtcagaactgatcgccgcctgcggggaaccagacaaaccaatcgtcaaaaagagtatcgacgagctgaattccgcatgggactcgctcaacaaggcatggaaggaccggattgacaaacttgaggaagccatgcaggccgctgtgcagtatcaggacggacttcaggctgtgtttgattgggtagacatcgccggaggtaagctggcctccatgtcacctattggcactgacttagaaaccgttaaacagcagattgaggagctcaagcagtttaaatctgaggcctaccagcagcaaatcgagatggagcggctgaaccaccaagcagagctcttattgaaaaaggtgactgaggagtcagataagcacacagtgcaggacccactgatggaactcaagctaatctgggatagcttagaggaacggattatcaacaggcaacacaagctggaaggcgccctgcttgcgctcggtcagtttcagcacgcactcgacgagctcctggcctggctgacccatacggaaggcctgctgtccgaacaaaagcctgtaggaggtgaccccaaggccatcgagatcgaactggctaagcaccatgtcctgcagaacgacgttctcgctcaccagtcaaccgtggaggccgttaacaaggcagggaacgacttaatcgaatccagcgcaggggaagaggcctccaacctccaaaataaactggaggtgttaaaccagcggtggcagaacgttctcgaaaagacagagcagcggaagcagcagctggacggtgcccttaggcaggccaagggattccacggtgagattgaggatcttcagcagtggctgacagataccgagaggcacttgctcgcctctaagcctttgggtggcctcccagaaactgccaaggaacagctcaacgttcatatggaggtgtgtgcagcctttgaagccaaggaggaaacctacaagagcctgatgcagaaggggcagcaaatgctcgcccgctgcccgaagagcgctgaaactaatatcgaccaggatatcaataatttaaaggaaaaatgggaatccgtagaaacaaagttgaacgagcggaaaactaagctggaagaggcgctcaacttggccatggagtttcacaatagcttacaggattttatcaattggttgactcaggcggagcagactctgaatgtggcctctagaccgtccttaatcctagacacggttctcttccagattgacgagcacaaggtttttgctaatgaggtgaactctcatcgcgagcaaattattgaacttgacaagacgggcactcatctcaaatactttagtcagaagcaagatgtcgtgctgatcaaaaatctgttgatctccgtgcagagccgatgggagaaggtcgtgcagaggcttgtcgagaggggacgctcactcgatgacgctagaaagcgcgctaagcagttccatgaagcctggagcaaattgatggagtggctagaagaaagtgaaaagagcctagacagtgagctggaaatcgcaaatgaccccgacaaaatcaaaactcaattggcacagcacaaagagtttcagaagtcactgggtgcgaaacactccgtatatgatacaactaacagaacaggcagatctttgaaagagaagacatccttggcagacgacaacttgaaactagacgacatgctctctgaactgagagacaagtgggacaccatttgcgggaagagtgttgaaaggcaaaacaagctagaggaggctttactctttagcggccagttcacagacgccctgcaagctctcatcgattggctgtaccgggtcgagccacaactcgctgaggaccagccggttcacggcgacattgatttagtcatgaatctgatcgataaccacaaggcttttcagaaagaattgggtaagcgcacttccagcgtgcaggcgttgaaacggagcgccagggaactgatagagggaagcagagatgacagctcttgggtaaaagtccagatgcaagaactgtctacaagatgggaaaccgtatgcgccctttcaatctccaaacagaccaggttggaagctgccctgcgacaggccgaagaattccactcagtggtccacgcactgctggaatggctcgctgaagcagaacagactctcagattccacggtgtgcttccagatgacgaggatgctctgcggacactgatcgatcagcacaaggaattcatgaagaagctggaagagaaaagggccgagctgaataaagccaccaccatgggcgacactgtccttgccatatgccatccagactccattactaccatcaaacactggataacaatcatcagagcccgctttgaggaggtgctcgcgtgggcgaaacagcatcagcagcgattagccagcgccctggccggacttattgctaaacaagaattgttggaagctctgctggcctggctgcagtgggcagagactactcttaccgacaaagataaggaggtgatcccccaggagattgaggaggtgaaggcactgatcgccgaacatcagacatttatggaagagatgacacggaaacaaccagacgttgataaggtgaccaaaacgtacaaacgtcgggccgctgacccctccagtctacaatcacacattccagtgcttgataagggcagagccggacgcaaaaggttccccgcttcttctttgtacccttctggctcccagacccagatcgagaccaaaaaccctagagtaaacctgctcttacgagaatttgcaaactttgactttgacatttggcgaaagaaatacatgagatggatgaaccacaagaaaagccgggtaatggacttcttcaggaggattgataaggaccaggatggcaagatcaccagacaggaatttatcgacgggatactcagttccaagttccctacttcaagactggagatgtctgccgtcgccgacatcttcgatcgagatggcgatggatatattgactattacgaatttgtggccgccctgcatccaaacaaggatgcttacaagccaattacagatgccgacaaaatcgaagatgaggttacacggcaagtggctaagtgcaaatgcgcgaagagatttcaagtggagcagatcggggacaataaatatagagtgtcatttcagtcaaattttggtgacagccagcaacttagactagtgcggattttgcgcagtaccgtgatggtgcgtgttggggggggatggatggccctcgatgagttcttagtcaagaacgatccttgccgagtgcatcatcacggaagcaaaatgctcagatcagagagcaatagcagcatcaccaccacacaaccaaccattgccaaaggccgtaccaacatggaactacgggagaagttcatcttggctgatggggcaagtcaaggtatggccgcttttaggcccagaggccgtcgttccagaccttcatccagaggcgcgtccccgaataggtcgacttccgtttcctcacaggctgcccaggcagcctccccgcaggtgcctgccactacaacccccaaaggcactcctatccagggatcaaagttgcggctacccggctacctgtctggaaagggcttccatagcggcgaggattccggtcttattacgactgcagctgcgcgggtgagaactcagttcgcagactccaagaagacgccgtctaggcctgggtcccgagcaggtagcaaggctgggagtcgcgcctcttcccgtaggggatcggacgcgtctgatttcgatatcagcgagattcagtccgtttgctcagatgtcgagacagtgccgcaaactcaccggccaaccccacgggctgggagccggccgtctacagccaaacctagcaagatccctactccccagcggaagagtccagcctcaaagctcgataagagcagtaagcggtag

SEQ ID NO: 186116 - DNA, 9183 bp, Artificial Sequence
  Description of Artificial Sequence: Synthetic coding sequence
atgcacagcagcagctacagctaccggagcagcgacagcgtgttctccaatacaacaagcacacggacatcactggactcaaatgaaaatctcctcctcgtgcactgtggccctaccctgatcaattcctgcatatccttcggctctgagtccttcgatggtcacagattagaaatgctccagcagattgctaacagagttcagcgggattctgtaatctgcgaggacaagctgatcctggccggcaacgcccttcaatccgactccaaaagacttgaatctggtgttcagttccagaacgaagccgagatcgcgggctatatactggaatgcgagaacctcctaaggcaacatgtcatcgatgtgcaaatactcattgacggcaagtattatcaggccgaccagctggttcaaagagtcgctaagttgcgggacgagattatggccctgagaaacgaatgcagcagtgtctattccaaagggagaatactcacaactgagcagacaaagctcatgataagtgggatcacacaatccttaaatagcgggttcgctcagaccttacatccgtccctgacttccggactaacacagagtctgactccttcgcttaccagttcctcaatgacaagcggcctatcttccggaatgactagtcggctgaccccttcggtcactcctgcttatactcctgggtttccttccggcctggtgccaaatttttcctctggggtcgaacctaatagcttacaaactcttaagttaatgcagattcgtaaacctctgctcaagtcttccttactggatcaaaacctcaccgaagaggagatcaatatgaagtttgtgcaggatctcctgaactgggtcgatgagatgcaggtgcagttagaccgtactgagtggggctcagatctgccgtccgtagaaagtcatcttgagaaccataaaaatgtccatcgcgccatcgaggagttcgaaagctccctgaaagaggcgaagattagcgagattcagatgacagctcctctcaagctgacttatgcggagaagcttcacaggttagagtcccaatacgcaaaactgttaaacacaagcaggaatcaggagcgccatctggacacactccacaacttcgtgtcccgggctacaaatgaacttatttggttgaacgagaaagaggaagaggaggtagcgtatgattggtcggaaagaaacacaaatatcgccagaaaaaaggattaccacgccgagcttatgcgtgaattggatcagaaggaagaaaacatcaagagtgtgcaagaaatagccgagcagctccttctggagaaccaccctgcacgactgacgatagaagcttacagagcggcaatgcaaacccagtggtcatggattctccaactctgtcagtgcgttgagcagcacattaaggagaataccgcctatttcgagttcttcaatgacgcgaaggaggcgacagactatctaaggaacctcaaagacgccatacagcgtaaatatagttgcgaccgctcatcgtccattcacaaacttgaagatctggttcaagagagcatggaggaaaaggaagaactcttacagtataagagtactatcgcgaacctgatgggtaaagcaaaaactattatccagttgaaaccccggaatagcgactgccccctgaagacatcgataccaatcaaagctatctgtgattaccgccaaatcgagatcactatttacaaagacgacgagtgcgtactagcaaataattctcatcgggctaagtggaaagtgatcagcccgactggcaacgaagccatggtaccaagtgtgtgctttactgtcccacctccaaataaggaagcagtggacctcgctaacagaattgagcagcaataccagaacgtcttaacgctttggcacgaatctcacatcaacatgaaatctgtcgtctcctggcactacctcatcaatgagatcgaccggattcgggcgtcaaatgttgcaagtatcaaaaccatgctgccaggcgagcaccagcaagtcctgagtaacctgcagagccgatttgaggatttcctggaggattcacaggagtctcaggtgttctcaggatctgacataactcagctggaaaaggaggttaacgtctgcaagcagtactaccaggaactgttaaagagtgccgagagagaagagcaggaggaatctgtgtacaacctttacataagcgaggtgcgtaacattcggctgagactagagaactgcgaagacaggctcataagacagatccgtacacccctggaacgagatgatctgcatgagtctgtgtttagaataactgagcaggaaaaactcaagaaagagctggagcggcttaaggatgacctgggaacgatcactaacaagtgtgaggagtttttctcacaagcagctgcttcttcatctgtgccaactcttaggtctgaactgaacgtcgtgctccaaaatatgaaccaagtttacagtatgtcctcgacttacatagacaaactgaagacagtcaatctcgtgttgaagaacacccaggcagcggaagctcttgtcaagctgtatgaaactaaactctgtgaagaagaggccgtgattgctgataagaacaatatcgaaaatttgatctccactctgaaacaatggcggagcgaggtcgacgaaaaaagacaagtgttccatgcccttgaagatgaactgcaaaaagccaaggctatctcagatgaaatgttcaaaacttacaaggagagggatctggatttcgactggcacaaggaaaaggccgatcagctcgtggaacggtggcagaacgtccacgtgcagattgacaaccgcctgcgagatctggaagggatcggcaaaagtctcaagtactacagggatacttatcaccctcttgatgattggatacagcaggtggaaacaactcagagaaagatccaggaaaatcaaccagagaatagcaaaaccctggcaacccagcttaaccagcagaagatgctggtgagcgaaatcgagatgaaacagagcaaaatggatgagtgtcagaagtatgccgagcaatacagcgcaaccgtgaaagactacgagctgcagactatgacatacagggcaatggttgattctcagcagaaaagcccagtcaagaggaggagaatgcagagtagcgcagatcttatcatccaggaatttatggatctgagaactcgctatactgccctagtgactttaatgacgcagtacatcaaattcgccggagactcgctgaaacgactggaagaagaggagaagtcactggaggaagagaaaaaggaacacgtggagaaagccaaggaactgcagaaatgggtcagcaatatctcaaaaacattgaaagatgccgagaaggcaggaaagcctccattttcaaaacagaaaatcagttcagaggaaatttccaccaagaaggagcaattgagcgaggcgctgcaaactatccagctgtttctggccaaacatggtgacaaaatgactgacgaagagaggaacgagctcgaaaagcaggtgaagacactgcaggaaagctacaaccttctgttcagtgagtccctaaaacagctgcaggagtctcagacctcaggtgatgtcaaggtggaagagaagctggataaggtgattgccggcaccatcgatcagacaactggggaagtgctgtccgtgtttcaggcagtccttcgcggcctgatcgactatgacaccggcattaggctgttggaaacccaactgatgatcagcggcctaatttcacccgagctgcggaagtgtttcgacctcaaagacgccaaaagccacggactgatcgacgagcaaatcctctgccagctgaaggagctgtctaaggctaaggagattatcagcgccgcttcacctactaccattcctgtgcttgatgcgctggcacagagcatgataaccgagtcgatggctatcaaggtgctggaaatcctgttgtctactggctccctcgtcatccccgcgacgggcgagcagttaacgctgcagaaggccttccagcagaacctggtgtcttccgcattattcagcaaagtgctggagcgacaaaacatgtgcaaggatcttattgacccgtgcacttctgagaaagtctcactgatcgacatggtgcagaggtctacccttcaggagaatactggaatgtggctgttgccggtgcgcccccaagagggggggagaattactttgaagtgtggaagaaatataagcatactgcgggccgctcacgaaggactgatcgaccgggagaccatgtttaggttactgagcgcccagctcctgagcggcggacttattaatagcaatagcggacagagaatgacggtcgaggaagccgtgcgagagggtgtgattgacagggacacagcttctagtatcctgacctatcaggttcaaactggaggcataatccaaagcaatccagccaagaggctcacagttgacgaagccgtacagtgcgatttaatcacaagctcatccgcacttttagtgctagaggcacaaagaggttatgtgggattaatatggccccactctggcgagatattcccgacttcttcctctctccaacaggaactcatcacgaatgaactcgcctacaagatactcaatggaagacagaaaatcgcagctctgtacattcctgagtcttcccaggtgatcggcctggacgccgcaaagcagctgggaataatcgataacaatacggcaagcatactgaagaacatcaccctccccgacaaaatgcccgaccttggcgacctggaggcttgtaagaatgctcgaaggtggctatctttctgtaaattccaaccatctacggtccacgactatcggcaagaggaggatgtgttcgacggtgaggaaccagttacgacccagacttccgaagagaccaagaagctgtttctatcctacctgatgatcaattcctatatggacgcaaacactggccagcggctcctgttgtacgatggggatctggatgaggcagtcggtatgctacttgaaggatgtcatgcggaattcgacggcaatacagccataaaagagtgcctggatgtcctgtcaagctccggagttttcctcaacaacgccagcggtagggagaaggacgaatgcaccgcaacaccgtcttcctttaataaatgccattgtggggagccagagcatgaggagacaccagaaaacagaaaatgcgctatagatgaagagtttaacgaaatgcggaacacggtcatcaacagcgagttttcccagtccggcaagctcgctagtaccatatctattgatcccaaagtgaactcctcaccgtccgtgtgcgtgccttctctgatatcctatctcacacagacggaattggctgacatctccatgctccgttccgattcagaaaacattttgactaattatgaaaatcagtcccgggtcgagacaaatgagagagccaacgagtgctctcacagcaaaaatatccaaaactttccctcagatctgattgagaaccctattatgaagtccaaaatgagcaagttctgtggagttaatgagacggaaaatgaggacaataccaacagggatagcccaatttttgactactccccaaggctaagcgcgttactaagccatgataaactcatgcactcgcagggctcctttaatgacacacacactccagagtccaacggaaacaagtgtgaggctccagccctgagttttagcgacaagacgatgctgagcggccagcgcatcggcgagaagttccaggaccaatttctgggcatcgcggcaattaacatttctctgcccggcgaacagtatgggcaaaagtccctgaatatgattagttccaacccacaggtgcaataccataacgataaatacatatcgaatacatccggcgaggacgagaaaacccatccaggttttcaacagatgccagaggacaaggaggatgagtccgaaatagaagagtactcctgtgcggtcactcccggaggagatacagataatgccatcgtttcgctcacttgcgcaaccccactccttgacgagactatatccgcctctgactatgaaactagtttactgaacgatcagcagaacaatactggcacagatacagattccgatgatgacttttacgatacacctcttttcgaggatgacgaccatgactccctgcttcttgatggtgatgatagggactgcctgcaccccgaggactacgacaccctccaggaggagaacgacgagaccgcatctcctgctgatgtgttctatgacgtcagcaaggaaaatgagaactcaatggtgccgcagggagccccggttggatcactgagtgtaaagaataaagcgcactgtctgcaggacttccttatggacgtagagaaagatgaacttgactcgggcgagaagatccacctcaatcctgttggcagcgacaaagtaaacggccagagcctggaaacgggatcagaacgcgagtgcacgaatatcttagaaggagatgaatctgatagcctaaccgactacgacattgtcggcggcaaagagtcctttacagccagcctgaaatttgatgatagcggctcctggagaggcaggaaagaagagtatgttaccgggcaggagtttcactctgacacagatcacttagactctatgcaatcagaggaatcctatggggattatatctacgactctaacgatcaggacgacgacgacgacgacggaattgacgaggagggcggcggcattagggatgaaaatggcaagcctcgttgccagaatgtcgctgaagatatggatatccagctatgcgcaagcatcttgaacgagaacagcgatgagaacgagaatatcaacaccatgatccttctggataagatgcactcctgctctagcctggaaaaacaacaaagagtgaacgttgtacaactggcctcgccttccgagaataacctggtgacagaaaagtctaatctgcctgagtataccaccgaaattgctggcaagtcaaaagagaatctccttaatcatgagatggtgttaaaggatgtgttgccccctatcattaaggacaccgaaagtgaaaaaactttcggcccagcctccattagccacgataacaataacattagtagcacaagcgaactcgggactgacttggcaaacaccaaagtgaagctgattcagggttccgaacttcctgaactgacagatagcgtgaagggcaaggatgaatatttcaagaatatgacccccaaggtggactcctcactggatcacataatctgtaccgaacccgacctgattggcaaaccggctgaggagtcccatttatcactgatcgcaagcgtgaccgataaggaccctcagggaaacggcagtgacctcatcaaaggtagagacggcaagagcgatatactgattgaggatgagacatccattcagaaaatgtaccttggggaaggcgaagtgctagtggagggactcgtcgaagaggaaaatcgccacctaaagctcctgccaggcaagaatacccgagactcctttaaattaattaatagccagtttcccttccctcagattactaacaacgaagagctgaatcagaagggaagtttgaaaaaggctaccgtcaccttgaaagatgagcccaacaacctccagatcatcgtcagcaagtcacccgtccaattcgagaacttagaggaaatctttgatacttcggtctcaaaggagatatccgacgacatcacatccgatatcacctcgtgggaaggaaatacccattttgaagaatccttcactgacggaccagaaaaggaattagacctgtttacttacttaaaacactgtgctaaaaacatcaaggccaaagacgttgccaaaccgaatgaagacgtaccgagccacgtccttatcacagcaccgcctatgaaagagcatctgcaactgggagtgaacaacactaaggaaaagagcacctctacacagaaagattccccgcttaatgatatgatacagtcaaatgacttgtgctctaaagagagtatcagcggaggcgggaccgaaataagtcagttcactccggagtctatcgaggctaccttgagcatattaagccgaaagcatgtcgaagacgtcggcaaaaacgacttcctacagtccgagcgctgtgctaacgggttgggcaatgacaactcttcaaacactctcaacacagactacagcttcttggagattaataataagaaggagagaattgaacaacagctgcctaaggaacaggctttgtcccccaggagccaggaaaaagaagtacagattccggaattgtcccaggtgtttgtagaggacgttaaggatattctgaaatcccgactgaaggaaggacacatgaaccctcaagaagtggaagagccttcagcttgcgcagacaccaaaatacttattcaaaaccttataaagcgcatcacgacttcccagttggtcaacgaagctagcactgtcccatcagacagtcagatgagcgatagttccggtgtttcccccatgaccaacagctctgagttaaagcctgaaagtagagacgaccctttttgcatcggcaacttgaagtctgagttgctgctgaatattctgaagcaagatcagcactcccagaagatcaccggagttttcgaactcatgagggaactgacacacatggagtacgatcttgaaaagagggggatcacgtccaaggtcctaccattgcagctcgaaaacattttttataagctcctggccgacggatactctgaaaaaatcgagcatgtgggcgatttcaaccagaaagcgtgttctacttctgagatgatggaggaaaaaccacatatattgggcgatatcaaatctaaggaggggaactattatagtcccaatctggagaccgttaaagagatcggcctggagtctagtaccgtttgggcaagcacgcttccccgcgatgaaaaactgaaggacctgtgcaacgattttccctctcatctagagtgcactagtggctctaaggaaatggcctcgggcgattccagtactgagcagtag

SEQ ID NO: 186117 - DNA, 21741 bp, Artificial Sequence
  Description of Artificial Sequence: Synthetic coding sequence
atgcacagcagcagctacagctaccggagcagcgacagcgtgttctcaaacacgacttccactaggacctcactcgattccaacgaaaatcttcttctggtacactgcggacccaccctgatcaactcctgcatcagttttggatccgagtcttttgacggacacagactggagatgctgcaacagatcgcgaatagagtccagagggacagcgtgatctgtgaggataaactgattctggccggaaatgccctccaaagcgactcaaagagattggaatcgggtgtgcaatttcagaatgaggcagaaattgctggctatattctggaatgcgaaaatctgctccggcagcatgtgattgacgtgcagatcctgatcgacggaaaatactaccaagccgatcagttggtccagcgggtcgcaaagctgcgagatgaaataatggccttgaggaacgagtgcagctcagtctacagtaagggccgcatcttgaccacggaacaaacgaaactgatgatttcggggatcacacagtcattgaatagtggcttcgcccaaaccctgcacccatctctgaccagcggtctgacccaatccctgacaccgtcccttacgtcgagctctatgacaagtggactttcttctggcatgacaagtaggctaactccaagcgtgactcccgcctatacaccagggtttccatctggcttggtgcccaatttctcctctggtgtggaaccaaacagtctgcagaccctcaagttgatgcagatccggaagccgctactgaagagctcgcttctggaccagaacctcaccgaggaagagatcaatatgaagttcgtccaggacctactgaattgggtggatgagatgcaggtccagttagaccggactgagtggggctccgatctgccctccgttgaatcccacttagagaatcataaaaatgtgcacagggccatcgaagagtttgaatcatctctgaaagaagccaagatctccgagattcagatgaccgcccctttgaagttaacttatgccgagaagctgcatcggctagagagtcagtacgctaagttgcttaataccagccgcaatcaggaaagacatctggataccctccataactttgtgagtcgtgcaacaaacgagctaatctggttgaacgaaaaagaggaggaggaggtagcatatgactggtcggaacggaatactaacatcgccaggaaaaaggactaccatgccgagttgatgcgggaacttgaccagaaagaagaaaatataaaaagcgtgcaggagatagccgagcagctgttgcttgagaaccatccagcccggcttaccatcgaagcgtatagagcggccatgcaaacgcaatggagctggatcctgcagttgtgccagtgtgtcgaacagcacatcaaggaaaacaccgcatatttcgaattcttcaatgacgctaaagaagccactgattacttgaggaacttgaaggacgccatccagcggaagtactcttgcgatcgatcctcctccattcacaaactggaagacttggtgcaagagagcatggaagagaaggaagagctgcttcagtacaagtccactatcgcaaacttgatgggcaaggccaagacaattatacagctgaaaccccggaactctgactgccccctgaagactagtatccctattaaggcaatatgtgactatcgccagattgaaattacaatttacaaggacgatgagtgtgtactggcaaacaatagtcacagagctaagtggaaggtgatcagccccaccggcaacgaagccatggtccctagcgtgtgttttaccgtgcccccccctaataaggaagcagtcgacttagcaaaccgtatagaacagcagtaccagaacgttctcaccctgtggcacgaaagccacatcaacatgaagagtgtggtttcctggcattatctgatcaacgagattgatcgcatccgcgccagcaacgtggcgtcgatcaaaaccatgttgcccggtgaacatcagcaggtgttatctaacttacagtcaaggtttgaagattttttggaagactcccaagagtcacaggttttctccggttcggacattacgcaactggaaaaggaagtcaacgtgtgcaaacagtactaccaggaattactcaaatctgccgaaagggaggaacaggaggagagcgtttataacctgtacatatctgaggtccggaatatccgccttaggctcgagaattgcgaggataggttgattcgacaaatccggaccccactcgaacgagatgatctgcacgagagtgtgttccgcattaccgaacaggagaagttaaagaaagaactcgagcgactgaaagacgacctgggcacaatcactaacaagtgcgaggagtttttcagccaagccgcagccagttcttctgtgccaacacttaggagcgagttgaacgttgttctgcaaaacatgaatcaggtatatagtatgagcagtacttacatcgataagctgaagaccgtcaatctggttttgaaaaatacccaagccgctgaggcattggtcaagctatacgagacaaagctatgcgaggaggaagcggtcatagctgacaaaaacaacattgaaaatttgatctcaaccctcaaacagtggagatctgaagtagatgaaaaacgtcaggtttttcatgctctagaagatgagcttcagaaagccaaggctatcagcgatgagatgtttaagacatacaaagagcgggacctggactttgactggcacaaagaaaaagcagatcagctcgtagaacgttggcagaacgtccacgttcagatagataaccgtcttcgggatctggaagggatagggaagagcttgaaatactaccgggatacttaccaccccttagacgactggatccagcaggtggaaacaacacagcgcaaaattcaagagaaccagccagaaaactctaagactttagctacccagctgaaccagcaaaagatgttggtgtcagagatcgaaatgaaacaaagcaaaatggacgagtgccagaagtatgcggagcagtactccgcgacagtgaaggactacgagctacaaaccatgacctacagagctatggtcgattcacagcagaaatcacccgtgaaacgccgaagaatgcagtcatccgcagatttgatcatacaagaatttatggatctccggacgagatacaccgctctggtgacactcatgacgcagtatatcaaattcgctggagactctctaaaaaggctggaagaggaggagaaatccctggaggaggagaaaaaagaacatgtcgagaaagctaaagaactccaaaagtgggtttccaacatcagcaagacacttaaggacgccgaaaaagccggtaagcctcccttctccaaacaaaagatttcgagcgaagagatcagtacgaagaaggagcagctttccgaagcgcttcagaccatccaattgttcttagcaaaacatggggataaaatgaccgacgaagaaaggaatgagctggagaaacaggtgaaaaccctccaagaaagttacaaccttctgtttagcgagtcacttaagcaactccaggagagccagacctccggcgatgtaaaggtggaagaaaagctcgataaagtcattgcagggacaatcgaccaaacaaccggtgaagtgttgtccgtcttccaggctgtcctgcgtggcctgatcgattatgacaccggcatcagactgctggaaacccagctgatgatctcaggcctaatttctcctgagcttcggaagtgttttgaccttaaggacgctaagagccatggactaatcgacgagcagatattgtgccagctcaaggagctgtcaaaggctaaagaaattatttcagctgcctcacccacaaccattcccgtcctggacgctttagcacagagcatgattacagaatcaatggcaataaaagtgctcgagattctgttgtccaccgggtctctagtgatcccggctacaggcgaacagctcaccttgcagaaggcttttcagcaaaatctggtaagtagtgcattattttccaaggtgctcgagaggcagaacatgtgcaaagacttaatagacccctgcacttccgagaaggttagcctcatcgatatggtgcaacggagtacactacaagagaatactgggatgtggttgttgccagtgcggcctcaggaggggggtcgcatcaccctgaagtgtggccgcaacattagtatcttacgcgcagctcatgaaggcctgattgaccgcgaaacgatgttccgtctgctctctgcccagctgcttagtggcggactgatcaactctaacagtgggcagcgaatgactgtggaggaggctgttcgcgagggcgttattgatcgcgacaccgcttcctcaattcttacctatcaagtgcagaccggtgggatcattcaaagtaatccagccaaacggctgaccgtagacgaagccgtccagtgcgatttaattacttcctccagtgcactactggtcttggaggcccagcgcgggtacgtcggcttgatctggccgcactctggagagatttttccaacaagctcatctctacagcaggagttaataacaaacgagcttgcatataagattctgaacggaaggcagaagatcgcagccttatatattccagagagcagccaagtgatcggcctcgatgccgccaaacagcttgggatcattgataataacacagcatcaatactgaaaaatattaccctacctgacaagatgcccgatcttggggacctggaagcttgtaagaacgcacggcggtggctcagcttctgcaagttccagccatccactgtacatgattatagacaggaggaagacgtattcgacggagaagaaccagtcacaactcaaacatctgaagagacaaaaaaactcttcttatcataccttatgattaactcttacatggatgctaacacgggtcaacgtctgctcctgtatgacggtgacctggacgaggcggttgggatgttattagaaggatgtcatgcggagtttgacgggaacaccgcaatcaaggagtgtcttgatgtcctttccagctctggggttttcctgaacaatgccagtggcagagaaaaggatgagtgcacagctacaccttcaagcttcaacaagtgtcactgcggagaacctgagcacgaggagacacctgagaacagaaaatgtgctatcgacgaggagttcaacgagatgcgcaatactgtgatcaattccgagttctctcaaagcgggaaactcgcttcaaccattagcattgatcctaaagtcaactccagcccaagtgtgtgtgtgcccagcctgatctcgtacctgacacaaaccgagctagctgacatcagtatgctgcggtccgacagtgaaaatatcctcacaaattacgagaaccagtcccgggtcgaaacaaacgaaagggccaacgagtgttcacactctaaaaatatacagaatttcccttctgatcttattgagaaccccataatgaagtcgaagatgtctaagttctgtggggttaatgagaccgagaatgaggacaacacaaacagagactcacctatcttcgattatagcccccgcctttccgcgctcctcagccatgataagctcatgcatagccagggatccttcaatgatactcatacaccagagtctaatggaaataagtgcgaggcaccagcccttagtttctcagataaaaccatgctaagcgggcaaagaatcggagagaaattccaggatcaattcctgggaatagctgccatcaatatatcccttccgggggagcagtacggacagaaatccttaaatatgatttcctccaatccccaggtgcaatatcacaacgacaaatatatttctaatacctcaggcgaggatgagaaaacacatccggggtttcagcagatgcctgaagataaggaggatgaaagcgagattgaggaatactcatgcgccgtgacgccaggcggtgacaccgacaacgccatcgtgtcactcacctgcgctacacccttgctggacgaaaccatcagcgcctcagactatgagaccagcctcctgaacgaccagcagaataacaccggaacagacactgactccgatgacgatttctatgatacaccgctattcgaagatgacgaccatgattcactgctgctggatggtgatgatagagactgccttcatcctgaggattacgatactttgcaagaggaaaacgatgaaactgcttcgcccgccgacgtgttctatgacgtttctaaggagaatgagaactccatggttccccaaggcgctccagtggggtcgctgtctgtcaaaaacaaagcacactgcctgcaggacttcctaatggatgtggaaaaggacgaactggacagcggggaaaaaatacacctcaatcccgtcggtagtgacaaagtgaatggacagagccttgagacagggtccgaacgcgagtgcacaaatattttggagggagacgagtcggacagtttgactgattacgacatcgtcggaggtaaagagtcatttaccgcttctctcaaatttgatgattccgggtcttggagaggacgcaaagaggaatacgtgaccgggcaggagtttcattccgacaccgatcatctcgattcaatgcagtccgaggagagctacggggactatatctacgactctaatgatcaggacgatgacgacgacgacgggatagatgaggaaggaggcggaatacgagatgagaatggaaaaccaaggtgtcagaatgttgcagaagatatggacatccagctgtgcgcctctattctgaatgaaaactccgatgagaatgagaacataaatactatgattctgctggacaagatgcattcctgctccagcttagagaagcagcaacgggtgaacgtggtacagttggctagcccctccgagaacaatttagtcacagagaaatctaacttacccgagtacacaaccgaaatcgccgggaaatccaaggaaaacctgctgaaccacgagatggtcctgaaggatgttctccctcccatcataaaggataccgagtcagagaagacttttggacccgcaagtatttctcacgacaataacaatattagttctacctcggagttagggaccgatttagcgaatactaaagtcaaactcattcagggatctgaactaccggaactgaccgattctgttaaaggcaaggacgagtactttaagaatatgactccaaaagttgacagctcgctggatcatatcatttgtacagaacctgatttaatcggtaagccagctgaggaatcccacttgtcgctgatagcatctgtcacagataaggaccctcagggcaatgggagcgacctgattaagggtcgcgacgggaagtccgacatccttatcgaggatgagacttccattcagaagatgtacctcggcgaaggcgaggttctggttgaaggtttagtggaggaggagaatcgtcatcttaaactacttcctggcaagaacacacgggacagttttaagctgattaattctcagtttccctttccacagatcaccaataacgaggagttgaaccagaaaggctccctcaaaaaggccaccgtcaccctgaaggacgagcctaacaatctacagattatcgtatccaaaagccccgtgcagttcgagaacttggaggagatattcgatacctctgtgtcaaaggaaataagtgacgatatcacctctgacattacttcgtgggagggaaacactcattttgaagagtcttttactgatggacccgaaaaagagctagatttgtttacttacctgaagcactgtgccaaaaacattaaggccaaggacgtcgcaaaacctaacgaggatgtgcctagtcatgtgctcattaccgcaccacctatgaaagagcacctgcagcttggcgtaaacaataccaaggagaagtctacctccactcagaaggacagtccactgaacgatatgatacagagcaacgacctgtgttccaaggagtccatctccggcggcggcacggagatttcccaattcacacctgaaagcatcgaggctactttgtccatcctcagccgaaaacacgtggaagacgtggggaaaaatgacttcctccagtctgagagatgcgccaatggtctggggaatgacaactcaagtaacactctcaacacagactactcatttcttgaaataaacaataaaaaagagcgcattgaacagcagttacctaaggagcaagctctgtctcctcgttcacaggagaaggaggttcagatcccagagcttagccaggtttttgtggaagatgttaaagatattctgaaaagtcgacttaaggagggacacatgaacccccaagaagtggaagagccctctgcctgtgctgataccaagattctgatccagaatctgatcaagagaattacaacctcgcagctggtaaatgaagccagtactgtcccgagtgactcacaaatgtcggactcatcaggcgtctcaccgatgactaatagtagtgagctgaagcctgaatcaagggacgatcctttttgtataggaaatctcaaatctgaactgctcttgaacatcctgaaacaagaccaacattcgcaaaagatcacgggggtgtttgagctgatgagagagttgacacacatggaatacgacctggagaaaagaggaatcacatctaaggtgctgccactacaattggagaacatcttctacaaactcctggctgatggatactccgagaaaatcgagcatgtgggggactttaatcaaaaggcatgcagcaccagtgagatgatggaagaaaagccccatatcctcggagatatcaaaagtaaggagggcaactattatagccctaatctcgagacggtgaaagaaattgggctggagagcagcactgtttgggctagcacactcccaagagatgagaagctgaaggatctgtgcaacgacttccctagccacctcgagtgtacatctggcagtaaagagatggcctccggagatagcagcacagaacagttttcatccgagctgcagcagtgtctgcaacatacagagaaaatgcacgaataccttaccctcctgcaggacatgaaaccacccctggacaatcaggaatccctagacaataatctggaagccctgaaaaaccagcttagacagctggaaacctttgaactggggctggcacctatcgcagtgattctgagaaaggatatgaagctggctgaggagttcctgaagagtcttcccagtgattttcccaggggacatgtggaagagctgagtatcagccaccagtccctcaaaactgccttcagctccctgagtaacgtgagctctgagagaaccaagcagataatgttggccatagattccgaaatgtcaaagcttgcagtgtcccatgaagaattcctgcataagttgaaatctttttccgattgggtgtccgagaaatcaaaatcggttaaggacatcgaaatcgtgaacgtgcaggactcagaatacgtcaagaagaggctggaattcctgaaagccaacaacgttctcaaagacttaggtcacaccaaaatgcagctggaaacaaccgccttcgacgttcaattctttattagtgaatatgcgcaggacctctcgccgaatcagtctaagcagctgttgaggctcctgaatacaacacagaagtgtttcctcgatgtccaggagtccgttaccacacaagtcgaaagactggagactcaattacacttagaacaggatctcgacgaccagaagattgtcgccgagcgccagcaagaatacaaggagaagctgcaggggatttgcgacctgctgactcaaaccgagaatcggctgatcggtcaccaagaggcattcatgattggcgatggtaccgtcgaactcaaaaaataccagagcaaacaagaggagctacagaaagatatgcaaggctctgcccaagccctcgccgaggtggtgaagaatacagaaaacttcctgaaagaaaatggagaaaaattgtctcaggaggacaaggcgctgatcgaacagaaactgaacgaggcaaagattaagtgtgagcagctcaacttgaaagccgagcaatccaaaaaggaactggacaaggtagttaccaccgctattaaagaggagactgagaaagtggcggcagtgaagcagttggaggaatctaagacaaaaatcgagaatctgctggattggttatcaaatgtagacaaagactcagaacgggcaggaacaaagcacaagcaggtgattgagcagaatggaacgcattttcaggaaggcgacggtaagtccgcaattggggaggaggatgaggttaacggaaatctattagagaccgatgtagatggacaggtgggtactacccaggagaatttaaatcagcagtatcagaaggtgaaggcccagcacgagaaaatcatttcccaacatcaagccgtgataatagctacccagtccgctcaagttctcctggagaaacagggacagtatttgtccccagaagagaaggagaaactgcagaaaaacatgaaggaattaaaagtgcactacgaaactgccctggccgaaagcgagaagaagatgaagctgacgcacagcctgcaggaggagttagagaagtttgacgccgactatacagaattcgagcattggctgcagcagtcagaacaagagctggagaacctggaggcaggggcagatgatattaacgggctgatgacaaagttaaagcgccagaaatcattctctgaggatgtgatcagtcacaaaggcgatctgaggtatattacaatcagcggcaaccgcgtgctcgaggcagctaagagctgtagcaagcgcgatgggggaaaagtcgacaccagcgcgactcacagagaggttcagcgcaagttggaccatgcaacggatcgttttcgctcactgtattcgaagtgcaatgtgctcgggaacaacttaaaagacctggtggacaagtatcagcactatgaggacgcgagctgcggcctcctggctggactgcaagcttgcgaagctacagcctccaaacacttatcagagccaatagccgtggatccaaagaacctgcagaggcagctcgaagagaccaaagctttgcaggggcaaatttcaagtcaacaggtagctgtggagaagctcaagaagacagctgaagtgctgctcgacgcaagagggagcctgctgcctgcgaagaacgatattcagaagaccttggacgatatcgtcgggcggtatgaggacctgagcaaaagcgtcaatgaaagaaacgaaaagcttcagatcactcttactagatcactgtctgtccaggatggactggacgaaatgctggactggatggggaacgtcgaaagttcgctaaaagagcaaggacaggtaccactgaacagcacggctctgcaggacatcatatctaaaaatataatgttggagcaggacatagcgggccgccaatcaagtataaatgcgatgaatgagaaggttaaaaagtttatggaaacaacagatccgtctaccgcctctagtttgcaggcgaagatgaaggacctgtctgcccgcttctccgaggcttcccacaaacacaaagaaactctcgcaaaaatggaagaattaaagacgaaagtcgagctgttcgagaatctgtccgagaagctccagacgtttctggagaccaaaacacaagcactgactgaggtcgacgtccctggaaaagacgtcacagaactgtctcaatatatgcaggaaagtacttcagaattcttagaacacaaaaagcacttggaggtgctccactctctgctcaaagagatcagcagccatggattgccgagcgataaagccctggtgttggaaaagacgaataacctgtccaagaagtttaaggagatggaggatacaatcaaggagaaaaaggaagccgtcacaagctgccaagagcagttggacgctttccaggtcttggtgaagtcgctcaagtcctggatcaaggagactacaaagaaagtacccatcgtacagccctctttcggggcagaagatctgggaaagtcattggaagacaccaaaaagttgcaggagaagtggagtcttaaaactcccgagattcagaaggtcaacaactctggaatatcactgtgcaacctcatcagtgccgtaacaacacccgccaaggccattgccgcggtcaagagtggcggggcggttctgaacggtgaaggcactgccacgaatactgaagaattttgggctaataaagggctgacgagtattaagaaggatatgaccgacatctcacacgggtatgaagaccttggtctgctgttaaaggacaagattgcagaactgaacacaaagttgtctaagttgcagaaagcccaagaggagtccagcgctatgatgcagtggctgcaaaaaatgaacaagaccgccactaaatggcagcaaacccccgcccctacagacacggaggctgtgaagactcaggttgagcaaaataagtcctttgaagcagaattgaaacagaacgttaataaggtgcaggaactgaaagataaactgaccgaactcttggaagaaaacccagacactccagaggctccccggtggaagcagatgctcacagagatcgactctaagtggcaggaactgaatcagctgactatagaccgccagcagaagttggaagaaagttccaataatctgactcagttccagactgtggaggcccagcttaagcagtggctggtggaaaaagaacttatggtaagtgtcttggggccactttctattgaccctaacatgctaaatacacagcgccagcaagttcagatcctgctgcaagaatttgccacacgaaaacctcagtacgagcagctaacagccgcaggtcagggaattctgtccaggcccggggaggacccttccctgcggggcattgtaaaagagcagttagccgcagtaacacaaaagtgggactcacttacaggtcagttatccgatcggtgtgactggatcgaccaagccatcgtgaagtctacccagtaccagagccttctgcggagtctgtcagacaagctaagcgatctggataacaaattaagttccagcttggcagtttctacccaccccgatgccatgaatcagcaactcgagaccgcgcagaagatgaaacaagagattcagcaagagaaaaaacagatcaaagttgcacaagccctctgtgaggacctgagtgccctcgttaaagaggaataccttaaggccgagctctcccgacagctggaaggaatcctgaagtcattcaaggatgtggaacagaaggccgaaaatcatgtgcagcatctccagagcgcttgcgctagctcacatcagttccagcagatgtcgagagatttccaggcctggctggatacaaagaaggaagaacagaacaaatctcaccccattagtgcgaagctggatgtcctggagagccttatcaaggaccacaaagacttcagtaaaacactaaccgctcagtctcacatgtacgagaagacaatcgccgaaggcgaaaatctgctgcttaagacccaaggcagcgaaaaggccgctttgcagttgcagctgaatacaattaagaccaattgggacactttcaataagcaggtgaaggagagggagaacaaactcaaggagagtctggaaaaggctctgaagtacaaggaacaggtcgagactctgtggccctggatcgataaatgtcagaacaaccttgaggagattaaattttgcctggaccctgcggagggtgaaaacagtatagccaagcttaagtctttacagaaggaaatggaccagcatttcggcatggtcgagctcctgaataacacagccaacagtctactgagcgtgtgtgaaattgacaaggaggtggtgactgatgaaaataagtcacttattcaaaaagtcgacatggtgactgaacaacttcacagcaagaagttttgtttagagaacatgactcaaaagtttaaggagttccaggaggtgagcaaagaatctaagcgacagcttcaatgtgctaaagaacaattagacatccacgattctctcggaagccaggcctactcgaacaagtatctgacaatgcttcaaactcaacaaaagtcactgcaggctttaaaacaccaggtcgatctcgcaaaacgcctggctcaggacctggtggtggaggccagcgactccaagggcactagcgatgtgttgttgcaggtcgaaacaatcgcccaggagcattcgaccctcagccagcaggttgacgagaaatgttcctttttggaaactaaactgcagggcatcgggcactttcagaacaccatacgggaaatgtttagccagtttgccgagttcgatgacgaactggacagtatggcgcctgtcggacgagacgctgaaacacttcagaaacaaaaagagacaatcaaagcctttctcaaaaaacttgaagcgctgatggccagcaacgacaatgccaataagacatgcaaaatgatgctggctactgaagagacttcacccgatctcgttggcatcaagcgtgacctggaggcattgtccaagcagtgtaacaaactattagaccgggcacaggcccgggaagagcaagtggaggggaccatcaagaggctggaggaattttacagtaaactaaaggagtttagtattcttctgcagaaggctgaagagcacgaagaaagccagggccccgtgggtatggagaccgaaacgatcaaccagcaactgaacatgtttaaggttttccagaaggaagagatcgagcctttgcaggggaagcagcaggacgtgaattggctgggccaggggcttatccagagtgccgcaaaatcaacgtctacacaggggctggagcacgacctggatgatgtaaacgcgcgctggaagactctgaataagaaggtggctcagagggctgcacagctgcaggaagcactgctccactgcgggaggtttcaggatgccctcgaaagcttgctctcatggatggtggataccgaagaactagtagccaatcagaagccaccttctgcagaatttaaggttgtgaaagctcagattcaggagcagaaactcctccaaaggctgctcgatgaccgaaaaagtaccgtggaagtgataaaacgggaaggcgaaaaaattgcaaccactgccgagcctgcagacaaagtgaaaatcctcaagcagcttagtctgctggactctcgctgggaagcgctgcttaacaaggctgagactcggaatcgtcagcttgagggaatctctgttgtggctcagcagtttcatgagactttggaacccctaaacgaatggctaacaaccatcgaaaagaggttagtgaactgcgagcccattgggacacaagcaagtaagctcgaggagcagatcgcacagcacaaggcactcgaggacgacatcatcaaccacaataagcacctgcaccaggcagtgagcataggtcaatccctaaaagtactgagctcccgtgaagataaggacatggtgcaaagtaaactcgatttctcccaggtttggtacatagagattcaggagaaatcccacagtcggtcagaattactgcagcaggccctgtgtaatgcaaaaatcttcggcgaagacgaggttgagctcatgaactggctgaatgaggtgcatgataaactttcaaagctatcagttcaggattactcaacagaggggctctggaagcagcagtcagagctccgcgttctgcaggaagatattctcctgcgcaaacaaaatgtcgaccaggccctgttgaatgggttggagctccttaagcagacgaccggcgacgaggtcctgattatccaggacaagctggaagcaatcaaggctaggtacaaggacattaccaagttaagcaccgacgtagccaagaccctggagcaagctctgcagttggcacgaaggttgcatagcacgcacgaagagctgtgtacctggctcgataaagtggaggtcgagctgctgtcgtatgagacccaggtactcaagggtgaggaggcatcacaggctcagatgagaccaaaggagctcaagaaggaagcaaagaataacaaggccctactggactccctgaatgaagtgtccagcgcactgctggaactggttccttggcgggcgcgggagggattagaaaagatggtcgcagaagataatgagaggtaccggctcgtgagcgatacaatcactcagaaagttgaggaaattgatgcagcaatcttacggagccaacagttcgatcaagctgctgacgctgagctcagttggataaccgagacagaaaaaaaactcatgtcgcttggcgacattcgccttgagcaagatcagacatcagcgcagctgcaggtgcagaaaacgttcactatggagatcctgagacataaagacatcatcgatgacctcgtgaagtccggacacaagatcatgaccgcgtgtagcgaggaagaaaagcagagcatgaaaaaaaagctggataaggtattaaagaattatgacacaatatgccagatcaactccgagagatacctccaactggagcgcgcccagtccctggtaaaccagttctgggagacatacgaagagctgtggccctggctcaccgaaacgcagagcattatatctcagctgccagcccccgcactcgaatatgagactctgagacagcaacaggaggagcaccgccaacttcgggagctgatcgcggagcataaaccgcacattgacaaaatgaataaaaccggacctcaattgctggagctgagcccgggagagggattctcgatacaagagaagtacgtcgctgcagatacactttacagccagataaaggaggacgtgaaaaaaagggcggttgcactggacgaggcgatcagccagagtacacagttccatgataagattgaccagatactcgaaagtctggagcgtattgtcgaacggctgagacagcccccctcaattagtgcagaagtcgaaaaaattaaggaacagatttctgagaacaaaaatgtttcggtggacatggaaaaattgcaaccgctttacgaaacactgaaacaacggggagaagaaatgatagcccgtagcggcggcaccgataaagacatctctgccaaagccgtccaggacaagctcgaccagatggtgttcatttgggaaaatatccacacattagtagaagagagagaggctaaactattagacgtgatggagcttgctgagaaattttggtgtgatcacatgagtttaattgtgacaattaaagacacgcaggacttcatccgagatctcgaggacccaggaattgacccctcagtggttaaacaacaacaggaggctgcagagaccatccgggaagagatcgacgggcttcaggaggaacttgacatagtcatcaatcttggctccgaactcatcgccgcctgcggagagccagacaaacccatcgttaagaaatccatcgacgaactcaattctgcttgggactctttaaacaaggcttggaaggatagaattgacaaactggaggaggcgatgcaggcagcagttcagtatcaggatgggttacaggccgtgtttgattgggtcgatatcgcaggaggaaagttagctagcatgagccccataggtacagatcttgagactgtcaagcagcagatagaagagcttaaacagtttaaaagcgaggcataccaacagcagatcgagatggaaagattgaaccaccaggctgaactgctgctcaagaaagttacagaagaaagcgacaagcacaccgtccaggatcctctgatggagctcaaattgatatgggacagcctcgaggaaaggattataaatcgacagcataaactggaaggggcgctgctggccctggggcagttccagcacgctctggatgagttactggcatggctaactcacacagaaggactgctcagcgagcagaagccggtcggcggagaccccaaagctattgaaattgagctggccaaacaccatgttctgcagaacgacgtgctcgcacaccaaagtactgtggaagctgtgaacaaagccggaaacgacctcatcgagtcctcggccggcgaagaagccagtaatctgcagaacaaactcgaggttcttaaccagaggtggcagaatgttctagaaaagacagagcagcgcaagcagcagctggacggtgcgctacggcaggccaaagggtttcacggagagatcgaggatctgcagcagtggctcaccgatacagaacgtcacctgctcgcctctaaaccacttggaggactgcctgaaacagccaaggagcagctgaacgtacacatggaggtctgcgcagcctttgaagccaaggaggagacctacaagtctctcatgcagaagggtcagcaaatgcttgcacgctgccctaaatctgcagaaaccaatatagaccaggatataaataacctaaaggagaagtgggaatctgtggaaacaaagctgaacgagaggaaaactaaactggaagaggccctgaacctggccatggagtttcacaactctcttcaggacttcatcaactggttaactcaggctgagcaaacacttaacgtcgcgtcacggccctcattgatactggatactgtactgtttcagattgatgaacataaggttttcgcaaacgaagttaactcccacagggaacagattattgagctagacaagacagggacccatttgaaatacttttcccaaaagcaagacgttgttttaatcaaaaatttgctcattagtgtgcaaagtcggtgggagaaggtagtgcagaggctggtggagcggggacggtccttagacgacgccaggaagcgggcaaagcagttccacgaggcatggtcaaaactgatggagtggctggaagaaagcgagaagagcctggactctgagcttgagatcgccaatgatccagacaagataaagacgcagctggcccagcataaggaattccagaaaagcctcggggccaagcactccgtgtacgacactactaaccgcacggggcgatccctgaaagaaaagacatcccttgccgatgataacctgaagctggatgacatgttatccgaacttcgggataagtgggatacaatttgcggcaaatcagtggaaagacagaacaagttggaagaggcgctgctattcagtgggcagtttacagatgcgctgcaagcactcatcgattggttgtaccgtgtggaaccacagctcgccgaggatcaaccagttcacggggatattgacctggtcatgaacctcatcgataatcataaagccttccaaaaagaattgggcaaaagaacctctagtgtacaggcccttaagcggtccgccagagagctcattgagggaagccgggatgactcatcttgggttaaggtccaaatgcaggagctcagcacccgctgggagaccgtgtgcgctctgagtatatccaagcagacccgactcgaggccgccctccggcaggccgaggagttccattccgtggttcacgccctcctcgagtggctggccgaggctgagcagacgctaaggttccatggcgtcctgcccgacgatgaagacgcgctcaggaccctgatcgaccagcacaaggagttcatgaaaaaacttgaagagaagcgcgccgagcttaacaaggccaccacgatgggagacactgtcctcgccatttgccatccagatagtatcacgaccattaaacattggattaccattatcagagcgcggtttgaagaggttctagcatgggccaagcagcaccagcagcgactcgcgagtgcccttgctggtctcattgctaagcaggaactcctagaggctctactggcctggctccagtgggctgagacaactctcaccgacaaagacaaagaggtgattccacaggaaatcgaagaggtgaaggccctgattgccgaacaccagacctttatggaggagatgacccgcaagcaacccgatgtcgataaagtgactaagacctacaaacggcgggccgccgacccttcttccctgcaaagccacattcctgtcctcgataaaggccgtgcaggacgaaaaaggttccccgcttcctcactttatccctctggtagtcagacccagattgaaacaaaaaaccctcgagtcaatttgcttgtctcaaaatggcagcaggtgtggcttctggcattagagcggaggaggaagcttaatgacgctttggatcgcttggaggaattaagggagttcgcaaactttgattttgacatttggaggaagaagtacatgagatggatgaaccacaaaaaaagccgcgtgatggacttcttccgtaggattgacaaggatcaggatggaaaaattacaagacaagagttcattgatggtattttgtcctctaaattccctacgagtcgtctcgagatgagtgctgtggcagacatcttcgaccgggacggtgatggctatattgactactatgagtttgtggccgccttgcacccaaacaaagatgcatataagccaatcacagatgctgataaaatcgaggatgaagttacccggcaggtcgccaagtgcaagtgtgctaaacggtttcaagtggagcaaataggcgataataagtaccgcgtttcatttcagtccaatttcggtgattcccagcagttgaggcttgtgcgcatcctgcgctccacagttatggtccgcgtgggcggtgggtggatggccctggatgaatttctggttaagaacgacccttgccgcgtgcatcaccacgggtcgaagatgcttaggtctgaatcaaacagcagcataactacgacgcaacccactattgccaaaggaaggactaacatggagctgcgcgaaaagttcatcctcgccgacggcgctagccaaggaatggccgcatttagaccccgcggtagacggtcgagaccctcaagcaggggggcgtcgcccaatagaagcacaagcgtgagctcccaggccgcacaggctgccagcccacaggtgccggcgacaacaacacccaagggcactccgatccagggctctaagctgaggctgcccggttacctaagcggcaaaggattccacagcggggaggacagtggccttataacaacagcggcggctcgggtcaggactcagtttgcagacagtaaaaagactcctagtcggcctgggtcaagagccgggagtaaagcaggcagcagggcctccagccggagagggagcgacgcttcggactttgatatttccgagatccagtccgtgtgctccgatgtggagaccgttccccagacgcatcgtcccacaccacgggcaggcagccggccttccacagccaaaccatccaagattccaacacctcagaggaagagtcccgcctctaaactagacaagagcagtaaacggtag

SEQ ID NO: 186118 - DNA, 768 bp, Artificial Sequence
  Description of Artificial Sequence: Synthetic coding sequence
atgaacaagaccggcccccagctgctggagctgagccccggcgagggattctccatccaggagaagtacgtggccgccgacactctgtacagtcagattaaggaggacgtgaagaaacgtgcagtggccttggatgaagctatttcacagtccacccagttccacgataaaattgaccagattcttgaaagtctggagcggattgtggagcggcttaggcagcctccatcgatatctgccgaagttgagaaaatcaaagagcagatatccgaaaataagaacgtatcggtggatatggagaaactgcaaccattatacgagaccctgaagcaacggggtgaggagatgattgcccggagcgggggaacggacaaggatataagtgctaaggctgtccaggataaactagaccaaatggtgttcatttgggagaacatccatacgctggttgaagaacgcgaggcaaaattgctggacgtgatggagctagcagaaaagttctggtgcgaccatatgtcccttatagtgaccataaaagatactcaggatttcattcgcgatttggaagatccaggcatcgatcctagcgtggtcaagcagcagcaggaagcagcggaaactattcgagaggagatcgatggattacaggaagaactcgatatcgtcattaatctgggatctgaacttattgctgcctgtggagagcccgacaaaccgatcgttaaaaagtctattgacgagttgaacagcatgggcttcagtaaatag

SEQ ID NO: 186119 - DNA, 1359 bp, Artificial Sequence
  Description of Artificial Sequence: Synthetic coding sequence
atgttccccgaccagcccgagaagcccctgaacctggcccacatcgtgcctccacgtccggtgaccagcatgaatgataccctcttcagccattctgttcctagcagtggaagcccgttcatcacgcgacgacttcccgagggtattagcgcctcttcccccgttgcagaggagcactcattaattaaactgtacgtgaatcagttagatcacggtgctcgatctcccccaaaggactctgaggtcgaacagaacaagctcctcgctcgcgctgcgcccgcattccttaaaggaaaaggcatccagtattcattgaacgtggccgatcggctggccgatgagcacgtgctcattggtctctatgtgaatatgctgcgaaataatccctcttgcatgctcgaatcctcaaaccgccttgacgaagagcaccggcttattgcacggtacgccgctcgcctggcagcggagagttcctcatctcagcctccacagcagcggagcgccccagacatctctttcaccatcgacgctaataagcagcagcgtcaattaattgccgagctcgaaaacaaaaatagggaaatcctgcaggagatccagaggctccgcctggagcacgagcaggcctctcagccgacccctgagaaggcccagcagaatcctactcttctcgccgagctccgtttactccgccagcgtaaagacgaacttgagcagaggatgagcgccctccaggagtcccggcgcgagctcatggtgcagctggaaggattgatgaaacttttaaaaacccagggcgcgggaagcccacgctcgtccccctcccatacaatcagcagaccaatccccatgccaattcggagtgcatctgcctgttccacccctacccacaccccacaggactccctcaccggggtcggcggggatgtccaagaagccttcgcgcaatcaagccgcaggaacctgagaaacgacctgctagtcgccgccgattccattacaaacacgatgagctccttggtgaaagaactgaattcagaggtggggtcagaaactgagtccaacgttgactctgagtttgctcgtacccagttcgaggacctggtgccaagtccaacgagcgagaaggctttcctggcgcagattcacgcccggaaaccaggctatattcactccggcgctaccacatcgaccatgcggggagatatggtcacggaggacgcagatccatatgtacagcctgaggacgagaactacgaaaatgactctgtgaggcagctggagaatgagctccagatggaagaatatcttaaacagaaactccaggatgaagcctatcaggtcagtctgcagggatag

SEQ ID NO: 186120 - DNA, 1116 bp, Artificial Sequence
  Description of Artificial Sequence: Synthetic coding sequence
atgatcgaggacagcggcaagcggggcaacaccatggccgagcggcgacagctgttcgccgaaatgcgcgcgcaggaccttgatcggattcgattgagcacatatagaacggcatgtaagttacggtttgtacagaagaagtgcaatctccacttagtcgatatctggaatgtgatagaggccttacgcgagaatgcgctgaataatctagatcctaacaccgagctgaacgtgtcaaggctggaggccgtgctgtctactattttctatcaactgaataagcgcatgcccactactcatcagatacacgtcgaacagagcatctcgctgctcttgaactttttattggccgcctttgaccctgaggggcacggaaagattagtgtctttgccgtgaagatggcactggccaccctatgcggaggaaaaatcatggataaactgcggtatattttttccatgattagtgactctagcggcgtgatggtgtacggccgttacgatcagttcctgagggaggtcctcaagctgcctacggccgtattcgagggaccctccttcgggtacactgagcagtctgccagatcttgtttctctcagcagaagaaggtgactctcaatggattcctggatactttgatgtccgacccccctccccagtgtctggtgtggcttcctctcttgcaccgcctagcaaacgtggaaaatgtcttccaccctgtggagtgctcatactgtcacagcgagtcgatgatgggctttagatatcgatgtcagcagtgccacaactatcagctctgtcaggattgcttctggcgcggacatgccggtggctcccatagcaaccaacaccagatgaaagagtatacctcttggaagtcccctgcaaagaagctcaccaatgctctctccaagtccctatcttgtgcttcctctagggagcctctgcatcccatgtttccagaccagcccgagaagccattgaatttggcacatatcgtgccacccaggcctgttacgagcatgaatgacacccttttctctcatagtgttccatctagcggttcaccattcatcacccgaagctccgatggcgcatttggagggtgcgtctag

SEQ ID NO: 186121 - DNA, 1188 bp, Artificial Sequence
  Description of Artificial Sequence: Synthetic coding sequence
atgttccccgaccagcccgagaagcccctgaacctggcccacatcgtacccccccggccagtgactagcatgaacgacaccctcttcagccactctgtgcccagtagcggctcaccttttattaccaggagactgcctgaaggaatctctgcttctagcccagtagctgaagagcactctctcattaagttgtatgtcaatcagttagatcatggagctagaatgcttgaatcttccaacaggcttgatgaggaacaccgcctcattgcgcgctacgctgcaagacttgccgccgaaagcagctccagccaaccgccgcaacagcgctcggcacccgacatctcattcactatcgacgctaataaacaacaacgacagcttatcgcggagctggagaataagaaccgggagatcctccaggaaatacagcgcctccggttagaacacgagcaggcctcgcaacctactccagaaaaggcgcagcagaacccaacactcctagcagagctgcgacttctgcggcaaagaaaagacgaattggagcagcgaatgtccgctctccaggaatcgcgcagagagctgatggttcagttggaggggcttatgaaactgctgaagacccaaggcgccggttcaccacgatcttcccctagtcacaccatctctcgccccatcccaatgccgatcaggtccgcttcagcctgctccacccctacccacacaccacaggatagcctgacaggcgtgggcggtgatgtgcaggaggcttttgctcagagtagtaggagaaacttaaggaatgacttgctggtggctgccgattctatcacgaacactatgtctagtctcgtgaaggaactaaacagcgaggttggaagcgaaacagaatccaatgtagactcagagttcgccagaacacaatttgaggacctggtcccaagccccacctccgagaaagcctttctcgcccagatccacgcccgaaagccaggatacattcatagcggcgcgactacttctaccatgcggggggatatggtgaccgaggatgccgatccctatgtccagcccgaggacgagaattatgagaacgactccgtgcggcagctcgagaacgaactgcaaatggaggagtatctgaagcaaaagctgcaggacgaggcttatcaggtgtcactccagggctag

SEQ ID NO: 186122 - DNA, 2175 bp, Artificial Sequence
  Description of Artificial Sequence: Synthetic coding sequence
atgatcgaggacagcggcaagcggggcaacaccatggccgagcggagacagctcttcgcagaaatgcgggctcaggatcttgaccgcataagactctccacatacaggactgcatgtaaactacgattcgtgcaaaaaaagtgtaatctgcacctcgtggacatatggaacgtaatcgaggccctgcgggaaaatgctctgaacaatctcgatccaaataccgagctgaacgtttcaaggctcgaagccgtcttgtcaaccatattttatcaactgaacaaacggatgcctacaacccaccaaatccacgtggagcagagtatttcactgctgctgaactttctcctggccgctttcgacccagagggacacggaaagatctctgtcttcgccgtcaagatggccctcgcaactttgtgcggaggcaagatcatggacaagctacgctatatcttttccatgatttctgattcctccggcgtcatggtgtatgggcgatatgaccagtttctgagagaggtgttaaaactgccgaccgctgtgttcgagggcccaagcttcggctatacagagcaaagcgccagaagttgctttagccagcaaaagaaggtgaccctgaacggatttctggacacactcatgagtgaccctccaccccagtgcttagtttggctgccccttctccaccgtctcgccaacgtggagaatgtttttcatccagtcgagtgtagttattgccactctgaaagcatgatgggcttcagatatagatgccagcagtgccataactatcagctgtgtcaagactgtttttggaggggtcacgcgggtgggtctcactccaatcagcatcagatgaaggaatatacgtcctggaaatcacccgccaagaagctgacgaatgccctgtcaaagtccctgtcctgcgccagcagcagggaacccttgcatcctatgttccctgatcaacccgagaagccactgaaccttgcccatatagtgcctccccgccctgtgacaagtatgaatgatacgttgttttctcacagcgtcccatcgtcagggtcgccttttataacaagatccatgctggagagcagcaatcgcctggatgaggagcaccgactgattgcacggtacgctgccaggctagcagcagagtcatcttcttcacagcctccccagcaaagatcagcccctgacatcagtttcaccattgacgcgaacaaacagcagaggcagttgattgctgagctggagaataaaaacagagaaatcctccaggaaatccaaagacttcgcctggagcatgagcaggctagtcaacctacaccggagaaagctcaacagaacccaacattattagccgagctccgcctcttgagacagcgaaaggacgaacttgagcagagaatgtcagctctgcaggaatcgagacgggaactgatggtgcagttagaaggtttaatgaaattgctcaagacccaaggcgctggatcccccagatccagcccatctcatacaatctccagaccaattcctatgcctatccgaagtgccagcgcatgcagcacacctacccacaccccccaggattctctaacaggcgttggaggcgacgtgcaggaggcctttgctcaatctagtcgcaggaacttacggaacgacctcttggtggccgcagatagcattacaaataccatgagctctctcgtaaaggagctgaactcggaggtgggaagtgagacggaaagcaacgtcgactccgagttcgcccgcactcagtttgaagatctagttccctcacctacgagtgaaaaagcctttttagcacagattcacgcccgtaagcccggatatatacactctggcgccaccacttctaccatgcggggagatatggttactgaggatgccgacccctatgttcagccagaagatgagaactatgaaaatgattcagtgagacagctcgagaacgaattacagatggaggagtatttaaaacagaagctccaggacgaggcctatcagctgcatgtaagtaccgagacaaggctcgagcacccttgccccgtgtctgagaccaagtggagagtactgttctggggatttgtgttcttcgggggctttctatctcttgcacttcagatctacttttggggactcttctag

SEQ ID NO: 186123 - DNA, 912 bp, Artificial Sequence
  Description of Artificial Sequence: Synthetic coding sequence
atgctggagaccctgcgggagcggctgctgagcgtgcagcaggacttcacaagcggtttgaagacccttagcgataaatctcgcgaggctaaggttaagtcaaagccccgcacagtgcccttcctccctaagtactcagctggcctggaacttctgtcccggtacgaagatacttgggctgccctccaccggcgcgctaaagactgtgcatccgccggcgaactcgttgattctgaagtcgtgatgctcagtgctcactgggaaaaaaaaaaaacctcgctagtggaactgcaggaacaacttcagcaactgccggctctgatcgcagatctggaatccatgactgccaacctgacccacctggaagcgagtttcgaggaggtcgagaataatctgctgcatttggaggacctatgtggccaatgtgaactggagcggtgcaaacatatgcagagccagcagctggagaactacaagaagaataagcgcaaagaattggaaaccttcaaggcagagttggatgccgaacatgcccagaaggtcctggagatggagcacacgcagcagatgaagcttaaggagcgtcagaagtttttcgaggaagccttccagcaggacatggagcagtacctgtcaaccggctatctccaaatcgcggagcgccgggagcctatcggctcaatgtcatcaatggaggtgaatgtcgatatgctcgaacagatggatctgatggacatctccgaccaggaggccctggacgtctttctcaatagtggcggagaagagaatactgtcctcagcccagctctggggcgggtagataagctggcattggcagagcctgggcaatacagatgccattccccacccaaggtcaggagggaaaaccatctgcccgtaacatatgcatag

SEQ ID NO: 186124 - DNA, 1056 bp, Artificial Sequence
  Description of Artificial Sequence: Synthetic coding sequence
atgctggagaccctgcgggagcggctgctgagcgtgcagcaggactttacctccggactcaaaacacttagtgataagtccagagaggctaaggtaaaatcaaagccccgcacagtgcctttcttaccaaagtattctgccggcctggagctcctgtcgaggtacgaagatacctgggctgccctgcaccgccgtgctaaagattgcgcatcagcaggggaactagtggacagcgaagttgtgatgttaagcgcccactgggaaaaaaagaagacgagcctggtcgagcttcaggaacagctccagcagttacctgccctcatcgcagatctcgagtctatgacagcaaatcttacccacttggaagcttccttcgaggaggtggagaacaatttattgcatctcgaggacctatgtgggcagtgcgagcttgaacggtgcaagcacatgcagtcgcagcagctcgagaactacaagaaaaacaagaggaaagagttagagacctttaaagcagagctggacgctgagcacgctcagaaggtactggagatggagcatacacagcagatgaagctgaaggaacggcagaaattctttgaggaggccttccaacaggatatggagcagtaccttagtacaggttacctgcagattgccgaacgtagagagcctatcggcagcatgtcaagcatggaggtcaatgtggacatgctggaacaaatggatctcatggacatcagcgaccaggaagctttggacgtgtttctcaatagtggaggggaggaaaataccgtgctgagtcccgccctaggacccgaatcctccacctgccagaatgagattaccctacaggttcccaatcccagcgaactgagggccaaaccaccatcatcctcgagcacgtgtactgactccgctactcgcgatatttcagagggaggcgagtcccctgtagtgcaatctgatgaagaggaagtccaggttgacacagccctggcaacgtcacacacagaccgcgaggccacccctgatggcggagaagactccgactcctag

SEQ ID NO: 186125 - DNA, 1059 bp, Artificial Sequence
  Description of Artificial Sequence: Synthetic coding sequence
atgctggagaccctgcgggagcggctgctgagcgtgcagcaggacttcaccagcggcctgaaaaccctctcggacaaaagccgggaggctaaagttaagagcaagccgcgcacggtccctttcctgccgaagtattcagccgggctcgagctgctcagcaggtacgaggacacatgggcagcacttcacaggcgagctaaggattgtgcatcagcaggtgaacttgtggactccgaggtcgtgatgctatctgctcattgggaaaaaaagaaaacatccctggttgaactgcaggaacagctacagcagctgccagcgctcatcgccgacctggagagcatgacggccaatctgacgcaccttgaagcgagttttgaggaagtcgagaataatttgctgcacctggaggacctctgtggccagtgtgagctcgagcgatgtaagcatatgcagtctcagcaattagaaaattacaagaagaacaaaagaaaagagctcgaggtcacatttcggagtgaactagatgccgagcatgctcaaaaggtgctcgaaatggagcacactcagcagatgaaactgaaggagcggcagaagttctttgaggaagcgtttcaacaggacatggaacagtatttatcaaccgggtatctccagattgcagagcggcgcgaacctatcggctctatgtcgtcaatggaggtcaacgtagacatgcttgagcagatggacctgatggacatttcggaccaggaggccttagatgtgtttctgaatagcggcggggaggaaaatacagtcctgagccctgcactgggccctgaatcttccacgtgtcagaatgaaatcacccttcaagtgccgaatccttcagagctgcgggctaagcccccctcatcttcctccacttgtaccgacagcgccactcgggacatctctgaaggtggagagtctcccgtcgttcagtccgatgaggaggaggtgcaagtcgacaccgctttggctacttcccacaccgacagagaagccacacctgacgggggcgaagacagcgactcatag

SEQ ID NO: 186126 - DNA, 813 bp, Artificial Sequence
  Description of Artificial Sequence: Synthetic coding sequence
atgctgagcgcccactgggagaagaagaagaccagcctggtggagctgcaggagcagctgcagcagctgcctgctttaattgcagatctggagtctatgaccgctaatctaactcatctcgaagcttccttcgaggaagtggagaacaacctgctgcacctggaggacttgtgtggacagtgcgagctggaaaggtgcaaacacatgcagtctcagcagctcgagaattataagaaaaacaaaagacgacgcctgaggacctttaagacagagctagatgccgagcacgcacagaaggtgctggagatggaacatacccaacagatgaagctgaaagaacgccaaaagttttttgaagaagcattccagcaggacatggaacagtatttgtccactggctacctgcagatcgctgaacggagggagccgattggatccatgtcctccatggaggttaatgtggacatgctggaacagatggaccttatggatatctccgaccaagaggctctagatgtttttctcaactccggtggcgaagaaaacactgttctcagccctgccctgggacccgagagttctacgtgtcagaacgaaatcacactgcaggtgcccaatccttctgagctgcgagctaagcctccgtcgtcctcatctacatgtaccgatagcgccacacgcgatatctctgagggcggcgaaagcccagtagtgcaatctgacgaggaagaagtccaggttgataccgcacttgccacctctcatactgatagagaggccacaccggacggaggcgaagattcagatagttag

SEQ ID NO: 186127 - DNA, 912 bp, Artificial Sequence
  Description of Artificial Sequence: Synthetic coding sequence
atgctggagaccctgcgggagcggctgctgagcgtgcagcaggactttacatctggccttaagacactctcagataagagtcgggaagccaaagtgaaaagcaaaccaagaactgttcccttcctgcccaagtattcagctggacttgaacttttgtcccgatacgaagacacttgggcagctttgcacaggagagcaaaggattgtgctagcgccggcgaattggtcgattccgaggtcgtgatgctgtccgcacactgggaaaaaaagaaaacatcacttgtcgagctgcaggaacagcttcagcaactcccagctctgatcgctgatttggaatctatgacagccaacctcactcatctcgaagctagctttgaagaggtcgagaataacctgcttcacctagaagatctctgtgggcaatgcgagctcgaacgttgcaagcacatgcaatcacagcagctcgagaactacaagaaaaataaaagtaaagaactcggaacaggcaaagcggagttggatgctgagcacgctcagaaagtcctggaaatggaacatacacagcagatgaaactgaaggaaaggcaaaagtttttcgaggaggcgtttcagcaggacatggagcaatacctctccaccggataccttcaaattgccgaacgtagggaaccaatcgggagcatgtccagcatggaggttaacgtagatatgctggaacagatggacctgatggacatctcagaccaagaggcccttgacgtgttcctgaactccgggggagaagaaaacactgtgctctccccagcactcggccgggtcgacaagctggcattggcagagcccggacagtacagatgccactcgcctccgaaagtccggcgcgaaaatcatctacctgtcacctatgcgtag

SEQ ID NO: 186128 - DNA, 135 bp, Artificial Sequence
  Description of Artificial Sequence: Synthetic coding sequence
atgctggagaccctgcgggagcggctgctgagcgtgcagcaggactttacatccggcttgaaaacactgtcggacaagtcacgcgaggcgaaggtaaagagtaaacctagctggctaaaccaggaacagttttag

SEQ ID NO: 186129 - DNA, 627 bp, Artificial Sequence
  Description of Artificial Sequence: Synthetic coding sequence
atgctggagaccctgcgggagcggctgctgagcgtgcagcaggacttcacatccggcctgaaaactctctctgacaaatctagagaggcaaaggtgaagagtaaaccacgctacgaagatacttgggcggcactgcaccggcgcgcgaaggattgcgcaagcgctggggaactagtagacagtgaagttgtcatgctttccgcacactgggagaaaaaaaaaaccagcttggtggaactgcaggagcagctccagcagctgcccgcactgattgccgacttagagtccatgacagccaacctcactcatctggaggcttcattcgaggaagtagagaacaacctgcttcatctggaggacctgtgcgggcagtgtgagctcgagcggtgcaagcacatgcagtcacagcagctggagaattataagaaaaataagaggaaggaattagagactttcaaggcagaactcgatgctgaacatgcacagaaagtactggagatggagcatactcaacagatgaaactcaaggagcggcagaagttttttgaagaggcctttcagcaggatatggagcagtacctctcaactggttatctgcaaattgctgaaaggagaggggatccctag

SEQ ID NO: 186130 - DNA, 2235 bp, Artificial Sequence
  Description of Artificial Sequence: Synthetic coding sequence
atgatcgaggacagcggcaagcggggcaacaccatggccgagcggcgccaactgtttgccgagatgagggcccaagatttggatcgcattagactgtctacctacaggactgcttgtaaactgagattcgtgcagaagaagtgtaatctgcatctggtggacatatggaacgtgatcgaggccctgagagagaacgcccttaataatttagaccccaacaccgagctgaatgttagccgactagaagctgtgctcagcacgatcttctatcagctgaacaagcgaatgcctacaacccaccagattcacgtagaacagtctatctccctgttgctgaactttctcctggcagcctttgatcctgaaggccatgggaaaatctccgtcttcgcggtaaagatggctctggcaacactgtgcgggggcaaaattatggacaaactaaggtacattttcagcatgatctccgactcctccggggtaatggtttacgggaggtatgatcagtttctccgggaggtactgaagctccctaccgcagtgttcgaaggaccgtcatttggctatacagagcagagtgctcgtagttgcttcagccagcaaaaaaaggtaacactaaacggcttcctagacactctgatgtccgaccctcctcctcagtgcctggtttggttgccccttctgcatagactggccaacgtcgaaaatgtatttcacccagtcgaatgtagttattgtcacagtgaatccatgatggggtttcgctatcgttgccaacagtgccacaactaccagctatgtcaggattgcttttggaggggccatgctggcggtagccacagcaaccagcaccagatgaaggagtatacaagttggaaatcccccgcaaaaaaactgactaacgccctgtcaaaatcattgtcctgtgcatccagcagggaacctcttcaccccatgttccccgatcagcccgagaagccactgaaccttgcccacatagtactggacaatatgcctcctcgacccgtcacctcgatgaacgatactctgttcagccattcagtcccgagcagcgggtctccattcattacaagatcctccccccctaaagactccgaagtggaacagaataagctgctggctagggccgctccagcatttttgaaaggcaaagggattcagtactctctgaacgtggctgatcggctggcagatgaacatgtgctaattgggctgtatgtcaacatgctccggaacaatcctagctgcatgcttgagagttctaacaggctcgatgaggagcaccggctgatcgcacggtacgctgcaagactagctgcagagtcttcttcttcccaaccccctcaacaaaggtctgctcccgacatttcgttcacgatcgacgctaacaaacagcagagacagttgatcgcagagctcgagaataaaaatagggaaatcttacaagagattcagcgtctgcgacttgaacatgagcaggcttcgcagcctacacctgagaaagcccagcagaatccgacccttctcgctgaactaaggctgctgcgccagcggaaggacgagctggaacagcggatgtccgctctgcaagaaagtcgccgcgagttaatggtgcagctcgagggactcatgaagctgctgaaaacccagggagccggctcaccaagatcgtcccctagccacacaatcagtcggcctatcccaatgcccattaggtccgcctcggcgtgctctaccccaactcatacacctcaagactctctgactggcgtcggcggcgacgtgcaggaggcattcgcccaaagcagtcgccggaatttgaggaacgacctcctggtggcggctgattccatcacaaacaccatgagtagcttagtgaaagaacttaacagcgaggtaggctccgaaacagagtctaacgtggactcggaattcgcgcggacccaatttgaggatctggtgccatctccgactagcgagaaagcattcctggctcagattcatgctagaaaaccaggatacattcacagtggcgccaccacctcgacaatgcgtggcgatatggtcaccgaagatgctgatccctatgtgcagcccgaggacgagaactacgagaacgacagcgtacgtcagcttgagaatgaactgcagatggaggaatatctgaagcagaaactgcaagatgaggcttatcaggtctccctccaggggtag

SEQ ID NO: 186131 - DNA, 1713 bp, Artificial Sequence
  Description of Artificial Sequence: Synthetic coding sequence
atgatcgaggacagcggcaagcggggcaacaccatggccgagcggcgtcagctttttgccgaaatgagagctcaggatctggatcggattcgcctgtcaacttatagaactgcatgtaagctgcggtttgtccagaaaaagtgtaatttgcatttagtcgatatttggaatgtcattgaggccctccgggaaaacgcgcttaataacctggatcctaacaccgaacttaacgtgagccgcctggaggccgtattgagcacgatattttaccagctgaataagcgcatgcccacaactcaccaaatccacgtagagcagtcaattagccttctgctaaatttcttgctggcagcgtttgatccagaaggccacgggaaaatttcagtgtttgctgttaagatggcgttggctactttgtgcggaggcaagatcatggataagctgcgttacatttttagcatgatctccgatagctccggtgtgatggtttacgggagatatgatcagtttcttagggaagtactgaagcttcctactgcagtgttcgaaggtccttctttcgggtacacagagcagtcggctcgttcatgcttctctcagcagaaaaaagtcaccctcaacggctttttagatacactgatgtcagatccccccccacaatgcctggtgtggcttcctcttttgcacaggctggccaacgtggaaaatgtattccacccagtcgagtgtagttactgtcactcagagagtatgatgggttttcggtacaggtgccagcagtgccacaattaccagctttgccaggactgtttttggcgtgggcacgctggaggcagccacagcaatcagcaccagatgaaagagtatacctcatggaagtcccctgcaaaaaaattgacgaacgctctgagcaagtccctgagctgtgccagcagtcgcgaaccacttcatccaatgttccccgatcagcccgagaagcctctgaatctggcccacatcgtcgatacttggccgcccagaccagtaacctcaatgaatgacaccctgttctcgcactcagtccctagtagcggatccccctttatcacccggtcaagccctcctaaagacagcgaggtcgagcaaaacaaactgctcgctcgggctgcacccgcctttctgaagggtaaggggatccagtattctctgaacgtcgccgataggttagcagatgagcatgtcctgatcggactgtacgtgaacatgctgcggaacaaccctagctgcatgctcgaaagcagtaatcgcctggacgaggaacaccgcctcatcgcacgctacgctgctaggctcgcagcagagagtagctcctcgcagccgccccaacagcgcagcgccccggacattagcttcacaatagacgcaaataaacagcagagacagctcatagccgagctcgagaataaaaaccgcgaaatcctccaggaaatacagaggctgcgattggaacacgaacaggcttcacagccaaccccagagaaagcacaacagaaccctacattgttagcagaactgagattacttcgccaaaggaaggatgagctggagcagcgaatgagcgccctgcaggagagccggcgggagctcatggtccagcttgagggtcttatgaagctattaaaagaggaagagctcaaacaaggcgtgagctatgtaccatactgtagatcttag

SEQ ID NO: 186132 - DNA, 2061 bp, Artificial Sequence
  Description of Artificial Sequence: Synthetic coding sequence
atgatcgaggacagcggcaagcggggcaacaccatggccgagcggcgtcaacttttcgccgaaatgcgcgcacaggatctggatagaatccggctgtccacttaccggactgcttgtaagcttcgatttgtgcagaagaaatgcaacctgcacctggttgatatttggaatgtcattgaggccttgcgtgagaacgcgcttaacaatcttgacccgaatacagagctgaatgtgtctagactggaagcggtcctgtccacaattttttaccaactaaacaaaagaatgccgacaacacaccaaattcatgtggagcagagtatctccttgctgttgaactttctcttagctgctttcgacccagagggtcacggcaagatctccgtatttgctgtgaagatggcccttgcaacattgtgtgggggcaagatcatggacaaactaaggtatatcttctcaatgatcagcgacagctccggagtcatggtgtacggcagatatgatcagttcctgagagaggtgctgaaactgcccaccgccgtgtttgaaggcccttcattcggttacacagagcagtctgcccgatcgtgctttagtcagcagaagaaggtgacgctgaacggctttttggacactcttatgtccgacccaccccctcagtgcctggtgtggctacccctgctgcacaggttagcgaacgtggagaacgtgttccatcccgtcgagtgcagttactgtcacagcgagagcatgatgggatttcgctaccggtgccagcagtgtcataattatcaactgtgccaggactgcttctggaggggacacgccgggggaagtcactcaaaccagcatcaaatgaaggagtatacctcttggaagtcccctgccaagaaactaacaaacgccctttccaagagcctgtcttgcgcgtcctcaagggaacctctgcatcctatgttcccggatcagccagaaaaaccccttaacctcgcccacatcgtcgacacctggccacctagaccagtcacatccatgaacgatacccttttctcccatagcgttcctagctcggggtccccttttatcacccggagcatgctcgaaagtagcaacaggttggatgaggaacaccgtctaattgctcgctacgcagctaggttggcagctgagtcttcctcaagccagccaccccaacaaaggagcgcccccgacataagcttcacaatagacgcgaataaacaacagcggcagctcatcgccgagcttgaaaacaaaaatcgtgagatattgcaggagattcagcggctaaggctggaacacgagcaggccagccaacccactccagagaaagcacaacagaatcctacactgttggcagagctgcggcttctacgccagaggaaggacgagcttgagcaacgcatgtctgcactacaagagtcgcggcgagaactgatggtgcaacttgaggggctgatgaagctgctgaaaacacagggcgcaggctcgccacgaagcagtccatcccacactattagtaggcctattcctatgcccatccgctctgcttcagcatgtagcaccccaacacatactccccaggactcccttacgggagtgggcggggatgtccaagaggccttcgcccagagctctagaagaaatcttcgcaacgaccttctcgtggcagctgattctattaccaacacaatgtcctctctggtaaaagagctcaatagtgaagttgggtctgagacagaatccaacgtggactccgaattcgccagaacccagttcgaggaccttgtcccatcccccactagtgagaaggcgttcctagctcagattcatgcccgaaagccagggtatatccatagcggcgctactacctctacaatgagaggcgacatggttactgaagacgccgatccctacgtgcaacctgaagacgagaattacgagaatgattccgtgcggcagcttgagaacgaactgcagatggaagaatatttaaagcagaaactgcaggacgaagcctaccaggtatccctgcagggatag

SEQ ID NO: 186133 - DNA, 1125 bp, Artificial Sequence
  Description of Artificial Sequence: Synthetic coding sequence
atgatcgaggacagcggcaagcggggcaacaccatggccgagcggaggcagctgttcgcagaaatgagggctcaagacctggatagaatacgcttgtcaacctatcggaccgcctgcaagctgagatttgttcagaagaagtgcaatctgcacctcgttgatatatggaacgtgattgaggcactgcgggaaaatgcgctcaacaacctcgatcccaacaccgagttgaacgtgtccagactggaggccgttctatcaacaattttctaccaactgaataagagaatgcctacaacacaccagatacacgtagaacaatcaatctcgcttctgctcaattttctgctggccgcgtttgacccagaagggcatggtaagatcagtgttttcgctgttaaaatggccctcgccacattatgtggcgggaagattatggataaactgaggtacatttttagcatgataagtgatagctccggagtgatggtctacggccgctatgaccagttcctgcgcgaggttctgaagctccctactgctgtctttgagggtccaagcttcggatatactgagcagtcagctcgctcatgtttcagccagcagaagaaagttactctgaacggatttctcgataccctcatgtcagatccgccccctcaatgcctggtgtggctgcccctgctccacagactagcgaatgtcgagaatgtcttccatcctgtcgagtgcagctactgtcacagcgaatcaatgatggggttccgctaccggtgccagcagtgccataattaccagctttgccaagactgcttctggcggggccacgccggcggtagtcactcaaaccagcatcaaatgaaagaatacaccagctggaagtcgcccgccaaaaagctgacaaacgctctgtctaagagccttagctgtgcctcctcccgggagccactacaccccatgttccctgaccaaccagagaaaccgttgaacctggcccacatcgttgacacatggccgcctcgacccgtgacctccatgaatgatactcttttctcccactccgtgcccagttccggaagccctttcatcaccaggtcatcagacggtgcgttcggcggatgcgtttag

SEQ ID NO: 186134 - DNA, 1704 bp, Artificial Sequence
  Description of Artificial Sequence: Synthetic coding sequence
atgatcgaggacagcggcaagcggggcaacaccatggccgagcggagacagctttttgccgagatgcgagcccaggatctcgaccgcattagactgtcgacctatcggactgcctgtaaactacgttttgtgcagaagaagtgtaacctccacctagtggatatctggaatgtgatagaggccttgagggaaaacgcactgaataatctcgacccgaatactgagctcaatgtcagccgactggaggcggtactgtccaccatcttttatcaactcaacaagcggatgcccacaacccaccaaatacacgtcgaacagtctattagccttcttctgaacttcctgcttgctgcctttgaccccgagggccatgggaagatcagcgtttttgccgtgaagatggctctagctactctctgtggtggcaaaattatggataagcttagatatattttttcaatgatatccgactcctccggagttatggtctacggacgttacgatcagtttctgagggaggtgctcaaactgcccactgctgtctttgagggaccatccttcgggtacactgagcagagcgcgaggagttgtttctctcagcagaaaaaggtaaccctgaacggcttcctcgacactctcatgtcagatccacctccccagtgcctggtctggctacctctgctgcaccgtctggctaatgttgagaatgttttccatccagtggagtgctcttattgccacagcgagtccatgatgggctttcgttaccggtgtcagcagtgccataattatcagctttgtcaggattgcttttggaggggccatgcagggggatcccattctaatcagcaccagatgaaagaatacacctcatggaagagtcccgccaagaagctgacaaacgctctcagcaaaagcctgtcttgtgcgtcatccagagagcctctgcaccctatgtttccggatcagccagaaaagccactgaaccttgcacacattgtcccaccccgtccagtaacctcgatgaatgacacactgttctcccacagtgtgcctagctcgggtagcccgtttataacacggtcctctccgccgaaggatagcgaggtagaacagaacaaactgctggcccgcgcagcccctgccttcctgaaagggaagggcattcaatacagcctaaacgtggcagaccggttggccgacgaacacgtcctcatcggcctatacgttaacatgctacggaataatccctcttgcatgttggagtctagtaatagactcgacgaggagcaccgtttgatcgctaggtacgccgcgaggctggcagcggagtctagcagtagccaacccccgcagcagagaagcgcccctgatatatccttcacgattgacgcgaacaagcagcagcgccagctgattgccgagctggagaacaagaaccgagaaatcttgcaagagattcagcgtcttcgactcgagcacgaacaagcaagccaacccacaccagagaaggctcagcagaatcccactctgctggcggaactgcgtctgcttagacagcgaaaggacgagctcgaacaaaggatgtctgcgttacaggagagcaggagagaacttatggtccagctggagggactgatgaagttgctgaaagaagaggaactcaagcagggcgttagctacgttccttactgccggtcctag

SEQ ID NO: 186135 - DNA, 1176 bp, Artificial Sequence
  Description of Artificial Sequence: Synthetic coding sequence
atgttccccgaccagcccgagaagcccctgaacctggcccacatcgtcccaccccgacctgtgacaagcatgaacgacacactattttcacactccgtgcccagctctgggagccctttcatcactcgctcatcaccacctaaagactctgaagtcgaacagaacaagctcctcgctagagccgccccagcatttctgaaaggaaaggggatgctggagtcttcgaatagacttgacgaagaacatcgtcttattgcacgctacgcggctcgcctggccgcagagagctcatcttcccagcccccacaacagagatccgctcccgacattagttttactatagatgctaataagcagcaaagacagctaatcgctgagttggaaaataagaatagagagatccttcaggagatccaaagactgaggctcgagcacgaacaggcctcacagcctacacccgaaaaggcccagcagaatcctacgctcttggccgaactgagacttctgcgtcaacgtaaagacgagctggagcagaggatgagcgcactgcaggagtcgcgacgggagctgatggttcagttggaggggctgatgaagttactcaaaacacaaggcgccggctcaccaagatcctctccaagtcacactattagtcgacctatccctatgccaattagatccgcttcagcctgctccacacccacacatactccacaagattctctgactggcgtgggaggtgatgttcaagaggcctttgcccagtcctctcgccggaacctgcgaaatgatctgctggtggctgctgactctatcaccaacacaatgtcctcactcgtcaaagagctgaattccgaggtgggaagcgagaccgagtccaacgtagactctgaattcgcgcgcacccaattcgaggacctggtgccaagcccaaccagcgaaaaagctttcctggctcaaatccatgcgcggaaacccgggtatatccactcaggagccactacttccacaatgagaggcgacatggttacagaagacgccgatccatacgtgcagccagaagacgagaattacgaaaacgactctgttcgacagctggagaacgaactccagatggaagagtatcttaaacagaagttacaagatgaggcctaccaggtgtcgcttcagggctag

SEQ ID NO: 186136 - DNA, 2232 bp, Artificial Sequence
  Description of Artificial Sequence: Synthetic coding sequence
atgatcgaggacagcggcaagcggggcaacaccatggccgagcggcggcagctgttcgcagaaatgagagcacaggatctagacagaataaggttgtccacatacagaaccgcctgtaaactgcgctttgtgcaaaaaaagtgtaatctccacttagtggacatatggaacgtgattgaggctctgagggagaatgctctgaacaatctggacccgaacaccgaacttaacgtgagccggctggaggcagttctgagcactattttttaccagctgaacaaacgaatgcccactacccaccagattcatgttgaacagagcatcagtctgctgctgaacttcttgctcgcagcatttgacccagaaggccatgggaagatatctgtttttgcggtcaagatggccctggcaactctgtgtgggggaaaaatcatggacaagctcaggtacatctttagcatgattagcgactcatctggagtgatggtttacggtaggtacgaccagtttttgcgcgaggtccttaagctgcccactgctgtgttcgaaggcccatcattcggttatactgaacagtccgccagatcttgtttctctcagcagaaaaaagtcactttgaacggcttcttagacactctgatgtctgatccccccccacagtgtctggtgtggttgccattgctccacagattggcgaatgtcgaaaatgtgttccatccggtggagtgcagctattgtcattccgagagtatgatgggctttagataccgatgtcagcagtgccataattatcagctgtgccaggattgcttctggcgcgggcacgcaggtgggtcccacagcaatcagcaccagatgaaggagtacacaagttggaagtccccagctaaaaagcttacaaacgccctcagcaagtctctctcgtgtgccagcagccgcgaaccactccatcctatgtttcctgatcaacccgagaaaccacttaacctggcccatattgtcgacacttggcctccaaggcccgtgactagcatgaacgatacacttttcagccatagcgttccatcctcggggtctccattcatcacacgtagttctccccctaaagattctgaggttgagcaaaataagctcctggcacgcgcggctcccgcattcctgaagggaaaggggatccaatacagcctgaatgtcgctgacaggctggctgatgagcacgtcctgatcgggctgtatgtcaacatgcttcggaataatccaagctgtatgctcgagagtagcaatcggttggacgaagaacataggctaattgcccggtatgctgcaaggcttgctgccgagtctagcagctcacaaccacctcagcagaggtctgctccagatatttcttttacaatagacgcaaacaagcagcagcgacagctgatcgccgagctcgagaataagaatcgggagattctgcaggagattcaacggctgcgtctcgaacatgaacaagcttcgcaaccgactccggagaaagcacaacagaaccctacattgttggcggagctaaggctgctgcggcagcgcaaggatgaactggagcagagaatgagcgccctgcaagagtctaggcgagagctcatggtccaactggagggtttgatgaaactgctgaagactcaaggggccgggtccccacgaagcagccctagccatacgatttcccggccgattcccatgccgatacgttccgcttcagcttgtagcacaccaacgcatacaccacaggactccctgacaggagttggcggcgatgtgcaggaagcattcgctcaaagctcaagacgcaacctacggaacgacctgctggtggccgccgattctatcacaaatacgatgagcagtttggtaaaagaactcaatagtgaggtcggatctgaaactgaaagtaacgtcgacagcgaattcgcccggacccagttcgaggatctcgttccgagtccaacttccgaaaaggcttttctcgctcaaatccacgctcggaagccaggatatattcacagtggagccaccacttccaccatgcgcggggatatggtgactgaggacgccgatccatacgtccaaccagaggacgaaaactatgaaaatgactctgttaggcagttggagaacgagctgcagatggaagagtatcttaaacagaagctgcaggatgaggcataccaggtgagcctgcagggttag

SEQ ID NO: 186137 - DNA, 2073 bp, Artificial Sequence
  Description of Artificial Sequence: Synthetic coding sequence
atgatcgaggacagcggcaagcggggcaacaccatggccgagcggaggcagctgttcgccgagatgcgggcacaggacctggaccggatccggctgtcgacatatcgaaccgcatgtaaactgaggtttgttcagaagaagtgtaatttacacctggtggacatctggaatgtgattgaagcattgcgcgaaaacgccttaaataacctagatccgaatactgagttgaatgtcagcagattggaggctgttctgagtaccatattctaccaactgaacaaacgcatgcctactacacatcagatccacgtagagcaatcaatctctcttttacttaacttcctgctcgcggcttttgatcccgagggtcatggtaagatttcagtgtttgcagtgaaaatggctctggccaccctgtgtggcgggaagattatggacaaacttcggtacatattctcaatgataagcgatagttccggtgttatggtttacggaaggtacgatcaatttttgagggaagtccttaaactgcccacggccgtttttgagggcccctcattcggctacacggagcagagtgctaggtcttgtttttcccaacagaaaaaggttacactcaatgggttcctggatactttaatgtcggatcctcccccccagtgcttggtatggctgccattgctgcacaggctggctaatgtggagaacgtgttccatccggtcgaatgctcttactgccattcggaaagcatgatgggcttccgctacaggtgtcagcagtgccataactatcagctgtgtcaggattgcttctggagggggcacgccggcggatcgcactcaaatcagcatcagatgaaggaatacacaagttggaagagtccggcaaaaaagcttactaacgccctgtccaagtctctaagttgcgcatcatcacgcgagccattgcaccccatgtttccagatcagcctgagaaacctctgaacctggcccacatcgtcccacccaggcctgtcacttcgatgaacgatacgctcttttctcactcagtgccctcgtctgggtccccatttatcactaggtccatgctggaatcctccaatcgattggatgaagagcaccgtctaatcgcccgttacgcagcccggttggccgccgaaagcagttcctcccagccacctcagcaaagaagcgccccagatatttcttttacgatagacgctaacaaacagcagagacaacttattgcggagctggagaacaaaaatagggagatacttcaggagatccagagactgaggctggaacacgaacaggcgtcccagccaactcctgaaaaggcgcagcagaaccctaccctcctggccgagctgaggttgcttaggcaacggaaggacgaattagaacagcggatgtcagcactgcaggagagcaggagagaattgatggtgcagttagagggtttaatgaaactgttgaaagaggaggagctgaaacaggggacccagggcgccgggagtcctcgctctagcccaagtcatactatctcaagacccattcccatgccaatcaggtccgccagcgcttgttcgactccaacccatacaccacaggattcactgaccggggttggcggtgatgttcaagaagcctttgcgcagtctagtcggcggaatctgcggaacgatctgctggtagccgctgattctattaccaacacgatgagcagcctggtcaaggagcttaattctgaagtaggaagtgagactgagagcaacgtcgattccgagtttgccagaactcagttcgaggatctagtgccatccccaacctcagagaaagcatttctggctcagatccatgcgcgcaagccaggctatatccacagtggcgcaactaccagtactatgcgcggtgatatggtgaccgaggatgcagacccgtacgtccagcccgaggacgagaactatgagaatgactccgtgcggcagttggaaaacgagctgcagatggaggaatatctaaaacagaagcttcaggacgaagcttaccaggtgagtctccagggatag

SEQ ID NO: 186138 - DNA, 2061 bp, Artificial Sequence
  Description of Artificial Sequence: Synthetic coding sequence
atgatcgaggacagcggcaagcggggcaacaccatggccgagcggcgtcagctatttgccgagatgcgcgcccaggatctggacaggatcaggcttagcacctaccggaccgcctgtaaacttcgatttgtccaaaaaaaatgcaatctccacttggtagacatctggaacgtgatagaggcgctccgtgaaaatgcattaaacaacctcgacccgaataccgaactaaatgtgagtagactcgaggcggtgctctctactattttctatcagcttaacaagcgtatgccaaccacccaccagatccatgttgagcagtccattagcttgctgctgaacttcctgctagccgccttcgatcccgaaggccacgggaaaatttctgtgtttgcggtgaaaatggccctggccacactgtgcggtggcaaaatcatggacaaactccgctacattttttcgatgatctctgacagttctggggtgatggtatacggtaggtatgatcaattccttcgagaagttctgaagctgccgaccgctgtgttcgagggcccaagttttgggtatacagagcagagcgctcgttcttgctttagccaacagaagaaggtgactcttaacggctttttggacactctgatgtcagaccctccacctcaatgtctagtgtggcttccactgcttcacagactagccaatgtggaaaacgtctttcatccggtggagtgctcttactgtcattccgagagcatgatgggcttcaggtatcgatgccagcaatgccacaactaccagctgtgccaggattgcttctggaggggccacgccgggggctctcacagcaaccagcaccaaatgaaagagtacactagctggaagtcccccgctaaaaaactgactaacgctctgagcaaaagcctctcctgcgcttcttctcgggaaccgctacatcctatgttccctgaccagcctgagaaaccgcttaacctggctcatatcgtttgcttcaggccccctcgcccagtgacaagtatgaatgacacactgttttcacactccgtgccgtcctctggctccccttttatcactagatctatgctcgaatcttccaatcggctcgacgaggaacataggctgattgctaggtacgccgcacgccttgccgccgagtcgtcctcatcccagcctccccagcagcgttcagctccagacatctcatttaccatcgacgctaacaaacaacagcggcagctgattgctgagttagaaaataaaaatagggaaatccttcaggagattcagcgcctgagactggaacacgaacaggcctcccagcctactcctgagaaagcacagcagaaccctacgttgctcgccgaactgcgcctcctacgccagagaaaggacgaactcgagcagaggatgtccgctctgcaggagtctaggagagagctgatggtgcagctggaggggctgatgaagttgctgaaaacccagggtgctggatccccaaggtcctcgccttcccataccatctcacggcctatccccatgcctatccgatccgcaagtgcatgcagcacccccactcacacgccccaggatagtctaacgggcgtggggggcgacgtgcaggaagcctttgctcaaagctcccgcaggaatctaaggaatgatctactggttgccgcggattctattaccaataccatgagttcactagttaaggaactaaatagcgaggttggatctgaaacagagtccaatgtcgacagtgagttcgctcggacccagtttgaagatttagtcccctccccaacatcggagaaagcctttctagcgcagatccacgcacgcaaacctggatatattcatagcggcgccactacttctaccatgcgaggtgacatggtgaccgaggacgccgatccttacgtccagccagaagacgagaactacgagaacgattctgtgaggcaacttgaaaacgaactccagatggaagagtacctgaaacagaagctccaggatgaagcataccaggttagcctgcagggatag

SEQ ID NO: 186139 - DNA, 2232 bp, Artificial Sequence
  Description of Artificial Sequence: Synthetic coding sequence
atgatcgaggacagcggcaagcggggcaacaccatggccgagcggcgacagctgtttgcggagatgcgtgcccaggacttggacagaatccggctctccacttacaggaccgcctgcaaattgaggttcgtgcaaaaaaagtgtaacctgcacctggtcgacatctggaacgtcatagaagctctcagagagaacgcactgaataatcttgatccaaataccgaactgaacgtgagtcggttagaggccgtgctctccactatcttttaccagcttaataagcgaatgccaactacccatcaaatccacgtggagcagagcatcagcttgcttcttaactttttgctggctgcatttgaccccgaagggcacggcaagatttccgtgtttgcggttaagatggcgcttgctacgctgtgcggcggtaagattatggataagctcaggtacattttttccatgatttctgatagttcgggggttatggtgtacggccgatatgaccagtttctgcgagaggtgttgaaattgccaactgccgtgttcgagggcccaagctttggttacacggaacagtccgctcgctcgtgtttcagtcagcaaaagaaggtcacattaaacgggttcctggatacccttatgagcgatccacctccgcagtgcctagtatggctccccctcctacacagactggccaacgttgaaaatgtgttccatccagtcgagtgctcctactgtcacagcgagtctatgatgggatttcgatataggtgtcagcagtgccacaattaccaattatgccaggactgtttctggcgggggcacgctgggggatctcactctaaccagcatcagatgaaggaatatacctcatggaaatcccctgctaaaaagctgacaaacgccttgtctaaaagcctctcttgtgcaagttccagagaacctttacaccctatgtttccggatcagcccgaaaaacccctgaatcttgcgcacatcgtctgcttccgtccacccaggccggtgacctccatgaatgacacacttttttcccactcggtgcccagctccggttccccatttataacgaggagtagccctccaaaggactcggaggtggaacagaacaagctgttggcccgagcggctccagccttcttgaaggggaagggcatccaatactctctcaatgtggctgaccgcttggctgatgaacatgtgctaataggactttacgtaaatatgttgaggaataacccctcttgtatgttggagtcctctaatcgcctggacgaggaacacaggttgatcgcccggtatgccgctagactggccgctgaatctagcagttctcagcctccacagcagcggagcgctcccgatatctcgttcacaatcgacgctaataaacaacagcgacaattgattgcggagttagaaaacaaaaatagggaaatcctgcaggaaatccaacgactcaggcttgaacacgagcaggcctcccagcctacgcctgaaaaagcacagcagaaccccacgttgcttgctgagctcagactgctgcgacaacgaaaggatgaacttgagcagcggatgagcgcattgcaagaatcccggcgagagttaatggttcagttagaaggtctcatgaaactgctaaagacacagggcgcagggagcccccgaagctccccttcacatacaattagcagaccaattcccatgcctatccgtagtgcaagcgcctgctccacacccactcacaccccccaggatagcttaaccggcgtgggcggtgacgtgcaggaagcctttgcccagtcttccaggcggaacttgaggaacgaccttctggtcgccgctgatagcattactaacactatgtcaagtttggttaaggagcttaactcagaggtcggttccgaaactgaatctaacgtggacagtgaatttgctcgcacccaattcgaggacctggttccttcccccacttctgagaaggcttttctggcccaaatacatgcccgcaagcccggttacattcacagcggtgcaaccaccagtactatgcgcggggacatggtgacagaggatgctgatccctatgttcaacccgaggatgagaattatgagaatgactccgtgcggcaactggagaatgagctccagatggaggagtacttaaaacagaagttacaggatgaggcataccaggtgagtctccagggctag

SEQ ID NO: 186140 - DNA, 2232 bp, Artificial Sequence
  Description of Artificial Sequence: Synthetic coding sequence
atgatcgaggacagcggcaagcggggcaacaccatggccgagcggaggcagctgttcgcagaaatgagagcccaagatttagatcggatcagactctcaacgtatcgcaccgcatgcaaactccgtttcgtacaaaagaagtgtaacctgcacctggttgacatatggaatgtgatcgaagccctgagggagaatgctttaaataatcttgatcctaatactgaactgaacgtgagtaggttggaggccgtgctttcaaccatcttttaccaactcaataaacgtatgcccaccactcaccagatccacgttgaacagagtatctctctcttactcaatttccttttggccgcgtttgaccccgaaggacacggtaagatcagcgtgtttgctgtaaaaatggctcttgccacactctgtgggggaaagattatggacaaactgcgctacatattttccatgatcagtgacagttccggtgttatggtctatggcagatatgaccagtttctgagggaggtccttaagttgcccacagccgtgttcgagggaccttctttcggctacacagaacagtcagctcggtcctgcttttctcaacagaaaaaggtcacactcaatggatttctggatacacttatgagcgaccctccgccccaatgtctagtgtggctgccactgcttcataggctggcgaacgtcgagaacgtgtttcatccagttgagtgcagttactgtcactccgagagcatgatgggattccgctaccggtgccagcagtgccacaattatcagctgtgtcaagactgcttttggaggggtcatgccggaggttcccattcaaaccagcatcaaatgaaagagtatacctcctggaaatcacccgcaaaaaaactcacaaacgctttgtctaaatcattatcttgtgctagcagtcgggagccactccaccccatgttcccagatcaaccggagaagccactcaatctggctcacatagtagatacatggccccctcgcccagtgactagtatgaacgacaccctgttttcccactccgtgccgtctagcggctccccatttatcacccggtccagcccaccaaaagattctgaggtagaacagaacaagctgttggcccgggcagcccctgcttttctgaagggaaagggcatccagtattctttgaacgtggcagatcgtctcgcggacgaacacgtcttgatcggtctctatgtgaatatgttgcggaacaacccctcctgtatgctggaatcttcaaatcgactggacgaggagcatcggctgattgcgcgatacgctgcgcgccttgccgccgagtcatcatcttcccaacctccacagcagcggtcagctcccgatatcagcttcacaattgatgcaaacaaacagcaacgtcaattaatcgccgagctcgagaacaagaaccgggagattttgcaagaaatccagcgactccggctggagcatgagcaggcaagtcagcccacccccgagaaagctcagcagaatccgactctactggctgaattaagactgctgaggcagaggaaggacgaactggagcagaggatgtctgcccttcaggagagccgccgcgagctgatggtccagctcgagggcctcatgaagctgctgaaaacacaaggagcgggctcaccaagatccagcccaagccatacaatcagtcgacccattcccatgcctatccgctccgccagtgcctgttcaactcccacacacaccccgcaggattctctgacaggcgtggggggtgacgtacaggaagccttcgcccagtcttcacgccggaatctccgaaacgatctcctcgtcgccgcagacagcattacaaacacaatgagctctctggtcaaggaactgaattcggaggtaggttccgaaaccgaatctaatgtggattctgagtttgcccgtacccagttcgaggatctagtaccgagcccgacttcagaaaaagcttttctggcccagatccatgctcgtaaacctggttacattcattcaggagctaccacatctaccatgaggggcgacatggtaactgaggatgctgatccctacgtccaacccgaagacgaaaattatgaaaatgacagcgtgcgtcagctggagaatgaacttcagatggaggagtacctgaagcaaaagttgcaggacgaggcttaccaggtgagcttgcagggttag

SEQ ID NO: 186141 - DNA, 1176 bp, Artificial Sequence
  Description of Artificial Sequence: Synthetic coding sequence
atgttccccgaccagcccgagaagcccctgaacctggcccacatcgtacctccccgccccgtaacttccatgaacgatacactgttttcccactcagtgccaagcagcgggtcccccttcattactcggtcttccccaccaaaggactcagaagtggagcagaataagttgctcgccagagcggccccagcatttctgaaagggaaagggatgctggagtcctctaatcgtctggacgaagaacataggttgatcgctagatacgccgctagactggccgcagaatcgtcatcaagccagcctccacagcagcggtcagctcctgatatctcattcactatcgatgcgaacaagcagcagagacagctgattgccgaactagaaaacaagaaccgggaaatcctgcaggagattcagagactgcgcctggagcatgagcaggcctcccagcctacacctgaaaaggcccagcaaaacccgaccctcctggctgaactgcgtttgctgagacagaggaaggatgagctcgagcagaggatgagcgcattacaggagtccagacgcgagttgatggtacagctggagggactcatgaagctcctaaagacacagggggctgggtctccacgctcttcaccatcccacacaatatcgcgccccattcccatgcccatccgttcagccagcgcctgctcaaccccgacacatactccccaggactctctgaccggggtcggaggtgatgtccaggaggccttcgcccagagcagtagacggaacttgagaaacgacttactggtggctgcggattctatcaccaacaccatgtcctccctcgtgaaagaactcaattccgaagttgggagcgaaaccgagagcaacgtggactcggaatttgcgcgcacccagttcgaggacctcgtaccgtctccgacatcagaaaaagctttcctggcccaaatccacgctcggaaacctggctacatacatagtggagctacaacgtccaccatgcgcggggatatggttacggaagacgccgacccatacgtgcagcctgaggacgaaaactacgagaacgacagtgttcgccaactagagaacgagctccagatggaggaatacctcaaacagaagttgcaggacgaagcttatcaggtaagcctgcaagggtag

SEQ ID NO: 186142 - DNA, 1116 bp, Artificial Sequence
  Description of Artificial Sequence: Synthetic coding sequence
atgatcgaggacagcggcaagcggggcaacaccatggccgagcggaggcagttgtttgccgagatgcgtgctcaggatctcgaccgtataaggctgagtacatacaggaccgcgtgcaaattacggtttgtgcagaagaagtgcaatttgcacctggtcgatatctggaacgtgatcgaggccctccgcgagaatgctcttaacaatttggatccaaacactgaacttaacgtatcgaggctagaagccgtcctttccaccattttctaccaactcaataaaagaatgcccacaacccaccaaatccacgtggaacaatccatatccctcctcctgaactttttactggcagcctttgatcctgagggccatggaaagatatccgtgtttgccgttaagatggccctggctactctgtgcgggggcaagattatggataaactcagatacattttctcaatgatatccgactcttcgggggtgatggtctacggaagatatgatcaattcctgcgggaggtcctcaagctccctaccgcagtatttgaagggccttcctttggctacactgaacagagtgcacgaagctgtttctcccaacagaagaaggtgaccttgaacggctttttggatacactgatgtcagatcccccacctcagtgcctggtgtggcttcccctcctccacaggctggccaacgtggaaaatgtgttccaccccgtagagtgttcttattgccatagcgaaagcatgatgggttttcggtaccgctgtcagcagtgccataactaccagttgtgccaggactgcttctggcggggacacgcgggagggtctcactccaatcagcatcagatgaaagagtacacctcttggaaatcacctgccaaaaaactcacgaatgctctctcgaagagcctcagctgcgcttctagccgtgagcctctgcatcccatgttcccggaccagcccgagaaaccattgaatctggcccacattgtccctcccaggcctgtgacatccatgaatgatacgctcttcagccactccgtgccatcttcgggctcaccgttcattactcgcagctctgacggggccttcgggggatgcgtctag

SEQ ID NO: 186143 - DNA, 1794 bp, Artificial Sequence
  Description of Artificial Sequence: Synthetic coding sequence
atgatcgaggagagcggcaacaagcggaagaccatggccgagaagaggcagctgttcattgaaatgagagctcagaatttcgacgtgatcagactgtccacataccgcacagcgtgtaaactaaggttcgtccagaagcgctgtaacctgcatttggttgacatttggaacatgattgaggctttccgggacaatggtttgaacacactggaccatacaactgagatctctgtgtcccgtctcgagacagtgatctcatctatatattaccagttgaacaagaggctgccctccacccaccaaatatccgtggaacagtccatcagtcttttgctcaattttatgattgccgcttacgattccgaaggtaggggtaagctgaccgtctttagcgttaaggccatgcttgccaccatgtgcggaggaaagatgctggacaaactgcgatacgttttctctcagatgagcgatagcaacggactgatgattttctctaagtttgaccagttcttgaaggaggtgctgaaactgccgaccgcagtgttcgaaggccccagtttcggctacaccgaacacagcgttagaacctgttttccacagcagcgcaagataatgctgaacatgtttttggacactatgatggccgatcctccccctcagtgccttgtgtggttgccgctgatgcaccgcctcgcacacgttgagaacgtgttccatcctgtagaatgcagctactgccggtgtgaaagcatgatgggcttcagatatagatgccagcagtgccacaactatcagctctgccagaattgtttttggcggggtcatgctggaggcccgcacagtaaccagcatcagatgaaggaacactcgagctggaaaagcccagccaaaaagctctcacatgcaatatcaaagtcactgggttgtgtgccaacaagggagccacctcacccagtctttcccgagcagcctgagaagccactagacctcgcccacatagtcccaccaagaccgctaaccaatatgaatgataccatggtgtcacacatgtcatctggggtgccgacacccacaaagagactgcaatactctcaagacatcccatctcatctggcggatgaacatgcgttgatcgccagttacgtagcccgcctgcagcactgtgcaagggttctcgattctccaagcaggctcgacgaggaacacagacttatcgcgaggtacgcggcacgcctggctgctgaggcaggaaatgtcacgcgcccccccaccgacctgtctttcaatttcgacgcgaataaacaacagcgacagctcattgcagaactggaaaacaagaatcgtgagatcttacaggagatacagagacttcgcctcgagcacgagcaggcctcacagcccactcctgaaaaggcccagcaaaaccccacactcctcgccgaactgaggctgctgcggcaacggaaggacgagcttgaacagcggatgtccgcactgcaggaaagccgtcgcgagctgatggtgcagctggaggaattgatgaaacttttgaaagaagcggaggcaagagagagtgcccaggcaaccggatcaccccatacttctccgacacatggcggaggcaggcctatgcctatgcccgtgcgatctacatcggcagggagtacaccaacccactgccctcaggattcactcagtggggtgggtggggacgtacaggaagctttcgcccaggccgaggagggggccgaagaggaagaagaaaagatgcagaacggaaaggaccggggctag

SEQ ID NO: 186144 - DNA, 567 bp, Artificial Sequence
  Description of Artificial Sequence: Synthetic coding sequence
atgatcgaggagagcggcaacaagcggaagaccatggccgagaagcgccagctgtttatcgagatgagggcccagaacttcgacgtcattcgtctgagcacgtatcgcactgcatgcaagctgaggtttgtgcaaaagagatgtaatctgcatttggttgacatctggaacatgatcgaggctttccgagacaatggtctcaatactctagaccacaccacagagatttccgtgtctcgactcgagactgtcattagctcaatctattaccagctcaacaaacgcctgccctctacacaccagattagcgtagaacagtcaatatctctcctgttgaatttcatgatcgctgcgtatgacagcgagggacgcgggaagcttacagtgtttagcgtgaaagcaatgctggcgacaatgtgcgggggaaaaatgctagataagctcaggtatgtgttctcccagatgtctgatagtaatggcctgatgattttcagtaagttcgaccagttcctcaaggaggttctgaagttacccaccgctgtgtttgagggtccttctttcggttag

SEQ ID NO: 186145 - DNA, 399 bp, Artificial Sequence
  Description of Artificial Sequence: Synthetic coding sequence
atgatcgaggagagcggcaacaagcggaagaccatggccgagaagcgccagctcttcattgaaatgcgtgcccagaactttgatgtcattagactgtcaacctacagaactgcatgcaaactgaggtttgttcagaagagatgtaaccttcaccttgttgatatatggaatatgatagaagcctttagggataatggtctgaacacgctcgaccacacaaccgagataagcgtgtccagactggagactgtgatatcgtcaatttactaccaattaaacaagaggctaccctccacccatcagattagcgtagagcagtccatctccttgttgctgaactttatgatcgccgcatatgactctgagggtcggggcaagctgaccgtgttcagcgtgtag

SEQ ID NO: 186146 - DNA, 450 bp, Artificial Sequence
  Description of Artificial Sequence: Synthetic coding sequence
atgatcgaggagagcggcaacaagcggaagaccatggccgagaagcgccagctgttcatcgagatgagagcccaaaactttgacgtgatccgtctctcaacataccgaaccgcttgcaaactaagatttgtgcagaaacgttgtaatcttcatctcgtggatatttggaatatgatcgaggccttcagagacaatggattgaatactcttgaccacacaacagagatcagcgtgtccagattggaaaccgtgatttcttccatctactatcagctaaataaacggctcccatcgacccaccaaatttcagtggaacagtccatttctttgctgttgaatttcatgatcgctgcttacgactcagagggcaggggcaagctgacagtgttctctgtcaaggcgatgcttgctaccatgtgtggtggcaaaatgctcgataaactgcggtag

SEQ ID NO: 186147 - DNA, 1794 bp, Artificial Sequence
  Description of Artificial Sequence: Synthetic coding sequence
atgatcgaggagagcggcaacaagcggaagaccatggccgagaagaggcagctgtttattgagatgagggcccagaacttcgatgttattcgattgagcacctaccgtaccgcctgcaagctgcgctttgtgcagaaacgttgcaacctccacttggtggatatttggaatatgattgaagcttttcgagataacggactgaataccctggaccataccaccgaaatctcggtcagccggctggagaccgtcataagctccatctactatcagcttaacaaacggctaccttctacccatcagatttctgtggaacagtctatttccctcctgctgaacttcatgattgctgcatacgattctgagggcagaggtaaactcaccgtgtttagcgtgaaagctatgcttgctaccatgtgcggtgggaagatgctggacaaactcaggtacgtgttttcccagatgtccgactctaacggactgatgatcttttcaaagtttgatcagtttctgaaggaggtcttaaagctgcccaccgctgttttcgaagggccgtcgttcggctatactgagcactcggtgcggacatgcttcccacagcagaggaaaattatgcttaatatgttcctcgatacaatgatggcagacccccctccccagtgcttggtttggttgcctctgatgcaccgcctcgcccatgtcgagaatgtgtttcatccagttgagtgtagttattgtcgatgcgaaagcatgatgggtttccggtacagatgtcagcaatgccataattaccagctgtgccagaattgcttttggagaggacacgccggcggcccccattctaatcagcaccagatgaaggagcatagctcctggaaatcccccgcaaagaaactctctcatgctatctccaagtctttaggttgcgttcccacgcgggaaccgccgcatcccgtgtttccggaacagcccgagaagcccttggacctcgctcacatcgtgccacctaggcccctgacaaatatgaacgacaccatggtctcccacatgagctcaggggtaccaacccctaccaaaaggctgcagtattctcaagatataccgagtcaccttgccgacgagcacgcccttattgcgtcctacgttgcacgcctacaacattgcgcccgagtgttggatagccctagcaggctggacgaagagcacagactcatcgctaggtacgctgcaaggctggctgcagaagccgggaatgtcacacgtcccccgactgacctaagcttcaacttcgacgccaataagcaacagaggcaactcatcgctgagctggagaacaaaaacagggagatcctccaggaaatccagaggcttagactggaacatgagcaggccagccaacctacccctgaaaaggcccagcagaatcccactttgctggccgagttgcggctcctcaggcagcgcaaggatgaactagaacagagaatgtctgccctgcaagagtcccggcgagaactaatggtgcagcttgaagagctcatgaaactgttgaaggaggaggagcaaaaacaggccgcgcaggcaacaggctctccacacaccagccctacacatggcgggggacggccaatgccgatgcccgtgaggtccaccagcgctggatccacacctactcactgcccacaggacagcctgagcggcgtcgggggcgatgttcaggaggcattcgctcaagctgaggagggtgctgaggaggaggaagaaaaaatgcagaatggcaaggatagggggtag

SEQ ID NO: 186148 - DNA, 1683 bp, Artificial Sequence
  Description of Artificial Sequence: Synthetic coding sequence
atgatcgaggagagcggcaacaagcggaagaccatggccgagaagcggcagctttttatcgagatgcgggctcagaattttgacgttatcagactcagtacttacaggaccgcctgcaagttgcgattcgtccagaaacgatgcaacctgcatctggttgacatctggaatatgatcgaagcctttagagacaatggcctcaacactctcgatcataccaccgagatatcagtatcgcggctggaaactgtgatctcttccatctactatcaactgaacaagcgcctaccatctacacaccaaatatccgtggagcaaagcatctccctgctccttaatttcatgattgccgcctacgactccgagggcagggggaaattgaccgtgttttcagtgaaggctatgctggctactatgtgcggtggtaaaatgttagataaattgcgatacgtgttcagccagatgtccgacagtaatggcctgatgatcttttctaagttcgatcaattccttaaagaggtgctcaagctgccgaccgctgtgttcgagggcccttctttcggctacacagagcactccgtgagaacatgctttccccagcaaagaaagataatgctgaacatgtttttagacacaatgatggcggacccccccccccagtgcctggtttggctccctttaatgcaccggctcgcccatgtggagaacgtattccatcccgtcgagtgctcttattgtcgatgcgagtccatgatgggattccggtatcgctgccaacagtgccacaactatcagctgtgtcaaaactgcttttggcgtggccacgcagggggtcctcactcaaatcaacaccagatgaaagagcacagttcatggaaaagtcccgccaagaagctatcccacgccatctcaaagtcactggggtgcgtgcctaccagagaacccccccaccccgtctttccagagcagcccgaaaagccattggacttggcccacatagtaccaccccgcccgttgactaacatgaacgacaccatggtgtcacacatgtcatctggggtgccgaccccaacgaagtctgtgctggactcacctagtcggctggatgaggagcatcgtctgatcgcaagatatgcagccaggttggccgccgaagcggggaacgtcactcgacctcccaccgatctgtcattcaacttcgacgccaacaaacagcagagacagctgatcgcggaactcgaaaacaagaatagagagatactgcaggagatccagaggctgagactggagcacgagcaggcttctcagcctacccctgagaaggcccagcagaatcccaccctgctagcagagctacgacttctgagacagaggaaggacgaactcgagcaacgaatgtcggcacttcaggagtccaggcgcgagctcatggtccagctcgaggaattgatgaagctcttaaaggcccaggccaccgggtcacctcacacctctcctacccacggcggcggcaggcccatgcccatgcctgtgagatccacatcagccggctcaactcccacgcactgcccccaggactcactgtcaggggtcggcggggacgtccaggaggcctttgcgcaggctgaggagggcgctgaggaagaagaggaaaaaatgcagaacgggaaggatcgggggtag

SEQ ID NO: 186149 - DNA, 1884 bp, Artificial Sequence
  Description of Artificial Sequence: Synthetic coding sequence
atgatcgaggagagcggcaacaagcggaagaccatggccgagaagcgccagctcttcattgaaatgcgcgctcagaactttgatgtcattcgcctttccacttacagaacagcctgtaaactgaggttcgtgcagaagaggtgcaatctccatctggtggacatctggaacatgatcgaggcgtttcgcgataacggactcaatacacttgaccatactacggaaatatctgtcagccgtctggaaactgtgataagttctatctattatcagctcaataaaagactaccgagcacccaccaaatttcggtcgaacaatcaatctccctgttgttgaacttcatgatcgccgcctacgacagtgagggtcgtggcaagctgacggtgttcagcgtgaaggctatgcttgccaccatgtgtggaggcaagatgctggataagctccggtacgtattctcacaaatgtctgacagcaatgggctaatgattttctcaaagtttgatcagttcctgaaggaggttctgaagctgcctactgcggtttttgaagggccaagctttggatataccgagcatagcgttcgtacctgttttcctcagcagagaaagattatgctaaatatgtttctcgatacaatgatggccgaccctcccccccagtgtttagtgtggcttcctctgatgcaccggctcgcacatgtggagaatgtgttccatcctgtcgagtgcagctattgtcgctgcgagagcatgatgggcttccgatataggtgccagcagtgtcacaactatcagctctgtcaaaattgtttctggaggggacatgcaggagggccacatagcaaccagcatcagatgaaggagcactcttcatggaagtctccagctaagaagctctcccatgcaattagcaagtctctggggtgcgttcccactcgagagcctccccaccccgttttccccgaacagccggaaaagcccctcgatctagcccacattgtccccccccgacctttgaccaacatgaatgacacaatggtttcccacatgtcatctggagtccccaccccgacaaagaggttgcagtacagtcaggacatcccaagtcatcttgccgacgagcacgctctgattgccagctacgtcgcccgcctacagcactgcgcgagggtcctcgattcccccagtcggcttgacgaggaacaccgactgattgcacgctatgccgcgcggctcgctgcggaggccggtaacgttactcgcccgccaacagaccttagctttaattttgatgcgaataagcagcagcgtcagcttatagcagagctggaaaataaaaatcgtgaaattctgcaggagatccagcgcctgcggctggagcacgaacaagccagtcagccaacacctgagaaagcccaacagaacccaacccttctggcggaattgcggctgctgaggcagaggaaggacgaactggagcagagaatgagcgccctccaggaatcccgacgcgagttaatggtacagcttgaagaactcatgaagctgctgaaggaggaggagcaaaagcaggcggctcaggccaccggctccccccatacctcgcccacccacggcggaggacgccccatgcccatgcccgtcagatccacttcggccgggagtactccgacccattgtccacaggactctctgtccggagttggcggagatgttcaggaagccttcgcccaggggacccgccgaaatctccgaaacgacttgctggtagccgccgacagcataacaaacaccatgtcttctcttgttaaggagttgcacagcgcagaggagggcgcagaagaggaagaggaaaagatgcagaatggtaaggataggggttag

SEQ ID NO: 186150 - DNA, 1704 bp, Artificial Sequence
  Description of Artificial Sequence: Synthetic coding sequence
atgatcgaggagagcggcaacaagcggaagaccatggccgagaagcggcagctgtttatcgaaatgagagctcagaactttgacgtaatccggttatccacataccgcaccgcatgtaaattgcgatttgtgcagaagcgatgcaatctgcatttggtggatatctggaatatgatcgaggctttcagggacaacgggctcaataccttagaccacactactgagatctctgtgtcaagactggagaccgtgatctcaagcatttattatcagctgaacaaaagactgccctctactcatcagatctccgtggagcaaagcatcagcctgctcctgaattttatgattgccgcatacgatagcgaaggtcgcggcaagcttaccgtcttctccgtaaaagctatgttggcaaccatgtgcgggggtaagatgctggacaagctgcggtacgtctttagccaaatgtccgactccaatggcctgatgattttcagcaaatttgaccagttcttaaaggaggtcctcaaactgcctacagctgtgttcgaaggcccaagctttggatacacggaacactctgtgagaacttgtttcccacagcagaggaaaattatgttgaatatgttcctggacactatgatggccgatccacctccgcagtgtttagtctggttgcccttaatgcatcggctcgcgcatgtggaaaacgtatttcatcccgtcgaatgcagctactgtcggtgcgagtctatgatggggtttcgttacaggtgccagcagtgccataactaccagctctgccaaaattgtttctggcggggccatgccggcgggccccattccaatcagcaccagatgaaagagcacagtagctggaaaagccccgctaaaaagctgtctcatgcgatatcaaaatcactgggctgcgtcccaacccgagagcctcctcatcccgtgtttccggagcagcccgagaagcccctggatttggcacacattgtacctccacgtcccctgacaaatatgaacgacacaatggtatctcatatgagctccggcgtccccaccccgacaaagagcgtgctggactcaccatctagactggacgaggagcaccggcttattgcacgttatgccgccagactggctgctgaggcaggtaatgtgaccagaccccctacggacttatcgtttaacttcgacgctaataagcaacagcgtcagttgatcgctgaactggaaaataagaatcgcgagattctgcaagaaatccagagattgcggttggaacacgagcaggccagtcagccgacacctgagaaggcccagcagaatcccacactgctggccgaattgcggcttctccgccagcgcaaggatgagctggaacaaagaatgagcgctctgcaggagtcccggagagaattgatggttcaactggaagaactcatgaagcttcttaaagaagaggaacagaaacaggccgcacaggcaactggatcaccacacacatccccaacccacggggggggcaggccaatgccgatgcccgtccggagcaccagcgccggctcgacccctacccactgtcctcaggattccctttccggcgtcggcggcgacgtgcaagaagcttttgctcaggcggaggagggcgccgaagaggaagaggaaaaaatgcagaatggcaaggacagaggatag

SEQ ID NO: 186151 - DNA, 1773 bp, Artificial Sequence
  Description of Artificial Sequence: Synthetic coding sequence
atgatcgaggagagcggcaacaagcggaagaccatggccgagaagcgccagttgtttatagaaatgcgcgcacaaaattttgatgtgattagactgtccacatatagaacggcctgcaagctcagattcgtgcagaaacgctgtaatctccacctggtagacatatggaatatgatagaggctttccgagacaacggattgaatacgttggaccacacgacggagatctccgtctcacgattggaaacagtaatatcaagcatatattaccaattgaacaagagactgccaagcacccatcaaatttccgtcgagcagagtatcagtttgcttctaaatttcatgatcgcagcctacgactcggaaggccggggaaagctcactgttttctcagttaaagcaatgctggctactatgtgtggcggtaagatgctagacaagctgaggtatgtgttctctcagatgtccgactcgaatgggctcatgatctttagcaaatttgatcagtttctgaaggaggtgctgaaactgccaaccgccgtattcgaaggcccaagtttcggctacactgaacactcggtgcggacgtgcttcccacagcagaggaagatcatgctgaacatgtttctcgataccatgatggccgaccccccaccccagtgcctggtctggctgccgcttatgcataggctggcccatgtggagaacgtcttccaccccgttgagtgttcctactgtcgctgcgaatcgatgatggggttccggtaccgttgccaacagtgtcacaactaccagctctgtcaaaattgtttctggcggggacacgccggggggcctcactccaaccagcaccagatgaaggagcacagctcctggaaatctcccgctaaaaagctgagccacgcaatctctaaatcactgggctgcgtcccaaccagggaacctccacatccggtgttcccagagcaacccgagaagcctctcgacctggctcatattgtcccaccacggccactcaccaatatgaacgatacaatggtgagccacatgtcttctggcgtgcccacccctacgaagagcgtactggactctcccagtcggctggatgaagaacacagactgattgcacgctacgccgctcgactcgccgctgaggctggaaacgtaaccaggccaccaaccgacctcagctttaatttcgacgctaataaacagcaacggcagttgattgcagaactggaaaataagaatagagaaatcctccaggagatccagcgcctgagattggagcacgagcaggcgtcccagccaacacctgaaaaagcccagcagaaccccactctcctggccgagctaagactattgcgccagcgaaaggatgagctggaacagaggatgagcgccctccaggaatcacgaagagaactgatggtccaactcgaggaactgatgaaactgctcaaggctcaggccaccgggtcacctcatacatccccaacacacggaggaggtcgccctatgcctatgcctgtgcgttctacaagcgccggatcgaccccaacacactgccctcaggacagtctgtccggcgtcggaggggatgtgcaggaggcttttgcacagggaacccgacggaatttgaggaacgatctcctggttgcagcagatagcattaccaacaccatgtcttccctcgtaaaggagttgcattcagccgaggagggagctgaggaggaggaggaaaaaatgcagaacgggaaggatcggggctag

SEQ ID NO: 186152 - DNA, 1830 bp, Artificial Sequence
  Description of Artificial Sequence: Synthetic coding sequence
atgatcgaggagagcggcaacaagcggaagaccatggccgagaagcggcagttgttcatcgagatgcgagcccagaatttcgatgtgatccgcttgtcaacttaccgcactgcctgtaagctgaggttcgtgcaaaagcggtgcaatttgcatcttgtcgatatctggaacatgatcgaggccttccgggataacggtctgaacacactagaccacactacggagataagcgtttcaagactggagaccgtaatcagttccatttactaccagctgaacaagcggctgccgtcaacccatcagatttctgtcgaacagtcaatatcactgcttctcaatttcatgatagccgcttatgactcagagggccgcgggaaactcaccgtcttctctgtgaaagctatgttagccaccatgtgtgggggtaaaatgcttgataagctgcgctacgtattcagccaaatgtctgacagtaacgggctgatgattttttctaagttcgatcaattcctgaaggaggttctgaaactgccaacggccgtgtttgagggcccttctttcggttatacagaacatagcgtgcggacttgtttcccacaacagcggaagataatgctcaatatgttcttggataccatgatggcagatcccccaccacagtgtcttgtgtggctccccctcatgcatcgcctggcccacgtggagaacgtcttccatcctgtggaatgtagttactgtcggtgcgagtcaatgatggggttccgctataggtgccagcagtgtcacaattaccagctctgtcagaactgtttctggaggggccatgcaggagggcctcatagcaatcagcatcagatgaaggagcacagctcttggaagtcaccagccaagaaactcagtcatgccattagcaaatccctaggttgtgtgccaacgagagaaccacctcatccagtgttcccagagcaacctgaaaaaccactggatctggcccacattgtcccccctaggccactcactaatatgaacgataccatggtgtctcacatgtcttccggcgtgcccactccgactaaacgcctccaatacagccaagacattcccagccacctggcggacgagcatgccctcattgcgtcttacgtagcaagactacagcattgtgcccgagtgttggactcacctagtcgactggatgaggaacatcgcctgatcgcaaggtatgcagctcggttggcggccgaggcaggaaacgttactagaccgccgaccgacctgtcttttaacttcgatgcgaataagcagcagaggcaactcattgcggaactggaaaataagaatcgcgaaatcttacaggaaatccaacgccttagattagagcacgagcaagcctctcagcctacaccagaaaaggcccaacagaatcccaccctcttagctgagctcagactgctccgccagcgtaaggacgaacttgaacagaggatgagcgcacttcaagagagccgacgtgagctcatggtgcagttggaggagctgatgaaactgcttaaggaggaggagcagaagcaggcggcccaggcgacaggcagtccacacacgagccccacgcatggcgggggacgacctatgcctatgccagtgcgcagtacctcggcgggatccacccccacccactgcccccaggactcactcagcggcgtgggaggtgacgtgcaggaggcgttcgcccagggcacacgtcggaatctgcggaatgacctgctagtggctgctgatagcataacgaatacgatgagttcccttgtaaaggagctccactcgggatag

SEQ ID NO: 186153 - DNA, 1638 bp, Artificial Sequence
  Description of Artificial Sequence: Synthetic coding sequence
atgatcgaggccttccgggacaacggcctgaacaccctggaccacacgaccgagatcagcgttagccggttggagactgtgattagttcgatttactaccaactgaataagaggctccctagtactcatcagatctcagtggagcagagtatctctctgctgctgaattttatgatcgcagcctacgacagcgaaggccggggaaaactgacagtcttcagcgtaaaggccatgctcgctacaatgtgtggcggcaagatgctcgataaactgcgttatgtgttttcacaaatgtccgactctaacggtctgatgattttctcaaagttcgaccaattcttaaaagaggtcctcaagctcccaactgctgtgtttgaaggtcccagtttcgggtacaccgagcattcagtccgtacctgttttccccagcagagaaaaattatgctcaatatgtttttggacacaatgatggccgatcctcctcctcagtgcctggtctggctgcccctcatgcaccggctggcccacgtagaaaacgttttccacccagtggagtgttcatactgccgatgtgaaagcatgatgggctttagatataggtgccagcagtgccacaactatcaactctgtcagaactgtttctggcgtggtcacgcggggggcccccacagcaatcagcaccaaatgaaggaacactccagctggaagtcccccgccaagaagctttctcatgctatttctaaaagtctcgggtgcgtccctaccagagagcccccacacccggtgtttccggagcagccagagaaaccgcttgacttggcgcacattgtcccacctcgccctctcaccaacatgaacgatacgatggtttcacacatgtccagcggcgttcctacgccgactaaacgactacagtactctcaggatatcccttcacatttggctgatgaacacgcgttgattgctagctacgtggctcggctccaacactgcgctcgtgtcctagacagtccatctaggctggacgaggaacaccggttgatcgcccgttacgctgcccgcctggctgctgaggctggaaatgtgactcgtcctcccaccgatctgagtttcaacttcgacgccaacaagcaacagagacaactgatagcagaactcgagaataagaatagggaaatcctccaggaaatacaacgtctccgcctggagcacgaacaggcatctcagcccaccccagaaaaagctcagcagaatcctactctgctggcagagttgcgtttgctgcgacaaaggaaagacgaactggaacaacgcatgtctgctctgcaggagtcccggcgggagttaatggtccagctggaagaactaatgaaattacttaaggcccaggctacaggatcaccacatacctctcccacccacgggggcggcagacctatgcccatgccagtgcgaagtacttctgcgggctcaaccccaactcactgccctcaggacagcctgtcaggcgttggcggggacgtccaagaagcttttgcacagggcactaggcggaatttacgcaacgatttgctcgtcgcagctgattccatcacaaatactatgtcaagccttgttaaggagctgcattctgggtag

SEQ ID NO: 186154 - DNA, 960 bp, Artificial Sequence
  Description of Artificial Sequence: Synthetic coding sequence
atgaccgacgtgttcagccagatgagcgacagcaacggcctgatgatcttttcaaagttcgatcagttcctgaaagaggtgctgaaactgccgaccgctgtgttcgaagggcccagtttcgggtatacagagcacagcgtgcgtacatgctttccgcagcagagaaagatcatgctcaacatgttcctggatactatgatggctgacccacctccacaatgtctcgtctggctgcccctgatgcatagactggcgcatgtggaaaacgtcttccatcctgttgaatgctcgtactgccggtgtgaaagcatgatgggcttccgatatcgatgccagcagtgccacaactaccagttgtgccagaattgtttctggcgggggcacgctggaggcccgcattctaaccagcatcagatgaaagagcactcctcttggaagagtcccgcgaagaaactgtctcacgccatcagtaagtccctgggctgcgtgcccacccgcgagccgccccatcccgtgtttcccgagcagccagaaaagccactggacctcgcgcatattgtgcctcctcggcccctgaccaacatgaacgacacaatggtctcccatatgagctcaggcgtacctactcctacgaagagactgcagtatagccaagatatccccagtcatctggccgacgagcacgccttaatagcaagctacgtcgcgaggctccaacactgtgcgcgagtccttgatagtccgtcacggctggacgaagaacacagactcatagcccggtacgcggcacgccttgccgccgaggcaggtaatgtgacacgccctccaaccgatttgtccttcaactttgacgccaataaacagcagaggcagttaatcgcagagctcgaaaataagaatagggagattttgcaggagatccagaggctgaggctggagcacgagcaagcctcacaatag

SEQ ID NO: 186155 - DNA, 1251 bp, Artificial Sequence
  Description of Artificial Sequence: Synthetic coding sequence
atgctgaacatgttcctggacaccatgatggccgacccccccccccaatgcctggtctggctgcctctcatgcataggctggcccatgtggagaatgttttccatccggtggaatgtagctactgccgttgcgagtcaatgatgggtttccgttacaggtgccagcaatgccacaactatcagctatgtcagaactgcttttggagaggacacgctggaggtccacactctaatcaacaccagatgaaggaacattcgagttggaagagtccggcaaagaagctatcacatgccatcagcaaaagcctggggtgcgtccctactagagagcccccccatcccgtcttccctgaacagccggagaaacccctcgacctcgctcatatcgttccaccaaggcccttgacaaatatgaatgacacaatggtgagccacatgtcttcaggggtgccgacccctactaagaggttacagtactctcaggatatccccagccacctggcagatgaacatgctctgatcgctagctatgtggcaaggctccagcactgtgcccgcgtgttggacagtccatctagactcgacgaggagcatcggctgattgcacggtatgccgctaggctggccgcagaggcaggcaatgtaacaagaccaccaactgacctgagctttaacttcgatgccaataagcaacagcggcaactgattgctgaactggagaataagaatagggaaatcctgcaagagatccagcggctgaggctggaacacgagcaggcatctcagcccacccctgaaaaagcgcagcaaaacccaaccttattagcagagctgaggctgctgcgtcagcggaaagatgaactggaacagaggatgagcgccctgcaagaatcacgcagggagttaatggtgcagctcgaggaactgatgaaattgctgaaggcacaggccaccggaagtccacatacaagccccacgcacgggggaggacggccaatgcctatgcccgttcgatcaacatccgctggatccaccccaacccactgccctcaagattccctgtctggggtgggaggggatgttcaggaagcgtttgcacagggtactcggcgaaacctgcgtaatgacttgttagtggctgcggatagcattacaaataccatgagctcattggtgaaagagttgcattcagccgaagaaggtgctgaggaagaggaagagaagatgcagaacggaaaggacagggggtag

SEQ ID NO: 186156 - DNA, 2688 bp, Artificial Sequence
  Description of Artificial Sequence: Synthetic coding sequence
atgcggatgagcgtgggcctgagcctgctgctgcccctgagcggcagaaccttcctgctcctgctctccgttgttatggcgcagtcacattggcccagtgaaccctcggaggctgttcgagattgggaaaatcaactcgaagcctcaatgcatagtgttctgtctgacttgcacgaggcagtgcccaccgtggtgggaatccccgatgggaccgccgtcgttggccggagttttcgagtgacaattccaacagacctgatcgcgtcgagcggtgacatcataaaagtgtctgctgccggtaaggaagccttaccttcttggctccactgggactctcaatctcataccctggaggggttaccccttgacaccgacaagggagtccattatatctctgtctccgctaccaggctgggcgccaacggctctcatattcctcagacctcctccgtgttcagcatcgaggtatatccagaggatcacagtgagctgcaatcagtcaggacagcaagccctgatcccggtgaagttgtaagtagcgcctgtgcggcagatgagcctgtgaccgtgctcacagttattttggatgctgacctgacaaaaatgacccctaaacaaaggatagacctgctgcacagaatgaggagtttttccgaagtcgagctgcacaacatgaaacttgtgcccgtggtgaacaatcgactttttgacatgtccgcctttatggccggccctgggaacgccaagaaggtggttgagaacggcgccttgctgtcctggaagttgggctgcagtctgaaccagaattccgtgcccgatatccacggggtcgaggccccagcgcgtgagggagccatgtctgcccagcttggttaccccgtcgtcggatggcatatcgcaaataaaaagccgccgctgcctaagagagtccgcagacagattcacgcgactcccactcctgtcactgcaattgggccgcccactactgccatccaagagccaccatctaggatcgtcccaactccaacgtcaccggcaatcgccccgcccactgagacgatggcccccccggttagagatcctgttcctggcaagcctaccgttactatccgtacccgcggcgccattatccagactccaacattgggtcctattcagccaactagggtgtcagaggccggaacaaccgtgcccggacagatccggccgactatgacaattccaggttatgttgagccaacagcggtggcaacaccccccaccacaaccactaagaaaccccgcgttagcacccctaaacctgccactccatccacagacagcacgaccacaactacacgtaggcccacaaaaaagccccggactccccgccctgtacctagggtaacaacgaaggtttccatcacccgcctggagacagcctctccgcctactcggatcagaaccaccacatccggagtacccagaggcggggaaccgaaccagaggcccgagttaaagaaccacatcgaccgtgttgatgcatgggtgggcacatatttcgaggttaaaattccctctgacactttctacgatcacgaggatactacaaccgacaagctcaaactcaccctcaagctcagagagcagcagctagttggtgagaagagctgggttcagtttaactcaaactcccagctgatgtatggccttccggactcgagccacgtcggcaagcacgagtactttatgcacgctacagacaagggtggcctctccgctgtggacgcctttgaaattcacgtgcacagacgcccacaaggcgatcgcgccccagctcgctttaaagccaagttcgtgggtgaccctgcattggtgttgaacgacatccacaagaaaatcgctctggtaaaaaaattagccttcgcattcggcgacaggaattgtagcacgataacattacagaatattacgagggggtccatcgtagtcgagtggacaaacaacacactgccactagaaccttgtccgaaggaacagattgctggactgtccaggcggattgccgaggatgatggaaagcctcggccagcattcagcaacgccctggaacctgactttaaggccacaagcatcacagtaactgggtccggttcctgccgacatctgcagtttattcccgtggttcctcccagaagggtgcctagtgaagccccccccaccgaagtccccgaccgtgatcctgaaaagagctcggaagatgatgtttatctccacaccgtgatccctgcagtcgtcgtggccgcaatcctactgattgccggaatcatcgcgatgatctgctatcgcaaaaagcgaaagggaaaactcacactagaggaccaggccacctttattaagaagggcgtccccatcatttttgctgacgaactggatgatagtaagccccccccgtcaagcagtatgcctctgattctgcaggaggagaaagccccactgccacctcctgagtatccaaatcagtctgtccccgaaacgacacctctgaaccaggatacaatgggggagtacacccctctccgcgacgaggacccaaacgctccaccataccagccaccgcccccctttactgccccaatggaaggaaaaggcagccgcccaaaaaacatgacgccctaccggagtccacctccctacgtgcccccctag

SEQ ID NO: 186157 - DNA, 432 bp, Artificial Sequence
  Description of Artificial Sequence: Synthetic coding sequence
atgacccccaagcagcggatcgacctgctgcaccggatgcggagcttcagcgaggtagaactccataacatgaagctcgtgcctgttgtgaacaacagactcttcgatatgagtgctttcatggctggccctgggaacgcaaaaaaagtcgtggaaaacggagcgcttctcagctggaagcttggctgtagcctgaatcaaaactcagttcccgacatacatggcgttgaggctcctgctcgcgagggtgcaatgtcagctcaacttggctaccctgtggtgggatggcatattgccaacaaaaagccaccagcgctgtctggccccccaaaaccccagtctagctggagagacttcggagattttttcatatttatcttttgtttgaccgcctttggcctgtttatcgaaaactcgtctttacacttttag

SEQ ID NO: 186158 - DNA, 267 bp, Artificial Sequence
  Description of Artificial Sequence: Synthetic coding sequence
atgcggatgagcgtgggcctgagcctgctgctgcccctgagcggcagaacttttctccttctgctgtccgtcgtgatggcgcagtcccattggccaagcgagccatccgaagcagtaagagactgggagaaccaactggaggcctccatgcactccgtgctaagcgaccttcacgaggctgtgccaacggtcgtgggcatcccggacggtacagcagtcgtggggcggagctttcgggtcacaatcccgaccgatttgattgcttag

SEQ ID NO: 186159 - DNA, 48 bp, Artificial Sequence
  Description of Artificial Sequence: Synthetic coding sequence
atgcggatgagcgtgggcctgagcctgctgctgcccctgagcggctag

SEQ ID NO: 186160 - DNA, 321 bp, Artificial Sequence
  Description of Artificial Sequence: Synthetic coding sequence
atgcggatgagcgtgggcctgagcctgctgctgcccctgagcggccgcacattcctcctgctgctcagtgtggtcatggcgcaatcccactggccgtctgagccatctgaagccgtcagagattgggagaaccagctggaggcatcaatgcactccgtgctgtctgatcttcacgaagcagtgcccaccgtcgttgggatccctgatgggactgccgtggtcgggaggtctttcagggttactattcctaccgatctgattgcttccagcggggatatcattaaggttagtgcggctggcaaggaagccctacccagctag

SEQ ID NO: 186161 - DNA, 291 bp, Artificial Sequence
  Description of Artificial Sequence: Synthetic coding sequence
atgcggatgagcgtgggcctgagcctgctgctgcccctgagcggccgcacttttctgctgttgttgtccgtcgtcatggcccagagtcactggcctagtgaaccttccgaggccgtccgagattgggagaatcagctagaggcatcaatgcactccgtattgagcgatttacacgaggcagtccccactgtcgtgggaatcccagacgggaccgctgtggtcggccgctccttccgcgtgaccattccgactgacttgatcgcgagtagcggagatattatcaaggtgtag

SEQ ID NO: 186162 - DNA, 30 bp, Artificial Sequence
  Description of Artificial Sequence: Synthetic coding sequence
atgcggatgagcgtgggcctgagcctgtag

SEQ ID NO: 186163 - DNA, 354 bp, Artificial Sequence
  Description of Artificial Sequence: Synthetic coding sequence
atgcggatgagcgtgggcctgagcctgctgctgcccctgagcggcagaacattcctgctgcttctctcagtagtcatggcccagagccattggccatctgagccatcggaggcagtgagagattgggaaaatcagctggaggcttccatgcatagtgttctgtcagaccttcatgaggcagtccccacagtcgtcgggatccccgacggtaccgcggtggtgggacggagcttccgcgtgacaatccctacggatctcattgcgagttccggcgacataattaaggtctctgccgcaggaaaggaggctctcccttcctggttacactgggacagccagtcccacaccctgtag

SEQ ID NO: 186164 - DNA, 159 bp, Artificial Sequence
  Description of Artificial Sequence: Synthetic coding sequence
atgcggatgagcgtgggcctgagcctgctgctgcccctgagcggccggacgttcctgctgcttctgtctgtagtgatggcgcaatcccactggccatctgagccttctgaggcggtccgtgactgggaaaaccagctagaggccagcatgcatagctag

SEQ ID NO: 186165 - DNA, 261 bp, Artificial Sequence
  Description of Artificial Sequence: Synthetic coding sequence
atgcggatgagcgtgggcctgagcctgctgctgcccctgagcggccggacgttcctgctgttactttctgtggtgatggcacaatcacattggccatccgaaccaagcgaagccgtgcgggattgggaaaaccaacttgaagcctccatgcacagcgttctctccgatctgcatgaagccgtgcccacggtggtagggatccctgacgggaccgcggttgttggtcggagcttccgagtgaccatccccaccgatttatag

SEQ ID NO: 186166 - DNA, 126 bp, Artificial Sequence
  Description of Artificial Sequence: Synthetic coding sequence
atgcggatgagcgtgggcctgagcctgctgctgcccctgagcggccgaacttttctcctgctcctgagtgtcgtcatggcccaatctcattggccatctgagccgtcagaggcagtgagggattag

SEQ ID NO: 186167 - DNA, 2688 bp, Artificial Sequence
  Description of Artificial Sequence: Synthetic coding sequence
atgcggatgagcgtgggcctgagcctgctgctgcccctgagcggcagaacttttctactgctgctgagtgtggtgatggcacaaagtcactggcccagtgagccctcagaagccgttcgcgactgggagaaccaactggaagccagtatgcacagcgttctgtcagacctgcacgaggcagtcccgaccgtggtcggcattcctgatggcacagccgtagtggggcgatcatttagagtgaccataccgactgacctaatagcttcttccggggatatcatcaaagtgtccgcagcaggaaaagaggccctgccgtcttggctgcattgggacagccagtctcacactttggagggcctgcctttggatacagacaagggggtgcactacatttctgtgtccgccacccgcttaggagcaaatggttcacatataccacaaacctcttcagtgttttctattgaagtgtacccggaagatcactcagaactacagtccgtaaggacagcatcccccgatccaggcgaagttgtgagtagtgcctgcgccgccgacgaacccgtaactgtcctgaccgtgatcctggacgcagacttgactaaaatgactcccaaacagcggatcgacctgctccacaggatgcgctccttcagcgaagtcgagctgcacaacatgaagctggtcccagtcgtaaataatcgattgttcgacatgtccgcctttatggccggtcccggaaatgcaaagaaagtcgtggagaacggcgccctgctgtcgtggaagctggggtgctcgctcaaccaaaacagtgtcccagacatacacggcgtcgaggcccctgcacgagaaggcgctatgagcgcacagttggggtaccctgtggtggggtggcacatagctaataagaagcctcctctgcccaaacgcgtgagaaggcagatccacgctaccccgacgccagtcacagctatcgggcctcccaccacagctatccaagagccaccctcaagaatcgttcccacccctacgtcccccgccattgcccccccaaccgaaacaatggcaccgcctgtgcgcgatcccgtgcctggcaaacctaccgtgaccatcaggacacggggcgctattattcagaccccaactctcggccccattcagcctacccgcgtgtctgaggccgggacaactgtccctggccagatccgcccaaccatgaccattcccgggtatgttgagcccactgcagttgcaactcctcctactactaccactaaaaagccgcgcgtgtccacgccaaaacccgcgacgccctctacagactccactaccaccacaacccgaaggcccacgaaaaagcccaggaccccgcgacctgtcccgagggttacaacgaaagtttcaataacgaggctcgaaaccgcgtcacctccaacccggattcggacaactacctccggcgtaccgagagggggtgagccaaaccagcgaccggagctgaaaaaccacatcgatagggtcgacgcctgggtgggcacttacttcgaagtgaaaatacctagcgataccttttacgaccatgaggacactactaccgacaagttgaagctcacccttaaactgagggaacagcaactagttggggagaagtcttgggtgcaatttaactcaaactctcagctcatgtatggtctccctgattcctcccacgttggaaagcacgaatattttatgcatgctacagacaagggaggcctttccgcggtggatgctttcgagatccacgttcaccgacgaccccaaggagaccgggcccctgcccgtttcaaggccaaatttgtgggagacccagccttggtcctcaacgacattcacaaaaagatcgccctggtcaaaaaactggccttcgcatttggagatcgcaactgctcaacaattactcttcagaatatcactcgaggtagcatcgtggtggaatggacaaacaacaccctgcccttagagccctgccctaaagagcagatcgccggcctctcacgtaggatcgccgaggacgatggcaaacctaggcctgcattttccaatgccttagagccagatttcaaggccacctccatcacggtgaccggatcagggtcctgccgacacctccagtttatccccgtcgtgccaccccgccgtgttcctagtgaggccccgccaacagaagtgcctgacagggatcccgaaaagagcagcgaagacgatgtgtatctccatacagtgatacctgccgtggtggtcgccgccatcttacttatcgccggcatcatcgctatgatatgttacaggaaaaagagaaagggaaagttgaccttggaggaccaagctaccttcattaaaaagggagttccaatcatctttgccgacgagctggatgacagcaagccccccccaagctcaagcatgcctctcattttgcaggaggaaaaggcacctctgcctcccccagaatacccaaaccagtccgttcccgaaacaaccccactgaaccaagacacgatgggcgagtacacccccctgcgcgacgaagacccaaatgccccaccatatcaaccacctcccccattcacagcgcctatggagggtaaaggatcccgtcccaagaatatgaccccttaccggagtcccccaccttatgtccccccctag

SEQ ID NO: 186168 - DNA, 2688 bp, Artificial Sequence
  Description of Artificial Sequence: Synthetic coding sequence
atgcggatgagcgtgggcctgagcctgctgctgcccctgagcggccgcacattcctcctgctcctgtccgttgtcatggcacagtctcattggcccagcgagccaagcgaggcagtcagagactgggaaaatcaattggaggcgtccatgcattctgttctgagcgatctgcatgaggccgtgcctactgtggtcgggatcccagacggcacagctgtggtaggacgctctttccgggtcaccatccccacggacctcattgcctctagtggtgacattatcaaggtatccgccgcgggaaaggaggcacttccttcctggctccactgggatagccagtcacataccttagagggactgcctttggacaccgacaagggagttcattatatcagtgtatcggccactagactgggagccaacggctctcacattccacagacaagttctgtgttctcaatcgaggtgtatcctgaggatcacagtgagttgcaatccgtccgtacagcctccccagatcccggcgaagtcgtgtctagtgcctgtgcagccgacgaacccgtcacagtactgactgttattcttgatgcagacttgaccaagatgacacccaaacagagaatagacctactgcatagaatgagaagtttcagcgaagtcgagctccataatatgaaactggtgccggtggtgaataaccgactgttcgatatgtctgccttcatggccggcccgggaaacgcaaagaaagtggttgagaatggcgccctgctgtcctggaagttgggatgcagtcttaaccagaatagcgtccctgatatacacggagttgaagccccagcccgggagggagccatgtcagctcaactgggctacccagtcgtgggatggcatatcgccaataagaagccccccctgcccaagagagtcaggcggcagattcatgccacaccgacacctgtcacggcaataggtccccccacgacagccatccaggagccgcctagtcgaattgtccccacaccaacatctcctgccattgctccgccgactgaaacaatggccccgccagttcgggatcccgtcccaggcaagccaacagtgacaatcaggacccggggcgctatcatccagactcccactttgggaccaatccagcccactcgtgtcagcgaagccggcacaacagtccctggtcagattaggccaactatgaccatacctgggtacgtagagccaactgccgtagcaactcctccaacaacaacaacaaaaaagccacgggtttccacccccaaacctgcaaccccatctacagactcgacaaccactaccacccggaggcccacaaagaaaccccgaaccccacgccctgtccctcgggtgaccactaaagtcagcataaccagattggaaacggcctcacctcccacacgtatcagaaccacgaccagcggagtcccacgcggcggcgaaccaaatcaacgccccgaactcaaaaatcacatcgatagagtggacgcatgggtcggtacatacttcgaggtgaagattccatctgatactttttacgatcatgaggacacgaccactgacaagttgaagcttacactgaaactgcgagagcaacagttggtgggggagaaatcatgggtccagttcaactctaactcccagctcatgtatggtctgcccgacagctcacacgtgggcaagcacgaatatttcatgcatgccacagacaagggaggtctgtccgcagtggatgctttcgagatccatgttcacaggaggccccaaggcgaccgggctcccgcccgctttaaggctaagttcgtgggggatccggcccttgtgctgaacgatatccacaaaaagatagcacttgtgaagaaattggccttcgcattcggggacagaaattgcagtaccatcaccctgcagaacattactcggggctctattgtggtggagtggaccaacaacaccttgcctctcgagccttgccccaaggagcaaattgcaggtcttagtcgccgcattgccgaagacgacgggaaacctagacctgccttttccaatgcgctcgagcccgattttaaagctacaagtattacagtaacgggctctgggtcctgcaggcatctgcagtttatacccgtggttcctcccagaagggttcctagcgaggcaccccccactgaggttccagatagagaccccgagaagagtagtgaggacgacgtctacctgcacactgtcatacctgcagtcgtggtggccgctatactgctgatcgccggaatcattgcaatgatctgttaccgcaagaagagaaaaggaaaactaacgctggaggatcaggctacattcatcaagaaaggagtgcccataatctttgcagacgaactggacgactccaaaccccccccctcctcctcaatgcccctcattctgcaggaggaaaaggcacctctgcctcctcctgagtaccccaatcagtctgtgccagaaacaacccctctgaatcaggacaccatgggagagtatactccactcagggacgaagaccctaatgcccccccataccagccaccccctcccttcaccgcgcctatggagggcaagggatcgaggcctaagaatatgaccccatatagaagtccaccgccttacgtgcccccctag

SEQ ID NO: 186169 - DNA, 2688 bp, Artificial Sequence
  Description of Artificial Sequence: Synthetic coding sequence
atgcggatgagcgtgggcctgagcctgctgctgcccctgagcggccgtacatttctgctgctgctctccgtggtcatggcacagtctcattggccatccgagccctccgaagcagtacgtgactgggagaatcagctggaggcatccatgcattctgtcttgagtgatctccacgaagcggtgcctaccgtggttggcatcccggacggcaccgccgtggtcggtcggagctttcgggtcaccataccaaccgatcttattgccagctctggggacattattaaggtctcagcagccggcaaagaggccctcccttcttggctgcactgggactctcaatctcacactctggagggcctgccgttggacacagacaaaggggtacattatattagcgtcagcgctacaagactcggggccaatggttctcacatcccccagacatcttctgtgttctctatagaggtgtatcctgaagaccacagcgaactccagagcgtaaggactgcatctcctgatcctggcgaggttgtgagtagcgcatgcgccgcggacgagcccgttacagtgctcacggtgattttagatgcagacttgaccaagatgacgcctaagcagagaattgacctgctccacagaatgcgtagtttcagcgaagtggaactacataatatgaagctggtgccagtggtgaacaacaggctgttcgacatgtccgccttcatggcaggaccagggaatgccaaaaaagtcgtggagaacggggccctgctctcttggaagcttggctgttctttgaaccaaaattctgtcccagacatccacggcgtcgaggcaccggcaagggagggtgccatgtctgcgcaattgggataccccgtcgtgggttggcatatcgccaacaagaaacctcctttgccaaagagggtgcgccggcagattcatgccacgccaaccccagtcacagccatcggacctcccaccaccgccattcaggaaccaccgtctagaattgtacccaccccaacatcacccgccatcgcccctccaaccgagacaatggctcctcctgtcagagatcccgttccaggcaaaccaacggtaacaattcgaacccgcggagccatcattcagacacccactctcggcccgattcaacccacacgcgtgtcagaggccggcaccacggtcccagggcagatccgtccaaccatgacgatcccaggctatgtggaacccacagcggtagctacacctcccacaactacgacaaaaaagccacgggtatctacgcctaaaccagctactcctagcacagattccaccaccacaactactcggagacccaccaaaaagccccggacaccaagacctgttccgagggtgacaaccaaggttagtatcactcggctggagaccgccagcccccccacaaggattcggactaccactagcggtgttccaagaggaggcgagccaaatcagcgtccggaacttaagaatcacatcgacagggtcgatgcatgggtgggaacttacttcgaggtgaaaattccgagtgacactttctatgaccatgaagacacgacaacggacaaattgaaactcactctaaagctgagagaacagcaactggtgggagagaaaagctgggtgcagttcaatagcaacagccagttgatgtacggtctcccggatagttctcatgtgggtaaacatgaatactttatgcatgctaccgataagggagggctgagcgccgtggatgcattcgagatccacgtgcacagacggcctcagggagaccgcgctccagcacgatttaaggctaagtttgtaggtgatcccgcactggtgctgaatgacatccacaagaaaatagccttagttaagaagctggcatttgcttttggagatcggaattgctccacaattacactccaaaatatcacgcggggaagtatcgtggtcgagtggaccaataatacgctccccctggagccgtgcccgaaggagcaaattgccggattgtcacggcgcatcgccgaggatgacggtaagccacgacctgccttttctaacgccttagagccagactttaaggctactagtattacagtcacaggatctgggtcatgtcggcaccttcagttcatccccgttgtccccccccggagggttccgtccgaagctccacctactgaggtccctgaccgcgacccagagaaaagctccgaagacgacgtttacttgcataccgtaattcccgccgtagtcgtagcagccatcctgctcattgccggcatcattgctatgatctgttaccgtaagaaacggaaggggaagctaaccttggaggaccaggcgaccttcattaagaaaggggtaccaataatcttcgccgacgagctggacgacagcaaaccaccaccatccagctccatgcccctgatcctacaggaagagaaggccccgctgccccctcccgaatatcccaaccagtctgtcccggaaactacaccattgaaccaggataccatgggggaatatacccctctgcgggatgaagatccaaacgctccaccttaccagcccccaccgccgttcaccgctcccatggagggcaaaggcagccgtcctaaaaacatgaccccctaccgaagcccaccgccctacgtaccaccatag

SEQ ID NO: 186170 - DNA, 2688 bp, Artificial Sequence
  Description of Artificial Sequence: Synthetic coding sequence
atgcggatgagcgtgggcctgagcctgctgctgcccctgagcggccgcacatttttgctgctccttagtgtggttatggcccagtctcactggccctctgagccgagtgaagccgtccgcgactgggaaaaccagctggaggcatccatgcattcggtgctctcagacttacacgaggcagtgccaactgtggtgggcattcctgatggcacagccgtggtgggccgctctttccgcgttacaattcccacagacttgatcgcttcttctggagacattattaaagtgagcgctgcaggcaaagaagcgctgccttcctggttgcactgggactcacagtcgcacaccctggagggtttacctcttgacaccgacaaaggagtccactacatctccgtttccgcaaccaggctcggagcgaatgggagccatatcccacagacgagtagcgtgtttagcatcgaagtatatccggaggaccattcagagcttcagagtgtgcgcactgcctctccggatcccggggaagtagtcagctccgcatgtgccgccgatgaaccagttacggttcttacagtcatcttagatgctgacctaactaagatgaccccaaagcagagaatcgacttattgcatcggatgcgaagctttagcgaagttgagctccacaatatgaagttggtgccagtggttaacaatagactgttcgacatgtccgctttcatggccgggccaggcaacgccaagaaagttgttgagaacggcgcattgctgtcatggaagctggggtgttccctgaatcagaattctgtgcctgatattcatggtgtagaggcaccagctcgtgaaggagctatgagtgctcaattgggctatcctgtcgtgggctggcacatcgcaaacaaaaaaccccctctgcctaagcgtgtgagaaggcagattcatgccactcccactcccgtgactgctattggcccgcctaccacagcgatccaggagcctccatctcgcatcgtgccaactccaacgtcacccgccattgctcccccaaccgagacaatggcccctcctgtgagagacccggtgcctgggaaaccaactgtgactattaggaccaggggcgctatcatccagacccctacactgggacctattcaacccaccagggtttctgaggcgggcaccacggtgcctgggcaaattaggccgaccatgactattcccggatacgtggagccgacggccgtggctacacctccgaccacaactactaaaaaaccacgagtaagtactccaaaacccgctacccctagcactgattccaccacgactaccacaaggcgccctacaaagaagccccggacacccaggccagtgccacgggttacaaccaaagttagcattacaagactcgagactgcctcgcctccgacgcgcatccggacaacgaccagcggggttcccagaggtggggagccaaatcagagaccggaattgaagaaccatattgaccgcgtggatgcatgggtgggaacgtattttgaggtgaagataccttctgataccttctacgaccacgaggatactacaactgacaagctaaaactgaccctgaagttacgcgagcagcaacttgttggggagaagtcttgggtacaattcaattcaaattctcagctgatgtatggcctgcccgatagttcgcacgtgggcaaacacgagtactttatgcatgctactgacaaggggggcctcagcgccgtcgacgcattcgagatccacgtccatcggcgaccgcagggtgatcgcgcgcctgctaggttcaaagccaaattcgtcggtgacccagcccttgtattgaacgatatccacaagaagatcgcattagtgaaaaaactggcctttgcattcggggatcggaattgcagcacaataaccctgcaaaatatcacccggggctctatcgttgtggagtggacaaataatacccttccacttgaaccatgcccgaaagaacagatcgccggtcttagtcgcaggatagcagaggatgatggtaaaccccgccccgcttttagcaacgccttggaacctgacttcaaggccacgagcatcactgtgaccggatcagggtcatgtaggcatcttcagttcatccctgtggtgcccccacggcgcgtacctagtgaggctcccccaactgaagtgccagatcgggaccctgaaaagtcatctgaggatgacgtatatttgcacaccgttatcccagcagtagtggtggccgctatattgcttatagctggcattatcgctatgatctgctacaggaaaaagcgcaagggtaaactgactttggaagatcaggcgacatttattaagaaaggagtgcccatcatatttgcagatgagctcgacgattcaaagccaccccctagctcaagcatgccactaatcctccaggaggagaaggccccactgcctccccctgaatatccaaaccagtcagtccctgaaactacacctctgaatcaggacacaatgggtgaatacaccccactgcgagacgaggatccgaatgcccccccatatcagcccccccctccattcactgctccaatggagggcaagggcagccggcccaagaatatgacaccctatagatcaccacctccttacgtgccgccatag

SEQ ID NO: 186171 - DNA, 2688 bp, Artificial Sequence
  Description of Artificial Sequence: Synthetic coding sequence
atgcggatgagcgtgggcctgagcctgctgctgcccctgagcggcaggactttcttgctgttgctatcagtggtgatggcacaatcccattggccatctgaacccagcgaggctgttcgcgactgggagaatcaactggaggcctccatgcatagcgtactcagtgatcttcacgaggctgtaccgacagtggtgggcattcctgatgggacggcagttgtgggaagatccttcagagtgactatccccacagacctgattgcctcaagcggcgacatcataaaagtctcagcagcaggtaaggaagccctgccgtcttggctgcattgggattcacagagccacaccctggaaggacttccactggatactgataaaggtgtacactacattagcgtgtccgccacgagacttggcgcgaacggctcccacataccacagacctcttccgtgttctccattgaagtgtaccccgaagaccatagtgaactccagagcgtccggacagcatctccagatcccggggaagtcgtgtcatctgcatgcgccgccgatgaacccgtgaccgtgcttacagtgattcttgacgctgacctcacgaaaatgacacccaagcagcggatagacctgcttcataggatgcgctccttttctgaggtggagttgcataacatgaaactagttccggtagtcaacaatcggctgttcgatatgtcagcttttatggctggacctggaaacgccaaaaaagtggtcgagaatggggccctcttgagctggaagttaggctgcagccttaatcagaactcggtaccagacattcacggggtcgaggccccagcccgcgagggagctatgtctgcccagctaggttatcctgtcgtgggatggcacattgcgaataaaaaaccacccttaccaaagcgggttcggcgacagattcatgccacacccacacccgtgaccgctataggccctccgactactgctatccaggagcccccgtcaaggatcgtgccaaccccgacttctccagcgatcgcacctcctacggaaactatggcacctcctgtgcgtgatccagtccccgggaaacccaccgtgaccatcaggactcggggggctatcatccagacccctactttgggacctatccagcctacaagagtgtcagaagccggaacaacggttccaggtcagatacgtccaaccatgacaatccctggttatgtcgagcctacagctgtggcaacaccgcccacaactacaactaagaaacccagagtgtcaactcctaaacccgccacacccagcactgattccacaaccacaactactaggaggccaaccaaaaaaccacggacaccacggccggttcccagagtgacaaccaaggtgtccataaccagactggagactgcaagccctcccactaggatccggacaacgacaagtggagtgcctcgaggaggcgagcccaatcaacgacctgagttaaagaaccatattgatagagtggacgcttgggtcggtacatatttcgaggttaagatccctagcgacactttttacgaccacgaagacacgacaactgacaagcttaaacttacactcaaactgcgagagcagcagttagtgggagagaaaagttgggtacagtttaactcaaatagccagttaatgtatggactccccgactcaagccacgtaggcaagcatgagtactttatgcatgcgacagataaagggggactttccgcggtggatgccttcgagatccacgtccataggcgccctcaaggcgaccgggctcccgctaggtttaaagctaagttcgttggggatccagcactggttcttaacgacatccacaaaaagatcgcactggtcaaaaagctcgcatttgcttttggcgaccggaattgcagcacaatcaccttgcagaacattacacgcggatctatagtggtcgaatggaccaacaacacattaccgctggaaccatgtccaaaggaacagatcgcaggactctcccgtagaatagcagaggatgatggaaaacctcgcccagcattctcaaatgctttggagccagatttcaaggcaacgagcattactgtgaccgggagcggctcctgtcgtcatcttcagtttattccagtggtgccaccacgtagagtgccatctgaggctccacccacggaagtgcccgatcgagatccagagaagagctcggaggatgacgtgtacctgcatacggtgatccctgcggtggtggtggccgccatcctactcattgctggcataatcgccatgatatgttatcgcaagaagcgaaagggtaagctgacactggaggaccaggccacttttatcaaaaagggcgtcccaataatttttgccgacgagctcgacgatagcaagccacccccctcctctagcatgccactgatacttcaggaggagaaagcacccttgccccctcccgagtaccccaatcagagtgtgcctgagaccacccccttaaatcaggataccatgggtgagtatacaccactgcgggatgaggatcctaacgctcctccgtatcagcctcccccgccattcaccgccccgatggaagggaaagggtccaggccaaaaaacatgactccctaccgcagtccacctccctatgtgcctccatag

SEQ ID NO: 186172 - DNA, 2025 bp, Artificial Sequence
  Description of Artificial Sequence: Synthetic coding sequence
atggccgccggcggcgccgagggcggcagcggccccggcgccgccatgggcgattgtgccgagatcaaaagccaatttcggactcgggagggcttctacaaactgctccctggggacggagccgcaagaaggtctgggcctgcctccgctcagaccccagtcccaccacagcccccgcagcctccccctggcccagcgtctgcttccgggccaggcgctgctggacccgcctcttcgcctcccccggcggggccaggcccaggacctgcacttccagctgtcagactgtccctggttcggcttggcgagcctgactctgccggagccggggagccgcccgctacccccgcaggcctcggctcagggggcgaccgggtctgctttaacctgggccgcgagctctatttttatccgggctgctgccgaagaggctcccagaggtctatcgacctgaacaaaccaatcgataaaagaatctacaaaggaacgcagccgacctgtcatgacttcaaccaatttacagcagctacagaaacaatcagcctactggtcggattttcagccggacaagtgcagtatctagatctgataaaaaaggacacatcaaagctcttcaatgaggagcgcttgatagacaaaactaaagtgacctacctgaaatggctccccgagagcgaaagcctgttcctggcgtcacatgcctctggtcacctgtacctctacaatgttagccacccttgtgcgtccgcgcccccgcaatactctctcttaaagcagggggaaggattctcagtttacgcagccaaatcgaaggcaccgcgcaaccccctggccaagtgggcagtgggggaaggaccactgaatgaatttgccttttctccggacggccggcacctggcttgcgtcagtcaggacggctgccttagggtctttcactttgattccatgcttctgagagggttaatgaagtcttacttcggtggactcctgtgcgtgtgttggagccctgatggcaggtacgttgtgaccggcggggaggacgacctggtgactgtgtggagttttaccgagggcagggtggttgcacgggggcacgggcataagtcctgggtgaatgccgtggccttcgatccttacaccactagggcggaagaggccgcaaccgccgccggagcggatggcgagcggagcggcgaggaggaagaggaagagccagaagctgctggcaccggcagtgctggtggtgcgccactgagccctctccctaaagcggggagcatcacatataggttcgggtccgccggccaggatacccagttctgtctgtgggatcttacagaggatgtgctgtaccctcatccccccctcgcgcgcacacgaaccttacccggaaccccaggcaccacccctcccgcggcatcttcctcccggggaggggagccagggcctggaccactccctaggtccctctctcgctcaaacagtctgccgcaccccgctggcgggggcaaggccggaggccctggagtggcagctgaacccggaacccctttcagcattggacgattcgcaacgctcaccctccaagaacgacgcgacagaggagcggagaaggaacacaagaggtaccactccctgggaaatatatcccgcgggggaagcggagggtccggctctggcggggagaaaccctcaggacctgtaccacgatcacgcctcgaccccgcaaaggtgctcggaaccgccttatgtccacgaatacacgaggtgccactgctggaaccactagtttgcaagaagatcgcacaggagagactgaccgtgctgttatttctggaggattgtatcatcacagcctgccaggaggggttgatctgcacctgggcaagaccgggtaaggcattcactgatgaggagaccgaggcgcagacaggcgagggatcttggccaaggtcaccatccaaaagtgttgttgagggcatatcctcacagccaggcaattcaccttcaggtaccgtggtttag

SEQ ID NO: 186173 - DNA, 1890 bp, Artificial Sequence
  Description of Artificial Sequence: Synthetic coding sequence
atgagcgccgaggtgcggctgcggcggctgcagcagctggtgctggaccctgggttcctgggtttagaaccactgttggacttattgctgggcgtccaccaagagcttggagccagcgagctggcgcaggataagtatgtggccgactttctgcaatgggcagaacctatcgtcgtgcgattaaaggaagtgcgactgcagagagatgactttgagatcctgaaggtgattggaaggggcgccttctccgaggtggctgtcgtgaaaatgaaacagactggccaggtgtacgctatgaagattatgaacaaatgggatatgttgaagagaggtgaagtcagctgcttcagggaggagagggatgtgttagtgaatggggacagaaggtggattacacaactgcacttcgctttccaggacgagaattacctgtatctggtgatggaatactatgtgggtggcgacttgctcactttactgtctaagttcggagagcgaattcctgccgaaatggcacgcttctaccttgccgaaatagttatggcaatcgattctgtacaccgactgggttacgtgcatcgggacatcaaaccagacaatatcctactggatagatgtggccatataagactcgcggacttcgggagctgcttaaagctccgggctgatggcacagtgaggtctctcgtcgccgtgggtacacccgactatctgagtccagagattcttcaggctgtcggaggggggcccggcactggctcttacggccccgaatgcgattggtgggctctgggtgtgttcgcgtatgagatgttttatggccaaactcctttttacgctgactcaaccgccgagacgtacggtaagattgtgcattacaaggagcacctatcattgcctttagttgatgagggggtcccggaggaagccagagattttatccaacgactgctgtgtcccccagagacccgactggggcggggaggagcaggcgatttccggacacaccctttcttctttggacttgactgggacggcctgagagacagtgttccaccctttacccccgacttcgaaggcgccaccgatacatgtaacttcgatctggtggaggatggactgactgctatggtgtccggcggaggagagaccctgtcagatatccgcgagggcgcacctcttggcgtgcatctcccttttgtggggtactcgtactcttgtatggctctcagagattctgaggtacccggacctactcctatggagctcgaggcagagcaactccttgaaccacacgtgcaggcaccctctctggaaccttcagtgagcccacaggatgaaacagcagaagttgctgtcccggccgccgtcccagccgccgaggcagaggctgaagttacccttcgggagctgcaggaggctctggaagaagaggtcctcacccggcaatccctctctcgggaaatggaagccatcaggactgataatcaaaattttgcttctcaactgcgggaggccgaagctcgtaaccgtgatctggaggcccatgtgcgccagctacaagagcggatggagttattgcaggcggagggagcaaccgctgtaaccggcgtgccgtcaccccgagcaaccgacccacctagtcatttggacggccccccagctgtggctgtgggtcagtgccccctggtaggtcccggcccgatgcaccgccgccatctgcttctgccagccagagttccacgacctggactgtctgaggccctgtctcttctccttttcgccgtggttcttagcagagccgcagctctaggctgtatcggacttgttgcccacgcagggcagctgactgccgtgtggcgtaggcccggagctgctcgagcgccatag

SEQ ID NO: 186174 - DNA, 1968 bp, Artificial Sequence
  Description of Artificial Sequence: Synthetic coding sequence
atggtgctgcccgtgcagcacgtgagccggggcgccgccgaggccgcccctgcggccggtgttggtcctggactgcctggagctggtgcccctgcccgaccctcccctggacgccctcctggagccggtcgccttagaacaggtccggggcaggtgcgcggtcggcttctcgcagtcggccccaaatcaagagtgtttcaaagtgtggtacaagagccacctgccagcgaatcaagagccgagcccatcgtagtccggctgaaggaagtcaggctgcagcgggacgatttcgagattttgaaagtgatcggaagaggtgcatttagcgaggtggccgtggtaaaaatgaaacagacagggcaagtatacgctatgaaaatcatgaataagtgggatatgttgaaacgcggcgaagtgtcatgttttcgcgaagaaagggacgtccttgttaatggagataggcggtggatcacccaactccactttgcctttcaggacgagaattacctgtatctggtcatggagtactatgtgggcggtgacctcctcaccctgctaagcaaattcggcgagagaatacccgcggaaatggcccgcttctatctcgccgagattgtcatggccatcgattccgtgcataggttggggtacgttcaccgggatattaaaccagacaatattctgctcgaccgctgtgggcatattcggctggcagacttcggctcttgtctgaagttgagagccgacggcaccgtgcgttcactggtggccgtgggaacgccagattatttgtctccagagatattacaggccgtcggcggcggcccaggcactggctcctacggccctgagtgcgactggtgggcattgggggtgttcgcctatgaaatgttttatggccagacgccattttacgctgattccaccgccgaaacctacgggaaaatcgtgcactataaagaacatcttagcttaccactggtggacgagggagtccccgaagaggctcgcgatttcatccagcgcctcctgtgcccccctgaaactcgtctcggacgtggaggcgccggtgactttcgaacacacccctttttttttgggttagattgggacgggttacgggattctgtgccaccattcactccagatttcgaaggagctaccgacacttgcaatttcgatctggtggaggacgggctcaccgcaatggtgagcggcgggggtgagaccctatcagatatccgggagggtgcccctctgggagtccaccttccctttgttggctatagctacagttgcatggccctgcgcgactctgaggttccgggtcctactcccatggaactggaggcagaacagctgctggagccgcatgtgcaggcaccttccctggagccctccgtttcaccgcaggatgaaacagccgaggtggcagtccccgcggctgtgccggcagcagaggctgaggcagaggtaacactgcgtgagctccaagaagccctcgaagaggaggtcctgacgaggcagagcttaagtagagaaatggaggctatacggacggataatcaaaattttgcatcgcaactgcgcgaggcggaggcaagaaatagggatctggaggcacatgtgaggcagttacaggagcgaatggaactgctgcaggctgagggcgcaacggcagtgacgggggtccctagtccccgggcaactgaccccccgtcacaccttgatggtccccccgccgtcgctgtggggcagtgtcccctggtcggtcctgggcctatgcaccgccgacatctattactacccgctagagtccctaggcccggactgtccgaagcactgagcctgcttttattcgcggtagtcctgtctcgcgctgccgctctgggctgtataggtctggtggcccacgcagggcagctcaccgcagtgtggcggcgaccaggggccgcccgagccccttag

SEQ ID NO: 186175 - DNA, 1920 bp, Artificial Sequence
  Description of Artificial Sequence: Synthetic coding sequence
atgggcggccacttctggccccccgagccctacaccgtgttcatgtgggggagcccgtgggaagccgattctcctcgcgttaagttgagaggacgggagaaggggagacagacagagggcggtgcctttcctttggtgtcctctgctctgtccggggacccaaggtttttcagcccaaccaccccccccgccgaaccgatcgtggttaggctcaaagaggtgcgacttcagagggacgattttgaaatcctcaaggtaatcggccggggagccttcagcgaggtggcggttgtgaaaatgaagcaaacgggacaggtctacgccatgaaaattatgaataaatgggacatgctgaaaagaggggaggtcagctgcttcagagaagagcgcgatgtcctagttaatggagacaggaggtggattactcaactgcacttcgcttttcaggacgaaaactatctttatctggtgatggaatattacgttggaggggatctgctgacactgcttagcaaattcggggagagaatcccggccgaaatggctaggttttacctggctgaaatcgtcatggccatcgactcggttcatcgcctcgggtatgtgcatagagatatcaagccagacaacatcctgctcgaccgctgcggacatattcgtctcgccgatttcggttcatgtctcaagttgcgcgccgatggaactgttcggagtctagtggctgtgggcaccccagattacctttctccggagattcttcaggctgtggggggaggaccaggaacaggctcctatggccctgagtgtgactggtgggccctgggggtatttgcgtacgagatgttctacggccaaacccctttttatgcggacagcacggcagagacctacgggaagatagtgcattacaaggaacacctcagtcttccacttgtagacgaaggcgtgcccgaggaggcccgcgacttcatacagagactcctgtgtccgcccgaaactcgcctcgggaggggtggcgcgggcgatttccgcacccatccatttttcttcgggctggattgggacggcctgagagactcagtccctcctttcacccctgattttgaaggtgcaactgatacttgcaactttgatctggttgaggatggacttaccgctatggtgagtggcggaggtgagacactcagtgatattcgcgagggtgcaccattgggagtacatctacctttcgtgggatattcctacagttgcatggccctgagagacagtgaagtgcccggacccacacccatggaactggaagctgagcagctgctcgagccacacgtgcaggctccatcactcgagccttcggtgtcaccccaggacgaaacagccgaagtggcggtccccgctgccgttccagctgcagaggctgaggccgaggtcacattgcgagagctgcaagaggcactcgaagaggaggtgctgacaagacaatccctgagtcgagagatggaggcaataaggaccgataatcagaactttgcctcacaattacgcgaggctgaggcacggaaccgcgatctggaagctcatgttaggcagttacaggagagaatggaattgttacaggccgaaggcgccacagccgttactggcgtgccatccccgagggccaccgaccctccctctcacctggacggtccccccgctgttgctgtgggccaatgtccacttgtgggccccgggcctatgcataggagacacctcttactgcctgcccgggttccaagacctgggttgagtgaagccctctccttgctgcttttcgccgtcgtcctatccagggcggccgccctgggctgcatcgggctggtggcccatgcaggccagctcaccgcagtgtggaggaggccaggggcggctagagctccttag

SEQ ID NO: 186176 - DNA, 1830 bp, Artificial Sequence
  Description of Artificial Sequence: Synthetic coding sequence
atgggcggccacttctggccccccgagccctacaccgtgttcatgtggggctcaccttgggaggcagactcgcccagagtcaagctgagaggtagagagaagggccggcagactgaggggggagcttttcctctcgtcagctcagctcttagcggggatccaaggtttttttcgccaactacccctcctgccgaacccatcgtcgtaaggctgaaagaggttaggctgcagagagacgatttcgagattctgaaggtgattggtagaggggcttttagcgaggtcgctgttgtcaagatgaaacagacaggccaggtgtacgcaatgaaaataatgaataaatgggatatgctgaagcgcggagaggtgagctgttttagagaggagcgggacgtcttggttaacggggaccgccggtggatcacacagttgcacttcgcttttcaggatgaaaactacctgtacctggtgatggagtattacgtgggcggcgatctgctgacactgctgtctaaattcggtgaacgtatccctgccgagatggctaggttttacctggctgagatcgtcatggctattgatagtgttcacaggctaggctatgtgcatcgggacatcaagccagacaacatcctgcttgatcggtgcgggcatataagactggccgattttgggtcctgcctaaagctgcgagccgacgggacagtcagatcactggtggccgtcgggactccagactacctgtcgcctgagattctgcaagccgtgggagggggcccaggaaccggatcttacgggccagagtgtgattggtgggccttgggcgtcttcgcctacgagatgttctacggtcaaacacctttctacgcagattctactgccgaaacctatggtaaaattgttcactataaggagcatctaagtctgcctttagtcgatgaaggagttccagaggaggccagagacttcatccagaggctgctgtgcccacccgaaacccgcctcgggaggggaggggctggggacttccgtacacacccctttttctttgggctcgactgggacggtctgcgcgatagtgtaccacccttcactccggacttcgaaggcgcgacagacacctgtaactttgaccttgtggaagatgggctgactgcgatggtcagtggcgggggggagacactgtctgacatcagagaaggcgctccactcggcgtgcacctgccatttgtgggctatagctactcatgtatggctttgcgcgatagcgaggtccccggaccaacaccaatggaacttgaggcagaacagctcctggaaccgcacgtgcaggcccccagcttggagccctccgtaagcccccaggacgagaccgcagaggttgcagttccagcggcagtgcccgctgcggaggctgaggccgaggtcaccctaagggaattacaggaggctcttgaagaagaagtacttacacgccagtcattgagccgggaaatggaagccatcaggactgacaaccagaactttgcctcccagctgcgagaagccgaagccagaaatcgcgaccttgaggcccacgtcaggcagctgcaggaaagaatggaacttctccaggccgaaggtgccaccgcagtaacgggagtaccaagccccagggccaccgatcctccttcacacgtgccgcgaccagggctcagcgaagctctgtcactcctgctgttcgctgtagttctgagcagggccgcagcattaggctgcattggcctcgtagcccatgcaggacagctcacggccgtgtggagacgccccggggccgcccgggccccttag

SEQ ID NO: 186177 - DNA, 1593 bp, Artificial Sequence
  Description of Artificial Sequence: Synthetic coding sequence
atgagcgccgaggtgcggctgcggcggctgcagcagctggtgctggacccaggcttccttgggttggaacccctcctggacctcttgctcggggtgcaccaggagttgggggctagtgaactcgcacaagataagtacgttgctgatttcctgcagtgggcagagcctatcgtggtcagactcaaggaggtgcggctgcaaagagatgatttcgagatcctgaaggtgatcggacgtggggcttttagtgaggtggccgtggtaaaaatgaagcaaaccgggcaagtctacgccatgaagattatgaataaatgggacatgctgaagcggggggaggtgagttgctttcgggaagagcgagacgtcttggtgaacggggacaggcggtggatcacccagctgcactttgcctttcaggacgaaaattatctgtacttggtgatggagtactacgtggggggagacctgttgaccctactgtcaaaattcggggagaggatcccggccgaaatggcccgcttctatttggcggaaatcgtgatggccatcgattctgtccatcgcttaggctacgtgcaccgagacatcaagcccgacaacatcttgctggataggtgcggacacatccggcttgcagactttgggagttgtctgaaacttcgagcggacggcaccgtgcgatccctggtggcagttggcacccctgactatctctccccggagattttacaagctgtcggcggtgggcctggaacaggcagttatggtcctgagtgtgactggtgggcactgggcgtgtttgcatatgaaatgttttatggccagacccccttttacgccgatagtacggcggagacctacggcaagattgtgcactacaaagaacacctgtctcttcccttagttgacgagggggtcccagaagaagctcgcgactttattcagaggttactctgccccccagaaacacggttgggcaggggaggagccggcgacttcaggacccatccattcttctttgggttggactgggacggtcttagggattccgtcccaccttttactcccgactttgagggtgctaccgatacatgcaattttgatctcgtggaggatggactgaccgcaatggagaccctgagtgacatcagggaaggggcgccactgggcgtgcatttaccattcgttggatacagttattcttgtatggcgctgagagattcggaggtccctgggccgactcctatggagctggaagctgagcagttgctggagccccatgtccaggctccctcccttgaaccaagcgtgtccccacaggacgaaacagcagaagtggccgtgccagcagcagtgcccgcagccgaggcggaagcggaggtcacactaagggaactgcaggaggctttggaagaagaagttctaaccagacagtccctatctagagaaatggaagcgattagaaccgataaccagaatttcgcatctcagctacgagaggcggaagccagaaaccgggatctggaagcccatgttcgccagttacaagaacgcatggaattactgcaggcggaaggggcaacaggcccttag

SEQ ID NO: 186178 - DNA, 1866 bp, Artificial Sequence
  Description of Artificial Sequence: Synthetic coding sequence
atgagcgccgaggtgcggctgcggcggctgcagcagctggtgctggacccaggctttctgggactggagccgctcctggatttgcttctcggcgtacatcaggaactaggtgcttctgaattggcccaggataagtatgtggcagacttcctccagtgggccgagccgatagtagtgcgcctgaaagaggttcgcctgcagcgggatgacttcgaaattctcaaggtgataggtcgtggggcattttccgaggtggcagtagttaaaatgaagcagactggacaggtgtatgccatgaaaattatgaataagtgggatatgctgaagcgtggcgaagtgtcttgtttccgcgaggagcgcgatgtgcttgtgaatggggaccgacggtggattactcagctgcactttgctttccaggatgagaattatctgtatctcgtgatggagtactacgtggggggggatcttctgaccctgcttagtaaatttggggaacgtatacccgccgagatggctagattctatctagcagaaatagtaatggcaatagactctgtccatcgcctcggctatgtgcaccgagacattaagccggacaatattctgttggacaggtgtgggcatattcgcttggcagactttggcagttgcctcaaactgagagcagacggtacagtgaggtcattagttgccgtcggaacccctgattatctttctcccgagatcctgcaggcagttggcggtggtccgggaacagggtcctatggccctgagtgcgactggtgggctttgggcgtattcgcatatgaaatgttctacgggcagaccccattctatgctgacagtactgccgaaacatatggcaaaatagtgcattacaaagagcatctttccctgccattggtagacgagggcgtgcccgaagaggcccgagacttcatccagcggctgttgtgcccccccgaaaccaggctcggtagagggggggctggagatttcagaactcatccgttcttcttcggcctggactgggacgggctgcgcgactctgtgccaccattcaccccagattttgaaggcgctactgatacgtgtaacttcgatcttgtggaagatgggctaacagccatggagacattatcggacatcagggaaggcgctcctttgggtgtgcacctgccttttgttgggtattcctacagctgtatggccctgcgcgactctgaggtccccgggcccacccccatggagctagaggccgaacaattgctggagccgcacgtccaggccccaagtctggaaccgtccgtttctccacaagatgagacagccgaggtagccgtgcctgccgccgtgccagctgctgaggcggaggctgaagtcactctccgtgaattgcaagaggcgttggaggaggaagttttgaccaggcagtcactgagtcgcgagatggaggccattaggacggacaaccaaaacttcgcctctcagctgagagaagccgaagctcggaatcgagatctggaggcccacgtgagacagttacaggaaagaatggagctgctccaggctgagggggcaactgcagtgacaggcgtgccctcccctcgcgctacggacccccccagccatttggatggacccccgtggctgtgggccagtgcacggtggtggggtcaaatgcacagaagacatctgctgctccctgcccgggtgcccagacctggtctgtccgaagccttgtcactgctcctatttgccgtggttctaagtagagcagccgctctgggctgtattgggctcgtggcccatgcaggacagctcacagctgtgtggaggagacctggagccgcgagggccccctag

SEQ ID NO: 186179 - DNA, 1875 bp, Artificial Sequence
  Description of Artificial Sequence: Synthetic coding sequence
atgagcgccgaggtgcggctgcggcggctgcagcagctggtgctggatcccggcttcctcggcttagaacccctgctcgatcttcttctgggcgtacaccaggagcttggagcgagtgagttggcccaggataagtacgttgccgactttttacaatgggccgagccaatcgtggttcgcttaaaggaagtcaggctccagcgggacgactttgaaattttgaaggtcattggcagaggtgctttctccgaagtggcggtggtgaagatgaaacagaccgggcaagtgtatgccatgaagatcatgaataaatgggatatgctgaaaagaggagaggtatcttgcttccgagaggagagagacgtgcttgtgaacggggacaggcggtggatcacccaactccattttgcattccaagatgagaattacctctacctggtgatggagtactatgtcggcggcgacttgcttacactgttgagcaagtttggtgagcgaatccccgccgaaatggcaagattctatctggccgagattgttatggcgatcgatagcgtgcacaggctaggttacgtgcatagggatatcaaacctgataacatcttgcttgatcggtgcggccacatcagactggcggatttcggctcttgcctcaagctgagggccgacggtaccgttcgctctctcgtggccgtcggcacccctgattacctgtcccctgagattcttcaggcagtgggcggaggccctgggactggatcttatgggccagagtgcgactggtgggcattgggcgtctttgcttatgaaatgttctatggccagacccctttctatgcagacagtaccgcagagacctacggcaagattgtgcactataaggagcatctctccttgcctcttgttgacgagggcgtaccagaggaagcccgggactttattcagcgcctgctgtgcccacctgagacaagactgggtcgtggtggagccggcgattttcgaacacatccattcttcttcgggcttgactgggacgggcttcgggactcggtccctccgttcacccctgattttgaaggggcaaccgatacctgcaactttgacctggtagaggacggtttgactgctatggagacactatcagacattagagaaggcgccccactgggggttcatttacccttcgtgggttattcttacagctgcatggctctgcgtgatagtgaagtccctggccctactcccatggagctcgaggcggaacagctgttggagcctcatgtgcaggcacctagcctcgaaccatcagtctcgccgcaggatgagaccgcagaagtggctgttccagccgcagtgcctgctgccgaggcggaggccgaggtaactctgcgggagttacaagaggcgcttgaagaggaggtcttgactagacagtccctgtcacgtgagatggaagcgatccggactgacaatcagaactttgcctctcaattgagagaggccgaggctcgcaatcgcgatctggaagcgcacgttagacagctgcaagagcgcatggagctgttacaggccgagggtgcaacggccgtcacgggtgtgccgagccctagggctaccgatccgccatctcacttggacggccctccagctgtggccgtcggtcagtgcccactcgtcggaccgggtcccatgcacaggagacacctgttactccccgcccgtgtgcccaggccaggattatcagaggctctatcccttctattatttgccgtcgtgctctcccgcgccgccgccttaggctgcataggactcgtggcacacgccggccagttgacagctgtttggcgccgacctggcgcagcccgcgccccgtag

SEQ ID NO: 186180 - DNA, 1878 bp, Artificial Sequence
  Description of Artificial Sequence: Synthetic coding sequence
atgagcgccgaggtgcggctgcggcggctgcagcagctggtgctggaccccggatttcttggccttgaacccctactagatttgcttctaggcgttcatcaggaattgggcgcatccgaactggcacaggacaagtacgtagccgatttcctccagtgggcagagcccatcgtcgtccgcctgaaagaggtgcgcctgcagagagacgatttcgaaatcctgaaagtgattggcagaggtgccttttctgaagtggctgtggtcaagatgaagcagaccgggcaggtctatgccatgaaaatcatgaataagtgggatatgcttaagagaggagaagtctcgtgtttcagggaagagcgcgatgtgctggtcaacggcgacaggagatggatcacgcagctgcacttcgccttccaagacgagaattacttatacctcgtgatggaatattacgtcggcggggacctcctcacattattaagcaagtttggtgagcgcatcccagctgaaatggcacgattctatcttgctgaaatcgtcatggccatcgatagcgtccaccgccttggttacgtacaccgggacattaagcccgataatattttgttggaccggtgtggacacataaggcttgccgatttcggctcctgtttgaagctgcgtgcggacggcacagtgaggtcactcgtggctgtgggcactcccgactatctgtctcccgagattctgcaggccgttggcggaggacccgggaccggctcatacggaccggagtgcgactggtgggcccttggcgtgtttgcttatgagatgttctacggacaaacaccattttatgcagattccacagcagagacttacggcaagatcgtccactataaggaacacctcagtctgccgctggtggacgagggggtccctgaagaggcccgggatttcattcaaaggctgctttgtcctcctgagacccgactgggccgtggcggggccggagactttcggacacatccattcttttttgggctcgactgggatggactgcgtgactccgtgccaccatttacgcctgatttcgaaggtgccaccgacacctgcaattttgatttggtggaagatggccttaccgcaatggaaacgctgtcagacatcagggagggagcccccctgggagtgcatcttccctttgtgggctattcctacagctgtatggctctgcgtgactctgaggtcccagggcctacacctatggagcttgaggcagagcagcttttagagcctcacgttcaggctcccagcttagagccatccgtttcgcctcaagatgagaccgccgaagtggccgtgcccgccgcagtgcccgctgcagaggccgaggcagaggtgactctaagagaattacaggaagcactggaagaagaggtgttgactagacagtcactttccagggagatggaggcaatccgtactgataatcagaatttcgcctctcagctgagggaggccgaagcccgcaatagggatcttgaggcacacgtacggcagctgcaggagagaatggagctgctgcaggctgaaggggcaactgctgtgaccggcgtgccaagtccgcgtgctactgaccctccctcacacatggctccacgcccatggctctgggccagtgcacgttggtggggccaagcaccttgcactgctgccacctgctgctcgttgcccggctctctggggcttgcctataggaggaggttcccctgctcatgttcacccttgttttgtctcgtccctcctccctgggcggccctgggatggtggccgactcctgctaacagccctcagagcggtgccgctcaggaaccacctgcattgcccgaaccatag

SEQ ID NO: 186181 - DNA, 129 bp, Artificial Sequence
  Description of Artificial Sequence: Synthetic coding sequence
atggagctgctgcaggccgagggcgccaccgcccggtggccccccggccggggctgcggtccagtacccgctggaggagcccgaccccacgctccccctccgcccgcagccccttgtcagggtccatag

SEQ ID NO: 186182 - DNA, 3402 bp, Artificial Sequence
  Description of Artificial Sequence: Synthetic coding sequence
atgcccagcagcctgatgctggaggtgcccgccctggccgacttcaacagggcatggactgaattaacggactggctgagcctcctcgatcaggtcatcaagtcccaacgagtaatggtgggagacttggaagatatcaatgagatgattataaagcagaaggctactatgcaggacctcgaacagcgccggcctcaactcgaagaactgataaccgcggcgcaaaatctcaagaacaagactagtaatcaggaagcaagaactattattaccgaccgtatagaacgaatccagaatcagtgggacgaggtgcaagagcacctgcaaaaccgcaggcaacagctcaacgagatgttgaaggactcgactcaatggctggaagcaaaggaggaggcggaacaagtactcggccaggcacgggcgaaactggagtcctggaaggagggtccctacacggtggacgcaatccagaaaaagatcaccgaaacaaagcaacttgctaaggatcttcgccagtggcagactaatgtagacgtggcgaatgacctcgctctaaagctgctgcgagattattcagccgacgatactcgcaaagtccatatgattaccgaaaacattaatgcctcttggaggtcaatacataaacgcgttagcgagagggaggctgccctcgaggaaactcatcgattgctgcagcagtttcctttggacctggagaagttcctggcttggctgaccgaagctgaaaccaccgcaaacgtgctccaggatgccaccagaaaggaacgtctgcttgaagacagcaagggtgtgaaggagctcatgaagcaatggcaggatctccagggagagattgaagctcacactgacgtataccataatttggatgagaactcccagaagatactccgctcccttgaaggctcagacgatgccgttcttctgcaaaggcgcctggacaatatgaactttaagtggtcagaactcagaaaaaagtctttgaacatccggagccacctggaagccagttcagaccagtggaaacggctgcatctctcattgcaagagctgttggtttggcttcagctgaaggatgatgaactgtcacggcaggcccctatcggcggagattttccggccgtgcagaagcagaacgacgtgcacagagccttcaaacgagagctaaagacaaaggagccagtgattatgtccacgctggagacggttagaatctttctgacagagcagcctttggagggcctcgagaagctgtatcaggagcctagagaacttcctcccgaagagagagcgcaaaatgtaactcggcttctgcggaaacaggcggaggaggtaaataccgagtgggaaaagctgaatctgcatagcgcggattggcagcgaaaaatcgacgaaaccttggagcgattaagagaactacaggaggccaccgacgaactggatttgaaactcaggcaggccgaagtcatcaagggatcctggcagcccgtaggagatctgctcatagattcgctacaagatcacctggagaaggttaaagctctgcgaggagagattgcgccacttaaagagaacgtgtctcatgttaacgacttggcacgacagctgacgaccttgggaatccaactatccccctacaatctgtctacactggaagatctcaacaccaggtggaaactgctccaggttgctgtggaagaccgggtgcggcagctgcatgaggcccatagagactttgggcctgcaagtcagcacttcctgtcaacttcggtccagggcccgtgggagagggctattagccccaataaagttccttactatatcaatcatgagacccagacaacttgctgggaccatcctaagatgaccgagctataccagagcctggccgaccttaacaatgtgagattttcagcttaccggacagcgatgaagctgagaagactccagaaagcgctttgtcttgatcttctcagcttgagcgccgcatgcgacgcacttgaccagcacaatttgaagcagaacgatcaaccaatggacatactgcagattattaactgcttaactaccatttacgatcgcttggaacaggaacataataacctggtcaatgtgccactctgtgtcgacatgtgccttaactggctgctgaatgtgtacgacacggggcgcaccggccggatccgcgtgctgagcttcaaaacaggaatcatttcactgtgtaaggctcacctggaggacaaatacaggtacttgtttaaacaggtagcgtcatctaccggattctgcgaccagcgacggctgggtttgctactccatgacagcattcaaatcccccggcagctgggcgaagtggctagttttggaggaagcaacattgagccctccgtgcggtcgtgtttccagttcgcgaataacaaacccgaaatcgaggccgccttgtttctcgactggatgaggttggagccacagagtatggtgtggctacccgtgctgcaccgcgtcgctgcggcagagacagccaaacatcaagctaagtgcaacatctgtaaagagtgccctattatcggatttcggtatcgaagtctcaagcattttaactatgatatttgccagtcctgtttcttcagtgggagagtggctaagggacacaagatgcactatccgatggtggaatactgcacgcctacgaccagcggggaggacgtgcgcgactttgcgaaggtgcttaaaaacaagttcagaaccaagcggtattttgccaaacacccgagaatgggatacttacccgtccagacggttctggagggggacaatatggagaccaacctccaggcggagtacgacagattaaaacaacagcatgaacataagggtctgtctcccttaccttcaccaccggaaatgatgccgaccagtcctcagagtccccgggacgctgaactcatagccgaagcaaaattgctcaggcagcacaaaggccggctggaggcgcggatgcaaattttagaagaccataacaagcaactggaaagtcagttgcatagactcagacaactcctcgaacagccgcaagcagaagcaaaagtgaatggtaccactgtatcgagtccatcaacaagcctgcaacgaagcgacagcagccaaccgatgctgctgcgcgtggtcggcagccaaacttcagactctatgggagaggaggatctcctgagcccccctcaagatactagtacgggacttgaggaagttatggagcagctgaacaattcattcccaagctcccgcggccacaacgtgggcagcctgtttcatatggctgatgatctcggcagggctatggagtcacttgtctcggttatgactgacgaggaaggagccgaatag

SEQ ID NO: 186183 - DNA, 11058 bp, Artificial Sequence
  Description of Artificial Sequence: Synthetic coding sequence
atgctgtggtgggaggaggtggaggactgctacgagcgggaggacgtgcaaaaaaagacatttactaaatgggttaacgcacagttttctaagttcgggaagcagcatatagagaatctcttctcagatctacaagatggccgccggctgctagacttgctcgaggggttaaccggacagaagctcccgaaggagaaggggtcaacaagagtgcatgccctgaataacgtgaataaagccctcagggtcctccagaacaataacgtcgacctggttaacatcggttcaacggacattgtggacggtaatcacaagctgacactgggtcttatttggaatatcattctccactggcaggtcaagaatgtgatgaagaatatcatggcagggctgcagcagacgaatagcgagaaaattctgctgtcttgggtgaggcagtcgacaaggaactatccccaggttaacgtgatcaattttaccacaagctggtccgatggcctggccctcaacgctctgatccacagtcaccggcccgacctcttcgattggaactccgtggtgtgtcagcagagcgccactcaacgtctagaacacgctttcaacatcgccagatatcaattaggaattgaaaaactgctcgatcctgaagatgtggacaccacttatcctgataagaaatcaatcctgatgtatattacctccttattccaggttctgcctcaacaggtctctatagaagcaatccaagaggtggagatgctcccccgcccccccaaggtcacgaaagaagaacactttcaattgcatcatcagatgcattactctcaacagattacggtatcactcgcccaggggtacgagaggacctcaagtcccaagcctcggtttaagagctacgcctatacacaggctgcgtacgtcaccacctccgatccgacacgctcccccttcccatcgcaacacctggaggcacccgaggataaatcctttggcagctccctgatggagtccgaggtgaacctggaccggtaccagacagcactggaggaagtgttgagttggctgctgagtgccgaagatactctgcaggctcagggagagatctccaatgatgtggaagtcgtgaaggatcagtttcacactcacgaggggtacatgatggacctaacggcgcatcaagggcgagttgggaatattctccagctggggtctaagttgatcgggactgggaaattatccgaggacgaggagaccgaggtccaggaacagatgaacctgctaaactctcgctgggaatgcttaagggttgcatccatggagaagcagtctaatttgcatagggtactgatggatctgcaaaatcaaaagctgaaagaactgaacgactggctcaccaagaccgaagaaagaacaagaaaaatggaggaggagcctctgggtcctgatctggaagatctgaaaagacaggtacaacagcataaagttctccaggaggatctggaacaggaacaggtgagggtaaactctctgacacacatggtcgtggtggtggacgagtcgtccggcgaccacgcaactgctgccctggaggagcagttgaaggtgctgggagatagatgggctaatatatgccggtggaccgaggatagatgggtgctgcttcaggatatactgttaaaatggcagcgtctcacagaggagcagtgtctgttttctgcctggctctcagagaaagaggatgctgtaaataagattcacaccactggtttcaaagatcagaatgaaatgctgtcatcacttcagaagttggcagtgctgaaagccgaccttgagaagaaaaagcagagtatggggaagctttattccttgaagcaggacctgttaagcactctcaaaaataagtccgttacacagaagaccgaggcctggttggacaacttcgcacgctgctgggataacctggtgcaaaaactggagaaatctacagcacaaataagtcaggcggtcactaccactcagccgtcactcacccagactaccgtgatggagacagtgaccacagtgaccactagggaacaaatccttgtcaaacatgctcaggaggagctgcctccgcctcctccccagaaaaagcgccagatcacagtcgattccgagattcgcaaaaggcttgatgtggacatcacagaacttcacagttggataacccgctcagaagctgtcttgcagtcccctgaattcgccatcttcaggaaggagggcaattttagcgatctcaaggagaaggtgaacgctattgagagggaaaaggctgaaaagttcaggaaattgcaggacgcttcgagaagcgcccaggccctcgtcgaacagatggtcaacgagggagtgaacgccgattccatcaaacaggctagtgaacagctgaactcaaggtggatcgagttctgtcagcttctgtctgagagacttaactggctggagtaccagaacaacataatcgcattctacaaccagctccaacagctggagcagatgactactacggctgagaattggctcaagattcagcccacaacccccagcgagcccacagccattaagtcacaactcaaaatctgtaaggacgaggtcaatcggttgtcggatctccagcctcaaatagagagacttaaaattcagtccatcgcgttgaaagaaaagggacaaggtccaatgttcctggatgcagactttgtcgcattcaccaatcactttaaacaggtattcagcgacgtacaggcccgggagaaggaactgcagaccatattcgatactctgccacccatgaggtaccaggagacaatgtccgccatccgcacctgggtgcaacaatccgagacaaagctctccataccacagttgtctgttactgactacgagattatggaacaacgactcggagagctacaggccctgcagtcctccctgcaggagcagcagtcaggtctgtactacttgtcgacgacagtaaaagagatgagcaagaaagctcccagtgaaatttctcgtaaataccaaagtgagttcgaggagatcgaaggcagatggaaaaagctttcctctcagcttgtggaacattgtcaaaagctcgaggagcagatgaacaaacttaggaagatccagaaccacattcagacgcttaagaaatggatggctgaggtcgacgtgtttctcaaagaagagtggccagcgttaggggacagcgagatcctcaagaaacaattaaaacaatgcaggctgctggtgagtgatattcagacaatccaaccaagcctcaatagtgtaaacgagggggggcaaaaaattaaaaatgaagcagagcccgaattcgcctccaggcttgagactgagctcaaggagcttaacacacagtgggaccacatgtgtcaacaggtttatgctcggaaagaagctttgaaggggggcctggagaaaactgtgtcacttcagaaggatctgtcagaaatgcatgagtggatgacacaagcggaggaggagtacctcgagagagatttcgagtacaaaacccccgatgagttacagaaggccgttgaggagatgaaacgggccaaggaagaagctcagcagaaggaggctaaggtaaaactgctcacggagtccgtgaatagcgtgatcgcacaggcacctccagttgcgcaggaggccttaaagaaggaattggagactctcacgaccaactatcagtggctttgtacccgcctgaacgggaagtgtaagacgctcgaagaggtgtgggcctgctggcatgaactactcagctatctggagaaagcgaataaatggctcaacgaggtcgagttcaaactcaaaaccacggaaaacataccaggaggcgccgaggagatctccgaggtgttagacagcctggagaacctgatgcgacacagcgaagataaccccaaccagattaggatcctagcccagacgctgacagatggaggggtcatggacgagctgatcaacgaggagctggaaaccttcaatagcaggtggcgtgagctgcatgaagaggcagtgcgacgacagaagttgctcgaacagagcatccagagcgcccaggaaactgaaaaatctctgcatctgatccaagaaagcctgacattcattgataaacaacttgccgcctacatagccgacaaagtggacgccgcccaaatgccacaagaagcacaaaaaatccagtccgatcttacctctcacgaaatctccctggaggaaatgaaaaaacataatcaggggaaggaggctgcccagcgcgttctgagccaaatcgacgtcgctcagaagaaactgcaggacgtcagcatgaaattcaggctcttccagaagccagccaactttgaacagagattgcaggagtctaagatgatcctggacgaagtaaagatgcatctgcctgccctggagacaaaaagtgtagagcaggaggtcgtgcaatctcaactgaatcactgcgtcaatctctacaaatctttatccgaggttaagagcgaggttgagatggtcataaaaaccggacggcagatcgtgcagaagaagcaaactgagaacccgaaagaactcgacgaacgcgtcacggccctgaagctgcactacaatgaacttggcgctaaagtgactgaaaggaagcagcagttggagaaatgccttaagctttcacgtaaaatgagaaaggagatgaatgtgctgaccgaatggcttgcagcgaccgacatggagctgactaagcggagtgctgtcgaaggaatgccgagtaacctcgatagcgaagtggcttggggaaaagccacccagaaggagatcgagaagcagaaggtgcatctgaagtccatcactgaggtgggcgaggctttaaagactgtgctcggtaagaaggagaccctagtcgaagacaagctctccttgctgaactccaactggattgcagtgacttccagggctgaagaatggctgaatctactgctggagtaccagaagcatatggagactttcgatcagaacgtggatcacatcacaaaatggatcattcaggctgataccctgctggacgagtctgaaaaaaagaaaccccagcaaaaagaggacgtgcttaaacggctgaaggccgaacttaatgatattcgtcctaaggtggattctacacgcgaccaggcagcaaacctgatggccaataggggagaccactgtagaaaactggtggagccacagatttcagagctaaaccataggtttgcggcgatctcccatcggatcaaaacaggtaaagcctctattccactcaaagaacttgagcagtttaatagtgacatccagaagttacttgaaccactcgaggccgaaattcagcaaggcgtgaatctgaaagaggaggattttaacaaagatatgaacgaagacaatgagggaacagtcaaggagcttcttcaacgcggagataatctccagcagaggattacagatgaaagaaagagagaggagattaaaataaagcagcagcttctacagaccaagcacaatgccttaaaagacctccgaagccaacggcgaaaaaaagcactggagatctcgcaccagtggtatcagtataagcggcaggccgatgatctgctaaaatgcctcgacgacatagaaaagaaattggctagtctcccagagcctagggatgagcgcaagattaaagaaatagatcgtgaattgcagaaaaagaaagaggaactgaacgccgtgagacgccaagcggaaggcttgtctgaagatggagcagctatggcagtagaaccaactcagattcaactgagtaagagatggagagagatcgagagcaagtttgcacagttcaggaggcttaacttcgcacagatccataccgtgagggaggaaaccatgatggtcatgacagaagatatgcctctcgagatttcctatgtgccaagcacttacctcacggagattactcacgtgagtcaagccctgctcgaggtagagcaactgctaaacgccccagacttgtgcgccaaggactttgaagatctatttaaacaagaggaatcattgaagaacatcaaggattccttacaacagtctagtggtcgcattgacatcatccattcaaagaagacagctgctcttcaatcggccactccagtagaacgcgtgaaactgcaggaagctctttcccagcttgattttcagtgggaaaaggtgaataagatgtataaagacagacaaggcaggtttgaccggtctgtggagaagtggcggagattccattacgacataaagatatttaaccagtggttgacagaggcagagcagttcttgcgaaagacccaaataccagagaattgggagcatgctaaatacaagtggtacttgaaagagttacaagatggtatcgggcagcgacagactgtggtgagaacgctgaacgcgacaggggaggagattatccaacagtcaagtaaaactgatgcatcgatcctgcaggagaaactggggagcctcaatctgcgctggcaagaagtctgtaagcaacttagtgaccgcaagaagcgccttgaggagcagaaaaatattctgtctgaattccagcgagacctgaatgagtttgtgctgtggttggaggaggctgacaatatcgcctccattccattagagcccggcaaggagcagcaacttaaagagaagctggaacaagtgaagctgctggtagaagaacttcctcttcgccagggtatcctcaaacaactgaatgagactggcggcccggtgctggtttctgctcccatttcaccagaggaacaggataagctcgagaacaagctgaagcagacaaatctgcagtggattaaggtgagtcgagcgctccctgaaaagcagggagaaattgaagcacagatcaaggacctgggtcagctcgagaagaagttggaagatttggaagagcagcttaaccacttgcttctgtggttgtctcctattcggaaccagttggaaatttacaatcaacctaatcaggaaggacccttcgacgtgaaggaaacggaaatcgctgtccaggccaaacagccagatgtggaggagatacttagcaaggggcaacacctctataaggagaagcccgccacccaacctgtcaaacgcaagctcgaggacctctcatcggagtggaaggcagtgaacagactattgcaggagttacgcgctaagcaaccagacctcgccccagggctgaccacgatcggagcctcgcccacgcaaacggtcacactggtgactcagcctgtagtgacaaaagaaactgccattagtaagttagaaatgccaagttcccttatgctggaggtcccggcactggccgatttcaaccgggcctggacagagctcaccgactggctgtctctgcttgaccaggtaatcaaatcccagagggtgatggtcggtgaccttgaagacataaatgagatgatcattaaacaaaaggccactatgcaggaccttgaacagaggcggccacagctggaggaattgattacggccgcacagaatcttaagaacaaaacttccaatcaggaggctcgcactattataactgacagaatcgaacgtattcagaaccagtgggacgaggtgcaagaacacttacagaatcggcggcagcagctgaatgagatgcttaaggactccactcagtggttggaggcaaaagaagaggccgagcaggtgctcggccaagccagagctaaacttgagtcttggaaggagggaccatataccgtggatgctatacaaaaaaaaattacggaaactaagcagctggctaaggatctcagacagtggcagacaaatgtggacgtggccaatgacttggctctcaaattactccgtgattacagcgcagacgacacccgcaaagtgcacatgataacagagaatatcaatgcctcctggaggtcgatccataaaagagtgtccgagagggaggcagcactcgaagaaacacataggctgctccagcaattcccgttagacctggagaaattcctcgcctggctaactgaagccgagacaaccgcaaatgttctgcaggacgctacacggaaggagagactgctcgaagattcaaagggtgttaaagaactcatgaagcaatggcaggacctgcagggggaaattgaagctcacaccgacgtctaccacaacttagatgagaacagccagaagatcctgcggagtctcgaaggctccgatgatgccgtgctgctccagaggagactggataacatgaatttcaagtggagtgagctgaggaagaaatccttaaacatacggtctcacctggaagccagttcggatcagtggaagaggttacacctttccctccaggagctgctggtgtggctgcagttaaaagatgacgaactgtcacgccaggcgccaattgggggcgattttcctgcagtgcaaaagcagaacgatgtccacagggcctttaaaagagagctgaaaactaaagaacccgtaattatgagcaccctcgaaaccgtgcggatcttccttacagagcaaccattagaggggctcgaaaaattatatcaggagccgagggaactccctcctgaggaaagggctcaaaacgtcacccgcttgttacgcaaacaggcagaggaggtcaatacggagtgggaaaagttgaatctgcatagcgctgattggcagagaaagatagatgaaaccctggagcgcctgcgggaactacaggaggccaccgacgaacttgatctaaagctgaggcaagcagaagtgattaaaggcagttggcagcccgttggggaccttctgattgactctttgcaggatcacctggagaaagtgaaagctctccgcggtgaaattgctcctttaaaggaaaacgtttcccatgtcaatgacctggcgcgtcagttgactaccctgggcattcagctgtcaccctacaacttaagcaccctggaggatctgaataccagatggaagctgctccaggttgccgtagaggatagggtgaggcagctgcacgaagcacatcgcgactttgggcctgcatcacagcacttcctgagcacgtccgtccaagggccttgggaacgtgccatatctcccaacaaagtgccctactatattaaccacgagacacagaccacctgctgggaccacccgaaaatgacagaactttaccagagtttggccgatctcaacaacgtgcgcttctctgcctacagaaccgcgatgaagctcaggagactgcagaaagccttgtgcctggatctactcagcctttctgccgcgtgtgacgcgctggatcagcataatctgaaacagaacgatcagccgatggacatcttacagataattaactgcttgaccacaatttacgacaggctcgaacaggaacacaacaacctcgtgaatgtgccactctgcgtagatatgtgcctgaattggctcttgaacgtgtatgatacagggcgcaccggcaggattagagtgctgtcttttaaaaccggcatcatttccctatgcaaagcacacctggaagataagtataggtacttgtttaagcaggtggcttccagtaccgggttttgcgaccagagacgacttgggctgctcctacatgatagcatacagataccccggcaactcggggaagtcgcttcttttgggggctcgaacatagagccttccgttcgatcctgcttccagtttgcaaacaacaagccggaaattgaagccgcactgtttctcgattggatgcgccttgagccgcagtccatggtttggttgcccgtattgcatcgcgtggcggccgctgagacagctaaacaccaggctaagtgtaacatctgcaaggagtgcccaataataggcttcaggtatcggtctctgaagcactttaactacgacatctgtcaatcctgtttcttcagcggcagggttgccaagggccacaagatgcactatcccatggtggaatattgcacaccgactacaagcggagaggacgtacgggattttgctaaggtgctgaagaacaaatttagaacaaagagatactttgccaagcacccccggatgggctatctgcccgtacagacagttctcgagggagataacatggaaacacctgtgacactcataaacttttggcccgttgacagcgctccagcctctagcccccaactctctcacgacgatacacacagcagaattgagcattacgccagcaggctcgcagaaatggagaactcaaacggcagctacctaaatgactctatctcccccaacgagtcaattgatgacgaacatctcctaatccagcactactgtcaatctctaaaccaggatagtcctctttcacagcctcggtccccggctcagattcttatcagtctcgagtctgaagaaaggggagagctggagcggattctcgcagatttggaggaggagaaccgcaacttacaggctgaatatgaccggctcaagcagcagcatgaacacaaaggcctgtcacccctgccgagcccaccagagatgatgccaacttctccccagtcaccaagggatgccgaactgatcgcggaggccaagttattacgacaacacaaagggagacttgaagctagaatgcagatcctggaggatcacaacaaacaattagaatctcagttgcatcggttgaggcagctccttgagcagcctcaggcagaagctaaggtgaacgggacgacagtaagctccccatcgacttcactgcagcgcagtgactcatcgcagcctatgttactgcgagtggtgggatctcagacgtccgatagcatgggcgaggaagaccttttatcgcctccacaagacacctcaaccggcctggaggaggtaatggaacaactcaacaacagcttccccagttcaagaggaaggaacactcccgggaaacccatgagagaagatactatgtag

SEQ ID NO: 186184 - DNA, 3693 bp, Artificial Sequence
  Description of Artificial Sequence: Synthetic coding sequence
atgcccagcagcctgatgctggaggtgcccgccctggccgacttcaatcgcgcatggactgaattaacagactggctgtcactgttggaccaagtgataaagtcccagagggtgatggtgggcgacttggaggatattaacgaaatgatcatcaagcagaaagctacaatgcaggatcttgaacagaggagacctcagctggaggagctcatcacagccgctcaaaatctcaaaaataaaacctctaaccaggaggcacgcaccatcattactgataggatagaaagaattcagaaccagtgggatgaagtgcaagagcatctgcaaaatcggcggcagcagttgaacgagatgctgaaggactcaacacagtggttggaggccaaagaggaggcagagcaagtgttgggacaggcacgcgcgaaactagagagctggaaggaagggccttatactgtggatgcaattcagaagaagattaccgagactaagcagctggctaaggacctcaggcagtggcagacaaatgtcgatgtggccaatgatctcgccttgaagttgctgcgcgactattccgctgacgacacccgaaaagtccatatgattactgaaaatataaatgcttcatggaggtcaatccacaaacgcgtctcagagcgggaagctgcactggaggagactcatcgcctcctccaacaatttcccctcgatctggaaaagttcctggcatggctcacagaggccgagaccaccgctaacgttctgcaggacgcgacacggaaagaacggttactggaggatagtaagggggttaaagagctgatgaagcaatggcaggacctccagggggagatagaggcccatacggatgtataccacaatcttgacgagaactctcaaaaaattttgaggagcctcgagggttccgacgatgcagttctactgcagaggaggctggataacatgaacttcaaatggtcagagttgaggaagaaaagtctgaacatccgaagccacctggaagccagtagcgaccagtggaaaagactccaccttagcctgcaggaactactcgtctggttacagctaaaagatgacgaattgagcagacaggccccaatcggtggagacttccctgccgtgcagaaacagaacgatgtgcacagggccttcaagagggagttgaagaccaaggagcccgtaataatgtccacactcgagaccgttcgtatctttttgacggagcaaccacttgagggcctggaaaagctctatcaagagccccgggaacttccccccgaggagcgcgctcagaacgtgacacggctcttaaggaagcaggccgaagaggtcaacacagagtgggaaaagctcaatctgcactcagctgattggcagagaaagatcgatgaaactctggaaaggttgagagaactgcaagaggccactgacgagcttgatctcaagctcaggcaagctgaagtaatcaaaggatcttggcagcctgtaggcgacctcctcatcgactcactgcaggatcatctggaaaaggtgaaggcactgaggggcgaaatcgcgcctctcaaggaaaacgtgagtcacgtgaatgacttggccaggcagctcaccactcttggaattcagctttcaccatacaacctgagtacgctcgaggacctgaacaccagatggaagctgctgcaggttgccgtggaggacagggtgaggcagctgcacgaggcacaccgtgattttggcccagcctcacaacatttcctgtctacttctgtccagggaccatgggagcgcgccatctcgcctaataaggttccctactacatcaaccacgaaactcagaccacctgctgggatcatccaaagatgaccgaactctatcaatctttggctgaccttaacaacgtccggttctccgcctaccgaaccgctatgaagttaaggcgtctgcagaaagccctgtgtttggacctcctctctttaagtgccgcttgtgacgccttagatcagcacaacctcaaacagaatgaccaaccaatggatatccttcaaattatcaactgtctcacaactatctacgaccgtctggagcaggaacataacaatttggtgaacgtgcctctgtgtgtggacatgtgtctcaattggctactcaatgtgtatgacacgggcaggactgggcggatccgagtactttcatttaaaactggtattatctctctctgcaaggcacatctcgaagacaaatatagatacctgttcaaacaagttgctagtagcacaggcttctgcgaccagcggcgcctgggcctactgctacacgacagcatacaaatcccacgacaactcggcgaagtcgcatccttcggcggcagcaatatagaaccatccgtgcggtcctgttttcagtttgccaataacaagcctgaaattgaggccgccctttttcttgattggatgagactggaaccccaatccatggtctggttgccagtgctgcaccgggtagccgctgcagagaccgccaaacatcaggctaaatgtaatatctgtaaggaatgtcccatcattggatttagataccgttccctcaagcactttaattacgatatatgtcagagttgtttctttagcgggcgggtcgctaaaggccataaaatgcactacccgatggttgagtattgtactccaacaaccagcggggaagacgtaagagactttgcaaaggtgttaaagaacaaattccgaacaaagcggtattttgccaagcacccacggatgggatatctgcctgtccagacagtcctggagggggataatatggagacccccgcgtccagcccacaactatctcatgatgatactcattcgaggatcgagcattacgccagccggctggctgagatggaaaatagtaatggcagctatctgaacgacagcatctcccccaacgagtcaatcgacgatgaacacctgctcattcagcactattgccagtccctgaaccaggacagcccactgtcacagcccaggtctccggcgcagatcctgataagcctggagtccgaagaacggggagagctcgagcgcattcttgccgatttggaggaggaaaataggaacctgcaggcagagtacgacagactgaagcaacagcacgagcacaaaggcctctctcccctccccagtccccccgaaatgatgcctacgagtccacagtcacccagggacgctgagcttatcgcagaggctaaattgctgcgtcagcataaaggtcgcttggaggcacgcatgcagatactcgaggatcataataagcaacttgagagccagcttcacagattgcgccagctgctcgaacaaccacaggctgaagcaaaggttaacggaacaaccgtgtccagcccttccacctctctccagcgcagtgattcatcccaaccaatgctgctgagggtggtcggaagccagacttctgactccatgggagaggaggatcttctaagccccccccaagacacttccacaggtttggaggaggtcatggagcaactcaataactcttttcccagcagcagagggcataacgttggctccctgtttcatatggctgacgacctgggcagagccatggagtccctggtgagtgtcatgactgatgaggagggcgcggaatag

SEQ ID NO: 186185 - DNA, 1869 bp, Artificial Sequence
  Description of Artificial Sequence: Synthetic coding sequence
atgcgggagcagctgaagggccacgagacccagaccacctgctgggaccacccaaagatgacagagctataccaatctttggcagatttaaacaacgtgagattcagtgcctacaggacagcaatgaagctgagacggctccaaaaagccctttgcttggacttgctttccttgtccgccgcctgtgacgccttggatcagcataatcttaagcagaatgatcagccaatggacatactacagattattaactgtctgactaccatttatgacaggctcgagcaggaacacaacaacttggttaatgttcctctgtgcgtggacatgtgcttgaactggctgctcaatgtctacgacacagggcggaccggccgcattcgggtcctaagcttcaagaccggcatcatcagcttgtgtaaggcccacctggaagacaaatatcgctatctgtttaagcaggtcgcctcctctacgggcttctgcgaccagcgccgcttaggtctcctactccacgattcaatacaaatcccgcgacagctgggcgaggtcgcctcctttggcggctcaaatatagaaccaagcgttcgcagttgttttcagttcgccaataataaacccgaaatagaagctgctctgttcctcgattggatgcgtctggaacctcagtctatggtttggctaccagtgctccacagagtcgcagcagccgagacggccaaacatcaggccaagtgcaatatctgcaaggaatgcccaatcattggtttcagatacaggtcactgaaacattttaactacgatatttgtcaaagttgtttctttagtgggcgcgtcgccaaagggcacaagatgcactaccctatggtggagtactgcactccaacaacttccggggaagacgtgagggattttgccaaagtcctgaagaacaaatttcggactaagaggtatttcgccaagcatccacgcatgggctatttaccggtgcaaacagtcttggagggtgataacatggagacacccgctagtagtccccagctatcgcatgacgatacccattctaggatagagcactacgcttctcgactcgcagaaatggagaacagtaatgggtcctatctaaacgattctatctccccgaacgaatccatagacgacgagcacctccttatccagcattattgccaatctttgaatcaggactctcccctgtctcagccgaggtccccagcccagatacttattagcttggagtctgaagaacggggcgaactggaaaggatccttgcggatctcgaggaagaaaacagaaacttacaagccgaatatgaccgactcaagcagcagcatgagcacaagggtttgtcaccactgccctctcccccagagatgatgcccacaagtccacagtctcctcgcgatgccgagctgatcgccgaagccaagctcctcaggcagcacaagggccgcctcgaggcaagaatgcagatactggaagaccataataaacagttggagtcacagttacatcgtctaaggcaattactggagcagccacaggccgaggccaaggttaatggaaccactgtgagcagtccttctactagcctacagcgatcagactcgagccagcccatgttgctgagagtcgtcggaagccaaactagcgacagcatgggagaggaagaccttctatctcctcctcaggacacgtcgactggccttgaggaagtgatggaacagctcaacaactcattcccctcaagccggggacacaacgtgggcagcctgttccacatggccgacgatttagggcgagccatggagtccctggtatctgtgatgactgacgaggaaggggcggaatag

SEQ ID NO: 186186 - DNA, 11046 bp, Artificial Sequence
  Description of Artificial Sequence: Synthetic coding sequence
atgagcgaggtgagcagcgacgagcgggaggacgtgcagaagaagacttttaccaaatgggtaaacgcccagttctcaaaatttggcaaacaacatatcgagaacttgtttagcgaccttcaggatgggagacggctgctcgacctcctggaaggcctcactggtcagaaactccccaaggaaaaagggagcacaagagtccatgctctgaacaacgtgaacaaagccctgcgagtactgcaaaataacaacgtcgatctggtaaatataggctcgacagatatagtggatggcaaccataagttaacactgggcctcatctggaacattattctgcattggcaggtgaaaaacgtaatgaagaatattatggctggtctgcagcagacaaactccgaaaaaatcctattatcctgggtccggcagtcaaccaggaattatccccaggttaatgtcatcaacttcaccacgtcgtggagtgatgggttagcacttaacgcactcattcattctcacaggcccgatctctttgactggaattcagtagtctgccagcaaagtgccacacagcgcctggagcacgcatttaacatagccagataccagctggggattgaaaaactgctggaccccgaggacgtggacacaacttatcccgacaaaaaatccattttgatgtacatcactagcctgtttcaggtgctcccccagcaagtgagtatcgaggccattcaggaggtggagatgctcccccggccacctaaggtcaccaaggaggagcacttccagctccatcaccagatgcactacagtcagcagattacggtatcactggcgcagggttacgagaggacttcgtcccccaagccacgtttcaagagttacgcatacacccaggccgcctacgttacaacttccgatcctacacggtcaccattcccttcccagcacctagaagccccagaggataaatcctttggatcttctttgatggagagcgaggtcaacttggatcggtatcaaacagccctggaggaggtgctgagctggctcctgagcgcggaagacacactgcaggcgcagggagagatctctaacgatgttgaggtggtgaaagatcagtttcacacgcatgagggatacatgatggatttgacagcgcaccagggacgggtgggtaatatactgcaattaggctctaagttgattgggaccggcaagctgtccgaggacgaagaaacagaagtgcaagagcagatgaacctgctgaatagccgctgggagtgcctgcgggtggctagtatggagaagcagtctaacctgcaccgtgtgctcatggaccttcaaaaccaaaagctgaaagaattaaacgattggttaaccaagacagaggagaggacgaggaaaatggaggaagaacctctcggcccagacctcgaggacctgaaacgccaggtccaacagcacaaggtactgcaggaagacctggagcaggaacaggtaagggtcaatagtctgacccatatggttgtcgtggtcgacgaatcctctggagaccatgcaacagccgcactcgaagagcagctcaaagtcctgggcgatagatgggccaacatttgtcggtggaccgaagacagatgggttctactccaggacatcctgctcaagtggcagcgccttactgaggagcagtgtctgttcagtgcatggctctccgaaaaggaggacgcagtgaataagatccacaccaccggctttaaagaccagaacgagatgctcagtagtctgcagaagctcgctgtcttgaaggccgacctggagaaaaagaagcagtccatgggaaagctctacagtctgaagcaggatctcctaagtaccctgaagaataagtccgtgactcagaagacagaggcctggctggataattttgccagatgttgggataacttagtccagaagctggaaaaatccacggcgcaaatcagccaggctgtgaccaccacacaacccagtctgacccagaccaccgttatggaaaccgtgacaaccgtgaccacacgtgagcagatcttagttaagcacgcgcaggaggagctgccgcctcccccgccacagaaaaagcgacagattaccgtcgactctgaaatcagaaagagactggatgtagatataactgagctgcattcctggatcacacggagcgaggcagtgctacagtcccccgagtttgccattttcagaaaagagggtaatttctccgatctgaaggagaaagtcaatgccatagaaagggagaaggctgagaaatttcggaagttacaggacgcctcacggtctgcacaagccctggtcgagcagatggtcaacgagggagtaaacgccgattccatcaagcaggcctcagagcagctgaacagccggtggattgagttttgccaactcttgagtgagcgcctcaattggttagagtatcagaataatataatagcattttacaaccagttacagcagttagagcagatgaccacgaccgccgaaaactggttaaagatacaacccaccacaccttccgaaccgactgccatcaaatcacagctgaagatatgtaaggatgaggtgaaccggcttagcgatctgcagccacaaatcgagagactaaagatacagagcatcgctctgaaggagaagggccaggggccaatgttcctggatgcggatttcgtggccttcacaaatcattttaagcaggtgttctcagatgtgcaagcccgagagaaagagctccagacgatcttcgacacactgccccctatgagataccaggaaaccatgtccgccatccgtacatgggtgcagcaatccgagacaaagctcagtattccccaattgagcgtcacggattacgagatcatggagcagcggctgggggagcttcaggccctgcaaagtagtctccaggagcagcagagcggcctgtactatctgagcaccaccgtgaaggagatgtctaagaaagccccttctgaaatatcccgaaagtaccagtctgagtttgaggaaatcgagggcagatggaagaagctgtccagtcagctcgtcgaacactgccagaaattagaagagcagatgaataagctccgaaagattcaaaatcacatccaaaccctgaaaaagtggatggccgaagtggatgtatttctgaaggaggagtggccagctttgggcgactccgaaattctgaaaaaacagctgaagcagtgcagactgctggtgtctgatattcagacaatccagccaagtttgaactctgtgaacgaggggggccagaagattaaaaacgaggccgaaccagagttcgcaagcagactggagaccgaacttaaagagctcaacacccagtgggatcacatgtgccagcaagtctacgccaggaaagaagccttgaagggaggtctggaaaaaacagtgtccttgcagaaggatctgtccgaaatgcacgagtggatgacgcaggccgaggaggaatatctcgagagagacttcgagtacaagacccctgacgagctccagaaggctgtggaggagatgaagcgagcgaaagaagaggcccagcagaaggaagccaaagttaagctcctgactgaatcggtgaatagcgttattgcacaggcccccccagttgcacaagaagcgctgaagaaggaactggagactcttaccacaaactaccagtggctatgcacacgcttgaacgggaaatgtaagacgctagaagaagtgtgggcctgctggcatgagctattgtcgtacctggagaaagcgaataagtggctgaacgaggtcgagtttaagttgaagactaccgagaacatccctggaggagccgaagaaatcagcgaggtgctggattctctagagaatttgatgcgacacagtgaggataatcctaatcaaattagaattctggctcagaccctgacggacgggggggtgatggacgaactcatcaatgaggagcttgaaacgtttaattctcgctggcgagagcttcatgaggaggctgtgcggcgccagaagctgctcgagcaatcaattcaaagcgctcaggaaaccgagaagagtctgcacctgatacaggagagtttgacctttattgataaacagttggcagcttatatagcagacaaagtggacgccgctcagatgccccaggaggcacagaagattcagtccgatcttacctcccatgagatttctctcgaggaaatgaaaaagcacaaccagggcaaggaggccgcccagcgggtgctgtcacagattgatgtggcacaaaaaaagcttcaagatgtgagcatgaagttccgactcttccagaaaccggcaaactttgagcagcgcttacaggaatccaagatgattttagatgaggtcaaaatgcacctgccagccctggagaccaaaagcgtcgagcaggaagtagtgcaatcacagctgaaccattgtgtgaatttatacaagagcctgtcagaggtcaaatcagaggttgaaatggtgatcaagactggccggcagatcgttcagaaaaagcagaccgagaaccccaaggagttagacgagagagtgactgctctcaagctccactataacgagctgggtgccaaagtgactgaacgcaagcaacaattagagaagtgcctgaaactgtcacgtaagatgaggaaagagatgaatgtccttaccgagtggctggccgcaacagacatggagctcacgaagcgtagcgccgttgagggaatgccaagcaacttggattctgaggtggcctggggcaaggcaacccaaaaggagatcgagaaacagaaggttcacttgaagtcaattaccgaagtgggcgaggccctgaagacagtattggggaaaaaggaaacactggtcgaggataagttatcccttctgaactcaaactggatcgccgtgacctcccgagccgaagaatggcttaatctcttgctagaatatcaaaaacatatggagacattcgatcagaatgtggaccacatcacaaaatggattattcaagcagacaccctgcttgatgagtcagaaaagaagaaacctcagcagaaggaggatgttttgaaacgactcaaggctgagctaaatgacatccgaccaaaggtcgattctacccgtgaccaggctgccaatttgatggctaaccggggagaccactgtcgaaaactggtggagcctcaaattagtgaactgaaccatagattcgccgccatctcccacaggatcaaaaccggtaaggcatctattcctctcaaggagctggaacagtttaactccgacatccagaagctgttagagcccctggaagccgagatccagcagggagtcaacctgaaagaagaggattttaataaagatatgaacgaagacaacgagggcacagtgaaggagctcctacaaaggggtgacaatctgcagcaacgtatcacagatgaaaggaaacgggaggagattaagattaagcagcagttactgcagaccaaacataacgcactgaaggacctgagaagtcagcgcaggaagaaggctcttgaaatttcccatcagtggtaccagtataagcgccaggccgatgatctgttgaagtgtcttgatgatatcgagaaaaagttagcttccctaccggaacctcgtgatgagaggaaaattaaagaaatagacagggagttgcagaagaagaaagaggaactaaacgcagttcggcggcaggctgaagggctcagtgaagacggggccgctatggcagtggagcccacccaaatccaactgtcaaaacgatggcgcgaaatcgaaagtaaattcgcccagtttaggcgccttaattttgcccagatccacacagtacgagaagagacaatgatggtgatgactgaagatatgcctctcgaaatcagctacgtgcctagcacctatcttacggaaattacacacgtctctcaggcactccttgaggtggaacagctgctgaatgctcccgatctgtgcgcgaaggattttgaagatctatttaagcaggaagaaagcctgaaaaatatcaaggactctctgcagcagagcagtgggcgcattgacatcatccatagcaagaagaccgcggcgctccagagcgctacaccagttgaaagagtgaagctgcaggaagccctgagccagttagacttccaatgggagaaggtgaataagatgtacaaggatcggcagggtcgatttgaccgatcggtagaaaagtggcggagatttcattatgacataaagatatttaatcagtggctcacagaggccgaacagttcctaagaaagactcagatacccgagaattgggaacacgctaaatacaagtggtatttgaaggagctgcaagacgggattggacaacggcagaccgtggtccggactttgaacgcgactggagaggaaatcatacagcagagttcaaagactgatgcgtccatactgcaggagaagttgggctctttgaatctaagatggcaagaggtatgcaagcaactgtccgaccgaaagaagagactggaggagcagaagaacatcctgtcggagttccagcgtgatctaaatgaatttgtactgtggttggaagaagcagataatatcgcctccataccactggagcctggcaaagaacagcagcttaaggaaaaactggaacaggttaaacttctggtggaggagctccctctgcggcaaggcatcttgaagcagctcaatgaaaccggcggcccagtcctggtaagcgctcctatttcccctgaggaacaggacaaactcgagaacaaactgaaacagaccaacctacagtggattaaagtttcaagggctctaccagaaaaacagggggaaatagaagctcagataaaagacctaggtcaactggagaaaaaacttgaggatttggaagagcaactgaaccacctgctcctgtggctgtctccaatcaggaatcagttagagatctacaatcaaccgaaccaggagggtccttttgatgtcaaagagaccgaaattgctgtgcaggccaaacagcccgatgtcgaggagatcctgtcaaagggccagcacctttataaagagaaaccagcaacacagcctgtgaaacgaaaactggaggacctttcatcggaatggaaagcggtcaatagactgctacaggaactccgggctaaacagccggacctagcccccgggctgactacaattggcgcctctcccacccagactgtgacactggttactcagccagtcgtaacaaaagaaacagcaatttctaagctggagatgccatcatcactgatgctagaagtgcctgcccttgctgacttcaatagggcatggacagaattaacagactggctttccctgcttgatcaagtgattaaatcccagcgggtgatggtgggtgatctggaggatattaatgagatgatcatcaaacaaaaagctacgatgcaagatctggaacagagacgaccacaactagaggagctgattaccgctgcccagaatctgaagaacaagacctcaaaccaggaagcacgaaccattatcacggaccggattgagcgcatacagaaccagtgggatgaagtgcaagagcacttgcagaaccggcggcagcaactcaacgaaatgttaaaggattccacacaatggctggaggcgaaggaagaggccgaacaggtgttggggcaggctcgagccaagctggagtcctggaaagagggaccctacacagtggatgctattcagaagaaaataactgagaccaaacaattggctaaggacctcaggcagtggcagacgaatgtcgacgttgctaacgatctcgctctcaaactcttacgggactactccgccgatgatacacgcaaggtgcacatgattactgaaaacatcaatgcctcctggaggagcatccacaaacgggtatccgaacgggaagccgcattagaagaaacccaccgactgctccaacagtttccacttgatctggagaaatttctggcgtggctgacagaggcagaaacgaccgccaacgtcctccaggatgccacccgaaaagagcgcttacttgaggatagcaaaggggtcaaggagctcatgaaacagtggcaggatctccagggcgaaatcgaagcccacacagacgtctaccacaaccttgatgagaatagtcagaagatactacgcagtctggaggggagtgatgacgcagtcctgctgcaacgacgcctggacaacatgaacttcaaatggtctgaattgcgaaaaaaatcactcaatattagatcccaccttgaagctagctccgatcagtggaaaaggttgcatctcagtctgcaggaactactggtgtggctccaactaaaggatgatgaactttctcggcaggcccctataggtggcgattttcccgccgtgcagaaacagaacgacgttcacagagccttcaaaagggagctcaagaccaaggagccagtgattatgagtactttagagaccgtcagaatctttctgactgaacagcccctggaaggtctggaaaaactgtatcaggagccacgggagttgcctcctgaagagagagcccagaatgtaactcgcctccttcgaaaacaagccgaggaggttaatacagagtgggagaagctgaacctgcattctgccgactggcagaggaaaattgatgagaccctcgagcggctgcgagagctccaagaggctaccgacgaacttgaccttaagttaagacaagccgaagttattaagggatcttggcagcccgtgggcgatctcctgatcgatagccttcaggatcacctcgaaaaggtcaaagcactccggggtgaaatcgctcccctgaaggagaacgtatcccatgtgaacgatctggcacgccagctgacgactttgggcattcagctgtctccatacaatctgtcaactctggaggatctcaacactcgctggaagttgctccaggttgcggtcgaggaccgcgtgcggcaactgcacgaagctcatagggactttggaccagcatctcagcactttctctccaccagtgtccaagggccctgggagagagcaatcagccccaacaaagtcccctactacatcaaccatgaaacacagacgacttgttgggaccacccgaagatgacagaactttaccaatccctggctgacctgaataatgtgcgattcagtgcctaccgcaccgcaatgaagcttcggaggttacaaaaagcgttgtgcctggatctgttgtccctgtccgctgcatgcgacgcactggaccagcataatctgaaacagaatgatcaacccatggatatcttgcagattatcaattgcttgacaacgatttatgacaggctcgaacaagaacataacaatctggtcaacgtaccgctgtgcgttgatatgtgccttaattggttgcttaatgtatatgacaccgggagaactggccgcatccgtgtgctgtctttcaagaccggcatcatcagcctctgtaaagctcaccttgaggataaataccggtacctcttcaagcaggtggcatctagcaccggcttttgtgaccagaggcgattgggcctcctgctgcacgattcaattcaaattcccaggcagcttggagaggtggcatcatttggtgggtccaacatagaaccctccgtgagatcctgttttcagttcgcaaacaacaaacccgagattgaggccgcactgtttctggactggatgagactcgaaccacagagcatggtttggcttccagtgctgcaccgggttgctgcagctgagacggcaaaacatcaagcaaagtgcaacatttgtaaggagtgccctatcatcgggtttcggtatagaagcttgaagcacttcaactatgatatatgtcagtcctgttttttcagcggaagggtcgcaaagggacacaagatgcattaccccatggttgagtactgtactccaacaacatctggagaggatgtgcgggattttgccaaagttctaaaaaataagttccggaccaaaagatatttcgcaaagcaccctcgcatgggatacctgcccgttcaaaccgtgctggagggtgataacatggagacacccgtgactctcattaacttttggcctgtggacagtgctccagcttcatctcctcagctgtcacacgatgatacccacagccggatcgagcactacgctagtcgattggcggagatggagaatagcaatggctcttacctgaatgactccatctctccaaatgaatcaattgatgacgagcatttactaattcagcactattgtcagagcctgaatcaggattccccactgtcacaaccgcgaagccccgcgcaaatacttattagcctggagtctgaagagcgcggagagctggaacggatcctggccgacctagaggaggaaaacaggaacttacaggccgaatatgaccgcctgaagcagcagcatgagcataaaggactctcacctcttccatccccacctgaaatgatgccgacgagcccgcagagcccgagggatgcagagcttatcgcggaggctaaactgcttaggcagcataagggcaggctggaggcaagaatgcagattctggaagaccataacaagcaacttgaaagccaactgcatcgcctgaggcagcttctcgagcagcctcaggccgaagccaaggtgaacggcaccactgtgagcagcccgagcactagtcttcagagaagtgattcatcccagcccatgctactccgtgtggtcggctcacagactagcgactcaatgggtgaggaggaccttctgagccctcctcaagacacatccaccgggttggaagaggtgatggagcaactgaataatagctttcccagttcccgaggcagaaatacaccaggcaagccaatgcgtgaggacacgatgtag

SEQ ID NO: 186187 - DNA, 7035 bp, Artificial Sequence
  Description of Artificial Sequence: Synthetic coding sequence
atgaccgagatgatcctgctgatcttcttccccgcctacttcctgaacgctgttcggcgccagaagttgctggagcaaagcatccaaagtgcccaggaaacggaaaagagcctgcatctaattcaggagtcattgacattcattgataaacagctggccgcctatatcgctgacaaagtggatgccgcccagatgccccaggaggcccaaaaaattcagagcgacctgacaagtcacgaaatatccctggaggagatgaaaaagcataatcaggggaaggaggccgcccagcgggtactttcccagatcgacgtggcccagaagaaactccaggacgttagcatgaaatttcgccttttccaaaaaccggcaaacttcgaacaacgtttacaggagtccaagatgatccttgacgaggtcaagatgcatctgcctgctttggagacaaaaagcgtagaacaggaggtcgtccaaagtcaactgaatcactgtgtaaacctctacaagtccctgagtgaggtgaagagcgaggtcgagatggtcatcaagacaggccgccagatcgtgcagaagaagcagacagagaatcccaaggagctggacgaacgcgtcaccgcactgaaactacactacaatgagctcggcgccaaagtgaccgaacggaagcagcaattagagaaatgtcttaaactctctcggaaaatgagaaaagagatgaacgtgcttactgaatggctggccgctaccgatatggagttaactaagcgttcggcagtcgagggcatgccatcaaacttggacagcgaagtggcctgggggaaggccacccaaaaggaaatcgaaaaacagaaggtgcatctcaagagcatcacagaagttggagaggccctgaaaaccgtcttaggaaaaaaagagacgctggttgaagataaactcagcctgctcaacagtaactggatcgcagtgacttccagagccgaggagtggctcaacctgctcctcgaatatcagaagcacatggaaaccttcgatcaaaatgtggatcatataaccaagtggataattcaggctgacacgctactggacgagtcagaaaaaaaaaagcctcagcaaaaggaagacgtactgaagcgcctcaaggcagaacttaatgatatcaggcccaaagtggactctacccgcgatcaagctgccaacctgatggcaaacaggggtgaccactgtcggaaactggtcgagcctcagatatccgaactaaaccatcggtttgccgcaatatcacacagaattaagactgggaaagcaagtatccccttaaaggagttggaacagttcaacagcgacattcagaagctcctcgagcctttagaggccgagatccaacaaggagtgaatctgaaagaggaggacttcaataaagacatgaacgaggacaatgaaggcaccgttaaagagcttctgcagaggggcgacaatctgcagcagaggataaccgatgaacggaagagggaggaaattaagattaaacaacaactgctccagactaagcataacgctctcaaggacctacgcagccaaaggcggaagaaagccctggagatctcacatcagtggtaccagtataagcgccaggccgatgatctgctcaagtgcctggatgacattgaaaagaaactggcttccctgccagaacctcgcgacgaacggaagatcaaggaaattgaccgcgaactccagaagaaaaaggaggaactcaatgccgtgcgccggcaggctgagggactctctgaagatggggccgcaatggccgtcgagccaacacagattcagctttctaaaaggtggagggagatagagtccaaatttgcccaattccggcggctgaattttgctcagatccatacagtcagagaggagactatgatggtgatgacagaggacatgcctcttgaaatatcttatgttccctcaacctacctcacggaaataacacatgtttcacaggcgttgctggaggtggagcagctcctaaatgctcctgatttgtgcgcaaaggatttcgaggatcttttcaagcaggaggaatcacttaagaatataaaagactcgctccagcagagctccggcagaattgacattattcacagcaaaaagacggccgccctgcagagtgccactcctgtcgaaagggtgaagcttcaggaagccctgtctcaattagatttccagtgggagaaagtgaacaagatgtataaagaccgccagggcaggtttgaccggtctgtggagaaatggcgaaggttccattacgacatcaaaatttttaatcaatggctcacggaggcagagcagtttctgcggaagacacagataccagaaaattgggaacacgccaagtataaatggtacctgaaggagctccaagacggcatcggccagcgccagaccgtggtaaggacactcaacgcaaccggcgaggagatcattcaacaatcctcaaagacggacgcgagcattctgcaggaaaaactgggctctctgaatctaagatggcaggaagtctgtaagcagctctccgaccgaaagaagaggctcgaggaacagaaaaacattctctcggagttccagcgggacttgaatgagtttgtgctttggctggaagaggccgataatatcgcctcgattcccctggaacctggaaaagaacagcagttaaaggagaagctggagcaggtgaaattgctcgttgaagagctgccattgcgacaggggatcttgaaacagctgaatgaaaccggtggccctgtccttgtgagcgcgccaatttccccagaggaacaggacaagctggagaataaactcaaacagactaatctccagtggataaaagtgtcaagggctctccctgagaagcagggcgaaatcgaggctcagatcaaggatctgggacagttagagaaaaagctggaggatttagaggaacagttgaatcatcttctgctctggctttcccccatccgtaaccagcttgagatctacaatcagcctaatcaggagggcccctttgatgtgaaagagaccgaaattgccgtgcaagccaaacagcctgatgtggaagagatactcagtaaaggacagcatttgtataaggagaagcccgctacacagccagtgaagaggaaacttgaagatctgtcatctgagtggaaggcggtcaaccggctccttcaggaactcagagctaaacagcctgatctggctccgggcttgaccaccattggagcatctccaacccagacggtcacattagtcacacagccagttgttaccaaggagactgctatctcaaagctggaaatgccgtcttctttaatgttagaagttcctgcgttagcagattttaacagagcatggacagagctgacagactggctcagtctgctcgaccaggtcatcaagagccagagagtgatggttggcgatctggaggatatcaacgaaatgattatcaagcaaaaggccacaatgcaagatctcgagcagaggaggccacagctcgaagagctgatcacagctgcccagaatttgaaaaacaagaccagcaatcaggaggctcgtactattattactgatcgaatcgagcggatccagaaccaatgggacgaggtccaagagcaccttcagaatcggaggcagcagttgaatgagatgttaaaggattctacccagtggctagaagccaaggaggaagccgagcaggtgctaggccaggccagagcgaagctagagagttggaaggaaggaccatacacagtagatgccatccagaagaagataactgagacaaagcagctcgccaaggatctgaggcagtggcagaccaacgtggatgtggccaacgatctcgccctgaagcttctgcgggactactctgcagatgataccagaaaagtccacatgattactgaaaacattaacgcctcttggcggagtattcataaaagagtctcagaacgggaagctgctctcgaggaaactcataggcttctgcaacaatttccactcgatctcgagaagttcctcgcctggctgacagaggctgaaacgactgcgaacgtccttcaggacgccactcgaaaagagagactgctggaagactccaaaggcgttaaggaactcatgaagcagtggcaggacctccaaggagagatagaagcgcacacagacgtgtaccacaatctcgacgaaaacagtcagaaaattctgcggtcattagagggctccgatgacgctgtgctgctgcaacggagattagataacatgaattttaaatggtctgagcttagaaagaaatccctgaacatccgcagtcacctcgaggcgagctctgatcaatggaaaagattgcatctctccctgcaggaactgttggtatggttgcaactgaaggatgatgaacttagcaggcaggcccccatcggtggcgacttccccgccgttcagaaacaaaatgatgtacaccgggcttttaagagagaattgaaaaccaaagagcctgtgattatgtccacgctggagaccgtacgcatcttcctcacagaacagccactggaaggtttggagaaactctatcaggagccccgggagctgccgcccgaggagcgcgcccaaaacgtgactcgactgttgcggaagcaggcagaagaggtgaatacagagtgggaaaaactgaacctccattcagcggattggcaacgcaagatcgatgagacattggaaaggctacgcgagctgcaggaggccaccgatgagctcgatctgaagctgaggcaggcagaagtgattaagggttcatggcagcccgtgggcgacctgttgattgatagcttacaggatcatctggagaaggtaaaggcacttaggggcgaaattgctccactcaaagagaacgttagtcacgtcaacgatctggcgaggcagctgacaacgctggggattcagctgtctccttacaatctgagtactctagaggatctaaacacgcgatggaagctcctccaggtggccgtggaagatagagtccgacagctgcacgaggctcatcgagatttcggtccggcctctcagcacttcctatccacctcggtgcagggaccttgggagcgcgctattagccccaataaagttccgtactatattaatcatgaaactcagactacatgctgggaccaccctaaaatgaccgaactttaccagtccctcgctgacttgaataatgtccggttcagcgcgtacagaaccgccatgaagctcagaaggcttcagaaggccctctgtctggatctgttgtccctttccgcagcctgcgatgcccttgaccagcacaatctaaaacagaatgatcagccaatggacattttgcaaatcatcaactgcctgaccaccatctatgatagactagagcaagagcataacaacctagttaatgtccccctttgtgtggacatgtgtcttaattggctcctgaatgtgtacgatactggccggaccggtcggatcagagttctctctttcaaaacgggcataatttcgctctgtaaggcccaccttgaggataagtaccgctatctgtttaagcaggtcgcaagctcgaccggtttttgtgatcaacggcggctgggcctgttattgcacgacagtattcaaatccctagacaacttggggaagtggcctcctttgggggcagtaacatcgagccatccgtaagatcatgtttccagttcgctaacaacaaaccggagatcgaagctgcactatttctcgattggatgagactggagccgcagtctatggtttggcttccggtcctccaccgcgtggccgctgctgagactgcaaagcatcaagctaagtgtaacatctgcaaggaatgtcccattatcggatttcgataccggtctttgaagcactttaattacgatatctgccaatcttgctttttttccgggagagtggctaagggacacaaaatgcactatcccatggtggagtactgtacacccacaacttcaggagaggatgtgagggacttcgctaaggtcctaaaaaacaaattccgtaccaagagatactttgcgaaacaccccaggatgggctatctgccggtgcagacagttctcgaaggcgataatatggaaaccccagtgacactcattaatttttggcccgtggactccgcgcctgcttcttcacctcaactatcgcacgatgatacacattctcggatcgagcactacgcaagtcgtttggccgaaatggaaaactccaatggcagctatctgaatgattcgataagtccaaatgagagtatcgacgatgagcatctcctgattcagcactattgtcagtctctgaaccaagactcacccctttcacagccccgctccccagctcaaatccttatatccttagaatccgaagagcgaggcgaacttgaacggattctggcggatctggaagaggaaaatagaaacttacaagcggaatatgatcgtttaaaacagcagcatgagcataaggggctgtcaccgctcccaagcccgcctgaaatgatgcctacgagccctcagtcgccccgggacgctgaactaatcgctgaagccaagctgctgcgacagcacaaaggtcggctcgaagccaggatgcagatcctggaggaccacaataaacagctggagagccagctgcacaggctccgccaactactggagcagccgcaggcggaggccaaagtcaatggtactacggtctcgagcccttccaccagtttgcaacggagcgatagctcacagcccatgcttctgagagtcgtcgggtcccagacgtccgattcgatgggtgaggaagaccttctctcgccaccccaggacacgtctactggactagaggaagtcatggagcagctaaacaacagttttccttccagcagaggcaggaatacacccgggaagcccatgagggaagacacaccctag

SEQ ID NO: 186188 - DNA, 7026 bp, Artificial Sequence
  Description of Artificial Sequence: Synthetic coding sequence
atgagcgcccggaagctgcggaacctgagctacaagaaggccgtgcgtcgtcagaaactgctggagcagtcaattcagtccgcacaggagacagaaaaatctctacacctaatccaggagtctctgacctttatagataaacagctagcggcttacattgccgacaaagttgatgctgcacagatgccccaagaagctcagaagatccagagcgacctgacatcccatgagatctctctggaagagatgaaaaagcacaaccagggaaaggaagccgcccagcgtgtgctgtcccaaattgatgtggctcagaaaaaactgcaagacgtgtctatgaaatttcgtctcttccagaaacctgcaaacttcgaacagcgacttcaggagtccaaaatgattctagatgaagtgaagatgcacctccctgctttggagacaaaatctgtcgaacaggaagtcgttcaatcccaactgaatcactgcgtaaacttgtataagagcctaagcgaagtgaaatcagaggtagagatggtcatcaaaaccggtcggcagatcgttcaaaagaaacaaactgaaaacccaaaagaattagatgaacgagtaactgccctcaagctgcactataacgaactaggagccaaggttaccgaaagaaaacagcaactggagaagtgcctcaagttgtccagaaaaatgcggaaggaaatgaatgttctgacggagtggctggcagccacggatatggaactaacgaagcggagtgcagtggagggcatgccatctaatctggattcagaggtggcatggggcaaagcgacgcagaaggaaattgaaaagcagaaagtccacctcaagtcaataaccgaggtcggtgaggctcttaaaacagtgcttggcaagaaggaaactctggtcgaagataaactcagcttgcttaactccaattggattgcggtgacaagccgcgctgaagagtggctgaatctgctgctcgagtatcagaagcacatggagacatttgatcagaacgtcgaccatataacgaaatggatcattcaagcggacacactactggacgagagcgagaagaaaaagccccagcaaaaagaggacgtgctcaagcggctgaaggccgagttgaacgacatccgaccaaaagtggactctacgagagatcaggccgcaaacctgatggcaaatcggggggatcactgccgcaaactggtagaaccccagattagtgaactaaatcaccgttttgccgcaatcagtcacagaataaagacaggaaaggcaagtattcctttgaaggaacttgagcaatttaacagcgacatccagaaacttctcgagccacttgaggctgagatccagcagggcgtgaatctgaaagaagaagactttaacaaggatatgaatgaagataatgaggggacagtaaaagaattgctgcaacgaggcgacaatctacaacagcggattaccgacgaacgaaagagggaggaaatcaagatcaagcagcaacttctgcagacaaagcacaacgcccttaaggatttacgctctcagcggaggaagaaagccctggagatttctcaccagtggtaccaatataaacgccaagctgatgacctgctaaagtgcctcgatgatattgaaaagaaactggcaagtctgcccgagcctcgggatgaaaggaagatcaaagagatcgacagagagttgcaaaagaagaaggaggagttgaacgctgtccggcgtcaagcggaagggttgagtgaagacggcgccgctatggctgtagaaccgacacaaatccagctgagcaaaagatggagggagatcgagtccaagtttgcgcaattcagaaggctgaatttcgcacagattcacacagtccgtgaggagaccatgatggtaatgaccgaagacatgcccctggaaatctcttatgtcccttcaacctacctgaccgagattacccatgtcagccaggcactcctggaagtcgaacagttgctgaacgcaccggacctttgcgcaaaggattttgaagacctctttaaacaggaggagagtctgaaaaacatcaaagactccctgcagcaatcttctggcaggatcgatattatccactccaagaagacggccgccctgcaatccgccacacctgtcgaacgagtcaaattacaggaggcgttaagccagctggacttccagtgggagaaagtcaataaaatgtacaaagaccgccaggggaggtttgaccgaagcgtggaaaaatggcgaagattccactatgatatcaagatttttaaccagtggctgaccgaggcggagcagttcctgagaaagacccagattcctgaaaactgggagcacgccaagtataaatggtatttgaaggagctgcaggacgggatcggtcaaagacagaccgtggttcgcacgctcaatgcaaccggagaggagatcatccaacagtctagcaagacagacgcctcgatcctgcaagagaaactgggttccttaaacctgagatggcaggaagtgtgtaaacagctgtcagatcgcaaaaaaagattggaagagcagaagaatatcctgtcggaattccaaagggacctgaatgagtttgtgctctggttggaggaagctgataacattgccagtattccgctggaacctggtaaggagcagcagctgaaagagaaactggagcaagtgaagttgcttgtggaagagctgcctctgcgacagggtattttaaaacagctgaatgagacgggaggaccagtgctggtgagtgcaccaatctcccccgaggagcaggacaagctcgagaacaagctgaagcagaccaacctccagtggattaaggttagcagagccttgccagaaaagcagggagagatcgaagcccagatcaaggacctcgggcagctggaaaaaaagctggaagatctcgaggaacaattgaatcatctgctgctgtggctgagcccaattcgaaatcagctcgaaatttataaccaaccaaaccaggagggaccgtttgacgtcaaggaaaccgaaatcgccgtccaggccaaacagcccgatgtggaggaaattctcagcaagggccagcacctctacaaagaaaagcccgcaacacagccggtcaagagaaagctcgaggacctttcatccgagtggaaagccgttaatcgattgcttcaagagctgagagcgaaacagcctgatcttgcaccaggactgactacgattggagcttcccccacccagacggtcaccctcgtgacccagcctgtcgtcaccaaagagactgctatcagcaaacttgagatgcccagctcactcatgctggaagtgcctgctttggcagacttcaatagggcatggactgaacttaccgactggttgtcactgttggaccaggttattaaatcccagcgagtgatggtgggcgacttggaagacattaacgagatgattattaaacaaaaggcaaccatgcaggatctagagcagagacggccacaactcgaagagctgattactgccgcccagaatctcaaaaacaagacgagtaaccaggaggctcgtacgataattactgatcgaattgaacggatccagaaccagtgggacgaagttcaggaacacttacagaatcgccgacagcagctcaatgagatgctcaaggactctacacagtggttagaggccaaagaggaggcggagcaagtccttggacaggcaagggctaagctggagagctggaaagaggggccttacaccgttgatgctattcagaagaagattaccgaaacgaaacagctcgcgaaggatctccggcagtggcagacaaacgttgacgtcgccaatgacctcgcgcttaagcttctcagagattacagcgccgatgataccaggaaagtgcacatgattactgagaatataaatgctagctggaggagcatccacaaaagggtctctgagcgggaggccgcactggaggagacacataggctgcttcagcagttcccactggatctggaaaaatttctcgcttggctgacagaggcagagaccacagccaatgtgcttcaggatgcaacccggaaggagcggttgctcgaagacagcaaaggagtgaaggaattgatgaaacagtggcaggatctgcagggtgagattgaggcccataccgacgtgtaccacaacctcgacgaaaattcgcagaagattttgcgctcccttgagggtagcgatgacgcagtgctcttgcagcggagactcgataatatgaactttaaatggtcggaacttagaaaaaagtcccttaatatccggtcacacctcgaggcctccagtgaccagtggaaaagattgcatctctccctgcaggaactgctggtgtggttacagcttaaggatgatgaattgtcccgacaggcgccgatcggcggagactttcctgccgttcagaagcagaatgacgtacacagagcttttaaaagggagcttaaaactaaggagcctgtgatcatgtcaactctggagaccgtgaggattttcctcacggaacaaccactggagggtctggaaaaactgtaccaggagccaagagagctgccaccagaggagagagcgcagaacgtaaccaggcttctgcggaagcaagccgaggaagtgaataccgagtgggaaaaattgaacctgcacagcgctgactggcagagaaagattgacgagactctcgagcggctgagagaactgcaggaggcaactgacgagctggatctgaagttgcgacaagccgaagttatcaagggcagctggcaacccgtgggggacctgcttatagacagcctgcaggaccatctggaaaaggtgaaggccctaagaggcgagattgccccgttgaaggagaacgtcagtcatgttaacgaccttgcccgccagctgactacactggggatacagctatctccgtacaacctcagcaccttggaggaccttaatactcggtggaagctccttcaggtggcagtcgaagaccgcgtgagacagctgcatgaggctcatcgcgacttcggcccagccagtcagcattttctctcaacatccgtccagggaccatgggagagggctatctcccccaacaaggtgccctattacatcaaccacgagacccagactacatgttgggaccacccaaaaatgacagagctttatcagagcctggccgacctgaacaatgttcgtttctccgcctatcgcacagctatgaaactcaggagacttcagaaggcactttgcttggatcttctttctcttagtgccgcttgtgatgctctggaccagcacaacctgaaacagaacgaccaacccatggacattttgcaaatcataaactgcctcacaacgatctacgacagactagagcaggagcataacaacttggttaatgtgcctttgtgtgttgatatgtgcctaaattggttgctgaatgtgtatgatacaggccggaccggtcgcatccgggtgctgagttttaagaccggaataatttccctgtgtaaagcacatctagaggataaatacagatatcttttcaagcaggtggctagcagcaccggtttctgtgaccagcgccgactggggctgttgttgcatgatagcatacagatcccacgacagctaggcgaggtggccagtttcggagggtccaacatagagccctcagtgaggtcttgctttcaattcgcaaacaacaaacccgaaatagaagcagccctgtttctcgactggatgcggctggagccgcagagtatggtgtggctgccagtgctgcatcgcgtggcggctgctgaaacagccaaacaccaagcaaaatgtaacatctgtaaggagtgccccataattggttttagatacagaagcctcaaacatttcaattatgatatctgccagagctgctttttctctgggcgtgtggccaagggccataagatgcattaccctatggtggagtattgtacgcccacgacaagcggagaggacgtgcgagatttcgccaaagtccttaagaacaaatttcgtaccaagcggtacttcgcgaagcatcctcgcatgggatatttgccggtgcaaacagtcctggaaggcgataacatggaaacacccgttaccctcatcaacttttggcctgtggactcagcccccgcatcctcaccacagctgtcccacgacgacacacactcgcggattgagcactacgctagcaggctggctgagatggaaaacagcaatggatcttacctgaatgacagtatttcaccgaacgagtctatagatgacgagcacctcctgattcagcattactgccagtccctgaatcaggactctcctctgagtcagccgaggtccccagcacaaatcctcattagtctggaaagtgaagagcgcggagagctggaacggattctcgcggatcttgaggaggaaaatcgcaatctacaggccgagtacgaccgtcttaagcagcagcacgaacacaagggactgtcccccctaccctccccgcccgagatgatgccaacctcaccacaatccccacgcgatgccgaactgatcgcagaagctaagctactgaggcaacataaaggccggctcgaagcacggatgcagatattggaggatcacaacaagcagctcgagagccagctgcacaggcttaggcagctattggaacagccccaggcagaagctaaagtcaacggaacgactgtctcctccccctctactagcctccaaagaagcgatagctcacaacccatgctgctgcgcgtcgtggggtcccagactagcgattcaatgggagaagaggacctcctctcccccccgcaggacacatcaacaggcttagaggaggtgatggagcaactgaataatagcttcccttctagcaggggccgtaacacacctggcaagccgatgcgcgaggacactccatag

SEQ ID NO: 186189 - DNA, 1854 bp, Artificial Sequence
  Description of Artificial Sequence: Synthetic coding sequence
atgcgggagcagctgaagggccacgagacccagaccacctgctgggaccatcctaaaatgaccgagctgtaccaaagcctagccgatctgaacaacgtacgttttagtgcttaccggactgccatgaagcttcgcagattgcaaaaagccctgtgcctggaccttctatcgttgagcgctgcctgtgacgcattagaccaacacaacctgaagcaaaacgatcagcccatggatatcctacaaatcattaactgtctcaccaccatttacgaccgccttgaacaggagcataataacctcgtgaacgtaccgctgtgcgtcgacatgtgcttgaattggctcctcaacgtatacgatacaggccgtacaggccgtattagagtgcttagcttcaagaccgggataattagcttatgcaaggcccatctggaggacaagtacagatatctgttcaagcaagtcgcttcttccaccgggttctgtgaccagagacgacttggactcctgcttcacgactctatccagattccaagacagctgggtgaggtcgctagcttcggcggctccaatattgaacccagtgtgaggtcttgttttcagttcgctaataacaaaccagaaatcgaagcagccttatttttggactggatgcgcctggagcctcagtccatggtctggctaccggtgctccatcgagtggcagccgccgagaccgccaaacaccaggcaaagtgcaatatttgcaaggagtgtccaatcatagggtttcgatacaggtcacttaagcactttaactacgacatatgtcagagctgttttttctctggacgagttgccaaaggtcataagatgcattaccctatggtggaatactgcacacccactacaagcggtgaagacgtgagagattttgctaaagttctgaagaacaagttccgtacaaaaaggtacttcgcaaagcacccaaggatggggtacctccccgtgcagactgtcctggaaggcgacaacatggagacacctgttaccctaattaacttttggccagtcgactcagcaccagcttcatcccctcaactctctcacgatgatacacacagtcgtatcgaacattacgcatccagactcgcagagatggagaacagtaatgggagttatcttaacgactccatttcccccaatgagtccattgatgatgagcacctgctgattcagcattactgccagagtcttaatcaggattcacctctgtcgcagccgaggtcaccagctcaaatcttgattagtctggagtccgaagagaggggcgagctggagaggatactggccgacctggaggaggagaatcgcaacctccaggcagaatacgataggcttaagcaacagcatgagcacaagggactaagcccattgccttctcctcccgagatgatgccaaccagtccgcagagcccacgagacgcggagttgatcgccgaggccaagctactgcgtcagcataagggaaggctagaagccaggatgcaaatcttggaagatcacaacaaacaactggagtcccaattgcatagactgcggcaattgctggagcagccacaggcagaagccaaagtcaacgggaccaccgttagttcaccgagcaccagcctgcagagaagcgacagctctcagcctatgcttcttagggtcgtaggcagtcaaacctctgattctatgggggaagaagatctactctcccccccccaggataccagcaccggcttagaagaagtcatggagcagttgaacaattcattccctagcagccgcggacgcaatacccccgggaaaccaatgagggaagataccatgtag

SEQ ID NO: 186190 - DNA, 3678 bp, Artificial Sequence
  Description of Artificial Sequence: Synthetic coding sequence
atgcccagcagcctgatgctggaggtgcccgccctggccgacttcaacagggcttggacagagttgacagattggctctccttgctcgatcaggtcatcaagtcgcagagagtgatggtgggcgacctggaggatattaatgaaatgatcattaaacaaaaggctaccatgcaggacctagagcaacgtagaccacagctggaggagcttatcacagccgcccagaatctgaagaataagacttccaatcaagaggcaagaactatcatcacagatcgaatagagagaatacagaatcaatgggatgaggttcaggagcacctacagaaccgacgccaacagctgaacgagatgctaaaagacagtacccagtggctggaagctaaggaggaggctgagcaagtgctagggcaggcccgagctaagctggaatcatggaaagagggaccatacaccgtcgacgccatccagaagaagatcaccgaaaccaagcagctggctaaggatctccgccagtggcagactaatgtcgacgtggcaaacgatctagcactgaagttactaagagattatagcgctgatgacacccggaaggtacacatgataaccgagaatataaatgcctcttggcgctccatccataagcgcgtttccgaaagagaggcagccctcgaggaaactcaccgactgctgcagcagtttcccttagacctggagaagtttctggcctggctgacagaagccgaaacaacagccaatgttctccaggacgctacccggaaggaacgtctgctggaggacagcaagggcgtgaaggagctgatgaagcagtggcaggaccttcagggcgagattgaggcccacacagatgtttatcacaacctggatgaaaatagccagaaaatcctgaggtctcttgaaggttccgacgatgcggtcctgctccagaggaggttggacaatatgaacttcaaatggtcagagctgaggaaaaaatccttaaacatcaggagtcatctggaggccagctcagatcagtggaaaaggcttcacctgagcttacaggagctgctggtatggctccagctgaaggacgacgagcttagtagacaggcccccatcggaggggatttcccagccgtgcagaagcagaacgacgtccaccgagcctttaagcgagagttgaaaacaaaagagccagtgataatgagtactctggagaccgtccggatcttcctgaccgaacaaccactggagggactggagaagctataccaagaacctagggagctgccacctgaggagcgcgcccaaaatgttaccagactcttacggaaacaagccgaggaggtgaataccgagtgggaaaagcttaatcttcattccgctgactggcagcgaaagattgatgaaacacttgagagactccgtgaacttcaagaggctaccgatgagttagatctgaagctacgacaggcagaagtcatcaagggcagttggcagcctgtgggggacctcctgatcgatagcctgcaggatcacctggagaaagtaaaggctctacgcggggagatagcccccttgaaagagaatgtgtcccacgtgaacgacctggctagacaacttactactctgggaattcaactgtccccttacaacctgagcaccctagaagatttgaatacccggtggaagttgctccaggtggctgtagaggaccgcgtgcgtcaactgcatgaagctcacagggattttgggcccgcttctcagcacttcctgagcacctctgttcaggggccttgggagagggccatatccccaaataaggtcccctattatattaatcacgagacacaaacaacctgctgggaccaccctaaaatgaccgaactgtaccaaagtctggccgacctcaacaacgtccgattctctgcttatcgcaccgcgatgaaattgcggaggctccagaaggccttgtgcctggacctgctgtctttgagtgccgcgtgcgacgcactcgatcagcataacctcaagcaaaatgaccagccgatggacatcctccaaatcataaactgtcttacaaccatatatgataggctggagcaagaacacaacaatttggtgaacgttccgctgtgcgttgatatgtgtttgaactggctgttaaatgtgtacgacactgggcgcaccggcagaatacgcgtcctgtcctttaagacagggatcatcagcctctgcaaggcgcatctcgaggacaagtatcggtacctgtttaagcaggtggcatcctccaccggtttctgtgaccagcggcggcttggactgctgcttcacgactcgatccagattcccaggcagttgggcgaagtcgcatccttcggtggctccaatatcgaaccaagcgtcagatcttgtttccagttcgccaataacaagccggaaatcgaggctgcgctgttcctggactggatgaggctcgaacctcaaagcatggtctggctgcccgtgctacatagagtcgcggccgccgaaactgccaagcaccaggccaaatgcaacatctgtaaggagtgtcccattatcggcttcaggtaccggagcctgaagcacttcaactacgatatttgccagagttgcttcttttcaggacgagtcgccaaaggccacaagatgcattacccaatggttgagtactgtacaccaaccacatctggggaagacgtgagggattttgccaaagtgctgaaaaacaagttcaggaccaaacggtatttcgccaagcatcctcggatgggctatctgccagtgcagactgtgttggagggtgataatatggagacacccgttacactcatcaatttttggccggtggactctgctcccgcatcatcaccccagctatctcacgatgatacgcacagtcgcatcgaacattatgctagcagactggccgaaatggagaactcaaatggctcatacttgaacgacagcatctctcctaacgagtctatcgatgatgagcacttgctcattcagcattattgtcaaagcttgaatcaggatagccctctcagccagcccaggagccccgctcagatcctgatcagtctggagagcgaggagaggggtgagctggaacggattcttgccgatctagaggaagagaatcgaaatcttcaggccgagtatgacagactgaagcagcagcacgagcataagggccttagtccattgccctcacctcccgaaatgatgccgacgtccccacaatccccaagggacgcagaattgatcgccgaggccaaattacttagacagcataagggcaggctggaggctaggatgcagattctggaggatcacaataagcaactcgaatcccagctacaccgcctgcgacagttgctggagcagcctcaggctgaggcgaaagtgaatggaactactgtgagctccccatctacttcactgcagagatccgattcaagccagcccatgcttctacgtgtggtgggcagccagacgagtgactccatgggagaggaagatttgctctcaccaccccaggatacatccacaggtctggaagaggtcatggaacagttgaacaacagctttccatcctcgcgggggagaaacacgccaggcaaaccaatgagagaggacacaatgtag

SEQ ID NO: 186191 - DNA, 1908 bp, Artificial Sequence
  Description of Artificial Sequence: Synthetic coding sequence
atgcgggagcagctgaagggccacgagacccagaccacctgctgggatcatccgaagatgactgagttgtatcaatcgctggctgacctcaacaacgttagattttccgcataccggacagccatgaaacttcgccgccttcagaaggccttgtgcctggatctactgtccctcagtgcagcttgtgatgctctcgatcagcacaatctgaagcagaacgaccagcccatggacattttacagataataaactgtcttacaacgatatatgataggttggagcaggagcataataacctggtaaatgtcccgttgtgcgtcgatatgtgtctgaattggctgctcaatgtatatgacaccgggcgaactggccggatcagagtactttcattcaaaaccggcatcatttcgctgtgtaaagcgcatctggaggataagtacagatatctgttcaagcaggtagcttcatctaccggcttctgtgatcaacgacgtctgggactcctgctgcacgactcgattcagattcctcggcaactgggtgaagtggcgagctttgggggctctaacatcgagcctagcgtccggagttgctttcagtttgcgaacaacaagcccgagatcgaagcagcactgttcctcgattggatgaggctggagccccagtcaatggtgtggcttcccgtgctgcacagggttgccgctgccgagaccgcaaaacatcaagcgaaatgcaatatttgcaaagagtgtcctatcattggtttccgttacagaagcctgaagcatttcaattatgatatctgtcagtcctgtttcttctccggtcgggtggccaagggtcacaagatgcattaccctatggtggagtactgtaccccgactactagcggcgaggacgtaagagacttcgccaaggtgctgaagaataaattccgcactaagagatactttgctaaacaccccagaatggggtatctccccgtgcagaccgtcctagaaggcgataatatggagacgcctgtgaccctgattaatttctggcccgttgatagcgcaccggcttcaagtcctcagctgtcacacgatgacactcactccaggatcgagcactatgcctcgcgactggctgagatggaaaactccaacggaagttatctgaatgacagtatatctccgaatgaatccatcgatgatgagcacctgctcatacagcactattgccagagtttaaatcaggattcgcctctgtctcagcctagaagtcccgcacaaatactgatttctttagaatccgaggagagaggggagctggagagaattctggccgacctggaggaggagaacaggaacctgcaggccgaatacgatcggcttaaacaacagcacgagcataagggcctgtcgcccctgccttctcctccagaaatgatgcccacatcaccgcagagtccacgtgacgccgagctcattgctgaagctaaattgttgaggcagcataagggcaggctcgaggctcgaatgcagatcctggaagaccataataaacagctggagagccaactgcatcgcttgcggcagctgctcgagcagccacaggccgaagccaaggtaaatggcaccactgtgtcttcaccttccacatctctccagagaagcgacagctcgcagccaatgctcctcagggtggttggctctcagacttctgatagcatgggggaggaagatctactgtcaccaccgcaagatacctcaacgggactggaagaggtgatggaacagctgaataattccttcccctcctctagaggccataacgtaggatcactgtttcatatggcggatgatctgggtcgtgctatggagtccctggtgtcagtcatgaccgacgaggagggagctgagtag

SEQ ID NO: 186192 - DNA, 3732 bp, Artificial Sequence
  Description of Artificial Sequence: Synthetic coding sequence
atgcccagcagcctgatgctggaggtgcccgccctggccgacttcaacagagcctggactgagctcactgattggctgagtttgcttgaccaggtgatcaagtcacagcgggtcatggtcggagaccttgaagacattaacgagatgattatcaaacagaaagctaccatgcaggacctggagcagaggagaccccagctcgaggagctgattacggctgctcaaaatctgaaaaacaaaacaagcaaccaagaggcccgcactataattaccgataggattgagaggatccaaaatcagtgggacgaagtacaggaacacctgcaaaacagacgccaacagctgaacgagatgctcaaggacagtacccagtggctcgaagctaaggaagaggccgaacaagtcctgggacaggccagagctaagttggaatcttggaaggaagggccgtatacagtcgatgcaatccagaaaaagattaccgagacgaagcaactcgcgaaagatctgaggcagtggcaaacaaacgtggacgtggcaaatgacctcgctttgaagctgcttagggattacagtgccgatgacacccggaaagtgcatatgatcaccgaaaacatcaacgcctcttggaggtcaattcacaaacgtgtgtcggaaagagaggcagctctggaagagacacatagactcctgcagcaattccctctagacttggagaagttcctggcctggctcaccgaggcggaaaccacagccaatgtgttacaggacgccactagaaaagagcggctgttggaggactcaaaaggcgttaaggaactcatgaaacagtggcaagacctccagggcgaaatcgaggctcacactgacgtgtaccacaacctggacgagaatagccagaaaatcctcaggtctctagaaggctctgatgatgccgtactgctccagcggagacttgataacatgaactttaaatggagcgagcttcgcaagaagtccctcaacattcgatcccacctcgaggcatcatcagatcagtggaaacgcttgcacctctcgctccaggaactcctagtgtggcttcaacttaaagacgacgaactcagtcgacaggcgccaattggaggcgacttccccgccgtgcagaagcagaacgacgtgcaccgcgcatttaagcgcgaactgaaaacaaaggagcctgtgattatgagtacactggagacagtgagaatcttcttaacagagcagcctctcgagggactggagaagctctatcaggagcccagggagctgccccctgaagagagggcacagaatgtcacgcggctcctacgaaaacaggcagaggaagtgaatacagagtgggaaaagttgaacctgcacagtgctgactggcagagaaaaatagatgaaacccttgagagactgagggagttgcaagaggccaccgacgaactggacctgaagttgcgtcaagccgaggtgattaagggctcctggcagcccgtcggcgatttacttatagactcactccaggaccacctggagaaggtgaaagctctgcgtggcgaaatcgccccattgaaagagaacgtctcacacgtcaatgacttggcccgtcagctgacgacactggggattcagttgagcccatataacctgtccaccctcgaagacctcaataccaggtggaagctgctacaagttgcagttgaggatagagtccggcaactgcacgaggcccaccgagattttggccccgcgtcccaacatttcctgtcgacctccgtgcagggcccatgggagcgggcgattagcccgaataaggtaccgtactatatcaaccatgaaacccagactacgtgctgggatcaccctaagatgaccgaactttaccagtccctcgccgacctgaataacgtcaggttttctgcctacagaaccgcaatgaagctaaggcgcctccagaaagctttatgcctggacttgttatccctcagtgccgcgtgtgacgcactcgaccagcacaacctaaagcagaatgaccagcctatggacatcctccagattatcaactgtctgactaccatttatgaccggctcgagcaggagcacaataacctggtgaatgtgcccctgtgcgtcgatatgtgcctgaattggctgcttaacgtgtacgacacagggagaaccggtcgcatccgagtgctttctttcaagacaggcatcatttccctgtgcaaggcacacttggaggataagtaccgatacctgttcaaacaagtcgcatcatccacaggtttttgtgatcagagaagacttggtctcttactccacgattctattcagatacctcgacagttaggcgaggtggcaagcttcggaggaagcaacatcgagccctccgtgcggtcttgttttcaatttgcgaacaataagcccgagatcgaggctgctctcttcttggattggatgagacttgagccgcaaagcatggtctggctacctgtcttgcatagagtggctgctgccgagaccgcaaagcaccaggcaaagtgcaatatctgtaaggagtgccctatcatcgggttccggtaccgaagcctcaaacacttcaactatgacatctgtcagagttgctttttcagtggtcgcgtagctaaggggcacaagatgcattatcctatggtggagtattgcaccccaaccacctccggagaagacgtccgagacttcgccaaagttcttaagaataaattccgaaccaaaagatactttgccaagcatcctcgcatggggtacttgcccgtccagacggtcctagagggagataatatggaaacccccgtcacccttataaacttttggccggtggattcagcccccgcctcctctccacagctgtcacacgacgatactcattctagaatcgaacattatgcctctcgactcgcagagatggagaactctaatggcagttatctgaacgactccatctctcccaacgagagcatcgacgatgaacatctgctgatccaacactattgccagagtctgaaccaagacagccctttgtcccaacctcggtctcccgcccagatacttatctctctcgagtccgaggaaaggggcgaactcgaaagaatcctggcggacttggaggaagagaaccgaaatctgcaggcggagtacgaccggcttaaacagcagcatgaacataaagggctgagtcccctgccctctcctcctgaaatgatgcccacttcgcctcaatctccgagagacgccgagttgatcgccgaggctaagctgcttcgtcagcacaagggtcgcctggaagccaggatgcagatcctggaagaccataataagcaactggagtcgcaacttcatcggctcagacagttattagagcagccacaagctgaggccaaggtgaatggaacaacagtctctagcccctcaacatcgcttcagagatcagacagcagtcagccaatgttgcttcgcgtagtaggttctcaaacatcagattctatgggagaggaggatttgctctctccacctcaggacactagcactggattggaggaggtgatggaacagcttaacaacagcttcccgtcaagccggggtcataatgtcggatcactgtttcatatggccgacgacctcggacgcgccatggagagcctcgtgtctgtcatgaccgacgaagaaggagcggagtag

SEQ ID NO: 186193 - DNA, 11034 bp, Artificial Sequence
  Description of Artificial Sequence: Synthetic coding sequence
atcctggacgagcgggaggacgtgcagaagaagaccttcaccaagtgggttaacgcgcagtttagtaaatttgggaagcagcacatcgagaatctgttctctgatctgcaagatgggcggcgactcttggatctgttagaaggcctgactggtcaaaagctgcctaaagagaaagggtcgactagggttcacgcccttaacaacgtcaataaggctctgcgggtgctccagaacaacaatgttgatctggtgaatattgggagcacagatatagtggatggcaaccacaaactgaccttgggactcatctggaacatcattcttcattggcaggtcaagaatgtgatgaaaaacatcatggctggcctgcagcagaccaactcagagaaaattttactgtcttgggtcaggcagtccactcggaattacccccaggtgaatgtgataaactttacaacgagctggagcgatgggttggcacttaatgcactcattcactcccaccgtccagacttattcgactggaattccgtggtgtgtcagcagtccgccactcaacgactggaacatgctttcaacatcgcccgttaccaactcggcatagagaaattgctggacccagaagacgtcgataccacttaccctgacaagaagtctattctaatgtacatcacaagtctgttccaagtcctccctcaacaggtgtctatcgaggctatccaggaagtagagatgctgcctcgccccccaaaggtcaccaaggaagagcatttccagctccatcatcaaatgcactatagccagcaaatcacagtctctttggcgcagggctacgaacgtacgtcttcccctaaaccgcgctttaaatcatacgcatatacccaggctgcctatgtgaccacctcagatccaacacggtcccctttcccctcacagcacctcgaggcacccgaagataaaagctttggcagttccctcatggagtccgaagtgaacctggatcggtaccagaccgcattggaggaggtcttaagttggctgctgagcgccgaggatacgcttcaggcacagggcgagataagtaacgacgtcgaggtagtgaaggaccagttccacacacatgagggctatatgatggatctgaccgctcaccagggccgtgtaggcaacatcctccaacttggaagcaagcttatcgggactggaaaactctccgaggatgaggagaccgaagtgcaagagcagatgaatctgctcaattcacgctgggaatgcctcagggtggcgtcgatggagaaacagtccaatctgcaccgggtgctgatggatctgcaaaatcaaaagttgaaggagctgaacgactggctgaccaagaccgaagaacgaactcggaagatggaggaggagccgttgggacccgaccttgaagatctgaagagacaagtccagcagcacaaagtgctccaagaagacctggaacaggaacaggtgagggtaaacagcctcacacacatggttgtggtggtggacgaaagcagtggcgaccacgcaaccgcagcactggaggagcagctgaaagtgctgggcgacaggtgggccaatatctgcagatggactgaggatagatgggttctcctgcaggacatcctgctgaagtggcagaggctgaccgaggagcagtgcctcttcagcgcctggctgtcagaaaaggaagacgccgtcaacaaaatacatacaacgggctttaaggatcaaaacgaaatgctatcctcgctgcagaagctggccgtcctgaaggctgacctggaaaagaaaaagcagagtatggggaaattatactccctcaagcaggaccttcttagcactctaaagaacaagagcgtaacccagaaaacggaagcatggctcgataactttgcccggtgctgggacaacttagttcagaaattggagaagtctactgctcagatctcccaggctgtgacgactacgcaaccgagcctcacacaaacaaccgtcatggagacagttacaaccgtgacaactcgggagcagattctggtcaagcacgcgcaggaagagctgcctccgcctcccccacagaaaaaacgacaaattacagtggactcagaaatacgcaaaagactggacgtggatatcaccgaactacactcctggatcaccaggtctgaagcagtactccagtcccctgaatttgctatctttagaaaggagggcaatttcagcgatttaaaggagaaagtgaacgcgatcgagcgggagaaggccgagaaatttagaaagctccaggacgcctctcgcagcgcccaggcactagtagagcaaatggtcaacgagggcgtgaatgcagactctataaagcaggcctctgaacagttgaattctcggtggattgagttttgtcagctactgtcagagagactaaactggttggagtatcagaacaatattatcgctttctacaatcagctgcaacagctcgagcagatgaccaccacagctgaaaactggctaaagattcagcccacaaccccaagcgaaccaacagctattaaaagtcaacttaagatatgtaaggacgaagtgaataggctaagcgacctgcagcctcagattgagagactcaagattcagagcatcgcattaaaggaaaagggacagggccctatgttcctcgacgccgactttgttgcattcactaaccactttaaacaggtgttttccgatgtgcaggcccgggaaaaagagcttcaaactatcttcgacactctgcctcccatgcggtaccaggagaccatgtctgccattagaacgtgggtgcagcagtccgagactaagctgtcaattcctcaactgtcggtgaccgattacgagatcatggagcagcgcctgggggaactccaggcccttcagtcgtcactgcaagaacaacagagcgggttgtattacttgagtacaacagtcaaggaaatgtccaaaaaggccccttccgagataagtcgaaaataccaaagcgagttcgaggagatcgaagggcgctggaagaaattaagctctcagcttgtggaacattgccagaaactggaagaacagatgaacaaactgagaaagatccagaaccatatacagacactgaagaagtggatggctgaggtcgacgttttcctcaaggaggagtggcctgcgctcggagatagtgagatcctgaagaaacagctgaagcagtgtcgactgctggtgtcggacatccagaccattcagcctagtctgaactctgtcaatgaaggcggtcagaagattaaaaacgaagccgagcccgaattcgctagtcgactggagaccgagctaaaggaactgaatactcagtgggaccacatgtgtcaacaagtttacgctcgaaaggaagccctgaaaggtgggctggaaaaaactgtctcactgcagaaagacctgagcgagatgcacgaatggatgactcaggctgaggaagaatacctggagcgcgattttgagtacaagacccccgacgaactgcagaaagctgtcgaagagatgaagagagcaaaggaggaggcacagcagaaagaagccaaggtaaaactgttgacagagagtgtcaactcagtgatcgcacaggctccccctgtcgcccaagaggctttaaagaaggagttggagaccctgaccaccaactatcagtggctatgtactcgcctgaacggaaagtgtaagactcttgaagaggtctgggcctgctggcatgagcttctctcttacctggaaaaagccaataaatggctcaatgaagtcgagttcaaactaaaaacaaccgaaaacattccagggggagccgaggagattagcgaggtcctggacagtctggagaatctcatgcggcactccgaggacaaccctaaccagatacggatcttggcccaaacccttaccgatggcggagtgatggacgagctaatcaatgaggaactggaaacatttaacagccgatggcgcgagcttcacgaggaagcggttaggcgacagaagctccttgagcagtctatccagagcgctcaggagaccgaaaagtcattacatcttattcaggagagtttaaccttcatagataaacaactggccgcgtacatagccgacaaagtggacgctgctcaaatgccccaagaggcacagaaaatccagagtgacctcacgtctcatgagatttctctcgaggagatgaagaaacacaaccaggggaaagaagcagcccaacgcgtcctgtctcagattgacgtggcacagaaaaagttgcaagacgtcagcatgaagttccgattgtttcaaaagcccgcaaacttcgagcagcgactccaggaatccaagatgatactggatgaggtcaaaatgcacttacccgctctggaaactaagtctgttgagcaagaggtggtgcagagccaactgaaccattgcgtgaatctatacaagtcactatctgaggtcaagtccgaagttgagatggtgatcaaaactggcaggcaaatagtgcagaagaaacagactgagaatccgaaggagttggatgagagggtgaccgccctcaaactccattataacgagctgggagccaaagtaactgaaagaaagcaacagctagagaagtgcctaaagctctctaggaagatgagaaaggagatgaacgtacttactgagtggctggcagcaacagacatggagcttactaagaggagtgcagttgagggcatgccaagcaatctcgacagtgaggtggcctgggggaaggctacgcagaaggaaattgaaaaacaaaaagttcacctgaaatctatcacagaggtcggagaggcactaaaaaccgtcctagggaagaaggagacacttgtcgaagacaaattgagcctgttgaattccaattggatcgcagtgacaagtagggccgaggagtggcttaacctcctgctggaataccagaagcacatggagacattcgaccagaatgttgaccacattaccaaatggattatccaggcagataccctgctggacgaatcagagaaaaagaagccccaacagaaagaagatgttctgaaacgtctcaaagcagaacttaacgacatcaggcccaaagtcgactcaacccgggatcaagctgcaaatttaatggctaaccggggcgatcactgtaggaagctagtggagcctcagatctcagagctgaaccaccgctttgcagccattagtcacagaattaaaactgggaaagcgtccattccgctaaaagagctggaacagttcaacagcgatatacagaaattacttgaacccctggaggctgagatccagcaaggtgttaatctgaaagaggaggacttcaacaaagacatgaacgaagataacgagggaactgtgaaagagctcctgcaacggggtgacaatctgcagcagagaattactgatgaacgcaagagagaggagattaaaatcaagcagcagttactgcaaacaaagcataatgctctgaaagatttgcgcagtcagcgacgcaaaaaagcactagagatatcgcatcagtggtaccaatacaaacgtcaagctgatgacctgctgaaatgcctggacgacatagaaaaaaaacttgcatctctcccagagccccgtgacgaacggaaaataaaggagatcgacagagagcttcagaaaaaaaaggaagagttaaacgcagtgaggcgccaggctgagggcttatcggaagatggagccgccatggccgtggagccaacacaaattcagctctccaagcgatggagagaaatcgagagcaagttcgctcaatttaggcggctgaatttcgcacagatccataccgtgcgggaagaaacgatgatggtcatgactgaagacatgccgctggagatctcatacgtgccatcgacatatctcactgaaatcacacacgttagtcaagccctactcgaggttgaacagctgctgaatgcccctgacctgtgtgcaaaggattttgaggacctattcaagcaagaggaatctctcaaaaatataaaggattccttgcagcagtcctctggtagaattgatatcatccatagtaaaaagaccgcagcactgcagtccgctacacccgttgagagggtcaaactacaggaagccctgagccaactggactttcagtgggagaaagtgaacaagatgtataaggatcggcagggaaggttcgaccgcagtgtggagaaatggcgccgcttccactacgatatcaagatcttcaaccagtggctgacggaagccgaacaattcttgcggaagacacagattcccgagaactgggagcacgctaaatataagtggtacctgaaagagctccaggatgggatcggccaaaggcagacggtggtccggacccttaacgccaccggcgaggagataatccagcagtcttctaagacagacgcctccatcctacaagaaaagctggggtccctcaacctccgctggcaggaagtgtgcaagcagttgtctgacaggaagaaacggctcgaggagcagaaaaacattctgtctgaattccagcgcgatctcaacgagtttgtattgtggctagaggaggctgacaatattgccagcattccattggagccaggaaaagagcagcagctaaaggagaagctggagcaggtcaaattgcttgtcgaggagctcccactccggcagggaatcttaaaacagctcaatgaaacaggagggccagtgttggtctcagcccccattagtccagaagagcaagacaagctcgaaaataagctcaagcagactaatctgcaatggatcaaggtgtctcgagctctgcctgagaagcagggcgaaatagaagcccagatcaaagatttaggccagctggagaaaaaattagaggacctggaagagcagctaaaccatctgttactgtggctgtctcccataagaaatcagctggagatctataaccaaccgaatcaggagggaccttttgacgtcaaagagacggagattgccgtacaggcaaagcaaccagacgtggaagagatccttagtaaagggcaacacctctataaggaaaagcctgcgacacagcctgtgaaaaggaagctggaagacctctccagcgaatggaaagcagtgaaccgattgctgcaggagttacgagccaaacaacccgacttagcccccgggttaactaccataggggccagcccaacacaaacagtgacgctcgtgacacagccagtagtaaccaaggaaaccgccatctcgaaactggagatgccctctagtctcatgttggaagtgcccgctctggctgatttcaatcgcgcctggactgaactaaccgattggttatccttactcgaccaagttataaagagccagagggtcatggtcggagatttggaggatattaatgagatgatcatcaagcagaaagctacgatgcaggatctagaacagcgtagaccacagctcgaagagctgatcactgctgcccagaatctaaagaataagacatcaaatcaggaagccaggactatcatcaccgaccgaatcgagcgcatacagaatcagtgggatgaggtccaagagcacttgcagaatagaaggcaacagttgaacgaaatgctgaaagactccacccagtggctggaagcgaaagaggaggctgaacaggtgttgggccaggctcgcgcaaagctcgaatcttggaaagagggaccttacacggtggatgcaatccagaaaaagatcaccgaaactaagcagctggcgaaggatttgcgccagtggcaaacgaatgtagacgtggccaatgacctcgctcttaagctcttgcgcgactactcagccgacgacactcggaaagtgcacatgattactgagaacattaatgcttcatggagatccattcacaagcgagtgagcgagagagaggctgccctggaggagacgcacagactattgcagcagtttcctttggatctggaaaaatttctagcttggttgacagaggccgagactacagccaatgtgctgcaggacgccacacgtaaggagcggttgctcgaagactcaaagggtgtaaaggaacttatgaagcagtggcaggacttgcagggagaaattgaggcccacacagatgtgtatcacaacttagacgaaaacagtcagaagatcctacggtccttagaagggagtgacgatgctgtgctgttgcagcgtcgcctcgataacatgaattttaagtggtccgagcttcgtaagaagtccctcaacatccggtcccatcttgaagcctcctccgatcagtggaagagactgcatctcagcctgcaagagctcttagtatggctgcagctgaaggacgatgaactgagtcggcaggcccccatcggaggagacttccccgccgtccagaaacagaacgatgtgcacagggccttcaaaagagagctcaaaactaaagagcctgtgatcatgtcaaccctcgagacagtgaggattttcctgaccgagcagcctttggagggcctggagaagttgtaccaggaaccacgggagctcccccccgaagaacgcgcccagaacgttactcgcctgctgcgtaaacaggctgaagaggtgaacacagagtgggagaagctgaacctacactccgctgactggcaacggaaaatcgacgaaactctggaacggctccgggaactacaggaagctaccgacgaactagatcttaagctccggcaggctgaggtgatcaagggctcctggcaaccagtgggagatctgcttatcgatagcctgcaggaccacctggagaaagtcaaagccctccggggcgaaattgccccccttaaggaaaatgtctcacacgtgaacgatctggcccggcagctgacaactctgggcattcagctttctccgtacaacctgtccactttggaggatctcaacacccgttggaagctgctgcaggtggccgtggaggaccgggtgcggcagttgcacgaggctcaccgtgatttcggacccgcgagtcagcactttctttcgaccagtgtgcaggggccatgggagcgggccatctctccgaataaagtaccatattacataaatcatgaaacccaaacaacttgctgggatcacccgaaaatgaccgaattgtatcagtctctggcagatttgaataacgtgaggttttccgcttatagaactgctatgaaattgcgaaggctccagaaggcactctgtcttgacctgctgtccctctctgcagcttgtgatgctctcgatcagcataacttgaagcagaacgatcagcccatggacatcctgcagataatcaactgcctgaccactatctacgaccggctggaacaagaacacaacaatctcgtcaatgtccctctgtgcgtcgacatgtgcctaaactggctgctcaatgtctacgatacaggtagaacaggtaggattcgagtcctgagcttcaagacagggatcattagcttgtgtaaagcgcacctggaggacaaatatcgttatctcttcaaacaagtggcttcatccaccggcttctgcgatcagagacgccttgggctgttgctgcacgatagtatacagatacccagacagctgggagaggtcgcaagcttcggcggatcaaatatcgagcccagcgtgagatcttgcttccaatttgccaataacaagccggagattgaagccgccctgtttcttgattggatgaggctggagccgcaatccatggtgtggctaccagtgttgcatagagtggctgccgctgagacagccaagcatcaagccaagtgtaatatttgcaaggagtgtccaattatcggcttccgctatagaagcctcaagcacttcaactatgatatctgtcagtcatgtttctttagcggccgggtggccaagggccacaaaatgcattaccccatggttgagtactgcactcccacaacatcaggggaggacgtgcgggatttcgccaaagttctgaagaacaaattcaggaccaaaagatactttgctaaacacccaagaatgggatacctgcccgtgcaaactgtattggaaggtgataatatggagacgcctgtcaccttaattaacttctggccagtcgattcagccccagccagctctccccagttatcacacgacgacactcactcccgaattgagcattacgcttccaggctggccgaaatggaaaactcaaatgggtcatatctaaatgatagtatctcgcctaatgaaagtatagacgacgagcacttgttgatccaacactactgccagtccctaaatcaggattctccactgtctcagcctcgaagccccgcacagattttgataagcctggaaagtgaagaaaggggagagctagaacgcatcttggctgacctcgaggaggagaaccgcaacctgcaagcggagtacgaccggctcaaacagcagcatgaacataaaggtctttcccctttaccttctccgcctgagatgatgcctacgagtccacagagccctcgagacgccgagcttattgccgaggctaagctactcagacaacacaaaggccgcctggaagcgcgcatgcaaatactcgaggatcataacaaacagctggagtcccagttacaccgacttcgccagctgctagagcagccccaggctgaagccaaggtcaatgggaccaccgtatcttctccctctacctcgttacagcggtctgactccagccagcctatgttgttgcgagttgtgggtagccaaaccagcgactcgatgggggaagaagacctgctgagtccaccacaggatacgagtacagggcttgaagaggttatggagcagctgaataacagttttccatcttctagaggtaggaacacaccaggcaaaccaatgcgagaggatactccctag

SEQ ID NO: 186194 - DNA, 10689 bp, Artificial Sequence
  Description of Artificial Sequence: Synthetic coding sequence
atgaagaacatcatggccggcctgcagcagaccaacagcgagaagattctcctgagctgggttagacaaagcactagaaactatcctcaggtcaacgtgattaacttcactacctcctggagcgatggccttgccttgaatgccttgatccattcacatagaccggatctcttcgattggaattcagtggtatgccagcaatcagcgacacagcgcctcgagcacgcattcaacatcgccaggtaccagctcggcatcgagaagctgctcgaccctgaggatgtggataccacttaccctgacaagaagagtatccttatgtacatcacgagtttgtttcaggtcctccctcagcaggtgtccattgaggccatccaggaagtagaaatgctgcccaggccacccaaggtcaccaaggaagagcactttcagctgcatcaccagatgcactacagccaacagatcaccgtgtcccttgcccagggttatgagcgtacatcgagccctaaacccaggtttaagagttatgcctatacccaggctgcttatgtgaccacgtcggacccaacccgatctccattcccctctcagcacctggaagcacccgaagacaagagtttcggaagttccttgatggaatccgaggttaacctcgaccgctaccagactgctctggaggaggtactgagctggctgttaagtgctgaagataccctacaggcccagggcgagatctcgaatgacgtcgaagttgttaaggatcaattccatacccacgagggatatatgatggatttgaccgcgcatcaggggagagtggggaatatcctgcagctcggatctaaattgattgggacaggcaagttgtcagaagatgaagagactgaggtgcaggagcagatgaatctcctgaatagtcgatgggagtgtctacgcgtggccagtatggagaaacagagtaatctgcacagggtgctgatggatctccaaaatcagaagctgaaggaattgaacgactggctaaccaagacagaggagaggacacgaaaaatggaggaggaaccccttgggccagacctggaggatcttaaacgacaagtgcagcagcacaaagtgctgcaagaagatcttgagcaggagcaagtcagagttaactcccttactcacatggtggttgtagtggatgagtcatctggtgatcacgctaccgcggccctggaggagcagcttaaagtacttggggaccgatgggctaacatatgcaggtggaccgaggatcgatgggtgttgctgcaagacatcttgcttaagtggcagcggcttacagaagaacagtgtctgttctcggcctggttatcagaaaaagaagatgctgttaataaaatacacaccacaggatttaaggaccaaaatgaaatgctgagttctctgcagaagcttgcggtgttgaaggcagatttagagaaaaagaaacagagcatggggaaactttatagcttgaaacaggacctactgagtaccctgaaaaataaaagcgtgacgcagaagacagaagcgtggctcgacaattttgcccggtgctgggacaacttagtgcagaagttggaaaagagtacagctcagattagccaggccgtgactacaacccaacctagcctcactcagacaacagtaatggaaaccgtgacgactgtgacaacaagggagcaaatcctggttaaacatgcgcaggaggagctgcctcctccgcctccccagaaaaagcgccagatcactgttgattctgaaattcgaaagcgtttagacgtcgacataaccgagctgcactcatggatcacgagaagcgaagctgtcctccagtcgccagagttcgctattttcagaaaagagggtaattttagtgacttaaaggaaaaagtcaacgcgatagagcgggagaaagcagaaaagtttagaaagctgcaggacgctagtcgctctgctcaggccctggtggaacagatggtgaacgagggtgtcaatgctgattcgatcaaacaggctagcgaacaacttaactccaggtggattgagttctgtcagctacttagcgagcgactgaattggttggagtaccagaataatatcatagctttttataatcaattacagcaactggagcagatgacaacaaccgcagaaaattggctgaagatccagcctacaactccctctgagccaacagcgatcaagtcccaactgaagatctgtaaggacgaggtgaaccgcctttccgatctacagcctcagattgagcggctgaagattcagtccatagctcttaaggaaaaggggcaaggccccatgttcctcgatgcagatttcgtcgcatttactaatcactttaagcaagtcttcagtgacgtccaggcacgtgagaaagagttgcaaaccattttcgacactttaccacccatgcggtatcaggaaactatgtccgctatcagaacctgggtgcagcagagcgagaccaagctgtcaattccgcagttaagcgtgacagactacgaaatcatggaacagcggctcggagaactccaggccctgcagtcctctctgcaggaacagcagtccggattatattatttatccacaacagtaaaggagatgagcaaaaaggctccctctgaaatatcacggaagtaccaatctgagttcgaggaaattgagggccggtggaagaaactgagttctcaactcgtcgaacattgccagaagcttgaggaacaaatgaataaactacgcaagatacagaaccacattcagaccctgaaaaaatggatggccgaggtggatgtgttcttgaaagaagagtggcctgcccttggggacagcgagattcttaaaaagcaactgaaacagtgtagattgttagtgagtgatatacagacaatccagccatctctgaattccgttaacgagggtggccagaagattaaaaacgaggcagagcctgaattcgcatctaggctagaaactgagctcaaagaactcaatacacagtgggatcatatgtgtcaacaggtttatgcccgcaaagaggctctcaaaggcggcctggagaaaactgtgtcgctccaaaaggacttatccgaaatgcacgagtggatgacacaggccgaggaggagtacctggaacgtgatttcgagtacaaaaccccggacgagctccagaaagccgtcgaggaaatgaagagagccaaggaggaagctcaacagaaagaagccaaggtgaaactgctgactgaaagcgtgaattcagtaatagcccaagcccctcccgtggctcaggaggctctcaaaaaggagctggaaaccctcacaaccaactatcaatggctctgtactcgtctgaatggaaagtgtaaaacccttgaggaggtatgggcttgttggcacgagctactgagctacttggagaaagcaaacaagtggctcaatgaggtggaattcaaactgaagaccacggagaacattcccggaggtgccgaggaaatttcagaggttcttgacagtctggaaaacttgatgaggcacagtgaggacaacccgaaccagattcggatcctggcacagaccctgacagacgggggagtgatggacgagctgatcaacgaggagctggaaacctttaattcaaggtggagagaactgcacgaggaagcagttaggcggcaaaagcttcttgagcaatccatccaatcagcccaggagacggaaaaatcactgcatttgatacaggagtccctgaccttcatcgataagcaattggccgcgtatatcgcggacaaagtggacgcagctcagatgccacaggaagcacagaaaatccagagcgacctcacgagccacgagatttctcttgaagagatgaaaaaacataaccagggtaaggaggctgcacaaagagtcttgtcacaaatagatgtcgcacaaaaaaaattacaagacgtaagtatgaaattcaggttgttccaaaagccagctaacttcgaacagaggttacaggagtccaaaatgatacttgacgaggtcaaaatgcatctgcccgctcttgaaacaaaatcagtggagcaggaggtcgttcagagtcagcttaaccattgcgtgaacctctataaaagcctctctgaggtgaagagcgaggtagagatggtcatcaagaccggacggcagatcgtccaaaaaaaacaaacagagaatcccaaagagctggacgagagggtgactgctctgaaactgcattacaatgaactgggagctaaagttactgaaaggaaacagcagttagaaaagtgcttgaagttgagtaggaagatgagaaaggagatgaacgtcctgacagagtggctggctgcaaccgacatggagctgacaaagagatccgcagttgagggcatgcccagtaatctggactctgaagtcgcctggggaaaggcaacacaaaaagaaatagagaaacagaaagtacatctgaagagtataactgaagtaggagaagcactgaagacagtactgggaaagaaggagactctcgttgaggacaaactgtctctgctcaatagcaactggattgctgtgacatccagggccgaggagtggttgaatctcctgctcgagtaccagaagcatatggaaacctttgaccagaatgttgaccatatcaccaagtggatcatccaagcagatacgctgctcgacgaaagcgagaaaaagaaaccccaacaaaaggaagatgttttaaaaagactaaaggcagaactgaatgatattcgcccaaaagttgatagcaccagagatcaggctgcaaacttgatggcaaatagaggcgaccactgtagaaagttagtagaaccacagataagcgagctgaaccaccgtttcgccgctattagccaccggatcaagaccggcaaggcctccattccactgaaagagttagagcagttcaattccgatatccagaagctgctggagcccctcgaagccgaaatacagcaaggagtaaacctgaaagaggaagactttaacaaagatatgaacgaagataatgaagggaccgtcaaggagttattgcagaggggcgacaaccttcagcagcggatcacagatgaaaggaagagagaagagatcaaaatcaaacaacagctccttcagaccaagcacaatgcgctcaaagaccttaggtcccagcggagaaaaaaggctctggagataagccaccaatggtaccagtacaagagacaggcagatgatcttctaaaatgtctcgatgacattgagaagaagctggcatctctgcctgaaccgcgagatgagcggaaaatcaaggaaatcgatagggaactgcagaaaaagaaggaagaactgaacgcggtccgccggcaggctgaagggctaagtgaagacggggcagccatggccgttgagccaacacaaattcaactgtcaaaacgatggcgagagatagaatctaaattcgctcagtttaggagacttaattttgcacaaattcacaccgttcgcgaggagactatgatggtgatgaccgaggacatgccgctggagatctcctacgtgcctagtacttatctgactgagatcactcacgtttctcaggcactgctggaagttgagcagctccttaacgcacccgatctgtgtgcgaaggattttgaagatctgtttaaacaggaagaatccctgaagaatataaaggattctctacagcaatcctccggtcgcatcgacatcatccactcaaagaagaccgccgccttgcagtccgctaccccggtggaacgcgtgaaactccaggaagctctatcacagttggacttccagtgggagaaggtgaacaagatgtataaggaccgtcagggacgctttgaccggtcagtggagaaatggcgcaggtttcactacgatattaagatattcaaccagtggcttacggaagctgaacagttcttgaggaaaactcagatacccgaaaactgggaacacgcaaaatacaagtggtacctaatagcactcaaagatggaatcggccaaagacaaactgtcgtgcgaacgttaaacgccaccggggaggagataatccagcagtcaagcaaaactgatgcctccatcctgcaagaaaaactgggtagtctgaatctccgctggcaggaagtgtgtaagcagctgtccgataggaagaagagactagaggagcagaagaatattctctcagaattccagcgcgatctgaacgaattcgttctgtggctggaggaggcagataatatcgcttccataccactggagcccggcaaggagcagcagctaaaggagaaactggagcaggtcaagctgttggtggaggaactccctctgcgacagggaattctgaagcaactcaacgaaacgggtggcccagtgctggtcagtgctcccatctcacccgaagagcaggacaagctggagaataaactcaagcagaccaacctgcagtggatcaaggtctcccgtgctctacccgaaaagcagggtgagatcgaggcccaaatcaaagatctgggacaattagaaaagaagcttgaagatcttgaggagcagcttaaccatttgcttctttggctatcaccaattaggaaccagctggagatctataaccaacccaatcaggagggacctttcgatgtgaaggaaaccgaaatcgccgtgcaggcaaaacagcccgatgtggaagaaattttgtcaaagggacagcacctatacaaggagaaaccggccactcagccagtgaaaagaaaactggaggacctttcaagcgaatggaaagctgtaaatcggctgctacaggagctgcgcgcaaaacagcccgatctagcaccaggtctcactaccattggagcatcccccacacagaccgttactttagtaacccagcctgtagtaaccaaggaaaccgcaatctcaaaactggagatgccatccagcctgatgctcgaggtaccagccctggcagatttcaatagggcttggacagagctgactgactggcttagcctgctcgaccaggttatcaaaagccaacgggtgatggtgggagatttagaagatataaatgagatgatcattaaacagaaagcaaccatgcaggacctggagcagcgccggccccaactggaggaactgatcaccgcagcccagaacctgaaaaacaaaactagcaaccaggaggctagaaccatcataacagatcgcatagagaggattcagaatcagtgggatgaggtgcaggagcatctgcagaaccgccggcagcagctcaacgaaatgctcaaagattctacccagtggctagaagccaaagaggaagcagagcaggttctaggacaggctcgcgccaaacttgaatcctggaaagagggcccatatacggtggacgccatccagaaaaagatcacagaaaccaagcagcttgccaaagacctcaggcagtggcaaaccaatgtagacgtggccaacgacctggcactaaagctgcttcgggactacagtgccgatgatactcggaaagtgcatatgataactgagaacatcaatgccagctggcgtagtatccataagagggtgtctgaacgggaggctgccctggaggaaacccatagactgctgcagcagtttcctctcgacctggagaagttcctcgcctggctaactgaagccgagacaaccgctaatgtgctgcaagatgccacacggaaggaacgcctcttggaagattctaagggtgtcaaagaactgatgaagcagtggcaggacttacagggggagatagaagctcatactgatgtctaccacaacctggacgaaaatagccaaaagatcctacggtcactggaaggttcagatgatgccgttcttctccaacgcagattggacaacatgaacttcaaatggagcgagctacggaagaagtccctcaacattaggagtcacttggaggcgtccagcgatcagtggaaacgccttcatctgtccctccaggagttgcttgtgtggctacagctgaaagacgacgaactctcgcgccaggctccaattggcggggacttccccgcggtgcagaaacagaatgatgtccatagagcatttaaaagggaactaaagaccaaagaaccagtgattatgagcaccctggagacagttcgcattttcctgaccgagcagccgctggaaggtctggaaaagctgtaccaggaacctagggaactcccccctgaggagcgcgcacagaacgtgacaaggctcctcaggaaacaagctgaggaagtgaacacagagtgggagaaactaaacctgcattctgctgactggcagcgcaagatcgacgagacactggaacggttacgggagcttcaggaggccactgacgagttagatcttaagctgcgccaggccgaggttataaaggggtcttggcaaccagtgggcgacctgctgatcgatagtctccaagatcacttggagaaggtgaaggctctgcggggggaaatcgccccactgaaggagaacgtctcccacgttaatgacttggcaagacagctgacaactctgggaattcagctctcaccatataatctaagcacactggaggacctgaatacacggtggaagctgctccaagtggcggtagaagaccgtgttaggcaactacacgaggcccacagagatttcggacccgcgagccaacattttctgagcacgtcagtgcaggggccctgggaacgagcaatatctccaaacaaagtgccctactacattaaccacgaaacacagacaacgtgctgggatcatcccaagatgacggagctgtaccagagcttagcggacctgaacaatgtccgattttcagcatatcgcacagcaatgaagttgaggagactccaaaaagcgctgtgtctggatctgttgtcactgagtgctgcttgtgacgcccttgatcaacacaatctgaaacagaatgatcagccaatggatattctccagatcattaattgtctgaccaccatctatgaccgtctggagcaggagcacaacaatctggtgaatgtacctttgtgtgtggacatgtgtctcaattggttattgaacgtttacgacactggccgcaccggtagaattagagtgctcagtttcaagaccggcattatttctctttgcaaagcccatttagaagataagtacaggtatctgtttaaacaggtggcatcctcaacaggcttctgtgaccagcgaaggttggggttgctgctccacgatagtatccaaattccccggcaactcggggaggtggcctcgttcggcgggtcgaacattgagccatcagttcgaagttgcttccagtttgctaacaataagcccgagatagaggccgccttattcctggactggatgcgcctcgaaccccagtccatggtgtggctgccggtactgcacagagtagcagccgctgagacagctaaacaccaggctaagtgtaatatatgtaaagaatgccccataatcggtttcagatataggtctcttaaacattttaactacgacatctgccagtcctgttttttttccggtcgagtggcgaaagggcataagatgcattatcctatggtcgaatattgtacgccaactactagcggtgaggatgtgcgtgatttcgctaaggtccttaagaataagttccggaccaagcgctatttcgccaagcatccacggatggggtacctgccggttcagaccgtgctcgaaggagacaacatggaaactcccgtgactcttatcaacttctggccagtcgactcagcacctgcaagctcacctcagctctcccacgacgacacacatagccggatcgagcactatgcgtctaggcttgctgagatggagaatagcaacgggtcgtatctgaacgactctatttccccgaacgagagcatagatgatgaacacctactcattcagcactactgccagtctcttaatcaggactccccgctgtcccaaccgcggagccctgcccagattttgatatccctggagtcggaagagcgcggagagctggaacgaattttggcggaccttgaagaagaaaaccgcaacctccaggctgagtatgaccgtttgaagcagcaacacgaacacaaggggctcagccccttaccctctcctccagaaatgatgccaaccagtcctcagtccccacgggatgccgagctgattgccgaggctaagttgctgaggcaacataagggaagactggaagcccggatgcaaattttagaagatcacaacaagcagttggagtctcaactacatcgactcagacaattgttagaacagccacaggccgaagccaaggtgaacgggaccaccgtgagctcccccagtacatctctgcaacggtctgacagctcccagcccatgctcctccgagtcgtgggtagccaaacatccgactcaatgggtgaggaagacctgttgtcgcctccccaggacaccagtacaggcttagaagaggttatggagcaactgaataactcatttccttccagtcggggtagaaacacaccagggaagcctatgagggaagacaccatgtag

SEQ ID NO: 186195 - DNA, 3348 bp, Artificial Sequence
  Description of Artificial Sequence: Synthetic coding sequence
atgcccagcagcctgatgctggaggtgcccgccctggccgacttcaatcgggcatggacggagctcacggactggctctcgttacttgaccaggtgattaagtcccagcgagtgatggttggagatctggaagacattaacgagatgatcataaaacaaaaggccacaatgcaggatttggaacaaagacgccctcagcttgaagaactgatcaccgctgctcagaatctgaaaaacaagaccagcaaccaggaggcccgaactatcatcaccgacaggatagaaaggatacagaaccagtgggacgaagtgcaggaacatttgcaaaatcgtaggcaacagttgaacgaaatgttgaaagattctacacaatggctcgaggcaaaggaagaggcggaacaagttctgggtcaggcgagagccaagcttgaatcatggaaggaagggccgtatactgtcgatgccattcagaagaaaataacagaaacaaaacaactggcaaaggaccttcggcaatggcagacaaatgtggacgtagccaatgatctagccctgaaattgctaagggattactccgctgatgatacgcgcaaagtacatatgattacagagaatattaatgcatcctggcggagtattcacaagcgcgttagcgagcgcgaagcagcgctggaggagacccaccggctgttgcagcagtttcctctggatcttgagaaatttctcgcctggctgacagaagcggaaacaacagcgaatgtcctgcaggatgcaacccggaaggagagactcctggaagacagcaagggggtgaaagagctgatgaaacagtggcaggaccttcagggagagattgaagcacataccgatgtgtaccataatctggatgaaaactcccaaaaaatcctacgctccctcgaaggatcagatgatgctgtcctgttgcaaaggagactggacaacatgaactttaagtggtctgagctgaggaagaaaagcctgaatattagaagtcacctggaggccagtagcgaccagtggaagcgtctccacctctctctgcaggaacttctggtgtggctgcagctgaaggacgatgaactgtcccggcaggcccctattggaggagacttccctgctgttcagaaacagaacgacgtccacagggcgtttaagcgtgaactgaaaaccaaagagccggtgattatgtccacgctggaaactgtgcgaatcttcctgactgaacagcctttggaaggactggaaaagctgtatcaggaaccaagggagctcccacctgaagagagggcacaaaatgttaccagattactgagaaaacaggcggaggaggttaacacagaatgggaaaagctaaacttgcactcagctgattggcaacgaaaaatcgacgaaactctcgaacggttgcgcgaactgcaggaagccacggacgagcttgatctcaagctgagacaagcagaagtgatcaagggctcttggcagccggtaggagacctcctaatcgatagcttgcaggaccatttagagaaggttaaagcactcagaggggaaattgcgcccctcaaggagaatgtgagtcacgtgaatgatctggcaaggcaactcactaccctgggcattcaactgagcccctataacctatctacactcgaggacctcaacacgcgctggaagctcttgcaagtggccgtggaggacagagtacggcagttgcacgaagcccatagagactttggcccggccagtcagcactttctctccacttccgtacagggaccctgggagagggccatttcaccaaacaaagtcccatactatattaaccacgagactcagactacctgctgggatcatccgaagatgacagagctgtatcaaagcctcgccgacctcaataatgtgcgcttctccgcctatcggacagccatgaagcttaggaggttgcagaaggcactgtgcctggacctcttatcgctgtcagcggcatgtgacgctctggatcagcacaacctgaagcagaatgaccaacccatggacattctgcaaatcattaactgcctgacaaccatttatgatcgacttgagcaggagcataataaccttgttaacgtgcctctgtgcgttgatatgtgtctgaattggctactgaatgtgtacgatacaggtaggactggccgtattagagtcttatctttcaagactggcattattagtctgtgcaaggcacatctcgaggataaatataggtatctgtttaagcaagtagcctctagtactggcttctgcgaccagcggcggctgggtctgctactgcacgactctatccagatcccccgccagctcggcgaagtcgcctccttcggcggaagcaacatcgaaccgtcagttcggtcttgttttcagtttgctaacaacaaacccgaaatagaggccgctctcttcttagattggatgagactggaacctcagagtatggtgtggctccccgtgttgcacagggtggcagccgccgagactgccaagcaccaggccaaatgcaacatatgtaaagagtgtccaatcattgggttccgttataggtcgctgaaacactttaattacgatatttgtcagtcttgcttctttagcgggagggtcgctaagggacacaaaatgcactaccctatggttgagtattgcaccccaactacgtccggagaggatgtgagagacttcgccaaagttcttaagaacaaattccgaacaaagcggtacttcgcaaaacatcccagaatgggctatctgcctgtgcagacagtgctggagggggataacatggagaccaacctgcaggcagaatacgacaggttaaagcagcaacacgaacataaagggctctcacccctcccctccccgcccgaaatgatgcccacatctccacaatctcctagggatgccgaactcattgcggaagccaagctgctgaggcagcacaaagggaggttagaggcccgtatgcaaattttggaagatcacaacaaacagcttgaatctcagctgcatcgccttaggcagctgttggagcagccccaggcggaggcaaaggtcaacgggacaacagtttcttctccttctacatcccttcagcggtcagattcgagtcagccaatgcttcttcgggtcgtgggctcccaaacatcagatagcatgggtgaggaggatttactgtctccaccacaggacacttctacaggactagaagaggtgatggaacagctaaataattcttttcccagttccaggggaagaaatactcccggcaagccaatgagagaggacacgatgtag

SEQ ID NO: 186196 - DNA, 11058 bp, Artificial Sequence
  Description of Artificial Sequence: Synthetic coding sequence
atgctgtggtgggaggaggtggaggactgctacgagcgggaggacgtacagaagaaaacctttacaaaatgggtgaatgcacagttcagcaaatttgggaaacagcacatcgagaacctcttcagtgacctgcaggatggaaggaggctgctggatctccttgagggcttgaccggtcagaaactgccaaaggaaaagggatccacccgggtgcacgccctgaacaacgtgaacaaggccctgcgtgttctgcagaataataatgtggacctggtgaatattggctctacggacatcgtggacggaaatcataagttgactcttgggctcatttggaacatcatcctgcactggcaggtaaagaatgttatgaaaaatatcatggctgggttgcagcaaaccaattcagagaagatcctgctgtcatgggttagacagtcaactcgtaattacccccaggtcaatgtgataaacttcactacttcttggagtgatggcctagctctgaatgctttaatccactcacacaggcctgatctctttgattggaactctgttgtttgccagcaaagcgctacccagcgattagagcacgcttttaacatcgctcgctatcagctcggaatcgaaaagctccttgatccagaggacgtggacactacctaccccgacaagaagtccatcctgatgtacattacctccctcttccaggtgctgccccagcaagtgtcgatcgaggctattcaggaagttgagatgctcccacgtccccctaaggtaaccaaagaggagcatttccagctccaccatcaaatgcattattctcagcagattaccgtgtctcttgctcagggctacgagagaactagctctcccaagcccaggtttaagtcatatgcctacacacaggctgcatacgtcactacgagcgacccgacacgctccccattccccagtcagcacttggaggccccggaggataagtcctttgggtcatccttgatggagtcagaagtgaacctggatcggtaccagacggctctcgaggaggtgctgagctggcttctttctgcagaggacaccctgcaggctcaaggtgaaatttccaatgatgttgaggtggtcaaagatcagtttcacacccacgaaggatacatgatggacctgacagcgcatcaaggacgggttggcaatatattacaactgggctcaaagctgattgggactggaaagctgtccgaggacgaggagaccgaagttcaggagcagatgaatctgctgaacagccgttgggagtgcctaagagttgcctccatggaaaagcaatccaatctgcacagagtgcttatggacctgcaaaaccagaagttgaaagagctcaacgattggttgaccaaaaccgaggagaggacccggaagatggaggaggagccgctgggccccgatctggaggatctcaagagacaagtccagcagcataaagtgctgcaggaggacctggaacaggagcaggttcgagtgaactctttaacccacatggtggttgtggtggatgagagttccggggaccacgcgacagctgctctagaagaacagttaaaagttctgggggacagatgggccaacatctgcaggtggaccgaggatcggtgggtcctcctgcaagacatactcctcaagtggcagaggttaacagaggagcagtgtctttttagcgcctggcttagcgagaaagaagatgctgtgaataagatacacacaactggattcaaagatcagaatgagatgctgtccagtctccagaagctagctgtgctcaaagccgatctcgaaaagaaaaaacagtcaatgggcaaactgtacagtctcaaacaggacctcctctcaaccctgaagaacaagagcgtgactcagaagacagaagcatggcttgataactttgcccggtgctgggataacctggtgcagaaattagaaaaatccacggcacagatatcccaggcagttacaacgacccaaccatccctcactcagaccaccgtcatggagacggttacaaccgtaacaacacgcgagcagatccttgtgaaacacgctcaagaggagctgccacccccaccgccccaaaagaaaaggcagattactgtggactctgaaattaggaagcggcttgacgtggatattacagaattgcatagttggattaccaggtctgaagcagttcttcagtcaccagaattcgctattttccgcaaggagggcaacttctctgacctgaaagaaaaggtcaatgccattgagcgggagaaggcagagaagttcagaaagcttcaggacgcttctcgttctgcacaagccctagtggaacagatggtgaatgaaggtgtgaacgctgatagtatcaagcaagcttctgagcagctcaatagtagatggattgaattttgtcagctcctcagcgagaggctaaattggctggaataccagaataacatcatcgctttctacaaccagcttcaacaacttgaacagatgaccaccacagcggaaaactggctgaaaatccagccaacaacaccaagtgagccaaccgcaataaagtctcagctcaagatttgcaaagacgaggtgaaccggctttccgatctccaacctcaaatcgaacgtttgaagatccaaagcatcgccctcaaagagaagggccagggacctatgtttctggatgctgattttgttgccttcacaaatcatttcaagcaggtcttttcagatgttcaggctagagagaaggaactccaaacaatcttcgatactctgccaccaatgagatatcaggagacaatgtcagcaatacggacatgggttcagcagagcgaaacaaagctctctatcccccagttgtccgtgactgactacgagatcatggagcagagactcggagaactgcaggctctgcagtcttcactccaggaacagcaaagcggactctactacctatccactaccgtcaaggaaatgtctaaaaaggctccatcagaaatctcccgcaagtatcaatcagaattcgaggagatcgaaggcaggtggaaaaagctgagtagtcagctggttgaacattgtcagaagcttgaggaacagatgaataagttgcgaaaaattcagaatcacatacagactctaaagaagtggatggctgaggttgatgtgttcttgaaggaagagtggcccgcccttggcgactccgaaatcctgaaaaagcaactcaagcagtgcaggctgctcgtgtccgatatccagactatccagccgtcgctgaacagtgtaaacgaaggaggacagaaaattaagaacgaagctgaacccgaattcgcgagccgattggagactgaattgaaagaactcaacacccaatgggaccacatgtgccagcaagtgtatgctagaaaagaggctcttaagggagggttagaaaagaccgtatcactgcagaaagatttgagcgagatgcacgaatggatgacccaggccgaggaggagtatctggagcgcgattttgaatacaagacccccgacgagcttcagaaggcagtggaagagatgaagcgagccaaggaggaggcccaacagaaggaggcgaaggtgaaacttctgactgagagcgtgaactctgtgattgcacaagccccaccagtggctcaagaggcgctaaaaaaggagttagaaaccctgaccacaaactatcagtggctgtgcactcgcctgaatggaaaatgcaagacccttgaagaggtgtgggcctgttggcacgaactcctctcctacctggaaaaggccaataagtggctgaatgaagtggaatttaagctcaaaacaacagaaaacattccaggcggcgctgaagagatttcagaggtcctcgactctttggagaatctgatgagacacagtgaggacaatccaaaccagataaggatcctggctcaaacactgacggatggaggtgtaatggacgagctgatcaatgaagagctggagacattcaatagccggtggcgagaactccacgaggaagcggtgagacggcagaagctgttagagcaatcgatacagagcgcacaagaaacggagaaaagcctgcacttaattcaggagagcctcacgtttattgataagcagctcgcagcttacatcgctgataaagtggatgccgcccaaatgccacaggaggctcaaaagattcagtcggatctaacctctcatgaaattagcctggaagaaatgaagaaacacaaccagggcaaggaggccgcacagcgggtgctgagccagattgacgtggctcagaaaaaactgcaggacgtctcaatgaagtttaggttgttccagaaaccagccaacttcgagcagcgcctgcaggagtccaaaatgatcctggatgaggtcaagatgcaccttcccgccttggaaaccaaatctgtagaacaggaggttgtgcagtcacagctgaaccattgcgttaatttgtacaagagcttgagcgaagtcaagagcgaggtcgaaatggtaatcaaaactggccggcagatcgtgcaaaagaagcaaaccgaaaatcccaaggaactcgatgaaagggtgacagccctaaagctacattacaatgagctaggggcaaaggtcaccgaacgcaaacaacagctggaaaaatgtctgaagctgagccgcaaaatgaggaaggagatgaacgttctgactgaatggcttgccgccacagacatggagctgactaagcgtagtgccgttgaggggatgccctctaacttggatagcgaggtggcatggggcaaggctacccagaaagagatcgaaaagcagaaggtgcatcttaaatcaatcacggaagtgggcgaggccctgaaaacagtactcggaaaaaaggaaactctggtggaagacaaactgtctcttttgaactccaattggattgccgtcacttcaagggccgaagaatggcttaacttgttactggagtaccaaaaacacatggagaccttcgatcaaaacgtagatcatatcacgaagtggatcattcaggccgacaccctcctagacgagagcgagaaaaaaaagccgcaacagaaggaagacgttctgaaaaggcttaaagcagagttgaacgacatcaggcctaaggttgactccactagggaccaggccgcaaacctgatggctaaccgcggggatcattgccgcaagctggtggaaccacaaatctctgaattaaaccatcgttttgccgcgattagccatcgcattaagactggaaaggcctcaatacccttgaaagagctggaacagttcaattccgacattcagaaattactggagcctctggaggccgaaattcaacagggcgtcaatctgaaggaagaggacttcaacaaagacatgaacgaggacaatgagggcactgtgaaagagctcctgcagaggggagataatctgcaacagagaattacggacgagagaaagagggaggaaatcaagatcaaacagcagctgctgcaaactaagcataacgcgctgaaagatttgaggagccagaggcgtaagaaagcgctcgagatttcccaccagtggtaccagtacaagcggcaagccgatgatctcctgaaatgcctggacgacatcgagaaaaaactggctagcctgcctgaaccaagagatgaacgcaagatcaaagagattgatcgtgagctacaaaagaaaaaagaagagctgaacgccgtgagaagacaggctgagggactgagcgaagatggtgcagcgatggcagtggaaccaacccagattcagctgtccaagcgttggagggaaattgagtcaaagttcgcgcaatttagacggcttaatttcgctcaaatccacactgtgagggaggaaacaatgatggtcatgactgaagatatgccacttgagatcagctacgtccctagcacttacttgactgagattacacacgtttctcaagccttgttggaggtggaacagcttttgaacgcccctgatctatgcgccaaagacttcgaagacctgtttaaacaagaggagagcctcaagaacataaaggatagcttgcagcagagctcgggcaggatcgatataattcacagtaaaaagaccgccgccctgcaatcagcaacacccgtggagcgcgttaagctgcaggaggcactcagccagttggattttcaatgggagaaagtgaataagatgtacaaggacagacagggcaggttcgacagaagcgttgagaagtggaggcggtttcactacgacatcaaaattttcaaccagtggctcactgaagctgaacagtttctacgaaagactcaaataccagaaaactgggagcatgctaagtacaaatggtatcttattgcactcaaagacgggatcggacagcgacagacggtggtgcgcacactgaacgcgaccggtgaggaaatcattcaacagtcatctaagacagacgcctctatcctgcaagagaagttaggttctttgaacctcagatggcaggaagtgtgcaagcaactgtccgacagaaaaaagaggcttgaagagcagaagaatatcctgtcagaattccagagggacctgaatgagttcgtgctgtggctggaagaggccgacaatatcgccagcatcccacttgagccaggcaaagagcagcaactcaaggagaagttggagcaagtcaagctcctcgtcgaggagctgccattgaggcagggcattctgaaacagttgaacgaaactgggggacctgttctcgtttccgcgccaattagtcctgaggaacaggacaaactcgagaacaagctgaagcagaccaatttgcagtggattaaagtctctagggccttgcccgaaaaacagggagagatcgaagcccagatcaaagacctgggacagcttgagaagaagctcgaggacttggaggagcaactcaaccatctcttactgtggttgtcacctatacgcaaccagctggagatatacaaccagcctaaccaggaaggcccatttgacgttaaggagaccgagattgcagtgcaggctaaacagcctgacgttgaggaaatcttgtctaaggggcagcatctttataaggagaaacctgcaacccaacccgtgaaacgcaagctggaggacctgtctagcgaatggaaggctgttaacagattattgcaggaactgagggccaaacagcctgatttggctccaggcctgaccaccataggcgcatcccccacccagaccgtcaccctggtaacacagccagtggttacaaaggagacagcaataagcaagctggagatgccatcatctctcatgttggaggttccggcgctcgctgacttcaatcgggcgtggacggagctgacagattggctgagtctcctggaccaggtgatcaagtcccagcgggtgatggtcggtgacctcgaggatattaatgaaatgatcatcaaacaaaaggccacaatgcaggacctggagcaaaggaggccacagctggaggagctaattacagccgcacagaatttaaagaataagacatcaaaccaggaggctaggacaataatcaccgatcgtatagaacgtatccagaaccagtgggatgaggtgcaagaacatttgcagaacaggagacagcagctcaatgagatgttaaaggatagcacacaatggctggaggccaaagaagaggcggagcaggtcctgggacaagcccgtgctaagctggagtcatggaaggaaggcccttatactgtggatgccatccaaaagaaaatcaccgagactaaacaactggctaaagacctacgacagtggcagactaatgtagacgttgcaaatgacttggccttaaaattgctgcgcgactattcggccgacgataccagaaaggttcacatgattaccgagaatatcaacgctagctggaggtcgatacacaagcgcgttagcgaaagggaggctgcactcgaagagactcacagactcctgcaacagttccccctcgatctcgagaaatttctggcgtggctgaccgaagccgagacaaccgcaaacgtgctccaggacgcgactcgcaaagagcggctcctcgaagattctaagggagttaaagaacttatgaagcagtggcaagatcttcaaggcgagattgaagcacacaccgatgtctaccacaatctggatgagaacagtcaaaaaattctgcggagtctggagggatccgacgacgccgtcttgctgcagcgtcgcctggacaatatgaattttaaatggtctgaacttcggaagaagagccttaatatccgaagccacctggaagccagcagtgatcaatggaaaagattgcaccttagcttacaggagctactagtgtggctacaactgaaagatgatgagctgtccagacaggcacccatcggtggggatttcccagcagttcaaaaacagaatgatgtccacagagccttcaaaagagaactcaaaactaaagagcccgtaatcatgagcaccctcgagaccgtgaggatatttctaactgagcagccgttggaggggctcgagaaactgtatcaggagccgagagaacttccacccgaggagcgtgcgcagaacgtaactcggctcctgcgcaaacaggcggaggaagttaacacagaatgggaaaagctcaatctgcactccgccgattggcagcggaaaattgacgagacactagaaaggttaagagaactgcaggaggctaccgacgaactcgacctcaaattgcgtcaggctgaagtgatcaaaggttcgtggcagccagtgggagatttactgatcgactctctgcaggaccacctggaaaaggttaaggccttgaggggggaaatcgcaccacttaaggaaaacgttagccacgtgaatgatctggctcgacagctcactactctgggcattcagctgagcccttacaatttaagtacgctcgaagacctgaacactcgctggaagctcttacaagtggccgtcgaggatagggtcaggcaactccacgaagctcatagggactttgggcccgcctcccagcacttcctgagtacctccgtccaggggccgtgggagagagccatatcgcctaacaaagtcccttactatataaaccatgaaacccagacaacctgctgggaccatccaaagatgaccgagctgtaccaaagtctggcagacctgaacaatgtgcgtttcagcgcatatcggactgcaatgaaactccgccgtctgcagaaagccttatgtctcgacctgctgagcctctccgcagcatgcgatgcactcgatcagcacaatttgaagcagaatgaccaaccgatggatattctgcagataattaattgcctcactactatatacgatagactggagcaggagcacaacaacctggtgaacgtcccgctctgcgtggacatgtgtctgaactggcttctcaacgtgtacgatacaggaagaacaggcaggatacgggtgctcagttttaagaccggtatcatctccctgtgcaaagcacatctcgaggataaatataggtatctattcaagcaggtcgctagcagcaccggcttttgcgaccagcgcaggctcggattgctgctgcacgactcaatacagattccccggcaactgggtgaagttgccagctttggcggcagcaatatcgagccctcagtgaggtcttgttttcaatttgctaacaacaagcctgagatcgaagcagccttattcctggattggatgagacttgaaccacagtccatggtttggcttccagtgctccatcgggtggcagccgccgaaactgctaaacatcaggctaagtgtaacatctgtaaagaatgtccaatcattgggtttcggtatcgctcgctgaaacactttaattatgatatctgccagtcatgcttcttctccggccgggtcgcaaaaggtcataagatgcactatcccatggtggagtattgcacacctaccacatccggcgaggacgtccgtgacttcgctaaggtgttgaaaaacaagttcagaaccaagcgttatttcgcaaagcatcctagaatggggtatctgccagtgcagacagtgctggagggcgacaatatggagactcctgtgacacttatcaatttttggccggtcgattccgcaccagcttcgagtccacagttatctcacgacgacacccactctcggatcgaacattacgcctctagactggctgagatggaaaactctaatggatcttaccttaacgactccatctccccaaacgagagcatcgatgatgaacaccttctcatccaacactactgtcaaagtctgaaccaggatagtccactttcccaaccaaggagccctgctcagatcttaatatccttggaaagtgaagaacgcggtgagctggagagaattttggcagatcttgaggaagagaatcgaaatctacaggctgagtatgatcgtctgaagcagcagcacgagcataaggggctttctccactgccgtcaccgccagagatgatgccaacgtccccccaatccccaagggacgctgagcttatcgctgaggcaaagctattgcgccagcacaaagggagactggaggcgaggatgcagatccttgaggaccataacaaacaactcgaatcacaactgcacagactgagacaactgctcgagcagccacaggctgaggccaaggtaaatggtactacagtatcaagcccatctacaagcctgcagcggagtgattctagccagcctatgctccttagagtggtcggctcgcagacctctgatagtatgggcgaggaagacctcctgtcaccaccgcaggacacgagcaccggcctggaggaagttatggagcagctgaacaacagctttccatccagcagagggagaaataccccgggaaagccaatgagagaagacaccatgtag

SEQ ID NO: 186197 - DNA, 2874 bp, Artificial Sequence
  Description of Artificial Sequence: Synthetic coding sequence
atgcagcccatggtgatgcagggctgcccctacaccctgccccggtgtcacgactggcaagctgctgatcagtttcatcatagtagtagcctgcgcagcacctgcccacacccgcaggttagagccgccgttacctctcctgcaccgcctcaagacggcgccggtgtgccctgcctaagtctgaagttgcttaatggaagcgtaggcgcaagcggcccattagagccaccggccatgaatctatgttggaatgagataaagaaaaagtcccacaacctccgagccaggctcgaggcgttctctgatcatagcgggaagctgcagctacccctgcaggagattattgactggctgtcacagaaggatgaagaactttccgcccagctgcctctgcagggggatgtggccttagttcagcaggagaaagaaactcacgctgcttttatggaggaggtgaaatctcgcggaccttatatctattcagtgcttgagagcgctcaggcttttttaagccagcatcccttcgaggagctggaggagccccatagcgagagtaaagatactagcccaaaacaacgaattcaaaacctgagccgcttcgtatggaaacaagccactgtagcttcagaactttgggagaagctcactgccagatgcgtcgaccagcatcgtcatatcgagcggaccttggagcagctcttggagatccagggcgccatggaagagctgagcaccaccctgtctcaagctgagggagtcagggcgacctgggagcccatcggggacctgttcattgattctctgcctgaacatatccaagccattaaactattcaaagaggaattttcaccaatgaaagatggagttaaactggttaacgatctggcacatcaactcgctatttctgacgttcatctgtccatggagaacagccaggctctggagcaaattaacgttagatggaagcagctgcaggcttctgtgagcgagagactgaagcagcttcaggatgctcatagagattttgggcccggctcccagcatttcctttcctcaagtgtccaagttccctgggagagggcaatttctcctaataaagtgccgtattacataaaccaccaggcgcaaactacgtgttgggaccacccaaaaatgacggaactgtaccagacactggccgatcttaataacattaaattttcagcataccgcacggctatgaagctgcgcagagtacaaaaggcactcagactggatctggtaacactgacgacggctctcgagatcttcaatgagcacgatctgcaggctagtgaacacgtaatggatgtcgttgaggtaatacactgcctcactgccctttacgagaggctggaggaagagagaggcatcctggtgaatgtgccactgtgcgtagacatgtctctcaactggctccttaacgtattcgattctggaagaagtggcaagatgcgcgccctgtcgtttaaaaccggtatagcatgcctctgcggcaccgaggtcaaggagaaattgcagtatttgttttcccaagtcgctaattcgggatctcagtgtgatcagaggcacctgggcgtcctgctccacgaagccatccaagtgccacggcagctgggagaagttgctgcctttggggggagtaacgttgagcctagtgtgaggagctgtttcagatttagtactgggaaacccgtcattgaggccagccagtttctggagtgggtaaacttggaaccacagtccatggtgtggcttgccgtgctccatagggtgacaatcgccgagcaggttaagcaccagaccaagtgctctatatgccggcagtgccctataaagggattccggtacaggtccctgaagcagtttaatgttgacatctgccagacttgttttctgaccggacgcgccagtaagggtaataagcttcattaccccattatggaatactacaccccaactacgtctagtgagaacatgagggacttcgccaccacgctaaagaataaattcaggtctaaacactatttcagcaagcatcctcagcgcggatatttgccggtccagagtgtgttggaggcagattattccgagacccccgcgtcatcgcccatgtggcctcacgcggacactcactcccgtatcgaacacttcgccagccgattagccgagatggagtcacagaactgctcattctttaacgatagcctgtccccggacgactcgattgacgaggaccagtacttacttaggcattcatctcctatcaccgaccgagagccagctttcggacagcaggccccctgtagtgtggcgaccgaaagtaaaggggagttgcaaaagatcctggcccacctagaagatgagaacagaatcctccagggtgagttgaggcggttgaagtggcagcacgaagaagcagctgaagcaccctcgttggctgatgggagcactgaggccgctacagatcaccggaatgaagaactactcgccgaagcacggatactccgccagcacaaatccaggcttgagacaagaatgcaaattctcgaggaccataacaagcagctcgaatcgcagctgcagaggctgagagagctgctgctgcagcctcccacagaaagcgatggttccggaagcgcaggtagcagcttagcttccagccctcagcagagcgaagggagtcatccccgcgagaagggacagactactcctgacactgaagcagcagatgacgtggggagcaaatcgcaggacgtgtctctatgcctggaggatattatggagaaactgcgccacgcattcccttctgtgaggagctctgacgtcacggcaaacacgttgctagcctcatag

SEQ ID NO: 186198 - DNA, 2874 bp, Artificial Sequence
  Description of Artificial Sequence: Synthetic coding sequence
atgcagcccatggtgatgcagggctgcccctacaccctgccccggtgccacgattggcaagcggctgaccagttccaccattcatctagcttaaggtccacttgcccgcaccctcaggtaagggccgcggtgacctcccccgcacctccacaggacggggctggcgttccgtgcctttccctgaagctccttaatggcagtgtgggggccagcggcccgttggaaccccctgctatgaacctttgttggaacgagatcaagaaaaagagccacaacctaagagctcgcctcgaggccttttccgatcattcaggtaagttacagctcccgctgcaggagataattgactggctgagccagaaggacgaggaactttccgcccagctgcccttacagggagacgtggcccttgtgcaacaggaaaaagagacccatgcagcttttatggaggaagtcaagtcacgaggcccctatatttattccgtcctcgagagcgcacaagcgttcttgtcacagcatccatttgaggagctcgaagagccacacagcgaatccaaagacacctccccgaaacaacggattcagaacctgtccagattcgtttggaagcaggccacagtcgcaagtgagctgtgggaaaaactcacggcccggtgcgttgatcagcatcggcacatagaacgcaccctggagcagctccttgaaattcagggcgccatggaggaactgtccacaactctctctcaggccgagggggtgcgggctacttgggaacctattggggacctgttcatcgacagtctcccggaacacatccaggcgattaagctgttcaaagaagagttttcccccatgaaggatggagtgaagctggtcaatgacctggcccatcaactggctattagcgacgttcacctgtcaatggagaatagccaagccctggaacagatcaacgtcaggtggaagcagcttcaggcgtctgttagcgaacggctgaagcagttgcaggatgcacaccgtgacttcggacctggctcacaacactttctaagcagctccgtgcaagtgccctgggaaagagctatcagtcccaacaaggtcccctattacattaaccaccaagctcagactacttgctgggaccaccccaagatgacagaactttaccagacgcttgccgacctgaataacattaaatttagcgcctatagaaccgcaatgaagctacggcgtgtgcagaaggcgctcaggctcgaccttgtgaccctaacaacggccctcgagattttcaatgagcatgatttgcaggcatcagaacatgtcatggatgtcgtagaggtgattcattgtttgaccgccttatacgaaagacttgaggaggaacggggcattcttgtgaatgtccccctgtgtgtggacatgagtttaaattggctcctcaacgtttttgacagtgggaggtctggcaaaatgcgtgccctgagcttcaaaacaggcattgcctgcctgtgcggcacagaggttaaagagaaattacagtacttattttcacaggtggcaaactccggctcacagtgcgatcagagacatctgggcgtgctcctgcacgaagccatccaggttccccgccagcttggtgaagtggccgcatttggcggttcgaacgtcgagccatctgttcgctcctgctttcggttttctactggcaaaccagtgatcgaggcaagtcagtttctggagtgggtcaacctggagcctcagagcatggtgtggctggctgtactgcaccgggtgactattgctgagcaggtaaaacaccaaactaaatgcagcatttgcagacagtgtcccattaagggatttaggtaccggtcactgaaacagtttaacgtagatatatgtcagacctgttttctgacagggagagcatctaaagggaataaactgcattatcctatcatggaatactacacccctactacaagctcagagaatatgagggacttcgccaccaccctgaagaacaagttccgatctaaacactacttctccaagcatccacagcgagggtacctaccggttcagagcgtgctggaggcagactattcagagacaccagcatccagccccatgtggcctcacgcagatacgcactcgaggatcgagcacttcgcttcccggttagcagagatggaatctcagaactgctcattttttaacgactccctatctcccgacgattccatagacgaggatcaatacttgctgaggcattcttctccaattacagacagggagcctgcattcggccagcaggctccatgttccgtggctaccgagtcaaaaggggagctccaaaaaatcctggcccatctggaggacgaaaataggatattacagggcgagctgcgtaggctgaagtggcagcatgaagaggccgctgaagctccaagtctcgccgatgggtcaactgaggcggccacagaccataggaacgaggaactcctggccgaggcccggattctgcgccagcacaagagccggttggaaactcggatgcaaatcttggaggaccataacaaacagctagagtcgcagctccagcgcctgcgggaactcctcctgcagccaccaacagagtccgatggttcgggatccgcaggctcctccctcgcaagctctccacagcagtcagagggctcccaccctcgggagaaaggccaaacaaccccggacacagaggctgctgacgacgtgggatccaagagccaggacgttagcctatgtctggaagacatcatggagaagttgcgtcacgcctttccatctgtaaggagctcagatgtaactgcgaacaccctcttggcgagttag

SEQ ID NO: 186199 - DNA, 2874 bp, Artificial Sequence
  Description of Artificial Sequence: Synthetic coding sequence
atgcagcccatggtgatgcagggctgcccctacaccctgccccggtgtcacgattggcaagccgcagatcagttccatcattcatcctccctgagatccacttgtccacaccctcaggtgagagctgctgtcacatccccggcaccaccacaagacggggctggtgtcccatgcctcagcctcaaattacttaacgggtccgtaggggcttcaggacctttagagccccctgccatgaatctttgctggaacgaaatcaagaagaagagtcacaacctacgcgcgagactcgaagccttcagcgatcattcaggcaagctccagctgccactgcaagaaatcattgactggctaagccagaaggacgaggagctatccgcccagttgcctctccagggagacgtggcactcgtgcaacaagagaaggaaacccacgcggcgttcatggaggaggtcaagtctcggggcccatatatatactctgtactcgaatctgcacaagcttttttatcccagcacccattcgaagaactggaagagcctcatagcgagagcaaggataccagcccaaaacagcggatccagaacctgagcaggttcgtctggaagcaggccactgtggctagcgagttgtgggagaaacttacggcaaggtgcgtcgaccaacaccgtcacatcgaacggactctggagcaactgctggagatccagggggcaatggaggagctgagcacaacactcagccaggccgagggagtcagagcaacatgggagccaattggcgacctgttcattgactcactgcctgaacatatccaggcaatcaaactttttaaggaggaattcagccccatgaaggacggggtgaagctggtcaatgacctggcacaccaactcgccatttcggatgttcacctgagcatggagaactcgcaggcactggaacagattaatgtgagatggaaacagcttcaggcaagcgtctccgaacgcctaaagcagctccaggacgcccacagggacttcggccccggatcgcaacactttctgtctagtagtgtacaggtgccctgggagcgggcgatctcacccaacaaggttccctattacataaaccaccaggctcagaccacatgctgggaccacccgaagatgactgagctctatcaaacgctagccgatctgaataatattaaattttcagcctaccgtacagcaatgaagctaaggagagttcagaaggcattgcgtctggatcttgttacactgacgaccgcattagagatcttcaacgagcacgatcttcaggccagtgaacacgtgatggacgtcgtcgaagtgattcattgtctcacagccctttacgaacgtctggaagaggaacgagggattttagtcaatgttcccctttgcgtagatatgagtcttaattggcttctgaacgtgtttgatagcgggcgttccggcaagatgagagccctgagctttaagactggcatagcctgtctctgcggtaccgaggttaaagagaaactccagtatctgttctctcaggtcgccaattcaggtagtcagtgcgaccagaggcacttgggagttttactacacgaggcgatccaggttccgaggcagctgggggaggtcgcagccttcggcggcagtaatgtcgagcccagcgtccggagttgtttccgcttcagcactggtaaacccgtgatcgaagcctcccagtttctcgaatgggttaatctcgaacctcagagcatggtatggttggcggtactccaccgggtgacgattgctgaacaggtgaagcatcagactaaatgtagtatttgcagacagtgtcctattaaggggtttcggtaccggtctttgaagcagttcaacgtagacatctgccagacatgtttcctgactggccgggccagcaagggcaataagctgcactaccccattatggaatactatacccccaccacctcatctgaaaacatgcgagacttcgccacaactttgaaaaacaaatttcgcagcaaacactacttcagtaagcatccgcagaggggatatcttccggtccagagcgtcctcgaagcagactactcagagacaccggccagcagccccatgtggcctcatgccgacactcactcccggatagagcatttcgcatccaggttggccgagatggaaagccagaactgcagcttctttaacgattctctctccccagacgactctattgacgaagaccagtatcttctgaggcacagctctcccataacggaccgggagcccgcattcggacagcaggctccctgctcagtcgccactgaatccaagggtgagctgcagaagatcctcgctcacctggaagacgagaaccggattctgcagggcgagctccgaaggctcaaatggcagcacgaagaagccgcagaagccccctctttggccgacggttcaacagaggcagctaccgatcatcgaaacgaggaactgctcgccgaggctagaattctgaggcagcacaaaagcaggttagagaccagaatgcaaattttggaagatcacaataagcagctcgagtcccagttacaacggcttcgggagctgctgcttcagccccctaccgagagcgacggtagtggatcagctgggtccagcctggcttcttccccacagcagagcgagggctctcaccctcgggagaagggacagacgacacccgataccgaagcagcggatgatgtgggctcaaaatcccaggatgtttctctgtgcctcgaggatattatggagaagctccgtcacgcctttccttctgtgaggtcttccgatgtcaccgctaatacattgctggccagctag

SEQ ID NO: 186200 - DNA, 2640 bp, Artificial Sequence
  Description of Artificial Sequence: Synthetic coding sequence
atgaacctgtgctggaacgagatcaagaagaagagccacaacctgcgtgcccgactggaggccttttccgatcactccggcaaactgcaacttccccttcaggagatcatcgactggctgagtcaaaaggatgaggaactttccgcacaactccccctacaaggggacgtcgccctggttcagcaggaaaaagaaactcacgctgcctttatggaggaggtgaaaagccgtggtccatatatatatagtgtccttgagtctgcacaggccttcctgagccagcaccccttcgaggaacttgaggagccccacagcgagtcaaaagacacctccccaaaacagcgaattcaaaaccttagtcggtttgtgtggaagcaagccaccgttgcttcggaactttgggaaaaactaactgctcgatgtgtagaccagcatcgacacatagagcgcacgctggaacaattgctcgagatccaaggggctatggaggagctcagcacaaccctgtcgcaggctgaaggcgtcagggctacttgggagcccataggcgatctgttcattgactccctccctgaacacatccaagcgatcaagttgttcaaagaggaattctctccaatgaaggatggtgtgaaactggtaaatgatctggctcaccagctcgctatctcagacgtgcatctctccatggagaactcgcaggccctggaacagatcaacgtgcgttggaaacagcttcaggcatcagtgtctgaacggctcaagcagctccaggacgcccaccgcgatttcggtcccggctctcagcactttctttcctccagcgtccaggtgccctgggagcgtgccattagccccaacaaagtgccctattatataaatcaccaggctcagacaacatgttgggaccatccaaaaatgacggaactctatcagactcttgccgacttgaataacataaagtttagtgcttacagaaccgccatgaaattgcggcgggtacagaaagccttgcgcctcgatctggtgactctgaccacggccttggaaatcttcaatgagcacgacctgcaggcatctgaacacgtgatggatgtcgttgaggtcattcattgtctgaccgctctatatgagaggttggaggaggagcgtggcatcctggtgaatgtcccattgtgcgtggacatgtctctgaattggctccttaacgtgttcgactcggggcgcagcgggaagatgagggccctcagttttaaaacggggattgcctgtttgtgtggaactgaagtgaaggaaaagctgcaatacctgttctcccaagtcgcgaactcaggcagccagtgtgatcagcggcatctgggcgtactgttgcatgaagctatccaggtgccccgacagctgggcgaagtggcggcctttggagggagcaatgtcgagccctctgttcggtcttgctttagatttagcactggaaaacccgtgatcgaagcctctcagttcctggaatgggtcaatctagagcctcagagcatggtgtggttggccgtgctgcaccgggtcactatcgcagaacaggtaaaacaccagacaaagtgttcaatctgtcgccagtgccccattaaggggttcaggtaccgctccctgaagcagttcaacgtcgacatctgtcagacctgttttctcaccggtagggcgagcaaagggaataagctgcactatcccatcatggagtattatactcctacaacaagcagcgagaatatgagagatttcgccacaaccctgaaaaacaagttccggagcaaacattatttctccaaacacccccaacgcggatatctgcccgtgcagtctgtgttggaggccgactattcggaaacccctgcttcctccccgatgtggccgcacgcggacacccattctcggattgagcatttcgctagtcgcttagcagaaatggaatcccagaactgcagctttttcaatgactcgctttctccagatgactcaattgacgaggatcaatatcttcttagacactcctccccaatcactgaccgggagcccgctttcggacagcaggcgccctgttccgtggctacagaatctaaaggggaactgcaaaaaattctcgctcatctggaagacgagaatcgcattctgcaaggagaactccgccggcttaaatggcaacacgaggaggcagctgaggccccttctctagcagacgggagtactgaggccgctaccgaccaccgcaacgaggaattgcttgctgaggctagaatcctcagacagcataaaagccgactcgaaacccggatgcaaattctcgaagatcacaacaagcaactagagtcgcagctgcagcgccttcgcgaactgctccttcagccaccaaccgagagtgatggcagcgggtcagccgggtcctctctggcctctagtcctcagcagtctgagggatcacatcctcgcgagaaaggtcagactactcccgatactgaagccgctgatgatgtggggtcaaagtcccaggacgtcagtctctgcctggaagatatcatggaaaagctgcggcacgcctttccctctgttcggtccagcgacgtcactgcaaacacgctgctcgcttcctag

SEQ ID NO: 186201 - DNA, 9129 bp, Artificial Sequence
  Description of Artificial Sequence: Synthetic coding sequence
atgcaccacggcaccggcccccagaacgtgcagcaccagctgcagcggagcagggcctgccccgggagcgagggcgaggagcagccagctcaccctaatccacccccatcccccgccgcacctttcgcgcctagcgcatctcccagcgcccctcagagcccctcttatcagatccagcagctaatgaacagaagcccggctactggccagaacgtgaatatcaccctgcagtcagtggggcccgtcgtcggaggtaaccaacagatcaccttggctcccctgcctctgccatcccctacctctcccggcttccagttttctgcccagccacgaagatttgagcacggctcgccgagctacatccaagtcacgtcccctctgtcccagcaagtgcagacccagtcccctacgcaaccgagtccaggacctgggcaggcgctgcagaatgtgagagctggcgcccctggacccgggttaggcctatgttcttcctctccgaccggcggattcgtggacgcgtctgtattggttcgacaaatcagcctgtcaccctcctctggtggtcatttcgtttttcaggacggaagcggcttgactcagattgcccaaggcgcgcaggttcaactgcagcaccccgggacccctatcacagttcgggagcgccgcccctcacagccacacacccagagtggcggtactatccatcacctggggccacagagtcctgcggcggctgggggggcaggactccaaccactggctagtccctcacacattactaccgcaaatctgccaccacaaattagctccattattcagggtcagttggttcaacagcagcaggtgctgcaggggccccccctgcctcggcctctcggcttcgaacggacaccgggggtgctgttacccggtgcggggggtgcagccgggttcggtatgacatctccccctcctccgacgtccccttctcgaaccgccgtaccccccggcctgtccagcttacctttgaccagtgtggggaacaccgggatgaagaaggtgcctaaaaaactggaggagatcccccccgctagccctgaaatggcacagatgcgaaaacagtgcctcgactatcactaccaggagatgcaggccctcaaggaagtgtttaaagaatacctcatcgagctgtttttccttcagcatttccaggggaatatgatggacttcctggccttcaagaagaagcactacgcccctctacaggcttacttgagacaaaatgacctcgacatcgaggaggaggaggaagaagaggaggaagaggaagagaaatccgaggtcataaacgacgaacaacaggctctcgctggatctctggtggccggcgctggctctactgttgaaaccgacctgttcaagaggcagcaagctatgccctcaaccgggatggccgaacaatctaaacggcccaggttggaagtgggccaccagggggtcgtctttcagcacccaggggccgacgcgggcgtgccattgcagcaactgatgcctactgcgcagggcggaatgccaccaacaccacaggccgcacagcttgctgggcagcgccaatcccagcagcagtatgatccctctacgggccctcccgtgcagaatgccgccagtctgcatacaccactgccgcagctgcccggcagattgcctccagcgggcgtccccactgctgctctgagtagcgcgctgcaattcgcccagcagcctcaggtagtcgaggcccagacccagttgcagatccctgtgaagacccagcagccaaacgtcccgattcccgcaccgccctcaagccagcttcccatcccaccaagtcagccagctcagctagctctccacgtcccaactcccggaaaggtgcaggtacaggctagccagcttagtagcctgccacaaatggttgcatccacccgtctccccgttgatcccgcccccccctgcccgcgacctctgccaacaagtagcacgagcagcctggcaccagtcagcgggtcaggacccggaccttctccagctcgctcttcacccgtaaacagaccatctagtgctactaacaaagctctctcccccgtgaccagccgtacgccaggtgtcgttgcaagcgcccccacaaagccccagtctcctgcacaaaacgctacaagcagtcaggatagctcccaggacacccttacggaacaaattacactggagaaccaggtacaccagcgcattgccgagctcaggaaggccggactgtggtcccaacgccggttgccaaaactgcaggaggccccacggcctaaatcccattgggattacctgctggaagagatgcagtggatggccactgattttgcacaggagagacgctggaaggtggcagctgccaaaaaactggtgcgtactgtcgtgaggcatcacgaagagaaacagcttagggaagagcgcggaaaaaaagaggaacagtcccgtctgcgtcggatcgccgcttcaactgcaagggagattgagtgtttttggtctaacatagagcaagtggttgagattaaattgcgcgtagaattagaggaaaagaggaagaaggccctgaatctgcaaaaggtgagcagacgtggtaaagaactgcgccccaaagggttcgatgcacttcaagagagcagcttggatagtggaatgtcgggacgtaaaaggaaagcttccatctctctgactgatgatgaagtggacgatgaagaggaaacaatcgaggaggaggaagcaaatgaaggggtcgtagatcaccagactgagctgtcaaatctggcaaaggaggccgaactgccgctactcgatctgatgaaactctatgagggagcttttcttccaagctcacagtggccacggcctaagcctgatggtgaggacacctctggtgaagaagatgccgacgactgcccaggcgacagagaatcacggaaagacctggtgctgatagactctttatttatcatggatcagttcaaggccgccgaacgtatgaacattggcaagcctaacgctaaggacatcgccgacgtgaccgctgtggcagaagccattctacccaaaggaagtgccagggtgaccacgtcggtcaagtttaacgcaccttctcttctttacggcgccctgagggattatcagaaaataggtcttgattggctcgccaaactgtatcgaaagaatctcaacgggatccttgcagacgaagccggcctgggaaaaacagtacagatcattgccttctttgctcacttggcgtgtaacgaggggaattggggtccccacttggttgtggtccgatcctgcaatatccttaagtgggagttggaacttaagcgttggtgccccggtttgaagatccttagctatattggatcccatcgagaactcaaggcgaagagacaggaatgggcagagccaaactcttttcacgtctgtatcacctcctatacccagttcttcagagggctcaccgccttcacacgtgtgcggtggaagtgcctggttattgacgaaatgcagcgtgtgaaaggtatgactgagagacattgggaggcagtcttcacactacagagccagcagcgcctgctgctgattgactctccactgcataatactttcctggagctgtggaccatggttcactttctggtgccgggaatttcccggccctatttgtcgtctccgctccgggcaccaagtgaggaatcccaggattactaccacaaggtagtgatccgactgcatcgcgtgactcagccgttcatcctgaggcggacaaagcgtgatgtggaaaagcagctgacgaagaagtacgagcacgtgttgaaatgtaggctgagcaatcgccagaaagccctatatgaggacgtgatcctccagcccggaacgcaggaggctctgaagtcgggtcactttgtgaatgtcctcagtatcctggtgcggctgcagagaatatgcaaccacccaggtcttgtggagccgaggcacccaggaagcagctacgtggcaggcccacttgaatatccttccgccagcctgatcctcaaggctctagaacgcgacttctggaaagaagcagacttaagtatgttcgatctgatcggtctcgaaaataaaattacccgtcatgaggcggaattgctctctaagaaaaagatcccacgcaagctgatggaggagattagcacttccgcagcaccggccgcccgcccagccgcagcaaaactaaaagcctcacgcctgttccagcctgtgcaatacggccaaaaaccggaaggtcgtacagtggcctttccttcaacgcaccccccccggaccgctgctcccacgacagcatccgctgcccctcaaggtcctctgcgtgggagaccccctattgccactttttcagcgaatcccgaggccaaaggcggggaagttgtgaaaattgcccagttagcatctattaccggaccccaatcaagggtggcccagcctgaaacccctgtcacactgcagttccaaggcagcaaatttacattatcacatagtcaactgcggcagctgacagccggccagcctttgcagttgcaggggagtgtgcttcagatcgtgtccgcgcctggccagccatatcttcgagcacctggacctgtcgtgatgcagacggtgtcccaagctggggcagtccatggcgctctaggaagtaagcctcccgctggcgggccttccccagccccgctgacaccccaggttggcgtgccaggcagagtggccgtgaacgccttggcagttggagagcctggaaccgcctctaaaccagcttccccaatcgggggtccaactcaagaggagaagaccaggttactgaaagagaggctcgaccaaatctacctggtcaatgaaagaagatgttcccaggccccagtctacgggagggacctactacgaatttgcgccctgccttcccacgggcgggtgcagtggcgcgggtcattggacggaaggcgcggtaaggaagccggacctgcccattcgtacactagtagctctgagagcccgtctgaactgatgcttacactctgccgctgtggggaatcactgcaagacgtgatcgatcgggttgctttcgtgatccccccggtagtggccgctcccccatctcttagagtgccgcgtccaccccctctttacagccacagaatgaggatcctccgccagggtctgcgggagcacgctgcgccttacttccaacagctgaggcaaactactgctccacgactgcttcagtttcctgaattaagactggtacagtttgactctgggaaactggaagccctagcaatcctactgcagaaactcaagtctgagggccggcgcgtgctcattctctcccagatgatcttgatgctcgatattctggaaatgtttctgaatttccattacttgacctacgttcgcatcgatgaaaacgccagctccgagcaacggcaggagctgatgcgaagctttaatcgggaccgcaggatcttctgtgctattctcagcacccactccagaacaacaggaattaacctggtggaagcagacacagttgtcttttacgataacgacctgaacccagtgatggatgccaaggcacaagaatggtgtgataggataggtaggtgtaaagatattcacatctacagactggtgagtggtaactcaattgaggaaaagctgctgaaaaatgggaccaaagacttgattcgagaagtcgctgcgcagggcaatgactattcgatggccttcttgacacagagaacaattcaggaacttttcgaggtatactctcctatggacgacgcaggatttccagtcaaggcagaggagttcgttgtcctgtcccaggaacccagtgtgaccgaaactatagctcccaagatcgctagaccattcatcgaagctctgaaatccatcgagtacttggaggaggatgcacagaagtcagctcaagagggagttctcggcccccataccgatgctctgtcatccgacagtgagaatatgccatgtgatgaggagccaagtcagctggaggagttagcggatttcatggaacaactgacccccatcgaaaaatacgcactgaactacttggagctctttcatacatcaattgaacaagagaaggagaggaacagtgaagacgctgtgatgacagccgttagagcctgggagttctggaacctcaagaccctgcaggagcgggaggcgagattacgccttgaacaagaggaggctgagctcctcacatatacccgcgaggatgcctattccatggagtatgtctacgaggatgtggacggacagacagaggtcatgccgctgtggactcctccaacgcccccacaggatgattccgatatctaccttgactcagttatgtgcctgatgtacgaggcgacacccattccagaagccaagttgccgccggtgtatgttcggaaagagcgaaagaggcataagacggaccctagcgcggccggccgtaaaaagaagcagcgacatggagaggccgtcgtgcctccgaggagcctgttcgatcgggctactcccggtctactgaaaatacgtcgcgagggcaaagaacagaagaagaacatcctgttgaaacagcaagtgccgtttgccaaacctctacctacttttgcaaagccaacggccgagccgggacaggataatcccgagtggcttatttcagaggattgggcactgttgcaggctgtcaaacagctactggagctgccactcaacctcacaatcgtgtccccagcacacacgcccaattgggaccttgtgtctgatgtggtaaatagctgctcaaggatctatcgatcatctaaacagtgccgaaaccggtacgagaacgtgattatcccacgggaggagggtaagtcgaagaacaacagaccccttaggacctctcagatctatgcccaggacgaaaacgccacacatacacagttgtacacctcccatttcgatctcatgaagatgacagccggaaagagatcaccaccaatcaagcctctcctgggcatgaatccattccagaagaatcctaagcacgcctcggtgctggccgagtccgggatcaactacgacaaacctctgccaccaattcaggtagcatcactaagagctgagcgcattgcgaaggagaagaaagctttggcggaccagcagaaggctcagcagcccgcagtcgcccagccacctcctcctcagccccagccacctcctccgcctcagcagcctccgccaccactgcctcagcctcaggccgctgggtcacagcctccggcagggcccccagcagtacagccccagccccagccccagccgcagacacagccccaaccggtacaagcaccagctaaggcccagcctgccatcactaccggaggtagtgcggccgttctcgctggtacaataaaaaccagtgtcacgggcactagcatgcccaccggcgccgttagtggtaatgtgattgtgaacactatcgcgggggtcccagcggccaccttccagagcatcaacaaaagattagcttcccctgtggctcccggcgccttgacgacacctggaggctctgcccccgcccaagtggttcatactcagccgcctccccgggcggtgggatcacctgctaccgctacacccgatctggttagcatggccacaacacagggcgttagggccgtcaccagcgtcacggcctcggccgtggtgactactaacctgacgccggtccagacgcctgcaagaagccttgttccgcaggtttctcaagccactggcgtgcagcttcctggcaaaactatcactcccgcacattttcagcttctacgccagcaacagcagcaacagcaacagcagcaacagcagcagcagcagcaacagcaacaacagcagcagcagcagcagcagcagcagcaaacgacaaccacttcacaggtgcaagttccgcaaattcagggtcaggctcaaagccctgcgcaaataaaagccgtgggtaaactcacccctgaacatctgatcaagatgcaaaaacagaaactgcagatgcctccccagccccctccaccacaggctcagtctgccccccctcagccaacagcccaagtgcaagtgcagaccagtcagccaccacagcagcagagccctcagcttacaactgtgacagccccccggcccggtgcactgctgaccggaaccaccgtcgccaatctgcaggtggcaagactgactagagttccgacaagccagctccaggctcagggccagatgcaaacccaggcccctcagccagcccaggtggcattagccaaacctccagtggtttccgttcccgccgcagtcgttagttctcctggcgtcactaccctgcctatgaacgtcgctggaatatcagtcgccatcggacaaccacagaaggcggcaggccaaacggttgtcgcccagcctgtgcacatgcagcagctgctgaaattaaaacagcaagccgtgcagcaacagaaggccattcaaccacaggccgctcagggacctgcagccgtacaacagaagatcacagcccagcagattaccactcctggcgctcagcagaaagtggcctatgccgcgcagcccgctctgaagactcagtttctgacaaccccaatctcgcaggctcagaaactagccggggcgcaacaggtgcagactcaaatacaggtggccaaactgcctcaggtagtgcagcagcagaccccggtagcatcgatccagcaagtcgcaagtgcctctcaacaggcttctccccaaactgtggccctcacgcaagccaccgcagccggacagcaggttcagatgattccagctgttacagctaccgcccaagtcgtgcagcagaagttgatccagcagcaggtggtgactactgcatctgcgccccttcagacgccaggggcaccaaaccctgcacaggtgccagcctcttcggactcgcccagccagcagcccaaattgcagatgagggttccggccgtgcggcttaagaccccaacaaagcctccatgtcagtag

SEQ ID NO: 186202 - DNA, 9261 bp, Artificial Sequence
  Description of Artificial Sequence: Synthetic coding sequence
atgcaccacggcaccggcccccagaacgtgcagcaccagctgcagcgctcaagagcctgccctggtagcgagggagaggagcaacctgcacaccccaatccaccaccctccccagccgctccattcgctccatctgcgtccccttctgccccccagagtccatcttatcaaatacagcagttgatgaaccggagtcccgccactggccagaacgttaatattacactgcagagcgttggcccagtggtagggggtaatcagcaaattacactcgccccactacctctgccctcccctacttcacctgggtttcagtttagcgctcagcctaggcggtttgagcatgggtcccctagctacatacaggttacttcacccctctcccaacaagtgcagacccagtctcccacccagccctcacccggacccggacaggccctgcaaaatgttcgggccggggctcctggacctggcctgggactttgctcaagctctcctacaggaggttttgtggatgcctccgtgctagtgaggcagatcagccttagtccatcgagtggcggccatttcgtttttcaggatgggtccggattgactcaaattgcccagggcgctcaggtgcagctccagcacccagggacccccatcaccgtgcgcgagcgcagaccttctcagccgcatacccagtcaggggggacgatccatcacctggggccacagtccccagccgccgctggtggagccggcctgcaacccctggcaagcccatcccatatcactactgctaatctgcctcctcagatttcctccattatccaggggcagttagtccagcagcagcaagtgttacagggcccaccactcccacgccccctcgggttcgaacggacaccaggggtgctcctcccaggcgcaggtggcgccgccggattcggtatgacttctccccccccccctacatcaccgtctcgaacagctgtgccccctgggctgagtagcttgcctctcacaagtgtgggcaacacaggcatgaagaaggtgcccaaaaagctagaagaaatcccacccgcctccccagagatggcccagatgcgcaaacaatgcctggactatcattaccaggagatgcaggcactcaaagaggttttcaaggaatatttaatagagctcttttttcttcaacactttcaggggaacatgatggactttttggcattcaagaagaaacactatgccccactacaagcttaccttaggcagaacgacctggatatagaggaagaagaggaagaggaggaagaagaagaggagaagagtgaggtgattaacgatgaacaggctctggcaggctccctagtagccggggccggaagcactgttgaaaccgatctttttaagagacagcaggcaatgccctcaaccggcatggcaggggggatgccccccacaccccaggctgcacaattagccggacagagacaatcccagcagcaatacgacccgtctaccggacctccagtgcagaatgctgctagtcttcatacgccgctgccacagttaccgggacggctcccacccgctggcgtgcccaccgcagctctcagctccgctctacagttcgcccagcaaccacaggtggtcgaggctcagacccaactgcagataccggtaaaaactcagcaacctaacgtgccaatcccagcccccccttcctcccagttacctatccctccgagccagcccgcgcagctcgctttgcacgtgcccactcccggaaaagtgcaggtccaggcgtcacagctgagctccctgccgcagatggttgcaagcaccaggcttccggtagatccagctcccccttgtcctagacccctccccaccagttcgacctctagcctggcccctgtgtctgggagcggtccagggcctagcccagcaaggtcttccccagtaaatcgcccttctagtgcgaccaacaaagccctgtcacctgtgactagtaggacgcccggagtcgttgcttcagccccaaccaagccccagtctccggcccagaacgccacttcttcccaggacagttcacaggacactttaaccgagcagattacgttagaaaaccaagtgcaccagcggattgccgaactcagaaaggccggactgtggtcccagaggcgtttgcccaaactgcaggaggctccccgacctaaatcacattgggactacctcctcgaggagatgcagtggatggcaaccgacttcgcccaggaaaggagatggaaggtggcagctgcaaagaaattagttcgtactgttgtgcgtcaccatgaggagaaacaactccgagaagagaggggaaagaaggaggagcagtcgaggctcaggcgaatcgctgcctcaacagcaagggaaatcgagtgcttctggagtaatatagagcaggtggttgagatcaagctgcgtgttgagctcgaggagaagcgaaagaaagccctaaatctccagaaagtatcaagacggggaaaggagctgagacccaaaggttttgacgccttgcaagaatccagccttgattctggcatgtcgggtcggaaacgaaaggcctcaatttctcttaccgatgacgaagtggacgacgaagaggagacaatcgaggaagaagaggctaacgagggtgtcgttgatcaccagactgagctgtctaacctagctaaggaggcggagctgccgctgcttgatctgatgaagctgtatgaaggggctttcctgccatcctcacaatggcctagaccgaagcctgacggcgaagatacatctggtgaggaggatgccgatgattgcccaggggacagggagtcccgcaaggacctcgtcctaatcgacagcctctttattatggaccagttcaaggctgccgagcggatgaacatcggtaagcctaacgccaaggatattgcggacgtgaccgcggtagctgaggctattctaccaaagggttccgccagagttactaccagtgtgaaattcaatgcaccttccttattgtacggcgcgctcagggactatcaaaagatcggcctggactggctggcgaagctttatcgaaaaaacctgaacgggattctggccgatgaggccggccttggcaagacagtgcaaatcatagcattttttgcccacctggcttgcaatgaagggaattggggaccgcaccttgtcgtggtaagaagctgcaacatcctgaaatgggaactggagctgaagcgctggtgcccaggcttaaaaattctttcttatattggatcccaccgcgagctgaaagcaaaacgacaggagtgggctgaacccaactctttccacgtgtgcattacaagctacacccagttctttcgcgggctcacagcatttacaagagtgcggtggaaatgcctggtgatcgacgaaatgcaaagggttaaaggaatgacggagcggcactgggaggctgtgttcaccctgcaaagccaacaaagactcttgctaattgattcacccctccataacactttccttgagctgtggaccatggttcacttcctcgtccctggtataagccgtccctatctcagtagccctctgagggccccatctgaggagtctcaggactactatcacaaagtagtgatcaggctgcaccgcgttacgcagccattcatccttcggagaactaagagggacgttgagaagcaactcaccaagaagtatgaacacgtgctgaagtgccggctcagtaatcggcagaaggccctgtacgaggacgtcatcctccaaccagggacacaggaggcgctgaaatcaggccattttgtcaatgttttgtcgatcctggtccgcctccagagaatatgtaatcatcctggcttagtagaacctcggcaccctggaagttcctatgttgcgggcccgctcgaataccctagcgcatcactcattttgaaagccctggagcgggatttctggaaagaggcagacctgagcatgtttgacctcatcgggcttgaaaacaagattacacggcacgaggcggaactcctgagtaagaaaaaaatacccaggaagctgatggaagagatcagcacgtccgccgctcctgccgcacggcccgccgccgccaaactcaaggctagccgcctctttcagcccgtgcagtatggccagaaaccggaaggtcgaaccgtcgcctttccatccactcatcccccaaggaccgctgcaccgactacagcctcggccgcccctcagggccccttgcgagggcggccacctattgcaacattctcggctaaccctgaggccaaggccgctgcggctccgttccaaaccagccaggcttcagcgtcggctccgcggcaccagcccgcatccgctagctccacagcggcaagcccagctcacccagctaagctgcgtgcccagactaccgcccaggctagcacccccggccagcccccacctcagccacaggcaccgtctcatgcagcgggccaaagtgctctgccgcaaagactcgtcctcccatcccaagcccaggcccgccttcccagcggcgaggtggtcaagatagcacagctggccagcatcaccggaccccagtcacgcgttgcgcagccagaaacaccagtgactctccaatttcaaggtagtaaatttaccctgagccattcacagctgcgtcaattaacagccggccagcctctgcagctgcaaggcagcgttctgcagattgtgtccgcacccggccaaccctatctgcgggccccgggacccgtggtcatgcagacagtgagtcaggccggggcggttcacggggctttagggagtaagccccccgctggcggaccttcccccgccccattaaccccacaggtaggagttccaggacgggtggctgtcaacgctctggctgtgggcgagcctggcaccgcctccaagcctgcctcacccatcggtggtccaacccaggaggagaagactcgcttgcttaaggaacggctcgatcagatttacctggttaacgagcgtcgctgttctcaggctcccgtgtatggccgagatctcctcagaatctgcgctctgcctagccacggcagagtgcagtggcgggggagcctggacggaaggagaggaaaggaagctggccctgcacactcctacacatctagttcggaaagtccatcagagctgatgttaaccctctgtcggtgtggagagtccctccaggacgttattgatagggtcgcttttgtgatccccccagtggtggctgcaccaccctccctacgcgtgcccagacctccaccgctatacagtcaccgaatgcggatactcaggcaggggttgcgagagcacgctgccccttactttcagcagttacgccagaccaccgcacccaggctgctccaatttcctgaactgcgcctggtgcagttcgattccggcaaattagaagcactggccattctcttgcagaaacttaagtccgaaggacggcgagtgctgatcttgtcacagatgatacttatgctggatattcttgagatgtttctgaacttccactacctgacatacgtccgaattgacgagaacgcaagtagtgagcagaggcaggaactcatgcgcagttttaaccgtgaccggcggatcttctgcgccatcctgtccacacatagccggacaacaggcattaacctcgtggaagccgatacagtggtattctacgacaacgacctgaaccctgtgatggatgccaaagcccaggagtggtgcgaccgcatcggacggtgcaaggatattcacatctatcgcctggtgtccggaaatagcatcgaagagaagttgctcaaaaacggtaccaaggatctcattcgtgaggtggccgcacagggcaacgattactcaatggcattcctaacgcagaggactatacaggaactgtttgaggtgtacagtcccatggacgatgcaggcttcccagtgaaggccgaggaatttgtggtcctgagccaagagccaagcgtgacggaaactatcgcacccaagatcgcacggccttttattgaggccctgaaaagcatcgagtatttggaagaggatgcccaaaagtcagctcaggaaggggtcttgggacctcatacagacgcactgtcatcagactccgaaaatatgccttgcgacgaagaaccgagtcagttagaggagctggctgattttatggaacagcttacacccatcgaaaagtatgcgcttaactacctagagctgttccacaccagcatcgaacaagagaaagagcgcaactcagaagacgccgtgatgacggccgttagagcctgggagttctggaacctcaagacattacaagaaagggaagcccgcttgcgtcttgaacaagaagaagccgaactgttgacttatacccgtgaggatgcctactctatggaatacgtctacgaagacgttgatgggcagactgaagtgatgcctctgtggacaccacctaccccaccgcaggacgattctgatatttacctcgactccgttatgtgcctcatgtacgaagctacccctatacctgaagctaaactgccacctgtctatgtcaggaaggaacgcaagcgccataaaacggacccctccgccgcaggcaggaaaaaaaagcaacgacacggagaggccgtggtgcctcctcggtccctgttcgatagagccacgcctggcctcctgaaaattcgccgggagggtaaggaacagaagaaaaacatcttattaaaacagcaggttccttttgcaaagccactgccaacatttgctaaaccaacagcagagcccggacaggacaatccagaatggctgatttccgaagactgggcacttttgcaggctgtgaagcaactcttagagctgccccttaacctcaccatcgtttctcctgcacataccccaaactgggatttggtctctgacgttgtgaattcctgctctcggatttaccggagctcaaagcaatgtcgtaacaggtacgagaatgtgatcatcccacgggaagagggcaaatccaagaacaacagacccctgaggacctctcagatttacgctcaagacgaaaacgccacgcacacacagctctatacttcacacttcgatcttatgaaaatgaccgcaggaaagaggtcgccgcctattaaaccactgctcggcatgaaccctttccagaagaacccaaagcatgcttctgtgctggcagaatccgggatcaactacgataagccgctcccccccattcaggtggccagtctgcgagctgaaagaatagctaaagagaaaaaagctctggcagaccagcagaaagcgcagcagcccgccgtcgcccaaccaccccccccgcagccccaacctcccccccccccgcagcagccccccccacctcttccccagccccaagcagcaggctctcagccacctgctggtccgcccgctgtgcagccccagccccaacctcagccgcagacacagccccaacccgtgcaggctcctgcgaaggcccagcctgcaatcacaaccggaggctctgctgcagtcctcgccggcacaattaagacctccgttactggcacaagcatgccaactggagcggtgtccggcaacgtgatagtaaacacaattgcaggcgtgccagctgctacatttcagtccattaataagcgtctcgcttcaccagtggcacctggtgcactgaccactcccggagggtctgccccagcgcaagttgtgcacactcagcctccccccagagcagttgggagccccgctactgcaacccccgatctggtaagtatggctaccactcagggagtgagggctgtgacctctgtgaccgcttcagccgtggtaactacaaatcttaccccagtgcaaactcccgcacgctcactggtgcctcaggtgtcccaagccaccggcgttcagctgccgggaaaaacaataacacccgcacacttccagctgctgcgccagcaacagcagcagcagcagcagcaacagcagcagcagcagcagcagcaacagcagcagcagcaacagcagcagcagcagcagcagacaactactaccagccaagtccaggtgccgcagatccagggccaggcccagagccctgcccagattaaggcagtcggcaagctgacacccgaacacttgatcaagatgcagaaacagaaattgcaaatgcccccacagcccccaccaccgcaggcacagagtgctcctccgcagccaaccgctcaagtgcaagtccagacatcccagcccccccagcagcagagtccacaactcacgaccgtgacagcgcctcggccaggggcgctgctgactggaaccactgtggccaatctgcaagttgccagactcactcgggtccctaccagccaactacaggcccagggccagatgcaaacccaagccccacagcctgcacaggtagccttagccaagcctccagtggtgtcggtgcccgccgcggtggtgagcagccccggcgtcaccacccttccaatgaatgtcgccgggatatctgttgccattggacagccacagaaagctgccgggcaaaccgtggtagcccagcctgttcatatgcagcaattgctcaagttgaagcagcaagcagttcagcagcaaaaagccattcagccccaggcagcgcagggtcctgcagcggtgcaacagaagattaccgctcagcagatcacaacccccggagcccagcaaaaggtcgcatatgccgcccaacctgcccttaaaacccagtttttgaccacacctattagccaggctcagaaattagccggggcccagcaagtgcagacacagattcaggtagcgaaactgccccaggtcgtccagcagcagacccctgttgcctctattcaacaggtggcctctgcatctcagcaagcctccccgcaaactgttgctctgacacaagcgaccgccgctggtcagcaggttcagatgatcccagcggttactgccacagcccaggttgttcaacagaaacttatccagcagcaggtagtgacaactgcctccgctccgttgcaaacgcctggcgcaccgaatcccgctcaggttccggcttctagtgactcacctagccagcagccaaaacttcagatgagggtcccggccgtgaggttgaaaacacccacaaagccaccctgccagtag

SEQ ID NO: 186203 - DNA, 9480 bp, Artificial Sequence
  Description of Artificial Sequence: Synthetic coding sequence
atgcaccacggcaccggcccccagaacgtgcagcaccagctgcagagatcaagggcgtgccctggatcagagggggaggagcaacctgctcaccccaacccaccccctagcccggcggcccccttcgcaccgtcggcatctccttctgcgccacaatctccgagttatcagattcagcagttgatgaatagaagccctgcgacaggccaaaatgttaacatcacactgcagagcgtgggcccagtggtcggaggcaatcagcagatcaccctagcccctttacccctgccaagtccaaccagtccggggttccagtttagcgcccaacctaggcggtttgaacatggatccccatcctatattcaggtgacttcaccactaagtcagcaggtgcagactcaatctcctacgcaaccttccccgggcccgggccaggcactgcagaatgtcagagcaggcgcaccgggccctggactcggtctctgtagctcttcacctaccggcggtttcgtcgacgccagtgtcctcgtgaggcagatctcgttgagtccttcttctggcggtcattttgtctttcaggatggaagtgggctcacccagattgcccagggtgcacaggtgcagctccagcatcctggcaccccaatcaccgtgcgcgagagaagaccatcccaacctcatacacagtctggaggcacaatccaccacctgggccctcaatcacccgccgcagcaggcggtgctggcctgcaaccgttagcctcaccttcccatattactactgccaacctgcctccacaaatatcatccataattcaaggccagctggtccagcagcaacaagtgctgcagggcccccctctgcctcgcccactgggatttgaaaggacccccggcgtcttgctgcccggggcgggaggagctgccggctttggaatgacgtcacctcctccccccacgtcaccatcccgcacagccgtccccccagggctctccagcctgccattgaccagtgtaggaaatacgggaatgaagaaagtccctaaaaagctggaagaaatcccgcctgcgagcccggaaatggcacagatgagaaagcagtgccttgattaccactatcaggagatgcaagccttgaaagaggtgttcaaggagtatctgattgagctgtttttcttgcagcacttccaaggtaatatgatggacttcctggcattcaaaaaaaagcactatgcacctttgcaggcatacctcagacagaacgacctggacatcgaagaggaagaagaagaggaagaagaagaagaagagaaatccgaggttataaacgacgaagtcaaggttgtgacaggaaaagacggacagaccgggacacctgtggccattgcaacccagctgccgcctaaggtgtccgccgccttcagcagccagcagcagccgtttcaacaggcattggccggatccctcgtggctggcgccggaagtacagtggagaccgacctctttaaacgccagcaggccatgccttcaacaggaatggcagagcaatcaaaacggccgcggctggaagtgggtcatcagggggtggtctttcaacatcccggagcagacgcaggagtgcctctccaacagcttatgcctaccgctcaagggggaatgccacccactccacaggccgctcagttggctggccagaggcagtcacaacaacagtacgacccaagcaccggcccgcccgttcagaatgctgcctcgctccatacccccttaccgcagctgcctgggcgcctgcccccagccggcgtgcctactgcagcgctatcttctgccctccagtttgctcagcagccacaagttgtggaggctcagacacagctgcagatccccgtgaaaacacagcagccgaatgtaccaattcctgccccccccagctctcagctgccaattcccccctctcaaccagcccagctggctctgcacgtgcccacgcctgggaaagtccaggtgcaggccagccagctctcctcactgccgcagatggtggcttccacacgcctccctgttgatcctgctcccccctgcccacggcctctcccaacttccagtacttcttccctggcgccggtgagtggttccgggcctggaccatctcccgcccgatcttcccctgtaaataggcctagttcagccactaacaaagccctgtccccagtcacgagtcggacacctggggttgtggcctctgctccaacgaaaccccaaagtcctgcccagaatgccacctcaagccaggactcctcacaagacacacttaccgaacagataactctcgaaaaccaggtgcatcagcgcatcgctgaactgaggaaggcagggctgtggtcccagaggcgcctgccaaaactgcaggaggccccgcgacccaaatcgcactgggattacctccttgaggaaatgcaatggatggctacagattttgctcaggaaaggagatggaaggtcgctgccgctaaaaaactggtgaggaccgtcgtcaggcatcacgaggagaagcagctgcgggaagagagaggcaaaaaagaggaacagtctcgcctgaggcgaattgcagcctccactgcaagagaaatcgaatgcttctggtctaacatagagcaggtggtggaaatcaagctgcgagtggagcttgaggagaaaaggaagaaagcactgaatctgcagaaagtgtctcgtaggggcaaggaactgcgcccaaaaggctttgatgcccttcaagagtcgagcctcgactctgggatgtccggtagaaagagaaaggcaagcatttctctgactgatgacgaagtggacgacgaggaggagacaattgaagaagaggaggcaaacgagggagtcgttgaccaccaaactgagctgtcgaacttggccaaagaagccgaactgcccctgcttgacttaatgaaattgtatgagggagcttttctcccaagctcacaatggccccggcctaaaccagatggggaggacacgtccggagaggaggatgcggatgattgtcctggagacagggagagccgcaaggatctggtgctgattgacagtctgttcataatggaccagttcaaggccgctgagcgcatgaatatcggtaaaccaaatgccaaggatatagctgacgtgactgcggtggccgaagcgatcctgcctaaaggatctgcccgagtgacaacctccgtcaagttcaacgcgccctccctgctgtatggagcccttcgggactatcagaagatcggactggattggctggccaaattgtatcggaagaacttgaacggcatactggccgatgaagccggactgggaaagaccgtgcaaattattgcttttttcgcccatcttgcctgcaatgagggaaattggggaccacatctggtcgttgtgaggtcctgcaatatccttaagtgggagctcgaacttaaaagatggtgtcctggtctgaagatactctcctacatagggtcgcaccgagagctaaaggctaaaagacaggaatgggccgagcccaacagcttccacgtgtgcatcacttcttatacccagttcttcaggggtctcacggcattcacacgtgtacggtggaagtgcctcgtgattgatgagatgcagcgtgtcaagggtatgaccgagcggcactgggaagccgtgttcaccttgcaatctcagcaaagactgctcctgattgatagtccactgcacaacactttcctggagctttggaccatggtgcatttcctggtccccggtatcagtcggccctatctgagcagtccactgagggcgcccagtgaggagagccaggactactatcataaagtggtgataagattgcacagagtgacccaaccctttatcctgagacggaccaagcgggacgtggagaagcagttgaccaagaaatatgagcatgtgctgaaatgtcggctcagcaatcgtcagaaggcgctttacgaggatgtaattctgcaacccggaactcaagaagcactaaagtccggacacttcgttaatgttctgagtattttggtgcgcttacagcggatttgtaatcatcctggactagttgaaccacggcacccaggttcaagctatgtggcaggcccattggagtacccatcagctagcctcattctcaaagccctagaacgcgacttttggaaagaggctgacctaagcatgttcgacttgatcggactagagaataagataacacgccacgaggcggagctgcttagtaaaaagaaaatccccagaaaactcatggaagagatttccacgtctgcggccccggctgctcgcccggctgccgcaaagttgaaggcatcacggcttttccagccggtgcagtacgggcagaaaccagaaggcagaaccgtcgctttccctagcacacaccctccacggactgcagctccgaccacggcaagcgctgccccccagggaccgcttcgtggtcggcctccaattgctacgttcagtgcaaatcccgaagctaaggccgcagcggcaccctttcagacgtcacaggcatcagccagtgctccgaggcatcagcccgcttccgcatcaagcacagcggcaagtcccgcccacccggctaaactccgcgcccagaccaccgctcaggccagcactcccggccagccgcctcctcagccacaagctccgtctcacgcagccggccaaagcgccctgccgcagagactcgttctgccaagccaagcgcaggccaggctacctagtggcgaagttgtgaagatcgcccaactggcaagtattacaggaccccagtctcgcgtcgcccagccagagacgcccgtgacactccaattccagggcagcaaatttaccctgagccattcacaattacgccagctgaccgccggtcagcctttgcaactgcagggcagcgtcctgcagatcgtgtctgcacccggccaaccgtacctgcgcgcacccggccccgtcgtgatgcaaactgtgtcacaggccggagctgtgcatggggccctcggttctaaaccacctgccggtggcccctcgcccgctccattaacacctcaagtgggagtcccaggtagagttgccgtgaacgccctcgcagtcggcgaacccggaacggcttcaaagccagcctctccaataggcggtcctacgcaggaagaaaagacgcggctactgaaagagaggttagaccagatctatctggtgaacgagcgccgttgtagccaagcgccggtgtacgggagggatttactccggatatgcgccctcccgtcacatggaagagttcagtggcgcggttcgctggacggtagacgtggaaaagaggcgggccccgcccactcttacacctccagctcagagtccccaagtgagcttatgttgactctttgcaggtgcggcgagagcctgcaggacgtgattgatcgcgtcgcttttgtgattcctccggtagtggccgcccctccttcattgcgggtccctcgacccccacccctctactctcacagaatgaggatccttagacaagggctccgtgaacacgcggcgccttactttcagcagctgcgccagaccaccgccccaaggttactgcaattccccgaactgcggctcgtgcagttcgactccggcaaactcgaggctctggccatcctcctgcaaaaattgaagagtgaagggaggcgtgtgttgattctatcacagatgatcttgatgctggacatcttagagatgttcctgaatttccactacctgacctacgtgcgcatcgacgaaaatgcgtcaagtgaacagagacaggaattaatgagatcctttaaccgggatcggagaattttttgcgctatcctgtcaacacactctaggactaccggaatcaacctggttgaggccgatacagtggtcttctacgacaacgaccttaatcccgttatggatgccaaagcccaggaatggtgtgacagaattggccgctgcaaggacatccatatctaccgcctggtatccggaaacagcatagaagagaagttgcttaagaacgggactaaagatctcatcagagaggtggccgcccagggaaacgactattccatggcatttctgacccagaggacaattcaggagctctttgaggtctactcccctatggacgacgctggatttcccgtgaaggccgaagaattcgttgtcctgagtcaagagccttctgtaaccgaaactattgctcccaaaatcgcccgcccattcatcgaggccctcaaatctatcgagtacctggaagaggatgcccaaaagagcgcccaagaaggtgtgctcggcccccacacagacgcgttgtccagcgactcagaaaacatgccctgcgacgaagaaccgagccaattagaagagcttgctgactttatggaacagcttacccccatcgaaaaatacgccctgaactacctggagttattccatacatctatcgaacaggagaaagagcggaattccgaggacgcagtcatgacagctgtgcgggcctgggaattctggaatctgaagacactgcaggagagagaagcccgcctgaggctcgaacaggaggaggccgagctcctgacatatactcgcgaggacgcgtatagcatggagtatgtgtacgaggatgtagacgggcagaccgaagtcatgcctttatggaccccacctaccccaccccaggatgactcggatatctacctggactcggtcatgtgtctaatgtacgaagcgacccccatacctgaggccaaacttccccccgtatacgtgcggaaagagagaaaaaggcacaagacagatcccagcgccgccggcaggaagaagaagcagcgtcacggcgaggccgtggttccccccagatctctgttcgaccgcgcaacacccggactcctgaagatccgacgagagggcaaagaacaaaaaaagaatatcctgttgaagcagcaggtgcccttcgccaagcctctccctacattcgccaagccgactgcagaacccggccaggacaacccagaatggctcatatcagaggattgggctctcctccaagccgtgaagcagctgctggaacttccactgaacttaaccatagtatcacctgcccacacacccaattgggacctcgttagcgatgtcgtcaacagctgctcgagaatctaccggagtagcaagcaatgtaggaacagatacgaaaacgtgattattcctcgtgaggaaggcaaatcaaaaaataacagaccccttcggacaagccagatctatgcccaggatgagaatgctactcacactcagctgtatacatcacattttgaccttatgaagatgactgctggcaagcggagtccaccaattaaacctctcctgggaatgaacccattccagaagaatccaaagcatgcttccgtccttgcggaaagtgggattaactacgataagcctctacccccgatccaggtggcatcactgagggcagagcgcattgctaaagaaaaaaaggcattagccgaccaacaaaaggcccagcagcccgcagtcgcccagcctccacccccccagccacaaccgcccccccctccacagcagcctccaccacccctgcctcaaccccaagccgccgggtcccagcctccagcggggcctcctgctgttcaaccacagccccagccccaaccccaaacccagccccagccagtccaagcaccagccaaggcccagccggccatcaccaccggaggaagtgcggcagtccttgcaggaaccattaaaacaagcgtcaccggaacttcaatgccaacaggagccgtttcgggcaacgtaatagtgaacacaattgctggggtgccggctgccaccttccagagcatcaataaaagactggccagcccggtagcgccaggagccctaacaactccggggggcagtgcccccgctcaggtggtccacacccagcctcctccccgggccgtcggttcacccgcaaccgcaacaccagatctggtgtcgatggcaacaacacagggggtccgagccgttacaagcgtaacggctagcgccgtagttacaaccaatcttacacccgtgcaaaccccggcccgctccctggttcctcaggtgtctcaagccacaggagtgcagttacccggcaagacaattactcctgcccattttcagctgctgcgccagcagcagcagcagcagcagcagcagcagcagcagcagcaacagcagcagcaacagcagcagcagcagcagcaacagcagcagcagaccacgaccacttcacaggtgcaagtccctcaaatacagggccaggcccagtccccagcacagatcaaggccgtaggaaaactgacccctgagcacctgattaagatgcagaagcaaaaactccaaatgcccccacagccaccccctcctcaggctcagtctgctccgcctcagccgactgcccaagtacaggtccagacctctcagcccccacagcaacagtcaccacagctcacgaccgtaactgccccccgccccggcgccctattaaccggcactaccgtggctaatctgcaggttgcgcggctgacaagagtcccaaccagtcagctgcaggcccagggacaaatgcagacacaagcccctcagccagctcaggtcgcactcgcaaaacccccagtggtgagcgtgcctgccgcggtggtgtcaagcccaggcgttacaaccctcccaatgaacgtcgctggcatttctgttgcaatcggccagccccagaaagctgcaggtcaaaccgtggtggcccagcctgtgcatatgcagcagctgctcaaacttaaacagcaggcagtgcagcagcaaaaggctatccagcctcaggccgcccaagggcccgccgccgtgcaacaaaagatcacagcccaacagatcaccacccccggcgcccaacagaaggttgcttacgccgctcagcccgcactgaagacacagtttttgaccaccccaattagccaggcccagaagctggcgggggcccagcaggtgcaaacacaaattcaggtagccaagttgccacaagttgtgcaacagcagacaccagtggcctccatccagcaggtggctagtgcttctcagcaagcttccccacagacagtggctctcactcaggctacggccgcgggccaacaggtgcaaatgatccccgcggtcaccgcaacggcacaggtagtgcagcagaaattgatccagcagcaggtcgtgaccacagcgtcagctcctctccagacacccggagctccgaatccagcacaggtgcctgcatcctctgactccccgtctcagcaaccaaagctccagatgcgcgttcctgcggtccgtctgaaaacgccaacaaaacccccctgccagtag

SEQ ID NO: 186204 - DNA, 9372 bp, Artificial Sequence
  Description of Artificial Sequence: Synthetic coding sequence
atgcaccacggcaccggcccccagaacgtgcagcaccagctgcagcgtagcagggcttgccccggttccgaaggtgaagaacagccagctcatccaaatcctccaccttccccagctgctccctttgccccctcagcgtcaccctccgcaccgcaatccccctcctaccagatccaacagctcatgaacaggagtcccgccacaggtcaaaatgtgaatatcactctccagagcgtaggcccggttgtgggcgggaatcagcagatcactctggccccccttccacttccatcaccaacatctcctggatttcaattctccgctcagcccaggcgtttcgagcacgggtcccccagttatattcaggtgaccagtccactttcccagcaggtacagacgcagtcacccactcaacctagcccagggcccgggcaggccctccaaaacgtgcgcgccggcgcccctggccccggcctcgggctgtgctcaagttccccaaccggagggttcgtggacgcctcagttctggtccggcagatcagtctttccccctcaagcgggggccattttgtttttcaagatggctctggactgacacagattgctcagggtgcccaagttcaacttcaacaccctgggacccccatcactgtgagggaaagaagaccgtctcagccccacacacagagcggtggtacgatccaccatcttggcccacagtctcccgctgccgccgggggcgctggtttacagcctctggcctctccatcgcacatcacaacggctaaccttccaccgcagatcagctccattattcagggacagctcgttcagcagcagcaggtcctgcaaggtcctccactcccaagacctttgggtttcgagcgaactccgggcgtcctgctgccgggagctggaggggcggctggctttgggatgacgtcaccgccccctcccacctcgccatccaggaccgccgtgccgcctggacttagtagcttgcctttaacgtctgtgggaaacacaggtatgaaaaaggtgccgaaaaagctggaagaaatccccccagcgagcccagaaatggcccagatgagaaagcagtgcctggactatcattatcaggagatgcaggcgttgaaagaagtttttaaagagtatctgatcgagctattcttccttcaacacttccagggaaacatgatggatttcctcgcctttaagaagaaacattatgctccactacaggcgtatctgaggcagaatgaccttgatatcgaagaagaggaggaggaggaggaggaggaagaggaaaagagcgaagtaattaatgacgagcaacaggctcttgcaggatctctggttgccggagctggctcaaccgtggaaactgatctattcaaacggcagcaggccatgcctagcaccggtatggccgagcagtctaagcgcccaagactggaagttggacaccagggggtcgtgttccagcatcccggcgctgacgcaggagtgcccctgcagcagcttatgccaactgcccagggcgggatgcctcccacaccccaggcagcccagctcgcgggccagcgtcagtcccaacagcagtacgacccgtccacaggaccacccgtgcagaatgcagcatcccttcacacccctttgccccagttaccaggcagattgccacccgcgggtgtgcctacagctgctttaagttcagctcttcagtttgcccagcagccgcaggtcgtcgaagctcaaacacaattacagatccccgtgaaaacccagcagcctaacgtgccaatccccgctcccccatcctcgcagctgccaattccgccctctcagccagcacagctggccctccacgtaccaacacccggtaaggtgcaggtgcaggcctcccagctttcatcgttgcctcagatggtcgccagcaccagactgcccgttgacccggccccaccatgccccagacctctgcctacaagtagcacatcatcattggctcctgttagcgggtccggccccggtccaagtcctgcccggtccagtcccgtcaacaggccatcttctgctaccaataaagccctctcgcccgtgacttcccgaactcccggggtggtagctagcgcacccactaaaccccagtcccctgctcagaatgctacctccagccaggattccagccaagatactctcaccgagcagatcacactggagaaccaagtacaccaacgaattgccgaactgcggaaggctggcctgtggagtcaaagaaggctgcctaaactccaggaggctcctcgcccaaagtcacattgggactacctcctggaagagatgcaatggatggcaactgacttcgcacaggaacgacgctggaaagttgcagctgctaagaagcttgttcgcacagtggtgcgccatcatgaagagaagcagcttcgcgaggagaggggaaagaaggaggaacagtctcggcttaggcgcatagccgccagtactgccagagagatcgagtgcttctggtctaatattgagcaggttgtggaaataaagctgagggtcgagctcgaagaaaagcggaagaaggcactgaatctgcaaaaagtaagccgcagggggaaggaactccggcctaaaggttttgatgcgcttcaggagtccagcctcgattctgggatgtcagggcgcaaaagaaaggcatccatatctcttactgatgatgaagttgacgatgaagaggaaacaatagaagaggaagaagccaacgagggtgtggtcgatcaccagaccgaactgtctaacctggcaaaggaggccgaactacccctgcttgatctgatgaaactgtacgagggcgcctttctaccatcttcacagtggcctcggccgaagcccgatggtgaagacaccagcggagaagaagatgccgatgactgccccggggacagggaatcaagaaaagatctagttttaatcgactccctcttcataatggatcaattcaaagctgccgaaaggatgaatatcggcaagccaaatgccaaagatatcgcagatgttacagccgtcgctgaagctattctaccgaaggggagcgcccgcgtgaccacttccgtcaagttcaacgctcccagcctgttgtacggagcgctgcgggattaccagaagatcggcctggattggctcgcaaaactctatcgcaaaaatctgaacggtatcctcgcggacgaggccggccttggcaagaccgtgcaaattatcgctttttttgcccacctcgcttgcaacgagggtaactggggcccccatctggtagttgttcggagctgtaatattttgaagtgggaactggagctgaagcgatggtgtcccgggcttaaaatactcagctatattggttcgcacagagaacttaaggccaagcgtcaggagtgggctgaaccgaacagtttccacgtgtgtataacgtcttacactcagttttttaggggactcacagcctttactagagttcggtggaagtgtctggtgatcgatgagatgcagcgggttaagggcatgacagaacgccattgggaggccgtctttacattgcagagtcagcagcggcttctgctgatcgatagcccactgcataacacgtttcttgagctctggaccatggtccactttctcgttcctgggatttccagaccctacttgtctagcccacttagggccccctccgaagagagccaggattattatcacaaggttgttattaggttacaccgcgtcacccaacctttcattctccgtcgtactaagagagatgtggagaagcagctgactaaaaaatacgaacacgtgctcaagtgtaggctcagtaacaggcagaaagcactgtatgaagatgtgattctgcaacccggaacgcaggaggccctaaagtcaggccactttgtcaacgtcctctctatcctggtcagattgcagcgtatctgtaatcaccctggactagtggaaccccgtcaccccggatcttcctacgtggctgggccactggagtatccatcagcctccctgatactgaaagcacttgagagggatttttggaaggaggcggacctttccatgtttgacttgatagggcttgaaaacaaaatcaccaggcatgaggctgagctgctgtctaagaagaagatcccgcgcaaattgatggaggagattagtactagcgctgcaccggccgctcgtcctgccgcggccaaactgaaggcctctcgattgttccagcctgttcagtacggccaaaagcccgagggaaggactgtggccttccctagtacgcaccctcctcggaccgcagcccccactactgcgtctgccgcccctcagggccctcttcgagggcgtcctcccatagcaactttcagtgcaaacccggaagctaaagcggccgcagccccctttcagacctcacaggcctcagcctcagccccccgccaccagcccgcttctgccagcagtactgctgccagccctgcccaccccgctaagctgcgggcccagaccacagctcaggcctcaacacctggccagccccccccacaacctcaggcacctagccacgcagctgggcaatctgccctcccacagcgactggtattaccttcgcaggctcaggctcgactgcctagcggcgaggttgtgaagatcgctcagctggctagtataaccggcccacaatccagagttgcccaacctgaaacccccgtcacgctacagtttcaggggtctaagtttacccttagccactcgcagcttcggcagctgacagctggtcagcccctgcaactccagggctccgtactgcagattgtctccgccccaggccaaccttaccttcgtgcaccaggtccagtcgtgatgcagactgttagtcaagccggcgccgtgcatggcgctctgggctcaaagccccctgccggaggaccctcaccggccccgttaacacctcaggtaggagttcccggtcgggtggctgtgaacgccctcgccgtgggcgaaccaggaacagcatctaaacctgcctcgcctattgggggtcctacccaggaggagaagactcggctcctgaaggaaaggctcgaccagatctacctggttaacgaaagaaggtgctcccaggcccccgtttatgggagagacttactccggatatgcgccctaccatcacacgggcgtgtccagtggcgcggtagtctcgacggccgcagggggaaggaagcgggccctgcccactcatacacatctagttccgaaagcccctccgagctgatgttgactctgtgcaggtgtggggagtcattgcaggacgtgattgaccgagtcgcctttgtgatcccccctgtcgtcgccgctcctccctccctccgagttcccaggccccccccactctatagtcaccgaatgcgcatcctaagacaggggctgagagagcacgcagcgccttactttcagcagctcaggcagactaccgcacctaggctgcttcagtttccggaactacgactagtgcaatttgactctgggaagctagaggctctggcgatcctgcttcagaaactcaaaagcgagggacggagggtgctgatcctgtcccagatgatccttatgctggacattctggagatgttcctgaacttccattatctgacatatgtcaggattgacgagaatgcttcaagcgaacaacgccaggagctcatgcgtagtttcaatagagaccgccggatcttttgtgcaatcctgtctacacattcaaggactacgggtatcaacctggtggaggctgacacggtagtcttctacgataacgatctcaatcctgtcatggacgcaaaggcacaagaatggtgtgaccgcattggtcgctgcaaagatattcatatctaccgcttagtgagcggtaactccatcgaggagaagctgcttaagaacggcactaaggacctgatacgggaggttgcagctcaggggaacgactatagcatggccttcctgactcaacgcaccattcaagaactcttcgaagtctactcgcctatggacgatgcgggctttcccgtgaaagcagaagaattcgtcgttttgtctcaagaaccatctgtgacggagacaattgcccccaaaatcgcccgcccatttattgaggctttgaaaagtatcgagtatttggaggaagatgctcagaaatctgcacaggaaggagttctcggtccccacacagacgcattaagtagcgattcagagaacatgccatgcgatgaagaaccctcccagctggaggaactggcagactttatggaacaactgaccccgatcgagaaatacgctctgaactatttggaactgttccacacttctatagagcaggaaaaagagaggaactctgaggatgccgtcatgactgccgtgcgagcttgggaattctggaatctcaagactctgcaggaacgcgaggctcgactgcgtctggagcaagaagaagccgagttactaacctataccagagaggacgcctactcaatggagtatgtgtacgaggacgtcgacggccaaaccgaagttatgcccctctggactcctcccacgcccccccaggacgactcagacatctacctcgacagcgtaatgtgtctgatgtacgaggctacgcccatccctgaggccaagctgccccccgtatatgtaaggaaagagcgaaagagacacaaaaccgaccccagtgcggccgggcgaaaaaaaaaacagcgccacggggaagcggtggtcccacctaggtcactttttgacagagcgacccctggcctgctgaaaattcggcgggagggtaaagagcaaaaaaagaacatactcttgaagcagcaggtgcctttcgcaaagcccttgcctaccttcgcaaagcctaccgccgagccaggacaggataatccagaatggctgatcagcgaagattgggcgcttttacaggccgttaagcagctgctggagcttcccctgaacctaaccatcgtgtctcccgcacacactccaaattgggatttggtaagcgatgtagtgaatagttgttctcgtatttatcggtcatccaaacaatgtagaaaccgctatgagaatgtcatcatcccccgggaagagggaaagagcaagaataatagacctctgaggactagccaaatctatgctcaggacgagaacgccacccacacccagctgtatacctctcacttcgacctgatgaaaatgacggccgggaagagaagtcctcccatcaagccactgttgggcatgaacccgttccagaagaatccaaagcacgcctccgtcctggccgagtctggcattaactacgataagccactgcctcctatacaggtggcatcattgcgggcggaaaggattgctaaggagaaaaaagccctcgccgatcaacagaaagcccagcaacccgccgtcgcgcagcccccccccccgcagccacagcctcctcccccacctcaacagccccctcctcccctgccgcagccacaggcagctgggtctcagccccccgctggcccacctgctgtgcaaccgcaacctcagccacagcctcagacccagccacagccggtgcaagctcccgccaaagcccagcctgccatcaccacaggtggctcggctgccgttctggctggtacgatcaagaccagcgtgactggcacaagcatgcccacaggagctgtgagtgggaatgtcattgtgaacacgattgctggggtgcccgccgccacctttcagtcaatcaacaagaggctggcatcccctgtggcccccggggcgctgactacgcccgggggcagcgctcctgctcaggttgtgcacacccagcctccacctagagccgtgggttcccccgctaccgctactcctgatcttgtgtcaatggctaccacccagggcgtccgcgcagtaaccagcgttactgctagcgctgttgtgacaaccaaccttacaccagtgcagactcctgcccgaagtctggttccccaagtttctcaggctacaggcgtgcagctgccggggaagacaattactcctgcacacttccagctgcttcggcagcaacagcagcagcagcagcagcaacagcagcagcaacagcagcagcagcaacaacagcaacagcagcagcagcaacagcaacagacaacaacaaccagtcaagtgcaggtgccgcaaatccagggccaggcacagagcccggcgcagatcaaggccgtaggcaaactcacgcctgagcacttaatcaaaatgcagaagcagaaacttcagatgcccccacagccgccccctccacaggcccagtcagcccctccacagcctacagctcaggtccaggtgcagacatctcagccaccccaacagcagtctccgcagcttacaactgtgacggctccaagacctggcgcactcctgaccggaacaaccgtcgcaaaccttcaagtggcaaggctgacacgcgtccctacctcgcaactacaagcccaagggcagatgcagacgcaggcaccacaaccagcccaggtcgcccttgccaaacccccagtcgtgagcgtgccggccgcggtcgtcagttctcccggagtaaccaccctgccaatgaacgtggccggcatatccgtagctattggtcagccccagaaggccgccggtcaaaccgtggtggcacagcccgttcacatgcaacaattgcttaaactaaagcaacaggcggtgcagcaacagaaggccattcagccccaggctgctcagggtcctgcggcagtacagcagaaaatcacagctcagcaaatcactacccccggagctcaacagaaggtggcctacgctgctcaacctgccctaaaaacacagttcctgaccaccccaatttcacaagcccaaaaactggctggcgctcagcaggtgcagacgcagatccaggtcgccaagctgccacaagtggtgcaacagcagacaccagtcgctagtattcagcaagttgcctctgcttcccagcaggcctccccgcaaactgtggcactgactcaggccacagctgcgggacaacaggtgcaaatgatccccgcggtcaccgcaaccgcccaggtcgtccaacaaaagctaattcaacagcaggtggtgacgaccgcaagtgcacctctccagacgccgggagccccgaatcccgcccaggtcccagctagttcggacagcccgtctcagcaaccaaagcttcagatgcgcgtgccagcggtgaggctgaaaacaccaacaaaaccaccctgtcagtag

SEQ ID NO: 186205 - DNA, 9369 bp, Artificial Sequence
  Description of Artificial Sequence: Synthetic coding sequence
atgcaccacggcaccggcccccagaacgtgcagcaccagctgcagcgatccagggcctgccctggctcagaaggcgaagagcagcccgcccatcctaacccacccccgagcccagccgcaccgttcgcaccatcagcaagtccttccgccccacagagtccttcttatcagatacagcagctgatgaaccgctcccctgctactggacagaacgttaatatcacgctgcaatcggtcggacccgtggtaggcggaaaccagcagattacgctggctcctctgcctctcccctccccaaccagccctggatttcaattctcggcacagccgcgtcggttcgagcacggatccccttcatacattcaggtgacttcccctttgtcacagcaggttcagacacagtctccaactcagccgagccccgggcccgggcaggccctgcagaacgtgagagccggcgccccagggccaggactgggcctatgctctagttctccaacgggaggcttcgtggacgcatccgttctggtgcggcagatttcactcagccccagctctggcggacatttcgtgttccaagacggctccggactcactcagatcgcacagggtgcgcaggtccagctgcagcatcccggaacccctattacagtgcgggagaggcggccatctcagccgcatacccaaagtggcggtacaatccatcacttaggcccacagtcgcctgccgcggccggcggggctggcctgcagcccctagcttcaccctcccatatcactacagctaacctgcctccacagatctcctccattattcagggccagctcgtccaacaacagcaagtgcttcagggccccccacttccgagacctctgggatttgagaggacgccaggggtgttgcttccaggggccggtggggctgccggttttggaatgaccagtccccctccccctacaagcccatctcggaccgccgtgccccctggcctgtccagcctgcctcttacctccgtcgggaatactgggatgaaaaaggtccccaagaagcttgaagagatcccccctgccagcccagagatggcccagatgcggaagcagtgcttggactaccactatcaggagatgcaggctctgaaggaggtgttcaaggagtacctgatcgaactgttctttctccagcacttccaaggaaacatgatggacttcttggcgtttaaaaagaaacactacgcacctctgcaggcctacctgagacagaatgatctggacatcgaggaggaagaagaggaggaagaggaggaggaagaaaaatccgaggtcatcaatgacgagcaagctctggcagggtctcttgtcgccggggccggtagcaccgtagaaacagacttattcaaacgccaacaggcgatgccttctaccgggatggccgaacagagcaagcgcccaaggcttgaagtgggacatcagggcgtggtgtttcagcaccctggcgcagatgccggtgttcctctacagcagctgatgcccacagcgcagggagggatgcctccgacgccacaggccgcccagttggcaggccagcgtcagtcacaacagcagtatgacccatccaccggccctcctgttcagaatgctgcctctttgcacacaccattacctcaactgcctggtcgcctgccgccagccggagttccaacagccgccctgagtagtgcactgcaattcgcccaacagccacaagtggttgaagcacagacccaactacaaattccggtcaagactcaacagccgaatgtgccgatcccagcgccaccatccagccaacttcctatcccccctagccagccagctcagctggccctgcatgtgcccacacccggaaaggtgcaggtgcaggcctcgcagctttcctccttacctcaaatggtggctagtacccgcctgccagttgatcccgccccaccgtgtccccggccactcccaacaagcagtacttcatccctagcccctgtgtcagggagcggccccggaccttcaccggccagaagttcacccgtgaatcgcccgagcagcgccaccaataaggcattatccccagtaaccagcagaactcccggagtcgtggcctctgcccccactaagccccagagtcctgcccaaaatgcaacctcatcccaggattcttcacaagataccctgacggaacagatcaccctggaaaaccaggtgcaccagcgcatcgctgaattgagaaaggccggactgtggtctcagcgccgtctgcctaaactgcaggaagccccccgccccaaaagtcattgggattatctactggaagaaatgcagtggatggccacagactttgctcaggagaggcggtggaaggtcgctgctgctaagaagttggtaaggaccgtggtgaggcaccacgaggagaaacagctaagggaggaacgaggaaagaaggaggaacaatctaggcttcggcgcatcgctgcctcaacagcccgcgaaattgagtgcttttggtcaaacatagaacaggtggtggaaatcaaacttcgagtagaattggaagaaaaacgaaaaaaggcacttaacctacaaaaagtctcaagaaggggcaaggaactacgcccgaaggggtttgatgcactccaggaaagcagcctcgattccggaatgtctggccgaaagaggaaagcatcaattagcttgacagacgatgaggttgatgacgaggaggagacaattgaggaagaagaggccaacgaaggagtggtggaccaccagaccgagctcagcaacctggctaaagaagccgaacttcctttattggatctgatgaagctgtatgaaggcgcatttcttccttctagtcaatggcctcgacccaagccagacggggaagacacgtctggggaggaagacgctgatgattgtcccggtgacagagaaagccgcaaagatttggtgctcattgactcactgttcataatggatcagttcaaggccgcggagaggatgaacattggtaaaccaaatgctaaagacatcgctgatgtgacggcagtggccgaggctatcttaccaaagggctccgccagagtaacaacttcagtcaagtttaacgccccatccttgttgtacggagcattgagagactaccaaaagatcgggttggattggcttgccaagctatatcgcaagaacctgaacgggattctggcggacgaggctgggttaggcaagaccgtgcagattatcgcgttcttcgcgcacctggcgtgcaacgaaggcaattggggaccccatctagttgtagtgaggtcatgtaacatcctgaagtgggaacttgaattaaagcgatggtgtccaggtctgaagattctgagctacatcggctcacaccgcgaactgaaggctaagaggcaggaatgggcagaacctaatagctttcatgtctgtatcacttcgtacactcagttctttcgcggccttaccgctttcactcgcgtccggtggaagtgcctggtcatagacgagatgcagcgagtgaaggggatgacagaaaggcactgggaagccgttttcacactgcagtcccagcagcgtttgttgctgatcgatagcccacttcacaacacctttctggaactttggactatggtccactttctggtgcccggcatctctcgcccgtacttgagctccccactgcgcgcaccttccgaagagtcacaggactattaccacaaggttgtgatcagactccacagggtgacacagcctttcattttaaggaggaccaagcgggacgtagaaaagcagttgacaaaaaagtacgagcacgtcctgaaatgccgtctgtccaaccgccaaaaggccctgtacgaagacgtgattctccaaccaggaacccaggaggctctgaagtccggacattttgtgaacgttctaagcattctggtaaggcttcaacggatttgtaatcaccctggactagtggagcctagacatccgggcagtagctatgtggccgggcccctagaatacccttccgcctcgctgattctcaaagcattggaaagagacttctggaaggaagctgacctgtcaatgttcgatttgattggcctcgagaataagataacgaggcacgaggccgaactcctttctaagaagaaaatcccacgcaaattaatggaagaaatctcaacatctgctgcccctgcagcccgccctgccgcagcaaagctaaaagcctctcggcttttccagcccgtgcaatacggacaaaaacctgagggtaggactgtggcatttccctctacacacccccctagaaccgcagcccctactaccgcttcggcagcccctcaaggtccacttagaggaaggccaccaatagccaccttttctgccaaccctgaggcaaaagcagcggccgcccctttccagactagtcaggcgagcgcatccgcaccacgccatcagccggcatcagcgtcatctacggcagcatcccccgcacaccccgctaaactgcgggcacaaaccactgcccaggccagtactcctggccagccaccgccccagccccaggcaccgagtcacgccgctggtcagtctgccctcccacaacggctcgttctgccctcccaagcacaggcaagattgccatccggggaagtcgtgaaaatcgcccaattggcatccatcactgggccacaaagtcgcgttgctcagcccgagactcctgtaacactacagtttcaggggagcaagtttactctgagtcatagtcaactgaggcagttgacagctggacagccactccagctgcaggggtctgtgttgcagatagtgagcgctcctggccagccttacttacgggccccgggacctgtcgttatgcagaccgttagtcaggcaggcgctgtgcatggagcactgggctcaaaacccccagccggcgggcctagtccagccccgcttactccccaggtaggcgtgccaggaagggtggctgtgaacgcactagcagtgggtgagcctggcactgctagcaaacccgcaagcccaatcggcggtccaactcaggaagagaaaacaaggctgctgaaggagcgtttggaccaaatttacttggtgaacgaacggagatgctcgcaagctcccgtgtatggacgtgacctactgcgcatctgcgctctgccctcacacggaagagtgcagtggcggggctcactagacggacgtcggggaaaagaagccggccctgcccactcttacacatcctcctctgagagtcccagtgagctcatgctcaccctgtgcagatgcggggaatccctgcaagatgtgattgaccgggtggcgtttgttatcccacctgtggtcgccgctcccccatccttacgagtgcctcggcccccccccctctactcccatcgtatgaggattctgcgacagggactgagggagcatgccgccccctatttccagcaacttaggcagacgaccgctcccagactgctacagtttccagagctgagactggtgcagtttgattccgggaaactggaagccctggctattttattgcagaagcttaagagtgagggaaggcgcgtcttgattctgagtcagatgatactgatgctcgacatacttgagatgtttctgaattttcattacctcacatacgtgcgcatcgacgagaatgccagtagcgaacagcgacaggaactgatgcgcagtttcaatagggatagaaggattttctgtgcgatactgtctactcacagcagaacaacgggaattaacctggtggaggccgacaccgtggtattctacgataatgacctgaacccagtcatggacgccaaagcccaggagtggtgcgataggattgggcgatgcaaggatatccatatttatcggctagtgtctggtaactcaatcgaggagaagctgctgaagaacgggacgaaagatctgatccgggaagtcgccgcccaaggaaatgactattcaatggccttccttacccagagaacaatccaggagctgtttgaagtttactccccaatggatgatgctggtttccctgttaaagcagaagagttcgtcgtcttgtcccaggaaccatcagttactgagaccattgcccctaagatcgcgcgtccctttatcgaggctctgaaatctatcgaatatttggaggaggatgctcaaaagtccgcacaagaaggcgtgttaggtccccataccgatgcactgtcatccgattcggaaaatatgccctgcgacgaagaacctagccaacttgaggaactggcggattttatggagcagctgactccaatagagaagtacgctcttaattaccttgagttgttccacacaagtatcgaacaggaaaaggagcgaaacagtgaggatgcagtaatgacagcagtgagagcttgggagttttggaatctgaagaccctgcaggagagggaggcaagactgcggctggagcaggaagaggcagagctcctcacgtacacgagagaagatgcatatagtatggaatatgtctacgaggatgtagatggccagactgaggtgatgcccctgtggacgcctccaacccctccccaggacgactccgacatctacctggacagcgtcatgtgtttaatgtatgaggctacacccattcccgaagcgaagcttccacctgtgtatgttagaaaagagagaaagcggcataaaacagatccgagcgctgccggccggaagaagaaacagcggcatggagaggctgtggtgcctccacgctccctgttcgatagggccacacccggccttctgaagatccgaagagagggaaaggaacagaaaaagaacattctactgaaacagcaggtgccatttgcaaaaccattgcccacttttgctaaacctactgcggagcccggccaagacaatccggaatggctcatctccgaggactgggcactcttgcaagcagttaagcagctcttagagcttcccctgaacctgacaattgtgagtccagcccacacccccaactgggacctagtcagtgacgttgtcaacagttgctccagaatctacagatctagcaaacagtgtaggaatagatacgaaaacgtgattatccctagggaggagggaaagtccaagaataaccgccctcttcgcaccagccagatttacgctcaggatgaaaacgcgacacacacacagctgtacactagccactttgatttgatgaagatgacagctgggaagcgctccccaccaatcaagccccttctgggtatgaatccatttcaaaagaacccaaagcacgccagtgttctggccgagtccggcatcaattatgacaaaccactgcctcccattcaggtggccagcctccgggccgagagaatagctaaagaaaagaaagccctggccgatcaacaaaaggctcagcagcctgccgtcgcccagcctcctcccccgcagcctcagccacctccacctccacagcaaccacctccgccgctcccccaaccacaggctgcgggctctcagccccctgcggggccccctgctgtccagccccagccccagcctcagcctcagacccagccacagccagtgcaggccccagctaaggcccagcccgccatcactacgggaggcagcgccgccgtcctggccgggacaataaaaacctctgtgactggcacaagtatgcctaccggagcagtatcaggcaacgtgattgttaacactattgcaggagtaccagcagcaacgttccagtccattaacaagcggttagcctctcccgtggcgccaggcgccctcactacacccggaggctctgccccggcccaggtcgtgcatacccagcctccgccgagggccgtgggcagtcctgctacagccaccccggatcttgtcagcatggccactacacagggagtcagagctgttacttcagtgactgcatctgctgtggtgacaacaaatcttacacctgtccagaccccagcacgaagcctggtcccccaggtctctcaggccacgggcgtccaactgcctgggaaaactatcaccccggcccatttccagttgcttcgccaacaacaacagcaacagcaacagcagcagcagcagcagcagcagcagcagcaacaacaacagcagcagcagcagcagcagcagcagactacaacaactagtcaggtgcaggtgccccagattcaaggccaggcccagagcccagcccaaatcaaggcagtcggcaaactgacaccagaacatctgatcaaaatgcagaagcagaagctgcagatgccaccgcagcccccccctccgcaggctcaatctgccccaccccagccgaccgcccaagtccaggtgcaaacatcccagcccccccagcagcagtctccacagctgactactgtgacagcccctcggcccggggcgttgctcacaggaacaaccgtggccaatctccaggtggctcgcctcaccagagtcccgacaagtcagctccaggctcagggacaaatgcagacacaggccccgcagccagctcaggtagctctggccaagccgcctgttgtttctgtgcctgctgcggttgtttcatcccctggggtgaccactcttccgatgaatgtggccgggattagcgtagcgatcggccaaccgcagaaggctgctggccaaacggtggttgcccagccggttcacatgcagcagctgctgaagctgaagcagcaggctgtacagcagcagaaagccatccaaccgcaggccgcacaggggccggctgctgtccagcagaaaattacagcccaacaaataacaactcctggtgcccaacagaaagtggcctatgctgcccagcccgctttgaaaacccagtttttgactacccctattagtcaggctcagaagctggcaggcgcccagcaagtacagactcaaatccaagtggccaagctcccacaggtggtacagcagcagacacctgttgcgtccattcagcaggtggccagcgcctcgcagcaggcatctccccaaaccgtggccctcacacaggctaccgcagctgggcagcaggtacagatgatcccagctgtgacagccactgctcaagtggtccaacagaaactaatacagcagcaggtggtcaccacggctagcgcacctctgcagacccctggagccccgaaccctgcacaagtacccgccagtagtgactctcccagtcaacagcccaagctgcaaatgcgtgtgcctgccgttcggctaaaaacgcccactaaacctccatgccagtag

SEQ ID NO: 186206 - DNA, 2475 bp, Artificial Sequence
  Description of Artificial Sequence: Synthetic coding sequence
atgcaccacggcaccggcccccagaacgtgcagcaccagctgcagaggtcaagagcctgcccaggctctgaaggcgaagagcaacccgcccatcctaatcccccgccctcccccgccgcccctttcgctccgagcgcttcacctagcgcacctcagagcccttcataccagattcagcagttgatgaacaggagccccgccacaggccagaatgtcaacattaccctgcagagcgtagggcccgttgtgggcgggaaccagcaaataaccttggccccactgccactgccatcaccgacttcaccaggatttcaattctcggcccagccaaggagattcgagcacggctcgccatcttacatccaggttacttctcctctttcccagcaggtccagacccagtcccctacccagcctagccctggccctggacaggcgctgcagaacgttagggctggggcacccgggccaggacttgggctttgttcctccagtcccaccggcggtttcgttgatgctagtgtcctagtcagacagatcagtctatcaccctcctccggcggacattttgtgttccaggacgggagcggcctgacccagattgcccagggcgcacaggtgcagcttcaacaccctgggacacctattactgttagagagcggcggcccagtcaaccccatacccagtccgggggtacgattcaccacttgggcccccaatctccagccgccgcaggcggagctggactccagccattggcctcaccgagtcacattacaaccgccaatctgcccccacagatttccagcatcattcagggccaactggtgcagcaacagcaggtactgcagggcccgcctctgcccagacccttaggattcgagaggacgcctggcgtgctcctgcctggcgcaggtggagcagccggctttggaatgacctcaccgccgccaccaacgtcaccaagccgcactgccgtcccccctggtctttcaagtttgcctttgaccagtgtcggaaatactgggatgaagaaggtccccaaaaagctcgaagaaatcccacccgcgagtcccgaaatggcccagatgagaaagcaatgtctagactatcattatcaggagatgcaggcactgaaggaggtgtttaaggagtacttaattgaactgttctttttgcagcatttccagggtaatatgatggatttcttagcctttaagaagaagcactacgcccctctgcaggcctatctgcggcagaatgatttagacattgaagaggaggaggaggaggaggaggaggaagaagaaaaaagtgaagtgattaacgatgagcaggcactagcaggcagcctcgttgcgggtgccggctcaaccgtggaaacagatctgttcaagagacagcaagccatgccttctaccggaatggccgggggcatgcccccgaccccccaagctgcccagctggccgggcagaggcagagccagcaacaatatgacccttctacaggcccacctgtccagaacgccgcctctctgcacacccctcttcctcagcttcccggcaggttgcctcctgccggcgtgcccacagcagccctgtcctcagcactgcagttcgctcaacagccccaggtggttgaagcccaaacacaactgcagattcccgtgaagactcagcagcctaacgtgcctatcccagctcccccatctagtcagctcccgatcccgccgagtcaaccggcccagctagcgctgcacgtgcctacccccggcaaggtgcaggtgcaggcctcccagctcagctcgcttcctcagatggtcgcttcaaccagacttccagtggacccagccccaccatgcccccgcccactccccactagttcaacttccagtctggcgcccgtaagcggatccgggccgggtcctagccccgcccggagctctccagtgaacagacccagcagtgctacaaacaaggcgctttctcccgtcacttctcgaactcccggcgtcgttgctagtgcccctacgaagcctcagagccctgcacagaatgcaaccagttcacaagactcctcacaggacaccctgacagagcagataactctggagaatcaagtgcatcaaaggatagcggagctgcgcaaagccgggttgtggtctcagaggagactccctaaactgcaagaggctcctcgacctaaatctcactgggattacttgcttgaagagatgcagtggatggccacagactttgctcaggaacggcgatggaaggtggccgccgcaaaaaaattagtgagaacagttgtgcggcatcatgaagagaagcagttacgagaagagagaggaaaaaaggaggaacagagtaggctccgtaggatagcagcctctactgcccgggaaatagaatgcttctggtccaatatcgaacaggttgtggaaatcaaattacgtgtggagttagagtag

SEQ ID NO: 186207 - DNA, 9372 bp, Artificial Sequence
  Description of Artificial Sequence: Synthetic coding sequence
atgcaccacggcaccggcccccagaacgtgcagcaccagctgcagcggtcgagagcatgcccaggcagcgagggagaagaacaaccagcacacccaaatccaccaccaagccccgcagcccccttcgctccctccgccagtccatcagcaccacagagccccagctatcagattcagcagctgatgaaccgcagtccagccaccgggcagaacgtcaacataaccctgcagagcgtgggacctgtggtgggcgggaatcaacagatcacattggctcccctacccctgcccagcccgacaagtccagggttccagttcagcgcccaacctcgcaggttcgaacatggcagcccaagctatattcaggtgacttcccccctgagtcagcaagtacagacacagtctccgacccaaccctctccaggtccagggcaggcgctgcagaacgtccgcgcgggagcccccggacccgggcttggcctgtgttctagctctcccacaggcggattcgttgatgcatctgtgctggtgcgacagatttccctctctccatcatctggaggacactttgtgtttcaggacgggagtgggctgacccaaattgcgcaaggagctcaagtacagctgcagcacccaggaacccctatcacagtgcgggaacgcagaccgagccagccccatacacaatcgggggggaccattcatcacctcggtccacagtcacctgcagcagccggcggagctgggctgcagcctctcgcctctcccagccacatcactactgccaacctgccaccccagatttcaagcatcatacagggacagctggtgcaacagcagcaagtgcttcagggccccccattgccccgccccctgggctttgaacgaacccccggagtactgctgcctggcgctgggggagcggccgggttcggaatgacctcccccccgccccctacatcgccgagccgaaccgctgttcctcctggcctcagctctcttcctctgacgtcagtgggcaatactggtatgaagaaagtgccaaagaagttagaagagatcccccccgcttctccggagatggctcagatgcgaaaacaatgtttggactaccattaccaggagatgcaagcactgaaggaagtatttaaagagtacctgatcgagctgttcttcctccagcactttcagggtaatatgatggacttcttggcctttaagaagaaacactatgccccattgcaagcatacctgcgacaaaacgatcttgacattgaggaggaagaagaggaagaagaggaggaagaagaaaaatctgaggtgatcaacgatgagcagcaggcactggccggatccttggtagctggcgccgggagtactgtggaaacggatctgtttaagcggcagcaggccatgccctcaaccggaatggcggagcaaagtaaaagacctcggctcgaggtgggacaccagggggttgtcttccagcatcctggagctgacgcgggcgtccccctgcagcagcttatgcctactgctcagggtgggatgccaccaacaccacaagctgctcagctggccggacaacgccaatctcaacaacagtatgacccatctactggtcccccagttcagaatgcggcttccctgcatacacccctgcctcagttgcccggaaggctccctccagctggggttcctaccgcagccctgagttcggcattgcaattcgcccagcagccccaggtagtggaagcacagacacagctgcagataccagtgaagactcagcagccgaacgttcccatccctgcccccccatcctctcagctccctatccccccatcacagcctgcccagctcgcccttcacgtgcccactcctggaaaggttcaagtacaagccagccagctgagtagccttcctcaaatggtagcgtcaacccgtcttcctgtcgaccctgcacccccttgccctcggcccctccccacttcctccacttcaagtctggcgcctgtttcgggttccggcccggggcctagtccagctcgttcctcacccgtgaataggcctagttctgctactaacaaagccctaagccccgtgacctccagaacaccgggggtagtagcaagcgccccaacgaaaccacaatccccagctcagaatgcaacttcatcccaggacagctctcaggacactctgaccgaacaaatcaccttggagaaccaggtgcatcagcgcatcgcagagctgagaaaggcaggcctgtggtctcagaggaggcttcccaaactgcaggaggcgccgcgtcctaagagccactgggattacctgctggaggagatgcagtggatggccacagactttgcacaggagaggcgatggaaggtggccgctgccaagaaacttgtacgcacagtcgtgaggcatcacgaagagaaacagttgcgtgaggaaagaggtaagaaggaggaacaatcaaggttacgcagaatcgccgcttctacagcgagggaaatcgaatgcttctggtcgaacatagagcaagtcgtagagataaaacttagggtggagttggaagaaaaacgcaaaaaagcccttaacctgcagaaagtgtctcgaagaggaaaggagctgcgcccgaaggggttcgacgctctgcaggaaagcagtttagactcgggtatgtcaggcaggaaacggaaagccagcatttcactaacagatgatgaggtggatgacgaggaagaaaccattgaggaggaagaggccaacgagggcgtggtggatcaccagacagagctgtcaaatcttgccaaggaagctgagctaccactcctggacttgatgaaactctatgagggagcatttctgcccagttcccagtggccacggccaaagcctgatggcgaagatacaagcggggaggaggatgccgacgattgtccgggagaccgagaatctcgcaaggatctagtcctcatcgacagcttgtttatcatggatcagtttaaagccgcagagcgcatgaatattggaaaacccaatgcgaaagatattgcagatgtgacagccgtggccgaggccattttgcctaaaggcagtgctcgagtgactacctccgtgaaattcaacgccccctccctgctgtatggcgcactcagggattatcaaaaaattggattggattggttagcaaagttatatagaaagaatctgaatgggattcttgcagacgaggccggacttggaaagactgtccagatcatcgcatttttcgctcacttagcttgcaacgagggcaactggggtccacacctggtcgtcgtgaggagctgcaacatcctcaaatgggaattagagctaaaacgctggtgtcccggtctgaaaatcctgtcttatattgggtctcatcgggagcttaaagcgaaacgccaggagtgggcggaacctaactcgttccacgtttgtattacttcgtacacccagttttttaggggcctgacggcttttacccgcgttcgatggaagtgtctcgtgattgacgaaatgcagagggtaaagggaatgacagagaggcactgggaggccgtgttcacactgcagtcccagcaacgactccttctgatcgattcaccactgcataatactttcctcgaactttggaccatggtccacttcctcgtaccaggtatctcgcgaccctacctaagcagtcccctccgagcacctagcgaagagtcacaggattactatcataaagtcgtcatccgtctgcaccgtgtgacacagcctttcatcttacggagaaccaagcgcgatgtggagaaacaactcaccaagaagtatgaacacgtactgaagtgcagactcagcaatagacaaaaggctttatacgaagatgtgatcctccagcctggaacacaggaagccctcaagagtggtcactttgtgaatgttctttcaatacttgtgcggctgcaaagaatttgcaaccaccccggactggtggagccccggcacccaggctcatcctacgtggccggtcccctcgagtacccatctgccagtctgatcctgaaggcccttgaacgcgacttttggaaggaggcagacctttctatgtttgatctgatcgggcttgaaaacaaaattactagacacgaggccgaattgctgtccaagaagaagattccgcggaaattgatggaagagatttcaacttctgccgcacccgctgcccgaccagcagccgccaagctgaaagcctccaggttattccaaccagtgcagtatgggcaaaagcccgagggccggactgtggcctttccaagcacccatccgccaaggaccgcagcccctaccacggcaagcgcagctccacaggggcccctgcgcggaagaccacctatcgccaccttttcagcaaaccccgaagccaaagctgccgcggctccgttccagacgtcccaagcctcggcgagcgcacctcggcatcagccagcttccgcttcaagcactgctgccagcccggcccaccccgcaaaactccgggcccaaactactgcccaggcatcaacccctggccagcccccaccccagcctcaggccccctcccacgcggctgggcagagcgcactgccgcagcgcctagtcctgccctctcaggcgcaggcgcggctcccaagcggcgaggtcgtgaagattgctcagctcgcaagtatcactggccctcagagcagagttgcccagcctgagacccctgtgaccctccagtttcaagggagcaagtttaccttaagtcattcccagctgagacagctcacagctggccaacccttgcaactgcaaggcagcgtcttgcagattgtgagcgcccctggccaaccatatttgagggctccaggccccgtcgtcatgcaaaccgtctctcaggctggtgccgttcacggggccttgggttctaagcctcctgccggaggcccatcccccgcaccacttacccctcaagtaggggttcctggccgagtggctgtgaacgccctcgctgtcggagaaccaggcaccgcctctaaaccggcctcgccaatcggaggccccacccaggaggaaaaaacccgccttcttaaggaacgtttggaccagatatatcttgtgaacgagcgacgctgttcgcaagccccagtgtatggtcgggatttactgcggatctgcgcgcttccgtcccatgggagagtacagtggcggggatccttggacggaagacggggcaaggaagccgggccagcgcatagttacacaagttcttctgagagcccatcagagttgatgttgactctctgccggtgcggggagtctttgcaggatgtaattgaccgcgtggccttcgtcatcccacctgtggtggctgccccgccctcactgagggttccaagacccccacccctttattcgcatcgcatgcgaatcttgagacagggtctgcgcgaacacgcagctccatacttccagcagttaagacagacaacagcccctcgtttactgcagttccccgaactacgcttagtacagttcgatagtggtaaactcgaggccctagctatcctcctgcaaaagttgaagagcgaaggccgccgggtgcttattctgtcccaaatgatcttaatgctcgacatccttgaaatgtttctaaattttcattatctgacatatgtgcgcatagacgaaaatgcatcttcagagcagcgtcaggagctgatgcgttcctttaacagggaccgccggattttctgcgctatcctaagcacccatagtcggactaccggcatcaatcttgtggaagccgataccgtggtgttttacgataacgacctaaacccggtgatggacgccaaagcacaggagtggtgcgatcgcattggccgttgtaaggacattcatatctacagactggtctccggcaattctattgaggaaaagctcttgaagaatggtaccaaggacctgattcgagaggtagcagctcagggaaatgactactcaatggcattcctgactcagcggacaattcaagaactatttgaggtgtattcccccatggatgatgccggattcccagtcaaggctgaagaatttgttgtgctaagccaagaaccaagtgtgactgagaccattgcccctaagattgccaggccttttatcgaagcactcaaaagtatagagtacctggaggaggatgctcagaagtccgctcaagagggggttctaggccctcatactgatgctttgtcatcagacagtgagaatatgccatgcgacgaggaaccaagccagctggaagagctggccgatttcatggagcagcttacccctattgagaaatacgccttgaattacctagagctgttccatacaagtattgaacaggaaaaagagaggaactctgaagacgccgtgatgaccgccgtgcgcgcttgggagttctggaacctgaaaacactacaagagcgggaggcaaggctgcggttggaacaggaagaagccgagctactgacgtacactagagaggatgcttacagtatggaatacgtgtacgaagacgttgacgggcagacagaggtcatgcctctctggacccctcccacccctcctcaggatgatagtgatatttacctggacagtgtcatgtgtctcatgtatgaagcgacacccattcccgaggccaaactgcctcccgtgtatgtcagaaaggaaaggaagcgtcacaagacagatccttccgcagctggaagaaagaagaaacagcgacacggagaggctgtcgtgccgccacggagtctgtttgacagggccacacccggattgttgaagatacggcgcgagggtaaggaacagaagaaaaatattctcctgaagcagcaggtgcccttcgcaaagcccctgcccactttcgcaaagcctaccgctgagcctggccaggataaccccgagtggttgatttctgaggattgggccctgttgcaggccgtgaagcagctgctcgagctccctctaaacttaacaatagtgagtcctgctcatacgcccaactgggacctggtgagcgacgtggtcaacagttgttcccggatctataggtcctcaaaacagtgcaggaaccggtacgagaatgtgattataccaagagaagagggcaagtccaagaataaccggcctttgagaacatcccagatttatgcccaagacgaaaatgctacacacacccaactgtacacgtcgcacttcgacctgatgaagatgacagcaggtaaacgatcaccgcccattaagccgcttttgggtatgaatccattccagaagaatcctaagcacgcgtctgttctcgctgaatcaggcataaattacgataagcccctgccccctattcaggtggcttctcttcgtgcagagcgtatcgcaaaagagaaaaaggctctcgcagatcagcaaaaagcccagcagcctgctgtggcacagccgcccccccctcagcctcagccgccaccacccccccaacagcccccccctccgctgccacagccgcaagccgctgggtctcagcctccagcagggccacccgccgtacagccacagccccagccgcagccccagacacagcctcagcccgtacaagctcccgcgaaggcccagcctgctatcaccactggcggatcggccgccgtcctggcaggcaccatcaaaacctcagtgactggcaccagcatgcccaccggagctgtttcaggaaatgtgattgtgaatacgattgctggcgtccccgccgccacctttcaatcaattaacaagcggctggcatcccccgtcgcgcctggtgcactgactacgcctggggggtctgcaccggcacaggtcgtacatacacaaccaccgccacgggctgtggggtcacctgcaaccgccacacccgacctcgtgtccatggccactacacagggtgttcgcgccgtcacttccgtgaccgcatccgcggtcgtgaccacaaatctcaccccagtgcagacacctgcgagaagtctcgttcctcaggtgtctcaggccaccggcgtgcaattgcctggtaagaccatcaccccagcccattttcaattattgcggcaacaacagcagcagcagcagcagcagcagcaacagcagcagcagcagcagcagcagcagcagcaacagcagcagcagcagcaacagacaaccacaacgagtcaggttcaggtgccacagatacagggccaagcccagtcacccgcccagatcaaggctgtaggcaagctcacccctgagcacctcattaaaatgcaaaagcagaagctgcagatgcccccgcagccacctccaccccaagcgcaaagcgccccccctcagcccaccgcccaggtccaagttcagacttcccagcctccccagcaacagagtcctcaactaactacagtcacagcaccgcgccctggggctctgctgacagggacaaccgtggccaacctgcaggttgctcgtctgaccagggtgcccacctcccagctccaggctcagggccaaatgcagacacaagctccacaaccagcccaggtggcactagctaagcctcctgtggtgagcgtgccagcagccgtagtttcttcgccaggcgtaactacactgcccatgaacgtggcgggcatttcagtcgcaataggccagcctcaaaaggcagccgggcagactgttgtcgcccagcctgtccatatgcaacagcttctcaaactgaagcagcaggctgtgcagcagcagaaagccattcagcctcaagcagcacaagggcctgccgccgtgcagcagaaaatcacagcccagcaaatcaccaccccaggcgcccagcagaaagtggcctacgccgcgcagcctgccttgaaaactcagttcctgactaccccaattagccaggcgcagaagttggctggggcccagcaagttcaaacccaaattcaggtcgctaaactgccccaagtcgtgcaacagcaaacacccgtcgcaagtatccagcaagtcgcatcagcaagtcaacaggccagtccccaaacggtggcactcacgcaggcgactgctgccggtcagcaggtgcaaatgatcccagcagttactgcaaccgctcaggttgttcagcagaaactgatccagcagcaggttgtcacaactgcatccgcgccactgcaaacgcccggagcgccaaacccggcccaggtgccagcatctagcgatagtccttctcaacagccgaagctgcagatgcgcgttcccgcagtccgactgaagacacctacgaagcctccctgtcagtag

SEQ ID NO: 186208 - DNA, 1314 bp, Artificial Sequence
  Description of Artificial Sequence: Synthetic coding sequence
atgctgcagggcccccgggccctggccagcgccgccggccagacccccaaggtcgtacctgctatgtcccccaccgaactatggccctctgggttaagcagtcctcagctatgtcccgctacggccacctactacacccccctttatccccaaactgctcctcctgcagctgccccggggacttgcctcgatgccacaccacacggacccgagggccaggtcgtgcgctgcctgccagccggacggctccctgctaagcgcaagttagatcttgagggaattggacggcccgtggtgcctgaatttcctacgccaaagggcaagtgtatccgtgtggacgggttgcccagccctaagactccaaagtcaccaggggaaaagacacggtatgacacctctctcggacttctgacgaagaaattcatatacctgttatctgagtctgaggacggagtcctcgatcttaactgggctgctgaggtgttggatgtccagaaacgtagaatttacgatataacgaacgtgctggagggaatccagctcatccggaaaaaagcaaagaacaacattcaatgggtcggacggggaatgttcgaggatccaacgaggcctggaaagcaacagcagcttggacaggagctcaaggaactcatgaatacagagcaggccctcgatcagctcattcagagctgttctctctccttcaaacacctgaccgaagacaaagcaaataagagattagcgtatgttacataccaagacatccgggccgtaggaaacttcaaggaacagaccgtgatagcggtcaaagctcccccacagactcgtctcgaagtgcccgacaggacagaagacaatttgcagatttatcttaaatcaactcaggggcctatcgaggtttatctgtgtcccgaagaagttcaggagcctgactccccttctgaagaacctctgccaagcacttccacgctgtgtcccagccccgactcagcccagccctcttccagtaccgatccgagcatcatggagccaacggctagttcagtaccggcccccgctcccactcctcagcaggccccacctccaccatcacttgtaccactcgaggccacagactctctcctagagctcccccaccccctgcttcagcagacagaagatcaatttcttagccccaccctggcttgcagctccccactcatttccttctccccttccctggaccaagatgattacctctgggggcttgaagccggtgagggtattagcgatctcttcgattcctacgatctgggagatctgctcatcaactag

SEQ ID NO: 186209 - DNA, 1398 bp, Artificial Sequence
  Description of Artificial Sequence: Synthetic coding sequence
atgcggaagggcatccagcccgccctggagcagtacctggtgaccgccggcggtggtgagggtgcagccgttgtcgctgctgccgcagctgcaagtatggataaaagggctctcctggcctccccgggcttcgctgccgcagctgccgccgccgccgcaccgggggcctacattcagatcctgactacgaacaccagtacgacttcctgctcatccagcctgcagtcgggcgctgtggcagccggacctctcctgccgtccgcccctggtgctgaacaaactgccgggtcgctattatacactacaccccatggcccgagcagtagggccggattgctgcagcaacccccggcgttgggacgcggcggtagtggcggtggaggaggcccacctgcaaaacgccgactggagctcggtgagtccggacatcagtacttatcagatggcctgaaaacccctaagggaaaagggcgtgccgcattgcggagccctgactcacccaaaacgccaaagtcacccagtgaaaaaaccaggtatgacacatcactgggattgctgaccaagaagtttatccaattactttcacagtctcccgacggtgtcctcgatctgaacaaagcagcagaagtcctgaaagtccagaagcgtcggatctacgatattactaatgtgctagaaggtatccacctgattaagaagaagtccaagaataacgtccaatggatgggctgttctctgagcgaggacggagggatgctggctcagtgccaaggattaagtaaggaagtaactgaattgtcgcaggaagagaaaaagttggacgaactgatccaatcttgcacccttgacctcaaactcctgaccgaagactcggagaaccaacggctcgcgtacgttacctaccaggatataaggaagatatcaggcttgaaggaccagaccgtgatcgtggtgaaggctcctcctgaaacgcggctggaggttcccgattccatcgaaagcctccagatccatctcgccagcacacagggacccattgaggtttatctgtgtcccgaagagacggagactcatagtcccatgaaaacaaataatcaggatcataacggaaacattccaaagcccgctagtaaggatttggcgtccacaaactccggccacagtgactgctctgtatccatggggaacttgtctccactggctagcccggcaaatctgctacaacaaaccgaagaccagatcccatcaaaccttgagggaccattcgtcaacttgttgcctcccttgctgcaggaggactatctgctgagcctgggcgaggaagagggtatcagcgatcttttcgatgcatatgatctggaaaaactccccctcgtcgaagattttatgtgttcctag

SEQ ID NO: 186210 - DNA, 387 bp, Artificial Sequence
  Description of Artificial Sequence: Synthetic coding sequence
atggacaagcgggccctgctggccagcggcggcggcggcggccccccggcaaagcgacgtcttgaacttggagaatccgggcatcagtatctttccgatgggctgaagaccccaaaggggaaagggcgtgcagctctccggagccccgattcccctaaaaagaagacacgctacgacacatctctggggttactcacaaaaaaattcattcagttgctaagccagtcccctgacggtgtgctagaccttaataaagcagccgaggtgctcaaggtgcagaagagaagaatctatgatattactaacgtgctcgaagggatttccgatctgttcgatgcctacgatctggagaaactgcccttggtcgaggactttatgtgttcatag

SEQ ID NO: 186211 - DNA, 1005 bp, Artificial Sequence
  Description of Artificial Sequence: Synthetic coding sequence
atgcccctgcagcagcaggccaagcggcggctggagctgggcgagagtggacaccaatacttgtcagatggcttgaagacacccaagggcaagggaagggcagcactgcgttcacctgactccccgaaaaagaagacacgatatgatacttccctaggcttactaacgaagaagtttattcagctactttcccagtcacccgatggcgtgctcgacctgaacaaagctgctgaggtgctgaaagtccagaaaagacggatctatgacattaccaatgtcctggagggcattcatctgatcaagaaaaagtccaagaataacgtgcaatggatgggatgttccttaagtgaagacggagggatgcttgctcagtgccaaggcctaagcaaggaggtcaccgaactctctcaggaagagaaaaaactggacgaactgattcagagttgtaccctggacctgaaactcctgaccgaagacagcgagaaccagcggctggcgtatgtgacctaccaggacattcgcaagattagcggcctgaaggaccagaccgtgatagtggtgaaggcgccacctgagacgagactggaggtgccagatagcatcgagagcctccaaattcacctagctagcacccagggacccatcgaagtctatctgtgccctgaagagaccgaaacacattctcccatgaagactaacaaccaagaccacaacggaaacattcctaaacctgcgtcaaaagacttagcgtccacaaattccggccattcagactgcagcgtttctatgggtaatctttcaccgctggcctcccctgccaacttgttgcagcaaaccgaggatcagataccttctaacctagagggtccatttgtcaacctcttgccgcctctccttcaagaagattacctgctcagcctaggcgaagaggaagggatcagtgacctgttcgacgcctacgatctggagaaattacctctggtggaggacttcatgtgcagctag

SEQ ID NO: 186212 - DNA, 2736 bp, Artificial Sequence
  Description of Artificial Sequence: Synthetic coding sequence
atggaggtgaactgcctgaccctgaaggacctgatcagcccccggcagccccggctcgacttcgcagtggaggacggtgagaatgcacagaaggagaatatctttgtggaccgaagccgcatggctccaaagacccccattaaaaacgaaccaattgatctgtccaagcagaagaaattcacacccgaacgcaatcccatcacacctgttaagttcgtcgatcgccagcaggcagaaccctggacacccaccgcaaacctcaagatgcttattagtgccgcatcgcctgatatccgcgaccgagaaaagaagaaagggctgttccgccccattgagaacaaggacgatgctttcactgatagtttacaactggatgttgtgggtgattcagctgtggacgagttcgagaaacagaggcccagcaggaagcaaaaatccttagggctactgtgtcagaaattcctggcaaggtaccctagctatccactgtctaccgaaaagaccactattagtcttgatgaggtcgcagtgtccctgggagtagagaggcgcaggatctatgacattgtcaacgttttggaatccttgcatctcgtatcccgtgtcgctaaaaatcaatatggatggcacggccgacatagtctgcctaagactcttagaaaccttcagcgtctaggcgaggaacaaaagtatgaggagcaaatggcgtaccttcagcagaaggaactggatttaatagactataagtttggagagcggaagaaagacggcgacccagattctcaggagcaacagctattagatttctcagagcccgattgtccatcttctagtgcaaactcacggaaagataaatctctgcgcattatgtcacagaagtttgtgatgctcttcttagtatcaaaaacaaagatcgtgacattggatgtggccgctaaaatcttaattgaagaatcccaggacgcaccagatcactctaaattcaaaacaaaggttcgaaggctctatgacattgcaaacgtactgacctcactggctcttattaagaaggtacacgtcactgaggaaaggggtagaaagccggccttcaagtggattggccccgtggattttagctcctctgacgaagagcttgtggatgtgtctgcgtcggtgttacctgaactgaagcgcgaaacatatgggcagatccaggtatgcgccaaacaaaagttggcgagacacggctctttcaatactgttcaggcatccgagcggattcagcgaaaggtgaattctgaaccttcatccccctatagggaggagcagggatcgggcggatactcactagagatcggctctctggcagccgtttaccgccagaaaatcgaagacaattcccaaggaaaagcctttgcgagtaaacgagtcgtgcctccatcctctagcctggacccagtggcaccttttcccgtgctgagcgtggatcctgaatattgtgtgaacccacttgctcacccagtattcagcgtagctcagacagacctgcaggctttttctatgcagaatggactcaacggacaggttgatgtgtccctcgccagtgccgcatccgccgtagagtccttgaagcccgcacttctcgctgggcaaccactggtgtatgtgccatcggcctccctctttatgttatacggctcactacaggaggggccggcctcaggatccggcagcgaacgggacgatcgatcttccgaggcaccagcaactgttgagctgagctcggcgccatcagcacagaagagactgtgtgaggaacgcaaaccacaggaggaggatgagcccgctactaagcgccagagtagagagtatgaagacggaccactgagcctggtgatgccaaaaaaacctagtgacagcactgatctggcatccccaaagaccatgggaaatagagcaagcattcccctgaaagacattcacgtaaatggccagcttccagctgcagaggagatatccggcaaagccacagctaatagtcttgtctctagtgagtggggcaatccaagtagaaatacagatgtggaaaagcctagcaaagagaatgaaagtaccaaggaaccctctcttttacaatacctatgtgtgcaatcccccgctgggttgaacggcttcaatgtgctgctctcagggtcacagacccccccgactgtggggccctcgtccggccagctgcccagcttctccgtgccgtgtatggtgcttccgtcccctccccttggcccatttcctgtcttgtactcgcccgccatgcctggcccagtgagcagtacgctgggcgcactgccaaatacaggacctgtgaacttctcactccctggtcttggatccattgctcagcttctggtgggaccaacagcggtggttaacccaaaaagctctacgctgccaagtgccgaccctcaactccaatctcagccaagcttgaatctcagccccgtgatgtccagaagccacagcgttgttcagcagcccgaatctcctgtgtacgtgggacatcccgtctccgtggtgaaactccaccaaagtcccgtgcccgtcactcctaagtcgatccaaagaacacacagggaaacattttttaagacacccggaagtctgggagatccggtgctaaagaggagggagagaaaccagtcaagaaacacgtccagtgcacaaagaaggctggaaattcctagtggtggagccgattag

SEQ ID NO: 186213 - DNA, 1149 bp, Artificial Sequence
  Description of Artificial Sequence: Synthetic coding sequence
atgcagaacggcctgaacggccaggtggacgtgagcctggccagcgcagcttcagcagtggaatcgttgaaacccgccctgttggccggccaacccctggtttatgtacctagcgcttctctttttatgctatacggaagcctacaggagggtccagcgagcgggtctgggtctgagagggatgacaggtccagtgaagctcccgccaccgtggagctgtcctcagccccaagcgcgcagaagcgcctgtgcgaagagagaaagcctcaggaagaagacgagcctgcgacaaagcggcagtctcgcgaatacgaagacggtccgctgtctctcgtgatgcctaaaaaacccagcgactctacggatcttgcgagccccaagactatgggcaacagggcctcaatacctctgaaggatatccacgtcaacggacagctgcctgccgcagaagagatcagcggcaaggctactgctaatagtttagtgtcctcagagtgggggaatccttcaagaaacacagatgttgaaaagccttctaaggaaaacgagagtactaaagaaccttccctacttcaatacctgtgcgtacagtctcctgctggtcttaacggattcaacgtgctactgagcgggagccaaaccccacctacggtgggcccatcaagtggacaactcccgtccttctctgtgccctgcatggtgttaccttcaccacctctgggtccgttcccagttctgtactcacccgctatgcccggaccagtgtcctctacactcggatcgatcgctcaactgcttgtgggaccaactgcagtagtgaacccaaagtcgagtacccttccttcagcagacccacagctgcagtcacaaccgtctctcaacttgtccccggtgatgtctaggagtcactccgtcgttcagcagccagaaagccctgtctacgttggacacccagtctcggtcgtaaagctgcaccagagccctgtgccggtgacacccaagtctattcaaaggactcacagggagacttttttcaagacccctggatcactgggggatcctgttcttaaaaggcgtgaacgcaaccagtcccgcaataccagctcagcccagcgaaggctggaaatcccttccggtggcgccgactag

SEQ ID NO: 186214 - DNA, 2187 bp, Artificial Sequence
  Description of Artificial Sequence: Synthetic coding sequence
atggaggtgaactgcctgaccctgaaggacctgatcagcccccggcagcctcggctggatttcgcggtggaggatggagaaaatgcccagaaggagaatatcttcgtcgacaggtctagaatggcgcctaagaccccgattaagaatgaacccattgatttgtcaaaacaaaaaaaattcactccagaacggaatcccatcactcccgtgaaatttgtggaccggcaacaggccgaaccttggacacctactgcaaatctgaaaatgctcatctccgccgctagccctgacatacgggatagagagaaaaaaaaggggctgttccgcccaattgaaaacaaagatgacgccttcaccgacagtctccagcttgatgtcgtgggagacagcgccgtcgacgaatttgaaaaacagcgcccgtctcgaaaacagaagagcttggggctcttgtgccagaaatttctagctcgctatccaagttatcccctgagcactgagaaaactaccatttctctcgatgaggtcgcggtgagtctaggggtggaacgccgccgcatctacgacatcgtgaacgtgctggagagtctccacctcgtgtcgcgggtggccaaaaatcagtatggatggcatgggcgccacagtctcccgaagacactgcgcaacctgcagcgcctaggcgaagagcagaaatatgaggagcagatggcttacctgcaacagaaggaactcgatctgattgattacaagtttggggaaagaaaaaaagacggcgaccccgattcacaggaacagcagttactcgatttttctgagccggactgtccatcttcttccgcaaattcaaggaaagataagtcattacgaattatgtcacagaagtttgtcatgctctttctggtgagcaagactaagatcgtgactctggatgtggctgctaagatccttatcgaggaatctcaggacgctcctgaccattccaaattcaaaacaaaggtcaggagactctatgatattgccaatgtactgacctcacttgcccttattaaaaaagtgcacgttactgaggagcgtggcagaaaaccagcctttaagtggattggtcccgtcgatttttcaagctccgacgaggaactggtagacgtgagtgctagtgtgttgcccgagctgaagagagagacatatggacaaatccaagtctgtgccaaacagaaacttgcgcgacatggtagttttaacaccgttcaggcatctgagaggatccagcgtaaagtgaatagtgagcccagttcaccttatagggaggaacagggctccggtggttactccctggagattgggagtcttgctgccgtttataggcagaaaatagaggataacagtcagggaaaagcctttgccagtaaaagagtggttcccccgtcctcttccctggacccggtcgctcccttccccgtgctgtcggtcgatccagaatactgcgttaatccactggctcatcccgtatttagtgtagcccagactgatttacaggcgtttagcatgcagaacgggttgaacggccaggtcgacgtgagcctggcaagcgcggcatctgccgttgagtctctaaaaccggcacttctcgcggggcagcctttggtctacgtaccaagtgcttcattgttcatgctctacggatcactacaagaaggccctgcctccggcagtggttcggagcgcgacgatcggtcaagcgaggcacccgcgacagtcgagttatcgtctgcgcctagcgcacagaagcgcctgtgtgaagagaggaaaccacaggaagaggacgaacccgcgactaagagacagtctagagaatatgaagatggtcccctgagtttggttatgcctaaaaaaccaagtgattccactgacctggcttctcctaagactatgggcaaccgtgcatcgatcccattgaaggatatccacgtgaacggacagctcccggccgctgaggagatttctggcaaggccaccgctaacagtctggtgtctagcgaatggggaaatccctcgcgcaacacagacgtggaaaagcctagcaaagaaaacgaatctacgaaggagcccagtctattgcagtatctgtgtgttcagtcacctgccgtcaccagcagttccgatccccaggaacacccaacccacactagctag

SEQ ID NO: 186215 - DNA, 348 bp, Artificial Sequence
  Description of Artificial Sequence: Synthetic coding sequence
atggaggtgaactgcctgaccctgaaggacctgatcagcccccggcagccccgcttggacttcgcggtggaggatggcgaaaacgctcagaaagaaaatatcttcgtcgatcgctcccggatggcccccaagaccccgatcaagaacgagcccatcgatctaagcaaacagaaaaagttcactccggaacgcaacccgataacacctgttaagttcgtggacaggcaacaggccgaaccctggacccctacagcaaatctgaagatgctaatctctgccgcttctcccgacatcagggaccgtgagaagaagaaggggttgtttcggccaattgagaacaaggattag

SEQ ID NO: 186216 - DNA, 2604 bp, Artificial Sequence
  Description of Artificial Sequence: Synthetic coding sequence
atggagaacgagaaggagaacctgttctgcgagccccacaagcgggggcttatgaagacgcctctgaaggaatccacgacagctaacattgtgcttgccgagatccagccggactttggacccctgacaacccccacaaaaccaaaagaagggtcccagggggaaccctggactcctaccgccaatctgaaaatgttgatctccgcagtatcccctgagatcaggaaccgagaccagaagcggggattatttgataaccgatctggcttgcccgaagctaaggactgtatccacgaacacctgtccggcgacgaattcgaaaaaagccagccatctaggaaagagaagtccctcggactgctgtgccacaagttcttagcccgctaccccaactacccgaacccagccgtcaataacgacatctgtctggacgaagttgctgaggagcttaacgtggaacgtcggcgcatctacgatattgtcaacgtgctggaatccctgcacatggtgtcccgcctggcaaaaaaccgctatacatggcacggcaggcataacctcaataagacgctcggcactttgaaatcaatcggcgaggagaataagtacgcggagcaaattatgatgattaaaaagaaagaatacgagcaggagttcgattttatcaagagttactctatagaggaccacatcatcaaatcaaatacaggacctaatggacatcctgacatgtgcttcgttgaattgcctggagtcgagtttcgagctgcaagcgtaaatagtaggaaggataagtccctgagggtcatgtctcagaagtttgtgatgttgtttctagtgagcacaccacaaatcgtgtctctggaagtggcggcgaagattttgatcggtgaagaccatgtcgaagatctggacaaaagcaagtttaagaccaagatccggcggttgtatgatatagccaatgtcctcagttcccttgaccttatcaagaaggttcacgtgactgaggagcgcgggcggaagccagcctttaaatggactggaccagagatcagccctaacacatctggcagttcacctgtgatccattttaccccctctgacctagaggttcggcgcagtagtaaggagaactgtgctaagaaccttttttctacccgagggaaacctaattttacacgccaccctagcctgattaaactggtgaaatcaattgagagcgatcggaggaaaattaactccgctccctcgagtcccattaagactaataaagctgaatcctcacagaactcggccccttttccaagcaaaatggcccaattagccgctatctgcaagatgcagctggaagagcagagcagtgagtctaggcagaaagttaaagtccagttagcacgctctggtccatgcaagcctgtcgcgccgctagaccccccggttaatgctgagatggaattgactgccccttctctcatccagccactcggcatggttcccctcatcccttccccgctgtctagcgctgttccattaatactgccccaggcgccctccggtccgtcatatgcaatatatctccaacctacccaggctcatcaaagcgtcacaccaccacaagggctctctcctaccgtgtgcaccacacattctagcaaagcaaccggaagcaaagactctacggacgctaccactgagaaagcagctaatgatacctcgaaggccagtgcctcaacgagacccggatcgctccttccggcgccagagagacaaggcgctaaatcacgtaccagggaacctgccggcgagaggggcagtaagcgagcgtccatgctagaggactcaggcagcaaaaagaagttcaaagaagacctgaagggcctcgagaatgtttctgccaccttatttccctccgggtaccttatccccctcacacagtgttcttctctcggagcagagagcattctgtctggaaaggagaactcctcagcacttagccctaaccaccgaatctactcatcgcccatcgcaggtgtgatccctgttaccagtagcgagctgactgctgtaaactttcccagttttcatgtaacacctctgaagctaatggtgtcaccaacgtctgtggccgcagtccccgtgggcaattcccctgccctggcaagctcccacccagtgcccatacagaatccttcaagcgcaatcgtcaattttactctacagcatcttggcctaattagtcctaatgtgcagttatctgcttctccgggttcgggcatagttccagtgagccctcgtatcgaatcagtcaacgtggcacccgaaaacgctggcacacagcagggtcgggccacaaattacgactctcctgtccccggtcagagccagcccaacggtcagtccgtcgccgtcaccggggcccaacaaccagtgccagtcacccccaagggcagccagctcgtagctgagtccttcttccgcacacccggcggacctactaaacccacctcttcgagctgcatggattttgagggtgccaacaaaacatcactcggcaccctgtttgtacctcagcggaagttggaagtgtcaaccgaggatgtgcactag

SEQ ID NO: 186217 - DNA, 2604 bp, Artificial Sequence
  Description of Artificial Sequence: Synthetic coding sequence
atgcagaagaagaaggagaacctgttctgcgagccccacaagcggggcctcatgaagacccccctgaaggagtcaaccaccgccaatatcgtcctggcggagattcagcccgacttcggaccgctaaccaccccgacgaagccaaaagagggatcgcaaggggaaccttggactcccactgccaacctcaaaatgctaataagtgcagtttccccagagattagaaacagggaccagaaacgcgggttgttcgacaataggtcgggactccccgaagctaaagactgcatccacgagcacctctccggagacgagttcgaaaaatcccagcccagtcgcaaagagaagtccctgggtctgctttgtcacaagttcctggctcgctatcctaattatcccaacccagccgtcaacaacgacatttgtctcgacgaagttgcggaggaactgaacgtagagaggagacggatctacgatattgtaaacgtgctggagagcctccatatggtcagtcggctggcaaaaaacagatacacctggcacggtaggcataatctcaacaagacactgggaacgcttaagtctatcggggaggagaacaagtatgctgagcagattatgatgattaaaaagaaagaatatgaacaggagtttgatttcatcaagtcgtacagcattgaggaccacatcatcaaaagtaataccggtccaaacggccaccccgatatgtgtttcgtggagctgcccggtgtcgagtttcgcgccgccagcgtcaattctcgtaaagataagtcactgcgtgtgatgagtcagaagttcgtgatgctgtttttggtctccacaccccagatcgtgtccttggaagtcgccgccaaaattttgatcggagaggaccacgttgaggaccttgacaaaagcaaatttaagacaaagatccgacggctgtacgacattgctaatgtactgtcttctctcgatttaattaagaaggtgcatgttacggaagagaggggtcggaaacctgcctttaagtggacaggtccagaaatctctcccaatacaagtggtagtagcccagtgattcatttcaccccttcagatctcgaagttcgccgcagcagcaaggagaattgcgccaagaacctctttagcacacgtggcaaacccaacttcaccaggcatcctagtctcatcaaactcgtgaagtccatcgagagtgatagaaggaaaataaattccgccccctcatcccccatcaagaccaataaagctgaaagctcccagaattccgcaccgttcccgtccaaaatggcacagctggctgcgatatgcaagatgcaactggaggagcagtcttccgagtcacggcagaaggttaaggtgcaattagcacggagcggtccatgtaagccagtggccccattggaccctccggtcaacgccgagatggagttgacagccccaagtcttattcagccattgggcatggtccctctcattccatctccactgagctccgccgtgcctctgatccttcctcaggctccgagtggtccgtcatatgcgatttaccttcagcctacccaggctcaccagagcgtaacacccccccaaggactgtcccccaccgtgtgtacaacccactccagcaaagctaccggctccaaggactctactgacgcgacaacagagaaagccgcgaacgatacgagtaaggcttctgcctctactagaccaggcagcctgctgcctgcccctgagaggcaaggggccaagtcaagaacccgggaacctgctggggaacgcggctctaaacgcgcttctatgctcgaggacagcggatccaaaaaaaagtttaaggaggaccttaagggactggaaaacgtgtcagccacgctcttccctagtggctacctcatccccctgactcaatgctctagcttgggtgctgaaagtatcctgagtggcaaagaaaactcctcagctctgtcacctaatcacaggatatacagcagccccatcgccggcgtaatccccgttacaagctcagaactgaccgcagtcaactttccatccttccacgtcacccccctgaagctcatggtatcacccacatctgtggccgcagtacctgtagggaattccccagccctggcatcgagccacccagtgccaatacaaaatcccagctcagcaatagttaacttcactctgcagcacttgggcctgatttcacctaacgtgcagttgtccgcctctcccgggtctggcatagtgccagtttcaccccgcattgagtctgtgaatgtggcaccagagaatgcggggacacagcaggggcgggccacaaactatgatagccctgtccctggacagtcacagcctaacggccagtccgtcgcagtcactggcgctcagcagcctgtgccagttactcctaagggttctcagctcgtggcagaaagcttcttcaggactcctggcggaccaactaagcccactagctcctcttgcatggattttgaaggagctaataagacctctctggggacgctgttcgttccgcagagaaaactggaagtatccaccgaagatgtgcattag

SEQ ID NO: 186218 - DNA, 2604 bp, Artificial Sequence
  Description of Artificial Sequence: Synthetic coding sequence
atggagaacgagaaggagaacctgttctgcgagccccacaagcggggactcatgaagaccccgctcaaggagtcaacgacagctaatatcgtcctggctgagatccagcccgactttgggcccctgactaccccgactaagccaaaagaaggctcacagggggaaccatggactcccactgccaatctcaagatgctcatatcagcagtgagcccagaaattagaaatagggaccaaaagagaggacttttcgataatcgcagcggactgccagaggctaaggactgtatccatgaacatttgtccggcgatgagtttgagaagtctcagcccagcaggaaagaaaagtccttgggactcctgtgtcataagttccttgcacgctaccccaattatcccaaccctgcagtcaacaatgatatttgtctggacgaggtcgctgaagaattgaacgtagagcggaggcggatttacgatattgtgaatgttttggagagtctgcatatggtctctagattagctaagaacagatatacttggcacggaagacataacttaaacaagactctgggaacgcttaaatcaattggcgaagaaaacaagtacgccgagcagatcatgatgattaaaaagaaggaatacgagcaagagtttgatttcatcaagagctactctattgaggaccatattataaagagcaatactgggcccaatggccacccagatatgtgtttcgtcgaactgcctggcgtggaatttagggcagcctctgttaatagcaggaaggacaaatcactgcgcgttatgtcacagaagttcgttatgttgtttctggtgtcgaccccgcaaatcgtctcactggaagtagctgccaagattctcatcggagaggaccacgtcgaagatctggacaaatcaaaatttaagaccaaaatcagacgattgtacgatatagctaatgttctgtcgtccctggatctgattaagaaagtacacgtgaccgaagagcgaggcagaaaacccgcctttaaatggaccgggcccgaaattagtccaaatactagtgggtcttcacccgtaatccacttcaccccatcggacctggaggtgagacggtcttcgaaagaaaactgtgccaagaatttgttttcaaccagaggcaagcctaatttcacacggcatccatcgctgattaaactggtgaaaagtatagagagcgaccgcaggaagataaattccgcccccagctcccccatcaaaacaaataaggcagaaagctcacagaacagtgccccatttcccagcaagatggcccaattggccgccatttgtaagatgcagctagaggagcaaagctcagagagcaggcagaaggttaaagtacaacttgcacgctccgggccttgcaagcccgtggctccgcttgatcctccggtaaacgccgagatggagctgaccgcaccatccctgattcagccactcggaatggtcccccttattccatcccctcttagttccgccgttcctcttatcttacctcaagctcccagtgggcccagttacgcaatttacctgcagcctactcaggcccaccagtctgtaactcctccgcagggcctaagccccaccgtgtgcacaactcacagctcaaaggctactgggtccaaggactctactgatgcgaccacagagaaggccgctaatgacacgagtaaggcatccgcttctacgcggcctgggtcactactgcctgccccagagcgacaaggggcaaaaagtcgcactcgtgaaccagctggagagcgtggatcaaaacgggcttctatgcttgaggactccggctcaaaaaagaagtttaaggaggacttgaaaggccttgaaaacgtgtctgcgacgctgtttccctctggttacctgatcccgctcactcaatgttcatccctgggcgccgaatccattctgagtggcaaagaaaactccagcgccctgtccccaaaccataggatctactctagccctattgctggtgtgataccggttacatcatccgagctcaccgctgtgaactttccatcattccatgttactccccttaagctcatggtatcacctacttccgttgccgccgtgccagtaggtaacagccccgccttggcttcctctcaccctgtgcccattcaaaacccttcttctgccattgtaaatttcaccctgcagcatctgggcctgatttcacccaatgttcagctctccgcttctcctggctctgggattgtgccagtgtcacctcggatagaatcagtcaatgtcgctccagagaacgcagggacacagcagggtcgcgcaacaaattacgacagtcctgtgcctggccagtctcaacctaatggacaatctgtggcggttaccggtgcacagcagccagtgcctgtgacaccgaaagggagtcagcttgttgctgagtcatttttcagaacccctggcggaccaaccaagcccacctcatcctcatgtatggatttcgagggagctaacaagaccagcttgggaaccctgttcgtgccacagaggaagctggaggtttccactgaggacgtgcactag

SEQ ID NO: 186219 - DNA, 2355 bp, Artificial Sequence
  Description of Artificial Sequence: Synthetic coding sequence
atggagggcgccatggccgtgcgggtgaccgccgcccacaccgccgaagcccaggccgaagctggcagggaggccggggaaggcgctgttgcagctgtcgcagcggccttggctccatccggcttcctggggctgcctgcccccttctcagaagaagacgaagatgatgtgcatagatgtggcagatgccaggccgagttcaccgccctcgaggacttcgtgcaacacaagatccagaaagcgtgccagcgcgccccccccgaagcgttacctgcaactcctgccactacggctctgctcggccaggaagtggtacccgccgcgccaggccctgaagagcctatcactgtcgcccatatcgttgtagaagccgccagtctggcagccgacatttctcacgcttcagacctggtcggaggaggacacattaaggaggtgatagtggccgcagaagcagagctgggggacggtgagatggccgaggcaccaggatcaccaagacagcaaggactgggcctggccggggagggagagcaagctcaggtaaagttactggtgaacaaggatggccggtacgtgtgcgccttgtgccacaagactttcaaaactggttccatcctgaaagctcacatggttacacactcctctcgaaaagatcacgaatgtaagttgtgcggagctagcttccgtacgaagggcagcctgatcagacatcataggaggcataccgacgaacgcccctacaaatgttcaaaatgcggcaaatcctttagggagtctggagccctaaccaggcatctgaagtcactgacaccttgtaccgaaaagatccgtttcagcgtgagcaaggatgtagtcgtgtcaaaggaagacgccagagccgggtcaggagctggggcggctggattggggactgcaacctcttctgtgacaggagagcccatagaaacatcaccagtcattcatctcgtgacggatgccaaaggcacggtgattcacgaagtgcatgtgcagatgcaggaactgagcctcgggatgaaggccctggccccggagcctcccgtttctcaggaactcccttgcagtagcgaggggtcacgggagaacctcctgcatcaagccatgcaaaattcaggcatcgtgctggagagagcagcaggggaggagggggcactggaaccagctccagctgcaggaagctccccacagccgctcgctgttgccgctccccaacttcctgttctcgaagtccaaccccttgaaacccaagtcgcctctgaggcaagcgcggtcccgcgcactcatccttgcccccagtgttccgaaacatttccaactgcagccaccctggaagcccataaacgtggccatactgggccaaggccttttgcgtgtgcccagtgcggcaaggccttcccaaaggcttacctcctgaagaagcatcaggaggtgcatgtgcgcgagcggcgttttagatgtggcgattgtgggaagctgtataaaactatcgctcacgtccggggacatcgacgcgtacactccgacgaaagaccttacccctgccccaagtgcgggaagagatataaaaccaagaacgctcagcaggttcactttcgcactcacctggaggagaaaccccacgtgtgccagttttgtagccgcggcttccgcgaaaagggatcactggtcaggcatgtgcgacaccatacaggggaaaagccttttaaatgttataagtgcggcagagggtttgcagagcacggtactctaaacaggcacctgaggacaaaaggcggatgtctcctagaggtcgaagagctgttggtctctgaagactcacccgctgctgccaccaccgtgctcactgaggacccacatacggtgctggtagaattctcgagcgtggtagccgatacacaagaatacattattgaagcaacggcggatgacgccgagacaagcgaggctaccgagattatagagggcacccagactgaggttgactctcatataatgaaggtcgtgcagcagattgttcatcaggcatcggcgggtcatcagatcatagtgcagaacgtgaccatggatgaagaaacagctcttggcccagaggccgctgccgccgataccattaccattgccacacccgaatctctcactgaacaggttgctatgacactcgcatcagctatcagtgaagggactgtcctggcagcaagagcgggaacttccggcacagagcaagccactgtgacaatggtgagttctgaggatattgagatcttagaacacgcaggcgaactggtgatcgcatcaccagagggccaactcgaggtgcagaccgtcatcgtgtag

SEQ ID NO: 186220 - DNA, 1047 bp, Artificial Sequence
  Description of Artificial Sequence: Synthetic coding sequence
atggccgccacctgcgagatcagcaacatcttcagcaactacttctcagctatgtactcatctgaagattcaaccctggcatcagtgccacccgctgccacctttggggcagacgacctggtgctgactctgagcaatccccagatgagtttagagggcaccgagaaggctagctggttgggtgagcaaccccagttctggagcaagacccaagttctggattggatttcgtaccaagtggagaaaaacaagtatgacgcctccgccattgacttctcccgttgcgacatggatggtgcaaccctgtgcaactgtgctttagaggaactaaggctcgtgttcggacctttgggagaccagctccacgctcaactgagggaccttacctcatcctcatctgacgagctgtcatggattattgaacttctagagaaagatggcatggccttccaggaggccctggacccggggcctttcgaccagggctctcccttcgctcaggaactactggatgatgttagcacggctggaacaggggcctctcgttcctcccatagctccgacagcggaggctcagacgtggacctggatcctaccgacggtaagctcttcccgagcgacggcttccgagattgtaagaagggcgaccccaaacacggcaaaaggaagaggggaaggcctcggaaactgagcaaggaatactgggactgtcttgaaggcaagaagagcaagcatgcacccagaggaacacacctttgggagttcattcgggacatcctgattcatccagaactgaacgaaggcttaatgaagtgggaaaataggcatgagggcgtcttcaaattcctgagatccgaagcagtggcccaactgtggggtcagaaaaagaaaaatagcaatatgacttatgagaaactgtccagagccatgcggtactactataagcgagagatcctcgagagagtcgacggccgacggcttgtgtacaaattcggcaaaaatagcagcggctggaaagaagaggaagttcttcagagccgtaactag

SEQ ID NO: 186221 - DNA, 1116 bp, Artificial Sequence
  Description of Artificial Sequence: Synthetic coding sequence
atggccgccacctgcgagatcagcaacatcttcagcaactacttctccgccatgtactcatccgaggactccactttagcgtcagtgcctccagctgctaccttcggcgctgacgacctagttctgactctctctaatccacagatgtctttggagggcaccgagaaggcttcttggctgggagaacagccccagttctggtccaaaacccaagtcttggactggatttcctatcaggttgaaaagaataagtacgacgcgtccgcaattgatttctctcggtgtgatatggacggcgccaccctctgcaattgcgcactggaggaactgagactggtattcgggcccctcggggatcagcttcacgctcaactgagggatctgacctcttcttcaagcgacgagctgtcatggatcatagagcttttagagaaagacggcatggcattccaggaagccctggacccaggaccattcgatcagggcagccccttcgcccaagagttgctggatgacgggcagcaggcttctccatatcatcctgggagctgtggagctggggctccctcccctgggtcttccgacgtgtctactgcagggaccggcgctagccgcagctctcactcctcagactctgggggaagtgatgttgatctggaccctaccgacggcaagctgttcccatctgatggatttagggattgcaagaagggggaccctaagcatgggaaacggaaaaggggccgtcctagaaagctgagtaaggaatattgggactgcttggagggcaagaagagcaaacatgccccacgcggcacccacttgtgggaattcatcagggacatacttatccatccagaactcaatgaaggcctgatgaaatgggagaaccggcatgagggggtgttcaagttcctaaggtccgaggctgtggctcaactttggggccagaagaagaagaacagcaacatgacatacgaaaagttgtctcgcgcaatgcgatactattataagcgggagattttagaaagagtcgacgggagacgactggtgtataagttcggtaagaatagttctggatggaaagaagaggaggtgttgcagagcagaaattag

SEQ ID NO: 186222 - DNA, 1116 bp, Artificial Sequence
  Description of Artificial Sequence: Synthetic coding sequence
atggccgccacctgcgagatcagcaacatcttcagcaactacttctccgccatgtatagctcagaggattccacactggccagtgtgcctcccgccgctacatttggtgctgatgatctcgtgctcaccctgtctaacccacagatgtctttagagggcaccgagaaggctagctggctcggggagcagccccaattttggtcaaagacacaagtcctcgactggatcagttaccaggtggagaagaataagtatgacgcgagtgccatagatttctcacgctgtgacatggacggggccaccctatgcaattgtgccctggaagagctcaggttggtgttcggacccctcggcgatcaactacacgcccagttaagagatctgacgtcgagtagctccgatgagttgagctggatcattgagctattggagaaggacgggatggccttccaggaggctctcgatcccgggcccttcgatcaaggcagcccattcgcccaggagctgttggacgacggccagcaagcgagtccctaccatcctggctcctgcggagcaggcgccccctcccccggatccagtgacgtatccaccgctgggacgggtgcatcacgctcctcacacagttctgattctggcgggagtgatgtggacctggacccgactgacggaaaattattcccctccgatgggttcagagattgtaagaaaggggatcccaagcatgggaagcggaagagaggtagacccagaaagctcagcaaagagtattgggactgcttagagggaaaaaaaagcaaacatgctcccaggggtacacatctctgggagtttatacgtgatatcctcatccaccctgagctaaatgaaggcctgatgaaatgggagaatagacatgagggcgtcttcaaatttctcaggtctgaggcagtggcacagctgtgggggcagaaaaagaagaattctaatatgacctacgagaagttaagtagggcaatgcgctattactataagagggagattctagagcgcgtggatgggcgacgactggtgtataagttcgggaaaaacagctcaggatggaaagaagaagaagtattgcaatcccgcaattag

SEQ ID NO: 186223 - DNA, 1116 bp, Artificial Sequence
  Description of Artificial Sequence: Synthetic coding sequence
atggccgccacctgcgagatcagcaacatcttcagcaactacttctccgcgatgtactcttccgaagatagcactctagccagtgtcccgcccgccgcaacatttggagctgacgacctggtcctgaccctttctaatccacagatgtctcttgagggtactgagaaggcctcgtggctcggggagcagcctcagttttggtccaagacacaggttttggactggatttcttaccaggtcgagaagaataaatatgacgcaagcgctattgatttttcacgatgcgacatggatggcgcaacactgtgtaactgcgcgctggaagaactcaggcttgtgttcggacccctaggcgaccagcttcacgcccaactgagggatctcaccagtagctcctctgatgaactgtcctggataattgagctcctggagaaagatgggatggcgtttcaagaggccctggatccaggaccatttgaccagggctcgccattcgcccaggaattattagacgatggtcaacaagcctccccatatcaccccggatcctgcggggccggggctccatcgccgggcagttcagatgtgtcaactgccggcacaggtgcctctagatcaagccactctagtgactccggggggagtgacgtggatctcgatcccacggacggcaagctctttcccagcgatggcttccgagattgtaaaaaaggggatccgaagcatgggaaaagaaaaagaggccgtcctcgaaaattaagcaaggagtactgggattgcctggagggtaaaaaaagcaaacacgcacccagaggcacccatctgtgggagtttataagagatatcttgatacacccagaactcaatgagggcctcatgaaatgggagaacaggcacgagggggtatttaaattcctccgctccgaagcagtggcacagctttgggggcagaagaaaaaaaactcaaacatgacttacgagaagctctcccgggcgatgagatactattacaaaagggaaattctggaacgtgtggacgggcgcaggctggtatataaatttggtaagaatagtagcggttggaaagaggaggaagttctgcagtccaggaattag

SEQ ID NO: 186224 - DNA, 699 bp, Artificial Sequence
  Description of Artificial Sequence: Synthetic coding sequence
atggccgccacctgcgagatcagcaacatcttcagcaactacttctccgccatgtatagtagcgaggattccaccctggcctcagtgccccctgccgctaccttcggtgcagacgatttagttctcacgctgagcaaccctcagatgtccctagaagagaaagctagctggctcggggaacagccacagttctggtctaagacccaggtcctggattggatcagctaccaggtggagaaaaataaatatgatgccagtgccatcgacttcagccggtgtgatatggacggggccactctatgcaactgcgccctggaagagctcagactcgtgtttggccctttgggtgaccaactgcacgctcagctgagggacttaacctcatcttcctccgacgagctgtcctggataatcgaattactggagaaagacgggatggcctttcaggaagcccttgatccaggtccattcgaccagggatccccctttgcccaggagctattagacgatggacagcaggcatctccctaccatccaggcagctgtggggcgggggccccaagccccgggagctctgatgtgagcacagccggaactggggcttcccgctcatctcacagttcagatagcgggggctctgacgtcgacctcgacccaaccgatggaaagctgttcccaagtgacggtttcagagactag

SEQ ID NO: 186225 - DNA, 1992 bp, Artificial Sequence
  Description of Artificial Sequence: Synthetic coding sequence
atggccatcaccctgcagcccagcgacctgatcttcgagttcgcctcaaacgggatggatgacgatattcatcagctggaggacccatccgtgtttcctgctgtcattgtagaacaagtcccctaccccgatctcttgcatctttatagtggattggaactggatgatgtacacaatggaataattacagacggcactctctgtatgacgcaggaccagattctggagggctcctttttacttactgatgacaatgaggcaacgagtcacactatgtctaccgccgaggtgctcctgaacatggagtccccgtcggatattctggacgaaaagcagatcttctctaccagtgagatgctcccagattccgacccggcccccgccgtcacccttcctaattatctgtttcctgcaagtgagcccgatgccctgaatcgggccggcgatacctcagaccaggagggccattcgttggaggagaaagcctcacgcgaggagtccgccaagaaaaccgggaaaagtaagaagcgaatccgtaagaccaaaggaaaccggtccacatcacccgtcactgacccctccattcccataaggaaaaagtcaaaagacggaaaaggaagcacgatctacctgtgggagtttctgttggcactccttcaggacaggaatacctgccctaaatacattaaatggacacaacgcgagaaaggaatttttaagcttgtggactccaaggcggtgtccaagctttggggcaaacagaagaacaagcccgatatgaactatgagactatggggagagccttgaggtattactatcagcggggaatcctcgccaaggtggagggacaaagacttgtttatcagtttaaagaaatgccgaaggacttagtggtgatagaagatgaagacgagtctagtgaggccaccgctgctcctccacaggctagtactgctagcgtagcgagcgcgagtacaacccgacgcaccagttcacgggtaagttccagatcggcacctcaaggcaagggcagctcttcctgggaaaagcctaaaattcagcatgtcggcctacagccatccgcttcgttagagctgggtccatccttggacgaggagattccgacaacaagcacaatgctggtaagtccagctgaaggacaggtgaagctcaccaaggctgtgagtgcatcatctgtaccgtcgaatattcacctgggagtggccccagtggggtcaggttccgctctcacccttcagaccatacccctcaccacagtgcttaccaacggtcctccggcctcaacgaccgccccaacccagctcgtgttacagtcagtgccagctgccagtaccttcaaggatacgttcaccttacaggccagcttccctctaaatgcctctttccaggacagtcaggtggccgctcctggtgccccacttatcctgtcaggactgccacagctcctggccggagcaaataggcctaccaatcccgcccctcctaccgtgactggggcaggccccgcaggtccgtcatcccagccaccgggcacggtgattgccgcttttatccgtacgtctggcacaaccgccgctccacgtgttaaggaaggtcctttgaggtccagcagttacgtgcagggcatggtaacaggcgcgcccatggaaggcctgctggtcccggaagagaccttacgggaactgctgagagatcaggcccatctccagccactgcctacacaggttgtatccaggggtagtcacaatccatccctgcttggtaatcagacacttagcccgccctcgcggcctaccgtggggctaactccagttgctgagctggagctttcatctggttccggttctctgctcatggcagaacccagcgtaactacgtccggcagtttgctgacacgttccccaacccccgcacccttctcacccttcaacccaaccagcttgatcaaaatggagccgcacgacatttag

SEQ ID NO: 186226 - DNA, 1992 bp, Artificial Sequence
  Description of Artificial Sequence: Synthetic coding sequence
atggccatcaccctgcagcccagcgacctgatcttcgagttcgccagcaacgggatggacgatgatatccaccaattggaagatccttccgtttttcccgcagtaatcgtggagcaagttccttaccccgatctcttacacctgtactctggcttggaacttgatgacgtgcacaacggaattataacagatggtaccctctgcatgacacaggaccagattctcgagggatccttcctattaacagatgacaatgaagccacctcacacacaatgagcaccgcagaggtgctgctcaacatggagagcccaagtgatattctggacgaaaagcagattttttcaacttccgagatgctgccggactccgaccccgctccagctgtgacccttccaaattacctcttcccagccagtgaaccagacgcccttaatagagctggggatacatccgaccaggaggggcatagcctggaagagaaggcatcccgcgaagagtccgctaagaaaacggggaaatccaaaaagagaattcgcaagaccaagggaaatagatcaacatccccagtcacagatcccagtatacccattcgtaaaaagagtaaggacgggaaggggagcactatatatctttgggaattcctcctcgcactgcttcaggatcggaacacttgtcccaagtacatcaagtggacccagcgggagaaggggatctttaagctggtagacagtaaggccgtttctaagctgtgggggaagcagaagaataagccagatatgaattatgagacaatgggacgggccctcagatattattaccagcgaggcattctggcaaaagttgaagggcagcgtctggtttaccagttcaaggaaatgcctaaagacctggttgtgattgaggacgaggacgaaagcagtgaggccacagccgcacccccacaggcctctacagctagcgtcgcgagcgcttctactaccaggcggacctcaagcagagtgtccagccgcagtgcccctcagggcaagggaagctcctcctgggagaagcccaagatccaacatgtcggactgcagccgtcggcttctttagaactgggtccttcattagacgaggagattcctactacaagcacgatgctggtgtcacctgcagaaggccaggtcaagcttaccaaagccgtctcagcttctagtgtgccttccaacattcacctgggggtcgcgcctgtcggcagcggctcagctctgaccctacagactatccccctcaccactgtcttgacgaatgggccgcccgcatccacaacagcccccacacaactggtcttgcagtcagtaccagcggcaagcacattcaaggacacattcacactccaggccagctttcctctaaacgctagcttccaggattcccaagtcgcagcccctggagcacccctgatactgagtggtctaccacagctccttgccggcgcaaatcgtcccaccaaccctgctcctccaaccgtcaccggggccgggcccgctggcccatcaagtcagccacctggcactgtgattgccgccttcatcaggacttctgggaccaccgcggcccctagagtgaaagaaggccccctgaggagttcgagctatgtacaaggtatggtgacaggggcccccatggaaggccttctcgtacctgaggagaccctgcgggagctgctccgggaccaagctcacctgcagcccttgccgacgcaggtggttagcagaggaagccacaacccgtccctgttaggcaaccagaccctctctccaccgagtcgcccaaccgtagggttaactcctgtggcagagcttgagctcagcagtgggtcagggagcctgttgatggccgagcctagcgtgacaacctctggctccctgctgaccaggtcccctacgccagcaccatttagccctttcaacccaactagccttattaaaatggagccacatgacatatag

SEQ ID NO: 186227 - DNA, 234 bp, Artificial Sequence
  Description of Artificial Sequence: Synthetic coding sequence
atggacgacgacatccaccagctggaggaccccagcgtgttccccgccgttatagtagagcaggtcccataccccgacctgctgcacctctactctgggctggaactcgacgacgtgcataacggcatcattactgacggtaccctgtgcatgacacaggaccagatcctcgagggaagttttctgttgactgacgacaacgaggcaacatcccatactatgtcgaccgcctag

SEQ ID NO: 186228 - DNA, 768 bp, Artificial Sequence
  Description of Artificial Sequence: Synthetic coding sequence
atgctggacagcgtgacccacagcaccttcctgcccaacgccagcttttgtgatcctttaatgagctggacagacctgttctccaatgaagagtactatccagccttcgaacaccaaaccgcctgcgacagctattggacttctgtacatcccgaatactggacaaagagacacgtctgggaatggctgcagttttgctgcgaccaatacaaactggacacaaactgcatttctttttgtaatttcaatatctcaggactgcagctgtgcagcatgactcaggaggagttcgtcgaggccgccggtctctgtggcgaatacctctacttcatcctgcagaatattagaacgcaggggtactccttcttcaacgacgccgaagagagtaaggcaaccatcaaggattatgccgacagcaattgccttaagacctctggcatcaagtctcaggactgtcattcccacagtcgcacctcacttcagtcaagccatctgtgggaattcgtgcgagatctgctactgtcacctgaggaaaactgtggtatcctcgaatgggaagacagagaacagggtatattcagagtcgttaaatccgaagcattggcaaagatgtggggacagagaaagaaaaacgatcgaatgacatacgaaaagctgtctcgagcactgcggtattactataagacaggtattctcgagcgcgtggacaggagactcgtgtataaatttggaaagaatgcccatggctggcaggaagataaactgtag

SEQ ID NO: 186229 - DNA, 798 bp, Artificial Sequence
  Description of Artificial Sequence: Synthetic coding sequence
atgcccagcctgccccacagccaccgggtgatgctggacagcgtgacccattctaccttcttgcctaatgcctctttttgcgaccctctcatgagttggaccgacttattctctaatgaggaatactacccggcttttgagcaccagacagcctgtgactcttactggacaagcgtccaccccgaatactggaccaagagacatgtgtgggagtggctgcagttctgctgcgatcagtacaagctggatacaaactgcatctccttctgtaattttaatattagcggccttcagctctgcagtatgacacaggaggaatttgtggaggcggcgggcctgtgtggggagtacctgtacttcattctccagaatatcagaactcaggggtattcattcttcaatgacgcagaagagtccaaagcaaccatcaaggactatgccgatagcaactgcttaaagacaagtgggattaagagccaggactgccacagccacagcaggacaagtctccaaagctcccatctatgggaattcgtgcgggatctgttactgtcgcctgaggagaactgcgggattctggaatgggaggaccgggaacagggcatttttagggtggtgaagagcgaggccctggcaaaaatgtgggggcagagaaagaagaatgatcgcatgacctacgagaagctttccagggccctgagatattattataaaactggcatcctcgagagggtggatcggagactcgtctacaagttcggcaagaacgcccatggttggcaagaagataaactgtag

SEQ ID NO: 186230 - DNA, 483 bp, Artificial Sequence
  Description of Artificial Sequence: Synthetic coding sequence
atgctggacagcgtgacccacagcaccttcctgcccaacgccagcttctgtgatcccctcatgtcatggacagacctcttctccaacgaagagtattaccccgcttttgaacatcagactgacgctgacagcaactgtctgaaaacatctggtatcaaatctcaagactgccacagccacagccgtacgtcgctgcagagcagccacctgtgggaatttgtgagagatcttttgctgagtccagaagaaaactgcgggatattggaatgggaggatcgggagcaaggaatttttcgagtagttaagagtgaggctctggctaaaatgtggggacagcgaaagaagaatgatcgaatgacttacgaaaagctgtctcgagcccttcgctattactataagactgggatcttggagcgtgtcgaccgtcggctggtgtacaaattcggtaagaacgctcacgggtggcaggaggacaagctatag

SEQ ID NO: 186231 - DNA, 1728 bp, Artificial Sequence
  Description of Artificial Sequence: Synthetic coding sequence
atgttcggcatccaggacaccctgggccggggccccaccctgaaggagaagagtctgggagctgaaatggatagcgtcagatcttgggtccggaatgtaggagtcgtggatgcgaatgtggccgcccagtccggtgtggccctgagtagggcacacttcgagaagcagcctcctagtaacctccgcaagtcaaatttctttcattttgtacttgcactttatgaccgccagggccagcccgtagaaattgagcgcacagcatttgtcgatttcgttgagaacgataaggagcagggaaacgaaaaaaccaacaatgggacccactataagctccagctgctgtacagtaacggggtcagaacggagcaggatctctacgtgcgactgatagactcagtaaccaaacagccaatcgcttacgaaggacaaaacaagaatccggagatgtgcagagtcctcctcacccatgaggtgatgtgctcaagatgttgcgagaaaaagtcctgtggaaacagaaacgaaactcctagcgacccagtgataatcgaccgctttttcttaaagtttttcctgaagtgcaaccagaactgtctgaagaccgccggcaaccctcgagacatgcgccgttttcaggttgtcttaagcacgacagtgaatgtggacggccatgtcctcgcggtgagcgacaatatgtttgtacacaataacagcaaacacgggagaagagccagaagactggatccttctgaagccacaccatgtatcaaagccatcagtcctagcgagggatggactacgggcggggcaatggtcattattattggagacaatttcttcgatgggctgcaggtagttttcggcaccatgctcgtctggtcggagctgatcacgcctcatgcaattcgggtgcagaccccccctcgacatatcccaggagtagtcgaggtgactcttagctacaaatctaaacaattttgtaaaggggctccgggaaggttcatttataccgccctaaatgaaccaacgattgactacggcttccagcgacttcagaaggtgatcccccggcatcctggtgatccagagcgcctggctaaagaaatgctgctgaaacgcgccgcggatttggtggaggcactctatggtacgccccacaataatcaggacattattctcaaacgggcagcggacattgcggaagccctgtactcagtaccccggaatccgtcacagctcccggccttgagcagcagtccggcgcacagcgggatgatgggcatcaacagctatggcagccaacttggggtgtcaatttccgaatccacacaagggaacaaccagggctacatccggaacacgtcatcaataagtccacgtggttattcgagttcctccacgccgcaacagtcgaactactctactagctcgaactccatgaacgggtacagtaacgtgccgatggcaaacctgggtgtgccgggcagccccggattcttgaatgggtccccaacaggttctccttatggcatcatgtcctccagccctaccgtgggaagctcaagcacatccagtatcctgccgttcagctcaagtgtcttcccggccgtaaaacaaaagtccgccttcgcgccagtgatccggccccagggatctccctctccagcctgttctagcgggaacggcaatggattccgcgctatgaccggcctcgtggtgccccctatgtag

SEQ ID NO: 186232 - DNA, 795 bp, Artificial Sequence
  Description of Artificial Sequence: Synthetic coding sequence
atggtgatcatcatcggcgacaacttcttcgacggcctgcaggtggtgttcggcactatgttagtgtggtcagagctcattacaccgcacgccatcagagttcagacaccccccagacatatcccaggggtggtggaagtcacgctctcatataagtctaagcagttctgcaagggcgccccaggaagattcatctacacagctttgaacgagccaaccatcgactacgggtttcagcgactgcagaaggtcattccaagacatcccggcgatccggagcggctagcaaaagagatgctgctgaaacgggcagcagatttggtggaagcgctctacgggactccccacaataatcaagatatcatcctcaaaagggctgcagacattgcagaggccctttattcggttccaagaaacccaagtcagcttcccgccctctcctcctccccagctcatagcggaatgatgggcattaatagctacggctcccagctgggtgtgagtattagtgagtctacccaggggaacaaccagggatacatccggaacacaagtagcattagccctcgcggctactctagtagtagcacccctcagcagtccaactacagcaccagctctaactcgatgaatggttattcgaatgtgccaatggctaatctcggcgtgcctggatcccctggattcctcaacggcagtcccactggatccccctatgggaccggactctggctcacttggttgctaaaggccttttggggaaagaaaagaatcgaaaccataccatttctgtag

SEQ ID NO: 186233 - DNA, 1791 bp, Artificial Sequence
  Description of Artificial Sequence: Synthetic coding sequence
atgttcggcatccaggagaacatcccccggggcggcaccaccatgaaggaggagccactcggttccggaatgaatccagtgcgctcttggatgcacactgcaggagtggtggacgccaacactgcagcccagtctggggtcggtttggcgagggcacatttcgagaaacagcctcccagcaacctgagaaaatcaaactttttccacttcgtgctggctctgtacgacaggcagggccagccagtcgagatcgaacggacagccttcgtcgactttgtcgaaaaggagaaagagcccaataacgagaagaccaataacggaatccactacaagctgcagcttctctattccaatggcgtcaggaccgaacaggatctgtatgtgcggttaattgacagcatgactaagcaggccattgtgtacgaggggcaagacaagaatcccgaaatgtgccgcgtattactgacacatgaaattatgtgtagtcgctgttgcgacaaaaagtcttgtggcaaccgcaatgagacaccatccgatcctgtgattatagaccggttcttcctcaaattctttttgaagtgcaatcagaattgtcttaaaaacgccggaaatcctcgcgacatgagacgcttccaggtggtagtcagcaccaccgtgaatgtcgatgggcacgtgttggccgttagcgataacatgttcgtgcataataactcgaagcatggaaggagagctcgaaggctagatccatcagagggcacagctcccagctacctggagaacgctacaccatgcattaaggctataagtccctctgagggctggacaaccggcggggccacagttattatcattggtgataacttcttcgacggcctgcaggtggtgttcggtaccatgcttgtgtggtcggagctgatcacgcctcacgccatacgggtacaaacccctccccggcacataccaggtgtcgtcgaagtgaccttatcctacaagagtaagcaattctgcaaaggcgcacctggaaggtttgtctacacagctttgaatgaacctacaatcgattatggcttccagaggttacagaaggttatcccacggcatcctggcgatcctgagagactgcctaaagaggtccttctcaagagggcagccgatctcgtggaagcactctatggcatgccacacaacaatcaagaaataatcctgaaaagggcagccgatattgctgaagccctttattctgtaccaaggaaccacaaccagatacctaccctggggaacaaccccgcccatacagggatgatgggggtaaattccttcagcagccagctggctgtgaatgtgtccgaaacttctcaggccaatgaccaggttgggtactctcgcaatacgtcaagtgtaagcccaaggggctatgtcccatccagcactccccagcagtcaaattataatacggtgagcacctcgatgaacggctacgggtccggagccatggcatccttaggcgtacctggtagcccaggttttttgaacggaagctctgccaattccccctacggcattgttccatccagccccacgatggccgcctccagcgtgacccttccttcaaattgttccagcacgcacggaatcttcagcttttcccccgcaaacgttatttccgccgtgaaacagaaaagtgcgttcgccccagtagtgagaccccaggcatcacctcccccttcatgcacaagcgctaacggaaatggcctgcaggctatgtctggcctggtggtcccccctatgtag

SEQ ID NO: 186234 - DNA, 1656 bp, Artificial Sequence
  Description of Artificial Sequence: Synthetic coding sequence
atgttcggcatccaggagaacatcccccggggcggcaccaccatgaaggaagagcccctgggtagcgggatgaatcccgtgcgaagctggatgcataccgcaggggtggtcgacgccaacacagccgcccagtctggtgtgggactggcgcgggcgcacttcgagaaacagccaccaagtaatttgcggaagagcaacttctttcactttgtgctggcactttatgaccgacagggtcagcccgtagagattgaaaggacagctttcgtggactttgtcgagaaagagaaggagcccaataatgagaaaacgaacaacggaattcactataaactgcaactgttgtacagcaacggtgtcaggaccgaacaggacctgtacgtgaggctaatcgattccatgacaaaacaggccatcgtatacgagggacaagacaaaaaccccgagatgtgccgagtgctacttacccacgagatcatgtgcagcaggtgctgcgacaaaaagtcatgcggaaataggaatgagacaccatcagatcccgtcatcatcgaccgcttcttcctgaagtttttccttaaatgtaaccaaaattgtctgaagaatgctgggaatccccgggacatgcgtaggtttcaagtagtggtctccacaaccgttaatgtggacggtcacgtgctcgctgtgagcgacaacatgttcgtccataacaactcaaagcatgggaggcgagcaaggcggctggatcctagtgaagctactccatgtatcaaagctatttctccatccgagggatggacaacagggggagccaccgttattattattggcgacaacttcttcgatggactgcaggtggtcttcggcactatgctggtgtggagcgaactgattacacctcacgctatccgtgtgcagacacccccccggcacattcccggggtggtggaggtgaccttatcctataagagcaagcagttttgtaagggggcccccggacgcttcgtatacaccgctctgaacgagcctacaattgactatgggtttcagaggctgcaaaaagtaattcctcggcatccaggcgatccagaaaggctcccaaaagaagtgctccttaagcgagccgctgatctggtagaggcactgtatggcatgccacacaacaatcaggagatcatcttgaaaagggccgccgatatagccgaggccctttactcagtgccccgaaatcacaatcagatccccacattgggtaataaccctgcacacaccgggatgatgggagtgaatagcttttctagccaacttgccgtcaacgtgagtgagacaagccaggccaatgaccaggtgggctactcccgaaacactagtagcgtatccccaagaggatacgtgcctagctctaccccacaacagagtaactacaatactgtatctacaagcatgaatggttatgggtccggtgccatggcctccctgggagttcccggcagccctggatttttgaatggcagtagtgcaaacagcccctacggcatgaagcaaaagtctgccttcgcgcccgtcgttcgccctcaggcgtctccgccgccatcttgcacaagcgccaatggcaatggactgcaggcgatgagtggactcgttgtgccacccatgtag

SEQ ID NO: 186235 - DNA, 576 bp, Artificial Sequence
  Description of Artificial Sequence: Synthetic coding sequence
tgattcagcagccagctggccgtgaacgtgagcgagaccagccaggccaatgaccaggtcgggtatagccgcaatacctctagtgtgtcccctcggggctacgtgcccagtagtacccctcagcaatccaattataatactgtgtcaaccagtatgaatgggtatggcagcggagccatggccagccttggagtccccggatcacccggcttcttaaatgggagctccgccaatagcccctacgggattgttcccagcagcccaaccatggcagcaagctctgtaacccttcctagtaactgttcctccacacatgggatctttagcttttctcccgctaatgttatttcagctgtcaaacagaaaagcgcctttgcacccgttgtgcggcctcaggcgtccccccccccctcttgcacctctgcaaatggcaacgggctacagggctccctccttggcgccgaggatgtggcagccgagaagactaattggcctttctgtgaagtgggaggtatttttcactttgatgaactcatgctgaaaaaaggcacaggaaagttgtgcttagggtggtag

SEQ ID NO: 186236 - DNA, 1809 bp, Artificial Sequence
  Description of Artificial Sequence: Synthetic coding sequence
atgttccccgcccaggacgccctgccccggagcggcctgaacctgaaagaggagccactactacccgccggcttgggcagtgtccgcagttggatgcagggggcggggatcttggacgcaagcaccgctgctcagtcaggggtaggcctcgccagggcacacttcgaaaaacagccacccagtaatctacgaaaatccaacttttttcatttcgtcctcgccatgtatgaccgacaaggccagcccgtggaagtggagaggacagcctttattgactttgtggaaaaggatcgtgagccaggcgcagagaaaaccaataacgggatacactaccgcctacgcttagtgtataacaacggactgcgcactgagcaggatctatatgtgcgccttattgactctatgagcaagcaagccattatttacgagggccaggacaagaatcccgaaatgtgtagagtgttactaactcatgaaattatgtgtagccggtgttgtgaccgaaaatcctgtgggaaccgcaacgaaactccaagcgatcccgtgatcattgataggtttttcctgaagttcttcctgaaatgcaaccaaaattgtttaaagaatgctggcaaccctagagatatgaggcggtttcaggtcgttgtttccaccacggtgtccgtggatggccacgtgcttgcagtatcagacaacatgtttgtgcataataacagcaagcatggtaggagggctcgcagactggaccctagtgaggcggccaccccgtgtatcaaagctatctcccccggggagggctggaccaccggcggcgcaaccgttatcgtcattggagataacttttttgatggactgcaggtggtattcgggaacgtgctggtctggagtgagctgattacacctcacgccatcagagttcagacccctccaaggcacattcctggtgtcgtcgaggtgaccctgtcttacaaaagtaagcaattctgtaagggctgtcccggtagatttgtttataccgctctaaacgagcctaccatagattatggatttcagaggctacaaaaggtcattcctcggcaccctggtgatccagaacggttaccgaaagaagtgttactcaagagagcagcagatctggcagaagcactctacggtgtccctggatcaaaccaggaactgctgttgaaacgtgccgctgatgtggccgaggccttgtatagcaccccgcgggcccccggtcctctggctcccctcgctccttcccacccacatccagccgtggtggggataaacgcatttagctcacccctcgccatcgccgttggagatgctacacccggtcccgagcctgggtacgctagatcatgcagtagtgcaagcccccgcggttttgccccctcacctggatcccagcaatcaggatacggcggagggctgggcgccggactgggaggatatggggctccaggggtggctgggctgggcgttccgggatcgccgtcatttctaaatggaagcactgccacgtcacccttcgccataatgcctagcagtcctccactagctgcggctagcagtatgtctctccctgctgctgctcccacaacatcagtgtttagcttctcccccgttaatatgatttcagctgtcaagcaacggagcgccttcgcgcctgtgcttagacctccgtccagccccccccaggcctgccctcgggcccacggagagggcctgcctgatcaatcgtttgaggacagtgacaagttccattctcccgcacgcggcttacaaggcctcgcttacagctag

SEQ ID NO: 186237 - DNA, 1797 bp, Artificial Sequence
  Description of Artificial Sequence: Synthetic coding sequence
atggacgccctgccccggagcggcctgaacctgaaggaggagcccctattaccggccggcctgggaagtgttcgtagttggatgcagggagctggaatattagacgcgtcgacagccgcgcagtcaggcgtaggcttagccagagctcatttcgagaaacagcctcccagcaatctgcgcaagtcaaacttcttccacttcgtactcgccatgtatgatagacagggccagcctgtggaagtggaaagaaccgcattcattgacttcgtggaaaaggaccgggaacctggcgccgagaagactaataacggcatccactacagactccggttagtttacaacaatggacttcgaacagagcaggatctctacgtcaggctcatcgactctatgagcaagcaggcaatcatctatgagggccaggacaaaaaccctgaaatgtgccgagtgctcctgactcacgagattatgtgctcacgttgttgtgaccgcaagtcctgcggcaacaggaatgaaaccccatcagaccccgtcattatagatcgcttttttcttaaattcttcctcaaatgtaaccagaattgccttaagaatgcagggaatcctcgggatatgaggcgctttcaagtggtcgtgagtacgaccgtttccgtagacggccacgtgcttgcagtgtccgacaatatgttcgttcacaacaatagcaaacatgggagaagggcccgaaggcttgatccaagcgaggcagcgaccccgtgtatcaaggctatctctcctggggaaggctggacaaccggaggagcaactgtgatcgtgatcggcgacaattttttcgacggattgcaggtagtgtttggaaatgtgttagtgtggagcgagctcatcacacctcatgctatccgtgtgcagacaccacctcgacatatacctggcgttgtcgaggttacactctcatacaaatctaagcagttttgtaaaggttgtccaggtcgatttgtttacacagcactcaacgagccaactattgactatggtttccagcgcctgcagaaagtaatccccagacaccccggggatccagagcgcctccctaaggaagtgttactcaaacgagccgcagacctcgcggaagcgctgtatggagtgccgggatccaaccaggagcttctgctcaaacgggcggcggacgtggccgaagcactgtattctacccccagagccccgggacctttggcacccctcgctcccagccatccacacccagctgtagtcggcattaatgccttttcgagccctctcgcaattgctgtcggagacgccacacccggacccgagcccggctatgctcgctcctgcagctccgcaagtccacgcgggtttgcgccttctcccggaagtcagcaatctggttatggcgggggcttgggcgccgggctcggaggttacggagcccccggagtggccggcctcggtgtgcctggctccccttcctttctcaatggttcaacagcgacctccccttttgcaatcatgccctccagtccaccgttggcagctgccagctcaatgtcactgcctgcggctgctccaacgacatccgtgttttcattttcacctgtaaacatgattagcgcggtcaagcagcgctcagcttttgctccagtcctgcgccccccctctagtccgccccaggcatgtcccagggcccacggcgagggcctgcccgaccaatcttttgaggacagtgacaagttccactcccccgccagggggctacaaggattggcatactcgtag

SEQ ID NO: 186238 - DNA, 555 bp, Artificial Sequence
  Description of Artificial Sequence: Synthetic coding sequence
cggggcagcgtgcagcacccccccgtggtgggcatcaacgccttctcttctcccctggccatagccgtgggcgatgctacaccaggccccgaacccgggtacgctcggtcctgctcgagtgccagtccccggggctttgctcccagtcccgggagtcagcagagcggatacggaggaggattgggcgcagggcttggggggtacggcgcccccggagttgcaggcctcggggtccctggcagcccatccttcctaaatggaagtaccgctacgagcccttttgcgattatgccatctagcccacccctcgccgctgcttcctccatgagcctgccagcagccgccccgactacatctgtcttttcattctccccagtgaacatgatcagtgcagtcaagcaacggtccgcgtttgcacccgtattacgcccaccatcaagcccaccacaagcctgcccaagggctcatggcgaaggtttgccggatcagtccttcgaggactctgataaattccactcccccgcccgtggcctgcaagggcttgcttactcatag

SEQ ID NO: 186239 - DNA, 1632 bp, Artificial Sequence
  Description of Artificial Sequence: Synthetic coding sequence
atggccgccgccaaggccgagatgcagctgatgagccccctgcagatcagcgaccccttcggaagctttccccattcaccaaccatggataattaccccaaactcgaggaaatgatgctcctaagcaacggggccccccagttcttgggggctgctggagccccagaaggatccggaagcaattccagctctagcagcagcggagggggtggcggcggaggcggcgggagcaactcttcaagctctagtagcacattcaacccccaggctgacacgggcgagcaaccatatgagcatttgacagccgaaagcttcccagatataagcctcaataacgagaaagttctcgtggagacatcgtatccgtctcaaaccacgaggcttcccccgatcacatatactggcaggttttcattagagcccgctccaaatagcgggaacacgctttggccagaacctctattcagcttggtttctgggctggtgtcaatgacgaatccgcctgccagctcttccagcgcgccgtcacctgccgcttcatcggcttctgcctcccaatcacctcccttatcttgtgctgtgccatctaatgactcctctccgatttactccgccgctccgacgttccctaccccaaatactgatattttccccgagccacaaagtcaagcatttcctggcagcgcgggcaccgcactacagtatcccccccccgcgtacccagcagcgaagggcggctttcaagtgccaatgatccccgactatctgttcccgcagcagcagggggaccttggcctgggtacacccgatcagaagccattccaggggttggaatcaaggactcagcagcctagcctgacccccctgtctacaatcaaagcgttcgccactcagagcggttctcaagatttaaaggctctgaacacttcatatcaatctcagctgatcaagccctcaaggatgaggaagtatccaaatcggccaagcaagactcctccccacgaacgaccctatgcctgtcctgttgagtcctgtgaccggcgttttagtcgttccgatgaactaacgagacatatcaggattcataccggacaaaagcctttccaatgcagaatttgcatgcggaatttctctcgatctgatcatcttacaacgcacataagaactcatactggagagaagcctttcgcgtgcgacatctgcgggcgcaaattcgcccggtctgatgagagaaagcggcacaccaagatccatctgcggcagaaggataagaaggccgacaagtcagttgttgctagttccgctacttcttcactatccagttacccctctcccgtcgccacaagctatccatcccccgttaccacctcttatccaagtcccgccacaacatcttaccctagtcccgtccctacctcgtttagtagccctgggtctagcacatacccatctccagttcactccggattcccatcaccgtcagtggccactacatactcctctgtcccgcccgcctttcccgctcaagttagttcctttccaagcagtgctgtcaccaatagcttcagcgcttctactggactgagcgacatgacagccacatttagcccgagaacaatcgaaatctgctag

SEQ ID NO: 186240 - DNA, 603 bp, Artificial Sequence
  Description of Artificial Sequence: Synthetic coding sequence
atggccgccgccaaggccgagatgcagctgatgagccccctgcagatttccgacccattcggaagtttcccccactcccccaccatggataactatcctaagctggaagagatgatgctactctccaatggcgccccacagtttcttggggcagcaggcgcccccgaaggaagcggatcaaattcaagttcatcctccagcggaggcgggggaggtggaggcggagggtcaaattcctcctccagctcatcaactttcaacccccaggctgacacgggcgagcagccttacgaacacctgacagccgagagcttccccgacattagcctcaataatgagaaggtgctagttgaaaccagttatcctagccagacaacgcgtctgccacctattacctataccgggcggttttcactagagcccgcgcctaatagtgggtttcctagtccaagtgtcgccacaacttatagttccgtgcctcccgccttccctgcacaggtgagcagctttccctctagcgctgtgaccaactccttttcggcatcaaccggtctgagtgacatgactgccacattcagtcccaggaccattgagatttgctag

SEQ ID NO: 186241 - DNA, 699 bp, Artificial Sequence
  Description of Artificial Sequence: Synthetic coding sequence
atggccgccgccaaggccgagatgcagctgatgagccccctgcagatctcagatcctttcgggagctttcctcactcacccactatggacaactacccgaaattggaagaaatgatgttactaagcaacggcgccccccagtttctgggcgctgccggggcccccgagggtagcggatctaactcctcatcatcaagctcaggaggaggcggaggggggggcggaggctctaattcctcttcatcctcttcaacctttaaccctcaggccgatacaggtgagcagccttatgaacacctcaccgctgagtcattcccggacatcagcctgaataatgaaaaggttttggtcgagacctcctatcctagccagaccacgcggcttccgcccattacctatacaggaagatttagcctggagccggctcctaattccggcaacacactgtggccagaacctttgttctccctcgttagtggcttggtgagcatgaccaacccacccgctagcagttcgagcgctccaagtccagcagcctcttcggcctctgcatcccagtctccgcctctgagctgtgctgtgcccagtaatgattcttctcccatctactcagccgctccgacctttccaacccccaatacggatatctttcctgagactgcaatgagtaagttctttacttccatccagcggacctag

SEQ ID NO: 186242 - DNA, 1431 bp, Artificial Sequence
  Description of Artificial Sequence: Synthetic coding sequence
atgatgaccgccaaggccgtggacaagatccccgtgaccctgagcggattcgtgcaccagctgtcggacaatatttaccccgtggaggatctggcggctacatccgtaaccatcttcccaaacgcagagctaggcggcccctttgaccagatgaatggcgtcgccggggacgggatgattaacattgatatgaccggagagaagcgctctcttgatttgccctaccccagctcctttgcacctgtgagcgcgccccggaatcagacgtttacctacatgggtaaattcagcattgacccacagtaccctggggcaagctgctatcctgaaggaattattaatatcgtcagtgctggcatcctgcaaggggtcacctctcccgcaagcactactgcctcatcttccgtgaccagcgccagtcctaatcctttggcgactgggccactcggcgtatgcaccatgtcccagacacagccggatctcgaccacctttactctccccccccacccccaccgccttatagtggttgtgccggcgacttataccaagatccttccgcctttctctccgccgccaccacaagtaccagtagctcactggcctatcccccgcctccctcttacccttcacccaaacctgctacagatcccggattatttcctatgatccccgattaccccggcttcttcccttcacaatgccagcgcgacctccacggcacagctgggcctgatcgcaagcccttcccatgccccctggacaccttgagggtgccacctccgttgacccccctgagcacgatcaggaactttacacttggcggaccttcggccggcgtcactggacctggcgcctccggcggcagtgaaggacctaggcttccaggcagcagctcggcggccgccgcagccgccgctgctgcagcttacaatccgcaccacctgcctttgcgtcctattctgaggcccagaaaatacccaaatagaccatcaaaaactccagtgcatgagagaccttacccatgccctgctgagggatgcgatagaaggttcagtcgatcagacgagttgactcggcacatcagaatccacactggacataagcctttccaatgtcggatttgcatgagaaacttttcacggagtgatcatttgactacccacattcggacccataccggggagaaacctttcgcgtgcgactactgcgggcgaaagtttgcccggtccgacgagcgaaagcggcacactaagatccacttacggcaaaaggaaagaaaatcctccgctccgtctgccagcgtcccagcaccatcaactgcatcatgttccggcggcgtacaacccggcggcaccctgtgttccagcaactccagcagcctggggggcggcccactggctccctgttcctctcgaacacggacaccttag

SEQ ID NO: 186243 - DNA, 1281 bp, Artificial Sequence
  Description of Artificial Sequence: Synthetic coding sequence
atgaacggcgtggccggcgacggcatgatcaacatcgacatgaccggcgagaagcgttcccttgacctgccctacccatcttctttcgcaccagtcagtgcccccaggaaccagacttttacctacatgggcaaattctcaattgatcctcagtaccccggagcttcctgctaccccgagggaattataaatatagtgtcagcaggtatcctacagggggtcacctcccctgcctccaccacagcatcctcctctgttacctcggcatctccaaacccgttggccaccggacccctgggcgtttgtacaatgtcccagacccagcctgacttggatcacctctactcacctccgccacccccacccccatacagcggctgtgcgggggatctttatcaggatccaagtgccttcttgtccgccgcaactacctctacgtcaagctccctggcctacccacctcccccatcatatccttcccccaaacctgccactgaccctggactgttccctatgatacctgactatcctggcttctttccatcccagtgccagcgggacctgcatggcactgccggcccagatagaaaaccttttccttgtccccttgacacactgcgcgtgccacctcccctgactccactgagtactataagaaattttactcttggaggcccttcagctggtgtcactgggcctggtgcatccggcggaagtgaaggacctagacttcccggttccagctctgccgcagctgccgccgctgccgctgccgcatacaatccacatcacctgcctttacgacctatcctgcgccccagaaagtacccgaatcgccccagcaagactcccgtccatgagcgcccatatccatgtcctgccgaagggtgcgaccgcagattctctagatccgacgaattgaccagacatatccggatacacacaggacacaagccctttcagtgtcgcatttgtatgagaaatttttcacggagtgaccacttgaccacccatataaggacacacactggagagaagcccttcgcctgcgactattgcggcagaaagttcgcaagatctgacgagagaaaaagacacactaagatccacctcaggcagaaagagcggaaatcttccgccccctcagcgtctgtgcccgccccttctaccgcatcatgcagcgggggcgtccaaccaggcggcacgctgtgctccagcaattccagctcactgggtggtgggcctctggctccttgtagcagtaggacgaggacaccatag

SEQ ID NO: 186244 - DNA, 786 bp, Artificial Sequence
  Description of Artificial Sequence: Synthetic coding sequence
atgcgggtgggcctgcccagcgaggccagcagctgcccctggagcgcgcggggacctcgtgatccccctgagcggaggcgctctgggttggcccatgtgctttcagacaatatctacccagtggaggatttggctgctacctctgtgacgatatttcctaacgccgagttgggaggcccatttgaccagatgaatggcgtcgccggcgacgggatgataaacattgacatgacaggtgaaaagcggagcctagatttaccgtacccatctagtttcgcgccggtgagtgcacccaggaatcaaacctttacatacatggggaaattttccatagacccccagtacccaggtgcctcatgctatccggaggggataatcaacattgtatctgccggcattctgcagggagtgacctctccagcaagcactactgcatcatctagcgtcaccagtgcttctcccaacccgctcgctaccggccccctgggggtgtgcacgatgtctcagacccaacccgatctcgaccatttatactcaccaccccctcccccccctccatattccggttgcgcgggcgatctgtaccaggatccgtctgcctttctgtcagcggcaactacgagcaccagctcaagtctagcatatccgcccccgcctagttacccatcccctaaacccgtggaagctgcccgggaccccggatgcctggttgctgcccagcagcagcagcagccaccacctccccctccaattacacacactacatgccattgtggccctttttag

SEQ ID NO: 186245 - DNA, 1431 bp, Artificial Sequence
  Description of Artificial Sequence: Synthetic coding sequence
atgatgaccgccaaggccgtggacaagatccccgtgaccctgagcggttttgttcatcagctgtctgacaacatttaccccgtcgaagacctggccgcgacctccgttaccatcttcccgaacgccgagctggggggaccttttgatcaaatgaatggagttgccggagacggtatgattaacatcgacatgacaggcgagaagcgaagcttggatctgccctacccctcttcttttgcccccgtgtctgccccaaggaatcagactttcacctatatgggaaaattttccatcgacccgcagtacccaggcgcttcgtgctatccagagggaattattaatatcgtgtccgccggcattcttcagggtgtgacttctccagctagcaccactgcttcgtcaagcgtcacatctgccagcccaaatcccctcgccactggccccttgggtgtctgcaccatgtcgcagactcagcccgatctagaccacctctatagcccccctcctcctccgccaccttactcgggctgcgctggcgacttatatcaggatccttctgcgtttctcagcgctgccaccactagcacttctagtagcctcgcttatccacccccaccgagttacccatctccaaagcccgctacggaccccgggttattccccatgataccagattatcctggcttctttccaagtcagtgtcagcgagatctgcatggcactgccggacccgacagaaagcccttcccttgcccactcgacaccttgcgggtcccacctccattgacacccctttctactatcagaaatttcactctcggcggcccgtcagccggtgtgaccgggcccggagcctctggaggtagcgagggtccgcgcttgcccggatctagttcagccgcggctgccgcggccgctgccgcggcatacaacccgcatcacctgcccctgcggcctattttgaggcccaggaagtatccaaacagaccttcgaagacgcctgttcacgaacgcccatatccgtgccctgcggaggggtgtgatagacgcttctctagatccgacgaactgacccggcatatccggatccataccggacacaaaccgttccagtgtcggatctgtatgagaaacttctctcgtagtgaccacctgacaacgcacattagaacacacactggcgagaaaccattcgcctgtgattactgtgggaggaagtttgctagatctgatgaacgcaaacggcacaccaaaattcacctgcgccagaaggagcggaagagtagcgcgccgagcgcctcagtccccgctccatccaccgcttcgtgttctggcggggtacaacctggcgggaccctttgcagcagcaacagtagcagcctgggcggtggaccgctcgccccttgtagctccaggacaaggacaccatag

SEQ ID NO: 186246 - DNA, 1461 bp, Artificial Sequence
  Description of Artificial Sequence: Synthetic coding sequence
atgctgcacctgagcgagttcagcgagcccgacgccctgctggtgaaatcaactgagggttgttgtgccgaaccaagcgctgaactcccaagactacctgctcgcgatgcacccgctgccacgggatatcctggggctggcgacttcctttcttgggctcttaacagttgcggggcctccggtgacctggctgacagttgctttctggagggcccagccccgacacccccgcctggcttgtcatattccggctcattcttcatccaagccgtacctgaacatcctcacgaccccgaagctttgttcaatctgatgagtgggatcttgggtttggctccgttcccaggccctgaggctgcagcctccaggtctcctctagacgccccattccctgccgggagtgacgctctgctgcccggcccacccgacctgtacagtcccgatcttggagcagcacctttccctgaagctttttgggaggcctccccttgtgcgggcgctccaagccagtgcctgtacgagcctcagctgagtccacctgacgtaaaacctggcttgcgcgccccgcccgcatcacccgcccttgacgcggtctcggcatttaagggcccctatgcaccatgggaactgctctccgtcggcgcccctggaaattgtggtagccaaggcgactaccaggctgcccccgaagctagatttcctgtgatcgggacgaagatagaggacctgctatcaatatcttgtcccgccgagcttcccgccgtgccagccaacagactttatccgtcgggtgcctatgatgctttccctctcgcaccaggtgacctgggagaaggagccgaagggctgcccggcctgctgacgccaccatctggcgagggtgggtcctctggcgacggcggggagtttctggcaagtacacaacctcaactaagtcctttgggactgcgttcggctgcggccgccgattttcccaagcccttggtcgcagatatccctggcagcagcggcgtggctgctccacctgtgcctcccccaccccccacacccttcccccaagccaaagcacgccgtaagggaagaaggggcggaaaatgcagcaccaggtgtttctgtccaagacctcacgccaaggcatttgcttgccccgtggagagttgtgttaggtcattcgcacggtctgatgaactcaacaggcatctgaggatccatactggccacaagccatttcaatgccgtatctgtctgcggaactttagtaggtcagaccacctcactacccacgtgcggacacatacaggtgagaagcccttcgcgtgcgatgtgtgcggcaggaggtttgcacggtctgatgaaaaaaaaaggcatagtaaggtccacctgaagcagaaagctagggccgaggagagactgaagggcttaggcttctactccctcgggctttccttcgccagtttgtag

SEQ ID NO: 186247 - DNA, 1770 bp, Artificial Sequence
  Description of Artificial Sequence: Synthetic coding sequence
atggccgtggcccggggcgtgggcagccccgagcccgcccccccccaactctataagtggggaggctgtggtctcggagaacctggttcagcactcgagcggcgtggcgctgcagccagagggagatgcggacgggcacgagctcctaggctgcccgattcatttcccagaggggagtgtcctaaaccgggcgcccgagcaccaagaagtgtccggtgcggtgagcctctgccgccagcatcacccccaccagctagaccgcaggcccagcgcgcccggcctcgggcacctcatagccgacgcagagctatgctgcacctctcggaattttctgaacccgatgctctcttagtgaaaagcacagaaggctgttgcgctgagccatccgcggagcttccccgtttgccagctagagatgcccctgccgctaccggatatcctggcgctggcgattttctcagctgggctctgaactcctgcggagcttccggcgatctagccgattcatgtttcttggagggacccgcgcccacgcctccacctggcctgtcatatagtggcagctttttcatccaggccgttcctgagcatcctcatgatcctgaggctctcttcaatttgatgagcggcatcctggggctggcccccttccccggccctgaagctgccgcttccagatcccccctggatgccccattccctgccggatcagacgccttactgccaggtccccccgacctgtactccccagacctgggtgcggctcccttccctgaggcattttgggaggcaagcccgtgtgccggggctccctcccagtgcctgtatgagccccagttaagtccacctgatgtgaagccgggattacgcgcccccccagcctcccctgccctggacgccgtttccgcctttaaaggcccctacgcgccttgggagcttctgtccgttggcgccccaggaaactgcgggagtcagggagactaccaagctgcaccagaggcacgctttccagtgattggcacgaaaatcgaggacctcctgtccataagttgcccagcagaactgcccgccgtgccggccaatcgcctttatccatctggggcctatgatgcctttcccctggctccgggggacttgggggagggtgccgaagggctcccgggactcctcaccccccccagcggagagggcgggtcctccggggatggcggcgagtttctagccagtacacaaccccagctatcaccattaggcttacggagcgctgctgctgccgatttccctaagccactcgtggctgacattcctggctcatccggcgttgcggccccacccgtgcccccaccgcctccaactccttttcctcaggccaaggccagacggaaagggcgacgcggcggtaagtgtagtacacgatgtttctgtccacggccccacgccaaagcctttgcttgtcctgtcgaatcctgcgtaagatcctttgccaggagcgacgagttaaaccggcacctaaggatccacaccgggcacaaaccatttcagtgccgcatatgccttagaaacttttcgcggtctgatcatctgaccacccatgttaggactcataccggggagaaaccctttgcctgtgatgtgtgtggacgccggtttgcacgcagcgacgagaaaaaacgccattctaaagtgcatcttaaacagaaggctcgggccgaggaacgcctcaaaggcctcggcttctattctctcgggctgtccttcgcgagcctatag

SEQ ID NO: 186248 - DNA, 921 bp, Artificial Sequence
  Description of Artificial Sequence: Synthetic coding sequence
atggacaccccccccctgagcgacagcgagagcgagagcgacgagtctttagtaactgacagagaactgcaggatgcttttagccggggtctcctcaagccaggattaaatgtggtgctagaaggccccaagaaagccgtgaacgacgtgaatgggctgaagcagtgtctggcagagtttaagagggatttagagtgggtcgagaggctggacgtcacgctgggcccagtgcccgagatcggcgggtccgaggcccctgcaccacagaacaaggaccagaaagcggtagaccccgaggatgattttcagcgagagatgagtttctataggcaggcccaggcagccgtgctcgccgttctgcctcgcttacaccagctgaaggtgccaacaaagcgacctacagactactttgcagaaatggctaagtccgaccttcagatgcagaagattagacaaaaattgcagaccaagcaggccgccatggagaggtcagagaaagccaagcagcttcgagctctgcggaagtacggcaagaaggttcagacagaggtgctccagaagcggcagcaggaaaaagctcatatgatgaatgctattaagaagtaccaaaagggatttagcgacaagctagattttctggagggggaccagaaaccattagcacagagaaagaaggcgggcgcgaaagggcagcagatgcgcaagggacccagtgccaaacgccggtacaaaaaccagaaattcggtttcgggggcaagaaaaagggcagtaaatggaatacgagggagagctatgatgatgtgtccagtttcagggctaaaacagcgcatggccggggcttgaaacgcccgggcaaaaagggcagcaataaacggcccgggaaaagaacacgtgaaaaaatgaagaaccggactcactag

SEQ ID NO: 186249 - DNA, 1086 bp, Artificial Sequence
  Description of Artificial Sequence: Synthetic coding sequence
atgtaccccgaggccctgcccgtgggcatcctgagcaaccccgacacatttaaacgaaggtcaggaagctattccaatgataaaccagaggtgtggtttgccgccggatcagggagcccaaatcagaagttgagttcatcctgcgtgggccgcgcctgtggggagatggatactccccccctgagtgatagcgaatcagaatctgatgaatctttggtgaccgacagggaattgcaagacgcattctctagaggcctgttgaagcctggcctgaatgttgtactggaaggcccaaaaaaggccgtcaacgacgtgaatggactaaaacagtgcctcgccgagtttaagcgggatttggagtgggtcgagcggctggatgtgacactaggaccggtgccagagataggcggttctgaggccccagctccacagaacaaggatcagaaggctgtggatcctgaagacgattttcaacgcgagatgtccttttatagacaggcccaggccgccgtgcttgccgtactgccacgcttacatcagctgaaggtgcccacaaagcgaccaacagattattttgcagaaatggcgaaaagcgacttacagatgcagaaaatccgacagaaacttcagaccaagcaggctgccatggaacggtcagagaaagcgaaacagctccgcgctctaaggaaatacggtaaaaaagtgcaaaccgaagttctgcagaaaagacagcaggaaaaggcacatatgatgaacgccataaagaagtatcagaaaggattttcggataagctggactttctggaaggcgatcaaaaaccccttgcccaacgaaaaaaagcaggtgccaagggacagcagatgagaaagggaccctccgctaagcgcagatacaagaatcaaaagtttggctttggcggcaaaaaaaaaggctccaaatggaacaccagggagagttacgacgacgtctctagctttcgggctaagaccgcccacggtagaggccttaaacgtccaggaaagaaagggagcaataagcggcctggcaaacggacccgggagaagatgaaaaatcgtacccactag

SEQ ID NO: 186250 - DNA, 2448 bp, Artificial Sequence
  Description of Artificial Sequence: Synthetic coding sequence
atggaggacggcttcagcagctacagcagcctgtacgacaccagcagcttactccagttttgcaatgacgactccgcctccgccgcctccagcatggaggttacagaccggatagcgtctctggaacaaagagtccagatgcaggaggatgatatccagcttttgaaatctgcccttgccgatgtagtcagaagactcaacattaccgaggaacaacaggcagtcttaaatcggaaagggcctactaaggcacggccactgatgcagaccttgcccctacggacaacggtgaacaacggaaccgtcctccctaagaagccaaccgggtctctgccgagtccatccggcgtcaggaaggagaccgcggtgccagcaacaaaaagcaacattaaaaggacttcatctagcgaacgtgtctcacctggtggtagacgagagagcaatggagacagtagagggaatcgtaacaggacgggctcaacctcttcgagctctagcggcaagaagaattctgagagcaagcccaaagagccggtgtttagcgcagaggagggatatgttaagatgttcctgagaggtagacctgtgaccatgtacatgcctaaggatcaagtggactcatactctctggaagctaaggtggaactgccgaccaaaagattgaaactggaatgggtgtacggttaccgcgggcgagactgtagaaataacctctacttgttgcccaccggtgaaactgtgtatttcattgcttccgtcgtcgtgctgtacaacgttgaggaacaactacagcggcactacgcgggccacaacgacgatgtgaaatgtttggctgtgcatcctgaccgcattacaattgccacaggccaggtggcgggcacgtctaaagatggtaagcaattaccaccacacgtaagaatttgggacagcgtgaccctcaatacacttcatgtgattggcataggattctttgatcgcgctgttacatgcatagctttttctaagtcaaacgggggtacaaatctgtgtgccgttgacgactctaacgatcacgtactgtcagtttgggactggcagaaggaggagaagttagccgacgtcaagtgttccaatgaagcagtgttcgctgccgatttccacccgactgacactaacatcattgtcacctgcggaaaatcccacttgtatttttggaccctggagggctcatcactgaataagaagcagggtctgttcgaaaagcaagagaagcccaaattcgtcctgtgtgttaccttttccgaaaatggcgacaccatcactggtgactcgtctggaaacatactggtgtggggcaaaggaaccaatcggatctcatatgctgtccagggagcccatgagggcggaatcttcgcactgtgtatgctgagggacgggacacttgtgtctggaggaggcaaagatagaaagcttatcagctggagcggcaactaccagaagttacgtaagactgagatccctgaacagttcgggccaatccggacagtggctgagggcaagggtgacgtaatcctgatcgggaccacacgaaatttcgtcctgcagggcacactatccggcgactttacacctatcactcagggccataccgatgagctctggggtttggccatccatgcttctaagtctcagttcctcacttgtggacacgataaacatgccacgctgtgggacgcagttggccatcggcctgtttgggacaagattattgaggacccggcccagagcagtggcttccacccatccggaagcgttgtggcggttggaacccttaccggcaggtggttcgtattcgacacagagaccaaggatctggtgacagtgcacactgacggaaacgagcagcttagtgtgatgagatattcacccgacgggaacttcctggcaatagggtcccatgataactgtatctatatctatggtgtgagcgacaatgggagaaaatatacccgggtgggtaaatgcagcgggcactcctcattcatcactcacttggattggagcgtgaactctcagtttttagttagcaactcaggcgactatgagattctatattgggtgccttctgcttgtaagcaggttgtctctgtcgagaccacgagggacatcgaatgggcaacctatacttgtaccctgggcttccacgtgtttggtgtgtggccggaggggagcgatggcactgatataaacgcggtgtgcagggcacatgagaaaaaactgttatctaccggagatgattttggcaaggtccatcttttctcctacccatgctcccagttccgagccccttcacacatatacggaggccactcaagccacgtcactaatgtcgatttcctgtgtgaggactctcatctgatctccacaggtggtaaggatacatcaatcatgcagtggcgagttatatag

SEQ ID NO: 186251 - DNA, 2505 bp, Artificial Sequence
  Description of Artificial Sequence: Synthetic coding sequence
atggaggacggcttcagcagctacagcagcctgtacgacaccagctccttattacaattttgcaacgatgactccgctagcgccgcatcatctatggaagtcacagacagaatcgctagtctagagcaaagggtgcaaatgcaggaagatgatatccaacttctgaagtctgcactggctgacgttgttagacgcctgaacataacagaggagcagcaggcagtgctgaatcgtaaaggccctacaaaggctcggcccctgatgcagactctccctcttaggaccactgtcaacaacggaacggtcctgcctaaaaagcctaccgggagcctccctagcccttctggtgttcgcaaggagacagctgtgccggccactaaaagactcaacagaagcgtttccctcttgaatgcttgcaagctgaacagaagtacaccgtcaaatatcaaacgtacctccagctccgagcgagtaagcccaggcggacgccgtgaaagcaacggggactctaggggaaacagaaatagaaccggatcaacatccagctcctcttcaggaaaaaagaacagcgagagtaaaccaaaagagcccgtgttcagcgccgaggagggctatgttaagatgttcctacgcggacggccggtgaccatgtatatgcccaaagaccaggtggatagctactcactggaggctaaagtagaactgccgaccaagcgcctcaaactggaatgggtatacggctatcggggtagggactgtagaaacaacctatatctacttccaacaggggaaacagtgtattttatcgcctccgtagtagtgctatataacgtggaggagcaactgcagaggcactatgctgggcataatgacgacgtcaagtgcctggctgtccaccctgacagaattacaatcgctacaggccaggtcgccggcacgtctaaggacggaaagcaactgcctccacatgtgcggatttgggattctgtaacactcaatacgctgcacgtcatcgggattggcttctttgatagagcggtgacctgtatcgcattctcaaagagtaatggcgggacaaatttatgcgcagtcgacgattcaaatgatcatgttctctctgtctgggactggcagaaggaagagaagctcgccgatgtgaaatgttccaacgaggcggtatttgcagcagactttcacccaactgacaccaacatcatcgtcacttgtggaaagtcacatctgtatttctggacattagagggcagctccttgaataagaaacagggcttgttcgagaagcaggagaaacccaagttcgttctgtgtgtcaccttttccgagaatggcgatactattaccggcgactctagcggtaacatcctggtctgggggaaaggcactaatcgaatctcttatgccgtccagggagcgcatgagggtggcatctttgcactctgcatgctgcgggacggcactctcgtttcagggggaggtaaggacagaaaactaatctcctggtcaggtaactatcaaaagttgagaaagacggagatcccggagcagtttggaccaatccgcacggtggctgagggaaaaggcgacgtgattctcattggaaccaccagaaatttcgttctacaggggactctgtctggtgattttacaccaattacacagggtcatacagatgagctttgggggctcgccatccatgcaagcaagtcacaatttctgacttgtggccatgataaacacgctactctatgggacgcagtggggcaccgcccggtgtgggataagatcatcgaagatccagctcagagcagtggtttccaccctagtggatctgtagttgctgtggggacattgacaggacgctggttcgtgtttgacacggagaccaaagacttggtgacggttcacacggatgggaacgagcagctctccgtcatgcgatattcacctgacggaaacttcctggcgatcggctctcacgacaactgcatctatatttacggggtctctgataacggccggaaatatacacgggtcgggaagtgctcaggacattcatcctttatcacccacctcgactggagcgttaacagccagttcctcgtgtccaattccggcgactacgaaatcctctattgggtccctagcgcctgtaaacaagttgtcagtgtggagacaactcgagatatagaatgggctacctatacatgtacgctgggcttccatgtgttcggcgtttggcccgagggcagcgatggaactgatatcaatgccgtgtgtcgtgcacacgagaagaaattgctcagcactggcgatgacttcggtaaggtgcacctcttctcctatccatgctcccagtttcgcgcaccctctcacatctacggaggacactctagccacgtgacaaatgtcgattttctatgtgaagatagccacctgataagcactggcggaaaagataccagcatcatgcaatggcgagtcatctag

SEQ ID NO: 186252 - DNA, 2505 bp, Artificial Sequence
  Description of Artificial Sequence: Synthetic coding sequence
atggaggacggcttcagcagctacagcagcctgtacgacaccagctcactcctccagttttgcaatgacgacagcgcaagcgccgcctctagcatggaggtcactgacaggattgcgagcctcgagcagagagtgcagatgcaggaggatgacattcaactgttgaaatctgcgcttgccgacgtggtacgccgtctgaatattacagaagagcagcaggcagtactgaaccgaaaggggcccaccaaagcacgaccactcatgcagacccttccactccggacaaccgtgaataatggaacagtgctcccgaaaaagcccactgggtcgttgcccagtccatcaggcgtcaggaaggagacagcagtgccagccaccaagaggttgaacaggtctgtctcgctgctgaatgcttgtaaactgaatcggtctactccatccaatataaaaagaacaagcagttctgaacgtgtaagcccggggggtcggagggagagcaatggtgattcccggggcaaccgtaacagaaccggctctacgagctcaagctcatcaggcaagaaaaactccgagtccaaacccaaggaaccggtcttctcagcagaggaagggtatgtcaagatgtttttgaggggtaggccagtgactatgtacatgccaaaggaccaggtagactcgtattccctggaggctaaggtggagctgcctacgaagcgtctcaagctagagtgggtttacggatacagaggtagagactgtaggaacaacctatacctcctgcccacgggcgagactgtctatttcatcgcaagcgtggtcgtgctgtacaacgtcgaggagcagctgcagcgacattatgccggtcataatgacgacgtgaaatgcctggcggttcacccggaccgcattacgatcgcaacaggccaagtggctggcacctctaaagacggcaaacaacttcccccccacgtgaggatctgggactccgtgactctaaacacccttcatgtgatcggtatagggtttttcgaccgcgccgtgacctgtatcgcttttagcaagtctaacggtggaaccaacctgtgcgccgtcgacgactctaatgatcatgtactcagtgtttgggattggcagaaagaagagaagttagccgatgttaaatgtagcaacgaagcagtgttcgccgcagatttccatccaactgacacaaacatcatagtcacttgcggaaagagtcacctgtacttttggacattggaaggtagctctcttaataagaagcaggggctgttcgagaagcaggagaagcccaaatttgtgctttgcgtgacgttcagtgaaaacggagacacgataacaggtgactcctccggcaacatacttgtgtggggaaaggggaccaatcgcattagttacgcagtgcagggcgctcacgagggcggcatctttgctctgtgtatgttgagagacgggaccctggtatctggcggcgggaaagatcgtaaactgatcagctggtctggaaattaccagaagctgagaaagacggagattcctgaacagtttggccctatccgaacagttgcagagggtaagggcgacgtcatcttgatcggcactacacggaactttgttctgcaggggacgctgagtggggatttcaccccaattacccagggccacacagatgagctgtgggggttggccatccatgcttctaagagccaatttctcacatgcggccatgacaaacacgctacactgtgggacgctgtgggacatcgtccagtctgggacaaaatcatcgaggatcctgctcaatcatccggtttccaccctagcgggtcagtggtcgccgtgggcacacttaccggtagatggtttgttttcgacacggaaactaaggatctggtcacagtgcatactgacggaaacgagcagctgagcgttatgagatatagcccagatgggaatttcctggcgattggctcccacgataactgcatctacatatacggcgtgtctgataacgggcgcaagtacacacgggtaggaaagtgctctgggcactcttcttttattacacacctggactggagcgtcaattcccagttcctggtgtcgaactctggggactacgaaatcctctattgggtgccgtcagcttgcaagcaggttgtgtcggtagagacaacgcgcgatattgagtgggctacctacacgtgcacgctgggattccatgtttttggcgtctggcctgaaggctcagacggaactgatatcaacgcagtttgccgagcccacgagaaaaagttactgagtacgggcgacgattttggcaaagtacatctgttttcttacccgtgttctcagtttagagctccttcccatatctatggcggacactcctcacatgtgaccaacgttgattttctgtgtgaagacagccacttgatttccacgggaggaaaggataccagcatcatgcagtggcgagtaatttag

SEQ ID NO: 186253 - DNA, 2946 bp, Artificial Sequence
  Description of Artificial Sequence: Synthetic coding sequence
atggacggcttcgccggcagcctggacgacagcatcagcgccgccagcactagtgacgttcaagaccgtctttccgcactagagtccagagtacagcagcaggaggatgaaataactgtcctgaaggctgcactagctgatgtgctcaggaggctggccatttcggaagaccacgtagcatccgtgaaaaagtcggtaagttcgaagggccagccttcacccagggctgtgattcccatgagctgtataacgaatggctccggcgccaatcgcaagccctctcataccagcgctgtgtcgattgctggaaaggaaaccctcagttccgcagctaaatccggcacagaaaagaagaaggaaaaaccgcagggacaacgggaaaaaaaggaagaatcccacagcaatgaccagtcaccacagataagagcatcaccttcacctcagccctctagccagccgctgcaaattcaccgccaaactcccgagtccaagaacgctacacccactaagtctatcaaacggccatctcccgctgagaagtctcacaattcatgggagaactcagatgattcccgtaacaaactctctaagattccatccactcctaagcttatccccaaggtcacaaaaaccgccgacaagcataaagacgtgatcattaaccaggagggcgaatacatcaaaatgtttatgagaggccgtcccattactatgttcatccccagcgacgtggacaactacgatgacattcgtacagaacttccaccagaaaagctgaaactggagtgggcctacggttaccgggggaaggattgtcgtgccaatgtatatctgctgcctaccgggaagatcgtgtattttatcgctagcgtggtggtcctgttcaattacgaagagaggacacagaggcactaccttgggcacacagattgcgtgaaatgcttggccattcaccctgataaaatcagaattgccacaggccagatcgcaggagttgataaggatggacggcctcttcaaccacatgtgagggtctgggacagcgtgactctctcgactctgcagatcatcggtctgggaaccttcgaacgcggagttgggtgtctagatttctctaaggcggattccggcgtgcacctctgtatcatcgacgactctaacgagcatatgctgacggtatgggattggcagaaaaaggccaagggggcagagatcaaaacaacaaacgaggtggtcttagctgtggagtttcacccaaccgacgccaacactatcataacttgtggcaagtctcacatcttcttttggacatggagtggcaattcactcacccggaaacagggaatcttcggaaagtatgaaaaacccaagttcgtccagtgtctcgcctttttaggcaacggtgatgtgctaacgggagattccggcggtgtgatgctaatttggtcaaaaaccactgttgagcccacgccgggtaaaggacccaagggggtctatcagatctcaaaacagatcaaggcccatgatggttccgtgtttacattgtgtcagatgcgcaacggaatgctgcttaccggcggcgggaaggatagaaagatcattctgtgggatcatgatttgaatccagagagggaaatagaggtgccagatcaatatggcaccatccgagccgtcgccgaggggaaagctgatcagtttctggttggcacgagtcgtaacttcattttacgaggaacattcaatgatgggtttcagattgaagtgcagggtcacacagacgaattatggggactggccacccacccatttaaggacttactgcttacctgtgcccaggacagacaggtttgtctgtggaacagtatggaacatcggctggagtggactagacttgttgatgaaccggggcactgcgccgatttccacccctcaggcactgttgtggcgatcggcactcatagtgggcggtggttcgtgttagatgccgagaccagggacctcgtgtccatacacacagacgggaatgagcagctttctgttatgaggtactctattgacggtacatttctcgctgtgggatctcatgataatttcatctatctctatgtcgtttccgaaaatggccggaaatactcacgatacggccggtgcaccggacatagctcctacataactcatctggactggagccccgataataaatacattatgtctaacagcggagactacgagattctgtattgggacattccaaacggatgtaagctcattagaaacaggtctgattgcaaggacatagactggacaacctacacatgtgtgcttgggttccaggtctttggggtctggccagaggggagcgacggcacggatatcaacgcgctagtgcggtcccataatcgcaaggttatagccgtagctgacgatttttgcaaagttcatctatttcagtatccttgctcgaaggccaaagctccatctcataagtacagcgcccacagttcccatgtgacaaatgtctcttttactcataatgacagtcacctgatcagcacagggggcaaggatatgtctataattcagtggaagctggtggaaaaactctctcttccacagaacgagacggtcgctgataccacattaacaaaggctcctgtctcaagcactgaaagcgtgattcagtcaaataccccaacgccaccgccatcccagcccttgaacgagacagccgaggaggaaagtaggatttcgagctccccaacactattagaaaacagtctagagcagacagtagagccaagcgaggatcactctgaggaggaatctgaggaggggtccggggacctgggcgagcccctctatgaggagccttgcaatgagatttccaaggagcaggcgaaggccaccctgttggaggaccagcaggatccctctcctagttcttag

SEQ ID NO: 186254 - DNA, 738 bp, Artificial Sequence
  Description of Artificial Sequence: Synthetic coding sequence
atgagcaacagcggcgactacgagatcctgtactgggacatccccaatggttgcaagttgattcgcaatcgatctgactgtaaagatattgactggaccacttacacatgcgtgcttggatttcaggtgtttggagtttggcccgagggctcagacggcaccgatattaacgccctagttcggtctcacaaccggaaggtgatcgccgtggctgacgacttctgtaaggtgcacctcttccagtacccatgctccaaggctaaagcccccagtcacaagtattcagcccactcaagccatgtcacaaatgtctctttcacacacaacgattctcaccttataagcaccggcggaaaggacatgagcattattcagtggaagctggtggaaaaactgtcgttgccacaaaacgaaactgtcgcagacacaaccctgaccaaggcaccggtcagctccactgaatccgtgatccagtccaacactccaacaccaccccctagccagcctttgaatgaaaccgcagaggaagagagccggatctccagtagccctactcttctcgaaaattcactcgaacagacagtcgaacctagcgaagatcattcagaagaagagagtgaggagggcagcggcgacctcggagaacccctctacgaagagccctgcaatgaaatttcaaaggagcaagcgaaggcaaccctccttgaggaccagcaggatccctccccttcctcatag

SEQ ID NO: 186255 - DNA, 2772 bp, Artificial Sequence
  Description of Artificial Sequence: Synthetic coding sequence
atggacggcttcgccggcagcctggacgacagcatcagcgccgcctcaacatcagatgtgcaggatcgccttagcgccctggagagccgagtgcagcaacaagaagatgagattactgtgctaaaggctgccttggctgacgtgcttaggcgacttgctattagcgaggaccatgttgcgtctgtgaaaaagagtgtgtcttcaaaaggacagccaagcccacgagccgttattcccatgagttgcattacaaacggcagcggagcaaacaggaagccttcgcatacgtccgcagtgtctatcgccgggaaagaaactttgtcatccgctgcaaaatcaattaagaggcctagccctgcagagaaatcacacaacagctgggagaacagtgatgactctcggaacaagttaagcaagattccatctactccaaaactaattcccaaagttaccaaaacggccgacaaacataaagacgtgatcatcaatcaagagggcgagtacatcaagatgttcatgcgagggcgcccaatcacgatgttcatcccaagtgatgtagacaactacgatgacatccgcactgagctccccccggagaagctgaaattggagtgggcttacggataccgggggaaggactgcagggccaatgtgtacctgttgccaactgggaaaattgtgtactttattgcatcggttgtagtcctgttcaactacgaagaaagaactcagcgtcattacttgggccatactgactgcgtgaaatgccttgctattcaccccgataaaatcagaatcgcgacaggacaaatcgcaggggtggataaagacggaagacctctgcagcctcatgtccgagtgtgggattccgtaacattgtcaaccctccagatcattggcctgggcacattcgagcgcggggtgggatgcctggacttttccaaagcagatagcggagtgcacctgtgcatcattgatgatagtaacgagcatatgctcacagtatgggactggcagaaaaaagccaaaggcgccgaaatcaagactaccaacgaagtggtgttagcagtagagttccatcccactgatgccaatactataatcacctgtggtaagagccatatcttcttctggacatggagcggtaattcactgacacggaaacaaggtatctttggtaaatatgagaagccaaaattcgtgcagtgcctggcctttctgggtaatggagacgtcctaacgggggacagtggcggcgtgatgttgatctggagtaaaacaacggtcgagccaaccccgggaaaaggtccgaaaggcgtctatcagatcagcaagcaaattaaagctcacgatgggagtgtgttcacactgtgccagatgcggaacgggatgcttctgaccggtggcggcaaagacaggaagatcattctgtgggatcatgatctgaatccagagcgggaaatcgaagttcctgaccagtatggtaccattcgtgcagtcgcagaggggaaagcagaccagttcctggtgggaacctcgagaaactttatcttgcgcggaaccttcaatgatggcttccagatcgaggtgcagggccacactgacgaactttggggcctcgctacacacccatttaaagatttgctgctgacttgcgcccaggacaggcaggtttgtctgtggaacagtatggagcacagactcgaatggaccaggctggtcgatgagcccggacattgcgcagactttcatccatccgggacagtggtagccattggcacccactccggcaggtggtttgtgttggacgccgaaaccagagatttggtgtccatccacacggacggaaatgaacagcttagtgtcatgaggtacagcatcgacggtacattcctagctgtgggtagtcatgacaacttcatctatctgtacgtggtgtccgagaacgggcggaagtactcacggtatggcaggtgtactggccattcctcatacatcactcacctggactggtcccctgacaacaaatacattatgtcaaactctggagactacgagatcctgtattgggatatccccaacgggtgcaagctcatcagaaaccgatcagattgcaaagatattgattggactacctacacctgtgtcctggggttccaggtgtttggcgtatggccagaagggtctgatggaaccgacataaacgcactggttcgcagtcacaatcgtaaagtgatagcggttgcggatgacttctgcaaggtgcatctgttccagtacccatgctccaaggccaaggccccttcgcataagtactcagctcatagtagccacgtgacaaacgtctcatttacacacaatgattctcacttgattagcacgggaggtaaagatatgagcatcattcagtggaagttagtcgagaagctgtcccttcctcagaacgagaccgtggcagatacgaccctgaccaaggcacccgtgagctccacagagtccgtgatccagagtaatacccccacgccgcctccatctcaaccactgaatgaaactgctgaagaggagtcgaggatcagctcttccccgacgctcctcgagaattcactggaacagaccgtggaaccatccgaggatcactctgaggaggagagtgaagaagggtccggtgacctgggcgaaccactgtatgaggagccgtgcaacgaaatcagcaaagagcaggctaaagctaccctgctggaagaccaacaggatcctagcccatctagttag

SEQ ID NO: 186256 - DNA, 780 bp, Artificial Sequence
  Description of Artificial Sequence: Synthetic coding sequence
atgctgctgcggagctggttcggcaacaaggacttccaggccctgccaatcctagctaggctgccatctatgccaaccgatatggagcatacgggacactacttgcatctcgctttcctgatgactactgtattctccttatcaccaggcaccaaagcaaactacactcgcttatgggctaattccaccagcagttgggatagcgtgatacagaataagaccggacggaatcaaaacgagaacattaacacaaaccccatcactcccgaagtcgattacaaaggtaactcaacaaacatgccggaaaccagccacatcgtggccctgacaagcaagtcagaacaagaactgtatatccccagtgtggtgtccaattcaccatctaccgtgcagagtattgagaacacatccaagagtcacggggagatctttaaaaaagacgtttgcgctgagaataacaataatatggccatgctgatttgcctgatcatcattgccgtactgttcctgatttgtactttcctcttcttgtctactgtggtcctggccaataaggtgagttcactgagacgcagtaaacaagtgggtaagcgacagccacgatccaacggagatttcctggcctccgggctctggccagctgagtctgacacgtggaagaggaccaagcagctgacagggcccaatctggtgatgcagagcacaggcgtactgacggcgaccagagagagaaaggacgaggaaggaacggagaagctaacaaacaaacagattgggtag

SEQ ID NO: 186257 - DNA, 711 bp, Artificial Sequence
  Description of Artificial Sequence: Synthetic coding sequence
atgcccaccgacatggagcacaccggccactacctgcacctggcctttctgatgaccacggtgttttcactgtcgcccggcactaaggccaactacacgaggctgtgggctaactccacatcctcgtgggactccgtgattcagaacaaaaccgggcgcaaccaaaatgagaacatcaacactaatcctatcacgccggaagtcgactataaaggaaatagcaccaacatgccagagacctcacatattgtggccttgacgtccaaaagcgagcaggagctgtacatcccctctgttgttagcaattctccaagcactgtacagtcaattgaaaacaccagcaaatcccatggcgaaatcttcaagaaggatgtttgcgccgagaacaacaataatatggcgatgctgatttgtctgattatcatcgctgtgctgtttctaatctgcacattcctttttctgtcgacagttgtgctggccaataaggtctctagccttagaagatctaaacaggttggaaagcgtcaaccacgctcgaatggggatttcctagctagcggactctggcctgctgagtcagacacgtggaaaagaaccaagcagcttaccggacctaaccttgtcatgcaatccaccggggttctcacagccacccgcgagcggaaagatgaggaaggcacagagaaactgacaaataaacaaatcgggtag

SEQ ID NO: 186258 - DNA, 711 bp, Artificial Sequence
  Description of Artificial Sequence: Synthetic coding sequence
atgcccaccgacatggagcacaccggccactacctgcacctggccttcctcatgaccaccgtgttcagtctgagccctgggactaaggcaaactacaccagactatgggccaacagtacaagtagctgggactcagtgatacagaataaaactggtaggaatcagaatgaaaacatcaatactaatcctattactcctgaggtggactataagggtaactctacgaatatgccggagaccagtcatattgtcgctctcacctctaagtccgagcaggaactgtatattccctctgttgtgtccaactccccatcaacagtacagtccatcgaaaacacaagcaaatcacacggcgaaattttcaagaaagatgtctgtgccgaaaataacaataacatggcaatgctgatctgcctcatcataattgccgtccttttcctgatttgcacattcctatttctcagcaccgtagtgcttgcgaacaaggtttcatcgctgcgtagaagtaaacaggtcggtaagagacagcctcggagtaatggggacttcctagcaagcggactgtggcctgctgaatccgacacgtggaagcgaaccaagcagctgacaggccccaacctggtgatgcagtctactggcgtcctgactgcaactcgggaaagaaaagacgaagagggcactgagaaattgaccaataaacagattggctag

SEQ ID NO: 186259 - DNA, 699 bp, Artificial Sequence
  Description of Artificial Sequence: Synthetic coding sequence
atggagcacaccggccactacctgcacctggccttcctgatgaccacggttttcagcttgtcaccaggcaccaaggccaattatactagactttgggcgaattctactagttcttgggactcagtgatccagaataagactggtagaaatcagaacgagaacatcaatacaaatcccatcacacccgaagtcgactacaaaggcaacagcaccaatatgccagagacttcccacatcgtcgcattgacttcaaagtctgaacaggaactttacatcccgagcgtcgtttcgaatagtccctctactgtgcagtcaatcgaaaatacatccaagtcacatggcgagatctttaaaaaggacgtatgcgccgaaaataacaacaacatggccatgttgatctgcctcatcatcatcgccgtgctcttccttatctgcaccttcctcttccttagcacagtggtcctagcaaataaagtctccagtcttcgtcgctcaaagcaggttggtaaaaggcaaccgcgcagtaatggcgatttcctggcgtcaggcttatggcctgcggaaagtgacacttggaaaagaactaagcaactgacgggacccaatctcgtcatgcaaagcaccggggttctcacggcaacacgggagcggaaggacgaggaaggtacagagaaactcactaataagcagatagggtag

SEQ ID NO: 186260 - DNA, 1347 bp, Artificial Sequence
  Description of Artificial Sequence: Synthetic coding sequence
atggaccccaagtacttcatcctgatcctgttctgcggccacctgaacaatactttcttctctaaaaccgagaccatcacaaccgaaaaacagagccaacctaccctgttcaccagctcaatgtcccaggttctggcaaattcccagaataccaccggtaatcctctggggcagccgactcagttcagcgacaccttctcaggccaatcgatctcccccgctaaagtcacagcaggccaaccaacacctgcagtttataccagcagcgaaaaacccgaggcacacacgtccgctgggcagccgctcgcctataatactaagcagccaacacccatcgccaatacctccagccagcaggccgtgtttacgtccgcccgccagcttccgtctgctcggaccagtactacccaacctccaaaaagttttgtctacacatttacccagcagtcatcttcagtccaaatcccaagcagaaaacagattacggtgcataatcctagcactcagcccaccagcaccgtaaaaaattctcctaggagcactccaggctttattctggatactaccagtaacaaacagactccacagaaaaataattataactcgattgccgccatcttaatcggagtcctgctgaccagtatgcttgtcgcgattatcatcatcgtgttatggaagtgcctcaggaagcctgtgctcaatgaccagaattgggcaggcaggtctccgttcgctgacggggagacccctgatatctgcatggacaacattcgtgagaatgaaatcagcacgaagagaacatccataatctctctgactccatggaagccatctaaatcaacccttctggcggatgatctcgaaattaagctcttcgaatcttccgaaaacatagaggactctaacaacccaaagaccgaaaagatcaaggatcaggtaaatggtacttcagaggacagtgctgacggttccaccgtcggtactgctgtaagtagttctgacgacgcggatctgcctcctcccccccccctcttagaccttgagggccaggaatcaaatcagtcagataaacccacgatgacaatcgtatcaccgcttcctaatgactctactagcctgcctcccagtctcgactgcttgaaccaggattgtggagaccataaaagcgaaatcatacaatccttcccaccacttgatagccttaacctgcccttacctccagtggattttatgaaaaaccaagaagactcaaacttggagattcaatgccaggagttctccatcccacctaattccgaccaggacttgaacgaatctctgccacctcccccagccgagctcctctag

SEQ ID NO: 186261 - DNA, 1392 bp, Artificial Sequence
  Description of Artificial Sequence: Synthetic coding sequence
atgctgttccggtacgccgagaagatcacccggaagtacagcgagatggatcccaaatatttcattctcattcttttctgtggccacttaaacaacaccttcttcagtaagaccgagaccatcactactgaaaagcagtcccaacccaccctgttcaccagcagtatgagccaggtcctcgctaactcacaaaataccacaggaaaccctctgggccagccgacccaattttccgacacattttccgggcaaagcattagcccggccaaagtaaccgccggtcaacctactcccgccgtctacaccagctctgaaaaacccgaggctcatacttccgcaggacagccccttgcatataataccaagcagcctacacccatcgctaatacatcaagccagcaggcagttttcacatccgctcgccaactccctagcgcccgtactagcaccacccagccgccaaagtcctttgtttacactttcacgcagcagtcctcctcggtgcaaattccttcaaggaaacagattactgtgcataaccccagcacccagcctaccagtacagttaagaattcgccaagatcaacacccggatttatactcgatactactagtaataagcagacccctcagaagaacaattacaacagcattgcagctattctaatcggagtgctgctcacttcaatgttggtcgctatcataattattgtgctgtggaaatgcctcaggaagcccgtgctaaacgatcagaattgggccggaagatccccattcgccgatggcgaaacccctgatatatgtatggataacattagagaaaatgaaattagcacaaaaagaacaagcatcatatcactgacgccctggaaaccctccaagtccacgctcctcgcggatgacctcgaaatcaagctgtttgagtcgagcgagaatatagaagatagcaataatcccaaaacggaaaaaattaaagaccaggtgaacggtacatcagaagattcagcggatggatcgaccgtaggcaccgccgtctccagcagtgatgacgccgacttgccaccaccaccacccctactggacttagaggggcaggagtctaaccagtctgacaagccaactatgaccatcgtgtctccactgcccaatgatagcacatcactccctccgagcttagattgccttaaccaggattgtggcgaccataagtccgaaatcattcaaagtttcccgcccctcgactccctaaatttacccctccccccagtagatttcatgaagaaccaggaagatagcaatcttgagatccagtgccaggagttttcaatcccacccaacagtgatcaggatctgaatgagagtttgccaccaccaccggccgagctactttag

SEQ ID NO: 186262 - DNA, 924 bp, Artificial Sequence
  Description of Artificial Sequence: Synthetic coding sequence
atgaaccaggccgagctgatgcagctggacatggagggcatgctgcagcatttccagaaggtgatcccccaccagtttgacggggttcctgataaactgattcaagccgcataccaggtgaaatataatagcaagaagatgaagaagttggagaaggagtatacaaccataaaaaccaaagaaatggaagagcaagtcgagatcaaaaggctccgcaccgaaaataggttgctcaagcagagaatcgagacactggaaaaagagtccgccagcttagcagatcgtctgatccagggccaagtaacacgtgctcaggaagcggaggagaattacctgatcaaacgggagttggcgaccattaagcaacaatctgacgaggctagtgccaagcttgagcaggccgagaataccatacgcaagctccagcaccaacagcaatggcacaaatgctcgtccaactacaatgaggactttgtcttacagcttgaaaaggaactcgtgcaggccaggctgtccgaggcagagtcccagtgtgcccttaaagaaatgcaggataaagtgctggatattgagaaaagaaataattccttacccgacgagaacaatatagccagattacaagaagagctgatcgcggtcaaacttcgcgaggctgaggcaattatggggctaaaagagcttagacagcaggttaaagatctcgaggagcactggcaacgacacctcgcacgcaccaccgggcggtggaaggaccccccaaaaaaaaacgccatgaatgagcttcaggatgagctcatgaccattcggctgcgggaggcggaaacacaagcggagatacgcgagatcaaacaacggatgatggaaatggagacacagtcaggcacctgtggccccttactgaagataattttcttcaacgcgtag

SEQ ID NO: 186263 - DNA, 2433 bp, Artificial Sequence
  Description of Artificial Sequence: Synthetic coding sequence
atggtgaccaacaagatgaccgccgccttccggaaccccagcggcaagcaggtcgctacagataaagtagccgaaaaattgagttctacattgtcttgggtgaaaaacaccgtctctcacacagtctcccaaatggctagccaggtcgccagcccctccacctcattgcacaccacctcctcttcaaccacactttctaccccggctctctctccttctagccctagccagctgtcgcccgacgatctcgagctcctggcaaaacttgaagagcagaaccgactgctcgaaactgactccaagagcctgagaagcgtgaacgggtcaaggcggaatagcggctcctctctcgtgagtagcagcagcgccagtagtaacctgtctcatctggaggaggatagctggattttgtggggcaggatagtgaacgaatgggaggacgtgcgcaagaaaaaagagaagcaggtgaaagagttggtacacaaaggaataccccatcacttccgggctatcgtctggcaattactctgctccgcacagtctatgcctatcaaggatcagtactccgaacttctgaaaatgactagcccgtgcgaaaagctaatccggagagatatcgctcgcacctacccggagcacaatttctttaaagaaaaggacagcctggggcaagaagtgctcttcaacgtgatgaaagcctactccctggtggatagggaggtgggatactgccaggggtcagcctttatagtgggactgctgcttatgcagatgccagaggaagaagctttttgtgtgttcgtgaaactcatgcaggactatagattacgcgagctgtttaagccaagcatggcagagctcggtctctgcatgtaccaattcgagtgcatgatccaagagcatctgccagaattattcgtgcactttcaaagccagtccttccacacgagcatgtacgccagtagctggttcctcactatattcctgacaacatttcccctgccaatcgccacacggatctttgatatctttatgtccgagggtctcgagattgtgttcagggtcgggttagctctactgcaaatgaaccaggctgaactcatgcaattagatatggagggcatgctgcagcacttccaaaaggtgatcccacaccagttcgacggagttcccgataaactcatccaagcggcctatcaggtgaaatataattccaaaaagatgaagaaattggagaaagagtacacaaccataaaaacaaaggaaatggaagagcaagtcgaaattaagaggctgagaactgaaaatagactgctcaaacaacggatagaaactctggagaaacataagtgctctagcaattataacgaggacttcgtgctccaactcgaaaaagaactggttcaggcccggctatccgaggcagagtcacaatgcgccttgaaagaaatgcaagataaggtgctggacatcgaaaagagaaataatagcctgcctgatgaaaacaacatcgctagactgcaagaagaactcattgccgttaagcttagggaggccgaagctattatgggattgaaggagttgagacagcaagtcaaagacttggaggaacactggcagcggcatcttgctcgtaccaccggccggtggaaagatccacctaagaagaacgccatgaatgaactgcaggatgaactcatgacgattagactgcgggaagccgagacacaggcagaaattagagagatcaagcagaggatgatggagatggagacgcagaatcaaattaattcaaatcacctacgccgcgccgagcaagaagtgatatccctgcaggagaaggtgcaatacctcagcgcacagaataaggggcttctgacacagctgagtgaggccaagcggaaacaagccgagattgagtgtaaaaataaagaggaagtgatggcggtgcgactccgggaagccgacagcattgcggccgtagcagaactgaggcaacatatcgccgaactggaaatccaaaaagaagaaggtaagctgcagggtcaactgaataagtcagattctaatcaatacataggggagctgaaagaccagatcgctgagctgaatcacgaacttagatgtctaaaggggcagagaggcttttcaggccagccaccttttgacgggatccacatcgttaaccacctgatcggagacgacgaatcattccactccagcgacgaggacttcattgataactccctgcaagaaacgggcgtgggattcccgctacacggcaagtccggatcaatgtcactcgatcccgctgtggcagatggctccgaaagtgagactgaagacagcgttctggagacgcgggagtcaaaccaggtggtgcaaaaggagagaccaccaaggaggcgggagtcatattcaacaaccgtctag

SEQ ID NO: 186264 - DNA, 2433 bp, Artificial Sequence
  Description of Artificial Sequence: Synthetic coding sequence
atggtgaccaacaagatgaccgccgccttccggaaccccagcggcaagcaggtggccactgacaaagttgcggaaaaactctcttcaactctctcatgggtcaaaaacaccgtatctcacactgtcagtcagatggcttcacaggtggcaagtcccagtacttccctccatactacgtctagttccaccactctatcaactccggccctgagcccatctagccctagtcagctcagcccagacgacctggagctgctcgctaagttagaagagcagaatcgcttactcgagacagatagcaaatccttgagaagtgttaacggctccaggcgcaatagcggaagctctctggtgagctcctccagtgcctcaagcaacctctcgcatttagaggaagactcttggatcctctggggcaggatcgtcaacgaatgggaggatgttaggaagaagaaagagaaacaggtcaaagagttggtgcacaaagggattccacaccacttccgcgccattgtgtggcaactgctgtgctcagcacagtctatgccaattaaggaccaatacagcgagctacttaagatgacatccccctgcgaaaagctgataagaagggacatcgcccgcacataccctgaacacaatttttttaaggagaaagatagcctcgggcaggaggtgctgtttaacgttatgaaagcctacagcctggtcgaccgagaagtgggatattgtcaggggagcgcttttatagtcggactgcttctcatgcagatgccggaggaggaggcgttctgtgtgtttgtgaaactgatgcaggattacaggctgagggaattgtttaagccaagtatggccgagcttggtctctgtatgtaccagtttgagtgtatgattcaggagcatctgccagaattgtttgtccatttccaatcccagtcatttcacactagcatgtacgcttcctcatggttcctcactatatttcttactacctttcccttgccaatcgcaacacgaattttcgacatctttatgagtgaaggactcgaaattgttttcagggtgggccttgccctgctccagatgaatcaggcagagctgatgcagctcgacatggaagggatgctccaacacttccagaaagtcatacctcaccaatttgacggagtgcctgataagctgattcaagccgcttaccaggtcaagtacaacagtaagaagatgaaaaagctagagaaagaatatacaaccataaagacaaaggagatggaagaacaagttgaaatcaaacgcctgcgcaccgaaaacagactgttgaagcagcgcatagagaccttggagaaacataaatgcagttctaattataacgaggattttgtcctccaactggagaaagagctcgtacaggctcggttatctgaagctgagtcccagtgcgcactcaaagaaatgcaggataaagtccttgacatagaaaaacggaataactcgctgcctgacgagaataatattgcccgcctgcaagaggaattaattgccgttaaactgagggaggccgaagctatcatgggcttaaaagagctgcggcagcaggttaaggacctcgaggaacactggcagagacaccttgcacgtaccacgggccggtggaaagaccccccaaaaaaaaacgctatgaacgagctgcaggacgagctcatgacgattcgcctacgggaagctgagactcaagccgaaattcgggagattaagcagcgaatgatggaaatggaaacccaaaatcagatcaactcgaaccaccttagaagggccgaacaggaggttattagcttgcaggaaaaggttcagtatctgtccgcccagaataaaggactgctgacccaactgagcgaggccaagcggaagcaagcggaaatagaatgtaagaacaaggaggaggtgatggccgtcaggttgcgggaagcggatagcatcgccgcagtggccgagcttcggcagcacattgcggagctggaaatccagaaggaagaagggaaactgcagggacagctcaacaagagcgacagtaaccagtatatcggtgagttaaaagaccagattgctgagctcaatcatgaattgcggtgcctgaagggccagagaggcttttctggtcagcctccattcgacggcattcacatcgttaatcacctgatcggtgatgacgaatcctttcattcatctgacgaggatttcatcgataattctctgcaggagactggtgttggcttccctctgcacgggaaatctgggagcatgtcactcgatccagctgtggctgacggatcagaaagcgagacagaagatagtgtgctggagactagagaatctaatcaggtggtgcaaaaagagcggcccccccgtcggcgtgagtcctattcaactaccgtttag

SEQ ID NO: 186265 - DNA, 2466 bp, Artificial Sequence
  Description of Artificial Sequence: Synthetic coding sequence
atggtgaccaacaagatgaccgccgccttccggaaccccagcggcaaacaggtggcaaccgataaagtggccgaaaagctgagctctactctgagctgggttaagaacacagttagtcataccgtgagtcagatggccagccaggtcgcatcccccagcactagtctgcacactactagttcctcaactacccttagtactccagcgttaagcccgagcagcccgtcacagctgtccccagacgatttggagcttctcgcaaaactggaggagcagaacagattactcgaaacagactccaaatccctccgcagcgtaaatgggtcacgtagaaactctggatcaagcctggttagtagctcttcagctagtagcaacctgagtcacctcgaggaggacagctggatcctgtgggggaggattgtaaatgaatgggaagatgtgagaaaaaagaaggaaaaacaagtgaaggaactggtacataagggaatccctcaccactttagagccatagtatggcagctactgtgctctgcacagtctatgcccataaaggaccaatactccgagttgctcaaaatgacaagtccatgcgagaaattgatcaggagagatatcgccaggacataccctgagcacaacttctttaaggagaaggacagcttaggccaggaagttttgttcaacgtcatgaaagcgtactcccttgttgatcgcgaagtcggttactgccagggctctgcgtttatcgtgggactgctattaatgcagatgcccgaagaggaggccttttgcgtctttgttaagttgatgcaggactaccggctgcgcgagctgttcaagccctctatggccgagctgggcttgtgtatgtaccagttcgaatgcatgatccaagagcatttgccagagctgttcgttcatttccaaagtcagtcattccacacatccatgtatgcaagttcatggtttttgaccatctttctcactacttttccactgcccattgccacccggattttcgatatctttatgtccgaaggcctggagatagttttcagagtaggcctagccctgttgcaaatgaaccaagcagagctgatgcagctggatatggaggggatgcttcagcacttccagaaggtgatcccgcatcagtttgacggtgtgcccgacaaattaatacaggcggcttaccaggttaaatacaactccaaaaagatgaaaaaattggagaaggaatataccacaattaagaccaaagaaatggaagagcaggttgagatcaagagactgagaactgaaaataggctgctgaagcagcgcatagaaacactggaaaaggaatcggcgtccctggctgatcgattgatccagcataaatgttctagcaattataacgaggactttgtgctgcagctagaaaaagaactcgtgcaggcacgcctgtctgaagccgaaagtcagtgcgcgttgaaagaaatgcaggataaggtgctggacatcgagaagcgcaataactccctccctgacgagaataatattgccaggttgcaagaagagcttattgccgtgaaactgcgcgaggctgaggccattatggggcttaaggagctgcgacagcaggttaaggacctcgaggagcattggcagagacatctggcgaggacgaccggaaggtggaaggacccccccaagaaaaatgccatgaatgagctgcaggatgagctaatgaccatccggctgcgtgaagcagaaacccaggccgagatcagggagattaagcaacgaatgatggagatggaaacacagaaccaaatcaactctaaccacctgcgcagagcggaacaggaagtaatttccctgcaggagaaggtgcagtacctgtccgcccagaataagggtttgttaacccaactgtcggaagcgaagcgtaaacaggctgagatagagtgtaaaaacaaggaggaagtcatggcggtccggctgcgtgaggccgatagcatcgccgctgtggctgaattgagacagcacatcgccgaattagaaatccaaaaagaggagggcaagctgcaaggacaattgaataagtccgactctaaccagtacatcggtgaactgaaagaccagattgcagaattgaaccatgagctacgctgcctgaagggacagcgaggtttttccgggcagccgccgttcgatgggatacatatagtgaatcacctgataggcgatgatgaatcattccatagctccgacgaagacttcattgataactccctccaggagactggcgtaggttttccccttcatggtaagagtgggtctatgtcactggaccctgctgtggccgacggcagcgagtcagagactgaagactccgtgctggagaccagagaaagcaatcaggtggttcagaaggaaagaccgcctaggcgccgggagagctatagcacaacagtatag

SEQ ID NO: 186266 - DNA, 891 bp, Artificial Sequence
  Description of Artificial Sequence: Synthetic coding sequence
atgagctgggtgcaggccaccctgctggcccggggcctgtgccgggcctgggggggcacctgcggagctgctctgaccggcacttctatttcgcaagtgcctcgccggctgccacgcggcttgcactgtagtgcggcagcccactccagcgagcagtccttggtccccagccctcccgaaccacggcagcggcctacaaaggcattggttcccttcgaagatctcttcggccaggcacccgggggagaaagggacaaggccagcttcctacagacagttcaaaagtttgccgagcactctgttagaaagcggggtcacattgacttcatttacctggctctgcggaagatgagagaatatggtgtcgaaagggaccttgctgtgtataatcagctcttgaacatctttcctaaggaggtgtttcggccacggaatattatacaaagaatcttcgttcactacccgcgccaacaagaatgtggcatcgcggtgctcgagcagatggaaaatcatggcgtgatgccaaataaagagaccgagttcctgttgatacagattttcggccgcaagagctacccaatgctgaagttggtacgtctgaaactttggttcccacggtttatgaatgtgaatcctttccccgtgcccagagatctgccacaagatcccgtcgagctggccatgttcggacttaggcatatggagcctgatctgagcgcccgggtaacaatatatcaggttcccctcccgaaagactccactggggcagcagaccctccacaacctcacatagtgggatcaggtcgcgacgccggaggagtggagcccctgctgcccgacgccgcagggccaggtgtgtgcgaagagtggctggggcagcttagggtgtag

SEQ ID NO: 186267 - DNA, 1296 bp, Artificial Sequence
  Description of Artificial Sequence: Synthetic coding sequence
atgagctgggtgcaggccaccctgctggcccggggcctgtgccgggcgtggggtggtacctgtggagccgctctgactggcacatccattagccaggtgcccagacggttgcctcgcgggttgcactgctcggctgcagctcactcatctgaacagtctctcgttccaagcccgcccgagccccgccagagaccgaccaaggctcttgtccccttcgaagatctgttcggacaagctccaggaggtgagcgggacaaagcttctttcctgcagaccgtgcagaaattcgcagagcactcagtgagaaagcgtggccacatcgacttcatctatctggcgttaagaaagatgagggagtacggcgttgagagagacctagctgtctataatcaactgttaaatatttttccaaaggaagtcttccggcctagaaacataatccagcggatcttcgttcattatcctagacaacaggagtgtggaatcgccgtgctggaacaaatggaaaaccacggggttatgcctaacaaagaaacagaattcctgttgatccagatctttggacgtaagagctatcccatgctcaaactggtcaggctaaagttatggtttccaagattcatgaatgtgaacccatttccagtaccacgggaccttccccaggacccagtcgaattggccatgttcgggctgcggcacatggaaccagatctgtccgcgagggtgaccatataccaggtacccctgccgaaggattctaccggcgcagccgatccgccccagccacatattgttgggatccagagccccgaccagcaagccgctctcgctagacacaaccccgctaggcccgtgtttgtcgagggacctttcagtctttggctgcgaaataaatgtgtgtattatcatatcctacgggccgacctgctccccccagaggagcgagaagtcgaggagacccccgaagaatggaacttgtactatcccatgcagttggatcttgagtacgtcagaagcggctgggacaattacgaatttgatattaacgaggtggaggagggcccagtatttgctatgtgtatggccggagcccacgaccaagctacaatggctaagtggatccaggggctacaggagaccaatcctactctggcacagattccggtggtctttcgattggccggaagcacgagggagctgcagacttcctcagcaggccttgaagaacccccattacctgaggaccaccaggaggaggatgacaacctgcagcggcagcagcaaggtcagagttag

SEQ ID NO: 186268 - DNA, 654 bp, Artificial Sequence
  Description of Artificial Sequence: Synthetic coding sequence
atgagctgggtgcaggccaccctgctggcccggggcctgtgccgggcctggggggggacgtgtggagccgccctcactggcactagcatttcgcaggtgcccctgccaaaagattctacaggcgccgccgaccccccgcagccacacatcgttggcattcagtcccccgaccaacaggctgcgctagctcgacataaccctgctcggcctgtctttgtcgagggacctttcagcctatggctgaggaataagtgtgtctattatcacatcctacgcgcggacctcctgccaccggaggagcgtgaagtcgaagaaacccccgaggaatggaacctttactaccctatgcagttagatctggagtatgttcgcagtgggtgggataactacgagtttgacattaacgaggttgaggagggtcccgtgttcgccatgtgtatggccggggcccacgatcaagcgacaatggccaaatggattcagggcttgcaggagacaaatcctacattggctcagatccctgtcgtcttcaggttagcaggcagtacaagggagctccagaccagctctgccggcctggaggaaccccccttgccagaggatcatcaagaagaggatgacaacttgcaaagacagcaacagggacagagctag

SEQ ID NO: 186269 - DNA, 891 bp, Artificial Sequence
  Description of Artificial Sequence: Synthetic coding sequence
atgagctgggtgcaggccaccctgctggcccggggcctgtgccgggcttggggagggacttgcggcgccgctctgacaggaacttccatatcacaggtgcctcggagactgcccaggggcctgcactgcagcgctgcagcccatagctctgaacaaagcctggtcccaagtcctccagaaccacgccagcgaccgaccaaggctctcgttccgttcgaagacctgtttgggcaggccccgggtggcgaaagagataaggccagtttcctgcaaactgttcaaaaattcgcggagcattccgtgcggaagcgcggccacatcgatttcatctatctggccctcagaaaaatgagggagtatggagtagaaagagatctcgctgtttacaaccagctcctgaacatttttccgaaagaggtgtttcgtccccggaatataatccagcgaatcttcgtgcactacccccgccagcaagaatgcgggattgcagttctggagcaaatggagaaccacggggtgatgccgaacaaggaaactgaattcttgctcattcagattttcggtcgtaaaagctatcctatgctcaagctcgtacgccttaaactttggttccccagatttatgaatgtgaatccgttccccgtccctagagacttgcctcaggatccagtggagcttgccatgtttggattgcgacacatggagccagacctcagtgccagggtgactatctaccaggtcccccttcccaaggactcgaccggggctgctgatccccctcagcctcatatcgttgagctaacttgctgcccaaggcggcgaggaaagtggaagaggcgtcggcggtctggtaccagcactactagatgcagctggacatggtcgatgtag

SEQ ID NO: 186270 - DNA, 1770 bp, Artificial Sequence
  Description of Artificial Sequence: Synthetic coding sequence
atgagcgtgagcgtgcacgagaaccggaagagccgggccagcagcggcagcattaatatctatctcttccacaagtcctcctatgccgatagcgtgctcacacacttaaacttactgcgccagcagcgcctcttcactgatgtgttgttgcatgcaggaaatcgcactttcccctgtcaccgcgccgtgctggcggcttgttcccgatactttgaggctatgttttcgggtgggctgaaagagagccaggattccgaagtgaatttcgacaacagtatacacccagaagtgctggagctgctccttgattatgcctattccagcagagtaatcatcaacgaagagaatgccgaatcactgctcgaggctggtgatatgctagagttccaagacattcgtgacgcttgcgcagagtttttggagaagaatctgcacccaaccaattgcctgggaatgttgctgttgagtgatgctcatcagtgcaccaaactgtacgagttatcgtggcgcatgtgtctgagcaactttcagacgattcgcaagaatgaggattttctgcagctgccacaggatatggtagtccagctgctgagttctgaggaactcgaaaccgaagatgaacgactcgtgtacgagtccgccattaactggatctcttacgacctaaaaaagaggtattgttacctgcccgaactgcttcagaccgttcgcctggcactcctaccagcaatttacttgatggagaatgtggccatggaagagcttatcacaaagcagcgcaagagtaaggagatcgtcgaagaggccatcaggtgcaagctgaaaatattacaaaacgacggtgtggtgaccagcttatgtgctaggccacggaagacaggccacgctctcttcctgctgggaggccagacgttcatgtgcgacaaactgtacctggtcgaccaaaaagccaaggaaatcattcccaaggctgacatcccgagcccccgcaaagaattctccgcctgtgcaataggctgtaaggtgtatataacggggggtcggggatcagagaacggcgtgtccaaggacgtttgggtctacgatactcttcatgaagagtggagcaaggctgctcctatgctggtcgcccgttttgggcacggctcagctgagctgaagcattgcttatacgtggttggcggccacacagccgcgactggttgtctgcccgcgtcaccaagcgtgtccctcaagcaggtcgagcattacgaccctacaatcaacaaatggaccatggtcgcgcccctccgcgagggtgtctctaacgcggctgttgtcagtgcaaaactgaaactgtttgcgttcgggggaaccagcgtgtcacacgacaagctgccgaaggtgcagtgctacgatcaatgcgagaacaggtggacagtccccgccacctgtccacagccctggaggtatacggctgcagcagtgcttggtaatcagattttcattatgggaggcgacaccgaattcagcgcgtgcagtgcgtacaagttcaatagcgaaacctaccagtggaccaaagtcggagatgtgactgccaagcgcatgagctgccacgcagtggcgtcaggaaataaactgtatgttgtgggcggctatttcggcattcagcggtgcaagacactcgattgctatgacccgaccctggatgtgtggaatagtatcacaacagtgccctactccctcatcccaacggccttcgtgagtacttggaagcacttgcccagctag

SEQ ID NO: 186271 - DNA, 153 bp, Artificial Sequence
  Description of Artificial Sequence: Synthetic coding sequence
atgagcgtgagcgtgcacgagaaccggaagagccgggccagcagcgggagcataaatatctatttgttccacaagtccagctacgctgattctgtcctgacccatttaaatctgctgaggcagcaacgcttgttcacagacgtcttactttag

SEQ ID NO: 186272 - DNA, 15 bp, Artificial Sequence
  Description of Artificial Sequence: Synthetic coding sequence
atgagcgtgagctag

SEQ ID NO: 186273 - DNA, 1770 bp, Artificial Sequence
  Description of Artificial Sequence: Synthetic coding sequence
atgagcgtgagcgtgcacgagaaccggaagagccgggccagcagcggcagcattaatatctacctgttccacaaatcgagctatgcagactcagtccttactcatttgaatctgcttagacagcagcgactgtttacagacgtgctgctccatgccggcaaccgcacctttccatgccaccgggcggtgttggccgcctgttccaggtatttcgaagctatgttctcggggggacttaaggaaagccaagattctgaagttaatttcgacaacagtatccaccctgaagtgctggagcttctgctcgattacgcttactcatcacgagtgatcatcaacgaggagaacgccgagtccctgttggaggcaggagatatgctggaattccaggacatcagagacgcttgcgcagagttcctggaaaagaacctgcaccccaccaattgtcttggcatgctgctgctgtccgacgctcaccaatgcacaaaactgtacgagttgtcttggagaatgtgtctgtcaaactttcagacaatacggaagaacgaagattttttgcaattaccccaggacatggtggtgcagctactcagttcagaagagctggagactgaggacgagagactcgtgtacgaaagtgccatcaattggatctcctacgatctgaaaaagaggtattgttatctgcccgagttgctgcagacagttagattggcactgttgcccgctatctacctgatggagaacgtggccatggaggagctcatcaccaagcaacgaaagtctaaggagatcgtcgaggaggccattaggtgcaagttaaagattcttcagaacgacggtgtggttacatctctgtgcgcccgcccgcgcaaaacaggtcatgccttgttcttgctaggaggacagacctttatgtgcgacaaactgtacctcgtggaccaaaaggccaaagagatcatccctaaagccgatatccctagcccacggaaggaattcagtgcctgcgccattggttgcaaggtctatatcactggggggcgggggagcgagaacggcgtatctaaggacgtatgggtatacgacactttgcatgaggaatggtccaaggctgctcctatgctcgtggcccgcttcggccacggctctgctgagctcaagcactgcctgtatgtggtcggaggccatacggccgccacgggatgtttgccagccagcccaagtgtgtctctgaagcaggtagagcattacgatccaactattaataaatggaccatggtggccccactgagagaaggggtgtccaatgccgccgtagtgagcgccaaactcaagctttttgcttttgggggcacctctgtgagccatgacaaattgcctaaggttcaatgttatgaccagtgcgagaaccgttggaccgttccagccacttgcccgcaaccctggcggtacacagctgcagccgttctggggaatcagatcttcattatggggggagacactgaattttccgcctgttcagcgtataagtttaattcagagacctaccagtggacaaaagtgggcgacgtcaccgccaagcgcatgtcttgccacgctgttgcctcagggaataagttgtatgtagtcggaggctacttcgggattcagagatgcaagaccctggactgctatgatccgactctcgatgtgtggaactccataactactgtcccttactcattgattcccacggcgttcgtgtccacgtggaaacatctccccagctag

SEQ ID NO: 186274 - DNA, 1551 bp, Artificial Sequence
  Description of Artificial Sequence: Synthetic coding sequence
atgttcagcggcggcctgaaggagagccaggacagcgaggtgaacttcgacaacagtattcatcctgaagtcctagaacttttgctagattatgcttacagctctagggtcatcatcaatgaggaaaacgcagaatccctgttggaagccggcgacatgctggagtttcaagatatcagagacgcctgtgcagagtttctggaaaagaatcttcacccgaccaactgcctcggtatgcttctgctcagtgacgcccaccagtgcacaaaactgtatgagctctcctggcgcatgtgcttgtccaacttccagactataaggaagaacgaagacttcctgcaactcccacaggatatggtggttcagctgctgagcagcgaggaactggagaccgaagatgaacggcttgtctacgaaagcgcgatcaactggatcagctatgacttgaagaagcgctattgctatctgcccgaactcctacagactgttaggctcgcactattgcccgcgatatacttgatggagaacgtcgctatggaggagctgatcactaaacagaggaagtccaaggagattgtcgaggaggccatacgctgtaagctgaagatcttacagaatgatggagtggtcacaagtctgtgcgcacgtcctcggaagacaggccacgctctgttcctgttgggaggacagacattcatgtgcgacaagctgtacctggtggaccagaaagcaaaggagataatccctaaggctgatattccaagcccacgcaaagagttttctgcctgtgctatcgggtgtaaggtttacatcactgggggccgcggcagtgaaaacggtgtctccaaagatgtctgggtgtatgatactctgcatgaggagtggagtaaagccgccccaatgctcgtggctaggttcggtcacgggagtgcagagcttaagcactgcctgtacgtcgtgggcggccacaccgctgctacaggatgcctgcctgcttcgccatccgtaagtctgaagcaagtggaacactatgatcctaccatcaataagtggaccatggtcgctccactccgggaaggcgtaagcaacgccgcggttgtcagtgcgaaactcaagttatttgccttcggcggaacatcggtctcacatgacaaactgcccaaggtgcaatgctatgatcagtgcgaaaaccgatggaccgtgccagcaacgtgtccccagccttggaggtatactgccgccgccgtgcttggcaatcagatttttatcatgggcggtgacacagaattctctgcgtgttccgcttacaagttcaactccgagacctaccagtggacgaaagttggagacgtcacagccaaaagaatgagctgccacgccgtcgcttccggcaacaagctgtacgtggtggggggatactttggaatacaaaggtgcaaaaccctcgactgttatgatcctaccctagacgtgtggaacagcattactactgttccgtactctctgatacctactgcattcgtgtcaacttggaaacatcttccctcatag

SEQ ID NO: 186275 - DNA, 1932 bp, Artificial Sequence
  Description of Artificial Sequence: Synthetic coding sequence
atggtggacgccggcggcgtggagaacatcacccagctgccccaggagctgccccagatgatggcagcagcggccgacggcctgggcagtatagcaattgacacaacacagttgaacatgtctgtaacagaccccacagcctgggcaactgccatgaacaacttgggcatggtgcccgtgggactgccgggccagcagctggtctccgactctatttgtgttccagggttcgacccatccctgaacatgatgacaggcatcacaccaatcaatcctatgattcctgggctggggctggtgccacctcctcctccaactgaggtggctgtcgtgaaagagattattcattgtaagagttgcacccttttcccgcaaaacccaaatctgccaccaccgtccacaagagagcgacccccgggctgcaagacagtgtttgtggggggattaccggaaaatgcaaccgaggagattatccaggaggtgttcgagcagtgtggcgacatcactgccatccgcaaatccaaaaagaatttctgccatattagattcgcagaggaatttatggtggacaaagccatttatctctctggctaccggatgcggttgggaagctccactgataagaaggattccggtcggctgcatgtcgactttgcccaggccagggatgatttttacgaatgggagtgtaagcaacgaatgcgggcccgagaggaacgccatcggcgcaaacttgaggaggaccggctgaggcctccaagccccccagctatcatgcactatagtgagcatgaggcagcgttgttggccgagaagctgaaggatgatagtaaattttccgaggccattacagtgctgctgtcatggattgagaggggggaagtgaaccgccgatctgccaaccagttttactcaatggtgcagagcgcaaactctcacgtccggcggctgatgaacgaaaaggctacacacgaacaggaaatggaagaggcgaaggagaatttcaagaatgccctcaccggtatccttacccagttcgaacaaattgtggcggtgttcaatgcctctacgaggcaaaaggcgtgggaccattttagtaaggcccagcgcaagaatatcgacatttggaggaaacattcagaggaactgcgtaatgctcagtcagaacaactcatgggcatccgtagggaagaggaaatggaaatgtcagacgacgagaactgcgactctcccaccaagaagatgagagtggatgagagtgcattagcagctcaggcatatgcacttaaggaggaaaacgacagcctccgctggcagctggatgcttaccgaaacgaagtagaactactaaaacaggagaaagagcagctatttagaactgaggagaacctgacgaaggatcaacagctccagttcttacagcagaccatgcaagggatgcagcaacagctcctcaccatacaggaggaactcaacaacaagaagtctgaactagagcaggcgaaagaggagcaatcccatacacaggctctgcttaaagtcttgcaggaacaactcaagggaactaaagagctggtagaaactaatgggcattcacatgaggacagtaacgagataaacgtgctcacagtggctctggttaatcaggacagagagaataatatcgagaagaggtcacagggcctcaagtctgagaaagaagctctgcttattggaattatcagcacatttctgcatgtgcaccccttcggggctaacattgagtacttatggagttacatgcagcagctagactccaagatttctgctaacgagatcgaaatgctactgatgcggttaccccgtatgttcaagcaggagttcacgggcgttggagctaccctggaaaagcggtggaaactctgcgcctttgaaggaattaagaccacctag

SEQ ID NO: 186276 - DNA, 1932 bp, Artificial Sequence
  Description of Artificial Sequence: Synthetic coding sequence
atggtggacgccggcggcgtggagaacatcacccagctgccccaggagctgccgcaaatgatggcagcagccgccgacggcctggggtccatagcaattgataccactcaattgaatatgtccgtcactgacccgacagcctgggcaaccgctatgaataaccttggaatggttccagtcggtctgccggggcagcagttggtgtcagattccatatgcgtccccggcttcgacccgtccctgaatatgatgacagggatcacaccaataaatccaatgatccccggcctcggcctggtaccacctcctccccctactgaggtagccgtcgtgaaggagatcattcattgcaaatcttgcaccttgtttccccagaatccgaacttgcccccccccagcaccagggagcggcctcctggctgtaagactgtttttgtcggcgggctgccagagaatgccacggaggagattattcaggaagtctttgagcagtgcggagatataacggccatcaggaaaagcaaaaagaacttttgccacatccgcttcgctgaggagttcatggtcgacaaagcaatctatctttcaggctataggatgcgcctcggttcttccacagataagaaggacagcggcagattgcatgtggacttcgctcaggccagggatgatttctacgagtgggaatgtaagcagaggatgcgtgctcgcgaagagaggcaccggaggaagctggaggaggacagactgcgtcctcccagtccacccgccatcatgcactactccgagcacgaggctgcattgctcgcagaaaagctgaaggacgattctaagtttagcgaagccattactgtgctgctatcttggatcgagcggggtgaagtgaaccgtcgatccgccaaccagttttactctatggtacagtcagccaattctcatgtgcggcgcctgatgaacgagaaagcaacacacgagcaggaaatggaggaggccaaggagaatttcaaaaacgccttgactggcattctgacccagtttgagcagattgttgctgtttttaatgccagtaccaggcagaaagcttgggaccacttctctaaggcgcaacgaaaaaacattgacatctggaggaagcattccgaggagctccgcaacgcgcaatctgagcagctgatgggaattaggcgagaggaggagatggaaatgtccgacgatgagaattgcgacagccctacaaagaagatgagggtggacgagtcagcgctagccgctcaggcttacgctctcaaggaggaaaacgacagtctcagatggcagctggatgcatatagaaacgaagtcgaattacttaagcaggaaaaggagcagctgttccggactgaggaaaatctcactaaagaccaacagctgcagtttctccagcagaccatgcagggcatgcaacagcaacttttgacaatacaggaagagctgaataacaagaagagcgaattggaacaggccaaggaagaacagagtcacacacaggctctcctaaaggttctgcaagagcaactgaaggggaccaaggagttggtggaaaccaatggacatagtcatgaagacagtaatgaaatcaatgttcttaccgtcgccctcgtcaaccaggatcgggaaaacaacatagagaaaaggtcccaagggctcaaatctgaaaaagaagcactgctgatcggtatcatctctactttcctgcatgttcatccctttggagccaacatagagtatctctggtcttatatgcagcagttggatagcaaaattagtgccaacgagatcgagatgctgttgatgagactgcccagaatgttcaaacaggagtttacgggagtcggcgcgacattggagaagcggtggaagttgtgtgccttcgaggggatcaagacaacctag

SEQ ID NO: 186277 - DNA, 708 bp, Artificial Sequence
  Description of Artificial Sequence: Synthetic coding sequence
atggtggacaaggccatctacctgagcggctaccggatgcggctggggtccagcacagataagaaagattcgggcaggctccacgtggacttcgcccaagccagggatgacttctacgagtgggaatgtaagcaacggatgcgggcacgggaagagaggcaccggcgaaagttggaagaggatcgactgcggcccccgagtccacccgcgattatgcattattctgaacatgaggccgctcttctggctgagaaactgaaggacgactcgaagttctcagaagctatcaccgtcctgctcagttggatcgaacggggcgaggtgaatagaaggagcgccaatcagttttacagtatggtccagtccgccaattctcatgtgaggaggctcatgaatgaaaaggccactcatgagcaggaaatggaagaggccaaagagaactttaaaaacgctctaacagggatcctgacccagtttgaacagatagtggcagtttttaatgccagcacccgccagaaggcctgggaccacttttctaaggcacaaaggaagaacatcgatatctggagaaagcattcagaagagctacgcaacgcccagagtgagcagttgatggggatccgaagggaggaagagatggaaatgtcagacgacgagaactgtgactcaccgactaaaaaaatgagggtggatgagagtggagcatag

SEQ ID NO: 186278 - DNA, 1833 bp, Artificial Sequence
  Description of Artificial Sequence: Synthetic coding sequence
atgcagcgggacttccggtggctgtgggtgtacgagatcggctacgccgccgataattccagaacactgaacgtggatagcacggcaatgactctgcctatgtccgatcctacagcctgggcaactgctatgaataacctgggcatggctcccttaggtatcgccggtcagcccatcctccctgacttcgatcccgccttgggaatgatgacgggtatccctcctatcacgcctatgatgccaggcctcggcattgttccacctccgattcctcctgacatgccggtagttaaagaaatcatccattgcaagtcctgtactttgtttccgccaaacccaaacctgcctcctccagccacaagagaacgcccaccagggtgcaagaccgtctttgttggcgggcttcctgagaatggcacagaacaaatcatcgtggaggtctttgaacaatgcggcgagatcatcgcgattaggaagtccaagaagaatttttgccatatacgattcgcggaagagtacatggttgataaggccctgtacctaagtggctatcgcattcggctggggtcttcgactgataagaaagatacaggacgattgcatgttgacttcgcccaggccagagacgacctttatgaatgggaatgcaaacagagaatgctggctagagaagagcggcatcggaggcgaatggaagaggagcgcctcagaccaccttctcccccccccgtggtacactattcagatcacgaatgctctatagtggcagagaagctgaaggatgactctaagttctctgaggccgtgcaaacccttcttacatggatcgagcgcggcgaggtgaatcgcagatctgctaataatttctattcgatgattcagtccgctaacagccacgtccggcgcctggtgaacgaaaaagccgcccatgaaaaggacatggaggaggccaaagagaagtttaaacaagccctatccgggatcctcatccagtttgagcagattgtggcagtgtaccatagcgcctccaagcaaaaggcctgggatcacttcactaaggcccagcggaaaaacatcagtgtttggtgcaagcaagccgaggagatcaggaacattcacaatgatgaactcatgggtatacgcagagaagaagaaatggaaatgtcagatgatgagatcgaggaaatgacagaaacgaaggagaccgaagaaagcgccctcgtcagtcaagctgaggccctgaaagaggagaacgattcgcttagatggcagctggatgcctataggaacgaagttgagttgctaaagcaagaacaaggaaaagttcacagggaagacgacccaaataaggagcagcaattgaagctactccagcaagcactacaggggatgcagcagcatctcttaaaggtgcaggaggagtacaaaaagaaagaagcggaactcgaaaagctgaaagatgacaaactgcaggtcgagaagatgctggagaacctgaaagagaaagagagctgtgcgagtaggctttgtgctagtaaccaggatagcgaatacccacttgagaagaccatgaatagcagtccgattaagtccgaacgcgaggctttactggtcgggattatctctactttcctgcatgtgcacccctttggagcctcaatcgaatatatctgtagctacctccacagacttgacaataagatttgcacttccgatgttgagtgtttaatgggccgactccagcacaccttcaaacaggagatgacaggcgtgggcgcatccttggaaaaaaggtggaagttctgtggctttgagggcttaaagctaacctag

SEQ ID NO: 186279 - DNA, 1917 bp, Artificial Sequence
  Description of Artificial Sequence: Synthetic coding sequence
ctgcccttcgaccccgccaacaacaacgagcccctgcagttcggctcggcaagtggtcccttggttaccgaagggctgatcgagaatggcggcgagtcttccaaaaaaaggaagaggacgaatacccccagtgcagacaattcacgcaccctgaacgttgactccacggcaatgacgctccctatgagcgatccaaccgcgtgggccaccgctatgaataatctggggatggcgccactgggcatcgctgggcaaccaatcctccctgactttgaccccgctttgggaatgatgacaggcatcccaccaataacaccaatgatgccaggcttagggattgtacctccgcccatcccacctgacatgcctgtggtaaaagaaattatccactgcaaaagctgtaccttgtttcctcccaatccaaacctgcccccgcccgccacccgtgagcgcccccctggctgtaaaacagtgtttgttggagggctccctgagaatggtactgaacaaatcattgtcgaggtgtttgagcaatgcggggaaatcattgcgatccggaaatcaaagaagaacttttgtcacattagattcgccgaggaatacatggttgacaaggctctgtacctgtctgggtatcggattaggttggggtcaagcactgacaagaaagacacggggcggctgcacgtcgatttcgctcaagctcgagacgatctgtatgagtgggagtgtaagcagagaatgctcgctcgcgaggagaggcatcggcgaaggatggaggaagagcgtttaaggcccccaagccctcctccagtggtccactacagcgaccatgagtgctccatcgtcgctgaaaagctgaaagacgatagtaaattttctgaagccgttcagactttgcttacctggatagaacgcggcgaagttaataggcgctcggccaacaatttttacagcatgatccagagcgctaatagccatgtgcggcgacttgtgaacgagaaggccgcccacgaaaaggacatggaggaggccaaagagaagtttaagcaggctctgtcaggcattctgatccagttcgaacagatcgtagccgtgtaccatagcgccagcaaacagaaggcctgggatcactttaccaaagctcagcgtaagaacatttctgtgtggtgtaagcaggctgaggagattagaaacatacataatgatgagctgatggggatccgacgggaggaggaaatggagatgagcgatgatgagattgaagaaatgaccgaaacaaaagaaactgaagaaagcgctctcgtttctcaggccgaggctctaaaagaggaaaacgacagtctcagatggcagctggatgcataccgcaatgaagtggagctcttgaagcaggagcagggtaaggtacaccgggaagatgaccctaacaaagaacagcagttgaaactgttgcagcaggctctgcaggggatgcagcagcatctcctaaaggttcaggaggaatacaagaagaaggaggcagagcttgaaaaactgaaagatgacaagttgcaagtggaaaagatgctcgagaaccttaaggaaaaggaatcgtgcgcaagtcggctctgcgcgagcaaccaagactctgaatatcccttggagaaaactatgaacagcagcccgattaagtctgagcgggaggctctgctggtagggattatctccacctttctgcacgtgcacccatttggcgcaagtattgaatatatctgtagctatcttcacagactggacaacaaaatatgtacttcagatgttgagtgtctaatggggcgtctccagcataccttcaaacaggagatgaccggagtgggcgcttctctagaaaaacgatggaaattttgtgggttcgaaggattgaaacttacgtag

SEQ ID NO: 186280 - DNA, 1833 bp, Artificial Sequence
  Description of Artificial Sequence: Synthetic coding sequence
atgcagcgggacttccggtggctgtgggtgtacgagatcggctacgccgccgataatagccgcaccctcaacgttgatagtactgccatgacattgcctatgtcggaccctacagcctgggctaccgcgatgaacaacctgggtatggccccactcggcattgccggccagcccattctccccgattttgatccagcacttgggatgatgactggtatcccacccatcacccccatgatgcctgggttgggtatcgtgccgccccccattccccctgacatgcccgtggtgaaagaaatcattcattgtaagtcgtgtaccttatttcctccaaacccaaaccttccaccacctgcaacaagagagagacctccaggctgcaagacagtttttgtggggggattgcccgaaaacggcactgagcagatcatcgttgaggtctttgagcaatgtggggagattatagccatccggaaatcaaaaaaaaacttttgtcacattaggttcgctgaagagtatatggtagacaaagctctgtacctttctggttaccgcatcaggctggggtcaagcaccgataagaaggacacagggaggcttcatgtggacttcgcccaggctagagacgatctctacgagtgggagtgcaagcaacggatgttggctagagaagagcgtcacagacgaaggatggaagaggaaagactccgaccgccatccccaccgcctgtagtgcattactccgatcacgagtgctccatagtcgcggagaaactgaaagacgatagtaagttctcagaggctgtccagacactgctcacctggatcgagcgcggtgaagtgaaccggcgcagcgcgaacaacttctacagtatgatccagtcagccaacagccacgtgcggcggctggtgaatgaaaaagccgcgcatgaaaaggacatggaggaggcaaaggagaagttcaaacaggctctctccggcatcctcattcagttcgagcaaattgtggctgtatatcactcagcttctaaacagaaggcctgggaccacttcactaaagcgcagcggaaaaacatctcagtgtggtgcaagcaggccgaggagatcagaaacattcacaatgatgagctgatgggtatcagaagggaagaggaaatggagatgagtgatgatgaaatagaagaaatgacagagactaaggagaccgaggaaagcgctcttgtgagccaggccgaagccttgaaagaggaaaacgactcgctacggtggcagctggatgcttatagaaacgaggtggagttactaaagcaggagcaggggaaagtgcatagggaagatgaccctaataaggagcaacagctgaaactcctccaacaggccttacaggggatgcaacagcatttgctgaaagtgcaagaggagtataagaaaaaagaggcagagctggaaaagctgaaggacgataaattgcaggtggagaagatgttagaaaaccttaaagaaaaggagagttgcgctagcaggctttgcgccagcaaccaggatagcgaatatccactggaaaagacgatgaactccagcccaattaagagtgaaagagaagcactgctggttggcatcatcagcactttcctccacgtgcatccatttggggccagtattgaatacatctgctcatacctgcaccggcttgacaataagatatgtacctctgatgtggaatgtcttatgggtcgcctgcagcacacctttaagcaggaaatgacaggagtgggggcgagccttgagaagagatggaaattctgcggattcgagggccttaagctgacatag

SEQ ID NO: 186281 - DNA, 1746 bp, Artificial Sequence
  Description of Artificial Sequence: Synthetic coding sequence
atgaccctgcccatgagcgaccccaccgcctgggccaccgccatgaataatctggggatggcgcctctgggcattgcgggccagccaattttaccagacttcgatcccgctttgggaatgatgaccggcatcccacccattacaccaatgatgccaggactagggatcgttccaccccccatcccacccgacatgccagtcgtcaaggaaattattcactgcaaatcgtgtacactgttcccacccaaccccaatctcccccctccagctaccagagaacggcctcccggttgtaaaacagtgtttgtaggcggtctgcccgagaatggcaccgaacaaatcattgtggaggtattcgagcagtgtggcgaaatcatcgcgattcggaaaagtaaaaaaaacttctgccacatacgtttcgcagaagagtacatggttgataaggcactgtacctgagcggatacagaatcaggctgggatccagcactgacaagaaagacactggccggcttcatgtcgacttcgcgcaggcgagagacgacctatatgagtgggaatgcaaacaacggatgttggcgcgtgaagaaagacacagaagacggatggaagaggaaagactccgcccaccttcgccacctcccgtagtccattatagcgatcacgaatgcagtatcgtagccgaaaaattgaaagacgattcgaagttcagcgaggccgttcagaccttattgacctggatagaacgaggcgaggtgaatagaaggtctgcaaacaatttttacagtatgattcagagcgctaacagtcacgttcgtcgcctggtcaacgagaaagctgcacatgagaaagacatggaagaggctaaagagaagttcaagcaggcactttcgggaattcttatccagttcgagcaaatcgtcgctgtatatcattccgcgtcaaaacagaaggcatgggatcactttaccaaggctcagcggaagaatatttcagtgtggtgcaaacaggcggaggaaattcgaaatatccataatgacgagctgatgggcatacgccgggaggaagaaatggagatgagcgatgatgaaattgaagagatgaccgaaactaaggagacagaagaaagcgctttggtgtctcaggctgaagccctgaaggaagaaaatgactcacttcgatggcagctcgacgcttatcggaatgaagtcgagctgctgaagcaggagcaggggaaagtccacagagaagatgacccgaataaggaacagcagttaaaactcctacagcaggcactacagggtatgcagcagcacttgctgaaggtgcaggaagagtacaaaaagaaggaggctgaactggagaaactgaaggacgacaagctgcaagttgagaagatgctggaaaatctcaaagaaaaagaatcttgtgctagccgcctttgcgcaagcaatcaggattctgagtatcctcttgagaaaaccatgaactccagtcctatcaaatccgaacgcgaggctctactagtgggaatcattagcacctttctgcatgtccaccctttcggcgcctccatagaatacatttgcagctacttgcatagactggacaacaaaatctgtacgagtgacgttgagtgtcttatggggaggctccagcatacatttaaacaggaaatgacaggggtcggcgcttccctggagaagagatggaagttctgcggattcgaaggtctgaaactgacttag

SEQ ID NO: 186282 - DNA, 1746 bp, Artificial Sequence
  Description of Artificial Sequence: Synthetic coding sequence
atgaccctgcccatgagcgaccccaccgcctgggccaccgccatgaataatctgggcatggcccccctgggcatcgcgggacagcctattttgccagacttcgatcccgcgttaggcatgatgactggcataccacctatcacgccgatgatgcctggtctcggcatcgtccctccgccgattcccccagacatgccagttgtgaaagagatcatacactgcaaatcctgcacattgtttcctccaaaccctaaccttccacctccagctactcgggagaggccccccgggtgcaaaaccgtgttcgtcggcggcctgcctgagaatggtactgaacagattatcgtggaagtctttgaacagtgtggcgaaatcattgccattcggaagagtaagaagaacttctgtcatattagattcgccgaggaatacatggtggacaaggctttgtatctctcaggatatcgaatccgtttgggctcatctacagataagaaggacaccggccggttacacgtcgatttcgctcaggctcgcgacgatttgtatgagtgggaatgtaaacaacgcatgctcgcacgggaggagcggcacagaagacgaatggaagaagaacgcctgcgcccgcccagtcctccacccgtggtgcactatagtgaccacgaatgcagcattgtggcagagaagctcaaggacgactctaagtttagcgaggctgtccagacgctgttgacctggattgaacgcggagaagtaaacagacgctcagcaaataatttttactccatgattcagtcggcgaactcacatgtccgccgattagttaatgaaaaggcagctcatgagaaggacatggaggaggccaaggagaaatttaagcaagccctctcaggaatcctgatccagttcgagcagatagtggctgtgtatcatagtgccagcaaacagaaggcatgggatcacttcaccaaagcccagcgaaagaacatctctgtgtggtgtaagcaggccgaggaaatacgcaatatccataacgatgagttaatgggcatcaggcgcgaagaagaaatggagatgagcgacgacgagattgaagaaatgactgagaccaaggaaactgaggaatccgcattggttagccaggccgaggccctgaaggaagaaaacgactctctgcggtggcagctggacgcttaccgcaacgaggttgagctgctgaagcaggagcagggcaaggttcacagggaagatgaccctaataaagaacagcagctcaagctactccaacaggcacttcagggcatgcagcaacacctgttgaaggtccaggaggagtataagaaaaaagaggcagaactggaaaaacttaaggatgataaactccaggtagagaagatgctggaaaacttaaaggaaaaggagtcatgtgcttcaaggctctgcgcatcaaatcaggactcagagtaccccctggaaaagaccatgaattcatccccaattaaatccgagagagaagcccttctggtgggcatcatatccaccttcctacacgtgcatcctttcggtgctagcatcgagtacatttgcagctacctgcacagactggacaataagatatgtacctccgacgtggaatgtctaatgggtagactgcagcacacttttaagcaggagatgaccggcgtgggggcttcattggaaaagcggtggaagttctgcggctttgagggactgaaacttacctag

SEQ ID NO: 186283 - DNA, 1131 bp, Artificial Sequence
  Description of Artificial Sequence: Synthetic coding sequence
atgaccctgcccatgagcgaccccaccgcctgggccaccgccatgaataatctgggaatggcgcctctggggattgctggccagccgattttgcccgacttcgaccccgcactcggaatgatgacaggaattccacccataacgcccatgatgccagggctgggtattgtccctcctcctatccccccggatatgccagtcgtaaaggaaatcatccactgcaagtcgtgtacactgtttcctcctaacccaaacctcccgccacccgcaacccgcgaacgcccaccggggtgtaaaaccgtgtttgtcgggggattaccagagaatggaactgaacaaattattgtggaggtatttgaacaatgtggagagatcatcgctatccgtaagtccaagaagaatttctgccatattcgctttgcagaagaatacatggttgacaaggcactctacctcagcgggtacaggataaggttgggaagctcaacagacaagaaggacaccggtcgacttcacgtggacttcgcccaggccagggacgacttgtacgaatgggagtgtaagcagcgaatgctagcccgggaggaaaggcacagaaggcggatggaggaggagcgccttagacccccttcccccccgccagtggtccattattcagaccacgagtgttcgatcgttgcagagaaactaaaggacgattcaaagttctccgaggctgtgcaaactttactgacatggatagaacgaggcgaagtaaacagacgcagtgccaacaatttctactccatgattcaatccgcaaacagccacgttcggagactggtcaacgagaaggctgcacacgaaaaagatatggaggaggccaaagaaaaatttaagcaggccctgagcggcatcttgattcagttcgagcagattgttgcagtgtatcacagcgcatccaaacagaaggcatgggatcactttactaaagcccagcggaagaatatttccgtttggtgtaaacaagcagaagaaattcgtaacattcacaatgatgagctgatgggcattaggcgggaggaagagatggagatgtccgatgatgagatcgaagagatgactgaaactaaagagacggaagaaagctag

SEQ ID NO: 186284 - DNA, 1407 bp, Artificial Sequence
  Description of Artificial Sequence: Synthetic coding sequence
atgaccctgcccatgagcgaccccaccgcctgggccaccgccatgaataacctcggcatggcgcccctcgggattgctggtcagccgatacttccggatttcgaccctgctttgggtatgatgacaggaataccgcccatcacccccatgatgccaggactcggcatagtccccccaccaatccctccggatatgccagtggtaaaggagattatccactgtaaatcttgtaccctgtttccacctaacccaaatctgcctccccccgctacgagggaaaggcctcctggttgtaagactgtgtttgtgggcggcttaccagagaacggtactgaacagatcatagtcgaagtgttcgagcaatgtggggagattattgctatccggaaatccaaaaaaaatttttgccacatccggtttgctgaagagtatatggtcgacaaagctctgtacctgtccgggtaccggattcggcttggttccagcactgataagaaggatacagggagactccacgtagactttgcacaggcgagagacgacctgtatgaatgggaatgcaagcaaaggatgctcgctcgcgaagagcggcataggagacgcatggaagaggaaaggctccgtccacccagtcctcccccagtcgtacattacagtgaccatgagtgttctatagttgcagagaagctcaaagacgacagcaagttttctgaggccgttcagactcttctgacttggattgagcggggtgaggtgaaccgcaggtccgcgaataatttctactctatgatccagagtgcgaacagccacgtcaggcggcttgtgaacgagaaggcagcccacgagaaggacatggaggaagctaaggaaaaattcaagcaggccctgagcggcattctcatccagttcgagcagattgtggccgtgtatcattccgcttccaaacaaaaggcctgggatcactttacaaaagcccaaaggaaaaatatcagtgtgtggtgcaagcaggcggaggagatcagaaatatccataatgatgagctgatgggcatcagacgcgaagaagaaatggagatgtcagatgacgagatagaagagatgactgaaactaaggagaccgaggaaagcgcgctggtgtcccaggcagaggcactgaaagaagagaacgactccttgcgttggcagctagacgcataccgcaatgaagtggaactactgaagcaggagcagggtaaagtgcaccgcgaggacgatcctaataaagagcaacagctgaagctgcttcagcaggctcttcagggtatgcaacaacacttgctcaaagtgcaagaggagtacaagaagaaggaggctgagctggagaagttgaaagatgataaattgcaagtggagaagatgaaaaaatag

SEQ ID NO: 186285 - DNA, 1119 bp, Artificial Sequence
  Description of Artificial Sequence: Synthetic coding sequence
atggagagcgaggagctggccgaccgggtgctggacgtggtggagcgaagtctctctaattacccgttcgactttcaaggagccagaatcataactgggcaggaagaaggggcctacggatggattacgatcaattatctgttgggcaagttttcccagaaaacccggtggttcagcattgtgccctacgaaaccaacaaccaagagactttcggggccctcgacctaggtggggccagcactcaagtaacgttcgtgccgcagaaccagacaatcgagtccccggacaacgctctgcagtttcgattgtacgggaaagactacaacgtgtacacccattcttttctgtgctacggaaaagaccaggcactctggcaaaaactggctaaggatattcaggttgcttcaaacgagatcctgagggacccttgttttcacccgggatacaagaaagtggtgaacgtgtctgacctgtataagaccccatgcactaaacggtttgaaatgacgctgccttttcagcagtttgagatacagggtatcgggaactatcagcagtgtcaccaatcaatcctggagctttttaatacgagctactgcccatattcacagtgcgccttcaacggcatcttcctgccgccgcttcagggagacttcggtgccttctctgccttttattttgtcatgaaatttctaaacctgacatccgagaaagtttctcaagaaaaagtgacagagatgatgaaaaaattttgcgctcagccctgggaagaaatcaaaacctcttatgccggcgtcaaggagaaatacctgtccgaatactgtttctcgggcacatacatcctgtcccttctactccaggggtaccactttacagccgacagttgggagcacatccacttcatcggaaaaatccagggttccgacgcaggttggactctgggatatatgcttaatctaacgaatatgatccccgccgaacagcctctttctaccccgttgagccactcgacctatgtttttttgatggtgctcttttccctcgtcctgttcacagtggccatcataggtctactaatctttcataaaccatcgtacttctggaaggatatggtatag

SEQ ID NO: 186286 - DNA, 1533 bp, Artificial Sequence
  Description of Artificial Sequence: Synthetic coding sequence
atggaggacaccaaggagagcaacgtgaagaccttctgcagcaagaatattctggccatcctggggttctcaagcattatcgcagtcattgccctgcttgctgttgggctgacccagaacaaagccctgcctgaaaatgtgaagtacggaatcgttctggacgctgggtcctcacatacttcgctgtatatatacaagtggcccgccgaaaaggaaaatgataccggtgtggtacaccaggtggaggaatgccgcgtgaagggccccggcatatccaagtttgtgcaaaaagtgaacgaaattgggatctacctgaccgactgtatggaacgagctcgagaggtgattcccaggagccagcaccaggagacccccgtttatctgggtgccacggcaggaatgcggcttctgaggatggagtctgaagagcttgccgatagggtgttggatgttgtcgagcgctccctaagtaactacccctttgactttcaaggagcacgaattattacagggcaggaggagggcgcctacggttggatcactattaactatctgttaggcaaattcagtcagaaaaccagatggttttcaatcgtgccatacgaaaccaataaccaggaaaccttcggggccctggaccttgggggcgccagtacgcaggtgaccttcgttcctcagaatcagacgattgaaagtccggacaacgctctccagttccgtttatacggcaaagactacaatgtgtatacccatagtttcctctgttacggaaaggaccaagcgctgtggcaaaagctagcaaaagatatccaggtagcaagtaacgagatcctccgggacccctgtttccaccctggctataaaaaagtcgtcaatgttagtgatctttataaaacaccgtgcaccaaacggttcgagatgaccctgccattccagcagttcgagattcagggaattggtaactaccaacagtgccatcaatccatattagagctgtttaacacttcatactgcccttactctcagtgtgccttcaacggcatttttttgcctccgctgcaaggggactttggcgcttttagtgcattttattttgtgatgaaattcctgaatctcaccagtgaaaaggtgagccaagaaaaagttacggaaatgatgaagaagttttgtgcacagccctgggaggaaatcaaaacctcctatgccggcgttaaggagaagtacctgagcgaatactgcttttccgggacctacattcttagcttactgcttcaagggtatcacttcaccgccgatagttgggagcatattcattttattggaaaaatccaggggagcgacgcagggtggactctggggtacatgttgaacctgactaatatgattcccgcggagcagccactgtctacccctctgtcacatagtacatacgtgttcctcatggtgctctttagcctggtcctatttaccgtcgcaattatcggattgcttatcttccacaaaccctcttatttttggaaggatatggtctag

SEQ ID NO: 186287 - DNA, 921 bp, Artificial Sequence
  Description of Artificial Sequence: Synthetic coding sequence
atgaagggcaccaaggacctgaccagccagcagaaggagagcaacgtgaaaactttctgttccaaaaatatcttagccattctaggcttctcaagcattattgctgtcatagctttattggcagttggcttgacccagaacaaggcactgccggagaacgtcaaatacggcatcgtcctggatgccgggagctcgcacacctcactgtacatttataagtggcccgcagagaaggagaatgacaccggcgtcgtgcatcaggtggaggagtgtagagttaagggaccgggcatctctaagttcgtgcagaaagtgaacgaaatcggtatatacctgaccgactgtatggaacgggcaagagaggtgatacctcgttcccaacaccaggagactcctgtgtacctcggagcaacggccggcatgcgattgctgagaatggaaagtgaggaactggcagatcgggtcctcgacgtggtggagagatccctgtcgaattatccctttgattttcagggagcccgcataattaccggacaggaggagggtgcctacggatggatcacaatcaattacctactagggaaattcagccagaagacgaggtggttcagtattgtcccctatgagacaaacaatcaggagacattcggggctttggatctcggaggagccagcacccaagtgacttttgtaccgcagaatcagacaattgagtctcctgataatgccttacagttccgtttgtatggtaaagactataacgtctatacccactcattcctgtgttatggcaaggaccaagctctctggcaaaagctggccaaggacattcaggcttctatcactcagtctcgtccagccccctttacaagcgccccccccgcgcctacaagctgttgcttcctgttccaaattcagtag

SEQ ID NO: 186288 - DNA, 1569 bp, Artificial Sequence
  Description of Artificial Sequence: Synthetic coding sequence
atgggccgggaggagctgttcctgaccttcagcttcagcagcggctttcaggagtcaaatgtcaaaacattttgcagcaagaatatcctggctatactgggtttttcctccatcatcgctgtgattgcccttctggctgttggcttgacccaaaataaagccctcccagaaaacgttaaatatgggatagtcctggacgcaggaagtagtcacacctccttatatatttataaatggccagcagagaaagagaatgacacgggggtagtgcatcaggtggaagagtgccgcgtgaagggtccagggatttctaaatttgtgcaaaaggttaacgaaataggtatctacctgaccgactgtatggagcgagcccgcgaggtgatccccaggagtcagcatcaggaaacaccagtgtatcttggggcaacagcgggaatgcggctacttcggatggagagcgaggagctcgctgacagagtgctcgatgtggtcgagcgctcgttgtctaactacccttttgacttccagggagcacgcatcattacaggccaggaagaaggagcatacgggtggatcaccatcaattatcttctgggcaagttttctcagaaaactagatggttcagcattgttccctatgagaccaacaaccaggaaacatttggggcgttagacctaggaggagccagcacgcaagtgacctttgttccacagaatcagaccatcgaaagtccagataacgcgttacagttccggctgtatggaaaggattataacgtgtacacccattctttcttgtgctatgggaaagatcaggctttatggcagaagctggctaaggatatacaggtcgccagtaatgagatcctgagagatccatgcttccacccggggtataaaaaggtggtcaacgtctccgacctgtacaaaaccccttgtaccaagcggtttgagatgaccctcccatttcagcagtttgagattcagggaatcggcaattaccagcagtgtcatcagtccatattagagctatttaatacatcgtattgtccctactcccagtgcgccttcaacggcattttcctgcctccccttcaaggcgactttggggctttctctgcattttacttcgttatgaagttcttgaacctaacctcagaaaaggtgtcacaggagaaggtcacagaaatgatgaagaagttttgcgcccagccatgggaggaaattaagaccagttatgccggcgtaaaagagaagtatctctctgagtattgcttctccggtacatatatcctcagcctgttactccaggggtatcactttactgcagactcctgggagcacatccatttcattggcaaaatccaggggtccgacgccggctggactctaggatacatgttgaacctcacgaacatgatccctgctgagcaacccctctctactccattgagccacagcacctacgtcttcctcatggtgctcttcagcctcgtgttattcacggtcgctattattggactcctgatcttccataagccaagctatttttggaaggatatggtgtag

SEQ ID NO: 186289 - DNA, 1554 bp, Artificial Sequence
  Description of Artificial Sequence: Synthetic coding sequence
atgaagggcaccaaggacctgaccagccagcagaaggagagcaacgttaaaacattctgttcaaagaacattttagctattctgggtttttcctcaataattgcagtcatcgccctgctcgccgtcggcctgacgcaaaacaaggccctgcctgaaaacgtcaagtacggcatcgtgttggacgccggctcgtcacatacatcactctacatatataagtggcccgcagagaaggagaacgacactggggtcgtacaccaggtcgaagagtgtagggtcaagggacccgggatatccaagttcgtgcaaaaggtaaacgagataggcatttatctgaccgactgtatggaacgggcccgcgaggttataccccggagccaacaccaagaaactcctgtttacctgggcgccaccgccggcatgaggctcctcagaatggagtcggaagagctggctgatagggtcctcgacgttgttgagagatctctctcaaactatccctttgacttccagggggccagaattatcactggacaagaggagggtgcctacggctggattactatcaactacctgctcggaaagttttcacaaaaaacccgttggttttctatagtcccgtatgaaaccaataatcaggagacctttggcgcgctggacctcgggggagcctcaacacaggtgacgttcgtgccgcaaaaccaaaccattgaatcccccgataatgctcttcagtttaggctttacggcaaggattataatgtgtatacacacagcttcttgtgttacggcaaggaccaggccttgtggcagaagctggcgaaagatatccaggtggcatccaatgagattctgcgcgatccttgtttccaccccgggtacaagaaagtcgtgaatgtatcagatctctataagacgccctgcactaagcgatttgaaatgactttaccttttcagcagtttgagattcagggcattggtaattaccagcagtgtcatcaaagcattctggagctgttcaatacatcttattgcccttactcacagtgtgccttcaacgggatctttttgccccccctacagggagactttggagcattttccgcgttctacttcgttatgaagttcttgaatctcaccagtgagaaggttagtcaggagaaggtgacggaaatgatgaaaaagttttgcgcacagccctgggaagaaataaagacctcctatgctggcgttaaagagaagtaccttagcgagtattgtttttccggtacttatatacttagcctgctgctgcagggataccattttaccgctgattcctgggagcacattcactttattgggaagatccagggctcagatgcaggatggaccctcggatacatgctgaatttgacgaacatgattccggcagaacaaccactgagtacccctttgtcccatagcacttatgtctttctgatggtgcttttcagccttgtcctgttcaccgtggccattattggactgctaatttttcacaagccttcgtacttctggaaagacatggtgtag

SEQ ID NO: 186290 - DNA, 1119 bp, Artificial Sequence
  Description of Artificial Sequence: Synthetic coding sequence
atggagagcgaggagctggccgaccgggtgctggacgtggtggagcgttcgctctctaactatccattcgacttccagggcgccagaataattacaggtcaggaggagggtgcttacggctggatcactattaattaccttctaggcaaattctcccagaaaacccgctggttcagcatcgtcccatacgagaccaataatcaggagacgttcggggctctggacctgggaggcgcctcaacacaggtcacctttgttcctcagaaccagacgatcgaatcgcctgacaatgccctgcaattccgtctatacggaaaagactataacgtatatactcactcctttctgtgttacggcaaggatcaggccctctggcagaagctggccaaggacattcaggtggcctcgaatgaaatcctgagagatccgtgctttcaccccgggtataagaaggtggtgaatgtgtccgacttgtataaaaccccctgtaccaaaaggtttgagatgaccctacccttccagcagttcgagattcaagggataggcaactaccaacagtgccaccagagcatactggagttattcaacactagttattgtccatatagtcagtgtgcatttaacggcatttttttgccacccttgcagggggattttggcgccttctccgccttttacttcgttatgaaattcctcaatctaactagtgagaaggtcagccaggagaaggtaaccgaaatgatgaaaaagttctgcgctcaaccatgggaggagatcaaaacatcatatgccggagtgaaagaaaagtacctaagtgagtattgcttttccggtacatacatccttagcctgttattgcaaggataccacttcaccgccgactcatgggagcacattcacttcattgggaagatccaaggttccgatgctggttggacactggggtatatgctcaacctgacaaacatgatcccggcagaacaacctctatctaccccactgtctcattccacatacgtttttctcatggtcttgttctctctagtactctttaccgtcgccatcattggcctgctgattttccacaaaccctcctacttctggaaagacatggtatag

SEQ ID NO: 186291 - DNA, 1209 bp, Artificial Sequence
  Description of Artificial Sequence: Synthetic coding sequence
atggagcgggcccgggaggtgatcccccggagccagcaccaggagactccagtctatctaggggcaactgccggaatgagacttctgagaatggaaagcgaggagctggctgacagggttctggatgtagtcgagcgaagtttaagcaactaccctttcgacttccaaggggcacgaatcatcacgggacaggaggagggggcttacggatggattactatcaactacctcttggggaagttttctcagaaaactaggtggtttagtattgtgccgtacgagacaaacaatcaggaaacattcggcgctctcgacctgggcggcgcctctacccaggtcacttttgtcccccaaaatcagacaattgaaagccccgataacgccttgcaattccgattgtacggaaaggattacaatgtttatactcactcttttctctgctatgggaaggatcaggccttgtggcaaaaattggcgaaggacatccaggtagcatctaatgaaatcctgcgagatccttgctttcatcccggatacaaaaaagtggtcaacgttagtgatttgtacaaaacaccatgcactaagcgcttcgaaatgacactgccctttcagcagttcgagatacagggaattggaaactaccagcagtgccaccagtcaatcttggaactgtttaacacctcatactgcccctattctcagtgcgcctttaacggtattttcctgcctcctctgcagggcgattttggggcattctcagctttttactttgtgatgaagtttcttaatctgactagtgagaaggtgtcccaggaaaaggtgaccgaaatgatgaagaaattttgtgcacagccttgggaggaaatcaagacatcatatgccggagtaaaagagaagtatctgtcagagtattgcttttcaggaacatatatcctaagccttctgctgcaagggtatcatttcactgcagactcttgggaacacatccactttatcggcaagatccagggcagcgatgctgggtggactctcggctacatgttgaacctgacaaacatgattcctgcagaacaacccctgagcactcctctgtcacattccacctatgtatttttgatggtgttgttttcactggttctcttcaccgtggcaataatagggctgctgatctttcataagccttcttacttctggaaagatatggtgtag

SEQ ID NO: 186292 - DNA, 1419 bp, Artificial Sequence
  Description of Artificial Sequence: Synthetic coding sequence
atggccggcaaggtgcggagcctgctgccccccctgctgctggccgctgccgggctggctgggcttttgcttctgtgtgtgccaaccagagacgtgcgcgagccaccggccctcaagtatggcattgtgctagacgcaggctcctctcacacaagcatgttcatttacaaatggcccgcagataaggagaatgataccggcatagttggacaacactcaagctgcgatgttccaggaggggggatttctagctacgccgataaccctagcggcgcctctcaatcattagtcgggtgtttagaacaagcgttacaggacgtgccaaaggaacgccacgccggcacccccctctacctaggggccactgccgggatgaggctacttaacctgacaaacccagaagctagtacctccgtgctcatggcggtgacccacacactgacccagtacccttttgactttagaggggctaggattctgtcaggacaggaggaaggggtgttcgggtgggtgacagcgaattatcttttggagaattttattaaatatggatgggtgggccgctggttcaggccgagaaaagggactctgggtgctatggatctggggggcgcatcgacccagattactttcgaaactacctctcccgccgaagatcgcgcgtccgaagtgcagcttcatctgtatggacagcactatcgggtttacacacattcgttcctatgttatggccgggaccaggtcctccagcggttgttagccagcgccctgcagacgcatggcttccacccctgctggccccgcgggttctctacacaggtgctgctcggcgacgtttaccaatccccatgcactatggctcagagaccacaaaacttcaatagttcagctagggtcagtctaagtgggtcctcagacccccacctttgccgggacttggttagcggtctgttctctttttccagttgtccattctcaagatgttccttcaacggcgtctttcagccacccgtggccggaaatttcgtcgccttctccgcttttttctacactgtggactttttaaggaccagtatgggactgcctgtggctacgttgcagcagcttgaggcggctgccgtaaatgtctgtaaccagacttgggctcagcaactcctgagccggggttatgggttcgatgaaagggccttcggcggagtcatttttcagaagaaagccgccgacaccgcagtggggtgggcactaggctatatgctgaatctgaccaacttgatcccggcagatccccctgggcttagaaagggcacagattttagctcatgggtcgttctgctcctcttgtttgcatcggccttgctggccgcactggtgctgctgctgcgacaggtgcacagcgcaaagctgcctagcaccatatag

SEQ ID NO: 186293 - DNA, 1488 bp, Artificial Sequence
  Description of Artificial Sequence: Synthetic coding sequence
atggccggcaaggtgcggagcctgctgccccccctgctgctggccgcagcagggcttgccggcttattgctgctgtgcgtccctactcgggacgtgcgagagcccccagctctgaagtatggaattgtcctagacgctggatcctcgcacacatcaatgttcatttacaagtggcccgcagacaaggaaaatgacactggcatcgttggccaacatagctcatgtgacgtgccgggtggtggaatcagctcatacgcagataatcctagtggggccagccagtcgctggtcggctgcttggagcaagcactgcaggatgtgcccaaggagcgccatgccggtacacccctgtacctgggggcaacagccggaatgcggctgctcaacctgactaaccccgaagcgtccacgtcagttctcatggcagtaactcacaccctgactcagtacccgtttgactttcgaggggcccgtatcttgtccggacaagaggagggcgtctttggctgggtgaccgcgaactatttgctcgagaacttcatcaaatacggttgggtcggcagatggttccgccctagaaagggcacattaggcgccatggacctggggggcgcttccacccagatcacattcgagaccacatcgcccgcggaagacagagctagcgaggtacagctgcatctttacggccaacattatcgcgtttatacccatagcttcctgtgttatgggagggatcaggtgctgcagaggctcctcgcctcagctctgcaaacccacggtttccacccttgttggcctcggggcttcagtactcaggtgctcctgggtgatgtttaccagtcaccttgtactatggcacaaagaccccagaatttcaattcttccgctagagtgtcattatctggaagcagcgatccacacctgtgcagagatctggtgtccgggctgtttagcttctcaagttgcccattctcccgttgcagtttcaacggcgtattccagcctcctgtggccggtaactttgtggctttttctgctttcttctatacagtcgatttccttcggacatctatgggacttccagtagcaaccctacagcagttggaagctgccgctgtgaatgtgtgtaaccagacttgggcacaactacaagctagagtgccaggtcagcgggcccgtctcgcagattattgtgctggggccatgtttgttcagcaattactcagtaggggctacggattcgatgagcgggcctttggcggcgttatcttccagaagaaggccgccgatacagctgttggctgggccctcggctatatgttgaacctgactaatctcattccagccgaccctcctggtttgagaaaggggacagacttttcctcatgggtggtgctacttctcttgtttgccagtgcactgctggccgccctcgtacttttactccgtcaagtccacagtgccaagctgccgagtactatctag

SEQ ID NO: 186294 - DNA, 1590 bp, Artificial Sequence
  Description of Artificial Sequence: Synthetic coding sequence
atgttcaccgtgctgacccggcagccctgcgagcaggccggcctgaaggccctgtatcgcacccctacaatcatcgcgctggtggtgttactggtgtctatcgtggtcttggtgtcaataactgtgattcaaatccacaagcaagaagtactgccccccggcctgaagtacgggatcgtgctggatgccggcagttcccgaacaacggtatatgtttatcagtggccggcagagaaagaaaacaacaccggggtggtgagccagaccttcaaatgcagtgtgaagggatccggcattagttcatacggtaataaccctcaggacgttccccgtgcattcgaggagtgtatgcaaaaggtgaaggggcaggtgccttctcatttacatggcagtacaccaattcaccttggtgccacagcgggaatgcgtctgctgcgcctccaaaacgagaccgctgctaacgaagtcctggaaagcattcaaagctactttaagagtcagcccttcgacttccggggagctcagatcatctccggccaagaggaaggagtgtacgggtggattacggccaactacttgatgggcaacttcttagagaagaacctgtggcacatgtgggtgcacccgcacggcgtcgagacgaccggagcactcgacctgggcggggcatccactcagattagcttcgtggcgggtgaaaaaatggacctcaatacttctgacataatgcaggtgtccctgtacggctatgtgtacacattatatacacatagcttccagtgctacggccgaaacgaggctgagaaaaaatttcttgcgatgctcttgcagaactcccccaccaaaaaccacctcaccaacccttgctatccaagagattattcaatttcttttaccatgggtcatgtctttgattcactgtgtaccgtggaccaaagacccgagtcctataacccaaatgatgtgattacattcgagggtaccggagacccaagtctgtgcaaggaaaaagtggcctctatctttgactttaaagcatgccatgatcaggaaacttgttctttcgatggggtgtaccagcccaagataaaaggtccttttgtggcttttgccggcttttactacacagccagcgcactgaacctcagcggatcctttagtttggacaccttcaatagcagcacatggaacttttgcagtcagaactggtcgcagctgccgctgctcctgcccaaattcgacgaggtttacgcacggtcctattgcttttccgctaattatatctaccatttgtttgtgaatggctacaagtttaccgaagagacctggccccaaattcacttcgaaaaagaagtcggcaactcaagcatagcatggtccctgggatacatgctgagcctgaccaaccaaatccctgccgagtccccattgataaggctgcctatcgaacccccggtatttgtaggcactctggcctttttcactgctgccgcactgctctgcctagcgttcctcgcatacctgtgtagcgcaacaaggcgaaagagacattctgaacacgcctttgatcacgcggtggacagtgactag

SEQ ID NO: 186295 - DNA, 1590 bp, Artificial Sequence
  Description of Artificial Sequence: Synthetic coding sequence
atgttcaccgtgctgacccggcagccctgcgagcaggccggcctgaaagccttgtatcgcactcccaccataattgcattggttgtcctcctggtgagcatcgtagtgttagtgagtatcaccgtcattcagattcataaacaagaggtattacctccaggactgaagtacgggatagttttggacgctggttctagtaggacaacagtgtatgtgtaccagtggccagcagagaaggagaataacactggagtggtgtcacagacctttaagtgctcggtgaagggatccggcataagctcctatggtaacaacccccaggatgtaccccgggcgtttgaggagtgcatgcagaaggtgaaagggcaggtgcctagccaccttcacggatccacccccatccacctgggcgccaccgccggtatgcgcttacttcgactgcagaacgagacggccgccaacgaagtgttggagtcaattcagtcgtatttcaaaagccagcccttcgactttaggggtgcccaaatcatctcagggcaggaggagggagtgtatggatggatcaccgccaactatctcatgggcaactttttggagaagaacttgtggcacatgtgggttcacccacatggggttgagactaccggtgcgctagacctggggggagctagtacacagatatcctttgttgctggcgaaaaaatggatctcaacacgtcagatattatgcaagttagcctgtacgggtacgtgtacactttatatacgcacagcttccaatgctatggtcggaacgaggcagaaaagaaatttctggcgatgctcttgcaaaattcaccgaccaagaatcacctgaccaacccctgctatcccagagactactctatctcattcaccatgggacatgtgttcgactctctgtgtactgtcgaccagaggcctgagtcttataatccgaacgatgtgattacattcgagggaactggtgatccaagcctatgcaaggagaaagtggccagcattttcgactttaaagcttgtcatgaccaggaaacgtgttcatttgacggagtgtaccaacctaaaattaagggtccgtttgtggcatttgctgggttttactataccgcttctgcgctgaacctctccgggtctttcagccttgacaccttcaacagcagcacttggaacttctgttcccaaaactggagccagctgccactcctgctgcccaagttcgacgaggtgtatgcgcggtcctattgcttttctgccaactatatttaccatctgtttgtaaacggctataagttcaccgaggaaacttggccacaaattcattttgaaaaggaggtgggcaattccagcattgcatggagcttgggctatatgctctccctcacaaaccaaatacctgcggaatcaccactgatccgcttaccaatagaacccccagtcttcgttggaaccttggcctttttcaccgccgctgcactcctctgtctggcgttcctggcttacctctgttctgccacgagacggaagagacattccgagcacgcattcgaccacgctgtggactccgactag

SEQ ID NO: 186296 - DNA, 1287 bp, Artificial Sequence
  Description of Artificial Sequence: Synthetic coding sequence
atggccaccagctggggcaccgtgttcttcatgctggtggtgagctgcgtgtgttctgcagtcagtcaccggaatcaacagacttggttcgagggcatttttttgtcatcaatgtgtcccatcaacgtgtccgcatccactttatacggtataatgtttgatgctggttctacagggacacgcattcacgtttacacattcgtgcagaaaatgcccggccaattgcctattttggaaggcgaggtcttcgacagtgtgaagcccggtctatcagcattcgtcgatcagcccaagcagggagccgagactgtccaaggactgttggaggtggcaaaagactcaattccacgaagccattggaagaaaactccagtagtgctcaaagctactgcaggactgcgactcctccccgaacataaagcgaaagctttattatttgaggtgaaggagatctttaggaaaagcccatttttggtccccaagggctcggtgagcattatggacgggagtgatgagggcattctggcatgggtcacagtcaactttctcaccggacagttgcatggccatcggcaggaaaccgttggcaccctggatctgggcggtgcctccacccagattacgttcctgcctcagtttgaaaagactcttgagcagacgcccagaggctacttgacctctttcgagatgtttaattccacatataaattgtacacccattcctatctcggattcggtctcaaggccgcgcggctggcaacactgggagctctcgagaccgagggcaccgatggccacacatttaggtcagcttgcctgcccagatggttggaggccgaatggatctttggcggcgtcaagtaccagtatggggggaaccaggaaggagaagtgggcttcgagccatgttatgccgaggtactgagggtggtaaggggcaaactccatcagcctgaggaggtccagcgaggcagtttctacgccttttcctactactatgacagggctgtagataccgacatgatagactacgagaaggggggaattctgaaggtcgaagacttcgagcgcaaggcgcgggaagtttgtgataatttggagaacttcacatcaggctcaccatttctgtgcatggatctcagttacatcacagccctgctcaaagacggttttggatttgccgactccaccgtcctgcagctgacgaagaaagtgaacaacatagagaccggttgggcattgggggctaccttccacctgctgcagtcactaggtatctcccactag

SEQ ID NO: 186297 - DNA, 1404 bp, Artificial Sequence
  Description of Artificial Sequence: Synthetic coding sequence
atgcagccccagcacggcccctggcagacccggatgcggaagatctccaatcatggctcacttagagtggccaaggtggcctaccccttaggactgtgcgtgggggtctttatttatgttgcctacattaagtggcatcgagccaccgcaacccaggccttcttctcaattaccagagccgccccgggtgcccgctggggccagcaggcccattctccacttggcacggcagctgacggacacgaagtcttctatggcataatgtttgatgcgggatcgactggcacgcgggtccacgtgtttcagttcacaaggcctcctcgcgagacgcctacgctcactcacgagaccttcaaagctcttaaacccgggttatccgcatatgccgatgatgtcgagaaatctgcacaggggatccgtgaattactcgatgtggctaaacaagatatcccttttgacttttggaaagccacaccgctcgtgctgaaggcgacggctggtcttagactcctgccgggcgaaaaggctcagaagctcttgcagaaggtcaagaaggtcttcaaggcatctccctttcttgttggcgacgattgtgtgagcattatgaacggcacagatgaaggggtcagtgcttggattactattaatttcctgactggaagcttgaaaaccccggggggatccagcgtcggtatgctcgacctggggggtggctctacacagattgcttttttacctcgggtcgaagggactctgcaggcttctccccccggatacctcaccgcgttgcggatgtttaatcgtacatacaagctgtacagctattcctacctcgggttgggacttatgtccgccaggttggccatactgggcggcgttgaaggccaacctgctaaagatggcaaggaactcgtatctccgtgcctgagcccaagctttaaaggcgagtgggagcacgccgaagtgacataccgcgttagtgggcagaaggccgcagcctctctccatgagctatgtgccgctcgagttagcgaggtcctccagaaccgcgtgcatagaacagaggaggtcaagcatgtcgacttctacgcgttcagttattattatgacttagcagcgggtgttgggctgatagatgctgagaaaggaggcagcctggttgtgggggactttgagatcgctgcaaaatacgtatgccgcaccttggagacacagccacagagtagccctttctcctgtatggacctgacgtatgtgtccctgcttctacaggagtttggtttcccccgctctaaagtgctcaaacttacacgaaagatcgataatgtagaaaccagttgggcattaggtgccattttccactatatagatagcctcaaccggcaaaagagtcctgcgagctag

SEQ ID NO: 186298 - DNA, 1452 bp, Artificial Sequence
  Description of Artificial Sequence: Synthetic coding sequence
atgaagaagggcatccggtacgagaccagccggaagaccagctacatattccagccacagcacggcccgtggcagacccggatgagaaaaatttcgaatcacggatcattacgggtggctaaggtcgcctacccccttggcctgtgcgtcggcgtattcatttacgtggcatatattaagtggcacagggccaccgcaacacaggcattcttcagtattacacgtgctgcccctggagctcgatgggggcagcaggcacactccccactgggcacagccgccgacggacacgaagtcttctacggcatcatgttcgatgccggttccacgggcacaagagttcacgtgtttcaatttaccagaccacctcgagagaccccaacactcactcacgagacctttaaagctctgaagcctggtttgagcgcttacgccgatgatgtggaaaagagtgcccaggggatccgagaactattggatgtggccaagcaagatattccattcgatttctggaaggccacgcccctcgtgttaaaggccaccgccggcctccgtttgttgccaggtgaaaaggcacaaaaactgctacagaaggtgaaaaaggtgtttaaggccagtccattcctcgtgggcgacgactgtgtaagcatcatgaacggaactgacgagggcgtgtcggcttggattacaataaactttctcactggtagtctgaagacccctgggggctcatccgtaggtatgttggacttgggcggtggatctacgcaaatcgctttcttgccccgcgtggaaggcaccctacaggctagtccgccaggttatctaactgctttgcggatgtttaatcgtacttataaattgtactcatactcatatctcggtttagggctgatgtccgctaggctcgccattttaggcggtgtggagggacaacctgccaaggacggcaaggaactggtatcaccttgcttaagtccctcttttaagggagaatgggaacatgccgaggttacttacagagtaagtggccagaaagctgcggcctccctgcatgagctgtgcgctgctagggtatccgaagtgctgcagaatagagtgcacaggactgaagaagtaaagcacgttgacttctacgccttcagctactactacgatctagcggcgggagtgggcttaattgacgctgagaagggaggctctcttgtggttggagacttcgagatcgccgcgaaatatgtatgtcgtacattagaaactcagccgcagagtagcccgttttcctgcatggacttgacttacgtttctctgctcctccaagagtttggcttccctcgtagcaaggttctaaagttaactaggaagatagataacgtggagactagctgggccttgggcgctatttttcactacatagattccctgaaccggcagaagtcacccgcttcatag

SEQ ID NO: 186299 - DNA, 1104 bp, Artificial Sequence
  Description of Artificial Sequence: Synthetic coding sequence
atgttcgacgccggcagcaccggcacccgggtgcacgtgttccagtttacacgaccacccagagaaactcctacattaacgcatgagacttttaaggcgctaaagcccggcctatctgcctacgccgacgatgtcgagaagtcggctcaggggatacgggagctgctggatgtcgcaaaacaggatatacccttcgatttttggaaagcaactcctctggtactcaaggccaccgccggcttgcgcctgttgcccggcgagaaggcgcagaaactgctccagaaggtgaagaaggtattcaaggcctctccgttcctcgtgggtgacgattgcgtttcaatcatgaatggcaccgatgaaggagtatccgcatggataacaattaatttcctgactggcagtctcaagaccccaggaggctcttccgtcggcatgctggatctggggggcggatctacccaaatcgcatttctcccacgcgtcgaagggactctgcaggcaagcccccctggctacctcaccgccttacggatgttcaatagaacctataagctctattcctatagctaccttggattgggcctgatgtcagcacgcctcgcaattttagggggggtggaggggcagccagctaaagatggcaaggagttggtctcgccgtgtctttccccctcgttcaagggcgagtgggagcacgcggaagttacgtatagagtgtccgggcaaaaagcagcagcgtccctccacgagctatgtgccgcccgagtatcagaagtccttcagaatcgagttcataggacggaggaagttaagcacgttgacttttacgccttttcttactattatgacttagctgcgggcgtcgggctgatcgacgcggagaagggcggctctcttgtggtgggggacttcgaaattgccgcaaaatacggcggatctcacctggagcgagagggcacttgtctgatcccctccgtatctgaccctggcgacactgcggctgaacagccgctcctgatgcatggtccccacctgaggcaaccagccacgccaggcgtgagactttctcaggaacagagcgccgaggcgcactccgagaactag

SEQ ID NO: 186300 - DNA, 1455 bp, Artificial Sequence
  Description of Artificial Sequence: Synthetic coding sequence
atgaagaagggcatccggtacgagaccagccggaagaccagctacatattccagcaaccacaacacggcccgtggcagacccggatgcggaagatcagcaaccacggatctctccgggtggctaaggtggcatacccacttgggttgtgcgtgggagtgttcatttacgtcgcctatatcaagtggcacagagcaactgctacacaagctttttttagtatcacgcgagcagctccaggtgccagatggggccagcaagcccactcgccactgggtacagctgccgatggccacgaagtcttctacggcatcatgtttgacgccggctctacaggaacccgagtacatgtgtttcagtttacacggccaccccgggaaactccaacacttacacatgaaacctttaaagctcttaagcctggactcagcgcctatgccgatgatgtggagaaatccgctcagggtatcagggaactgctcgacgtggccaaacaagatatcccatttgacttttggaaagcaactcccctcgtgctgaaagccactgccgggcttcgcctcttgcccggggaaaaggcccagaaactcctccaaaaagtgaaaaaagtattcaaagcttcaccattcctcgtgggcgacgactgtgtaagcattatgaatggcacagatgaaggcgtgagcgcttggattactattaactttttaacagggagtctgaagacacccggcggatcatcagtcggtatgctcgacttagggggaggctccacccagattgcattccttccacgcgtggaaggcaccctccaagcctctcctccgggctacctgacagccctgaggatgttcaatagaacttacaaactttactcctattcatatttggggctgggacttatgagcgcccgacttgctattctcggcggggtcgaaggacagccagccaaggacggcaaagaactggtatcgccctgtcttagcccatcattcaagggggagtgggaacacgccgaagttacttatagggtttctggtcagaaggcagcggcttcactgcatgagctgtgtgccgctcgcgtgtcagaggtcctgcagaacagggtgcacaggacagaggaagtcaagcacgttgacttctatgcattttcttactactatgacctggccgctggagtagggttaattgacgcggaaaaaggaggaagcctcgtcgtgggggattttgaaattgcggccaagtacgtgtgcaggactcttgagactcagccacagagctcccccttttcctgcatggatctcacctacgtgtcccttctacttcaagagttcggtttcccaaggagcaaagttttaaaacttacaaggaagattgataacgtggaaacgtcctgggcgctgggtgccattttccattacattgactcattgaatcgccagaaatctccggcctcttag

SEQ ID NO: 186301 - DNA, 888 bp, Artificial Sequence
  Description of Artificial Sequence: Synthetic coding sequence
tgagtgctgaaggccaccgccggcctgcggctgctgcccggcgagaaagcccagaagttgctgcagaaggtgaaaaaggttttcaaagcttccccttttctggtaggcgatgactgtgttagcatcatgaacgggacggacgagggagtctcagcatggataaccataaatttcctgacagggtccttaaaaacccccgggggatcaagtgtcggaatgctggacctgggaggtggttccacccagatcgccttcctgccacgggtagagggcacactccaggcatcgccacctggatacctgaccgccttacgcatgttcaaccgcacatacaagctatactcatatagttacctgggactggggctcatgagcgcgcgactcgctattctgggaggcgtcgagggtcagccggctaaggacgggaaggaattagtctctccttgcctcagcccctcttttaaaggagaatgggagcacgccgaagtcacttaccgggtgtctggccagaaagccgccgccagtcttcacgaactctgtgctgccagggtgtccgaagtacttcagaaccgtgtgcaccggacagaagaggtaaaacacgtggatttttatgctttcagctactattatgatctggcggctggcgtcggtcttatcgatgccgagaaaggaggctcactggtcgttggcgatttcgaaatcgcagctaagtacggagggtcccacctggaaagggaagggacctgccttattccctcggtgagtgaccccggagacacagcagccgagcaacccttgctcatgcatggaccccatcttcgccagcccgccacacccggagtcagactctctcaggaacaatccgctgaggcacattctgaaaattag

SEQ ID NO: 186302 - DNA, 681 bp, Artificial Sequence
  Description of Artificial Sequence: Synthetic coding sequence
atgccccagcacggcccctggcagacccggatgcggaagatcagcaaccatggaagtttgcgggttgcaaaggtggcctatccgctcgggctctgtgtaggagtgttcatttatgtggcctatatcaaatggcatcgggccaccgctacccaggcttttttcagtatcactcgcgcagcccccggagcccgctggggtcagcaggcacattcacctctaggtacggcagcagatgggcacgaagtgttctacggtattatgtttgacgccgggagcactgggaccagggtgcacgtatttcagtttacccgtcctcctcgggaaacacccactctgacccatgagaccttcaaggctctgaaacccgggcttagcgcatacgcggatgacgtggaaaaagttaagaaagtgttcaaggcaagcccatttttagttggggacgattgcgtgagtattatgaatggcaccgacgagggggtgtcagcctggatcacaataaatttcttgacagggagcctaaagacccctggaggatcatctgtcggtatgttggacttgggaggtggatccacccagatcgctttcctgccacgcgtggagggaacacttcaggcatctccacctggctatctgactgcacttcgcatgttcaacaggacttacaagctatatagctattag

SEQ ID NO: 186303 - DNA, 588 bp, Artificial Sequence
  Description of Artificial Sequence: Synthetic coding sequence
atgcagccccagcacggcccctggcagacccggatgcggaagatcagcaaccacggaagcctgcgcgtcgcaaaagtggcttacccactggggctatgcgtgggggtgttcatttatgtggcatatatcaagtggcatcgggcaactgccacgcaagccttttttagcataactcgggcagccccaggtgctcgctggggccaacaagctcacagccctctgggcactgctgccgacgggcacgaggtgttttacggcatcatgttcgatgcaggaagcacgggcactagggtgcacgtgttccagtttaccaggcctcctagagaaacccctaccctcacccatgaaaccttcaaagctctgaaacccgggctctcggcctacgccgatgacgtcgaaaaggtcaaaaaagtcttcaaggcctcaccgtttctggtgggcgacgactgcgttagcatcatgaatggtactgatgagggtgtgagtgcctggattacaatcaactttctgacgggctcgctcaagactcctgggggcagctcagttggaatgttggatcttggaggggggtctactcagatcgcctag

SEQ ID NO: 186304 - DNA, 903 bp, Artificial Sequence
  Description of Artificial Sequence: Synthetic coding sequence
atgaagaagggcatccggtacgagaccagccggaagaccagctacatatttcagcaacctcagcatggaccttggcagaccaggatgaggaagatttccaaccatggcagtctgcgtgtggccaaggtggcctacccgctagggttgtgcgtcggagtgttcatttacgtggcctatatcaagtggcatagggcgactgccacccaggcattctttagcattacccgagccgcaccaggggctcgatggggtcagcaggcccactcacccctgggaacagccgcagacggacacgaggttttctacggaatcatgttcgatgctgggtcaaccggcacgcgcgttcacgtttttcaatttactaggccaccccgggagacacccactctgactcatgagacctttaaagctctgaaaccggggttgtccgcctacgccgatgatgtggagaaggtgaaaaaggtgttcaaggcttcccccttccttgtgggagacgattgtgtaagtatcatgaacggaacagacgagggggtatcggcttggattacgatcaacttcctgactggttctctcaagacacccggcgggagcagcgtggggatgctcgatctcggaggtggcagcactcagatagcctttttgcccagagtggaaggtactctgcaggcttctccgcccggttacctaactgcactgaggatgtttaatagaacatacaaactatacagctacagctatctaggactaggcctgatgagcgcccgcctggctatcctgggcggcgtggaaggtcagcctgcaaaagacggaaaggaactcgtatctccctgtctctcccccagttttaagggtgaatgggagcacgccgaggttacttatagggtttctgggcagaaggcttag

SEQ ID NO: 186305 - DNA, 453 bp, Artificial Sequence
  Description of Artificial Sequence: Synthetic coding sequence
tgacccggccggggcagccccaaggaccggctgccccccgccccccgcaaaagagctctcgtcagcgttggggtggccgagcgtgccgtgcacgagaccccaacactgacacacgagactttcaaagccctcaagccaggactgtctgcttacgctgatgacgttgaaaaagtcaagaaagtgttcaaagcctccccatttttggtgggagatgactgtgtgtcgatcatgaatggcactgatgaaggtgtctcagcatggataactataaactttctgaccggaagtttgaagacaccaggagggtcctcagtcggcatgctggatctcggcggtggttcaacccaaatcgcgtttttacccagagttgaaggcactcttcaagcgtccccacctggttacctgaccgcccttcggatgtttaaccgcacatataaactgtattcctactag

SEQ ID NO: 186306 - DNA, 1314 bp, Artificial Sequence
  Description of Artificial Sequence: Synthetic coding sequence
atgaagaagggcatccggtacgagaccagccggaagaccagctacatttttcagcaaccacagcacggaccctggcagactcgtatgcgaaagatctcaaaccacgggagtttaagggtcgccaaggtggcgtatcctttaggactgtgtgtgggcgtatttatctatgtagcttacattaagtggcatcgcgctacagctacacaggcattcttcagcatcacacgtgctgcacccggagctaggtggggtcagcaggcccacagtccactagggaccgccgcagacgggcacgaggtgttctatggaattatgtttgacgcggggtcaaccggaacgagggttcacgtatttcaatttacccgccccccccgagagacgcccaccctaacgcacgagacctttaaagctctcaagccagggcttagcgcttatgctgatgatgtggagaaaagtgctcaaggtattagagagcttctcgatgtcgccaaacaggatatccctttcgatttttggaaggcaacacccctcgtgttaaaagctacggccggactcaggctactgcctggggagaaagcccagaagctgctgcagaaagtaaagaaagtgttcaaggctagccccttcctcgtgggggatgactgtgtctccatcatgaatgggaccgatgaaggggtaagcgcttggattacgattaattttcttaccggttcattgaagacccccggaggtagtagcgtcggcatgctggatctgggcgggggttctacccagatcgccttcttgcctagggttgaaggaactctgcaggcatccccacccggttatctgactgccctccgcatgtttaaccgaacctacaagctgtactcatattcctacctcggcctcggattgatgtctgctcgtctggctatccttgggggggtggaagggcaaccggcagcttcgttgcatgaattgtgtgccgcacgcgtttctgaggtgctccaaaatagggttcatcggacagaagaagtcaaacacgtggacttctacgcattttcatattactacgacctggcagcaggagtgggactcatcgatgctgagaaaggtggatccctggttgttggagacttcgagatcgccgccaaatacgggggcagtcacttagagagggagggaacgtgtctgataccaagtgtaagtgaccctggcgataccgccgccgaacaaccattgctgatgcatggtcctcatttacggcagccggccacacctggcgttaggctgtctcaggaacagtccgcagaagctcactccgaaaactag

SEQ ID NO: 186307 - DNA, 945 bp, Artificial Sequence
  Description of Artificial Sequence: Synthetic coding sequence
tgaaaccggggcgtggtgagccggggctggcggcccggctggcggagacccgggagaggctcaccaaaagatcgactgcccccagctcctaggaagcgggcgctggtttcagtcggcgttgccgagcgtgctgttcatgaaacccccactctcacacacgagacattcaaagcactgaagccaggcctcagtgcatatgccgacgacgtggaaaaaagtgcacaaggcatacgcgaactgctggacgtagctaagcaggatatcccgttcgacttctggaaggcaaccccactcgttctgaaagccactgcagggctgcgactcctcccaggggaaaaggcccagaaacttctgcagaaggtgaaaaaggttttcaaggcctctcccttcctagtaggcgacgattgtgtcagcattatgaacggaacggacgagggagtgagtgcctggatcaccattaatttccttactggcagtttgaagacacccggcggatcatctgttggaatgctggatctgggagggggcagcactcagatagcgtttctgcctcgcgtcgaaggtaccctgcaggcttccccccctggctacctgactgccttacgaatgttcaatcgcacttataaactgtattcgtactcgtacctgggacttggcctcatgtctgctcgtctcgccatcctgggtggcgtggaaggccagcctgccaaggatggaaaggagcttgtctccccctgcctgtcaccttctttcaagggcgaatgggagcatgctgaggtgacgtaccgcgtgagtgggcagaaggcagctgcctcactgcatgaactctgcgctgcccgtgtttctgaggtgctgcagaatcgtgttcaccgtactgaagaagtcaagcacgtagacttctacgccttcagctactattatgacttggccgccggagtggggtag

SEQ ID NO: 186308 - DNA, 567 bp, Artificial Sequence
  Description of Artificial Sequence: Synthetic coding sequence
atgaagaagggcatccggtacgagaccagccggaagaccagctacatttttcaaccgcagcacggcccttggcagactcgcatgcgcaaaatttcaaaccacggatctctcagagttgctaaggtagcttatcccctgggcctctgtgtcggtgttttcatttatgttgcctatatcaaatggcaccgggcgacagctacccaggccttctttagcattaccagagctgctccaggagcacggtggggacagcaggcccactctccattgggcactgccgcggacggccatgaggtgttttacggtattatgttcgatgcagggtcgaccggtactagggtccacgtctttcagtttacaaggccaccaagggagacccccaccctgacccatgaaacctttaaggcgctaaagccaggcctgtccgcctatgccgacgacgtggaaaagtctgcccagggaatcagggaacttctcgatgtggccaagcaggacatcccatttgacttctggaaggccactccactcgtcttgaaggcaaccgcagggcttcgtctgctcccttag

SEQ ID NO: 186309 - DNA, 891 bp, Artificial Sequence
  Description of Artificial Sequence: Synthetic coding sequence
atgccccagcacggcccctggcagacccggatgcggaagatcagcaatcatggcagcctgcgggtggctaaggtggcctatcctctgggcctgtgtgtgggagtgttcatctacgttgcttacatcaaatggcacagagcaactgctactcaggccttcttctctatcacaagggccgccccaggcgctcggtgggggcaacaggctcacagcccacttggaactgcagcagacggtcatgaagtattttacggtattatgttcgacgctggtagtactggaactcgcgtgcacgtcttccagttcaccaggcctccccgagagacccctactctgactcatgaaacattcaaggcactcaagcctggcctgtctgcctacgcagatgatgttgagaaaagtgcccagggtattagggaactgctggacgtggccaagcaggacatccccttcgatttctggaaggctacaccactcgttttaaaggccactgccgggttgaggctgctgcccggcgagaaggctcagaaactcctgcagaaggtgaagaaagtgtttaaagcctccccattcctcgtgggggatgactgcgtcagcatcatgaatggcaccgatgagggggtgagtgcgtggattactataaatttcctcacaggctccctcaagacacccggcggttcatccgtcggaatgctcgacctcgggggcggttccacgcagatcgcctttctaccaagggtggaggggaccctgcaggcatctccacctggataccttacggccctaagaatgttcaaccgcacatataagttatacagctactcgtatctgggccttgggctgatgtctgcccgcctcgctatcctggggggagtagaaggccagccttag

SEQ ID NO: 186310 - DNA, 936 bp, Artificial Sequence
  Description of Artificial Sequence: Synthetic coding sequence
tgaggcagcaccggcacccgggtgcacgtgttccagttcacccggccccccagggagacccctacactgacacacgaaactttcaaagctctgaagccaggcctgtctgcttacgccgatgacgtcgagaaaagtgcgcaaggcatccgcgaacttctggatgtcgcaaagcaagacattccgttcgatttttggaaggcgacaccactagtccttaaggctacggccgggctgcgcttactgccgggggagaaggcccagaagttgctgcaaaaggttaagaaggtttttaaagccagcccttttctggtaggagatgattgcgtctctataatgaacggcacggatgaaggggtctccgcttggattaccattaatttccttacaggctcactgaaaaccccaggggggtcttccgtcggaatgttagatctcggtggcgggtctacccagatcgcatttctgcctagagtcgagggtacattgcaggccagcccgcctggctacctgacagctttgcggatgttcaataggacatacaagctctactcatatagctatctggggctaggtctgatgtcggcgcggctggccattttaggtggcgtcgaaggccagcccgccgccagcctgcacgaattatgcgccgcgcgggtaagcgaggtcctacagaatagggtccacagaaccgaggaggtcaagcatgtagacttctacgctttctcgtattattacgatttagcagcaggcgtggggcttatagacgcagagaaaggcggttctctggtcgtgggcgattttgagattgctgccaagtacgtctgtcggacattagagacgcaaccccaatcctcccccttctcttgcatggatttaacatatgtctctcttttgttgcaggaatttggattccctaggtccaaggtcctcaagtag

SEQ ID NO: 186311 - DNA, 942 bp, Artificial Sequence
  Description of Artificial Sequence: Synthetic coding sequence
aaccggggcgtggtgagccggggctggcggcccggctggcggcggccgggacgcggatcccctaaagatcgcctgccacctgcaccacggaagcgggccttggttagcgtaggtgtggctgagcgggcagtacacgaaacacccacactgacccatgagacttttaaagcacttaaacccggacttagtgcctatgcagacgacgttgagaaatctgctcagggcataagagagctgttggacgttgcaaaacaggacattccattcgacttctggaaggccaccccattagtgctcaaggccacggcgggtctgcgattgttgcctggggagaaggcccagaagttgcttcaaaaggtgaagaaggtgtttaaagcctctccttttctggttggtgacgattgtgtctctattatgaacggcacagatgagggcgtaagtgcctggatcacgattaacttcctgactgggagcttaaagactccaggcggcagttcagtgggcatgctcgacctgggaggcggatcaacccaaatcgccttcctgccccgtgtggaaggaacactgcaagcctcaccaccaggataccttaccgcactgagaatgttcaataggacatataaactctattcctactcttatctaggactcggactgatgtccgcccggctcgccatcctgggaggcgtggaaggccagccggcaaaagatggaaaagagctggtgagtccgtgtttatctccaagttttaaaggtgaatgggagcacgcagaggttacttatcgagtgtcgggacagaaagctgcagcctcacttcacgagctctgcgcagcccgcgtctcggaggtgctgcaaaaccgggtccatcgcacggaagaagtgaaacacgtggacttctatgccttttcatactactacgaccttgccgcaggtgttggctag

SEQ ID NO: 186312 - DNA, 2778 bp, Artificial Sequence
  Description of Artificial Sequence: Synthetic coding sequence
atggagcgggacggctgcgccggcggcggcagccggggcggcgagggcggtagagctccccgcgaaggccccgccggaaatggcagggatcgcgggagatcccacgctgcagaggccccgggggacccccaagccgcggccagcctgctcgccccaatggatgtgggtgaagaacccctggagaaagctgcccgggctcgtactgccaaggatcccaacacctacaaggtcttgtcactcgtgctctcagtgtgcgtgctaaccaccatcctcggctgcatctttggtctcaagcctagctgtgcgaaagaggtgaaatcatgcaagggaagatgcttcgagcgcaccttcggaaattgccgctgtgacgccgcctgcgtcgagctaggcaactgctgcctcgactaccaggagacctgcatcgagccagagcacatttggacctgtaacaaatttaggtgtggcgagaagcgcttaactcgctctctgtgcgcctgtagcgacgactgtaaagacaagggtgattgttgtatcaactactcctcggtgtgccagggcgagaaatcctgggtggaggagccctgcgaaagtattaatgaacctcagtgtccggccggatttgagaccccccctactctcttgttttccctcgacggtttccgagccgagtatcttcatacgtggggaggtctcttgcccgtcatctcaaagttaaagaagtgtggcacctacacaaagaacatgaggcccgtctaccccaccaaaacattccctaatcactactcaattgtgacgggactgtatccagagtcccacggcatcatcgataacaagatgtatgaccctaaaatgaatgcctccttcagcctcaaaagcaaggagaagttcaatccagaatggtacaagggggagcctatttgggtgactgccaaataccaggggctgaaatctgggacctttttttggccaggctctgatgtggaaatcaacgggatcttccctgatatatataaaatgtacaacggctctgtccctttcgaggagcgcattttggctgttcttcagtggttgcagctccctaaggatgagcgcccacacttttatacgctgtatctcgaggagccagacagttctggacactcttatgggccagtgagttcagaagtgatcaaggccctgcagagagtggatggaatggtggggatgctaatggatgggctgaaagaactcaacctgcacagatgtttgaacctgatcctcatcagcgaccacggcatggagcaggggagctgcaaaaaatatatctatctcaacaaatatctcggggatgtgaagaacattaaagtgatttatggaccagccgcaaggctgcgcccaagtgacgtgcccgataagtattactcctttaactacgaggggatagcccggaatctttcttgtcgggaaccgaatcagcattttaagccttatctgaaacatttccttcctaaacgactccattttgcaaaaagcgacagaattgagcccctgaccttttatcttgacccccagtggcaactcgccttgaatccatccgaaagaaaatattgtggttctggctttcacgggagcgataatgtgttttccaacatgcaagccctgtttgtaggttatgggccagggttcaaacacggcattgaggctgacactttcgagaacatcgaagtgtataacctgatgtgtgatcttctgaatctgacacccgcaccaaataacggaacacacggtagtctgaatcacctcctgaaaaacccggtttacacccctaaacaccctaaggaagttcaccccctggtccagtgtccgtttaccaggaaccctagggacaacctaggctgctcctgtaacccctccatcctgccaatcgaggactttcagacacagttcaacttgaccgtagccgaggagaagataattaagcacgagaccctgccttacggccgacctagggtccttcagaaagaaaataccatctgtctgctgtctcaacatcagttcatgtcgggttacagtcaggatatccttatgcctctgtggaccagttacacggtagatagaaatgacagtttttcaacagaggatttcagcaactgcctctaccaggattttcggatccccctttcacccgtccacaaatgttccttctataagaataatacaaaagtgagctatggctttctctcacctcctcaactaaataagaacagctccgggatctactctgaagccctgctaacaacaaacatcgtacccatgtatcagagtttccaggtgatctggcgatactttcacgatacacttttgcgcaagtatgccgaggaaagaaatggggtgaacgtggtgtcaggccctgtgtttgatttcgactacgatggtcgatgcgattccctcgagaacctcagacagaagagacgggtgatacgaaatcaggaaatattgatccctacccacttcttcattgtcctgacgagctgcaaagacaccagccagactcccctacattgtgaaaacctcgacacactcgcgtttatcctccctcacagaacggacaatagtgagagctgcgtccatggcaagcacgatagcagttgggtcgaagagcttcttatgttacatcgagcacgaatcaccgatgtcgaacacatcaccggactcagcttttaccaacagcggaaggagcccgtgagcgatatccttaagttgaaaacgcacctgccgaccttctcccaggaggactag

SEQ ID NO: 186313 - DNA, 2592 bp, Artificial Sequence
  Description of Artificial Sequence: Synthetic coding sequence
atggcccggcggagcagcttccagagctgccagatcatcagcctgttcacctttgctgtgggagtgaatatctgtctgggcttcacagctcatagaatcaaaagggctgaaggatgggaggaaggaccccctacagtcttatccgattcaccctggaccaacatatcgggatcatgtaagggtcgatgctttgagctgcaggaggctgggcccccagattgcagatgtgataacctgtgcaagagttataccagctgttgccatgattttgatgaattgtgtctaaagactgccaggggttgggaatgtacgaaagaccggtgtggcgaagtgaggaacgaggagaatgcctgccactgcagtgaggattgtttagcaagaggggattgctgtactaactaccaagtagtatgcaagggggaaagccactgggttgacgacgattgcgaagagattaaagccgccgagtgtcccgccgggtttgtgcgtccacctctgatcatctttagtgttgacggatttcgcgcctcttatatgaagaaaggctctaaggtgatgcctaacattgaaaagctgaggagctgtgggacacattccccgtatatgaggcccgtgtaccccactaaaacatttcctaacttgtacaccctcgcgaccggcctgtatcccgaaagtcacggcatcgtgggcaatagcatgtacgaccctgtcttcgatgccacgttccacttacggggaagagagaaattcaaccacagatggtggggcggacaacccttgtggattacggcgacaaagcaaggagtgaaggccggtaccttcttctggagcgtcgtaatcccgcacgagcggaggatactgaccatcctacagtggttgactttacctgaccacgaaaggcctagcgtatacgcgttttactcagagcagcccgatttctccggccataagtacggcccctttggacccgagatgaccaaccctctgagagagatcgataaaattgtgggacagttaatggatgggctcaagcagctgaagcttcacaggtgcgtcaacgtgatatttgtaggtgaccatgggatggaggacgtcacatgtgaccggactgagtttctgagcaattatcttactaatgtggacgatattacgctggtcccgggaactctggggcggattcgcagcaagtttagtaataacgcaaagtacgatccaaaggcaattatcgcaaacctaacatgtaagaagccggaccagcactttaagccctatctgaagcaacatctgcctaaaagattacactacgccaacaatagacgcattgaagacatacacctgctggtggagcggagatggcacgtagcccggaaacctctggatgtgtataagaagccttcaggtaagtgttttttccagggagaccacgggtttgacaataaagttaacagtatgcagacggtcttcgtgggctacggctccacctttaagtacaagacaaaagtgcctccattcgagaacatcgaactatacaacgtgatgtgcgatctgttgggattgaagccagctcctaacaacggtacccacggctccttgaatcacctactgaggactaatacattccgtcccacaatgcccgaagaagttacccgacctaattatccggggataatgtacttacagtctgatttcgatttgggttgcacctgcgatgacaaggtggaaccaaaaaataaactggatgaactcaataagcgcctgcacacaaaaggcagcacagaagagcggcatcttttatacggcaggcctgccgtcctgtaccgcacccgttacgatatcctttaccacacggactttgaaagtggatactctgaaattttcctgatgcccctttggacctcttacactgtgtccaagcaggctgaggtttcctccgtgccagaccacctcaccagctgcgtgagaccagatgtaagagtttctccgagcttttcccagaactgtctagcctataagaatgacaagcagatgtcttacggattcctgttcccgccatacctatccagcagtcccgaagctaagtacgatgcctttttggtgaccaatatggtgcccatgtacccagcctttaagcgggtgtggaattactttcagagagtactcgttaagaagtatgcaagcgagcggaacggagtaaatgtgatctcagggcccatatttgactacgattatgacgggctccacgacaccgaggataaaatcaaacagtacgtagagggatcctcaattcccgtccctacgcattactactctataattactagctgtttagacttcacacagccggccgacaagtgcgacggcccattgagtgtcagctccttcattttgccacatagacctgacaacgaagaatcttgtaatagcagcgaggacgaaagcaaatgggtagaagagcttatgaaaatgcatacggcccgcgtgagggacatagagcatctcacatctcttgattttttcaggaagactagccggtcttacccagaaatccttaccttaaagacctacctacacacctatgagagtgagatatag

SEQ ID NO: 186314 - DNA, 2748 bp, Artificial Sequence
  Description of Artificial Sequence: Synthetic coding sequence
atggcccggcggagcagcttccagagctgccagatcatcagcctgtttacctttgccgttggagtgaacatttgcctcggctttactgcgcataggatcaaaagagccgaaggatgggaagagggcccccccaccgtgttgtccgacagcccttggacaaacatatcaggctcctgcaagggtaggtgttttgaattgcaggaagccgggccacctgactgtcgctgtgacaacctctgcaaatcctatacatcctgttgccatgactttgatgaactctgcctgaagacagccaggggatgggagtgcaccaaggacaggtgcggtgaggttcgcaacgaagagaatgcatgccactgctctgaagattgcttagctaggggcgattgctgtaccaactaccaggtggtatgtaagggagaatctcattgggtagacgacgactgcgaagaaattaaagccgctgaatgtcctgccggattcgtcagacctcctctcatcattttttctgtagacggttttcgcgccagttatatgaagaagggtagcaaagtgatgccaaacattgagaagctcagatcatgtggaacccattccccctacatgaggccagtctaccctactaaaacttttcccaacctgtacaccctggctacgggtttgtaccccgagtctcacggcattgtaggcaatagtatgtatgatcctgtcttcgatgccacattccacctcagagggcgggagaagttcaatcatcgatggtggggaggacaaccattgtggatcacggccactaagcaaggggtcaaggccggcacatttttttggtccgtggttattccacacgaacgcaggatcttgaccatattacaatggttaacccttcctgaccatgaacggccctccgtgtacgcattttattctgaacagcccgatttttctggacacaagtacggaccttttggtcctgaggagagcagctacggatcaccctttacacccgccaagcgtccgaaaagaaaggtcgcacctaaacgacgacaggaacggcccgtcgccccgcccaaaaaacggcggcggaagatccaccggatggatcactacgctgcagagacacgccaggacaaaatgacaaatccgctgcgggagatcgacaaaattgttggacagctgatggacggcctgaagcagctgaagctccaccgttgcgtcaatgtcatcttcgtgggcgaccatggcatggaagacgtgacttgtgacaggaccgaattcctgtctaactatctaacgaacgtggatgacattaccctggtgccgggtaccttagggcgtatcaggtctaaatttagtaataatgccaagtatgatcccaaggcaataatcgccaatctgacctgtaaaaagccagaccagcactttaaaccctatctcaagcaacaccttcctaagagattacactatgctaacaacaggcggatagaggatattcatctgctcgtagagagaagatggcatgttgcgaggaagccactggatgtctataaaaaaccttctggaaaatgcttcttccaaggcgaccatggattcgataataaggtcaactcgatgcagaccgttttcgtgggctatggcagcacatttaagtataaaacaaaagtgcctcccttcgaaaacatcgagctctataacgttatgtgcgatctgcttggacttaagcccgctccaaacaacggaacacatggttctcttaaccacctacttaggacgaacacattcagacccaccatgccggaagaggttacccgtcctaattaccctggaatcatgtacctgcagtcggactttgatttgggctgtacctgcgacgataaggtggaacccaaaaacaaactcgatgagctgaacaagcgcttacacaccaagggatcaaccgaagagagacatttgctctatggccggccagcagtgttgtaccgtactcgctacgatatactctaccataccgacttcgaaagcggctactcggagatctttctgatgccactttggaccagctacactgtctccaagcaagctgaggtcagctctgtaccagatcacctcacctcatgcgtaagacccgatgtgagggttagcccttcttttagtcagaactgcctggcttataagaatgataaacaaatgagctacggatttcttttccctccatacctgtcctcctcacctgaggcgaagtatgacgccttcctggtcacaaacatggtcccaatgtaccccgcatttaagagagtctggaactacttccagagggtcttagttaaaaaatatgccagcgaacggaacggcgttaatgttatctctggccccatctttgactacgactacgacgggctccatgacacagaagacaaaatcaaacagtatgtggaagggtcctctatccccgtccccacgcactactattccattatcaccagctgcttggacttcactcagccggccgacaagtgtgacggaccactttccgtctccagctttatcctgccccatcgccctgacaatgaagaatcctgtaacagctccgaggatgaatctaagtgggtggaagagctgatgaagatgcacacagctagggttcgggatatcgagcacttaacatcgttggacttttttcgcaaaactagccggtcgtatccggagattctaacccttaaaacttatctgcatacatatgaatctgagatctag

SEQ ID NO: 186315 - DNA, 2667 bp, Artificial Sequence
  Description of Artificial Sequence: Synthetic coding sequence
atggcccggcggagcagcttccagagctgccagatcatcagcctgttcacatttgctgttggggtgaatatatgccttggatttaccgcccaccgcatcaagagggctgagggatgggaggagggacccccaacggtcctctcagactcaccttggaccaacatcagtggatcctgtaagggccgctgctttgagctgcaagaggccggtcctccagattgccgctgcgataacctgtgtaaatcctacacaagttgttgtcatgactttgatgaactgtgcctgaaaactgccagaggctgggagtgcacaaaggaccggtgtggggaagtgaggaacgaggagaatgcgtgccactgttccgaagattgtttagcccgcggcgattgttgtactaattatcaggttgtctgtaaaggcgagtctcattgggtagatgatgactgtgaggagatcaaagccgcagaatgccccgcgggcttcgtccgcccacctcttattattttctcggtagatggattcagagcttcctacatgaagaaagggtccaaagtcatgccgaatattgagaagctgcggagttgcggaacgcattctccctacatgcgccccgtgtaccctacaaagacctttcccaacctgtacacccttgccaccggactttacccggaaagtcatggaatagtgggcaactcgatgtacgatcccgtcttcgatgccacctttcacctaagaggccgcgagaagttcaatcatcgctggtggggcggacaacctctctggattaccgccactaaacagggagtgaaggcaggcacattcttctggagcgtggtcattccacatgagcgccggattctgacgattttgcagtggttgaccctccccgaccacgagagaccttcagtgtacgctttttattcagaacagcctgactttagtgggcacaagtacgggccctttggacctgagatgactaaccctcttcgggagatcgataagatagttggtcagctcatggatggtctgaaacagttgaagctacaccgctgcgtgaatgtcattttcgtgggcgatcatggtatggaagatgtgacttgtgaccgaaccgagttcctctctaactatctgacaaatgtcgacgacattactttggtcccaggaaccctgggcagaatccgatccaaatttagcaacaatgctaaatacgatccaaaagccattatcgccaacctgacttgtaagaaacctgaccagcacttcaagccctacctaaaacagcatttgccaaagcgactccattatgccaataataggcggattgaggatattcatttactggtggaacgcagatggcacgtggccagaaagccgctggatgtatacaagaagccctctggcaagtgcttcttccagggagaccacgggtttgacaacaaggtgaacagcatgcagacagtgttcgtggggtatggtagtaccttcaaatacaaaacgaaggttcccccttttgagaacatcgagctctataacgtgatgtgcgatctgctgggtcttaagcctgctcctaataacgggacacacgggtctctaaaccatctgttgcgtaccaatacctttcgacctacgatgcccgaggaagtgacccgcccaaactatccagggatcatgtatctgcagagcgattttgacttggggtgtacctgcgatgacaaggtcgagccaaaaaataagctggatgaactgaataagaggctgcacacaaaagggtccaccgaagcagagaccaggaagtttaggggatcgcggaacgaaaataaggaaaacataaatgggaactttgagccacgtaaagagcgacacttactgtacgggcgcccagccgtgctataccggaccagatatgatatcctgtaccacaccgactttgagagcggctactctgagatttttcttatgcctctatggacttcatataccgtgagcaagcaggcggaagtgagcagtgtccccgaccatctgacatcatgcgtgcgacccgatgtgcgagtaagtcctagtttctcgcagaattgtcttgcatacaagaacgataaacagatgtcatatggcttcctgttccccccatacttgagttcgtcacccgaggccaagtatgatgcctttctggtgacaaacatggtcccgatgtatccagcctttaaaagagtgtggaactacttccagagggttctggtgaagaagtatgccagcgaaaggaatggggtaaatgtgatcagtggccccatctttgattacgattacgacggtttgcatgacacagaggacaaaataaagcagtacgtggagggttctagcattcctgtacctacgcattattactccatcatcacaagctgcctggatttcacccagcccgccgacaaatgcgacggaccacttagtgtgtcctcgtttatactcccccatagacccgacaatgaagaaagctgtaactcctccgaagacgaatctaaatgggtggaggagctaatgaagatgcacaccgcccgagtgagagacatcgaacacctaacttctctggatttttttcgaaaaacatctcgaagctaccccgagatcctcaccctgaaaacctatctccacacctatgaatcagaaatatag

SEQ ID NO: 186316 - DNA, 2628 bp, Artificial Sequence
  Description of Artificial Sequence: Synthetic coding sequence
atggagagcaccctgaccctggccaccgagcagcccgtgaagaagaacactttgaagaaatacaagatagcttgtatcgtgctcctggccctacttgtgattatgagcttgggcctcgggttagggttggggctgcgcaagctcgagaaacagggatcttgcaggaagaagtgttttgatgcttcctttaggggtctcgaaaactgtagatgtgacgtggcctgtaaggataggggcgactgttgctgggattttgaggatacttgtgtggagtccacccgcatctggatgtgcaacaaatttagatgcggggaaacaagactggaagcaagcttgtgctcgtgtagcgacgattgcctacaacgtaaagactgttgcgcggattacaaatcggtttgtcagggcgaaaccagctggctggaagagaactgcgataccgcacagcaaagccaatgtcctgaaggtttcgaccttcctcctgtcattctcttttccatggatggtttccgggctgagtatttatatacgtgggacactctaatgccgaacatcaataaactgaagacatgtggtattcattcaaaatacatgcgcgccatgtatcccaccaagacttttcccaaccactatacgattgtgaccggcctgtatccggaaagtcatggaatcatcgacaacaacatgtatgatgtgaacctgaacaagaacttttccttgtcatctaaggagcagaacaacccagcctggtggcacggtcagcccatgtggctgacagctatgtaccaggggttgaaggccgctacatacttctggccaggatctgaggtggcaattaacgggtcctttcctagcatctatatgccctacaacggatcggtcccctttgaggaacgaatctccaccctgctaaaatggctggatttacctaaggccgaaaggccaaggttttacaccatgtatttcgaagagccagacagttccggccatgccggagggcctgtttcagcgagagtgatcaaggcactgcaggttgtcgaccatgcattcgggatgctgatggaaggactaaagcagaggaacctccacaattgcgtcaatatcatactcctcgcagaccacggaatggatcaaacctactgtaacaagatggaatacatgaccgattattttcccagaataaacttcttctatatgtacgagggacctgcaccccggatacgcgcgcataatatcccccatgattttttctcattcaacagcgaggagatagtgcgtaatttgagctgcaggaagcctgaccaacactttaagccatatttgacaccagatttacctaagagactgcactacgccaaaaatgttagaatcgacaaggtccatttgttcgtggaccagcaatggctcgctgtacgctctaagtctaacacaaattgcggagggggcaaccacggctataataacgagttcaggagcatggaggctatctttctggctcatggtccatcattcaaggaaaagacagaggtagagccattcgaaaacatcgaagtgtataacctaatgtgtgacctactccgcattcagcccgcccccaacaacgggactcacggctccttgaatcatctacttaaagtgccattttatgagccttcccatgcagaggaggtgagcaaattcagcgtctgtggattcgccaatccacttccaactgagagtctcgactgtttttgtccacatctacaaaattccacccagctggagcaggtcaatcagatgcttaaccttacccaggaggagattactgccactgtgaaagtcaatctgcccttcggcagaccaagagttctgcaaaaaaatgtggatcactgtctcctgtatcacagagaatacgtcagtggctttgggaaggcaatgcggatgcccatgtggtctagttatacggtgccacagttaggagatacatcacccctgccccccaccgtccccgactgcctcagagctgatgtgcgcgtgcccccatccgaatctcaaaaatgcagcttctacctggccgataagaacatcactcacggattcctgtaccctcctgcgtccaaccgcacatccgactcccagtatgacgccttgataacatctaatctcgtacctatgtacgaagaatttagaaagatgtgggattatttccacagtgtgctcctgatcaagcatgccactgagcgaaacggagtgaacgtggtgtccggacctatctttgactacaactatgacggccacttcgatgcccctgacgaaatcaccaagcatctggctaatacagatgtccccattcctacgcattattttgtggtcctcacctcttgtaagaacaagagtcacactcccgaaaattgccctggctggttggacgtgctgccctttatcattcctcaccggccaacaaatgtggaatcctgccctgagggtaaaccagaggccctatgggtggaggaaaggtttacagcacacatcgcgcgcgtaagagatgttgagctgctcacagggctggacttctatcaggacaaggtccagcctgtctcggaaatcctgcagctcaagacatacctcccaaccttcgaaacaactatttag

SEQ ID NO: 186317 - DNA, 1992 bp, Artificial Sequence
  Description of Artificial Sequence: Synthetic coding sequence
atggagagcaccctgaccctggccaccgagcagcccgtgaagaagaatacactgaaaaagtacaagatcgcatgcattgtgttgcttgcactgctggtcattatgtcactgggactcggcctgggcctgggcttgaggaagctggagaaacaagggagttgccggaagaagtgctttgatgcttcgttccggggcctcgaaaattgtaggtgcgacgtggcatgcaaagacaggggagactgctgttgggactttgaagacacatgcgtcgagtccactagaatctggatgtgcaataagtttcggtgtggggagaccaggttggaggctagcttgtgcagttgtagcgatgactgtctgcaacgaaaagactgctgcgccgactataagagcgtctgtcagggtgaaacttcgtggctcgaagagaactgcgatactgcacaacagtcgcagtgtcccgagggcttcgacctcccacctgttatcctcttttctatggacggctttcgtgcagagtatctgtatacctgggacaccctgatgcctaatatcaacaaactgaagacttgtggcatccactccaaatacatgcgagctatgtatccaacaaagacttttcccaaccattacaccatagtaacaggtctttacccggagagccacggcattatcgacaataacatgtatgacgtgaacctcaataagaacttttccctctcctccaaggagcagaacaacccagcctggtggcacggacaacccatgtggctcaccgcaatgtaccagggcctgaaggccgctacatacttttggcccggcagcgaggtggcgatcaacggttcatttccctccatttatatgccatataatggcagcgtgccattcgaggagagaatttctaccctactgaagtggttagacctgcccaaagccgaacgccctaggttctacaccatgtattttgaagaacccgatagctcgggccacgcgggaggccccgtgtctgcccgagtgatcaaagctttgcaagtagtagaccatgcctttgggatgttgatggagggtttgaagcagcggaatctgcataactgtgttaatatcatccttctcgctgaccacgggatggatcagacctattgcaataagatggagtatatgaccgattacttccccaggatcaattttttttatatgtacgaagggcctgcaccgagaatcagggcacacaatatccctcatgacttcttcagcttcaactccgaggagatagtgagaaacttgtcatgcagaaaacctgaccagcacttcaagccttatctcacccctgacctcccaaagagactgcattatgccaagaatgtaagaatcgacaaagttcacttgtttgtggaccagcagtggcttgccgtgcgctccaagtccaacacgaattgtggcgggggcaaccatggctataacaatgagtttcgtagcatggaagcaatttttctggcacacggtccatcttttaaggaaaagacggaagtggagccattcgagaatatcgaggtgtataatctcatgtgtgatctgctgagaatccagcccgcccctaataacggcactcatggctccctgaatcacctcttaaaagtgcccttctatgagccaagccacgccgaagaggtctcgaaattctccgtctgcggatttgctaatccgctccctacagagtccttagactgtttctgtcctcacctccagaatagcacccagctggagcaggtgaaccaaatgttgaacttgacccaagaggaaataaccgcgactgtaaaggttaacctaccattcggaagaccccgtgtgcttcagaaaaatgtggaccattgcctactgtaccaccgggaatatgtgtctggatttgggaaggctatgcgcatgcccatgtggagctcgtacacagtgccgcagcttcccgccatagaacatcagattgccaacatgatgctgtag

SEQ ID NO: 186318 - DNA, 2628 bp, Artificial Sequence
  Description of Artificial Sequence: Synthetic coding sequence
atggagagcaccctgaccctggccaccgagcagcccgtgaagaagaacacgctgaaaaagtataagattgcttgtatcgtcctgctcgccctgcttgtcattatgtccctcgggctgggcctaggtctgggcctcaggaaattggagaaacaagggtcatgtcgtaaaaagtgttttgatgcaagtttccgcggattggagaactgccggtgtgacgttgcgtgcaaggacaggggtgactgctgctgggactttgaggacacctgcgttgaatcaactcggatttggatgtgtaacaagtttagatgtggggagacccgcctcgaggccagtctttgcagctgtagcgacgattgcctgcagcgaaaggactgctgcgccgattataagagcgtgtgccagggcgagacctcctggttggaagagaactgtgatactgcgcaacagtcacagtgtccggagggatttgacctacccccagtgattctatttagcatggacggcttccgcgcggagtacctgtacacatgggatacattaatgcccaatattaataaactgaaaacctgtggaatccattccaaatacatgcgcgccatgtatcctacgaaaacgttccccaatcactacactattgtcactggattgtaccccgaatcccatgggattatcgataataacatgtacgatgtgaacctaaataaaaactttagtctgtctagtaaagagcagaataacccagcctggtggcatggacagccaatgtggctgacagccatgtaccaaggccttaaggccgctacatacttctggccgggaagtgaagttgctattaacggctcctttccgtctatttatatgccttataacggctcagtccccttcgaggaaaggatttcaacgttgctaaaatggttggatttgcccaaggccgaaaggccgcgcttttataccatgtattttgaggagcctgactcttctgggcatgcaggaggacctgtttccgcccgagtcatcaaagctttacaggtggtggatcatgcttttggcatgctcatggagggcctcaaacagcggaacttgcacaactgcgttaacattatcctccttgccgaccatggcatggatcagacctactgcaacaagatggagtacatgactgactactttccccgcatcaactttttctacatgtacgaaggcccagcaccaaggatccgtgcccacaatatcccccacgactttttctctttcaatagcgaggagattgtgaggaacctgtcttgccgtaaacccgatcagcacttcaaaccttacctcactcctgacttgcctaagcgtctgcactatgcaaagaatgtgaggattgacaaggttcatctgttcgtcgatcaacagtggctggcagtgaggtctaaatccaacactaactgtggggggggcaaccatggttataataatgagttccggtctatggaggctatctttctcgcacatggccccagcttcaaagagaagacggaggtcgaacccttcgagaacattgaggtatacaacttaatgtgcgacctcttgcgtatccagcccgcacctaataacgggacccacggttctctcaaccacctcctgaaggtgccattctatgagcccagtcacgccgaggaggttagtaagttttcagtctgtggcttcgcgaaccccctgcccactgagagcttggactgtttttgcccgcaccttcagaactccacccagttggagcaggtgaatcagatgctcaacctgacacaggaagagattaccgctactgtgaaagtaaacctgccattcggtcgtcctcgtgtgctgcagaaaaatgtcgaccattgcttgctttaccatcgggagtacgtgtccggatttggtaaggccatgcggatgcccatgtggtcaagttacacagttccacagttgggagacacctcacctctcccaccaacagttcctgactgtctgcgcgccgacgtgcgagtcccgccctccgagtcccagaagtgcagcttttacttggctgataaaaacataacccatggctttctgtatcctcccgctagcaacagaacctctgactcacaatatgacgccctgatcacaagcaatttggtgcctatgtatgaggagttcagaaagatgtgggattattttcacagcgtactcctgattaaacacgctaccgagaggaatggcgtgaatgtcgtgtccggacccattttcgattataattatgacggacactttgacgctccagatgagattactaagcacttagccaataccgatgtgccgattcccacccattacttcgtggtgttaacctcctgtaaaaacaaaagccatacgccggagaattgtcccggatggctggatgttctgccctttattatcccccaccgcccgacgaatgtagagtcctgtccggaggggaaaccggaggccttgtgggtcgaggagaggtttactgctcacatcgcccgcgtgagggacgtggagctgttgacagggctggacttctatcaggacaaggtccagcctgtttcagagatcctgcagcttaagacctatctgccaacttttgaaactaccatatag

SEQ ID NO: 186319 - DNA, 765 bp, Artificial Sequence
  Description of Artificial Sequence: Synthetic coding sequence
atgagcctgggcctgggcctgggcctgggcctgcggaagctggagaaacagggctcgtgcagaaagaaatgcttcgacgcttccttcaggggtcttgagaattgcaggtgtgatgtcgcctgcaaagataggggtgattgctgttgggacttcgaagacacatgtgtcgagagcacccggatctggatgtgtaacaaattccggtgcggagagacacgcctggaagcttccctctgttcctgctcagatgactgcctccagaggaaggattgctgcgccgattacaagtcagtgtgtcagggtgaaacatcatggctggaagaaaactgcgatactgctcagcagagccaatgcccagagggtttcgatcttccccccgtcattctattttccatggacggattcagggcagaatacctctacacctgggatacgctcatgccaaacatcaacaagctcaagacctgcggcatccacagcaagtacatgagggctatgtacccaactaagacctttcctaaccattacaccattgttaccggcctgtatcctgagagccatgggattatcgataacaatatgtatgacgtgaacctaaataaaaatttttcactgtcttccaaggagcagaataaccccgcatggtggcacgggcaacccgtatgtagcatcctgcatgtggctaccgaggtgacctcaatcagtcagtgtgaccggcgtacattgtttagcctcagcggagcctcctccatgagccccatctag

SEQ ID NO: 186320 - DNA, 774 bp, Artificial Sequence
  Description of Artificial Sequence: Synthetic coding sequence
atgagcctgggcctgggcctgggcctgggcctgcggaagctggagaagcaggggtcatgccgcaaaaaatgctttgatgcttcgtttcgcggcctggagaattgtagatgcgatgtcgcatgtaaagacaggggtgactgctgttgggattttgaagacacatgcgtggagagtactagaatttggatgtgcaataaatttcgctgcggagagacccgcctcgaagcatctctctgcagttgttccgatgactgcctgcagcgcaaggattgctgcgcagactataagtcggtgtgtcaaggagagacatcttggctggaagaaaactgcgatactgcccagcagtctcagtgtccagaaggctttgatctgccacccgtgatattgttttccatggatggtttcagggcagagtacttatatacttgggatactctgatgcccaacattaacaagctaaagacatgcgggattcactcaaaatacatgcgggccatgtatccgaccaagacatttcccaatcactacacaatagttacaggactatatccagaatcccacggaattatcgataacaacatgtacgacgttaatctgaataaaaacttctccctatcaagcaaggaacaaaataatcccgcctggtggcacgggcagcctatgtggctcaccgctatgtaccaggggctgaaggcagccacatacttctggccaggtagcgaggtagccattaacggaagtttccctagcatctacatgccatacaacgggtag

SEQ ID NO: 186321 - DNA, 1200 bp, Artificial Sequence
  Description of Artificial Sequence: Synthetic coding sequence
atggccagccccggcaagcccggcgccgacgaggcccaggaggaggaaggcgagctggaaggaggctccgccggtcctcgcgctgcaatcctggaacaggccgaggagctgttccttttgtgtgacaaagaagcaaaaggttttatcactaaacatgatctccagggtctccagtctgatctccctctgacaccggaacagctcgaagctgtcttcgagagcctggaccgagcacatacaggcttcctgaccgcaagagaattctgtctgggactgggcatgttcgtgggagtggcttccgctcaaggcgccaacccgtgtagaacccccgaagagactttcgagagtgggggcctggacgtgcagggaaccgccggaagcctcgacgaagaggaagaggaggaagagagattccacactgtccttgaacagttgggggtggccccggtactcggcaagcaacgcgctgtccggactctgtgggctaggcttcagagggagcggcccgaattgctggggagcttcgaggacgtactcatacgcgcgtcggcttgtctggaggaggccgccagggaacgggatggtctggaacaggcactgcggcgccgcgagtctgaacacgagagggaggtacgcgctttgtacgaagaaactgagcaactgagggagcaatctcgtcgaccccctagccaaaatttcgctagaggtgagcgtcggtctcgcctcgaactggagttacaatctcgggagcaggacttggagcgcgccgggctccggcagcgggagcttgagcagcagctccacgcccaggccgccgaacaccttgaggctcaggcacagaactcacagctgtggcgcgcccacgaagcgttacggacccagctggaaggggcacaggaacagattcgaaggttggagtcagaagccagaggccgccaggagcagacacagagagacgtggttgccgtaagtaggaacatgcagaaagagaaggtaagccttttgaggcagctcgaattgctgcgggagctgaatactaggctgcgcgatgacagggacgcctgcgaggccaggcgcgcggggagcagctgccgcaaagctctcacgactgccagattacctgggccaacatgctgttgctgttgttgttgggctaggcccccgcggcggggatcaggacacttgccatccgcccgatag

SEQ ID NO: 186322 - DNA, 885 bp, Artificial Sequence
  Description of Artificial Sequence: Synthetic coding sequence
atggccagccccggcaagcccggcgccgacgaggcccaggaggaggaaggtgagctagagggaggatcggcagggccaagggctgcaattctcgagcaggctgaggaattgtttctgctgtgcgacaaggaagcaaaaggcttcattaccaagcacgacctccaaggactgcagtcagacctcccactcacaccagagcagctggaagccgtcttcgagtccttggaccgggcccatactggattcctcactgcaagggagttctgtcttggcttaggcatgtttgtgggtgtggccagtgcccagggtgccaatccctgtcggactccagaggaaactttcgagtccggaggtctggatgtgcaggggacggctggtagccttgatgaagaggaggaagaggaggagaggttccataccgtgctcgagcaactgggggtcgctccagtgttgggcaaacaaagagctgtgcggacgctgtgggctcgcctgcagagggaaagacccgagttattgggcagctttgaggatgttttgatcagggcctcagcttgtttggaggaggctgctcgcgagcgcgacgggctcgaacaggcgctccggagaagggagagcgaacatgaaagagaggtcagagcactgtacgaggagaccgaacagcttagggagcagagccgtaggccgcctagtcaaaacttcgctcgaggagaaagacggagtcgcctcgagcttgagcttcaaagcagagagcaggatctagagcgcgccggccttaggcagcgagaacgtcggggcaggagactgcaggagcacgcagagagagagtcacagcctgctacagccactggagctgctcagggggccgagtatacagctgctgggtag

SEQ ID NO: 186323 - DNA, 267 bp, Artificial Sequence
  Description of Artificial Sequence: Synthetic coding sequence
atggccagccccggcaagcccggcgccgacgaggcccaggaggaggagggggaacttgaaggcgggtccgcgggcccacgcgccgcaatactggaacaggctgaggagcttttccttctgtgtgacaaggaagccaagggcttcatcacgaagcacgatttgcagggcctccaatctgatcttccattgactcctgaacagcttgaggccgtctttgaatcgttagatagggcacacaccggatttctgaccgccagagaattctag

SEQ ID NO: 186324 - DNA, 105 bp, Artificial Sequence
  Description of Artificial Sequence: Synthetic coding sequence
atggccagccccggcaagcccggcgccgacgaggcccaggaggaggaaggggagttggaagggggaagtgccggcccaagggcggctatcttggagcaggcctag

SEQ ID NO: 186325 - DNA, 885 bp, Artificial Sequence
  Description of Artificial Sequence: Synthetic coding sequence
atggccagccccggcaagcccggcgccgacgaggcccaggaggaggaaggtgaactggaggggggcagcgctggacctcgggcagcgattctggaacaagctgaggagctcttccttctatgtgataaagaggccaagggttttatcaccaagcacgatttacagggactgcagagcgatctgcccctgactcctgagcagttggaggcggtttttgagagcctagatagagcccataccggttttctcaccgccagagagttttgccttgggctgggtatgtttgttggagttgcgagcgcacagggcgcaaacccttgtagaacgcccgaggaaacgttcgagagtggcggcctggacgttcagggaacagctggttcacttgatgaggaggaagaggaagaggaaagatttcacacggttctggagcagcttggagtcgcaccggtactgggaaaacagagagctgtgcgtaccctctgggccagactccagcgggagcgtccggagctccttggcagctttgaagatgtattgatccgagccagcgcctgtcttgaggaggcagcgcgcgagcgagatggtctggagcaagccttacgacgacgggagtccgaacacgagagggaggtgcgcgccctttatgaggagacagagcagctgcgagaacagtctaggagacctcccagccagaacttcgccagaggggagcggaggtcgcggttggagctggaactacagtctcgagagcaggacttggagcgggcaggtctgcgccagcgggagaggcggggcaggcgattacaggaacacgccgagagggaaagtcaaccagctaccgccaccggagcagcccaaggagcagagtatactgcagcaggatag

SEQ ID NO: 186326 - DNA, 162 bp, Artificial Sequence
  Description of Artificial Sequence: Synthetic coding sequence
atggccagccccggcaagcccggcgccgacgaggcccaggaggaggaaggagaactggaaggaggatctgcaggcccacgcgccgctatcctcgagcaggcagaagagctctttctcctatgtgataaggaggcaaaaggatttatcacaaaacacgattag

SEQ ID NO: 186327 - DNA, 246 bp, Artificial Sequence
  Description of Artificial Sequence: Synthetic coding sequence
atggccagccccggcaagcccggcgccgacgaggcccaggaggaggaaggggagcttgaaggaggcagcgctggaccccgggctgccatactcgagcaagctgaagaactgttcctgctgtgcgataaggaagctaaaggctttattaccaaacacgacttacagggcctccagtctgatctgccgttaacccctgagcagctcgaggccgtcttcgagtcattggatcgggcacatacgggatag

SEQ ID NO: 186328 - DNA, 1188 bp, Artificial Sequence
  Description of Artificial Sequence: Synthetic coding sequence
atggccgcccccgacggccgggtggtgagccggccccagcggctggggcagggaagtggtcagggccctaaaggatcaggcgcttgcctccatcctctggattccctggaacagaaggagacacaggagcagacatcaggacagttggtcatgctgaggaaggcacaagagtttttccaaacctgtgacgcagaaggcaaaggctttatagcccgaaaagatatgcagcgacttcataaagagctcccattgagccttgaggagttggaggatgtgttcgacgctctggacgctgatgggaacggatatttgaccccccaagagttcacaacgggtttttcacacttcttcttcagtcagaataatcccagccaggaggacgccggtgagcaggtggcccaacggcacgaagagaaggtctacctgagccggggagacgaggatttaggagacatgggagaagacgaggaggcgcaattcaggatgttgatggaccgacttggtgcccaaaaggttctagaggatgagtctgacgttaaacaactgtggttgcagctgaaaaaggaggaacctcatctattgtccaacttcgaggattttctcactaggataatttcgcagctgcaggaagcccacgaggagaaaaacgaactggagtgcgcattgaagcggaaaattgctgcgtatgacgaagagatccaacatctgtatgaggaaatggaacagcagatcaagagtgagaaggaacagttcctcctcaaagatactgagagatttcaggcccgctcccaggaattggagcaaaagctgctgtgtaaggagcaggagttggaacaattgacccaaaaacagaagcgtctggaggggcagtgcacggctctacatcacgataaacatgagactaaagctgaaaacacaaaactgaaattgactaatcaggaattagcccgcgaactggaaaggacatcatgggaactacaagatgctcagcaacagctggagtccctccagcaagaggcctgcaaattgcatcaggagaaggagatggaggtgtacagagtcacagagtccctgcaaagggagaaagctggtctcttaaagcaactggacttcctaagatgtgtgggcgggcactggcccgtactcagagcaccacctagatctcttggatccgaaggccccgtctag

SEQ ID NO: 186329 - DNA, 2196 bp, Artificial Sequence
  Description of Artificial Sequence: Synthetic coding sequence
atggccgcccccgacggccgggtggtgagccggccccagcggctgggacagggttctggtcagggacctaaaggctccggggcttgcctgcatcccctcgactcactcgagcagaaagagacacaggagcagacttcaggacagcttgtgatgttgcggaaggcccaggagttttttcagacttgcgatgcggagggtaaaggattcatcgcccggaaagacatgcagcggctgcacaaagaattgcccctcagtcttgaagagctggaggacgtctttgacgccctggatgccgatggcaatggataccttacccctcaggagttcactacgggattcagccatttcttctttagccaaaataacccatcacaggaggacgcaggggaacaagtggcccagagacatgaggagaaagtgtacctaagccggggcgacgaagaccttggagacatgggcgaggacgaggaggcgcagttcagaatgcttatggatcgtctgggtgcgcaaaaggttcttgaagacgaaagcgatgtcaaacagctgtggctccaactgaaaaaggaggaaccacacctcctgtcaaactttgaagactttctgacacggatcatttcacaactgcaggaggcacacgaggagaagaacgaactcgagtgtgcgttgaaacgtaagatcgctgcatatgacgaggaaatccagcacctgtacgaagagatggaacagcagatcaaaagtgagaaagaacaattcctgcttaaagacacggaaaggttccaggctcggtctcaggagttggaacagaagctgttatgtaaggaacaggagttagaacaactaacccagaagcaaaaaaggctcgagggccagtgcacagcattacaccacgacaagcacgaaacaaaagctgagaatactaagctgaagctgacaaaccaagagctggctagggagctggaaaggacgtcttgggaactccaggatgctcaacagcagctggaatctctgcagcaggaagcgtgcaaattacatcaagagaaagagatggaggtgtaccgagtgaccgaatctttgcagagagagaaagccggccttttgaagcagctggattttctgcgggagaggaacaagcaccttcgagatgaacgggacatctgtttccagaagaacaaagctgcaaaagcgaacacagccgctagtcgggcctcctggaagaagcggagcggcagcgtgattgggaaatatgtagacagtcgaggcattctgagatcccagtctgaggaggaagaggaggtgtttggcatcccccgtaggtccagcctcggtctatctggttacccacttactgaggaagaaccaggcactggagagccgggtcctgggggaccgtacccaagacctctcagaaggatcatctcagtcgaggaagaccctctgccgcaactgctagacggtggattcgagcagcccctctctaaatgcagcgaggaagaggaggtttccgaccagggggtgcaggggcaaattcccgaggctccaccactaaaattgaccccgacttccccgagagggcagccggtcggaaaagaggcactgtgcaaggaggagtcctccccctctgcccccgaccgattgtttaagattgtgtttgttgggaacagcgctgtcggcaagactagctttctgcggaggttctgcgaggaccggttttcgcccggcatggcggccacggtgggcatcgattacagagtgaagacgctcaacgttgataacagccaagtggcattgcagttgtgggacacagcaggccaggaaaggtataggtgcataacccagcagttcttcagaaaggcagatggcgtcattgtgatgtatgacttgacggacaagcagagttttctaagcgtgcgtcgctggttgtcaagtgttgaggaggccgtgggcgacagggtgcccgtgctgttgctcggtaataagctggacaatgagaaggaacgggaagtgccaaggggattgggcgagcagctggcaaccgagaataatttgattttttatgagtgctccgcttacagcggtcacaacaccaaagagagcctactgcacttggcccgatttctgaaagagcaagaagatactgtccgggaagataccatccaagtcggtcacccggccaagaagaaatcatgctgcggctag

SEQ ID NO: 186330 - DNA, 1389 bp, Artificial Sequence
  Description of Artificial Sequence: Synthetic coding sequence
atggccgcccccgacggccgggtggtgagccggccccagcggctgggacaggggagcggacagggacccaagggttctggtgcatgcctccacccccttgatagcctggagcagaaggagactcaggaacagacttccggccagctcgttatgctgagaaaggcccaggagttttttcagacgtgcgatgccgagggcaagggatttattgcacggaaggacatgcaacgccttcataaagagctgcccctctccctggaggagctagaggacgtgtttgacgccttagatgccgacggtaacggttacctgactccccaggaattcaccaccggcttttcacacttcttcttcagccaaaataatcccagccaggaggacgccggcgagcaggtggcacagaggcacgaggaaaaggtttatctgtctcggggcgatgaagatctgggtgatatgggggaagatgaagaggcccagttcaggatgctaatggacaggcttggggcccagaaagtccttgaggatgaatccgatgtcaagcagttatggttacagctgaaaaaagaagaaccccacctcctgtccaatttcgaggacttcctgaccagaatcatctcacagttgcaggaagctcacgaggaaaaaaacgagctggaatgcgccctgaagagaaagattgccgcctatgatgaggagattcagcacctgtatgaggaaatggagcagcagattaagtctgaaaaggagcagttcctcctgaaagataccgaaaggttccaggctagatcgcaggaacttgagcagaaacttctctgtaaggagcaggagttagaacaactgactcaaaaacaaaagcgattggagggtcaatgcacagccctccaccatgataaacacgagacgaaagcagaaaatactaaactgaagctgactaaccaggagctagcgcgggagctggagagaacatcttgggagctgcaggatgcccagcaacaactagagtctctgcaacaagaagcctgcaaactgcaccaagagaaggaaatggaggtatatcgggtgacagagtctcttcagcgtgagaaggctggccttctgaagcagctggacttcctccgcgagcgtaataagcacctgcgcgatgaacgggatatttgtttccaaaagaataaggcggcaaaagctaatactgccgctagtcgggcttcctggaagaagaggtccggttccgtcatcggtaagtacgtggatagccggggaatcttgcgccgctggcctcagagagatagaggaatccctacgcttcaataccagacccagcgggatctggaggactgcaagcacgagatgaaaaaaatctgcaaggccgaggtgactctggagatgtag

SEQ ID NO: 186331 - DNA, 357 bp, Artificial Sequence
  Description of Artificial Sequence: Synthetic coding sequence
tgagagaaggagatggaggtgtaccgggtgaccgagagcctgcagcgcgaaaaggcagggctcttgaaacaactggacttccttagggagaggaacaaacacctaagagatgaacgcgacatttgttttcagaagaacaaggcggcgaaggccaacacagcggccagccgcgcaagctggaagaagcggagtggctcagtgattggaaaatatgtggattctcgaggaattctaagaaggtggccccaacgcgatcggggtatccccaccctgcagtaccagacacagagggacttggaggattgcaaacacgaaatgaaaaagatctgcaaggcggaggtaactctagaaatgtag

SEQ ID NO: 186332 - DNA, 1923 bp, Artificial Sequence
  Description of Artificial Sequence: Synthetic coding sequence
atggtgagcaaccccgtgcacggcctgcccttcctgcccggcaccagctttaaagactccaccaaaacggccttccacagatcccagacactgagttatcgtaacggctatgccatcgtcagacggcccacagtcggtattgggggggatcgcctgcagttcaaccagctctcacaggcagaacttgatgagcttgccagcaaagcccccgtcttaacatacggccaaccaaaacaagcgccgcctgccgatttcatccccgcccacgtggctttcgacaaaaaggtgctcaagttcgacgcctatttccaagaagatgtgcctatgtccacagaagagcagtatcgcattagacaggtcaacatatactactacctggaggatgactctatgtccgtgattgaaccagtggtcgaaaactctggaattctgcagggaaaacttataaaaaggcagcgcctggctaagaacgataggggggaccactatcactggaaagatcttaacagagggatcaatatcacaatttacggtaaaaccttcagagtggtggattgcgaccagtttacccaggtctttttagagagccaagggatcgagctgaatcctcccgaaaagatggctctggacccatacaccgagctgcgcaagcagccactgaggaaatacgttacgccatctgatttcgaccaactcaaacaattcctaacatttgacaaacaggttctcagattttatgcaatctgggacgataccgattcaatgtacggcgagtgccgcacatatataattcactactatctcatggacgacacagtcgagattcgggaagtgcatgagcgtaatgacggccgggatcctttccctttgctgatgaatcgccagagagtccctaaagtcctagttgaaaacgcgaaaaatttccctcagtgcgtactggaaattagtgaccaggaggtcctggagtggtacaccgcaaaggactttattgttggcaagtccttgaccattctgggaagaacctttttcatttatgattgcgacccattcacacgcaggtattacaaggagaaatttggaataacagatctccccagaatcgacgtgagcaaacgtgaacccccacctgtgaagcaagagctgcctccttacaacggatttgggctagtagaggactcagcgcaaaactgcttcgcactcatccccaaagccccgaagaaggatgtgatcaagatgttagtcaacgataataaagtgttacggtatctggcggtcttggagtcccccattcctgaggacaaagaccggcgtttcgtgttcagctattttctggctacagacatgataagcatttttgaacctcctgtgcgcaattctggaataatcggaggaaagtacctaggaagaacgaaggttgtgaagccctattctacagttgataatcccgtgtactatggccctagtgacttcttcataggggctgtgattgaagtgtttggccaccgcttcattattctggacaccgatgagtacgtgctgaagtacatggaaagtaacgcggcccaatactcaccagaggctctggcatcgattcagaaccatgtgcgcaagagggaagctccggccccagaagccgagtctaagcagacggagaaagaccctggggtgcaagagttggaggctcttatcgataccattcagaaacagctcaaggaccactcgtgtaaagacaatattagggaggctttccagatctatgataaagaagcgagcggatatgtcgatcgggacatgttcttcaagatatgcgagtcgttaaatgtacctgttgacgactccctcgtgaaggagctgatccggatgtgctcgcatggagagggcaagatcaactactacaacttcgtgagggcattcagcaactag

SEQ ID NO: 186333 - DNA, 1653 bp, Artificial Sequence
  Description of Artificial Sequence: Synthetic coding sequence
atgagctggcccgtgctgaagttcgacgcctacttccaggaggacgtcccaatgtcaaccgaagaacaatacagaataagacaggtgaacatttactattacctggaagacgactccatgagcgttatagaacctgtcgtggaaaactcaggtattctgcagggaaaactcattaagcgtcagcggcttgccaagaatgacaggggggaccactaccactggaaagatctgaaccgaggaatcaacattacaatttacgggaagacattccgagtcgtggactgtgaccagttcacacaggtgttcctggagagccagggaatcgagctgaatccacccgagaaaatggccctagatccgtacactgaattgagaaagcaaccactgagaaagtatgttaccccgtcggatttcgatcagttaaaacagtttctcacatttgacaagcaggtactccgcttttacgctatctgggatgatacagattctatgtacggtgaatgtcggacctatataatccactactatctgatggatgatacagtcgagattagggaggtccacgagagaaatgacgggagagatccattccccctgttaatgaaccgacagagggtcccaaaagtcctggttgagaatgctaagaacttccctcagtgcgtgctcgaaattagcgatcaagaggtgctcgagtggtacaccgcgaaagattttattgtagggaagtccctgaccatcctgggccggacgttcttcatatatgactgcgatcctttcactcggcgttactataaggaaaaattcggtatcacagatctgccccgtattgatgtgagcaaacgggaacctccgccggtcaagcaagaactcccaccctacaatggattcggacttgtggaagatagcgcccagaactgctttgcccttattcctaaggctcctaagaaggacgtgatcaagatgctagtcaacgataacaaggtgctgagatatctcgctgtgttagagtctcctatcccagaagacaaggataggcggtttgtcttcagttattttctcgccaccgacatgataagtattttcgaaccccccgtgagaaacagtggcatcataggggggaagtacctgggccgcacgaaagtcgtgaagccttattccaccgtggataatcccgtctactacgggccatccgactttttcattggcgcagttattgaagtgtttggtcatcgattcatcatcttagacactgacgaatacgtgctaaagtatatggagagtaacgccgcccaatattctccagaagccctggcatccatccagaatcatgtgaggaagagagaagcccctgctccagaagccgaatccaagcagacggaaaaagatccaggtgtgcaggagttggaagcactgatcgacaccatccagaaacagctgaaagaccatagctgtaaggataacatccgagaagcattccaaatctatgataaagaagcatcgggctacgtcgaccgagacatgttcttcaagatttgcgaatccctgaatgttcccgttgatgattctctcgttaaggaagtcacttgcaagaggttactgcttccagccttcaccttcccctcacccgtctggatcccactgtgcgggctgtag

SEQ ID NO: 186334 - DNA, 1866 bp, Artificial Sequence
  Description of Artificial Sequence: Synthetic coding sequence
atgctgaagaccgccttccaccggagccagaccctgagctaccggaacgggtatgcaatcgtgcgcagacctacagtgggcatcggcggcgatcgcctgcagttcaaccaattgtcccaagcagaacttgacgagcttgccagtaaagcaccagtcctgacttacgggcagcctaaacaggccccaccggcagatttcattccggcgcacgtggcatttgacaaaaaggtgcttaagtttgacgcctactttcaggaggacgttccaatgagcaccgaggagcagtacagaatcaggcaagttaacatctactactatttggaggacgactccatgtcggtgatcgagccggtggtcgagaattccggcatcctgcagggcaaactaattaagcggcaacgcctggccaagaacgatagaggagaccactaccattggaaggacctaaatcgggggatcaacatcactatctatggcaagacattcagagttgtggactgtgatcagtttacacaggtcttcctcgaatcccagggtatcgagctcaacccccccgagaagatggcgttggacccatacaccgagcttcgaaaacagccactgcgtaagtacgtcacacctagcgacttcgaccagctgaaacaattccttaccttcgacaaacaagtcttgcgcttctatgccatctgggacgacaccgatagcatgtacggcgaatgtaggacgtatatcatacactactatctcatggatgacaccgtggaaatccgcgaggtgcatgaaagaaacgatggccgcgacccatttcccctgttaatgaataggcagcgggtgcccaaggtgctggtggagaacgctaagaattttcctcagtgcgtgctggagatatctgatcaggaagtcttagagtggtacaccgcaaaagacttcatcgtgggaaaaagcctgacaatactgggacgaaccttttttatttatgactgcgaccctttcacccgccgttattacaaggaaaaattcggaattactgacctgcctaggatcgacgtctcaaagcgcgaacccccacccgttaaacaagaactgcccccctacaacggctttggactggtggaggatagcgcacaaaactgctttgccttaattcccaaggcgccaaaaaaagacgtgattaagatgttagtgaacgacaataaagttctgcggtatctggccgtactcgagtctcccattcccgaggacaaggatagaagatttgtattcagttatttcctagcaacagacatgatctctatctttgagccgccagtgagaaactccggaattatcggtggcaaatatctggggagaacaaaggtcgttaagccttactctactgttgacaacccagtgtattatggcccttccgactttttcatcggtgcagtgattgaggtgttcggccatcgcttcatcattctcgataccgatgagtatgtcctgaagtatatggaatctaacgcagcgcagtactctcctgaagccctggccagcattcaaaaccatgtgcgaaagagggaggctcccgcgccagaggccgaaagtaaacagaccgagaaagatcctggtgtgcaggagctggaggctctgattgataccatccagaaacagctgaaggatcacagttgtaaggataacatccgcgaggctttccaaatctatgataaggaggccagcgggtatgtggatagagatatgttctttaagatatgtgagtccctgaacgttccggtcgacgactcgttggttaaagaactcatccggatgtgttcccacggggagggtaaaattaactattataactttgtccgagctttcagtaattag

SEQ ID NO: 186335 - DNA, 2250 bp, Artificial Sequence
  Description of Artificial Sequence: Synthetic coding sequence
atggccctgcccctgctgcccggcaacagcttcaaccggaacgtggggaaagagaagtttcataagagccagcactgggggttctgtaataatgtgatgatgctcgtttcagatgaaaagccaggaatcgggggtgagccacttctcggtcagaagattaaaccgaagtgctccatctatcccaaaggggatggaagcgatgtacctagctgggtggcctttgacaaacaggtgctgtctttcgacgcctatctggaagaggaagtgttagataagagtcaaaccaactatcgcatccgctactataaaatctatttttatcctgaagacgataccatacaagtgaatgagccagaggttaaaaactcgggattgcttcaaggaacgtccatccggagacacaggatcacacttccgccacctgatgaggaccagttttatacagtataccacttcaacgtcggtaccgaggtcgttttctacgggcgtacctttaagatctacgattgtgacgcctttactcgtaattttctccggaaaattggcgtcaaagtgaatccccccgtgcagtgccccgaagatccatatatgaagatacggagggaggtagttgagcacgtagaacctctgagaccctatgaatcactggatacgctcaaacagtttttgcaatatcatggaaaaatactttgctttttttgcttgtgggatgacagcgtctcgatgtttggagacaggcgggaactcatcctgcattactttctgtgtgatgacacgatcgagatcaaagagttgctcccgcactctagtggccgggatgctctcaagatgttcttgcgccggtcaaagttaccgaagaattgcccacccagggtgtatcagcctggtcagattaccgaccgcgccgtcctgaattcatatggggacttcattaagaatcaagccgatggatatctctttgacaggtataaactcggaaaggtggatcaagaattttacaaagacagtgacttgtccctgggcgtgaccattaacgtgtggggccgcaaggtcctcctatacgactgtgacgagtttacaaagagctattacaagtcaaagtacggtattgaaaatttcaccagcgtttcctgtaaacccccatctccccctccaaaaatagagcggaagtttccaccctataatggatttggatcggaagaggactcattgagaaactgcatcgatttaaaacccactcctcacagacgcaacttcaaaaaattcatggagaaggatagttatggatcgaaatctaatattcttcgcttctttgccaagctcgtgacggataaatgcgttgacttagaccgcatgttcgtgatttcttactacctcggggatgatacaatctccgtgttcgagccaattgaacgaaactccggtattgccggcggcatgtttctcaaacggtccagagttaagaagccaggacaggaggttttcaaaagcgagctgtctgaatacataaaggcagaagagctgtacattggagtcaccgtgaacgtgaatggatatcttttccggctgctgaatgcggacgagtatacacttaattatatggagcaaaacaccgataagtacccattcagtaatcttaagttggcattacagaaattaaagcaggaagaggggaaatcccgcgagctgaagcaggtttttaaagctgcagattcaaagcacacaaatatggtggattataacacctttcgcgacattctgatgagtttgacggtcggcaatctcgccgagcaggagtttgtcaccatcgctaggcactaccgtgtgcccgagggtacctgctccgatatggacttcctgatagctctagcccacgaaaaattcaagaagaatatgttcgagaacttcgacacttttatctactcttgtgtgtacgaggacagagagaagaaaaatgtgctgccgacaaaggatataaaacggttatgcaagtcctcaagactccctttatccgatgacctcctggagagcctgctaagtaggttcgaggacagcgagaaacagattgactacaagagcttcttttccgcgttgaactggcgcaaaaaccccgttccggaactgcaacccgcctcatatctaaaggagagatgtgaagatgtttggctcggcatgcctagtcccattccagcaaaatacatcgattactggactttcctcaaggacgcattcggcctcgaagaggagtag

SEQ ID NO: 186336 - DNA, 489 bp, Artificial Sequence
  Description of Artificial Sequence: Synthetic coding sequence
atgagcctgaccgtgggcaacctggccgagcaggagttcgtgaccattgccaggcattatagggtgcccgagggcacttgttccgacatggatttcctgattgccctagctcacgagaagtttaaaaaaaacatgttcgagaatttcgacaccttcatttattcatgtgtgtatgaggacagggagaagaagaatgtgttacccacaaaggatatcaaaaggctgtgcaagtcctcacgcctgcctctgagtgacgacttactcgagtcgctgctgagcagatttgaggatagcgaaaagcaaattgactacaagagtttttttagcgccttgaattggcgcaaaaaccctgtgcccgaactgcagcccgctagctacctaaaggagaggtgcgaagacgtctggctcggaatgcctagcccaattcctgccaaatatatcgactactggacattcctcaaggacgctttcggactcgaggaagagtag

SEQ ID NO: 186337 - DNA, 753 bp, Artificial Sequence
  Description of Artificial Sequence: Synthetic coding sequence
atgaagatccggcgggaggtggtggagcacgtggagcccctgcggccgtatgagagcctggacacactcaagcagtttctgcagtaccacgggaaaatcctctgcttcttctgtctctgggatgatagcgtcagtatgtttggcgaccgcagggagcttatactccactacttcctgtgcgacgatactatcgagattaaagagctgctgccacattcctccgggcgggatgctcttaagatgtttcttaggcgctctaagcttcccaagaactgtccacctcgcgtttaccagccaggtcagattacagatagagcagttctcaatagctatggagatttcatcaagaatcaggctgatgggtatctgttcgacagatacaaactgggaaaagttgaccaggaattttataaggactctgacctgtctctgggcgtcacgattaatgtgtggggacgtaaggtactactgtacgactgcgatgaattcaccaagtcctattataagagcaaatacggaatcgaaaattttaccagcgtgtcctgcaaaccgccatccccaccgcccaaaatagagcgaaaattccctccttacaatggatttggatccgaggaagactcactacggaattgcatagaccttaaacccacaccccatagaagaaattttaaaaaatttatggaaaaggactcctatggatccaagagcaacatcctgttcttttgcaagacttcccatcgacagatgtgctag

SEQ ID NO: 186338 - DNA, 2334 bp, Artificial Sequence
  Description of Artificial Sequence: Synthetic coding sequence
ggcggccagaccacccggcccggcggcgccgccgcctgccgggccctctcaagtggcacacttgattttcggacactgtccgcaatggcactgccactgctgccaggtaatagctttaatagaaatgtgggtaaagagaaattccataagtctcagcactggggattctgcaacaacgtgatgatgctagtgagcgatgaaaaacctgggatcggtggcgagcccctgctgggccaaaaaattaaacctaaatgttccatataccctaagggagacggtagtgatgttccatcttgggtggcattcgacaaacaggtcctgagtttcgacgcttatctggaggaggaggttcttgacaaaagtcagaccaactaccggatccgctattataaaatttatttctatccggaggatgataccattcaggtgaacgaacccgaggtcaagaatagcggcttgctgcagggcacctctatccgccggcatagaatcaccctgcctccaccagatgaggatcaattctatacagtctatcattttaacgttggcacagaggtagttttctatgggcggacattcaagatatacgattgcgacgcctttacgcggaacttcctgagaaagattggtgtgaaagtgaaccctcctgtgcagtgtccggaagatccctatatgaagattcggcgggaggtggtggagcacgtcgaaccgttacggccatatgaaagtctagataccttgaagcagtttctgcagtaccacggaaagattctgtgctttttttgcttgtgggacgattccgtctcgatgttcggagatcggagagaattgatcctacactacttcctgtgtgatgacacaatagagatcaaagagctccttccgcactccagcgggcgcgatgctttgaagatgttcctcagacgaagcaaacttccaaagaattgccctcctcgagtgtatcagccaggtcagataactgacagggctgtcctgaattcatacggcgactttatcaagaaccaggccgatggatatcttttcgacagatacaaattgggcaaggtagaccaagagttttacaaggattccgacctgtctctgggtgtcaccatcaacgtttggggaaggaaagtactgctctatgactgcgacgagtttaccaaatcatactataaatcaaaatacggcatagaaaacttcacaagtgtgtcgtgcaaaccaccatcccctccacccaaaattgagcgaaaattcccaccctacaacggattcggcagtgaagaggactccctgagaaactgcatcgatttgaaacctaccccccataggcggaactttaaaaaatttatggagaaagacagctatggctctaaatcaaacattcttagattctttgccaaattggtaacagacaagtgtgtggatctcgaccgcatgttcgtgatttcatactatttaggcgatgataccatttcagtatttgagcccattgagcggaactctggcatcgcaggaggtatgtttctgaagagatcaagggtgaaaaagccgggacaggaggtcttcaaatccgagctgtcagagtatattaaggctgaggaactctatatcggggttactgtaaatgtgaatggttatctgtttaggctgctcaacgctgacgagtacacccttaattacatggaacaaaacaccgataaataccctttcagtaacctgaagctcgctctccaaaaactgaaacaggaagaggggaaatccagagagctcaaacaagtgttcaaggctgccgatagcaagcacaccaacatggtcgattacaacacattcagagacattcttatgagcctgactgtcggtaaccttgcagagcaagagtttgttaccattgcgcgccactatcgagtgccggagggcacatgttcagatatggactttctgattgccctggctcacgagaagttcaaaaagaatatgttcgagaatttcgacactttcatatattcttgcgtgtacgaggacagagaaaagaagaacgtactgcccaccaaggacatcaagcggctgtgcaaatcctctagattgccactgtctgacgacttgctcgaatcactgctgtcacgcttcgaggattcagaaaagcagatagattacaagagcttcttctcggccttgaactggcgtaagaaccctgtccctgagctgcagcctgccagctacctcaaggaacgttgcgaagacgtatggctcggcatgccaagcccgatacctgccaagtatatagattactggacattcttgaaagatgcctttggactcgaggaggagtag

SEQ ID NO: 186339 - DNA, 2193 bp, Artificial Sequence
  Description of Artificial Sequence: Synthetic coding sequence
tgaaacaacaccgccggccggcggcggtgcctgcccggccccctgttttgggatcccgggttttctgatacagagcgacacgggccggcatctgccgctgggcagcaacttcagccacagagggagaaaggcgatgggtctgatgtaccctcatgggtagcctttgataagcaagtgttgtccttcgatgcgtacttagaagaagaggtcctcgacaagtcccagacaaattaccgaattcgctactacaagatctacttctaccccgaggacgacacgatccaggtgaacgaacccgaggttaagaacagtggcctcctgcaagggaccagcattaggcgccacagaattacgctcccaccccccgacgaggatcagttttacactgtgtaccactttaatgtggggactgaggtggtcttttatggccgcacctttaagatctatgactgcgacgcatttacacgaaactttctgcggaaaatcggagtgaaagtgaaccctccagtgcagtgcccggaggatccctacatgaagatccgcagggaagtggtggaacacgtcgagcctcttcggccttatgagtccctcgacactttaaaacaatttctgcagtatcatggcaaaattctgtgcttcttctgcctctgggatgatagcgtctcaatgtttggcgaccggcgggaactgatactgcattacttcctgtgcgatgacactattgagattaaagagttgctgccacactcctccggccgggatgccttaaagatgttccttcgacgatctaagttaccaaaaaattgccctcctcgtgtatatcaacccggacagatcactgacagagcggtgcttaattcttatggggactttattaagaatcaagccgatggctacctttttgatcgctataaactgggaaaggttgatcaggaattctacaaggatagcgaccttagtctgggcgtaaccatcaacgtgtggggacgtaaagtcctcctatacgattgcgacgagtttacgaagagctactacaagtctaaatacggaatcgagaacttcacaagtgtttcctgcaagcctccctcaccaccacccaagatcgagcggaaatttccaccatacaacgggtttggcagcgaggaagacagcctcaggaactgcatagacctcaagcccacccctcatagacgtaatttcaagaagtttatggagaaagactcttatggctctaaaagtaatatactgagattctttgctaagctcgtcactgacaagtgtgtcgatctggatcgaatgttcgtcatcagctactatctgggtgatgataccatcagcgtgtttgaacctatcgagcggaactctggcatcgcaggaggcatgttccttaagcgtagcagagtgaaaaagcctggtcaagaggtatttaagagcgagttgagtgagtatatcaaggccgaagagctgtatatcggcgtgacagtgaatgtaaacggctatctgttccgacttcttaacgcagacgagtacacgctcaattatatggaacagaacacagataagtacccattctctaatctgaaacttgccctgcagaaactaaagcaagaggaaggaaagagccgagaattgaaacaagttttcaaagctgctgattcaaagcacaccaatatggtggattataatacctttagggatatcctgatgtctctcacggtgggcaatttggccgagcaggagtttgtgaccatagcccgccactatagagttccagaaggaacttgctccgacatggactttctcatcgccctggcgcatgagaagttcaaaaagaatatgtttgagaattttgatacattcatttacagttgtgtctacgaggacagagagaaaaaaaatgtgttacccactaaggatattaaacgattgtgtaaaagttcccgcctgccccttagcgacgatctgttggaaagcttgctgagccgatttgaagactctgagaaacaaatcgactataagagtttcttctcagcactgaactggcgcaagaatccagtcccagagctccaaccagcttcttacctaaaggagagatgcgaagatgtctggttggggatgccctctcctatccccgccaagtacatagactattggacatttttgaaagacgcatttggactggaagaagagtag

SEQ ID NO: 186340 - DNA, 720 bp, Artificial Sequence
  Description of Artificial Sequence: Synthetic coding sequence
atggccagcgaggagctggcctgcaagctggagcggcggctgcggagggaggaagccgaggagagcgggccccaattagctccgctcggtgcccccgcgcccgagcccaagcctgaaccagagcctcctgccagggcacccactgcatccgccgacgcagagctctcagctcagctgtccaggaggctagacatcaacgagggggccgcaaggccgaggagatgtcgggtcttcaacccttatactgagttcccagagtttagtaggcgtctgatcaaggatctcgaatccatgttcaagctgtacgatgcaggaagagacgggttcattgacctaatggagctgaaactcatgatggagaagctcggcgctcctcagacgcacctcggtcttaagtcaatgataaaggaagtcgacgaggatttcgatgggaagttaagcttccgcgagttcctattgatcttccataaagcagcggctggagaacttcaggaagattcagggctgatggctctggccaaattgtctgagatagatgtcgcccttgagggtgtaaagggcgccaaaaattttttcgaagccaaggtccaggccctgagcagtgcgtccaaattcgaagccgaactgaaggctgagcaagacgaacgcaagcgggaggaagaagagcggcgcctcaggcaggcagcgttccaaaagctgaaagcaaactttaacacctag

SEQ ID NO: 186341 - DNA, 432 bp, Artificial Sequence
  Description of Artificial Sequence: Synthetic coding sequence
atgggcgagctgcagtacgacgccggccgggacggcttcatcgaccttatggaacttaaactgatgatggagaagctgggagctcctcagacgcatctgggactaaaatctatgattaaagaggtggacgaggatttcgatgggaaactgtctttccgcgagtttctgctgatttttcacaaagctgcggcaggtgaactgcaggaggacagcggtctgatggccttagccaagctgtcagagatcgacgtagccttggaaggggtgaaaggggccaaaaatttcttcgaagcaaaggttcaggcacttagtagtgcatctaagttcgaagctgagctgaaggccgaacaggatgagaggaaacgggaagaagaggagcgtcgcttacggcaggcagcatttcaaaaattgaaagctaatttcaatacatag

SEQ ID NO: 186342 - DNA, 384 bp, Artificial Sequence
  Description of Artificial Sequence: Synthetic coding sequence
atggagctgaagctgatgatggagaagctgggcgccccccagacccacctggggctgaaaagtatgattaaggaagtggacgaggacttcgacggtaaattgagcttcagagagttcctgttgattttccataaagcggcagctggagagctccaggaggatagtggcctaatggcactggccaagctttccgagatcgacgtcgccttggaaggtgttaagggcgccaagaattttttcgaagccaaggtgcaagccctgagctcggcgagtaagtttgaagcagagctcaaggccgaacaggatgagcgcaagagggaggaagaggagcgtaggctgcggcaggccgccttccagaagctgaaagccaacttcaatacctag

SEQ ID NO: 186343 - DNA, 384 bp, Artificial Sequence
  Description of Artificial Sequence: Synthetic coding sequence
atggagctgaagctgatgatggagaagctgggcgccccccagacccatctcggtctgaaaagcatgatcaaggaagtggatgaggacttcgatggcaagctgtcctttagggaattcctgttgatctttcataaagcagctgccggtgagcttcaggaagattccggattgatggcccttgcaaaactatctgaaattgacgttgcgcttgaaggcgtaaaaggtgccaagaacttttttgaggcgaaggtgcaggccctctcttctgcgagcaagtttgaagctgagctcaaagctgaacaggatgagaggaaacgggaggaggaagaacggcggctgagacaggcggcattccagaagctcaaggctaactttaacacatag

SEQ ID NO: 186344 - DNA, 429 bp, Artificial Sequence
  Description of Artificial Sequence: Synthetic coding sequence
atgttcaagctgtacgacgccggccgggacggcttcatcgacctgatggagcttaaattgatgatggagaaattgggtgccccccagacacacttgggactgaagtctatgattaaagaggttgacgaagactttgatggaaaattgagctttagggagtttctcctgatttttcacaaggctgccgcgggggaactgcaggaagacagcgggttgatggccctcgctaaactctccgagatcgacgtagcattggagggtgtgaagggggccaagaatttcttcgaagctaaggtccaggcactgtcttcagcaagcaaattcgaggcagagctgaaagctgaacaagacgagaggaagcgcgaggaagaggagagaagattgcggcaagctgcatttcagaaattaaaggcaaattttaacacttag

SEQ ID NO: 186345 - DNA, 2466 bp, Artificial Sequence
  Description of Artificial Sequence: Synthetic coding sequence
atgcccacccgggtgtgctgctgctgcagcgccctgcggccccggtataaacgattagtcgataatatttttccagaggaccctaaagatggactagtcaaaactgatatggagaagctgactttctacgctgtttcagccccagaaaaactggacaggatcggcagttaccttgccgagcggttatctagggacgttgttcggcacagaagtgggtacgttctcatagccatggaggcattagatcagcttctgatggcatgccattctcagagtatcaaaccgtttgtcgaaagttttttgcatatggtcgcaaagctgctggaatcgggcgaaccaaaactccaggttttgggcactaatagcttcgtgaagttcgcaaacatcgaggaagatacaccatcctaccaccgccgctacgacttctttgtcagtcgtttttctgctatgtgccacagctgccacagcgaccccgaaatccggacagagatacgtatcgcagggatacgagggattcagggggtggtcagaaagaccgtgaacgatgaactcagggcgacgatttgggaacctcagcacatggataaaattgtacctagccttctgttcaatatgcagaaaattgaagaagtggattcaaggatcggccctccatcttctccttcggccacagacaaggaggagaaccctgccgtgctagcagaaaactgtttcagggagcttctcggacgtgccacctttggcaatatgaataatgccgtgcgccctgtcttcgctcatctggaccaccacaagctatgggatcccaatgagtttgccgtccattgtttcaaaatcatcatgtacagcatccaggcacagtacagtcaccacgttatacaagagatcctcggtcacctcgatgcccgtaaaaaggacgcccctagggttagagccggtatcatccaggtgctccttgaagctgtggccattgccgcaaaaggcagtatcggcccaacagtgcttgaggttttcaacaccctgttgaagcacctccgcttatctgtggaatttgaggctaacgatttgcagggtggatccgtcgggagcgtaaacctgaacacgagttccaaagataatgacgaaaagattgtgcagaacgctatcatacaaacaattggtttctttggatctaacctgcctgactaccagagaagcgaaattatgatgtttatcatgggcaaggtgcccgtattcgggacttcaacacacaccctagacatcagtcagctaggggacctcggtacaaggcgcattcagatcatgcttcttcgatcactgcttatggttacaagcgggtataaggcgaaaacgatcgtgaccgcccttccaggcagtttcctcgaccctttgctttccccctctttgatggaggactatgaactgagacagctagtcctagaagtcatgcataatcttatggataggcatgacaaccgcgcaaagctgcgtggcatccggattatccccgacgttgccgacctgaagataaagagggaaaaaatctgcaggcaagacaccagtttcatgaagaaaaacggccagcagttgtatcgacacatctacctcggctgtaaggaggaggacaatgtgcagaagaactacgagcttctttacaccagccttgccttgataactattgagttagccaacgaggaagtagtgattgatctgatacgcctggccatcgcacttcaagactccgcaatcattaacgaggataacctgcctatgttccaccgctgtgggatcatggcactggtcgccgcctatttgaacttcgtttctcaaatgatagccgtcccagctttttgccagcacgtgtccaaagtcatagagataaggacgatggaggctccttacttcctgcctgaacacattttccgggacaaatgtatgctgccaaagagccttgaaaagcacgaaaaggatctttattttcttaccaacaaaattgcggaatctctcggcgggagcggctactctgtagaaaggctgtctgtgccctacgtgccacaagtgaccgatgaggatcggttgagcaggcgcaagagcattgtcgacaccgtcagcatccaggtggatatcctctccaacaacgttcctagcgatgatgtggtgtcaaacacagaagagataacattcgaggcccttaagaaggctattgatacttccggtatggaagagcaagaaaaagagaaaagacgcttagtcatcgagaagttccaaaaggctccctttgaagaaattgctgctcagtgtgaatccaaggcgaacctcctacacgatcgactcgctcagatccttgaactgactatccgcccccctccttcccccagcggaactcttaccatcacatcgggccatgcccaataccagtccgttcctgtctacgaaatgaagtttccggacctgtgtgtgtactag

SEQ ID NO: 186346 - DNA, 2466 bp, Artificial Sequence
  Description of Artificial Sequence: Synthetic coding sequence
atgaagagccgggtgtgctgctgctgcagcgccctgcggccccggtacaaacgactcgtcgataatattttccccgaggatcccaaggacgggcttgttaaaactgatatggagaagcttaccttctatgcagtttccgcgcccgaaaagctcgatcgcattggaagttacctcgctgagagactgagccgcgacgtagttcggcaccgttctggatatgtgcttatcgccatggaagccctggatcagctgcttatggcctgccattcccagagtatcaagcccttcgttgagtcctttctgcatatggtcgccaagctgctcgagtccggcgaacccaaactgcaggtcctcgggacaaattccttcgtgaaatttgctaatatcgaggaagacacaccttcctatcatcggagatatgatttctttgtgagccgcttcagcgccatgtgtcatagctgtcacagcgaccccgaaatccggaccgagattcgaattgccggaattcgcggcatccagggtgtggtccgcaaaaccgtgaatgatgagttacgtgctacaatatgggagccccagcatatggataagattgtcccctctctcctgtttaacatgcagaagatcgaggaagttgattccaggattggccccccctcaagcccatcggctaccgacaaagaagagaatcctgccgtgctcgctgagaactgttttagggagcttttaggacgggcaaccttcggcaacatgaacaacgctgtgcgccctgtgtttgcacacctggatcatcacaaactgtgggacccgaatgagtttgccgtgcactgtttcaagatcatcatgtattctatacaggcacaatactctcaccatgttatccaggagatcctgggtcatctcgatgcgcgaaaaaaagacgctccgagggttagggcagggattatccaggtgttgttagaagctgtagcaatcgcagcaaaggggagcatcgggccaaccgtcctcgaagtttttaatacattattaaaacatctcaggctgagcgtggaattcgaggcaaacgacctgcagggaggttccgttgggagcgtcaacttgaacacaagttccaaggataacgatgagaagatcgtacagaatgctataatccagactattggcttttttgggagtaacttgcccgactaccagcgctcagagattatgatgtttattatgggcaaagtccccgtgttcgggacctcaacacataccttggacatcagtcaactcggggatctgggcacaaggcggattcagatcatgctcctgcggtccttgctcatggtgacaagcggttataaagccaaaaccatcgtcaccgcactgccaggcagctttttagatcctcttctcagcccatcccttatggaggattatgagctgcgccagttggttttagaggtaatgcacaatttgatggatcgtcacgacaaccgcgctaaactcagaggtatccgcataattcccgatgttgcggatctcaagatcaagcgtgagaagatatgccgccaagacacatctttcatgaaaaagaacgggcaacagctatatcgccacatctacctgggctgcaaggaagaggataacgtgcagaagaactacgagctcctgtacacatctttggccctcatcaccatcgaacttgcaaatgaagaggtggtcattgatctgatcaggctggcaattgctttgcaagacagtgccatcatcaatgaagacaatttgcctatgttccatagatgtgggataatggctttagtcgcggcgtatcttaacttcgttagtcaaatgatcgctgtcccagccttttgccaacacgtgagcaaagttatcgaaatccgtaccatggaggctccatacttcttgccagagcacatattcagagacaaatgcatgttgcccaaaagccttgagaagcacgaaaaagatttatatttcctcacaaacaagattgctgagagcttaggaggctctggctatagtgtcgaaaggttatccgtcccttacgtgccacaggttacggatgaggatcgcctgtcccggagaaagtcaatcgtggatactgtgtcaatccaggtagacatcctcagcaacaatgtgccttcagacgatgtggtgagtaatacagaggagatcacctttgaagccctgaagaaggccatagatacatctggcatggaggagcaggaaaaggagaagcggagactcgttatagaaaaatttcaaaaggcaccctttgaagagatcgccgcccagtgtgagagcaaggccaatctcttgcacgacaggcttgcccaaatcttagaactcaccattcgaccacctccctctccgtccggcactctgacaatcacctccgggcacgcccaatatcagtctgtacctgtttatgagatgaaatttcctgatttgtgtgtgtattag

SEQ ID NO: 186347 - DNA, 2334 bp, Artificial Sequence
  Description of Artificial Sequence: Synthetic coding sequence
atgcccaagggcgtgtgctgctgctgcagcgccctgcggccccggtataaacggcttgtcgataacatttttcctgaggatccaaaggacgggctggtgaagacggatatggaaaaactgaccttctacgcagtctccgctcctgagaaactggaccgcattggatcctacctggctgaacgcctgagtagagatgtggtgcggcacagaagcgggtatgtactgatagcaatggaagccctggaccaattgctgatggcctgtcatagtcagtctatcaagccgtttgtcgagtcttttctgcacatggtcgcaaagctgctggagtccggagagcccaaactacaggtcctggggaccaattcctttgtgaagtttgcaaatatagaggaagacaccccatcataccacagaaggtacgacttttttgtgtcccgcttcagcgcgatgtgccattcttgtcattcggatccggagattcgcactgagatcaggatcgccggcatccggggaatacagggagtggtgcggaagacagttaacgatgaacttagggcaactatctgggagccgcagcacatggacaagattgtgccttctttgctgttcaacatgcaaaagatagaggaagtcgacagcaggatagggcccccatcatctccgtccgccaccgataaagaagagaatcctgccgtgttggccgaaaattgctttcgcgaactcctcggacgggcgactttcggaaatatgaataatgcagttcggcccgtgttcgcccaccttgatcatcacaaactgtgggatcctaacgaattcgccgttcattgctttaaaattatcatgtactccatccaggcccagtactcacaccatgttattcaagagatcctgggacatctcgacgctcgaaaaaaagacgctccacgagtacgggccggtatcatccaggtcctgctcgaggctgtcgccattgccgctaagggctccattgggccaaccgtgttagaagtcttcaatacgttgctgaaacacctgagactgtctgtggagtttgaggcaaacgatctgcagggaggtagcgtaggaagcgtgaatcttaacacctctagcaaggacaacgacgaaaaaattgttcaaaatgcgatcattcaaaccatcgggtttttcggtagcaatctcccagactatcagaggagtgaaatcatgatgtttatcatggggaaagtgccagtctttggcacgagcacccacacattggacattagccagttgggtgatctaggtacaaggcggatacagatcatgctgcttaggagtctgctgatggtgacgtctggttacaaggcgaagacgatcgtcaccgcccttcctggtagcttcctggatcctcttctgtccccctcattaatggaagattatgaactgcgccagctggtcctagaggtgatgcacaatttaatggaccggcacgacaatagggccaagcttcgtggaattagaatcattcctgacgtggccgacttaaaaattaagcgggaaaagatctgtcgacaggatacaagttttatgaagaagaacggccagcagttatatcgccatatttaccttggatgcaaagaagaagacaacgttcagaaaaactatgagctgctgtacactagcctggccctaattacaatagaactggctaatgaggaggtcgtgattgacctcataagacttgcaatcgctctccaggacagtgccattatcaacgaggataacttgccaatgtttcacagatgtgggatcatggctctcgtggccgcctatcttaatttcgtatctcaaatgatcgctgtgcccgcattctgccacaagattgctgaatcactcggcggatctggctactctgtggagcggctcagcgtgccctacgtgccacaagtcacagacgaagaccgactgagccggcgcaaaagtattgtcgataccgtgagtatccaggtggacattctttccaataatgttccgagtgatgacgttgtctccaataccgaggaaatcacttttgaggccctgaagaaggccattgatacgagcggtatggaggagcaagaaaaggagaaaagacggcttgtgatcgagaaattccagaaggcgccattcgaagagatcgccgcccagtgtgagtcaaaggcgaatcttctgcacgatcgactcgcacagatcttggagttgacaattcgtccaccaccctctccctccgggaccctgactatcacctcaggacacgcccaatatcagtctgtcccagtgtatgagatgaagtttcctgatttgtgcgtctactag

SEQ ID NO: 186348 - DNA, 603 bp, Artificial Sequence
  Description of Artificial Sequence: Synthetic coding sequence
atgctggcccggctgctgaagttcgaggaggccccctacttcctgccagaacacattttcagagacaagtgtatgctgccaaagtccctggagaagcatgaaaaagatctgtactttttaacaaacaagatcgcagagtctttgggagggtccggatactcagtggaacgtttgagtgtgccctacgttccacaggtgacagatgaggacaggctcagccgccggaaatctattgtggacaccgtcagcatccaggtggacatactctctaacaatgtgccgtccgatgacgtggtgtctaacacagaggagattacattcgaagccctgaagaaggcaattgacacaagcggcatggaagaacaggagaaggagaagaggcgcctagtaatagagaagtttcaaaaggcccctttcgaggagattgccgcccaatgcgagtccaaggccaacctcctccacgaccgccttgctcagatcttggagctcaccatcaggcctcccccatcacccagtggcacgctgactatcacttccggccacgcacaatatcagagcgttcccgtgtatgagatgaagttccccgatctctgtgtgtattag

SEQ ID NO: 186349 - DNA, 2358 bp, Artificial Sequence
  Description of Artificial Sequence: Synthetic coding sequence
atggagaagctgaccttctacgccgtgagcgcccccgagaagctggaccgcattgggtcctacctggccgagaggcttagtcgtgacgttgtccgacacaggtccggttatgttctgatcgccatggaggcactggaccagcttctgatggcctgtcattcccagtctattaaaccattcgtggagtctttcctgcatatggttgcgaagctgctagagtctggtgagccgaagctgcaggtgctgggcactaactcgtttgtgaagtttgctaatatcgaagaggacactccttcataccacagacgatatgattttttcgtcagtcgcttctccgctatgtgtcactcttgtcatagcgaccctgaaatccgcactgaaattcgcatcgctggcattagaggtatacagggggtagtgcggaagactgtcaacgacgaactgagagccaccatatgggagccacagcacatggataaaatcgttccctcactcctgtttaatatgcagaagatcgaggaagttgacagcagaatcggcccaccctcctccccaagcgccacagacaaggaagagaacccagctgtgctcgccgagaactgctttcgtgaactactggggagggcgacttttgggaacatgaacaatgccgtgagacccgtgttcgcccatctggatcatcataagctgtgggatccaaacgaattcgctgtccactgcttcaagatcattatgtacagtatccaggcacagtatagccaccacgtgatccaggagatcttaggccacctcgacgcccgaaagaaagacgccccccgggtgcgagccggcataatccaggtgctgctggaagcggtcgccatcgccgctaaagggagcatcggccccacggtgctcgaggtgttcaacactttactgaaacatctgagattgtcagtggagttcgaggctaacgacctccaaggcggaagtgtggggtcagtgaatcttaacacctcttcgaaggataatgacgagaagattgtgcagaacgctatcattcagaccataggatttttcggtagcaacctgcccgattaccagcggtcagaaataatgatgtttattatgggcaaagttccagtgttcggcacttctacccacactctcgatatcagccagttgggcgatctggggacacgaagaattcagatcatgcttttgagaagcttacttatggtaactagcgggtataaagctaaaaccatcgtgacagctttgcccggtagcttcctcgaccctctgctctctcctagtctgatggaggactatgaactgcgacaactggtgctggaagtgatgcacaatcttatggacaggcacgataatcgcgccaagttacggggaatcagaattattccagacgtcgccgacctgaagatcaagagggaaaagatctgcagacaagacacttcattcatgaagaaaaacggtcaacagttatatcgccatatctacttgggctgcaaggaggaagacaatgtgcaaaaaaattacgagcttctttacaccagtttagctttgattacgattgagttagctaatgaggaggtcgtgatcgacttgattaggctcgccatagctctccaagactccgctataataaacgaagacaacttgcccatgtttcacagatgcggaatcatggccctggttgccgcatacttgaacttcgtgtcccagatgattgccgtccctgcgttttgccaacatgtgagcaaggttatagagatcaggactatggaggctccctatttccttcccgaacacatttttagagataaatgcatgctcccaaagtcccttgagaagcacgagaaggacttgtactttctgactaacaaaatcgcagagagtctggggggaagcggctattccgtggagcgtctgtccgtgccctatgtcccacaagttaccgatgaggaccgacttagtaggcgtaagtcgattgtcgataccgtttcaatccaggttgacattctttctaataacgttccctccgatgatgtagtctccaacactgaggagataacattcgaagccctgaagaaagcaatcgacacctctggtatggaggaacaggaaaaggaaaagcgccgactggtgatcgaaaaattccagaaagcacctttcgaagaaatcgcagcccagtgtgagtctaaggccaatctgctgcatgatcggctggcacagatcctcgaactgaccatccgaccccctccatctccctctggcactctgacaataacctcgggccacgcacagtatcagtccgtgcctgtgtacgagatgaagtttccagacctctgtgtttattag

SEQ ID NO: 186350 - DNA, 1482 bp, Artificial Sequence
  Description of Artificial Sequence: Synthetic coding sequence
atgctgaaggccctgttcctgaccatgctgaccctggccctggtgaaaagtcaggatactgaagagacaatcacctacacacagtgcaccgacggctacgaatgggatcctgtgcgtcaacagtgcaaagacattgatgagtgtgacatcgtgccagatgcttgtaagggtgggatgaaatgtgtgaaccactacgggggatatttatgtctgcccaaaacagcccagattatcgttaacaacgaacagcctcagcaggaaacccagccagcagagggcacgagtggggcaaccaccggggtagtggcggccagcagcatggccacctctggagtgctccctggtggaggcttcgtggccagtgccgccgctgtggccgggcctgaaatgcaaacagggcgtaacaacttcgtgattaggaggaatccggctgatccacagagaataccaagtaacccttcccacaggatacagtgcgccgcaggatacgagcagagtgagcacaatgtatgtcaggatattgatgagtgcactgctggaactcataattgcagggctgaccaggtttgtattaatctccggggtagtttcgcctgtcaatgccctcctgggtaccagaaaaggggcgagcagtgtgtggacatcgatgagtgtacaatccctccgtattgccatcaaagatgcgtcaatacgcccgggtccttctactgtcagtgtagccctggttttcagctggcagccaataactacacctgtgttgatattaacgagtgcgatgcgtctaaccagtgcgcacagcagtgttacaatattctcggaagttttatctgtcagtgcaatcaagggtacgaactaagttctgacagattaaattgcgaagacatcgatgagtgccgtacctcctcttatctgtgccagtatcagtgtgtgaacgaacctggtaagttttcctgcatgtgtccccagggatatcaggtagtgaggtctaggacatgtcaggacattaacgaatgcgaaacaacaaacgagtgccgggaggacgaaatgtgctggaactatcatggggggttcagatgctatccaaggaacccctgccaggatccttacattctgaccccagagaacagatgcgtatgtcccgtatctaacgcaatgtgccgggagctcccacagtcaatcgtgtacaaatatatgtctataaggagtgatcgtagtgttccatcagacattttccagatccaggcaaccaccatatacgcaaatacgattaataccttcaggatcaaatctggtaatgagaacggagagttctatctgaggcagacatcacctgtgagcgccatgttggtcctggtgaagagcctgagtggaccccgggagcatatcgtcgacctagagatgcttactgtgagtagcatcggtaccttcaggactagtagtgtgcttcggctgactataatcgttgggcccttctcgttttag

SEQ ID NO: 186351 - DNA, 1482 bp, Artificial Sequence
  Description of Artificial Sequence: Synthetic coding sequence
atgctgaaggccctgttcctgaccatgctgaccctggccctggtgaagtcccaggatacggaagaaaccattacctatacacagtgtactgatggctatgagtgggacccagtccgccagcaatgcaaggacatagacgagtgcgacattgtaccggacgcatgtaaaggggggatgaagtgtgtgaaccattacggtggctacctttgcctaccaaagaccgcccagatcattgtcaacaatgagcaacctcaacaagaaacccagcctgcagagggtacttctggcgcgactaccggagttgtggccgcctcttccatggccaccagtggcgtcctccctggaggggggtttgtggcatcggccgcagctgttgccggccctgaaatgcagacagggcggaacaacttcgtcatccgaagaaaccctgcagatccccagaggatcccaagtaatccaagccaccgtattcagtgcgctgcaggctacgagcagtccgagcacaatgtgtgccaggatatcgatgagtgcacagccggaacacacaattgtcgcgccgaccaggtgtgcattaatctgagggggagttttgcctgccagtgtccgccaggctatcagaagagaggcgaacaatgcgtggatattgacgaatgcacaatacccccatattgccatcagcgctgcgtcaatacacctggctctttttactgtcagtgcagtcctgggtttcagctggccgcgaacaattacacatgcgtcgacattaatgaatgtgatgcatccaaccagtgcgctcagcagtgctataacatccttggctcattcatctgccaatgtaatcaaggttacgagctatcctcagatcgcctgaactgcgaagatatagatgaatgtagaactagctcttatttgtgtcagtaccagtgcgttaacgagcctggcaagttctcgtgtatgtgcccccagggatatcaggtagtcagaagtagaacatgccaagatataaacgaatgcgagaccaccaatgagtgtcgtgaagatgagatgtgttggaattaccatggaggtttccgctgttacccacgaaacccgtgtcaggatccatacatattgaccccggagaatagatgtgtctgcccggtgtccaatgcaatgtgtagagaactgccccaatctattgtgtacaaatatatgagtattcgcagcgaccggtccgtcccatcggacatatttcagatccaagcgactaccatttatgcgaacactatcaatacattccggatcaaatctggcaatgagaatggcgaattttaccttcggcaaacaagccccgtcagtgccatgctcgtgcttgtgaagagcttgtccggcccccgggaacacatcgtggacttagaaatgcttacagtgtcctccatcggaacattcaggacttccagtgttcttcgactaacaattatagtgggacccttctcgttttag

SEQ ID NO: 186352 - DNA, 1482 bp, Artificial Sequence
  Description of Artificial Sequence: Synthetic coding sequence
atgctgaaggccctgttcctgaccatgctgaccctggccctggtgaaatctcaagatacggaagagacaattacatacacccagtgtacagacggttatgagtgggatccagttcggcaacagtgtaaggatatcgatgaatgcgacatagtgccggacgcctgtaagggcggcatgaagtgcgtcaaccactatggaggttacctgtgtctgccaaagactgcgcaaattatcgtcaataacgagcagccccaacaagagactcagccggccgagggaactagcggcgccacaacaggagtcgttgcagcgagctccatggcgactagcggcgtgcttcccgggggcggcttcgtggcctcggccgccgctgtcgccggcccagaaatgcagacaggtcgcaataattttgtaattcggaggaacccggccgacccgcagcgcatccccagtaacccatcacatcggattcagtgtgccgccgggtacgaacaatcagaacataatgtttgtcaggacatagatgagtgcactgctggtactcataactgcagagcagaccaggtgtgtattaatttgcgtgggtccttcgcatgtcagtgtcctcctggttatcaaaaaaggggcgaacaatgcgtggacatcgatgaatgtaccatcccgccctactgtcaccagagatgcgttaatacaccgggaagcttctattgtcagtgctcacctggcttccagcttgcagctaataactatacatgcgtggacatcaacgagtgtgatgcctccaatcagtgtgcacagcagtgctataacatccttgggtcctttatttgccagtgtaatcaagggtacgaattgtcaagtgaccggcttaactgtgaggacattgatgagtgccgcacctctagctacctctgtcagtaccaatgtgtgaatgaacccggaaaatttagttgtatgtgtccccaaggttatcaggttgtgagaagccgaacgtgccaggatattaatgaatgcgaaacaaccaatgagtgtcgggaggatgagatgtgctggaactaccatggcggcttcaggtgctaccccaggaatccctgtcaagatccttatatcctgactcctgaaaacaggtgcgtctgtcccgtttctaatgcaatgtgcagagaactgccccagagcattgtttataaatatatgtcaatcagaagtgacagatcagttccaagcgacatcttccagatccaggctacaacgatctatgccaatactataaatacgttccgcatcaaatcaggaaacgagaacggcgagttttatttaaggcagaccagcccggtgtctgctatgttggttctggtgaaatccctctccggaccacgggagcatattgtggacctggagatgttgactgtttcgtcgatcggaactttccggacttcatctgtgttgagactgactattatcgtgggaccgtttagtttttag

SEQ ID NO: 186353 - DNA, 1050 bp, Artificial Sequence
  Description of Artificial Sequence: Synthetic coding sequence
atggaggacaccagcgccttccggaagcagccccggctgctgagcattatgaattctctgagctcagagcacaacgtttgtcaggacatcgacgaatgtactgcaggaactcacaattgtagggctgatcaggtatgtatcaacctgaggggttcatttgcctgtcagtgtccgcctgggtaccagaagaggggggagcagtgtgtcgatattgacgagtgcacgatacccccttactgtcaccagcggtgtgtgaataccccagggagtttttattgccagtgtagccctggctttcagctggccgccaacaactacacctgtgttgacatcaacgagtgcgatgcttcaaatcagtgcgcccagcagtgttataacattctggggagcttcatctgccaatgtaatcagggctacgagctcagcagtgataggctaaactgcgaagacatcgacgagtgccggacgtccagttacctatgccagtatcaatgcgttaacgaacctgggaaattctcgtgcatgtgtccgcaggggtatcaggttgtgaggtcccgcacgtgtcaagatatcaacgagtgcgagactacaaatgagtgcagagaggacgagatgtgttggaattaccacgggggcttcaggtgttatccacgcaatccttgtcaggacccctatatccttacccccgaaaacagatgcgtctgtccagtctcaaacgctatgtgcagggagctccctcagagcattgtttataagtatatgtccatccgcagtgatcggagcgtccctagcgatatctttcagatacaggccacgaccatctacgcaaacaccattaacacattcagaattaagtcaggaaatgagaatggcgaattctatttaaggcaaacaagcccagtgagcgccatgctcgtcttagtcaagtccttatcaggccccagagaacatatcgttgatctggagatgctgacggtgagcagcatcgggacttttaggaccagttccgtcctgcgcttgactatcattgtaggacccttttcgttctag

SEQ ID NO: 186354 - DNA, 159 bp, Artificial Sequence
  Description of Artificial Sequence: Synthetic coding sequence
atgctgaaggccctgttcctgaccatgctgaccctggccctggtgaaatcccaagataccgaagaaacaatcacgtacacacagtgcacagatggttacgagtgggacccagttcgtcagcagtgtaaggacatcgacgagtgcgacattgtgccgtag

SEQ ID NO: 186355 - DNA, 84 bp, Artificial Sequence
  Description of Artificial Sequence: Synthetic coding sequence
atgctgaaggccctgttcctgaccatgctgaccctggccctggtgaaaagtcaggatactgaggagaccattacgtacacatag

SEQ ID NO: 186356 - DNA, 1068 bp, Artificial Sequence
  Description of Artificial Sequence: Synthetic coding sequence
atgaagtgcgtgaaccactacggcggctacctgtgcctgcccaagacagcacagatcatcgtaaacaatgaacagccccagcaggagactcagccagccgaggggacttccggggctaccaccggagtggtcgctgcaagcagtatggcaactagtggggtgttacctggaggaggatttgtggcttccgcagccgcagtggctggtcccgagatgcagacaggcaggaataacttcgtgataagaaggaaccccgctgaccctcagagaatcccttcaaacccctcacaccggatacagtgtgccgctggatacgaacagtcagagcataacgtgtgtcaggatatcgacgagtgcaccgccggaacacacaactgccgcgccgatcaggtgtgtatcaacctgcggggctcatttgcatgccagtgtccacctgggtaccaaaaacgcggtgagcagtgcgttgatatcgatgaatgtagaacctcctcatatctgtgccagtaccaatgcgtgaatgaaccaggcaagttttcatgcatgtgtccccagggatatcaggtcgtacgctcacgcacttgccaggacataaatgagtgtgagacaaccaatgagtgtagagaggatgaaatgtgttggaattatcacggtggctttagatgctacccgcggaacccctgccaggatccatatattttaacaccggaaaatcgatgcgtatgcccagtgagcaacgccatgtgcagagaactcccgcaatccattgtgtacaagtacatgtctattcgttccgacaggagcgttccaagcgatatatttcagattcaggccactaccatctacgcgaacactataaacactttcagaatcaagagtggaaatgagaacggcgagttttatctcaggcagacatcgccggtctccgccatgttggttctcgtcaaatctttatccggtcccagagagcacattgtggatcttgaaatgctgaccgtgtcttctattggcacctttcgcacatcttccgtactgcgccttaccatcatcgtggggccttttagcttctag

SEQ ID NO: 186357 - DNA, 264 bp, Artificial Sequence
  Description of Artificial Sequence: Synthetic coding sequence
atgctgaaggccctgttcctgaccatgctgaccctggccctggtgaagtcccaggatacagaagaaacaattacttacactcaatgtacagatggatacgaatgggaccccgtccgtcagcagtgcaaggacattgacgagtgcgatatcgtgcccgatgcttgtaaaggagggatgaaatgcgtcaaccactacggaggatatctgtgtctgcctaagacagcccagattatcgtgaacaatgagcagccccagcaagaatag

SEQ ID NO: 186358 - DNA, 519 bp, Artificial Sequence
  Description of Artificial Sequence: Synthetic coding sequence
atgctgaaggccctgttcctgaccatgctgaccctggccctggtgaaaagtcaggatactgaggagactattacatacacccaatgcactgatggctatgagtgggaccccgtgagacagcagtgcaaggatattgatgaatgtgacatcgtgcccgatgcttgcaagggtggaatgaagtgtgtgaatcactatgggggatatctctgtcttccaaaaactgcccagatcatcgttaataatgagcagccacagcaggagacccagcctgccgagggaaccagcggcgccacaactggtgtggttgctgctagttctatggccacctcaggagtacttccaggtggaggctttgtggctagcgctgctgcagtcgcgggtccagaaatgcaaaccgggcgcaataactttgtcatcagacgcaaccccgccgacccacaaaggataccatctaacccctctcatagaatccagtgcgccgccgggtatgagcagagcgagcacaacgtgtgccagtag

SEQ ID NO: 186359 - DNA, 360 bp, Artificial Sequence
  Description of Artificial Sequence: Synthetic coding sequence
atgctgaaggccctgttcctgaccatgctgaccctggccctggtgaagtctcaggacacggaagagaccattacctatactcagtgtaccgatggttatgagtgggaccctgtcaggcaacagtgcaaagatatcgacgaatgcgacatcgttccagatgcctgtaaaggagggatgaaatgcgtcaatcattatggtgggtacctgtgcttgcctaaaacagcccagatcattgtcaacaacgaacagcctcagcaggagacccagccggcagagggcacgagcggggccaccacaggggtagtagcggcgagctccatggccacatcaggggttctgcctgggggcggctttgtgtag

SEQ ID NO: 186360 - DNA, 321 bp, Artificial Sequence
  Description of Artificial Sequence: Synthetic coding sequence
atgctgaaggccctgttcctgaccatgctgaccctggccctggtgaagagccaggacacggaagaaacaatcacctatacacagtgtacggacggctatgagtgggacccggtgaggcagcaatgtaaagatattgatgaatgcgacatcgtgccggatgcttgtaagggcggtatgaaatgcgtaaaccattatggaggctacctgtgcctgccaaaaacagctcagatcattgtcaacaatgaacagccacagcaggaaacacagcccgcagaagggacctccggcgcaacaaccggcgtggtcgccgcatcctcatag

SEQ ID NO: 186361 - DNA, 189 bp, Artificial Sequence
  Description of Artificial Sequence: Synthetic coding sequence
atgctgaaggccctgttcctgaccatgctgaccctggccctggtgaagtcccaggacactgaggagacaattacatacacacagtgcacagatggatacgaatgggaccctgttcgccaacagtgtaaagatatcgatgaatgcgatattgtgccagacgcctgcaaggggggtatgaaatgtgtgtag

SEQ ID NO: 186362 - DNA, 1332 bp, Artificial Sequence
  Description of Artificial Sequence: Synthetic coding sequence
atgctgccctgcgccagctgcctgcccggcagcctgctgctgtgggcgcttctgctgctgttgctgggctccgcatcgcctcaggattccgaagagccagatagctacactgagtgcaccgatggctacgagtgggatcccgatagccagcattgccgggatgtgaatgaatgccttactatacctgaagcctgtaagggagagatgaagtgtattaaccattacggcggatacctttgtttgccacgctctgcggctgttataaacgacttgcatggagaaggtcctccgcccccggttccgccagctcagcacccaaatccttgcccaccaggttacgagcccgacgaccaggattcctgcgtggacgtggacgagtgtgcgcaggctcttcacgactgccgcccaagccaagactgtcataatttaccaggaagctatcagtgtacttgccccgacggttatagaaaaatcggtcccgagtgcgtggatatagacgaatgtagatatcgttactgccagcaccggtgcgtcaacctgcctgggtccttcagatgccagtgtgagcccggctttcaacttggtcccaacaaccggagttgcgtcgacgttaatgagtgtgacatgggagccccttgcgaacaacgttgcttcaattcctatgggaccttcttgtgtagatgccaccagggatatgagctccatcgggatggattctcctgcagtgatatagacgagtgttcttactcctcctacctttgccaataccgttgcatcaacgagcctgggcggttcagctgccattgcccacaggggtatcaactgctagcaactcgactctgtcaggacattgatgagtgcgagtcaggggcccaccagtgttccgaggcccagacgtgtgtcaatttccacggcggataccggtgtgttgatactaatcggtgcgttgagccctatattcaagtctcagaaaataggtgtctctgtccggcgtccaatccactttgccgggagcagccatccagcatagtgcatagatatatgaccattacctctgagaggtctgtgcccgccgacgtcttccaaatccaggccacaagcgtgtatcccggagcgtataatgcattccagattcgcgccggtaactctcagggcgacttctacatcaggcagatcaataatgtcagcgccatgctggtcctggctcggcctgtgaccgggccacgggagtatgtgttggacctggaaatggtgacaatgaactctctgatgtcctaccgtgcctcatctgtcctccgactcacagtatttgtcggcgcttacaccttttag

SEQ ID NO: 186363 - DNA, 609 bp, Artificial Sequence
  Description of Artificial Sequence: Synthetic coding sequence
atgctgccctgcgccagctgcctgcccggcagcctgctgctgtgggccttgctactgttgctgcttggttcggcctcgcctcaggacagcgaagagcctgactcttacaccgaatgtaccgacggatatgagtgggatcccgattcccagcactgccgcgacgtgaacgaatgccttacgattcctgaagcctgcaaaggcgagatgaagtgcatcaaccattacggcggatacctgtgtcttccgcgctctgctgctgtaatcaatgatctgcacggggaaggccccccaccacccgtcccacctgctcaacaccctaatccttgtcctcccgggtatgagccagatgaccaggatagctgtgtggacgtggatgaatgcgcccaggcactgcatgattgccgcccatcccaggattgtcacaacctgccgggaagttaccaatgtacgtgtcccgatggatatcgaaagatcgggccagaatgcgtggacattgacgagtgcagataccgctattgtcagcatagatgcgttaacctgccaggatcttttaggtgccagtgcgagccaggtttccaattgggccccaacaatcgatcatgtgtctag

SEQ ID NO: 186364 - DNA, 552 bp, Artificial Sequence
  Description of Artificial Sequence: Synthetic coding sequence
atgctgccctgcgccagctgcctgcccggcagcctgctgctgtgggctcttctgctgcttctactcggcagcgcttctccacaagatagcgaggagcccgactcatacacagaatgcactgatgggtatgagtgggatccggatagccagcactgccgagatgtgaacgaatgccttaccattcccgaagcctgcaaaggagagatgaaatgtatcaaccattatggggggtacctttgtcttccccggagtgccgctgttattaatgacctacacggagagggccccccccctcccgtgccccctgctcagcatcccaatccctgccctcctgggtatgagccagatgatcaggactcgtgtgtggacgttgatgagtgtgcgcaggccctccatgattgtaggccaagtcaggactgtcacaacctgcctgggagttatcagtgtacctgccctgatggttatcgcaagattggtccagaatgtgtggacattgacgagtgccgataccggtattgccagcaccgctgcgtgaatctccccgggagttag

SEQ ID NO: 186365 - DNA, 1332 bp, Artificial Sequence
  Description of Artificial Sequence: Synthetic coding sequence
atgctgccctgcgccagctgcctgcccggcagcctgctgctgtgggcattgctcttattgctgctggggagtgccagtcctcaggacagtgaagagccagactcatacaccgagtgtaccgatggctatgagtgggaccctgacagccagcactgtagagacgtgaacgagtgtctgacaatccctgaggcatgtaaaggagagatgaagtgcatcaatcattacggggggtacctgtgcctgcctagatctgctgctgtgatcaatgacctacacggtgagggtcctcccccgcccgtccctcccgcacagcacccaaacccctgtccccccggttatgaaccggatgaccaggactcctgtgtggacgtggacgagtgcgctcaggccctgcatgattgtcgccctagtcaggactgtcataacctcccgggaagttaccagtgtacgtgtccggatggctatcgcaaaatcggcccagagtgcgtggatattgatgaatgtcgctaccggtattgccagcaccggtgtgtcaatctgcccgggagcttcagatgtcaatgcgagccaggtttccagcttggccccaacaatcgaagctgtgtggatgtgaatgaatgcgacatgggtgcgccatgtgaacaaagatgtttcaatagctacggaaccttcctgtgccgctgtcaccaggggtacgaattacatagagacggattctcctgttctgacatcgacgagtgttcatatagctcttatctctgccaataccgatgtatcaatgaacccgggaggttctcgtgccactgcccccagggctaccaactattagctacccggttgtgtcaggacattgacgagtgtgagagcggagctcatcagtgttccgaggcccagacatgtgtgaacttccatggggggtacaggtgtgttgataccaatcggtgcgtcgagccatatatccaagtgtcagagaaccgttgcctgtgtcccgctagcaaccctctgtgtagagaacagccttcgtctattgtgcaccggtacatgacaataaccagcgagaggtccgttcccgctgacgtgtttcagatccaggcaacaagtgtgtatcctggagcgtacaatgccttccaaatccgagctggtaattcccaaggcgatttttacattaggcagatcaacaatgtttctgccatgttagttctggccagacccgtaacaggacccagggaatacgtcctggatctggagatggtaaccatgaattcccttatgtcataccgggccagctccgtcctacgcttgactgtattcgtgggggcgtatactttctag

SEQ ID NO: 186366 - DNA, 2466 bp, Artificial Sequence
  Description of Artificial Sequence: Synthetic coding sequence
atgcggggcttcaacctgctgctgttctggggctgctgcgtgatgcacagctgggagggccacataagacccacccggaaacccaacacaaaaggcaacaattgtagggattccactctttgccccgcttatgcaacttgcaccaacacagtagactcatactactgtgcctgtaaacaagggttcctcagttcaaatgggcagaatcacttcaaagacccaggagtgcggtgtaaagacattgatgagtgctcgcagtctccacaaccatgcggcccaaacagctcctgtaaaaatctgtcggggcgctataagtgctcatgccttgatggcttctcttcccccactggtaacgattgggtcccaggtaagccgggtaatttctcatgtacagatatcaatgaatgtcttactagcagcgtttgtcccgagcacagcgactgtgtcaattctatgggcagttatagctgttcatgtcaagttggattcatctctcgcaatagcacatgcgaggatgttgacgaatgtgcagacccaagagcctgcccagaacacgcaacatgtaataataccgtggggaactacagttgcttctgcaatccgggctttgaaagttcaagtggtcatctgtcttttcagggcctgaaagcctcctgcgaagatatcgacgagtgtactgagatgtgccccatcaactcaacatgtacaaatacccctggatcatatttttgcacatgccaccccgggtttgccccgtctaatggacagctcaactttactgaccagggggtggagtgtcgggacatcgacgagtgtcgccaggatccaagtacatgtggacccaactccatatgcacaaatgcgctgggctcctacagttgcggatgtatcgccggattccatccaaatcccgaaggttcacaaaaagacggaaactttagctgtcaacgcgtccttttcaagtgcaaggaagacgtgataccagacaataaacagatacagcagtgccaggagggaactgctgtgaagcccgcatacgtgtcattctgcgcccagatcaataatattttctccgtcctcgataaggtttgtgagaacaagacaacagtcgtatcactgaagaatacaacagaatctttcgtgcctgttttgaagcaaatctcaacttggaccaagtttaccaaggaggaaaccagcagcctggccacagtgtttctggagtcagtggaatcaatgactcttgcttccttctggaagccttccgcgaacatcacccccgccgtccgcactgagtacttagatatcgagtccaaggtcataaataaggagtgcagcgaggagaacgtgactctggatctagtagccaaaggagataagatgaagattggctgttcaaccattgaagagtccgagagtacagagactacaggagtcgcattcgtgagcttcgtgggcatggagtccgtgctgaatgagagattctttaaggatcaccaggccccactgaccacgtcagagatcaaactgaaaatgaactctagagtcgtcggtggaattatgacgggagagaaaaaggacggtttttctgatcccattatttataccctcgagaacatccagcccaaacagaagtttgaacgtcccatctgtgtgagctggagcactgatgttaagggaggtagatggacatcttttggatgtgtgattctagaagcctctgaaacctataccatttgctcttgcaaccagatggcaaacttagccgtcatcatggccagtggggaacttacaatgggttgtgctatcatcgccggcttcttacattatctgttccttgcatgttttttctggatgctcgtggaagcggttattctgttcctgatggtgcgaaacctgaaagttgtgaattacttctccagccgcaatattaaaatgctccacatctgtgcgttcgggtatgggctgcccatgctggtggtggtcatatccgccagtgtccagccacaggggtacggcatgcacaatagatgttggctaaacacggaaaccggctttatctggagttttcttggacctgtgtgcacagtgatcgtaatcaactctctcctcctgacatggacactgtggatactcagacaacggctttccagcgtgaatgctgaagttagtaccctcaaagatacgaggctgctgacgttcaaagccttcgctcaattattcattctcgggtgcagctgggttctggggatctttcagataggacctgtggcaggcgttatggcatatttattcaccataataaactctctgcagggtgccttcatcttcctgatccactgcctccttaacggacaggtcagagaggagtacaaacggtggatcacgggaaagaccaaaccgtctagtcaaagtcagacatcaagaatccttctcagctccatgcctagcgcgagcaagaccgggtag

SEQ ID NO: 186367 - DNA, 2661 bp, Artificial Sequence
  Description of Artificial Sequence: Synthetic coding sequence
atgcggggcttcaacctgctgctgttctggggctgctgcgtgatgcattcttgggaaggacacatacggcccacccgaaagcctaacacgaaaggcaacaattgtcgagattctacattgtgtcccgcctatgctacctgcacaaacacggttgactcttattactgcgcctgtaaacagggatttttatcttctaatgggcagaatcacttcaaggacccaggcgtccgctgcaaggacatcgatgagtgtagccaaagccctcagccttgtggacccaatagctcttgcaaaaacctttcaggccggtacaaatgttcctgcctggatggttttagtagccccacaggtaatgactgggtgccaggaaagccgggcaacttcagctgcacggacatcaatgagtgcctgactagcagtgtgtgtcctgagcacagcgattgcgtgaactcgatgggcagctattcctgttcttgtcaagtaggattcatctcccggaacagcacctgcgaggatgtggatgagtgtgcagatcctcgggcatgcccggagcacgctacctgtaataacacggtcggcaattactcctgcttctgtaaccccggcttcgaaagctcttcaggccatctcagcttccagggtcttaaagcttcctgtgaggacattgatgagtgtactgaaatgtgccctattaattccacgtgcactaatacaccgggatcttatttttgcacttgccaccccgggtttgccccgtctaacggccaattgaattttaccgaccaaggcgtagagtgccgagatatcgacgagtgtcgccaagatccatcaacttgcggtccgaattctatttgcaccaatgccctcggctcctatagctgtggctgtatcgccggctttcaccccaaccccgagggctctcagaaggacgggaacttctcctgtcagcgtgtgctgttcaaatgcaaggaagacgtcattccagacaataaacagatccaacagtgtcaggaaggcacggccgtgaaaccagcgtatgtgtccttctgtgcccaaatcaataacattttcagcgtcctcgacaaggtctgcgaaaacaagacaaccgtggtgtctctcaaaaataccactgaatcttttgtccccgtactaaaacaaatttccacctggaccaagtttaccaaggaagaaaccagcagcctggctacagtctttcttgagtccgtggaaagcatgacgctagctagtttctggaaaccaagcgcaaatatcactccagcggtccggaccgagtatctcgacattgagtctaaggtcattaataaggagtgttctgaggaaaacgtgaccctagacctggtagccaaaggagacaaaatgaagattgggtgtagcaccatagaagaatctgaaagcaccgagaccacaggggtcgcgttcgtgagtttcgtagggatggagagcgtcctgaacgagaggttcttcaaagatcaccaggccccccttaccacttctgagatcaaacttaagatgaacagccgcgttgtgggcggaatcatgacaggtgaaaagaaggacggcttttctgatcctatcatttatactctagagaatattcagccgaagcagaaatttgaacggccaatttgtgtgtcctggagcaccgatgtgaaaggaggccgttggacttcatttgggtgcgtgattctagaggctagcgagacctacaccatttgcagttgtaatcagatggccaacctggctgttatcatggcatctggggaactgactatggatttcagtctgtacattatttcacatgtgggaatcattattagcttagtctgcctggtgctggctatcgcaaccttcctgttgtgtaggtctatccgaaatcacaatacctatctccatctgcatctctgcgtgtgtttgctcctggcaaaaacgctgtttttggctggcatccataagacagataacaagatgggatgcgccataatcgctggttttctgcattacttgttcctggcttgcttcttctggatgctggtggaggctgtcattctgttcctgatggtccggaacctaaaagtggttaactacttctctagtcgcaatattaaaatgttacacatttgcgcctttggttacggacttcccatgctcgtcgtggtcatatcggccagtgttcagccacagggctatgggatgcataatagatgttggttgaacaccgagactggatttatctggtccttcctgggtccagtttgtacggtgatagtgatcaatagtctgctgttaacatggactctctggattctccgccagagactctcatccgtgaacgccgaggtgtctactctgaaagacaccaggctcctgactttcaaagcctttgcgcagctcttcattcttggatgctcatgggtccttggtattttccagatcggcccagtcgccggcgtcatggcctacctgttcacaatcatcaatagtctgcaaggggcgttcatattcttgatacactgcctcctgaacggccaggtacgcgaggaatacaagcgatggattactggtaaaacaaaacccagcagccagagtcaaacgagccgaatcctgctgtcaagcatgccatccgcttcaaagaccggctag

SEQ ID NO: 186368 - DNA, 2604 bp, Artificial Sequence
  Description of Artificial Sequence: Synthetic coding sequence
atgcggggcttcaacctgctgctgttctggggctgctgcgtgatgcatagttgggagggtcatatccggccgacaaggaagcccaatacgaagggcaacaactgcagggatagcaccctgtgccccgcttacgccacctgcacgaacactgtagattcctattactgtgcctgtaagcagggcttccttagctccaacgggcagaaccactttaaagatcctggtgtgagatgcaaagatatcaacgagtgtctgacaagcagcgtgtgccctgagcactctgattgcgttaactccatgggctcgtactcctgtagttgtcaggtcggcttcataagtcgcaattcaacctgcgaggacgtcgatgagtgcgctgatcctagagcgtgccctgagcacgccacctgcaacaacactgtgggcaattattcttgtttctgtaaccccggcttcgagagctccagtggccatctgtctttccagggccttaaggccagctgtgaggatatcgacgaatgtacagagatgtgtcccatcaattcaacgtgtaccaacacccccggcagctatttttgcacatgtcaccctggtttcgctccatctaacgggcagctcaactttactgaccagggcgtggagtgccgggacatcgatgagtgtagacaagaccccagtacttgcggtccaaatagtatctgcaccaatgccctcggctcatactcctgcggctgcatagccgggttccatcctaacccagaaggttcccagaaagatggtaatttctcctgtcaaagggtcctttttaagtgtaaagaagacgtgattcctgacaacaagcagattcaacagtgccaggagggcactgcggttaagcctgcatacgtatccttttgcgcccaaatcaataatattttctcggtacttgataaggtgtgcgagaacaaaactacagtcgtcagtctgaagaacaccactgagagcttcgtgccggtgctcaagcagatttctacgtggactaagtttacaaaagaagaaacatcatccctggccacggtgttcctggagtccgtggagagtatgaccctcgcttcattctggaagccatccgccaatataactccggccgtccgcacagagtacctagatattgaaagtaaggtcatcaataaggaatgttctgaggaaaatgtgactcttgacctggtagccaagggcgataagatgaagatcggttgttcaaccattgaagaatccgagtctaccgagaccacaggggttgcctttgtgtcattcgtgggaatggagagcgtactgaacgagcgattctttaaagaccaccaggccccactgacgacatccgagattaagctgaagatgaacagcagggtggtcggcggcatcatgactggggagaagaaggacggcttttccgatccaatcatctatactctggagaacatccaacccaagcaaaaattcgaacgccccatctgtgtatcttggtcaacagatgttaagggaggtcggtggacctcattcggctgcgtcattttggaagcatccgagacttatacaatctgtagctgtaatcagatggccaatctggccgtcatcatggcgagcggcgaattgactatggacttcagcttatacataattagccatgtgggaattattatatcattggtgtgcctagtgctggccattgctaccttcctcctttgtaggagcatacgtaaccacaacacctacctgcacctgcacttgtgtgtttgtttacttctcgctaaaactctgttcctcgcgggcatccacaaaaccgacaataaaatggggtgcgctattattgcggggttccttcactatttattcctcgcctgtttcttctggatgctggtggaagcggtcattttatttctgatggtgcgtaacctgaaggtagtaaactacttcagcagcagaaatattaaaatgcttcatatatgcgcatttggctatggattaccaatgctggtcgttgtcatctccgcttccgtgcagccccaaggctacggcatgcacaacagatgttggctcaatactgaaaccggctttatctggagcttcctaggaccagtctgcacggtaatcgttgtctctaagtactataattcattggctaaatgcgtgctgaaggaagagcaaggggacctgcgggatttggaattccctggaacctgtgctgcagaaaggatcaactcactgctcctaacttggacactatggatcctgaggcagaggctaagtagcgtgaacgccgaggtctcaacacttaaggacacccgcctcttgacattcaaagcttttgcacagctcttcattctgggctgctcttgggtgctgggcatctttcagatcggccccgtggccggtgttatggcttacttgttcactattataaacagcctgcagggggcttttatcttcctaatacactgcctattaaatggtcaggtgagagaggagtataagagatggattacaggcaaaaccaaaccttcatcccagtcacagacctcaagaatcttgctgagtagcatgccctccgcctcaaagaccgggtag

SEQ ID NO: 186369 - DNA, 2238 bp, Artificial Sequence
  Description of Artificial Sequence: Synthetic coding sequence
atgcggggcttcaacctgctgctgttctggggctgctgcgtgatgcactcctgggaggggcatatccggccaacacggaaaccaaacaccaaggggaataactgcagggattcgaccttatgtccagcgtatgcgacgtgcaccaacacagttgattcctattattgtgcttgtaagcagggttttttatcatcaaacggacagaatcacttcaaagacccaggggtacgttgtaaggacatcgatgaatgtacagaaatgtgccctatcaattctacatgcaccaacactcccggctcctatttttgcacctgtcacccaggattcgcgccctccaacgggcagctgaacttcacagaccagggagtggagtgtagagacatcgacgaatgtcgacaggacccatctacttgcggaccaaatagtatctgtaccaacgctcttggaagttacagctgtggctgtatcgccggatttcatcccaaccctgagggatcccagaaggatggcaatttctcatgtcagcgggttctattcaaatgcaaagaggacgtgatacctgataataaacaaatccagcagtgtcaggagggcaccgccgtaaagcctgcgtacgtgtctttttgcgcacagattaataacatattctccgtgctggataaggtgtgtgaaaataagactacagtcgtttctctcaaaaacaccaccgaaagtttcgttccagtccttaagcagatttccacatggaccaagtttaccaaggaggagaccagctctctggccaccgttttccttgagagtgttgagtcaatgacattggcctctttctggaaacctagcgctaatattaccccagccgtgagaacagagtatctcgatatagagagcaaggtcattaacaaggagtgtagtgaagagaatgtcactctagacttagtggccaagggggataaaatgaagatcggctgtagtaccatcgaggagtcggagtctactgaaacgactggcgtggccttcgtttcttttgtgggcatggagagtgttctgaatgagaggtttttcaaagaccaccaagcacccctgacgacctctgaaatcaaactaaagatgaatagtagggtggttggcgggatcatgactggagaaaagaaagacggattctcagaccccattatctacacactggagaacattcagccaaagcagaaatttgagcggcctatctgcgtatcctggtcaactgacgtaaagggcgggcgctggaccagcttcggctgtgtgattctggaggcctctgagacatataccatttgctcttgtaatcagatggccaacctagctgttattatggccagcggggagctcaccatggacttctcgttgtacattattagtcatgtcggaattatcattagtctcgtgtgtctagtgctggctattgcaactttcttactgtgccgttccatccgcaaccataacacgtacttacacctgcacctctgcgtatgtctgctgctggctaagacacttttcctggcgggtattcataagaccgacaataaaatgggctgcgcgatcatcgccggattcttacactatctctttttagcctgcttcttttggatgctcgtcgaagccgtgatcctgttccttatggtccgcaatctgaaggtagtcaactacttctcctctcggaatattaaaatgctccatatctgcgcattcgggtacggtctgcctatgctggtggtagtgatcagcgcttccgtccagcctcagggctatggaatgcataatcgatgctggctgaacaccgagacagggttcatatggagctttctcggcccagtgtgtaccgtcatcgttatcaatagcctactcctgacttggacactgtggatactcaggcaacggttgtcttcagtgaacgccgaagtatcaactcttaaggatactagattgttgacatttaaagccttcgctcaactgtttattctgggatgtagctgggttctgggcattttccagatcggccccgtcgctggggtgatggcgtatctatttaccattatcaatagcttgcagggagcatttatatttctgatccactgcctgctcaatggccaggtgagagaggaatacaagaggtggatcacagggaaaaccaagccaagctcccagagccagacgtctaggattttactcagtagtatgccttccgcttccaagacaggctag

SEQ ID NO: 186370 - DNA, 2130 bp, Artificial Sequence
  Description of Artificial Sequence: Synthetic coding sequence
atgcggggcttcaacctgctgctgttctggggctgctgcgtgatgcactcctgggaggggcatatcagacccactaggaaacccaacacaaaggggaacaactgtagggatagcacactgtgtccggcctacgctacatgcactaataccgttgattcctactattgtgcctgcaagcaggggttcttgagttccaatggtcagaaccactttaaggatccaggggttagatgcaaggacatcgacgaatgcagccagagcccccaaccctgcggccctaatagttcctgcaagaatttgagcggacgatataaatgctcgtgccttgatggcttcagttcgcccaccgggaatgattgggtacccggcaaaccagggaatttctcttgtaccgacatcaacgaatgcctgactagccgggtgttgtttaaatgtaaggaagacgtgatccccgacaacaaacagatccaacagtgtcaggagggcaccgccgtgaaaccggcctatgtgagcttttgcgcacagattaacaacatcttctccgtcctggacaaagtctgcgagaacaaaacaaccgttgttagcttgaaaaataccacggagtcattcgtgccagtacttaagcagatatcgacctggacaaaattcactaaagaggaaaccagctccctggccacagtttttctcgagtcagtggagtccatgaccctggcttctttctggaagccctcggccaatatcacgccagccgtcagaacagaatatctagatattgaaagtaaggtgatcaacaaagagtgttcagaagagaatgtgactctggatctggttgccaaaggcgacaaaatgaaaattggctgctctaccatagaagagtcagaaagcacagaaactactggagtggcttttgtctccttcgtgggaatggagtccgtgctaaacgaaaggtttttcaaggatcatcaggccccactgaccacaagcgaaatcaagctgaaaatgaatagccgcgtcgtgggaggtattatgaccggcgagaagaaggacggtttttccgatcccattatttacaccctcgagaacatccaacccaagcagaaattcgaacgccctatatgtgttagctggagtacagacgtgaagggggggagatggacctctttcggctgcgttatccttgaggcgtctgaaacatataccatctgttcctgtaatcagatggctaatctggccgtgataatggcgagtggtgagcttacaatggacttctccctgtatatcatctcccacgtaggaatcatcatctcacttgtgtgcttggtgctggctatagcaaccttcctcctttgccgctccatcagaaaccacaacacttacctgcaccttcacctgtgcgtgtgtctcctacttgccaaaaccctctttctggctggaattcacaaaactgataacaaaatggggtgcgcgatcattgccgggtttctccattacctgttcttggcctgtttcttctggatgcttgtagaggcggttatccttttcctcatggtccgcaacctaaaagtggtaaattatttctcttcgagaaatattaagatgcttcatatctgtgccttcggatacggactcccaatgctcgtcgtggtgatctccgcaagtgtgcagccgcagggctacggcatgcacaatcgctgttggttaaacaccgaaactgggtttatctggtcttttctgggcccagtgtgcaccgtgatcgtgattaattctctgttgctgacctggactctctggattctgcgccagcgcctctctagcgttaatgcggaagtctcaactcttaaggacaccaggctgctgacctttaaagcctttgcgcagctgttcattctagggtgttcctgggtgttgggcatcttccaaatcgggccggtcgccggagtgatggcttatctgtttactatcataaactctctgcaaggggcctttattttcctgatacactgcttgctaaacggccaggtgagagaagagtataagcggtggatcactggcaagacaaagcccagcagtcagtctcagacgtcccgcatactgctctccagcatgccttccgcatccaagaccgggtag

SEQ ID NO: 186371 - DNA, 2466 bp, Artificial Sequence
  Description of Artificial Sequence: Synthetic coding sequence
atgcggggcttcaacctgctgctgttctggggctgctgcgtgatgcacagttgggaagggcatattcggcctaccaggaagccaaacaccaagggcaacaactgcagggacagcacgctgtgtccggcttacgcaacttgtaccaatacagtggacagctattactgcgcatgcaaacaggggtttctttctagcaatggccaaaaccacttcaaagacccaggagtgcgatgcaaggatattgacgaatgcagtcagagccctcagccttgtggaccaaattcttcttgtaaaaatctgagcggacggtataaatgttcatgtctcgacgggtttagctcacctacagggaatgactgggttcctgggaaacctggcaatttttcatgtaccgatattaatgagtgtttaacttcatccgtatgtcccgaacactcggactgcgtgaatagtatggggtcatattcttgctcctgtcaagttggattcatctcacgtaacagcacatgcgaagacgtggatgagtgtgcagaccctagagcatgccccgagcatgccacatgtaataacaccgtcggcaattactcctgcttctgcaaccccggatttgagtcctcaagcgggcacctgtctttccagggattgaaggccagttgcgaggatattgacgaatgtaccgaaatgtgtccgatcaattctacatgcactaacaccccaggatcatatttttgtacatgtcatcctggattcgcaccttccaacgggcagctgaactttaccgatcaaggcgtggaatgtagggatatagacgaatgccgccaggatcctagcacatgcgggccaaattccatatgtacaaacgccttgggctcatatagctgcggttgcattgcaggcttccaccccaatcccgagggatcccagaaggatggaaactttagctgtcagcgggtgctgtttaagtgtaaggaagatgtaattccagacaacaaacagatacagcagtgtcaagaaggaacagctgtgaagccagcgtatgttagcttctgtgcgcagattaataacatcttctcagtgctcgataaagtgtgcgagaataaaaccactgtggtttctctcaagaacacgaccgaaagctttgtccccgtgctgaagcagatctctacatggacgaaatttacaaaggaggaaacgagcagccttgccacagtgttcctagagagtgttgaatcaatgactctggctagcttctggaagccttctgccaatatcacgcccgcagtgaggacagagtacctggacatcgaatctaaggtcatcaataaggagtgttctgaagagaacgtaaccctcgaccttgtggctaaaggcgacaaaatgaaaattgggtgttcaacaatcgaggagtccgagtccacagagactaccggcgtagcattcgtgtcattcgtaggaatggaatccgtcttgaatgaacggttttttaaagatcaccaggcgcccttgacaacctccgaaattaagctgaagatgaatagtagagtcgtgggcggcatcatgacgggagagaagaaggacggcttcagcgaccccatcatttatacactggaaaatatccaacctaaacagaagttcgagcgaccaatatgtgtgtcctggtctaccgacgtcaagggcggtaggtggacttcatttggctgcgttatactggaagccagtgagacttatacgatttgctcctgtaatcagatggctaacctcgccgtgataatggcttccggcgaattgacaatgggctgtgccatcatagcaggctttttacattacctcttcttggcgtgcttcttctggatgttggtcgaagcagtgattcttttcttaatggttcggaatctcaaggtcgttaattatttctcaagtcggaatatcaaaatgctccacatctgtgcctttgggtatggcctgcctatgctggttgttgtgatcagcgcatctgtgcagccgcagggctatggcatgcataatagatgttggctgaatactgagaccggcttcatttggtcttttctcggcccagtatgcactgttatcgtgattaacagcttactgctcacatggacactttggatactgcgtcagagattatccagcgtcaacgcggaggtgtctacactgaaagacactaggttactgacgtttaaagcgttcgcccagttgttcattctcggatgctcttgggtgctgggcatctttcagataggacccgtcgctggagtgatggcgtacctgttcacaattattaattctttgcagggggcctttatctttctcatacattgtctcttaaatggccaggtcagagaggaatataagcgatggataactggcaagactaagcccagcagccagagccaaacaagtcgcatcctgctctcctccatgccctctgcctctaaaacgggctag

SEQ ID NO: 186372 - DNA, 1662 bp, Artificial Sequence
  Description of Artificial Sequence: Synthetic coding sequence
atgcccctgccctggagcctggccctgcccctgctgctgagctgggttgcaggagggtttggtaatgccgcttccgccagacatcacggcttgctggcgtccgccagacagccaggggtgtgtcattatggcacaaaactggcttgctgctatgggtggcgcagaaatagcaagggggtatgcgaggcgacgtgcgagcctggctgtaagtttggcgagtgcgtgggccctaacaagtgtcgctgctttcctggctacacgggtaagacttgcagccaggatgttaatgagtgcgggatgaaaccacgcccatgccagcaccggtgcgtgaatactcacggttcctacaagtgcttttgtctcagcggtcacatgctcatgcccgacgctacatgcgtaaacagtcggacatgtgcaatgatcaactgtcagtattcttgtgaggacaccgaagagggcccacagtgcttgtgtccatcatccgggttgaggctggcacccaatgggagagactgccttgatatcgatgaatgcgcttctggcaaagttatctgcccctacaaccggcgctgcgtgaacacgtttggatcatactactgcaaatgtcacatcggcttcgagctgcagtatataagcgggaggtacgactgtattgacataaacgagtgcaccatggacagccacacttgttcccatcacgcaaactgttttaacacccagggctccttcaagtgcaagtgcaagcaggggtataaaggtaacggtctgcggtgttccgctattcctgaaaacagtgtgaaagaggtccttagagctccaggcaccattaaggataggattaagaagctgttggctcataagaactctatgaaaaaaaaggctaaaattaagaatgtcaccccagaacctacaagaactcccactcccaaagtgaacctgcagccctttaattacgaagagatcgtgtctcgggggggcaacagccatgggggaaaaaaaggaaacgaagaaaaaatgaaagagggcttagaagacgagaaacgtgaagaaaaggctcttaaaaatgacattgaagagcgtagcctccgcggtgatgtgtttttccctaaggtgaacgaggctggcgagttcggcttgattcttgtccagcgcaaggcccttactagcaaattggagcataaggacctgaacatctccgttgactgcagcttcaatcacgggatctgcgattggaaacaagatcgtgaggacgattttgactggaacccggctgatagagataacgcaatcggattttatatggccgtgccggctctcgcaggacataagaaagatataggccgactgaaattactgctcccagatttacaaccacagagcaatttttgtctactgtttgactaccgtcttgccggcgacaaggtcggcaaattgcgagtgtttgtgaaaaactctaacaacgcacttgcgtgggaaaagaccacatccgaagacgagaagtggaagacaggaaagatccagctgtaccagggtaccgatgccactaaatctattattttcgaggccgagcgggggaaaggaaagacaggagagattgccgtggacggggtgctgctcgtgtctggattgtgcccagactcgctactgagtgtcgatgattag

SEQ ID NO: 186373 - DNA, 1665 bp, Artificial Sequence
  Description of Artificial Sequence: Synthetic coding sequence
atgcccctgccctggagcctggccctgcccctgctgctgagctgggtcgctgggggattcgggaatgcagccagtgctcgacaccacggcctccttgcttctgccaggcagcctggtgtgtgccactacggtaccaagctcgcctgttgctacggttggcgacgtaacagcaagggtgtctgcgaggccacgtgcgaacccgggtgtaagtttggtgagtgtgttggtcccaataaatgcaggtgcttccctggttacacggggaaaacatgtagtcaggatgtaaacgaatgtggcatgaagccacggccttgtcagcatagatgcgtcaacactcacgggagttacaaatgcttctgcctttcagggcacatgttgatgccggacgcaacctgcgtgaactctcggacctgcgcgatgatcaattgccaatacagttgtgaggatactgaggaaggaccgcagtgcctctgcccgagcagcggcctgcgtcttgctcccaacgggagggattgcttagacatcgatgagtgcgcttcggggaaggtgatctgtccctataaccgccgttgtgtgaataccttcggatcgtattactgtaaatgccacataggatttgagctacagtacatctccggcaggtacgattgtattgatataaatgagtgcacgatggatagtcacacatgctcgcatcacgccaactgtttcaacacacaaggctctttcaagtgtaagtgcaagcagggctacaaggggaacggattaagatgctcagcgatccctgagaactctgttaaggaagtcctcagagcccctgggactattaaagacagaattaaaaaacttctcgcacacaagaactccatgaagaagaaagccaagattaagaacgtcacccctgagccaacgaggacccctaccccaaaggtcaacctacagccctttaactatgaggaaattgtgtcacgcgggggtaattcacatggggggaaaaagggcaacgaagagaaaatgaaggaaggcttagaggacgagaagcgcgaggagaaggcattaaaaaacgacatcgaagaaaggagcctgcggggggacgtgttcttccccaaagtgaacgaagcaggagaattcggacttatcctggtgcagcggaaggcactgacttcaaagctcgagcataaggccgatcttaatattagtgtcgattgcagctttaaccacgggatttgcgattggaaacaggacagggaggatgacttcgattggaatcccgctgaccgggacaatgccattggtttttacatggcagtcccggcactggcgggccataaaaaggatattgggagactgaagctgttgctgcccgacctccagccccagtcgaacttctgtctgctgtttgattatcgtttggcgggcgacaaggtaggtaagctgagagtcttcgtcaagaattctaataatgcactagcctgggaaaagacgacttccgaagatgagaagtggaagacagggaagattcaactttatcagggcactgacgctactaaatcaatcatttttgaggctgaaagaggcaaaggaaagaccggggagatcgctgtagatggagtactgctcgtgtccggcctctgtcccgattctctgttgtcggtcgatgactag

SEQ ID NO: 186374 - DNA, 822 bp, Artificial Sequence
  Description of Artificial Sequence: Synthetic coding sequence
atgcggggcagccaggaggtgctgctgatgtggctgctggtgctggctgtcggcggtaccgagcacgcctaccgccctggacggcgagtctgcgctgttagggcacatggagacccagtctctgaatcgttcgtccagagagtgtatcagccttttcttaccacgtgcgacggccaccgggcatgcagcacatatcgcacaatctaccggacggcataccgccggtccccggggttggctccagcccgaccgcgctacgcctgttgtcccgggtggaagcggaccagcggccttcccggagcatgcggggctgctatttgtcaacctccctgtcggaacgggggttcttgcgtccagccaggccggtgtcgatgtccagcaggatggaggggggatacctgccagagcgacgtcgacgagtgcagcgcccgcaggggaggctgcccccagcgttgtgtgaacacagctgggagttactggtgccaatgctgggagggacactccctcagcgcagacggtactctttgcgtccctaagggcgggccccccagagtggcacctaaccccaccggcgtcgattctgccatgaaagaagaggtgcaaagactgcagtcaagagtcgatttgctggaggaaaaactccaactggtcctcgcgccacttcattccctggcatcccaagctctcgagcacgggcttccagaccccgggtcactgctcgtgcattcttttcagcagctgggtaggattgattcactgagtgagcagatcagcttcctggaagagcagctgggatcttgtagctgcaaaaaggactcgtag

SEQ ID NO: 186375 - DNA, 822 bp, Artificial Sequence
  Description of Artificial Sequence: Synthetic coding sequence
atgcggggcagccaggaggtgctgctgatgtggctgctggtgctggctgtgggtggtactgagcacgcctacagacccgggagacgggtgtgtgccgttcgagcgcacggcgacccggtttccgagtcttttgtgcagagggtgtaccagcctttcttaaccacatgcgatggacatcgggcatgttctacctacagaaccatttataggacagcctaccgaagaagccccggtctagcccccgcgcggccaaggtatgcgtgttgtcccggctggaaacggactagcggtttgcctggggcctgtggggcagccatttgccagcctccttgccgcaacggcgggtcatgtgttcagcccggcaggtgccgctgcccagctggctggagaggcgatacatgccagtccgacgttgatgaatgcagcgcacgcagagggggatgtccacagcggtgtgttaataccgccgggtcttactggtgtcaatgttgggaggggcatagcctgtcggctgacggaaccctgtgcgtgccaaaaggcggcccccccagggtggctccgaatcctaccggagtcgactctgcaatgaaggaggaggttcagcggttgcagagccgggtcgatctgctggaggaaaagcttcagctggtactggccccccttcattcgcttgcctctcaggcactggagcacggcctccccgatcctggctctctcctggtacatagttttcaacagctcggccgtattgactccctgtcagaacaaatctcattcttggaggaacagctgggcagttgcagctgcaaaaaagacagctag

SEQ ID NO: 186376 - DNA, 822 bp, Artificial Sequence
  Description of Artificial Sequence: Synthetic coding sequence
atgcggggcagccaggaggtgctgctgatgtggctgctggtgctggctgtcggcggtactgagcacgcgtaccgcccaggccggcgggtttgcgcggttcgggcacacggggatcccgtctcggaatctttcgtacagcgcgtataccagccctttctgaccacttgcgacggacatcgggcatgcagtacctaccggaccatttatcgaactgcttaccggcggtctccaggactcgcacccgccagaccccggtacgcctgttgtccgggatggaagcgcacctcagggctgcccggggcctgcggggctgcaatctgccagcccccctgccgcaatggtgggtcttgcgtgcagccgggtagatgtcggtgtcccgctgggtggcgaggcgatacctgtcaatctgacgtcgacgagtgctctgcacgccggggcggatgccctcagaggtgtgtgaacacagctggcagctattggtgtcagtgctgggaaggccactctctttccgcggacggtactctgtgtgtacccaagggcggcccccctagagtagcacctaatcccacgggtgtggattcagctatgaaagaagaggtccagcgcctccagagtagagttgatctgctggaggagaaactgcagttggtacttgccccactccacagcttggccagccaggcactggaacacgggttgcctgatcccggaagcttgctggtacactcctttcagcagcttggtaggatcgattctctctccgaacagatcagttttttagaggaacagctgggatcttgtagttgcaaaaaggatagttag

SEQ ID NO: 186377 - DNA, 822 bp, Artificial Sequence
  Description of Artificial Sequence: Synthetic coding sequence
atgcggggcagccaggaggtgctgctgatgtggctgctggtgctggctgtgggcgggactgaacacgcataccgccctggccggagggtctgcgcagtacgagcccacggggatcccgtcagcgagtcgtttgtgcagcgggtttatcagccattcctgactacttgcgatgggcacagagcctgttctacttatcgcacaatttaccgtactgcctatcggagatccccagggctggccccagcgcgtcctcgctacgcctgctgtcctgggtggaagcgcacatctggtctccccggggcctgtggcgccgcaatttgtcaaccgccatgccgtaatggcgggtcgtgtgttcagcctggaagatgccgctgtccagctggatggcggggagacacgtgccaatccgacgttgatgaatgctccgccaggcgagggggatgcccacaaaggtgcgtcaatacagccgggtcttactggtgtcagtgctgggagggacatagcctgtccgcagacggaactctgtgcgtgcctaagggaggccccccacgggtagcaccgaacccaaccggcgtggactctgcaatgaaagaggaagtgcaacgcctgcaatctagggtcgacctcctggaggaaaagctgcaactcgtgttggcccctttgcatagtctcgcatcccaggcgctggaacacgggctgccggacccaggaagcttgctggtgcactccttccagcagttaggccggatcgactctctgtcagagcagatcagctttcttgaagagcagttaggctcttgctcgtgtaagaaagatagctag

SEQ ID NO: 186378 - DNA, 882 bp, Artificial Sequence
  Description of Artificial Sequence: Synthetic coding sequence
atgggcagccgggccgagctgtgcaccctgctgggcggcttcagctttctcctacttctgataccgggcgaaggagcgaaggggggctccctgcgggagagtcaaggagtttgctctaagcagacgctggtcgtcccgctacattataatgagagttacagccagcctgtatataagccttatctgacgctgtgcgcgggacggagaatttgtagtacttatagaacaatgtaccgcgtgatgtggcgagaagtgcgccgtgaggtgcaacaaacgcacgctgtgtgctgtcagggatggaagaagcggcatcccggagccctcacctgtgaggcaatttgcgccaaaccatgtctcaatggaggcgtgtgtgtcagaccggatcaatgtgaatgtgcccccgggtggggggggaaacattgccacgtggatgtggacgagtgtcgtacctccatcaccctgtgttcccatcactgtttcaatacagcaggtagtttcacttgcggctgtccacatgatttggtgcttggagtggacggacggacatgcatggaagggagccccgaacctcccaccagcgcatcaatcctctccgtggccgtgagggaggccgagaaggatgaacgggccttgaagcaggaaatccacgagctccgcggccgcttggagcggctggaacaatgggctgggcaggcaggggcctgggtgagggccgtactgcctgtacctccagaagagttacagccagagcaagttgccgagctgtggggacggggcgacagaatcgagagtcttagcgaccaggttctgctgctggaggaacgtctaggggcatgttcctgcgaagacaattctctgggattaggggttaaccacaggtag

SEQ ID NO: 186379 - DNA, 882 bp, Artificial Sequence
  Description of Artificial Sequence: Synthetic coding sequence
atgggcagccgggccgagctgtgcaccctgctgggcggcttcagcttcttgctcctgcttatccccggtgagggcgccaagggcggttctttgagggaaagccaaggggtctgctcaaagcagaccctggtcgtaccccttcactataacgaatcatactctcagcccgtgtacaagccgtacctcaccctttgtgcaggaagaaggatctgtagtacctaccggacgatgtaccgcgtgatgtggcgggaggtgagacgcgaggtgcagcagactcacgccgtctgctgccagggatggaaaaaaaggcatcccggagcattaacgtgcgaagctatctgcgcgaagccctgcctgaacggcggtgtttgtgttcgtccggatcagtgtgaatgtgccccggggtggggaggaaaacattgtcacgtcgacgttgatgaatgtcggaccagtataacgctatgttctcatcactgcttcaacacagccgggagcttcacctgtggttgcccacatgacctggtgctcggtgtggatggtcgtacgtgtatggaaggctctccagaaccacccacctccgccagcatactgtccgtggcagtccgagaagctgagaaggacgaacgagccctcaaacaggagattcatgagctgcgggggcgactcgagagattagaacagtgggccggtcaggccggagcctgggtgcgcgccgtgctgcccgtaccccctgaggaactgcagccggagcaagttgcagaactctggggcagaggcgatcgcatcgaaagcttatccgatcaggtcctcctcctcgaggagcggctgggggcatgtagctgtgaggacaactctctgggtctcggggtcaatcaccggtag

SEQ ID NO: 186380 - DNA, 882 bp, Artificial Sequence
  Description of Artificial Sequence: Synthetic coding sequence
atgggcagccgggccgagctgtgcaccctgctgggcggcttcagcttcttacttttgttgatcccaggtgagggcgccaaaggaggtagtctgcgagaatcccaaggagtctgctcaaagcagaccttggtggtgccactgcattacaacgaatcttattcccaacctgtctacaaaccatacctgacattgtgcgctgggaggcggatctgtagcacttacaggacgatgtacagagtgatgtggcgcgaggtgaaacgggaggtgcagcagactcatgcggtgtgctgccagggatggaagaagcgacaccctggagctttgacatgcgaggccatatgcgcgaagccatgcctgaacggaggggtgtgtgtcaggccggatcagtgcgagtgcgccccaggatggggcgggaaacattgccacgtggacgtggatgagtgtcgtacatcaatcactttgtgctcccatcactgtttcaataccgccggatcatttacctgtggttgtcctcacgacttagttctgggagtggacggccggacctgtatggaagggtcgccagaaccacccaccagcgcatccattctgtccgttgccgtgcgcgaggctgagaaggacgagagggccctgaaacaggaaatccatgagctacgaggtaggctagaacgcctggagcagtgggcaggccaggcaggagcatgggtgagagcggttctccccgtgccacccgaggaactacagccagagcaggtggcagaactgtggggccgcggagaccgcatcgagtccttatcagatcaggtgcttcttttagaagaaaggttgggggcttgttcctgcgaggataacagcctgggtctcggcgtgaatcacaggtag

SEQ ID NO: 186381 - DNA, 777 bp, Artificial Sequence
  Description of Artificial Sequence: Synthetic coding sequence
atgggcagccgggccgagctgtgcaccctgctgggcggcttcagctttttgctcctgttgattcccggcgagggagccaaaggaggttctttgagagagtctcagggcgtgtgctctaagcagacattggtggtccccctgcattataacgagagctacagccagcctgtttacaaaccatatctgacactctgcgctgggcggagaatttgctccacctaccgaaccatgtatcgcgttatgtggcgcgaggtgcgcagagaggtgcagcaaacacacgccgtgtgctgtcagggctggaagaaaagacaccccggcgcactgacctgcgaggctatctgtgctaagccttgtctcaacggcggagtctgtgtcagacctgaccagtgcgaatgcgctcctggatggggcgggaagcattgtcatgtgggctccttcacatgtggatgtcctcacgatttggtgctcggtgtggatgggcgcacttgtatggaagggagcccagagccacccacctcagctagcatcttgtctgtggccgtacgtgaagcagaaaaggacgagagagctttgaaacaggaaatccacgagcttagaggccgcctggagaggctggagcaatgggcggggcaggccggtgcttgggtgcgcgcagtattgcctgtgcctccggaggaactgcagcccgagcaggtagcggagctttggggacggggagaccgtattgaatctctcagcgaccaggtacttctgttagaggaaagactaggcgcgtag

SEQ ID NO: 186382 - DNA, 882 bp, Artificial Sequence
  Description of Artificial Sequence: Synthetic coding sequence
atgggcagccgggccgagctgtgcaccctgctgggcggcttcagctttctgcttctgctgattcctggagaaggggcaaaaggaggctctctccgggagagccagggcgtgtgctcgaaacaaaccctcgttgtccctctgcactacaatgagagttacagtcagccagtatataaaccttatcttacattgtgtgccggtaggcgcatttgctctacataccgtaccatgtatcgcgtcatgtggagggaggtcagaagagaagtccagcagacgcatgctgtgtgctgtcaggggtggaagaagcggcatcccggtgcactgacttgtgaggcaatttgtgccaaaccttgcctgaacggcggggtgtgcgttagacccgatcagtgtgagtgcgccccagggtggggtggaaagcattgtcatgtggatgtcgatgaatgtcggacctccatcaccctgtgctctcatcattgttttaacacagcaggctctttcacctgcggctgtccccatgatctggttctgggcgtggatggacgcacctgcatggagggtagccccgagcctccgacctccgccagcatcctgtcagtcgccgttcgagaagccgaaaaggacgagcgggcactgaagcaagagatccacgaactcaggggcagactagaacgcctggagcagtgggcaggccaagccggcgcttgggtgagggctgtactgcctgtacctccagaagagctccagcccgaacaggtggctgaactgtgggggaggggggatagaatcgagtctctgtctgaccaggtgctgttattggaggagaggctgggggcatgtagttgtgaagataactctctgggtctaggcgttaaccatagatag

SEQ ID NO: 186383 - DNA, 882 bp, Artificial Sequence
  Description of Artificial Sequence: Synthetic coding sequence
atgggcagccgggccgagctgtgcaccctgctgggcggcttcagctttttgctgcttctcatacccggggaaggggccaaaggcggctcactgagagaatctcagggagtatgcagcaagcagactctggtggtgccactccattacaatgaaagctattctcagcctgtttacaaaccctacttaaccctatgtgctggccggcggatttgctccacctaccgaaccatgtaccgggtgatgtggcgcgaggtccggagagaagtccagcaaacacacgctgtctgctgtcagggctggaagaaaaggcatcccggcgcattaacttgtgaagcaatatgcgccaagccatgtctcaatggtggagtgtgtgtgcgaccagaccagtgcgagtgtgcacccggctggggaggcaaacactgccacgtcgacgtggacgaatgcaggaccagtataaccctgtgctcacaccactgtttcaacacagccgggtcattcacatgcgggtgtcctcacgacttggtgctcggagtagacggcaggacttgcatggagggatcaccagaacctcctacgagcgctagtatcctgtcagtagctgtgagggaggctgagaaagacgagagagctctgaaacaggagatccacgaactgcggggacggttggagcgccttgagcagtgggcagggcaggccggcgcttgggtgagggcagttttaccggttcctccagaggagttgcagcccgaacaagtcgctgaactgtgggggcgcggggacaggatcgagagcctcagtgatcaagtgttgttgctcgaggaaagacttggtgcttgctcttgtgaggacaacagtctggggctgggggtgaatcaccgttag

SEQ ID NO: 186384 - DNA, 882 bp, Artificial Sequence
  Description of Artificial Sequence: Synthetic coding sequence
atgggcagccgggccgagctgtgcaccctgctgggcggcttcagctttctattactcctaatcccaggcgaaggtgctaaaggcggctccctcagggaatcacagggcgtctgctcgaagcagaccttggtcgtcccgttgcactataatgaatcatactcccagccagtctataaaccctacctgactttatgcgccggcaggcgaatatgttcgacttacagaacaatgtatcgagtcatgtggagggaagtcaggcgagaggtgcagcagacacacgctgtttgctgtcaaggctggaagaagaggcatcccggggccctgacatgtgaagcaatatgcgccaagccctgtcttaatggtggcgtatgcgtgcgccccgaccagtgtgagtgcgctcccggatggggcggcaagcattgtcacgtggacgtggatgagtgccgaacatcaatcacactatgtagccaccactgttttaacactgcagggtccttcacatgcggatgtccacacgatttagtgcttggcgtcgatggccgcacttgtatggaaggcagccccgaaccccccacatcagcttctatcctcagtgtggctgtccgcgaggccgagaaggacgagagagccctgaagcaggaaatacacgaattgaggggacgccttgagcgcctggagcagtgggccggacaggcgggcgcgtgggtgagagctgttttaccggtcccccctgaggaactgcaacctgaacaagtcgccgagctctggggaagaggcgaccgtatcgaatcactgagcgaccaggtgctccttctagaggaacgcctcggcgcctgtagctgcgaagacaattccctaggtctcggggttaaccaccggtag

SEQ ID NO: 186385 - DNA, 777 bp, Artificial Sequence
  Description of Artificial Sequence: Synthetic coding sequence
atgggcagccgggccgagctgtgcaccctgctgggcggcttcagcttcctactgctgctcataccaggggagggcgctaaaggaggttcactgcgggagtcacagggcgtttgctctaaacaaactctcgtcgtccccttgcattacaatgaatcctactctcagcccgtctataaaccctatctaaccctttgtgctgggcggcgcatttgctctacttatcgcaccatgtaccgtgtgatgtggagagaggtacgccgtgaagtgcagcagacccatgcggtgtgttgtcagggctggaaaaagcggcacccaggcgccctcacctgtgaagctatctgcgccaaaccctgtctcaatggcggtgtatgcgtacgacctgaccaatgtgagtgcgcccctgggtggggagggaagcactgtcatgtaggcagtttcacttgcggttgtcctcatgacctcgtgctgggtgtcgacgggcgaacttgcatggaggggtcccccgaaccccccacaagtgcctctattctgtctgtcgcagtgcgtgaagctgaaaaagatgaacgcgccctaaagcaagagattcacgagctgagaggaaggcttgagcggttggagcagtgggcagggcaggcaggggcttgggtccgagcagttctgcccgtcccgcccgaggagctgcagcctgagcaggttgccgagttgtggggccgaggggatcggatagagtctctcagcgaccaggtgctgctgctggaggagcgcctcggagcatag

SEQ ID NO: 186386 - DNA, 777 bp, Artificial Sequence
  Description of Artificial Sequence: Synthetic coding sequence
atgggcagccgggccgagctgtgcaccctgctgggcggcttcagctttctgctactgttaatacccggcgaaggcgctaaaggcggatctctcagggagtcacagggagtgtgttccaagcaaacactcgttgtccccctgcattataacgaatcctactcccagccagtttacaagccatatctgacactttgcgcaggcagacgaatctgctcaacatataggaccatgtatagagtgatgtggcgagaggtgcgtcgggaagtacagcagacacatgctgtgtgttgtcaggggtggaaaaagaggcatccgggggcacttacatgtgaagcaatatgcgccaaaccttgccttaacggtggtgtttgtgtgagaccggaccagtgtgagtgtgctcctggctgggggggcaaacattgccacgtgggcagcttcacgtgcggctgcccacatgatctggtgctgggggtggacggtcgaacgtgtatggaagggtctccggaaccaccaacttccgcatcaatattgagcgtggccgtgagagaggcagaaaaggatgaacgcgcgcttaagcaggaaatacatgagctgcgcggacgcctagaacggctagaacagtgggccggacaggctggagcctgggtacgggctgttctgccagtgccccctgaagagttacagcccgagcaggtggccgagctgtggggcagaggtgaccgcattgagagcttgtctgatcaggttcttctcctagaggagcgcctgggtgcatag

SEQ ID NO: 186387 - DNA, 777 bp, Artificial Sequence
  Description of Artificial Sequence: Synthetic coding sequence
atgggcagccgggccgagctgtgcaccctgctgggcggcttcagcttcctgctcctactgattcctggtgaaggggctaaagggggctcactgagggagtcccagggggtttgctctaaacaaacccttgtagtacccttgcattacaatgaaagttactcacaaccggtgtataagccctacctcaccctctgtgccgggagacggatatgcagcacatacagaaccatgtatagagtcatgtggcgcgaagtcaagcgtgaggttcaacagacccatgccgtctgttgtcagggttggaaaaagaggcatccaggcgcactcacatgtgaagctatctgcgccaaaccttgtctgaacggaggggtgtgtgtcaggcccgatcagtgcgagtgcgccccgggctggggcggtaaacactgccatgtcggcagcttcacatgcggctgcccccacgacctggtgttaggagtggatggacggacctgcatggagggatcaccagagcctccgacctcggcatcgattttgagcgtagcagtccgcgaggctgaaaaggacgagcgcgccctgaaacaggagattcatgagctacgtgggcggttggagcggttagaacagtgggctggccaggccggagcctgggtgcgcgcagttctgcccgtgccacctgaggagctccagcctgagcaagttgccgagttatgggggcgtggggaccgcattgagagcctcagcgatcaggtgttactgctggaagagcgtctgggcgcatag

SEQ ID NO: 186388 - DNA, 882 bp, Artificial Sequence
  Description of Artificial Sequence: Synthetic coding sequence
atgggcagccgggccgagctgtgcaccctgctgggcggcttcagctttctactcttactgatacctggtgagggagccaaggggggatcactgcgtgagagccagggggtgtgtagcaaacagactctagttgttccactgcattataatgagtcctactctcaacccgtgtacaagccgtacctaactctgtgtgccggccggcgcatatgctctacataccgcaccatgtacagggttatgtggagagaagtccgaagggaggtccagcagactcacgccgtgtgctgtcaaggctggaagaagaggcatcccggcgcattgacatgcgaagcgatttgcgctaagccctgtctgaacggcggagtgtgcgtccgccctgaccaatgcgagtgcgctcccgggtggggcggtaagcactgccacgtcgatgtggatgaatgtaggacttcgattacactctgttcccaccactgctttaatacagccggcagcttcacatgcggatgtcctcacgacttggtcctgggcgtggacggacggacctgcatggagggctctccagagccgcccacatcagcctccatcctgtctgttgccgtgcgtgaggctgagaaagatgagagagccctgaagcaagaaatccacgagctgcgcgggcggctggagcggttggaacagtgggcgggccaggcaggtgcctgggtacgcgcggtgcttccagtgcctcccgaagaactgcagcccgaacaagtggccgaactctgggggagaggcgatcggatcgagagcctgtctgaccaggtacttctgctggaagaaaggcttggtgcctgtagctgcgaagataattcgctgggcctgggagtcaaccatcggtag

SEQ ID NO: 186389 - DNA, 882 bp, Artificial Sequence
  Description of Artificial Sequence: Synthetic coding sequence
atgggcagccgggccgagctgtgcaccctgctgggcggcttcagctttcttcttctgctgatacctggcgaaggcgcaaaaggaggctccctgcgggaaagccagggggtatgcagcaaacagactctagtcgtccctctgcattacaatgagtcatactcacagccagtgtacaagccctacttaaccctatgtgccggccggcgaatatgtagcacctatagaactatgtatcgcgtgatgtggagagaagtccgtcgggaagttcagcagacacacgctgtatgctgccagggctggaaaaaaagacaccctggtgccctgacgtgcgaagccatatgcgcgaagccgtgccttaatggcggagtctgcgtccgccctgaccaatgtgagtgtgcaccgggctggggcggcaagcattgccacgtcgatgtcgatgagtgccgaactagtatcactctctgtagtcaccactgcttcaacaccgcaggctcttttacttgcggttgtccccacgatttggttctgggtgttgacggcagaacttgtatggaagggtctcccgagcccccgactagtgcctcaattctctccgtagccgtccgagaagctgagaaggatgaaagggcccttaagcaggagattcatgagctacgggggcgtctggagaggctggagcagtgggccggccaagcaggtgcatgggttagggccgtgttgcccgtccctcctgaggaactgcagcctgaacaggtagcagaattgtggggacgaggggatcgcattgaatcactgagcgatcaagtactgttgctggaagagcgacttggtgcatgttcctgcgaggataactccctcggtcttggcgtcaaccaccgctag

SEQ ID NO: 186390 - DNA, 882 bp, Artificial Sequence
  Description of Artificial Sequence: Synthetic coding sequence
atgggcagccgggccgagctgtgcaccctgctgggcggcttcagctttctgctcctattgatcccgggcgagggcgccaaaggtggaagtctgcgcgaaagccagggcgtttgtagcaagcaaaccctggtggtgcccctccactacaacgagtcgtactcccagcccgtctacaagccttatctcactctttgcgctgggcgacggatatgttcaacttacaggacgatgtatcgggtaatgtggagagaagtccggagagaggtccaacagacacatgcagtatgttgccaggggtggaaaaaacggcatcccggagccctgacatgtgaagctatctgtgctaagccctgtttaaacggtggagtttgtgtgcggcccgaccagtgtgaatgcgcacccggctggggagggaagcactgccacgtcgatgtggatgaatgcaggacctctattactctctgctctcaccattgctttaacacagctggatccttcacctgtggctgcccacacgacttagttctgggcgtggacggtaggacctgtatggaagggtctcctgagcctccaacaagcgcctcaattcttagcgtggcagttcgggaggctgagaaagacgaaagagccctgaagcaagaaatccacgaactgcgcggacggttggaaagactagagcagtgggctggtcaggccggagcttgggtgagagccgtcctaccagtgcctcccgaggagctacagccagagcaggtggccgagctgtggggtcgtggcgatcgcattgaaagcctgtcagatcaagtcctattgctcgaggagcgtctgggtgcctgcagctgtgaagacaactccctgggtctgggcgtgaaccatagatag

SEQ ID NO: 186391 - DNA, 882 bp, Artificial Sequence
  Description of Artificial Sequence: Synthetic coding sequence
atgggcagccgggccgagctgtgcaccctgctgggcggcttcagctttctgttactcctaatccccggtgagggcgctaaggggggcagcttacgcgagtctcaaggcgtctgctccaagcagaccttggtggtgccactccattacaacgagtcttatagtcagcccgtctataaaccttatttgaccctgtgcgcggggcgcagaatatgcagtacctacagaaccatgtaccgagtcatgtggcgggaggtgaagcgcgaggtgcagcaaacccacgccgtgtgttgccagggatggaagaagcggcatcccggagccctcacctgtgaagctatatgcgccaaaccttgcttaaatggcggagtttgcgtcaggcccgatcagtgcgagtgcgcacccggctggggcggcaaacattgccacgtggacgtggatgaatgtcgcactagcattacactatgttcccaccattgctttaacactgctggtagctttacctgtggatgtccacatgatcttgtcctcggtgtggacggccgcacctgtatggaaggcagcccagagccaccaacatcagcttccatcctgagcgtggctgtgcgtgaggcagagaaggatgagcgggccttgaagcaggagatccacgaactgaggggtcgactggagcgcctggagcagtgggccggtcaggctggcgcctgggtaagagccgtgttgccagtgccaccggaagagttgcagccagagcaggtggcggaactgtggggtagaggcgacaggattgagagtctgagtgatcaagtgctcttactcgaggagcggctgggcgcctgctcatgtgaggataattcacttggcctgggtgtgaaccaccgatag

SEQ ID NO: 186392 - DNA, 882 bp, Artificial Sequence
  Description of Artificial Sequence: Synthetic coding sequence
atgggcagccgggccgagctgtgcaccctgctgggcggcttcagcttcctgctcctgctgatcccaggcgaaggagctaaaggagggagcttgcgtgagagccaaggggtgtgctccaagcagaccctggtagtgccgctccattacaacgagtcttactcacaaccggtttataaaccctacctgacactctgcgcaggaagacgaatctgtagcacttatagaacaatgtatagggtgatgtggcgtgaggtcagaagagaggtgcagcagacacatgcagtgtgttgccaaggatggaaaaagagacatcccggcgccttaacctgtgaagctatctgtgcgaagccatgtctgaacggtggggtgtgcgtgaggcccgaccagtgcgagtgtgcacccggatggggggggaaacactgccacgttgatgtggacgaatgtcggacctcaattaccctgtgttcacatcactgctttaacactgccggttctttcacctgcggctgccctcacgacctggttttgggtgtggacggaaggacttgcatggagggcagtccagagcctcctacaagcgccagcattctctccgtggcagtccgcgaagccgaaaaggacgagcgcgcactgaaacaagaaatccacgaattgagaggccgcctggaaagactggagcagtgggccggccaggccggagcgtgggttagagcagttctacccgttccccccgaggagttgcagcccgagcaggtggctgagttgtggggccgaggcgaccggattgagtctttatcagatcaggtgctgcttttagaggagagattgggcgcatgctcctgcgaggacaactctctgggcctcggtgtgaatcataggtag

SEQ ID NO: 186393 - DNA, 882 bp, Artificial Sequence
  Description of Artificial Sequence: Synthetic coding sequence
atgggcagccgggccgagctgtgcaccctgctgggcggcttcagctttctccttctgctgattcccggcgagggagccaagggcgggtcactgagggaaagccagggagtgtgttcgaagcaaactctggtggtgccactccattacaatgagtcgtatagccagcctgtctataagccctatttgacactgtgcgccggccgcagaatttgttcaacatataggactatgtaccgtgttatgtggcgtgaggtacggagagaagttcagcagacgcacgcggtgtgctgtcaagggtggaagaaacggcacccgggggcactcacatgtgaggctatctgcgctaagccctgcctcaatggtggagtgtgcgtgaggcccgatcagtgtgagtgcgcaccaggttggggtgggaaacactgccatgttgacgtggacgagtgccgtacatcaataacgttgtgcagtcaccactgctttaacactgccggcagttttacctgcggatgcccacatgatctggtcttgggcgttgatggcagaacttgcatggagggaagcccagagcctcccacaagtgcaagtattttgtcagtcgcagtaagagaagcagaaaaggacgagcgggcactcaagcaggaaatccacgagcttagggggaggttagagaggctggaacaatgggctgggcaggcaggggcctgggtgcgggcggtactgcccgtcccacccgaggaactgcagccagaacaagtcgccgaactgtggggtcgcggggatcgaatagagagtctctccgaccaggtgttgctcctcgaagaaagactgggagcctgctcctgcgaggacaatagcctggggctcggcgtgaaccatcgatag

SEQ ID NO: 186394 - DNA, 882 bp, Artificial Sequence
  Description of Artificial Sequence: Synthetic coding sequence
atgggcagccgggccgagctgtgcaccctgctgggcggcttcagcttcttgttacttctgatccccggagagggcgcaaagggaggttctctgcgcgagtcccagggggtgtgctctaaacagacgttggtggtgcctctacactacaacgaatcttacagtcagcctgtgtataaaccgtacctgacgctctgcgcaggcagaagaatttgtagtacgtaccgcaccatgtatcgcgtgatgtggagagaagtcaggagagaggtccagcagacacacgctgtctgttgccaaggatggaaaaaacggcacccaggtgcactgacctgcgaggccatttgtgctaagccatgtctaaacggcggggtctgcgtgagacccgaccagtgcgaatgtgccccagggtggggaggcaaacactgtcacgtcgacgtcgacgagtgccgaaccagtatcacgttgtgctctcaccactgcttcaacaccgccgggagcttcacttgtggttgtcctcacgatcttgttcttggcgtggatggtaggacgtgcatggagggttctcccgaaccaccaacgtcagcatcaatactgtccgtagcagtacgcgaggcagaaaaggacgaacgcgctctgaaacaggaaattcacgaactccgggggcggcttgaacgattggagcagtgggccgggcaagccggcgcctgggtgcgagccgtgcttccagttccaccagaagagctccaacccgaacaagtcgcagaactctgggggagaggtgacagaatagaatcattgtccgaccaagtgctgttgttggaggaacggctcggtgcatgttcatgtgaggataactccctgggcctgggggttaaccatcggtag

SEQ ID NO: 186395 - DNA, 777 bp, Artificial Sequence
  Description of Artificial Sequence: Synthetic coding sequence
atgggcagccgggccgagctgtgcaccctgctgggcggcttcagcttccttttgctgttaatccccggtgagggggcgaagggaggctctctcagggaatcccagggtgtgtgcagcaaacagacactagtagtgcctctgcactataatgagagctacagccaaccagtctataagccttacctgacattgtgtgctggacgcagaatttgttcaacctaccgaactatgtacagggtcatgtggagagaagttcgtagggaagtacagcagacacatgctgtgtgttgccaggggtggaaaaagagacaccctggggcgctgacctgcgaagccatttgtgccaagccttgcctcaacggaggcgtatgcgtgcgcccggatcagtgcgagtgcgcccccgggtggggaggtaaacactgccacgtgggatccttcacatgcggctgcccacatgatctggttctgggcgtcgacggacggacttgtatggagggcagtcctgagccccccacttcagcgagcatcttgagtgtggccgtgcgggaagcagagaaggatgagcgggctctgaagcaggagatccacgaactgaggggccgactggagaggctcgagcagtgggccggccaggcgggcgcttgggtgcgcgcggtgttgccagttccaccggaagaattgcagcccgaacaggtggccgagctgtggggccgcggtgatcgaatcgaaagcttgagcgaccaggtgctcctcttggaggaacgcctgggagcttag

SEQ ID NO: 186396 - DNA, 882 bp, Artificial Sequence
  Description of Artificial Sequence: Synthetic coding sequence
atgggcagccgggccgagctgtgcaccctgctgggcggcttcagcttccttctcttgctcattccaggagagggcgcaaaaggcggaagcctgcgagaatcccagggggtgtgcagcaagcagaccctggtggtccctttgcactacaatgagagctactcacagcccgtctataaaccgtacttgactctatgcgctggccggcgtatttgtagcacatacaggacaatgtatcgcgtgatgtggagggaggtgagaagagaggtgcagcagactcatgccgtgtgctgtcaggggtggaagaagagacaccccggcgccttaacttgcgaagcaatctgcgctaagccatgtctgaacggtggcgtgtgcgtaaggcccgatcagtgcgagtgtgcacctggatgggggggcaaacactgtcatgtcgacgttgacgagtgccgcacctccatcacactctgcagccatcactgctttaacacagctggttcatttacctgtgggtgtcctcacgatttagtcctaggagtggacggcaggacctgcatggaagggagccccgagcctccaacatccgccagtattctgagcgtggcggtgcgcgaagccgagaaagacgaacgcgcactcaagcaggagatccatgagctccggggcaggctggagcggctcgaacaatgggccggtcaggcaggagcttgggtaagagcggtgctgcccgtcccaccggaggaattgcaacccgaacaggtggccgagttgtgggggcgcggggaccggattgagagcttgagcgatcaggtgctcctgctagaggagcgcctgggagcttgtagctgcgaggacaacagtcttggactcggggttaaccaccggtag

SEQ ID NO: 186397 - DNA, 1281 bp, Artificial Sequence
  Description of Artificial Sequence: Synthetic coding sequence
atggccaacgacagcggcggccccggcggccccagccccagcgagcgcgaccgtcagtactgtgaactgtgtggaaagatggagaatctgctgcgctgctctcggtgtcggagcagcttctattgctgcaaagaacaccagaggcaggattggaaaaaacacaagctggtgtgccaaggttctgaaggagccctgggccacggcgtcggccctcaccagcacagcggacctgctccccctgctgccgtgccccctccacgggctggcgcacgcgaaccccgcaaagcagcggccagacgtgacaatgcatctggagacgctgccaaagggaaggtgaaggcaaaaccccctgccgatcccgccgcagccgcctccccttgtcgggctgctgcgggtggtcagggttccgccgtggccgccgaagctgagccggggaaggaagagccacctgcccggtcatcgcttttccaagaaaaagctaacctgtacccaccttccaatactccaggcgatgcgctgtctcccggcggcgggctgaggcctaacggtcagactaaaccattacctgcactgaagctggcactagagtacattgttccctgtatgaacaagcatggtatttgtgtggtggacgatttcctcggcaaagaaactggtcagcagatcggcgatgaggtgcgcgcgctgcatgacacaggaaagttcaccgatgggcaacttgtgtcccagaaaagcgattcctccaaagatattaggggggataagattacatggatcgagggcaaggagccagggtgtgagactatcggtctgctgatgagtagcatggatgatctgatacgtcactgtaacggtaaactggggtcttacaaaatcaatggcagaacaaaagccatggtcgcatgttatccgggaaatggcaccgggtacgtgcggcatgtagataatcccaacggtgacggtcgatgtgtcacctgcatatactacctgaataaggattgggatgccaaagtgagcggtggcattctgaggatctttcccgagggaaaggctcaattcgctgatattgagccaaagtttgatagattgctgttcttttggtccgatcgacgaaaccctcacgaggtacagcctgcgtacgctacaagatatgcaattacagtttggtacttcgacgctgacgaaagagcccgagccaaagtaaagtacctgacaggagagaaaggagtgagggtggaattaaacaagcccagcgatagcgtcggtaaggacgtgttttag

SEQ ID NO: 186398 - DNA, 216 bp, Artificial Sequence
  Description of Artificial Sequence: Synthetic coding sequence
atgaacaagcacggcatctgcgtggtggacgacttcctgggcaaggagacaggccaacagataggagacgaggtgcgtgcgctccatgacacaggtaagtttactgacggatcttggagcgcccgcagagttacacggccccggacaagtgaggcaattcgcagtccaggaagccgcgccaggtcacccgctgctaagccccttgggtgctcttag

SEQ ID NO: 186399 - DNA, 1224 bp, Artificial Sequence
  Description of Artificial Sequence: Synthetic coding sequence
atggacagcccctgccagccccagcccctgagccaggccctgccccagttgcctgggtcctcatctgaacccttagaacccgagcccgggcgggcacggatgggcgttgaaagctatcttccttgtccactgctgccttcataccactgccctggagtaccgagtgaggcttctgcaggcagcggtacaccacgcgcaactgccacttcaacaactgcctcccccctcagggacggatttggcggccaggacggcggagaactgcgccctcttcagagtgagggcgccgcggcactcgtgacaaagggatgtcagcgcctcgctgcccagggagctcgccccgaagctccaaaaaggaaatgggctgaagacggaggcgacgccccctctccatcaaagcgcccctgggccaggcaagaaaaccaggaggctgagagggaaggcgggatgagctgctcctgctcctcagggtctggggaggcaagcgcggggttgatggaggaggctcttccctcagcaccagaacgactagcactggactacatcgtgccttgtatgcgctactatgggatctgtgtgaaggattctttcctgggggccgcacttggaggcagagtgctcgctgaggtggaagccctcaaacgcggcggaaggcttagagacggccagctcgtctcccagagggcaatccccccacggagcattcgcggggaccaaatcgcatgggtcgaagggcatgaaccgggctgtcgcagtattggagctctcatggctcacgttgacgccgtgattagacactgtgccggaaggttaggcagttacgtgatcaacgggcggactaaagccatggttgcctgttaccctgggaatgggctgggctatgtcagacacgttgacaatccgcacggagatggccggtgcatcacctgcatttactatttgaatcagaactgggacgtcaaagtgcatggaggcctgctacagatctttcccgaaggaagacccgtggttgctaacatcgaacccctgtttgaccggcttctcatcttttggtcagatcgaagaaacccacacgaggttaaacctgcctacgctacacggtatgccatcaccgtgtggtacttcgatgccaaggaaagggccgccgccaaggacaaatatcagcttgccagtggacagaaaggcgtccaggtgcctgtatcgcagccacctacacctacttag

SEQ ID NO: 186400 - DNA, 1224 bp, Artificial Sequence
  Description of Artificial Sequence: Synthetic coding sequence
atggacagcccctgccagccccagcccctgagccaggccctgccccaacttcccgggtcctcaagcgaaccattagaacccgaacccggtagagcacgtatgggcgtggagtcatacttgccttgtcctttgctcccaagttatcactgcccaggggtaccttctgaggcatccgctggaagcgggaccccccgagccaccgctacaagtaccactgctagtccgttaagagatggtttcggcggacaggacggcggcgagctccgaccgctccagtcggaaggggccgctgcacttgtcacaaagggttgtcagcgcttggcagcccagggagccaggccagaagctccaaaacggaaatgggctgaggacgggggcgatgcgccctccccctctaagagaccatgggcccggcaagaaaaccaggaagcggagagggaggggggcatgtcttgtagctgtagcagcggatctggcgaggctagtgcaggtctcatggaagaagccctgccttcagctcctgagaggcttgctctggactacatagtcccttgtatgcgttactacgggatctgcgtgaaggactcgttcctgggcgcagctctgggaggtcgcgtcctcgcagaggtcgaggctctgaaacgcggaggaaggctccgtgacgggcagctggtgtcacaacgggcaattcctcctcgttctatcagaggagatcagatcgcctgggtggagggacatgagccgggatgtcgaagcattggggcccttatggcccacgtggacgctgtgatcaggcattgtgcaggacggcttggcagttacgtgattaacggtcgtaccaaggccatggtggcatgctacccagggaatgggctggggtatgtcagacacgtggacaaccctcacggagatgggagatgtatcacttgcatctactacttaaatcaaaattgggacgtcaaggtgcacggcggtctgctacaaatattccccgaaggtagacctgtggtggctaatatcgagccgctcttcgaccgtctcctgatcttttggtcggatcggcgcaatccacacgaggttaaacctgcctacgctacgaggtatgctattaccgtgtggtacttcgacgcaaaagagagagccgccgccaaagataagtatcagctggcatccggccagaagggggtgcaggtgcctgtgagtcaaccgcccacccccacttag

SEQ ID NO: 186401 - DNA, 720 bp, Artificial Sequence
  Description of Artificial Sequence: Synthetic coding sequence
atgcccctgggccacatcatgcggctggacctggagaagatcgccctcgagtacatcgttccgtgcctgcacgaagtgggattctgctacctggacaacttcctgggcgaagtggtcggggactgcgtacttgaacgcgtaaagcagctacactgtaccggtgccttgagggatgggcagctagctggcccaagggccggagtgagcaaaagacatctccgaggcgaccagataacctggatcggcggaaacgaagaagggtgcgaagcgatatcatttctgctctctcttatcgataggctggtgctttactgcggttctcggctcgggaagtactacgtcaaggagaggtcaaaggcaatggttgcctgttaccctggcaatgggacgggctatgtgcgtcacgtagataatccgaacggcgacggaaggtgtatcacctgtatatactatcttaacaaaaattgggatgccaagctccatggcggaattttacggatcttccctgagggcaagtccttcattgccgacgttgagcctatattcgatcggcttctgtttttctggtctgatagaaggaatccgcatgaagtccaaccgagctacgcaacccgctacgcaatgacagtttggtacttcgacgccgaagagcgagctgaagcaaaaaaaaaatttcgaaacttgaccagaaaaaccgagtccgccttgactgaggattag

SEQ ID NO: 186402 - DNA, 720 bp, Artificial Sequence
  Description of Artificial Sequence: Synthetic coding sequence
atgcccctgggccacatcatgcggctggacctggagaagatcgccctcgagtacatcgtgccctgcctacacgaggtgggattttgttacctggacaacttcctgggcgaagttgtcggcgattgtgtgttggagcgcgtgaaacagcttcactgtacaggcgcattaagagacgggcagctggctggacctcgggcaggggtatccaagcgccatctgcgcggcgaccagattacctggatcgggggaaacgaggagggatgcgaggccatctcctttttactgtcactaattgacagactcgtcctttactgcgggtcccgcctaggtaagtactatgtgaaagaacgctccaaagccatggttgcctgctatcctggcaacggcacggggtacgttagacacgtggataaccccaatggggacggccgctgtatcacttgcatttattacttgaacaagaattgggacgccaagctacacggtggtatcctccggatctttcccgaaggaaagagcttcatcgcagacgtggaacccatctttgataggcttctgttcttctggtccgaccggcggaacccgcatgaagtgcagccaagctatgctaccaggtatgctatgaccgtgtggtatttcgatgctgaggagcgcgccgaagctaagaaaaagttccgcaacctgactaggaaaactgagagcgccttgacagaggactag

SEQ ID NO: 186403 - DNA, 1605 bp, Artificial Sequence
  Description of Artificial Sequence: Synthetic coding sequence
atgttcagctgggtgagcaaggacgcccggcggaagaaggagcccgaactcttccagactgtggccgaaggattgaggcaactatatgcccagaagctcctgcccctggaggaacattaccgtttccatgaattccacagtcctgccctggaagatgccgattttgacaacaaacccatggtactgttagtcgggcagtactcgacaggaaaaaccacctttatcaggcacctcattgagcaggactttcccggcatgagaattggaccagaacccacaaccgatagttttatcgccgttatgcacggtccaaccgagggcgtggttcctggcaatgcgttagtcgtagacccccgccggcccttcagaaagctcaacgcattcggaaatgcttttttgaaccgatttatgtgcgcccagcttcctaatcccgttctggatagcatcagtataattgatactcccggaattctcagtggagaaaagcagcggatttcccggggttatgattttgcagccgtcctcgagtggttcgctgagagagtagaccgcattattcttctgtttgacgcccacaaactggacattagcgacgaatttagcgaggtgatcaaggcgcttaaaaaccacgaggacaagatccgggtggtcctcaataaagctgaccaaatcgagacgcagcaactcatgagagtgtatggggcactcatgtggtctctcggtaagattatcaacactccagaggtagtgagggtctacataggttctttttggtctcatcctttgcttatccctgataaccgaaaactcttcgaggcggaagagcaagatttgttcaaggacatccagtccctgccgaggaacgcagccttacggaagctcaatgacctgataaagcgcgcccgactggcaaaggtccacgcatacataattagctctctgaagaaagaaatgccaaacgtctttgggaaggagagcaaaaaaaaagagctcgtgaataaccttggcgaaatttatcagaaaatcgaacgggaacatcagatctccccgggggatttcccgtctctccggaagatgcaggagctgctgcagacccaggacttctccaagtttcaagccctaaagccaaagttactcgacactgtggacgatatgctcgccaacgacattgctagattaatggttatggtcagacaagaggagagtctgatgcctagccaagtggtgaaggggggcgcatttgatgggacaatgaacgggccattcggacatgggtacggggagggagctggcgagggaatcgacgacgtggagtgggtggtgggcaaggataagcctacatatgatgagatcttttatactttgtctcccgtgaacgggaaaatcaccggagccaacgccaaaaaagaaatggttaagagcaagcttccaaataccgtgctgggcaaaatttggaaattagctgatgtggataaagacggcctcctagacgatgaggagttcgcgctggctaatcatctgattaaagtgaagctcgaaggacatgagttgcctgcagacctgcccccgcacctggttcccccgtcgaagcgtagacatgaatag

SEQ ID NO: 186404 - DNA, 1605 bp, Artificial Sequence
  Description of Artificial Sequence: Synthetic coding sequence
atgttcagctgggtgagcaaggacgcccggcggaagaaggagcccgaactgtttcagacagtggccgaagggctgagacaattgtatgctcagaaattgctgccgctcgaagagcactataggtttcacgaattccattcacctgccctcgaggacgcagatttcgacaataaaccaatggttctcctagtgggccagtattccacaggcaaaacaaccttcataaggcatctgattgagcaggatttccctggcatgcgcattggccccgagcccaccaccgatagtttcattgctgtcatgcatggccccactgagggcgtggtccctggaaatgcactggtcgtggacccacgcaggccattcagaaaattgaatgcctttggaaacgctttcctgaaccggtttatgtgcgcacagctccccaatcccgtcttggactctatcagcatcatcgacacacccggtattttgagtggggagaagcagcgcatttccagaggatatgattttgccgcagtcctggaatggttcgccgagagagttgatcgaataatcctcctgtttgacgcccacaaattggacatttccgatgaattttccgaggtgattaaagcactgaagaatcacgaggacaagatccgcgtagttctgaacaaggctgaccagatagagacccaacagctgatgagggtgtacggggccctgatgtggtctctgggcaaaatcattaacaccccggaggtggtacgcgtttacatagggtcattctggtctcacccactattgatccccgacaaccggaagctgtttgaagcagaggagcaggatttgtttaaagacatccagagtctccccagaaacgccgctctcaggaaactcaatgacctgattaaaagggctaggctggcgaaggttcacgcctacatcatttcttccttaaagaaagaaatgcctaacgtcttcggtaaggagagcaagaagaaagagctagtcaataatctcggtgaaatttatcaaaaaatcgagagggagcatcagatctccccgggcgatttccctagcctgcgtaaaatgcaggagctcctccagacccaggacttcagcaaatttcaggctcttaaacccaaactgcttgacaccgtggatgatatgttggccaatgacattgcccgcctcatggtgatggtcaggcaggaggagtccctcatgccatctcaggtcgtgaaaggcggcgcattcgatgggactatgaatggccctttcggtcacggctatggagaaggcgccggcgaaggaatcgatgatgtcgaatgggtggttggtaaagacaagccaacctatgatgaaatcttctacacactcagccccgtgaatggcaagattacaggggcaaatgctaagaaagagatggtgaagtcaaaacttccaaataccgtactgggcaagatctggaaactggcagacgtagataaagacgggttgctcgacgacgaggagttcgccctcgcgaaccacttaattaaggtcaagctcgagggccatgaactgccggccgaccttccccctcacctggtgccccccagcaagcgccgacacgagtag

SEQ ID NO: 186405 - DNA, 438 bp, Artificial Sequence
  Description of Artificial Sequence: Synthetic coding sequence
atgttcagctgggtgagcaaggacgcccggcggaagaaggagcccgaactcttccagacggtcgccgagggcctccgccaactgtatgcacaaaaactcctgccactagaggagcactacaggttccacgagttccactcaccagccttagaggatgcagacttcgataataaacctatggtcctgctcgtggggcaatatagtacaggcaagactacattcatcaggcacctgattgagcaggatttcccgggcatgcgcatcggtccagaacccactacggactcctttatcgctgtgatgcatggacctacggagggagttgtccccggtaatgctctagttgtggatcctcggcgcccattccgcaaattgaacgccttcggtaacgctttcctgaatcggttcatgtgtgcccagctcccaaaccccgtttag

SEQ ID NO: 186406 - DNA, 1296 bp, Artificial Sequence
  Description of Artificial Sequence: Synthetic coding sequence
atggagcagcccggcaccgccgccagccccgtgagcggcagcatgttttcttgggtctctaaagatgccaggcgcaagaaagagccagagctgttccagaccgtagcagaggggctgaggcagttatacgcacagaagttgttgcctctggaggaacattatagattccatgagttccactcgcccgctctcgaagatgccgattttgataataagcctatggttctgctggtcggccagtattccacaggaaaaacaacttttattcggcacctgatagagcaggattttcctggcatgcgtatcggtcccgagcccaccacggactctttcatcgcagtcatgcatggccctacggagggagtggtcccaggaaacgcactcgtggtggatccaaggaggcccttccgaaagctgaacgctttcggcaatgcgtttctgaataggtttatgtgcgctcagctacctaaccctgtgttggattccattagcatcattgacacccccggaattctgtctggggagaaacagcgcattagccgagggtatgacttcgccgcagtgctggagtggttcgccgagcgagtcgatcgcataatcctgctgtttgatgctcataaactggatatttccgacgagttttcggaggtaattaaagccctaaagaaccatgaggataagatccgcgttgtattgaataaggccgaccagattgagacccaacaactaatgagagtgtacggcgctttaatgtggagcctgggcaagatcataaataccccagaggtcgttcgggtttacattgggtctttttggtcacatcctctcttgattccagacaataggaagctgttcgaggctgaggagcaagatcttttcaaagacatccagagcctaccacggaacgccgctctgcggaagctgaacgacctgatcaaacgggcacgcttggcaaaggtgcacgcttatatcatttcatctctcaagaaagagatgccaaatgtgtttggaaaagagtccaaaaagaaagagttggtgaacaatttaggagagatttaccagaagattgaacgagaacatcagatttcaccaggcgatttccccagtctgcgcaagatgcaggagctcctgcaaacccaggatttctcaaagttccaggccctgaagcccaaactgctggacgatgaggaatttgcgcttgccaaccatttaattaaggtgaagctagaagggcacgaactgcccgctgatctgcccccgcacctggtcccaccctctaaaaggcgccacgaatag

SEQ ID NO: 186407 - DNA, 447 bp, Artificial Sequence
  Description of Artificial Sequence: Synthetic coding sequence
atgttcagctgggtgagcaaggacgcccggcggaagaaggagcccgaactgtttcagacagttgccgaggggctgcgccagctgtatgcccaaaagctgctccctttggaggagcattaccggttccatgagttccatagtccagccctagaagatgctgattttgataataagcccatggttctgctggtggggcagtacagcaccgggaagaccacgttcatcagacatttgatcgagcaggattttcccggtatgagaattggtcccgagcctactaccgattcttttatagccgtgatgcatggtcccactgaaggtgtggtacccgggaacgcgctcgtggtggacccgagaaggccgtttcgaaagctgaatgcgtttgggaacgcattcctgaatagattcatgtgtgctcagctgcctaatcctgtacttgattcttag

SEQ ID NO: 186408 - DNA, 1533 bp, Artificial Sequence
  Description of Artificial Sequence: Synthetic coding sequence
atgttcagctgggtgagcaaggacgcccggcggaagaaggagcactaccgcttccatgagtttcactctccagctctcgaagacgccgatttcgacaacaaacccatggtgctcttggttggccaatacagtactggtaagaccacctttattaggcatttgatcgagcaggacttccccggtatgcgaattggccccgagcccaccactgacagctttatcgcggtgatgcatggtcccaccgagggcgtagttcctgggaatgccctggtcgtggacccccgccgaccctttaggaagctcaacgccttcggcaacgcctttctcaacaggttcatgtgcgcccagcttccaaaccccgtgttggattctatctctatcatcgatacaccaggcatcctgtcaggcgaaaaacagcgtatatcgcgagggtacgatttcgctgcagtgctggagtggtttgccgaaagagtggaccgcattatactcctcttcgatgctcataagttagatataagtgacgaattttctgaagttatcaaggctctcaaaaatcacgaggataagattcgggttgtgctaaacaaagcggatcagattgagactcaacagcttatgcgtgtctacggcgccctgatgtggagtcttggaaagatcattaatacccccgaggtggtccgcgtctacattggcagcttttggtcccacccgctgttgattcctgataatagaaagttgttcgaggcagaagaacaggacctcttcaaggacatccagagtctccctcgtaatgccgccctgaggaaactgaacgacctgattaaacgtgccagactcgcgaaagttcacgcatacattatctcctcacttaagaaggaaatgcctaacgtctttggaaaagaatccaagaagaaggagttggtgaataatctcggtgagatctatcagaaaatcgagcgcgaacaccagatttctcctggggatttcccttctctcagaaagatgcaggaactgttgcagacccaggatttctccaagtttcaggctctcaaacccaaactgctcgacaccgtggacgacatgctggcaaatgacattgcacgactgatggtgatggttaggcaggaggagtccctgatgccctcgcaagtagtgaagggcggagctttcgacggcaccatgaatgggccctttggccacggttatggagagggcgcaggagagggaatagacgatgttgaatgggtcgtgggcaaggacaagccaacctatgacgaaattttctacaccctgtcccctgtgaacggtaagattaccggggcaaacgcgaagaaagagatggtgaagtctaaactccctaacacagtcctcgggaagatttggaagcttgcggacgttgacaaagacggactgctggacgacgaagagtttgctcttgctaatcacttgataaaagtcaaactggaaggccatgaactgccagctgatctgccaccacatctggtgcccccctctaagaggcgccacgagtag

SEQ ID NO: 186409 - DNA, 1632 bp, Artificial Sequence
  Description of Artificial Sequence: Synthetic coding sequence
atgttcagctggctgaagcggggcggcgcccggggccagcagcccgaagcaattcggaccgtaaccagtgccctgaaggaactgtatagaactaagctgttgcctttagaggaacattaccgctttggcgcgttccatagtcccgcactggaagatgctgactttgatggcaagcccatggtacttgtcgcagggcagtattccacaggaaagaccagctttatccaatacctcctggagcaggaagtccctgggagtagggtaggccccgagcccacaacagattgcttcgtcgcagtgatgcatggagacacggagggcacggtgcccggtaacgcattggttgtggacccagacaagccttttcgcaaactgaacccattcgggaacacctttctgaaccgctttatgtgcgcccagctgccaaatcaggtgctggaatccatctcaatcatcgatacaccaggaatcctgtcaggcgcaaaacaaagggtatcgagaggatatgacttccccgctgttcttcgctggtttgctgaacgcgttgacctgataatcttgctttttgacgcccacaagttggagattagcgatgagtttagtgaagctattggggcactccgaggacacgaggataagatccgcgttgttttgaataaggctgacatggtcgaaactcagcagctcatgcgagtgtatggggcactgatgtgggctcttggcaaagtggtgggaactcccgaggtacttagagtctacatcgggtctttttggtcacagccactactcgtgcccgacaatcgacgactttttgagctggaagagcaggacctgtttagagatatacagggcctgccacggcacgccgcgcttcggaagctgaacgatctggtcaagagagcgagactcgtccgggtccatgcttacataatcagttacctgaaaaaagagatgcccagcgtatttggcaaggaaaataaaaaaaagcagctgatactcaaactccctgtcatctttgccaaaatccagctcgaacatcatattagccctggggacttccccgactgccagaaaatgcaggaactgttgatggcccacgactttaccaagtttcactccctgaagcctaagttacttgaggcattggatgagatgctgacacacgatattgccaaactcatgccccttctgagacaggaggaattggagtccactgaagtcggagttcagggcggcgcttttgaaggcacccacatgggcccttttgtggaacgggggcccgacgaggccatggaagacggcgaggagggctccgatgacgaggctgagtgggttgtcacaaaagacaaatcaaagtatgatgagatcttttataaccttgcacccgccgatgggaagctcagcggatctaaagcgaaaacctggatggttggcactaaactgcccaactctgttctgggacggatatggaagttaagcgacgtcgatagggacggaatgctagacgatgaggagttcgcattggcttcccatctcatagaagctaagctggaaggtcacggcctacccgctaacttaccaagacggttagtacccccttctaaacggcggcataagggaagtgcagagtag

SEQ ID NO: 186410 - DNA, 516 bp, Artificial Sequence
  Description of Artificial Sequence: Synthetic coding sequence
atgcccagcgtgttcggcaaggagaacaagaagaagcagctgatcctgaagctcccggtgatcttcgctaagatccagctggagcaccacatcagccctggagatttccccgattgccagaaaatgcaggagctgcttatggcgcatgatttcacgaagtttcactctcttaagccaaagctcctcgaagcgttggatgaaatgttgacccatgacattgcgaaactgatgcctctgctgagacaggaggaactggagtcaaccgaagtaggagtgcagggaggggcctttgagggcacacatatgggcccgtttgtcgagcgtggaccagacgaggcgatggaagaccaagggcaggttcaaattcggcgcgatctgcttcagcccggggcttgtcgcaggcaggcggagagacttcagggacaggacttggatggcggcgatcaggcccctcagctgtccgccggcgcacacctggaagcgcagaggtgtggcccacgaaggcacgccggatag

SEQ ID NO: 186411 - DNA, 1224 bp, Artificial Sequence
  Description of Artificial Sequence: Synthetic coding sequence
atgtgcgcccagctgcccaaccaggtgctggagagcatcagcatcatcgacactccaggaatcttgtccggggccaaacagcgcgtgtcaagaggctatgactttccagcggttctgagatggtttgccgagagggtcgatcttattattctcttattcgacgctcataaactcgaaatcagtgacgaatttagcgaggccattggcgcactgcggggtcatgaggacaagattagggtggtgctcaacaaagcggatatggtggagacacagcagctgatgcgagtgtatggcgctctgatgtgggccctggggaaagtggttgggacacccgaggttcttcgggtgtatataggatcgttctggagccagccactgctggttcctgataaccggagattgttcgagttggaggagcaggacctcttcagagacatacagggattgcctcgtcacgctgcccttcgtaaactgaatgacttagtcaaaagggccaggctagtgagagtccatgcttatataattagctacttgaagaaagagatgccatccgtctttggcaaagaaaacaagaaaaagcagctgattttaaagctgcctgtcatatttgcaaaaatccagctggagcatcacatctcgcccggcgattttccggactgccagaagatgcaggaactactaatggcgcacgatttcacaaaatttcacagcctgaagccaaagcttctggaggccctcgacgagatgttgacacacgacatcgcaaagcttatgccactgctgagacaggaagagctcgagtccacagaggtgggagtgcaagggggagcgtttgagggcacccacatgggcccattcgtggaacgcggccccgacgaagcaatggaggatggggaggagggaagcgacgacgaggctgaatgggttgtcaccaaggacaaatcaaaatacgacgagatcttttataacctggcacctgctgacggaaaattgagcggctccaaggccaagacatggatggtcgggactaagttgcccaattccgtactgggacggatctggaagctctctgacgttgacagagatggtatgctggacgatgaggaatttgccttggccagtcatttgatcgaggccaagctggagggccatggactgcccgcaaacctccctcgacgcctggtccctccatccaagagaaggcataagggctcggccgaatag

SEQ ID NO: 186412 - DNA, 1242 bp, Artificial Sequence
  Description of Artificial Sequence: Synthetic coding sequence
atgttcagctggctgaagcggggcggcgcccggggccagcagcccgaagctattagaacagtcacctctgcattgaaggaactgtacaggacgaaactgctacctctggaggagcattaccggttcggggctttccactctcctgcattagaagacgcagattttgatggcaagcctatggtgctagtggctggccagtactcaacaggaaaaacatccttcatccaatacctgttggagcaggaagttcccggcagccgggtcggtccagaaccaacaacggattgcttcgtggccgtgatgcacggtgacaccgaaggcactgttcctggcaacgccctagttgtcgaccccgataaaccatttagaaagctgaaccccttcggcaataccttcctgaacagattcatgtgcgcccaattgccaaatcaggtcctcgagtcaatttcaataatcgatactcccggcattcttagtggggctaaacagcgtgtgtcaagagggtacgatttcccagccgtcttacggtggtttgctgaacgggtggatctcattattctcttgttcgatgcgcataagctggaaatcagcgacgagttctcagaggctatcggggcattgcgcggtcatgaagataagattcgcgtcgtcttaaacaaggccgatatggtggagactcagcaacttatgagagtctacggtgctctgatgtgggcccttggaaaggtagtagggacacccgaggtcctgcgggtgtatatcggcagcttttggagccagccattactggtgccggacaatcggcggctctttgagttggaagagcaagacctattccgagatattcaaggactgcctcgacatgcagccttacgtaagctgaatgacttggtcaaacgggcaagactggtgcgggtgcacgcatacatcatttcctacctgaagaaagaaatgccttccgtcttcggcaaggaaaacaaaaagaagcagctcattttgaagctcccggtcatcttcgcaaagatacaactcgaacatcatataagtcctggcgattttccagactgtcagaaaatgcaggaacttcttatggcccacgacttcacaaagttccactcccttaagcctaaactgcttgaagctctggacgaaatgctgacccacgatattgccaagttgatgccattgcttcgccaggaggaactggagagcagtccggtagccgaaatgacaagtcgctag

SEQ ID NO: 186413 - DNA, 1602 bp, Artificial Sequence
  Description of Artificial Sequence: Synthetic coding sequence
atgttcagctggctgaagcggggcggcgcccggggccagcagcccgaggccattaggacggtgacgtctgccctgaaggagttgtatagaaccaagttacttcctctggaggagcactatcgctttggtgcttttcattctccagcactggaggacgccgattttgatggcaaaccgatggtgctcgtggcgggacagtattctacaggtaagacctctttcattcaatatcttttggagcaggaggtgcctggatcgcgcgtcgcggttatgcacggagacaccgaagggacagtgcccggcaacgcacttgttgtcgatccggacaaacctttcagaaagctgaatccctttggtaatacttttctgaataggttcatgtgtgcccaactgcccaaccaggtgttagagtcaatcagcataatcgacacccccggcatactgtccggcgcaaagcagcgggtgtctagggggtacgatttcccagcagttctgagatggttcgcggagcgagtcgacctcattattcttctgttcgacgcgcacaagctcgagatttctgacgaatttagcgaggcgatcggggcacttcgcggccacgaggataaaatcagagttgttctgaacaaagccgatatggtggaaacacagcagctcatgagagtgtatggcgccttgatgtgggcactgggaaaggtcgtgggcacccctgaagtgctcagggtgtacattggcagcttctggtctcaaccattgctggtccccgacaatcgtaggctgttcgaactggaggagcaggatctgttccgggatatccagggactccctcggcacgcggcgctgagaaagctaaatgatcttgtgaagagggctcggttggtcagggtccacgcttatattatcagctaccttaaaaaagagatgccgagtgttttcggcaaggaaaacaagaagaagcagctcatcctgaagctgccggtgatctttgccaagatccagcttgaacaccacatctcgccaggcgattttcccgattgccaaaaaatgcaggaactattaatggcccacgactttactaagttccactccctcaaacctaaattactggaggccctggacgagatgctgactcatgacatcgcaaagctgatgcctctactacgccaggaggagctggaatctaccgaggtgggcgtgcaaggcggcgctttcgaaggaacccacatggggccttttgtcgaacgaggcccagatgaagccatggaagacggggaagagggcagcgacgacgaagcagagtgggtggtgacaaaggacaagagtaagtacgatgagattttttataacttagcgcccgccgacgggaagctgtcggggagcaaggccaaaacctggatggtcggcacgaaactgcccaactccgtgctgggacgcatctggaaactaagtgacgtagacagggacggcatgctggatgacgaggaatttgctctagcgtcacacctgatcgaagccaagctcgaagggcacggccttcccgccaatttgccccgtagactcgtgccaccatcaaagcgaagacacaaggggtctgccgagtag

SEQ ID NO: 186414 - DNA, 681 bp, Artificial Sequence
  Description of Artificial Sequence: Synthetic coding sequence
atgcccagcgtgttcggcaaggagaacaagaagaagcagctgatcttgaagctccctgtgatttttgcgaagatccagcttgagcatcatatctctccaggcgacttccctgattgccagaaaatgcaggaactgctgatggcccatgacttcactaagtttcactcactcaagcctaagctgttagaggcccttgacgagatgttgacccacgatatagcaaagctcatgccattgttaagacaggaggaattggaatcgacagaggtaggggtgcagggcggtgccttcgagggtactcatatgggaccttttgtggaacgcggcccggatgaggccatggaggatggtgaggaaggtagcgacgacgaagccgagtgggtcgtgaccaaagataagtctaagtacgatgagatcttctacaacttagccccagcagatggaaagctgagcggcagcaaggccaaaacatggatggtgggaactaaattgcctaactccgtcctcggccgaatatggaagctgtctgacgtcgacagggacggaatgctggatgatgaggaatttgcgctggcctcccatctcatcgaggccaagctggagggccatggcctaccggccaacctgccgcggcgcctagttccaccatccaaacgcaggcacaaaggctccgcagagtag

SEQ ID NO: 186415 - DNA, 1608 bp, Artificial Sequence
  Description of Artificial Sequence: Synthetic coding sequence
atgttcagctggctgggcaccgacgaccggcggcggaaggaccccgaagttttccagacggtgtcagagggcttgaagaaactctacaagtcgaagttgctgcccctggaggagcactacaggtttcatgagttccatagccctgccttagaagacgcagacttcgataataagccaatggtattgttagtcggccagtacagtaccgggaaaactactttcatccggtatttgttagaacaggattttcccggcatgcgaattggacctgaaccaacaacggacagtttcatcgctgtaatgcagggagatatggaggggattattccaggcaacgctctggtggtggacccaaagaaaccttttcggaagttgaacgcctttgggaatgctttcctcaatcgatttgtatgcgcacagctccctaaccctgtgctcgagagcatctcagtgattgacaccccaggtattcttagtggcgagaagcagcggatttctcgcggttacgatttcgcagccgtgctggagtggtttgctgagcgcgttgaccgcatcattctactcttcgacgcccataaactggatattagtgatgagtttagcgaggtcattaaagcacttaagaatcacgaggacaagatgcgcgtggttttgaataaggcagaccaaattgagacccagcaactgatgagagtttacggagctttaatgtggagcctgggaaaaatcgtgaacacacctgaggttatccgggtctatatcggatccttttggagccatccactgttgatccccgacaaccgaaagctgtttgaggctgaagagcaagatctctttcgggacatccagagtctgcccagaaacgcagcactgaggaagcttaatgacctgataaaaagggctaggctggccaaggtgcatgcatatattatcagctccctaaaaaaagaaatgccttccgtattcggtaaagacaacaagaaaaaagaactggttaacaatctcgcagagatctacgggaggatagagagagagcaccaaatatcccctggtgattttcccaacttgaagagaatgcaggatcaacttcaggcccaggatttttcaaagttccagcctcttaagagtaagctgttggaggtcgttgacgatatgcttgctcatgacatcgctcaattaatggtccttgtgagacaagaggaatcccagagaccaatacagatggtgaaaggaggagcgttcgaggggactctgcacggaccttttggacacggatatggcgaaggagctggagagggcatagatgatgcagagtgggtggtggcccgcgataaaccgatgtacgatgagatcttttacaccttgtcccccgtagatggcaagatcaccggggcaaacgctaagaaggagatggttaggtccaaactgccgaattctgtgctgggaaagatctggaagttggctgacattgataaagatggcatgttagatgacgacgaatttgcattagccaatcatctgattaaggtgaaactggagggacacgaactaccaaacgagctgcccgcgcatctgctccccccctcgaagaggaaggttgctgaatag

SEQ ID NO: 186416 - DNA, 528 bp, Artificial Sequence
  Description of Artificial Sequence: Synthetic coding sequence
atgttcagctggctgggcaccgacgaccggcggcggaaggaccccgaggtgtttcagaccgtgtctgagggcctgaaaaagctgtacaagagcaaacttcttccccttgaagaacactatcggttccacgaatttcattctcctgccctggaggacgcagacttcgataacaagcccatggtgttgctggtagggcaatacagcacaggtaagaccactttcattcggtacttgctggaacaggacttcccaggcatgcgcatcggccccgagcccactaccgattccttcatcgctgttatgcagggggacatggagggtataattccaggcaacgcactagtggtagaccctaaaaagccatttagaaagcttaatgcttttgggaatgcgttcttgaatcgctttgtgtgcgcccagttaccaaatccagtgttggaatctattagcgttattgacacacctggaattctgtccggggagaagcagaggatttcccggggcccggcagccggaccaggtttatag

SEQ ID NO: 186417 - DNA, 4086 bp, Artificial Sequence
  Description of Artificial Sequence: Synthetic coding sequence
atgggcgccgccggccggcaggacttcctgttcaaggccatgctgacgatttcctggcttacactgacctgtttccccggagctacaagcacggtggctgccgggtgccctgaccagtcacctgagcttcagccttggaatccagggcacgatcaggaccatcatgtgcacatcgggcaggggaaaactctcctcctgacttcaagtgcaactgtatattcgattcacataagcgagggagggaaactggttattaaggatcacgacgaacccattgttctgcgtacacgccatatcctaatcgataacgggggtgagctccacgcagggagcgccctgtgcccatttcaggggaacttcactatcattctctatggtagggcggacgaaggcattcagccggatccgtactatggtctcaagtacatcggtgtgggcaaagggggtgctctggagttgcacggtcagaagaagctgagctggacatttctgaacaagaccctgcatccaggtgggatggcagagggaggctattttttcgagcgctcatggggtcacaggggggtgatcgtacacgtaattgaccctaagtccgggacggtgatccactccgatcgctttgacacttatagaagcaagaaggaaagtgagaggttggttcagtatctgaacgccgtccctgatggccggattctgagtgtcgccgtcaacgacgagggttcccgcaatttggacgacatggcccgtaaggcaatgacaaaactgggtagcaaacacttcttacacctgggctttagacacccatggtctttccttaccgtgaaagggaacccttcttcttctgttgaagaccatatcgagtatcacggacaccgaggcagtgccgcggcccgggtttttaagctatttcagaccgaacacggagagtattttaacgtcagtctgtcgtcagagtgggtgcaggatgtggaatggacagaatggtttgaccatgacaaggtctcccagacaaagggtggcgaaaagattagcgacttgtggaaggctcatcccggaaagatatgcaaccggccaatagatatccaggccaccacgatggacggggtcaacctaagcaccgaggtagtgtataagaaaggccaggactaccggtttgcttgttacgatagggggagagcttgtcggtcctaccgagttcgattcctctgcggtaaaccagtgcgcccgaaacttaccgtgaccattgacactaacgtaaattcaaccatcttgaatctcgaggataacgtgcagtcttggaaaccaggagacaccctcgtgatcgcctcaactgactatagcatgtaccaagcggaagagtttcaggtgctgccgtgcaggtcctgcgctcccaatcaggtcaaggttgcagggaagcccatgtatctgcacattggagaggaaatcgatggtgttgacatgcgggctgaagtgggcctgctgagccgcaatattattgtgatgggagagatggaggacaaatgctacccataccggaatcacatttgtaacttcttcgacttcgatacgttcggcggccacattaagttcgcactgggcttcaaggctgcacaccttgaaggcactgagttgaagcatatggggcagcaactcgtggggcaataccctatacactttcatttggcaggcgacgtggacgagagaggaggctacgatccgccaacatatattagggacctatcgatacatcacaccttttctaggtgcgttacggtgcacggtagcaatggccttcttattaaggatgtggtgggctacaacagtctcggccactgcttctttaccgaggatggtcctgaagagcgaaatacgttcgatcactgtttgggcttgctggtcaagtcgggtaccctcctgcccagcgacagagattccaagatgtgcaaaatgattactgaggattcctatcccggctacatccccaaaccaagacaggattgtaatgccgtttccaccttttggatggcaaatcccaacaataatttgattaattgcgccgcagctgggagcgaggagactgggttctggtttatctttcatcacgtgccgactgggccgagtgtggggatgtactctccgggatattccgagcacattccgctgggcaaattttataataatagagcccattctaactatcgggccgggatgattatagataacggtgtcaaaaccactgaggcatccgccaaagacaagaggcccttccttagcatcatctctgcgcggtactccccacatcaagacgccgatccactgaagcccagggagcccgcaatcatacggcactttatcgcatacaagaaccaggaccacggtgcgtggctcagagggggcgacgtgtggctcgattcgtgccgtttcgccgataacgggattggattgacactggcatcagggggtacttttccctatgacgatggatcaaaacaggaaatcaaaaattcactgtttgttggagagtccggtaatgtaggtacagaaatgatggacaatcgaatctgggggcccgggggcctagatcactcaggcaggacactgcctattggccagaactttcccatacgtggaatccaactgtatgatggcccaatcaacattcagaactgcacttttcggaagtttgtggccttggaaggccgacacacctctgccctggccttcaggctgaacaatgcatggcaatcatgtcctcacaataatgtgacaggcatcgcatttgaagatgtgcccatcacctctcgagtatttttcggcgagcccggtccctggttcaaccagttggatatggatggggataagacctccgtcttccatgatgttgacggaagtgtcagcgagtacccgggtagttacttgactaaaaacgacaattggcttgtgcggcatccagactgcatcaacgttccagattggcgcggtgcgatctgtagtggttgctatgcccagatgtacatccaggcatacaagacaagtaacctccgtatgaaaataatcaagaatgacttcccatcccaccccctgtacctggaaggggccctaacccgcagcacccactatcagcagtaccagcctgtcgtgactctccagaagggctatactattcattgggatcagaccgcacctgcagaacttgccatctggctcatcaactttaataagggggattggatccgcgttggactgtgttaccctaggggaaccaccttttccattttgagtgacgtgcacaaccgcctgctcaaacagacctccaagacaggggtgttcgttcgcaccctgcagatggataaagtggagcagtcctatcccggccgaagtcactactattgggatgaagatagtggtttgctctttctcaagctgaaggcccagaacgaacgggaaaagtttgccttttgtagtatgaagggctgcgagcgcattaagataaaagctttgataccgaaaaacgccggggtgtcagattgtacagctacagcttaccccaaatttacagagcgagccgtagtagacgtccccatgcccaaaaaactgttcgggagtcagcttaagacgaaagatcacttcctcgaagtgaagatggagtcatccaaacaacatttttttcacctctggaacgatttcgcttacatcgaggtcgatgggaagaagtatccaagttctgaagacggcattcaagttgtggtgatcgatggaaaccaggggcgggtggtgagccatacctcgtttcgaaattcaattctgcagggcatcccttggcagctgtttaactacgttgcaacgatcccagataacagcatcgtgcttatggctagcaagggccgctacgtctcccgcggtccatggacgcgagttctggaaaaactcggcgcagatcgggggctgaagttgaaagagcagatggctttcgtgggctttaaaggctcttttcggcccatttgggtgaccctcgacactgaagatcacaaggctaagatctttcaggtggtgccaatcccagtcgtgaagaagaaaaaactctag

SEQ ID NO: 186418 - DNA, 1092 bp, Artificial Sequence
  Description of Artificial Sequence: Synthetic coding sequence
atgagcatggacgtgaccttcctgggcaccggcgccgcctacccctcgcccaccaggggggcaagcgccgtcgtactccgctgtgaaggggaatgttggctattcgattgcggcgaagggacacagacacaactgatgaagagtcagctgaaggccggacgcatcacgaaaatcttcatcacacacttgcatggcgaccacttctttggcctgcctgggctgctctgtactatttcgctgcagtctgggtccatggtctccaagcagcctatagaaatatatgggcccgtaggtcttcgggattttatctggcggacaatggaactgagtcacaccgagttagtctttcactacgttgtccacgagctagtgcccacagctgatcagtgccctgcagaagaactgaaagagttcgctcacgtcaacagggccgacagccccccgaaggaagagcaaggacgcacaatcttactggattctgaggaaaattcgtacttgctgttcgacgacgaacagttcgttgtaaaggccttcagactgtttcatagaatcccgagtttcggctttagcgtagttgagaagaaaagaccagggaagttaaatgctcaaaaactgaaggaccttggagtcccccccggccccgcctacggcaaactaaagaatggcattagcgtggtgctggagaacggcgtcactattagcccacaagacgtgctcaagaagcctatcgtgggtaggaagatttgcatcctgggcgattgtagtggtgtggtaggcgacggaggggtcaagctttgttttgaggcagacctgctcattcacgaggctacactagatgacgcccagatggacaaagccaaagaacacgggcatagcactccacaaatggctgccaccttcgctaaactctgccgggcaaaaaggctggtcctaacacatttttcgcaacgttataaacccgtcgcactagcgcgggagggggagaccgacgggatcgccgagctcaagaagcaggctgagtccgtcctggatctgcaggaggtgacacttgctgaagattttatggtcattagcatccctattaagaaatag

SEQ ID NO: 186419 - DNA, 2481 bp, Artificial Sequence
  Description of Artificial Sequence: Synthetic coding sequence
atgtgggccctgtgcagcctgctgcggagcgccgccggccggaccatgtcccagggtcggaccataagccaggcacccgcacggcgagaacgaccccggaaggatcccctccgccatctccgcactcgcgagaaacgcggtccttccgggtgcagcgggggacctaatacggtgtacctccaggtcgtggctgccggaagcagagacagcggggccgctctgtacgtattcagtgaattcaatcgatacctcttcaattgtggcgagggcgtacagcgcctgatgcaggaacataagttgaaagtggcccgactggacaacatcttcctcacaaggatgcattggagtaacgtgggaggcctgtccggcatgatcctcacgttaaaagaaacaggcctccctaaatgcgtcctgagtggtcccccccagctcgagaagtaccttgaagccatcaagattttttcgggccctctgaaaggcattgagttggctgtgaggccccacagcgcaccggagtacgaggatgagacgatgacagtctatcagattccgattcactcagaacagcggcgtggcaaacaccagccatggcagagccccgagaggccactgtcacgcctcagccctgagcgaagctctgacagcgaaagtaatgaaaacgaaccccatctacctcatggtgtgtctcagaggcgcggcgtccgcgacagcagcctggtggtagcttttatctgcaaactacacctcaagagaggaaattttctggtgctcaaggctaaagagatgggtcttccagtaggcacagccgctatcgctcccatcattgcagccgtgaaagacgggaaatccataactcatgaaggcagggaaatcttggccgaagagctgtgcacgccgcccgaccccggggccgcttttgtggtagtggaatgccccgatgagtcgtttatacaaccgatatgcgagaacgcaactttccagcggtatcagggtaaagccgacgctccagtcgcactggtggtacatatggctcctgctagcgtgctcgtcgactcaagataccagcagtggatggaacgatttggccccgacacgcaacacttggtccttaacgaaaattgcgcttccgttcataatttacgttctcacaagatccagacacagctcaatctgatccatccagatatctttccactgctgacttcattccgatgcaagaaggagggccccaccctgtcagtacccatggtgcagggtgagtgcctgttgaagtaccagctccgccctaggagagagtggcaaagggatgcaataatcacatgcaaccccgaggagttcatagtcgaagccctccaattgccaaatttccagcagtcagtgcaagaatacaggcgctccgcccaggacggccccgctcccgccgagaaaagatcccagtatcccgagattatttttcttgggaccggaagcgctattccaatgaaaatccgtaatgtcagcgccacactcgtcaacattagcccggacacatccctcctgctggactgcggcgaggggacttttggccagctctgcagacactatggcgatcaggttgacagagttctgggcaccctggcagcagtgtttgtgagccatctgcatgccgatcaccatactggcttgccctcgatcttattgcaaagagaaagggctcttgcctcgttaggtaagcccctgcatcctctactggtggtggctcccaatcagctgaaagcctggcttcagcagtaccataaccagtgccaagaagtattgcaccacatatcgatgatccctgcgaagtgcctgcaggagggtgcggaaatctcctctccagccgtagagaggctgatctcctctctgctccgaacttgcgacttggaagagttccagacgtgtttagttcggcattgcaagcacgcatttggatgcgcattagttcacaccagcggctggaaagtagtgtactcaggcgataccatgccttgcgaggcactggtgcgcatgggcaaggacgctactctcttaatacatgaggccactctggaggacggacttgaggaagaagccgtcgagaaaacccactcgactaccagccaagccatctcagtcggcatgaggatgaacgcagagtttataatgcttaaccacttttcccagcgatatgctaaagtgcctctgtttagtccaaacttctctgagaaagtgggggtcgcttttgatcacatgaaagtgtgcttcggagatttcccgaccatgcctaagctcatcccgcccctgaaggcactcttcgcaggggacatagaggagatggaggaacgccgtgaaaagcgggagctgaggcaagtgagagctgccttgttgtccagagaattagccggtggcctggaggatggtgaaccccagcagaagcgcgctcacacggaggagcctcaggcgaagaaggtgcgggcacagtag

SEQ ID NO: 186420 - DNA, 2424 bp, Artificial Sequence
  Description of Artificial Sequence: Synthetic coding sequence
atgtgggccctgtgcagcctgctgcggagcgccgccggccggaccatgagccagggacggacaatctcacaggctcccgccaggcgcgaacgaccgcgcaaggatcccctacgccatttaagaaccagagagaagcgcggccccagcggctgctctggcggacctaacacagtgtatctgcaagtggtggcggccggcagtagagactcaggagtccagagattgatgcaagagcacaaacttaaagtagcaagactagacaatattttcctcactagaatgcattggtctaacgtggggggtctcagcggcatgatcctgactctcaaggaaactggcctccccaagtgcgtcctgtccggccccccgcagctagaaaaatatctggaagcaataaagatcttcagcggaccacttaaaggcatcgagcttgccgtgcgccctcacagcgcaccagagtacgaagacgagaccatgacggtatatcagatacccatccattccgagcaacggagaggcaagcatcaaccctggcagagtccagaacgccctctctccagactgagccctgagaggagttccgactctgagagcaatgaaaatgaaccccacctgccccacggcgtgtcgcagcggcggggagtaagagattcctctctcgtcgtggccttcatatgtaagcttcacctaaagaggggcaatttcttggtgctcaaggcgaaggagatgggtctgccagtgggtaccgctgcgatcgctccaatcatagccgctgtgaaggacgggaaaagcatcacccacgagggcagggagatcctggctgaggagctttgcactcctccagatcccggagctgcctttgtcgtcgtcgagtgtcctgatgagtcttttatccagccaatttgcgaaaacgccacattccagcgctaccaggggaaggccgatgcaccagtggccttggtcgtgcatatggctcccgcttccgtcctcgtcgacagcaggtaccagcagtggatggagcgatttggacctgacacacagcatttagtgctgaatgagaattgcgcctcggttcacaatttgcggagtcataagattcaaacccaactgaatctcatccacccagatattttcccactgctgactagtttccgatgtaaaaaagaaggcccaacgctgtccgtgccaatggtgcagggggaatgtctactcaaatatcagttgagaccccgccgcgagtggcagagagatgctatcatcacttgcaacccagaggagtttatcgtcgaagccctccaactccctaattttcaacagtccgtacaggaatacagacggtctgctcaggacgggcccgctcccgcagaaaagcggagtcagtacccagaaataatttttctgggaactggctctgcaattccaatgaaaatccgtaatgtgagcgctactttggtgaacatttctccagatacctcactgttgctggattgtggtgaggggacctttgggcagctttgtaggcattacggcgatcaggtggaccgggtgttggggacgctggctgcagtgttcgttagccatcttcacgcagaccatcatactgggctgcccagcatcctgttacagagggaacgggctttggccagcttaggaaaacccctgcacccactcctggtggtcgcccctaatcagttaaaggcttggctgcaacagtatcacaaccagtgccaggaggtactgcatcatattagcatgatcccggccaagtgcctgcaagaaggggcggagatctcttctcccgcagtcgaacgacttatcagcagtctactacgaacatgcgatcttgaagagtttcagacgtgccttgttcgacattgtaaacacgcctttggctgtgcattagtgcacacctccggttggaaggttgtttatagcggcgatacaatgccctgcgaggctctcgtgcggatgggaaaagatgcaaccttgttaatacatgaagcgaccctggaggacggactcgaagaggaggcagtggaaaagacccactctactaccagccaggctattagcgttggaatgcgaatgaatgcagagtttatcatgcttaaccatttctctcagcgctacgccaaggtgccactgttcagccctaatttctccgaaaaagttggagtggcctttgatcacatgaaagtgtgcttcggcgactttcctacgatgcccaagctcattcctcctctgaaggccctgttcgccggcgacatcgaggagatggaagaacgacgcgagaaacgagagctgcgccaggttagagccgctctgcttagcagggagctagccggtgggttggaagatggcgagccccaacagaaaagagctcacactgaggagcctcaagcaaaaaaagtgcgagctcagtag

SEQ ID NO: 186421 - DNA, 2361 bp, Artificial Sequence
  Description of Artificial Sequence: Synthetic coding sequence
atgtgggccctgtgcagcctgctgcggagcgccgccggccggaccatgagtcagggtagaacgataagccaagctccagcgaggcgcgagaggcctcgcaaggatcctttgagacatctgcggactcgcgagaagcgtggcccgtctggttgttcaggtggccctaacactgtttacctccaagttgttgctgcaggctctagggatagcggagctgctttatatgtgttcagcgaattcaacaggtatctttttaattgcggcgagggcgtgcagaggctcatgcaagaacataaattaaaagtggccagactggataatattttcctgacccgcatgcattggagcaatgtgggtggcctgagcgggatgattctgaccttgaaggaaaccgggttgcccaagtgcgtgctgtcagggcctccccagctcgaaaagtatctggaggctattaaaatcttctctggtcccttgaaaggcatcgagctagccgttcgtccccattcagccccagagtatgaagacgagacaatgacagtgtaccagataccaatccactccgtcagtcagagaaggggcgtaagggatagcagtctggtggtggcttttatatgcaaactgcatctgaaacgcggcaacttccttgtgcttaaggcgaaggagatggggcttcccgtcgggacagccgccattgcgcccataatcgccgcagtcaaggacggcaagtctatcacccatgaaggcagagaaatactagcggaggagctgtgcacacccccagaccccggagctgcattcgtcgtggtggagtgccctgacgaatccttcatacagccaatctgtgagaatgccacatttcagcgctatcagggaaaagcagacgcccccgttgcgctcgtcgttcatatggcccccgcttctgtcctggtggattctcggtaccagcaatggatggaacgattcggacccgacacgcagcatctggtacttaacgagaactgcgctagtgtgcataacctccggagccataaaatacagacccagttaaatctgattcacccggacatcttccccctgttgaccagctttcggtgcaaaaaagaggggccaacactgagcgtcccaatggtgcagggcgagtgtctcctcaagtaccaactccggcctaggcgcgagtggcagagggacgcaattattacctgtaacccagaagaattcatcgtagaagctttgcagctgccaaactttcagcagagcgtacaggagtaccgccgctcggctcaagacggaccagcccctgccgaaaaacggtctcagtaccccgaaattatatttctgggtactggctccgccatacccatgaaaattcggaacgttagcgctaccctcgtgaacatcagcccagacacttctttgctgttggactgtggggaagggacgttcggccaactatgcagacactatggggaccaggtcgacagagttctgggcacacttgccgccgttttcgtttcccatctgcacgcagatcaccacacgggacttcccagtatcctgttgcagagagaacgggcactggctagcctggggaaaccattgcatccccttctagtggtggcacctaatcagttaaaggcctggctgcaacagtatcacaatcagtgtcaagaagtgctgcaccatatctccatgatcccagcaaaatgtttgcaggagggagccgagatcagttcgccagccgtcgaacgcctaatttcttctctgctccggacatgtgatctggaggagtttcagacctgcctggttcgccattgcaagcacgccttcgggtgcgccttggtccacacaagtgggtggaaggtggtgtactccggcgatacaatgccctgtgaagccctagtccggatgggtaaagatgctacactactgatccatgaggctacgttggaagacggtttggaagaggaggccgttgagaaaactcatagcaccacatcgcaagctatatccgtgggaatgcgcatgaatgccgagttcattatgctgaaccacttctcccagcgctacgcaaaagtacccctgttctcccctaatttctcagagaaggtcggggttgctttcgaccacatgaaggtctgctttggggacttccctaccatgcccaaactcataccacctctgaaggccctttttgccggcgacatagaagaaatggaagagcgacgcgaaaagcgcgagctcaggcaggtgcgcgccgcattgttgagtagagaacttgcaggaggattagaagacggagagccccaacagaagcgagcccacactgaggaaccgcaagctaaaaaggtcagggcacagtag

SEQ ID NO: 186422 - DNA, 861 bp, Artificial Sequence
  Description of Artificial Sequence: Synthetic coding sequence
tgaccccacggcgtgagccagcggcggggcgtgcgggacagcagcttggtggtggcattcatttgtaaactccacctgaagcgcggtaatttcctcgtgctgaaagcaaaggaaatgggcctgcccgtcggaactgccgccatagccccaatcatcgccgccgtcaaagatgggaaatcaatcactcacgaaggccgcgaggtgctgcaaattctcgccgaggaattgtgcacccctcctgaccctggggctgcatttgttgtcgtcgagtgtccggatgaaagctttatacaacccatctgtgagaacgccaccttccagcggtaccaaggcaaagccgatgctcccgtcgctctcgtcgtccatatggcccctgcatccgtgctcgtggactccagataccaacagtggatggaaagatttggaccggacacccagcacctggtgcttaatgagaattgcgcctcagttcacaacttgcgcagtcacaaaatacagacacagttgaacctgatacatccagacatatttcctttgctaacctccttccgctgcaagaaggagggccccaccttgtccgtgcctatggtgcaaggggagtgtctgctgaaatatcaactgcggcccagacgggagtggcagagagatgccattatcacttgtaaccccgaggagttcattgtggaggcactccaactccctaacttccaacaaagcgtccaggagtacaggcggagtgctcaggacggccccgcgccagccgaaaagcgatcacagtacccagaaatcatcttcctcggcacaggctctgcgatccccatgaaaatccggaatgtgtcagcgaccctcgtaaacatatag

SEQ ID NO: 186423 - DNA, 837 bp, Artificial Sequence
  Description of Artificial Sequence: Synthetic coding sequence
atcctggccgaggagctgtgcaccccccccgaccccggcgccgccttcgtggtagtggaatgccctgatgaatcattcattcagcctatttgtgagaacgccacatttcaacgctttggtccagacacgcagcacctggttctcaatgaaaattgcgcatccgtccataacctccgctcccacaaaatccagactcagctcaacctaattcatccagatatcttccccctattgacaagctttcggtgtaaaaaagaggggcccaccctctcagtccccatggtacagggagagtgtttgcttaagtatcagttgagaccaaggagagaatggcagcgcgatgcaattataacgtgtaatcctgaagagtttatcgtggaggcgctccagctgcccaacttccagcagtctgttcaagagtatcgcagaagcgctcaggatggcccagcccccgcggaaaagcggtcccaataccccgagattatctttctgggaacaggaagtgccatccccatgaagattagaaacgttagcgccactctcgtcaacattagccctgatacctcactgttgctggactgcggggagggaactttcgggcagttgtgccggcattacggcgatcaggttgatcgcgtgttggggacgctcgcggccgtgttcgtcagtcacctgcacgccgaccaccacactggactcccatcaattctgctccagcgtgagcgcgccctggccagtctgggcaagcctctgcatcccctacttgttgtggcccccaatcagcttaaagcatggttgcagcagtatcacaaccaatgtcaagaggtgctgcattag

SEQ ID NO: 186424 - DNA, 804 bp, Artificial Sequence
  Description of Artificial Sequence: Synthetic coding sequence
atgaccctgggccggcggctggcctgcctgttcctggcctgcgtgctccccgccctgctgctcggcgggactgcattggcgtcggaaattgtgggtggacggagagcacggccccacgcctggccatttatggtctcgctccagctaagaggcgggcacttctgcggcgcaactttgattgccccaaatttcgttatgtctgccgcacactgtgtggcaaatgtgaacgtccgcgcagtgagggttgtcctgggggcccacaatttgtctagacgcgaacccacaaggcaggtcttcgccgtgcaaaggattttcgaaaatgggtacgaccctgtaaatcttcttaacgacattgtcattttgcagctgaacggctcagccaccattaatgcgaatgtccaggtcgcgcaactgcccgctcaggggaggcgtttaggaaatggggtgcagtgcctcgccatgggttggggcctgctggggaggaataggggtatcgcctctgttttgcaggagctgaatgttaccgtggtgactagtctctgcagaaggagtaatgtgtgtaccctggttcgcggacgacaagccggcgtgtgttttggtgacagcgggtctccacttgtttgcaatggtctcatccacggcatcgcctctttcgtacgaggcgggtgcgcaagcgggctttatcccgacgccttcgctccggtggcccagttcgttaattggatagacagtatcattcagcgtagtgaagataacccatgtccccacccacgagatcccgaccccgcctcacggacacactag

SEQ ID NO: 186425 - DNA, 804 bp, Artificial Sequence
  Description of Artificial Sequence: Synthetic coding sequence
atgaccctgggccggcggctggcctgcctgttcctggcctgcgtgctgcctgcactgctgttgggaggaactgcgctagcctctgagatcgttggggggcgacgcgccagaccacacgcatggccattcatggtgtctctgcagctgcgggggggacatttttgcggtgccaccctgatagcgcctaactttgtgatgtctgcagcgcactgcgtggctaatgttaatgtgagggcagtaagagtggtgctgggcgctcataacctgtcacggcgagagcccacaagacaggtttttgcagtgcagagaatcttcgagaatgggtatgatcctgttaatctcctgaatgacattgtcattctccagctgaatggatccgccaccattaatgcaaatgttcaagtcgctcagctgcctgcccagggacgccgcctcggcaacggcgtccaatgcttggcaatgggctggggtctgctcgggcggaatcgggggatagcatcagtgctgcaggagttaaacgtcaccgtagtcacatctttatgcagacggagtaatgtgtgcaccctcgtgcgcggcagacaagctggtgtctgctttggagattccggcagccctctcgtctgcaatggtttgatacatgggatcgcctcattcgtgagggggggttgtgcctcaggcttgtatccagacgctttcgcccccgtggcacagttcgtgaattggatcgacagtattatccagaggagtgaagacaacccttgcccccacccccgagaccccgatcccgcgtcacgaactcactag

SEQ ID NO: 186426 - DNA, 3051 bp, Artificial Sequence
  Description of Artificial Sequence: Synthetic coding sequence
atggccccccggaccctgtggagctgctacctgtgctgcctgctgaccgctgcagctggcgccgccagctatcccccgcgaggcttcagtctgtatacagggagtagcggagcactgagtccggggggccctcaggctcagattgccccacggcctgcatcgaggcacaggaactggtgcgcctatgttgtaacgcggaccgtgtcatgtgtgttggaggacggggttgaaacatatgttaagtaccagccttgtgcctggggccaaccacagtgcccccagtccatcatgtaccgccgttttctgcggccccgataccgggtggcttataaaacagtcactgacatggagtggaggtgttgtcaaggctatgggggcgatgattgcgctgaatcaccggccccagcgctaggtcctgcttcctcaacgcccaggcccctggctcagcccgcccggcccaacctcagcggaagttcggcgggttccccacttagcggcttgggtggggagggcccgggagaaagcgagaaagttcagcagttagaggagcaagtgcaatcactaacgaaagagttgcaggggctccggggcgtccttcaggggctgagtggccggttagctgaggatgtgcagcgcgctgtcgaaacagcctttaacgggcgccaacagcctgctgacgcagcggcccgccctggggtacacgagactcttaatgagatccagcaccagctgcagcttttggatacgcgtgtgtcgacccacgatcaggagctcggacatttgaacaatcatcacggtggttcctcttccagcggtggctcccgagcacctgcaccagcctccgcaccgcccgggccatccgaggaattattgcggcagctggagcagagattgcaggaaagttgctcagtgtgcttagcgggcctcgacgggttccgccggcagcagcaggaggaccgcgagcgcctgcgcgccatggaaaaactgctggcttcagtcgaggagaggcagagacatctcgctgggctggctgtaggacgaagacccccacaggagtgttgcagccccgaacttggtcgcagacttgcagagctcgaacgcagactcgacgtggtggcgggttctgtaacggttctgtccggacgcaggggtaccgagctcggcggggccgccggtcagggggggcaccctcccggctacactagtctggcatccagactctcccgtcttgaggatcggttcaattccactcttggcccatcagaggagcaggaagaaagttggcccggcgctccgggaggactctctcactggttacccgcagcgcgtgggaggttggagcaactaggcggcctcctggcgaacgtcagcggcgagctgggcggcaggctcgatctgctggaagagcaagtcgccggggctatgcaggcctgcggccaactttgttccggcgcacccggggagcaggacagtcaggtgagcgaaatcctgtcggcgcttgagcggcgggtcctagattctgagggacaattgcgcctcgtgggcagtggcctgcacacggtggaggctgcgggggaggcccggcaagccacactcgaggggctgcaagaggtggtgggaaggctgcaggacagggtggacgcccaggacgagaccgccgcagagtttacactgcggctcaaccttaccgcagcacggcttggccaactcgagggcctgctgcaggcccacggcgacgaaggctgcggggcatgcggaggagtacaagaagagctcggccgcctgcgcgacggggtcgaacgctgttcatgcccccttctccccccaagggggcctggcgcgggaccgggagtgggtggcccgagccgcgggcccttggacggattctctgtgttcggcggatcatcaggtagtgccctccaggctctccagggagaactctccgaagtcatcctgtcatttagttccctgaatgattctttgaatgaactccaaaccactgtggagggacaaggagctgatctcgcggatcttggggccaccaaggatcgcataatttcggagattaatagactgcagcaggaggccacggagcatgccaccgagagtgaagaacgattcagaggactagaggaagggcaagcccaggcaggacaatgtccttccttggagggacgtctgggccgcctcgaaggagtgtgcgaacgtctggacaccgtcgctggtggcctccagggcctgcgggaaggcctcagccggcatgttgccggtttatgggctgggctccgcgagaccaacacaacgagtcaaatgcaagcagcgctcctggagaagctggtcggcggacaggccgggttggggcgcaggctaggggccttgaactcgtccctgcagctcctagaggacagacttcaccagctttccctaaaggatcttactggaccagccggtgaggccggtcctccagggcccccgggcctgcagggcccgcccggcccagcaggccccccagggagccctggaaaggacggacaggagggtccaattggcccccctggtccgcaaggagagcagggtgtggaaggagcccccgctgcacctgtaccacaagtggcgttttcagccgccctgagtcttccacggagcgaaccgggaaccgtgcctttcgatcgagttcttctaaatgacggcggatattatgacccagaaaccggagttttcaccgcacccctggcaggacgctaccttctgagcgccgttctaacgggacacaggcacgagaaggtggaggcggtcctgagccggagtaaccagggggtagcaagggtcgactctggaggctatgagccagaaggcctggagaacaaaccagttgctgaatcccagccaagccccgggaccctcggtgtattttcgttgatcctgccattgcaggcaggcgacacggtgtgcgtggacctcgttatggggcagctagcccactccgaggaacccttgactattttttctggcgctctcttgtacggcgacccagagcttgaacatgcctag

SEQ ID NO: 186427 - DNA, 1044 bp, Artificial Sequence
  Description of Artificial Sequence: Synthetic coding sequence
atggccgacctgggcgccaccaaggaccggatcatcagcgagatcaatcgactgcagcaggaggccaccgaacacgccacggaaagtgaagaaaggtttcgcggactggaggaaggccaggcccaggccggccaatgccccagccttgaaggccgcctgggacgactggaaggggtgtgtgagcgccttgacactgttgctggcggcctgcaaggcctgcgcgaaggtctttccaggcatgttgctgggctgtgggctgggctgcgcgaaactaataccacttcgcagatgcaagcagccctcctggaaaagttggtaggtggtcaagcaggtctcggacggcggctgggagcccttaactcctcactgcaacttttagaggaccgtctccatcagctgagtttgaaagacttgaccggcgagggcacgaaggggccagctggcgaagcgggacccccaggtccccctggcttacaaggtccccccggcccagccggaccgcccggcagcccaggtaaggacggtcaagaaggccctataggccccccaggcccccaaggtgaacagggggtggaaggagcgccggcggctcctgtgccccaggttgcatttagcgccgcactgagtctgccgcggtccgagcccgggaccgtaccttttgatcgagtcctgctaaacgatggaggttactatgatcctgaaacaggcgtctttacggctcctttggctgggcggtacctccttagcgctgtgctgacaggacaccggcatgagaaagtggaggcagtactctcccggtctaaccagggcgttgcccgagttgattccgggggttacgaacctgaaggcttagagaacaagcccgtggcagaatcacagcccagtcctggaacacttggcgtcttctctctgatccttccccttcaggccggagatacagtatgcgtggatttggtcatgggacagctggcacactcagaagaaccgttaacaatcttctctggcgccttactttacggagacccagaactcgagcatgcttag

SEQ ID NO: 186428 - DNA, 1062 bp, Artificial Sequence
  Description of Artificial Sequence: Synthetic coding sequence
atgggcagcggcggccggagcgcccaggtgagcaccggccagcgggcctggctcctgccatgtagattcctcaaaaacaccatgagtaacgggtatgaagatcacatggcagaggactgcaggggagacattggtagaacaaacctgatcgtcaactatctgccacagaacatgacacaagacgaactgcgcagcctcttctctagcattggtgaggtggagtctgccaagctgattagagataaagtcgccggccactctctcggctatggatttgttaactatgtgacagcgaaagatgccgagcgagccatcaacactcttaacggcctgcggctgcagtccaagaccataaaggtatcctacgctaggcccagcagcgaggtcataaaagacgccaatctgtatatttcaggactaccaagaactatgactcagaaagacgtggaggacatgttctcacgcttcggaagaatcattaatagtagggtgcttgttgatcagaccaccgggctcagcagaggggtggcctttatacgctttgacaagagatctgaagccgaggaggctattactagttttaacggacacaaacctcctgggtccagcgagcctataacggttaagttcgcggcgaaccctaaccagaataagaacgtagcattgctatcccagttatatcacagccccgcccgtaggtttgggggacccgttcaccaccaggcccagaggttcagattcagtcccatgggcgtcgatcatatgtctgggctgtccggcgttaacgttcccggtaatgcttcatctggctggtgcatcttcatctataacttaggccaagatgctgatgagggaatcctgtggcagatgttcggccccttcggagccgtgaccaatgtcaaagtcatccgcgattttaacacaaataaatgcaaaggatttgggttcgtgaccatgacaaattatgaggaggcagctatggccatcgcatctctgaacgggtaccgactgggcgataagatcctccaagtatcttttaagactaataagagccataagtag

SEQ ID NO: 186429 - DNA, 981 bp, Artificial Sequence
  Description of Artificial Sequence: Synthetic coding sequence
atgagcaacggctacgaggaccacatggccgaggactgccggggcgacattggcaggactaatctgatagtgaactatctgccccaaaacatgacacaagacgaactgaggagcttattcagtagtatcggggaagtcgagagcgccaagctcatacgcgacaaggtcgctggccatagcctgggctatggctttgtcaattacgtgaccgccaaggacgccgagagggctatcaataccctgaacgggctgaggctccagagtaaaacgataaaagtgtcatacgcaaggcctagttccgaggtcattaaggatgctaacctgtacattagcggcttgccacgtacaatgactcaaaaagacgtcgaggacatgttctcccggttcgggcggattattaatagccgagttttggttgaccagacgaccggcctttcacgcggagtagcttttatacggtttgacaaacggtcagaggccgaagaagccattacaagcttcaacggacataagccaccaggtagttctgaacccattactgtgaagtttgctgccaaccctaaccagaacaaaaatgtggcactcctgagccagctgtatcacagcccagcgagacggttcggcggaccagtgcaccatcaggcacagcgcttcaggttttctcccatgggagttgaccacatgagtgggctgtccggcgtgaatgttcccggcaacgcgagctccggctggtgcatcttcatctacaatttgggccaagatgctgacgaaggcattctgtggcagatgttcggcccttttggagccgtgaccaacgttaaagtgattagagactttaatactaataaatgtaaaggattcgggtttgttacaatgacgaattatgaggaggccgccatggcaattgcctccttgaacggctacagactgggcgacaagatacttcaggttagcttcaagaccaataaatcccataaatag

SEQ ID NO: 186430 - DNA, 828 bp, Artificial Sequence
  Description of Artificial Sequence: Synthetic coding sequence
atgagcagcctgcacaagagccggatcgccgacttccaggacgtgctgaaagagccgagtattgcactcgagaagctcagagagctcagtttctccgggataccctgcgaggggggcctgaggtgtttgtgctggaagatccttctcaactaccttcccctggaacgagcatcatggacatccattctcgcgaagcagagggaactatacgcacaattcctcagagaaatgatcattcagcctggcatcgccaaagccaatatgggggtttctagggaagatgtgactttcgaagaccatcctttaaatcccaaccccgattcgaggtggaatacctattttaaggacaacgaggtccttctgcagattgacaaggatgtaagacgcctctgtcccgatatctccttttttcagcgtgctaccgactatccatgtcttcttatactcgatccacaaaacgaatttgagacactgaggaagcgcgtcgagcaaacgacacttaaatcacagactgtagcacggaaccgcagtggagtgacgaaccaggaacagaatattaaaccacagtttttcgctttccgctggcttaccttgctcctgtctcaggaattcctgttgcctgatgtcatcaggatctgggactcactcttcgctgacgataataggttcgattttctcttactggtttgctgtgccatgttgatgctgattcgggagcaactgctcgaaggagactttaccgtgaacatgaggctgcttcaggactaccccataaccgacgtttgtcagatacttcagaaggcaaaagaactgcaggatagtaaatag

SEQ ID NO: 186431 - DNA, 1164 bp, Artificial Sequence
  Description of Artificial Sequence: Synthetic coding sequence
atggccgtgcggctgtgcgacgtggccagcctgctgcggagcggctcatgggctgccgagccatggacaggagtcatagccgccatggaaactcaactaagcaacggtccaacgtgcaataatacagccaacggaccgactacgattaacaacaattgcagttctccggtggacagtgggaacacagaggacagcaagactaatctgatcgtcaactatttaccccaaaatatgacccaggaagaattgaagtccttgttcggcagcatcggcgaaattgagagctgcaaattggtgcgggacaagatcactggacagagcctggggtacggattcgttaactacatagaccccaaggacgcggagaaggctatcaacaccctgaacggcctccgcctccagacgaagactatcaaggtctcctacgcccgtccctcttctgcatcaatccgggatgcaaatctgtacgtgagtggactgcctaagaccatgacccagaaggagctcgaacaactgttcagtcaatatggccggatcattacatcacgcattttagtagaccaagtaactggcatatcacgtggcgtaggattcattagattcgacaagcgcatcgaagccgaggaggcgattaaaggtctgaatggtcagaaaccacctggcgcgactgaaccgataacagtaaagttcgcaaacaaccccagtcagaaaactaaccaggccattttgagtcagctgtatcagagcccaaataggcgctatccgggccccttagcgcagcaggcacagcgcttcaggctggataacttgcttaacatggcttacggtgtaaaacgtttctctccaatgactatcgatggtatgacttccctcgccggcatcaatatccccggccatccagggaccgggtggtgcatcttcgtgtataacctagcccccgacgctgatgagtcgattctatggcaaatgtttgggcccttcggggcagttacgaatgtgaaggttatccgagacttcaacacaaataagtgtaaaggtttcgggttcgttacaatgactaattacgatgaagctgctatggctattgcttccctgaatggctacaggttgggcgaccgcgtgcttcaggtgtctttcaagacaaacaagacgcacaaagcctag

SEQ ID NO: 186432 - DNA, 1041 bp, Artificial Sequence
  Description of Artificial Sequence: Synthetic coding sequence
atggagacccagctgagcaacggccccacctgcaacaacaccgccaatggacccactacaattaacaataactgttctagcccagtcgatagcgggaataccgaagacagtaagactaatttaatcgtgaattacttgccacagaacatgacgcaggaggagctcaagagcttgttcggctctatcggcgaaatcgaaagctgcaaattggtgagagacaaaataacaggccaaagcctgggatacggctttgtgaattacatcgatccaaaggacgccgagaaagccatcaacactttgaatggcctacggctccaaacgaagacgataaaagtctcttatgccaggcctagcagcgcatctattcgggatgccaatctgtacgtgtctggcttaccgaagaccatgactcagaaagagctagaacaactcttttctcaatacggcagaatcattactagccgcattctcgtggatcaggtgaccggaattagcaggggcgtggggttcattaggttcgacaagcgcatcgaagccgaggaggccattaaggggctgaatggacagaaaccccccggtgccactgaacccatcactgtcaaattcgctaacaacccctctcagaagacaaaccaagcgatcctgagccaactgtatcaatctcctaataggcgatatcccggacctcttgcacagcaggctcagcgcttcaggttcagtcccatgaccatagacggaatgacatccctggctggcataaatatcccagggcaccctggtacggggtggtgcatttttgtgtacaatctggccccagacgctgacgagagtatactgtggcaaatgtttggaccctttggggccgtcaccaatgtgaaggtgatccgagacttcaacaccaacaagtgcaaaggcttcggattcgtcactatgacaaactatgatgaagcagctatggccatcgcctcactaaatgggtatcggctgggtgacagggtgctacaggtgagctttaaaacaaataagacgcacaaggcctag

SEQ ID NO: 186433 - DNA, 1080 bp, Artificial Sequence
  Description of Artificial Sequence: Synthetic coding sequence
atggagacccagctgagcaacggccccacctgcaacaacaccgccaacggacccactacaatcaacaataattgttcatcacccgttgattctggcaacacggaggacagtaaaaccaatctcattgtgaactatctacctcagaatatgactcaggaggagctaaagtccctatttggctctattggggagattgagtcttgcaagctcgtgagggacaagataacagggcaaagtctgggttatggcttcgtgaactacattgaccccaaggatgccgaaaaggccatcaatactctgaacgggctgaggctgcagacaaaaacaatcaaggttagttacgcacggccctcctcagcgtccatccgagacgcaaacctgtacgtttccggactaccgaagaccatgacacaaaaggaactggaacagctgttttctcagtacggcaggatcatcacgtctcggattctggtggaccaggtgaccgggatttcccgcggggtggggtttattcgatttgacaagaggatcgaagccgaagaggctataaaaggcctcaacggccaaaaacctccaggagcaaccgaaccaatcaccgtgaagtttgcaaataacccatctcagaagaccaaccaagcaatcctttcacagttatatcaatcacccaaccgcaggtaccccggcccacttgctcagcaggcacagagattccgtttagataacctgctgaatatggcttacggtgttaaacgattttcaccgatgactatcgacggcatgacttcacttgcaggaatcaatatcccaggacacccaggcacggggtggtgcattttcgtctataacttagcacccgacgctgacgagtctattctttggcagatgttcggtccctttggggctgtgacgaacgtaaaggtcattcgggatttcaataccaacaaatgcaaggggttcggctttgtgacaatgacgaattatgatgaggctgccatggccattgcttcgctgaacggctacagactgggcgatagagtactacaggtctctttcaaaactaataaaacccacaaagcttag

SEQ ID NO: 186434 - DNA, 1080 bp, Artificial Sequence
  Description of Artificial Sequence: Synthetic coding sequence
atggagacccagctgagcaacggccccacctgcaacaacaccgccaatggtccgaccacaatcaataacaattgctcttcacccgtagactctggcaatacggaggactctaagaccaatctcatcgtgaactaccttccacaaaacatgacgcaggaggagctcaagagcctgttcggttctattggggaaattgagtcttgtaagttggtgcgagataagattacgggccaatctctgggctatggcttcgtaaattacatagaccctaaagatgccgagaaggctatcaataccctcaatggtctcaggttacaaacaaaaactattaaggttagctatgcacggccaagctccgctagcatcagagacgcaaatttatatgtatctggactgcctaagactatgacacaaaaagagctcgaacagctcttttcacagtatggacggatcataacctcgcgaatactggtagatcaggtcaccggtatttccaggggcgtgggcttcattaggtttgacaaacggatagaagcagaagaggccatcaagggtctgaatggtcagaagccaccaggtgcaactgagccaattacagtgaagtttgccaacaaccctagtcagaagactaaccaggccatcctgtctcaattatatcagtccccaaatcgaaggtacccggggccactggcacaacaggctcagagatttaggcttgacaatctcctgaatatggcatatggggtaaaaaggttcagcccaatgacaattgacggcatgacgtctcttgcaggcatcaacattcctgggcaccctggcaccggttggtgcattttcgtgtacaacctggccccggatgctgacgaatccattttatggcagatgtttgggcctttcggcgctgtgaccaacgttaaggtgatccgagacttcaacacaaacaagtgcaagggctttggattcgttacgatgactaactacgatgaggctgccatggccatcgcgtctctgaacggataccgtctgggcgaccgtgtgctgcaggtgtcctttaagaccaataaaacgcataaggcttag

SEQ ID NO: 186435 - DNA, 273 bp, Artificial Sequence
  Description of Artificial Sequence: Synthetic coding sequence
atgacccagaaggagctggagcagctgttcagccagtacggccggatcattactagtaggattcttgtggaccaagtgacagggataagtaggggggtgggcttcatcagattcgataagcgtattgaggccgaagaggccatcaagggactcaatgggcagaaacctcccggagccactgaacctattaccgtcaagttcgccaacaatccctcacagaagaccaatcaggcaatcctcagccagctatatcagtcacccaacagacggtag

SEQ ID NO: 186436 - DNA, 570 bp, Artificial Sequence
  Description of Artificial Sequence: Synthetic coding sequence
atggagacccagctgagcaacggccccacctgcaacaacaccgccaacggcccaactactattaacaacaattgctcatctccagttgacagcggcaacaccgaggacagtaagaccaaccttatcgtgaactatctgcctcagaatatgacgcaggaggagctgaaaagcttgtttggcagcataggcgaaatagagtcttgcaagctagttcgtgacaagatcacggggcaatctctggggtacgggtttgtgaattacatcgaccccaaggatgccgaaaaggccataaatactctgaacggtttacggctgcaaactaaaactatcaaagtaagttacgcgcgacccagcagcgctagcatacgagatgcaaacttgtacgtctccggattaccaaagaccatgacccagaaagaactggagcaactgtttagtcaatatggacggattattacatctcgtatcttagttgatcaggtcaccgggatctcccgcggtgttggatttattaggtttgacaagaggattgaggcggaggaggccatcaagggattgaatggacagtag

SEQ ID NO: 186437 - DNA, 1080 bp, Artificial Sequence
  Description of Artificial Sequence: Synthetic coding sequence
atggagacccagctgagcaacggccccacctgcaacaacaccgccaacggacctacaacaatcaacaataattgttcatcccccgtcgattccggtaacacagaggactctaagactaatctgattgtgaattacctcccacagaatatgacccaggaagagctgaagagtctctttgggtccattggtgagatcgagagctgcaagctcgtccgcgataaaatcaccgggcagagcctggggtacggctttgtgaattatatagatcctaaagatgccgagaaggccattaacaccctgaacggcttgagacttcagacaaaaacgataaaggtgtcatatgcaaggccatcttctgcatcaattagggatgctaatctgtacgtgtcaggccttcctaaaactatgacccaaaaggagttggaacagttgttttctcagtacgggcgcatcatcaccagccgcattttagtagatcaagtgactgggatctcacgtggagttggattcataagatttgacaaaagaatcgaagctgaagaagctatcaagggactgaacggccagaagccccccggggccaccgagcccatcacagtgaaatttgccaacaatccctcccagaagacaaaccaggccatcctgtctcagctctatcagtcccctaaccgccgctacccgggacctttagctcaacaagcccagaggtttaggctcgacaacctgttgaatatggcatatggagtcaagaggttttctcccatgacaatagatgggatgacctctttggccgggataaatatacctggtcaccccggcaccggatggtgtatattcgtgtataacctggcaccagatgctgacgagagtatcctttggcagatgttcggacccttcggggcggttaccaacgtaaaggttattagagattttaacacaaataaatgtaagggcttcggctttgtgactatgactaattacgacgaggcggccatggctatcgcatcactgaacgggtatcggttgggagatagggtactgcaggtgtcattcaagactaataagactcacaaggcctag

SEQ ID NO: 186438 - DNA, 1104 bp, Artificial Sequence
  Description of Artificial Sequence: Synthetic coding sequence
atggtgacccagatcctgggcgccatggagagccaggtgggcggcggccctgccggtccagcgcttcctaacggacccctgctcggtactaacggtgcaactgacgattccaagacaaacctaatagtcaactatctgcctcagaatatgacacaggacgaatttaagagcttgtttggcagtattggagacatagaatcctgcaagcttgtgagagacaagattaccggccagtctctcggctatggttttgttaattactcggatcctaatgacgcagacaaagccataaataccctgaatggtctaaaattgcagactaaaacaataaaggtcagttacgcacgcccgagctctgcctccatacgcgatgctaacttatacgtcagcgggctcccaaaaacaatgagtcaaaaagagatggagcagctgttcagtcagtacgggcgcatcataacctcacgcatcctcgtagatcaagtcactggggtctcccgtggagtggggttcatacgcttcgacaagagaatcgaggccgaggaagcgatcaaggggttaaacgggcagaagccgttaggagcagcggaacccatcaccgtcaagttcgctaataaccctagccaaaagaccggccaggccctcctgacacatttgtatcaatcttcagcccggcgctacgctgggccattgcatcaccagacgcagaggtttcgccttgacaacttgctcaacatggcatacggcgtaaagtctcccctgtccttaatcgcaagattcagtcccatcgccattgatggcatgtcaggtttggccggcgtcggtctttccgggggggccgctggggcaggttggtgcatcttcgtatacaatttgagcccagaagctgacgagtctgtactctggcagctatttggaccctttggcgcagtgacaaacgtaaaagtcattcgggatttcacaaccaacaagtgtaaagggtttggcttcgtcactatgaccaactatgacgaggcagcaatggccatagccagcctgaatggctatcggctaggcgagcgtgtgttgcaggtatcttttaaaaccagtaaacagcataaggcttag

SEQ ID NO: 186439 - DNA, 1083 bp, Artificial Sequence
  Description of Artificial Sequence: Synthetic coding sequence
atggtgacccagatcctgggcgccatggagagccaggtgggcggcggtcccgctggccccgctctcccaaacgggcccctgctgggcaccaacggtgcaacagacgattcgaagaccaatctaatcgtgaactacctcccccagaatatgactcaggacgaattcaaatctctgttcggttccatcggggacattgaaagttgtaagctggttcgcgataagataacagggcagtcactcggctacggctttgtgaactactcagaccccaacgacgcagacaaagctatcaatactctgaatgggttgaagctgcagacaaaaaccatcaaggtatcctatgcccgtccttcttccgccagtattagagacgctaatctctatgtgtcaggtcttcctaagaccatgtctcagaaggagatggaacagctcttctctcaatatggtagaatcatcacctcccgaattctggtggatcaagtgacaggggtttctaggggagtgggatttatacgctttgacaagcggatagaggccgaagaggcaatcaaaggcctgaatggccaaaaaccactgggtgctgccgaaccgatcacagtcaagtttgccaataatccatcccaaaagacgggacaggcgctgctgacccacttataccagtcatctgctcgcagatatgcaggccctctgcatcatcagacccagagattccgcctggacaatttgttaaatatggcctatggggtgaaaagattctcgcctatcgcaatcgacggcatgagcgggctggccggcgtgggcctcagcgggggcgccgcgggtgctgggtggtgtatattcgtgtacaatctctcccctgaggctgacgaatccgttctctggcagctttttggccccttcggtgccgtgaccaacgtcaaggtgattagagatttcacaacaaacaagtgcaaggggttcggtttcgtgaccatgactaattatgatgaggctgcgatggcaatagcaagcctcaatggctacaggttgggtgagagggtactccaagtcagcttcaaaacctccaagcagcacaaggcatag

SEQ ID NO: 186440 - DNA, 1152 bp, Artificial Sequence
  Description of Artificial Sequence: Synthetic coding sequence
atgcggctgctgctgctgcgggagatcgtgatcaacgagagccggaattgcagcttcatgatcatctccacaatggagcctcaggttagtaatggtcccaccagcaacacctctaacgggccctcctccaacaatcgaaactgtccaagtccaatgcagaccggcgcaactactgatgacagcaagacaaacctgattgtgaactacctcccacagaacatgacacaggaggaatttagaagtcttttcggcagcatcggggagatcgagtcatgtaagcttgttcgggataaaattaccggtcagtccctgggctacggctttgtaaactatattgaccccaaagacgccgaaaaggcaattaacacacttaacggcctcaggctgcaaaccaagactatcaaggtttcttacgctaggccatcaagtgcaagcatcagagacgcaaacctttacgtgagcggactacctaagacaatgactcaaaaagagcttgaacagctgtttagccagtatggccggattattacaagcaggattctcgtggatcaggtgaccggagtgtcccggggggtgggctttattaggtttgataaacgcatcgaggctgaggaggccatcaagggcctcaatggccaaaagcccagtggggcaacagaacccatcaccgtcaagttcgctaacaacccgtcccagaagtcctcccaggcgctgctctcacagctgtatcaatcgcccaaccggaggtatcctggacctttgcaccatcaagcacagagattccgtcttgacaatctgctgaatatggcatatggcgtaaaaaggtttagtccaatcaccattgatggcatgacgtctctggtgggcatgaatattccaggacatacaggaaccggatggtgtatctttgtgtataacttatcacccgattctgacgaatccgtattgtggcaattgttcggcccctttggggcagtgaacaatgtgaaggtgattagggattttaacactaacaagtgtaagggatttggattcgtaacaatgactaactatgatgaggctgccatggcaatcgcttcgcttaatggttacaggctcggcgacagggttctgcaggtcagctttaaaaccaacaaagctcacaagagctag

SEQ ID NO: 186441 - DNA, 1116 bp, Artificial Sequence
  Description of Artificial Sequence: Synthetic coding sequence
atggagtggaacggcctgaagatgatcatcagcaccatggagccccaggtgtccaatggacctacatctaatacaagcaatggccctagcagcaacaatagaaattgtccaagccctatgcagacgggtgcaacaacagacgattcaaagactaatctgatcgtcaattaccttccccagaacatgacccaggaggagtttcgctctcttttcgggtcaattggagaaattgagagctgtaagctggtgcgcgacaagatcactggtcagtctctcggctatgggttcgttaattacatcgatcccaaagatgcggaaaaagcgattaatactctcaacggcctgcgcttgcagactaagacaatcaaggtgtcatacgcaagacctagctctgcctcaatcagggacgcaaatctctatgtgtccggattgccaaaaacgatgacccagaaggagctcgaacaactcttctcccagtacgggaggattatcactagccgcattctggtcgatcaggtcaccggtgtgtcccgcggcgtgggatttattcggttcgataagagaatagaggccgaagaggccatcaagggactgaatgggcaaaagccatccggcgcaaccgagcctatcacggttaagttcgccaacaatccgtcgcagaagagctcccaggctctgctgagccaattgtaccagtctcctaatcgtcgctaccccggcccgctccaccatcaggctcagagattccgccttgacaacttgctgaacatggcctacggcgtcaaaagattttctcccattaccatcgacggcatgacatcactggtaggtatgaacatcccaggacacaccggaaccgggtggtgcatcttcgtgtacaatctgtctccagactcagacgagtcagtgctttggcaactcttcgggccctttggagcggttaacaacgtgaaggtgattcgggatttcaatactaataagtgcaagggatttggattcgtgacaatgactaattacgacgaggcggccatggccatagcatctctcaatggatatcggctgggggatagagttctccaagtgtccttcaaaacaaataaggcacataaatcatag

SEQ ID NO: 186442 - DNA, 1158 bp, Artificial Sequence
  Description of Artificial Sequence: Synthetic coding sequence
atggagtggaacggcctgaagatgatcatcagcaccatggagccccaggtgtccaacggaccaacaagtaacactagcaacggccccagcagcaataaccgtaactgccctagccccatgcagaccggggccaccacggacgatagtaagactaatctgattgtcaactacctgcctcaaaatatgacgcaggaagagtttagatcattatttgggagcattggagaaatcgagagctgtaagttagtgagagataaaataaccggtcagtctctgggatacggattcgttaattatatcgaccctaaagacgccgagaaggctataaatacactgaatggcctcaggctccaaactaaaaccataaaggtttcctatgcacggccaagttcagctagcatacgggacgctaatctatatgtgagcggtctgcctaagaccatgactcagaaagagttagagcagctgttctcacagtacgggcgcatcatcacctcccgcatcctcgtcgatcaagtgacaggtgtgagccgaggagtgggatttatccgtttcgacaagagaattgaggccgaggaggccattaagggccttaatggccaaaagcctagtggggcaacggagcctattactgtgaagtttgcaaataacccctctcagaagtcctcacaagcacttttgagccagctttaccagagcccaaaccgccggtatcctggtcctcttcaccaccaggcgcagagatttcggttggacaacttgctgaacatggcatacggcgttaaaagactaatgtcagggcctgtacccccaagtgcatgtcctcctagattttctcccatcaccattgacggcatgaccagcctggtgggtatgaatatccctgggcataccggcaccggctggtgcatcttcgtgtataatctctcgccagacagcgacgagtctgtgctctggcaacttttcgggcccttcggcgcagtcaataacgtcaaggtgattcgtgacttcaacaccaataagtgcaaaggcttcgggttcgtgaccatgacaaactatgacgaagcagcgatggctattgcctccttaaacgggtataggctgggcgacagagttctacaggtcagcttcaagacaaataaggctcacaaatcatag

SEQ ID NO: 186443 - DNA, 1143 bp, Artificial Sequence
  Description of Artificial Sequence: Synthetic coding sequence
atggtgatgatcatcagcaccatggagccccaggtgagcaacggccccacttctaatacttcgaacggccccagctccaacaaccgtaactgcccctcccccatgcaaacaggcgctacaaccgacgacagtaaaaccaatctgatagtgaattatttgccacagaatatgacccaggaggaatttcgatcacttttcggttctattggggagatcgagtcatgcaagctggtgcgcgacaagatcactggacagtctctcggttatggatttgtgaattatatcgatcctaaagacgcggagaaggccatcaacacactgaacgggctgaggctgcagaccaaaaccatcaaagtttcctatgctaggccctcgagcgcatcgatccgcgatgcaaatctctatgtcagcggccttccaaagacaatgactcagaaagaacttgagcagttatttagccagtatggacgcattatcacttctcgtatattggtggatcaggtaacaggagtctctcgcggggtgggattcatccggtttgacaagcgcatagaagctgaagaggctatcaagggcttaaacggccagaagccctcaggggccaccgaacctattacggtgaagtttgccaacaatccctcacagaaatcatcccaggctctgctttctcagctctaccaaagcccaaatcggagataccccggtccactacaccatcaggcccagcggtttcggctggataatctactcaacatggcatatggagtcaaacgcctgatgagcgggccggttcctccatccgcgtgcccgcccagattttcaccaataactatcgacggcatgacctccctggtcggtatgaacattccaggtcacacagggactggatggtgcatattcgtctacaatttgtcacctgactcagacgagtcagtcctatggcagctattcggtcctttcggggccgtgaacaacgtaaaggtcataagagattttaacaccaacaaatgcaaggggttcggcttcgtaaccatgaccaattatgatgaggcggcgatggcaattgccagcctgaacggatataggttaggggatcgcgtcctgcaggtcagttttaagaccaataaagcacacaaatcatag

SEQ ID NO: 186444 - DNA, 1101 bp, Artificial Sequence
  Description of Artificial Sequence: Synthetic coding sequence
atggtgatgatcatcagcaccatggagccccaggtgagcaacggcccgacttctaacaccagtaacgggccgtccagtaacaacagaaattgcccaagtccaatgcaaaccggggctactacagacgactcgaagaccaaccttattgtgaactacctcccacagaacatgacacaggaggagtttagatccctgtttggttctattggcgagatcgagagctgcaaactcgtgagagacaagatcactggacagtctctgggttacgggtttgtcaactacatcgatcccaaagacgcagaaaaagctattaatacattgaatggtttgcgactgcagaccaagaccatcaaagtctcctacgcacggccaagcagcgccagcatcagggatgcaaacctgtacgtctcgggtctgcctaagacaatgacacagaaggaactcgagcagctgttcagccagtatggccgaatcattacaagtcgcattttggtcgatcaggtgactggcgtgtcaaggggcgttgggttcatccggtttgataaaaggattgaagcagaagaagccattaaaggcctcaacggccagaagcctagtggcgctacggaacctatcacggttaagtttgctaataatccctcccaaaagtcctcacaagccctgctctcacaactgtaccaatccccaaaccgcagataccccggacctctccaccatcaggcccagcgctttaggctggacaatctgttgaacatggcctacggagtgaagagattcagccccattaccattgatgggatgacgtcgctggttgggatgaacatcccaggacacacgggtactggctggtgcatctttgtgtacaacctgtcccccgacagcgatgaaagtgtgttatggcagctctttggccctttcggcgctgtaaataacgtcaaggtgataagagactttaacacaaataaatgcaagggcttcgggtttgtgaccatgacaaattacgatgaggccgcgatggccattgcgtctctgaatggctacaggttgggcgatagggtcttgcaggtgtcctttaagactaacaaggcccacaagtcatag

SEQ ID NO: 186445 - DNA, 1101 bp, Artificial Sequence
  Description of Artificial Sequence: Synthetic coding sequence
atggagcagatcatcagcaccatggagccccaggtgagcaacggccccactagcaatacaagcaatgggccgtcctccaataaccggaactgccctagtcctatgcagaccggcgctaccaccgatgacagtaagacaaatctgatagttaactaccttcctcagaacatgacccaggaggaatttcgatccctttttggaagcataggagaaatcgagtcttgtaagcttgtgcgagataaaatcaccggccaaagcctgggatatggtttcgtcaactatatcgaccctaaggacgcggaaaaggccataaacaccctcaacggcttgcgccttcagactaaaactataaaggtgtcctacgccagaccatcctcagccagcatccgggatgcgaatctgtacgtgtctgggttgcctaagaccatgacacagaaggaactggagcagctcttcagccagtatggaaggattattactagccggatcctggttgatcaggtgaccggagtgagtcggggcgtcggattcattaggtttgataagagaattgaggcggaggaagccatcaaaggcttaaatggacagaagccctctggtgcgacagagccaatcacagtaaagtttgccaacaatcctagccagaagtcaagccaggccctgctttctcagctgtaccaatcccctaatcgcaggtaccccggacctttgcaccaccaggcccagaggtttagattagataatctgctgaatatggcttacggcgtcaagcggttttctcccattactatcgacgggatgaccagcctggtcggcatgaacattcccggccacactggtacaggttggtgcatctttgtatataatctgagcccagactccgacgaaagcgtcctatggcaattgttcggacctttcggcgctgtgaacaacgtgaaggtcatacgcgatttcaacaccaataaatgcaaagggttcgggttcgtcacgatgactaattacgatgaagccgcaatggcgattgcatccttgaatgggtatcgcttaggcgaccgcgttctgcaggtcagcttcaagacaaataaggcccataaatcatag

SEQ ID NO: 186446 - DNA, 1110 bp, Artificial Sequence
  Description of Artificial Sequence: Synthetic coding sequence
atgcggctgaagaaccagatcatcagcaccatggagccccaggtgagtaatggccctacatccaatactagcaacgggcctagttcgaacaatcgtaattgtccgtctccaatgcaaactggagccactacagatgatagtaagacaaacctcattgtgaattatctgcctcagaatatgacgcaggaggaatttagatcactctttgggagtatcggcgagatcgagagttgcaaactggtgagggataagatcactgggcaatcacttgggtacgggttcgtgaattacattgatcctaaagacgctgagaaggcaatcaacactctgaacgggttacgcctacaaacaaagaccatcaaagtctcttatgcaagaccctcctctgcttcaattcgggacgcaaacctttacgtgagcggcttaccgaagacaatgactcagaaagaactggagcagctcttcagtcaatatgggagaatcataactagtcgcatcctggtggatcaggtgactggagtatcccggggcgtgggcttcatccgcttcgacaaacgcatcgaggcagaggaggcgattaagggccttaacggacaaaaacccagtggggctacagagccaatcaccgtcaaattcgccaataatccctcccaaaaatcttcacaagcactgctgagtcagctgtatcagagtcctaatcggcgttacccaggccctctgcatcatcaggcacaacgctttagactagataacctgttgaacatggcttatggggtaaaaagattcagtcctatcactattgatggaatgaccagcctcgtaggtatgaatatacccggacacacagggaccgggtggtgtatcttcgtgtacaacttgagcccagactccgatgagagtgttctgtggcagctctttggaccgttcggtgccgtcaacaatgtcaaagtgatccgggacttcaacacgaacaaatgcaagggatttggattcgtcactatgaccaattacgacgaggctgccatggccatagcatctctgaacggctatcgcttgggagacagagttctccaggttagctttaaaaccaataaggcacacaagagctag

SEQ ID NO: 186447 - DNA, 855 bp, Artificial Sequence
  Description of Artificial Sequence: Synthetic coding sequence
atgttccgggccgccgcccccggccagctgcggcgggccgtggcccaggatctgtgtaaagtagctggtatcgcaaaagtgctggtagcgcagcatgacgtctacaaagggttactccctgaggagctcacgcctctgatcttagctactcaaaaacagtttaattacacccatatttgtgctggcgcatccgcatttggcaaaaacctgctgccccgtgttgccgccaaactggaagtggcacccatcagtgatatcatcgccatcaagtctccagacacattcgtacggacaatttatgccggaaacgcactctgtacagtcaaatgcgatgagaaggtgaaagtttttagcgtgcggggcacgtccttcgatgcggccgcaacttctggcgggtcggctagcagtgaaaaggccagcagcacctcccctgtcgagattagtgaatggctggaccagaaactcacaaaatcagacaggcccgagctgaccggagctaaggtcgtcgtgtctgggggtcgcgggctgaaatctggtgagaacttcaaacttctttacgacctagccgatcaacttcacgccgctgtaggcgcttctcgggcggcagtcgacgccggattcgtgcccaacgacatgcaggtaggtcagaccgggaaaattgtcgcacctgagttgtatatcgccgtgggcatttccggagcaattcagcaccttgcgggaatgaaggactccaagactatcgtcgccattaacaaagatcccgaggctccaatttttcaggtggctgattatggaatcgtggcggacctgtttaaggtggtgcccgagatgacggagatactgaagaagaagtag

SEQ ID NO: 186448 - DNA, 1002 bp, Artificial Sequence
  Description of Artificial Sequence: Synthetic coding sequence
atgttccgggccgccgcccccggccagctgcggcgggccgccagcctcctccgcttccagtcaactctggtgatcgccgaacatgcaaatgacagcctcgccccgattacccttaatactatcacagccgccacccggctcggtggtgaggtaagctgcttagttgctggcactaaatgcgacaaggtggcccaggacctctgtaaagtggctggtattgctaaggtgcttgtggcccagcacgacgtctacaagggccttttgccagaagaactgacccccctcatcctcgctacccaaaagcagttcaattatacccacatttgcgccggtgcttccgcctttggcaaaaacctcctgcctcgggtggccgccaagttggaggttgctccaataagtgacatcatcgccatcaagagccctgacaccttcgtcagaactatttatgctggcaatgccttgtgcacagtgaaatgtgatgaaaaagtgaaggtgtttagcgtccgtggcacctcctttgatgccgcagccacctccggaggaagtgcatcctctgaaaaggctagcagcacaagccccgtggagatatctgaatggcttgatcagaaactgaccaaaagcgacagacccgagcttaccggagccaaggtcgtggtctccggaggcagaggcttaaaaagtggggaaaattttaagctgctgtacgatctggcagaccagctccacgcagccgtcggtgccagcagagcagcagtggatgcaggctttgtccctaatgacatgcaggtgggccaaaccggaaaaatcgttgctccagaactttatattgccgtcggcataagcggagccatacagcacctggcaggcatgaaggattccaaaaccatcgtggcgatcaacaaggatcccgaagctcccatattccaagttgcggactacggtattgttgcagacctcttcaaggtcgtcccagaaatgaccgaaatcttaaaaaagaagtag

SEQ ID NO: 186449 - DNA, 768 bp, Artificial Sequence
  Description of Artificial Sequence: Synthetic coding sequence
atggccgagctgcgggtgctggtggccgtgaagcgggtgatcgactatgccgtaaaaatcagggttaagcccgatagaaccggcgtggtcaccgatggagtgaagcatagcatgaacccgttctgcgagatcgcagttgaagaggctgtccggctaaaggaaaagaaactggtgaaggaggttatcgcagtttcctgcggcccggcccagtgtcaggaaactatccgaaccgctttagcaatgggagcagacaggggcatacatgtggaggtgccccccgccgaggccgaaagactggggccactgcaggtggccagagtcctggccaaattagccgagaaggagaaagtagacctggtgctgctcggcaagcaagccatagacgatgactgcaatcaaacaggccagatgactgcggggtttttagactggccccagggcacttttgccagccaggttacactggaaggagacaagctgaaagtcgaacgcgagattgatgggggactggaaaccctgcgccttaaactacccgcggtggtaactgcagatttgcgtctcaatgagccaagatacgcaacgctcccaaacatcatgaaagccaagaagaagaagatcgaggttatcaaaccaggagatctcggggtggatctgacatctaaactgtctgttattagtgtggaggaccccccgcagaggacagccggcgtgaaagtggagactaccgaggaccttgttgcgaagttgaaggagatcgggagaatttag

SEQ ID NO: 186450 - DNA, 1041 bp, Artificial Sequence
  Description of Artificial Sequence: Synthetic coding sequence
atgtacctgagcctgtgggtgaccatcaacaccgtgaacctgcggaacaccttatccggcctacgcggggccgtaaccacagtgggaatgataaaaagcgacgtgcccggcacacaggaatggttggacgagcggaggagacagggagatctcccgctgccgaccaacagcaatcctgtactgtcgctggaactgtgcgatcccggtcaggggccggccccgtttcaggccgtggtggtattgatacagcctggcagggggctggctctgcggccgccacccagctgtctgttcccccctgacccgacgccgagcccccctgctggccagattcgcgtgaagcccgaccggactggcgtggtgaccgacggtgtaaaacactctatgaaccccttttgtgaaatcgccgtagaggaagcagtgagacttaaagagaaaaagctggttaaggaggttatcgctgtgtcctgtggtcccgcccagtgccaggaaactatccgaaccgccctggctatgggcgctgacaggggcattcatgtcgaggtgccacccgcagaagcagaacgtctgggaccacttcaagtggcaagggttctggccaaattagcggagaaggagaaagtggacctcgtgctgctggggaagcaggctatcgatgacgactgcaatcagaccggccaaatgacagcggggtttctcgattggccccagggaacgttcgccagtcaggtcactttggaaggtgacaaacttaaagtggagcgagaaatcgacggtggtctggagacactccggctcaagctacccgccgtagtcaccgccgaccttcggctgaacgagcctaggtatgccacactcccgaatataatgaaggccaaaaagaagaagatcgaggtgatcaaacctggtgaccttggtgttgaccttacaagcaagctgtccgtcatcagcgtcgaagatcccccccaacgcactgccggtgtgaaagtggagacaacggaggacctggttgccaagctgaaagaaattggcagaatctag

SEQ ID NO: 186451 - DNA, 1713 bp, Artificial Sequence
  Description of Artificial Sequence: Synthetic coding sequence
atgctggtgcccctggccaagctgagctgcctgggcgtgaacatggaacggtttgcggaagaggccgatgtggttatcgtcggtgccgggcccgccggtctttctgcggcagtgcgcttgaaacagctggcagtggcgcatgagaaggacatccgggtctgcctggtggaaaaggctgcccaaattggtgcgcacaccctgtcgggtgcctgtttagatcctggcgcgtttaaagagctctttcctgactggaaagaaaagggtgctccactaaatactcctgtgaccgaggatcggtttgggatcctcacagaaaagtatcgcataccggtgcctattctgccaggattacctatgaacaaccacggcaattacattgtaaggcttggccacctggtaagttggatgggagaacaggcagaggccctcggggtcgaggtctaccccggatacgccgctgcagaggtcctcttccacgatgatggctctgtgaagggcattgccacaaatgatgtgggcatccaaaaggacggcgcgcctaaagctaccttcgaacggggacttgaactacatgccaaagtaacgatctttgcagaaggctgccatggacatcttgcgaagcaattgtacaagaaatttgacctgagggcaaattgtgagcctcagacctatggaattggcctgaaggagctatgggttattgatgaaaagaactggaagcctggccgcgtggaccatacagtgggctggcctttggacaggcacacatatggcggcagtttcctgtaccatctgaacgaaggcgagcccctggttgctttaggcttggtggtaggattagattatcagaacccgtacctgtctcctttccgcgagttccagagatggaaacatcacccctcgatacgccccacactcgagggtggcaagcgcatagcttatggagccagagccctgaacgagggaggtttccagtcgatacctaagcttacattccccggggggctgttgatcggatgctcacctggcttcatgaacgtacctaaaatcaagggcacgcacaccgccatgaaatccggaatcttggctgcggaatccatatttaaccagctcacctcagaaaacttacagagcaagaccatcggactgcatgtcaccgaatacgaggataatcttaagaatagttgggtttggaaggaactgtactccgtgaggaatatcagaccaagctgccatggagtcttaggcgtttacggcggaatgatttacacagggattttctactggattctaagaggtatggagccatggaccctcaaacacaaagggagcgatttcgagcgtctcaaacccgcaaaagactgtacacctatcgagtatccaaagcctgacggacagatcagctttgaccttcttagttctgtagctcttagtgggactaaccatgaacatgaccagccggcacacctcacactgagagacgacagcatcccagtgaatcgcaatctgtccatttatgacggaccagagcaacgcttttgccctgccggggtttacgaattcgtacccgtcgagcagggagacggattcaggctgcagattaatgcccagaactgtgttcactgcaaaacttgtgacattaaggatccttcacagaacattaattgggttgttcccgaaggcggcgggggtcccgcatataacggcatgtag

SEQ ID NO: 186452 - DNA, 1854 bp, Artificial Sequence
  Description of Artificial Sequence: Synthetic coding sequence
atgctggtgcccctggccaagctgagctgcctggcctaccagtgcttccacgcactgaagataaagaaaaactaccttccactatgtgctacgcgctggagctctacttcgactgtccccaggatcaccacacattacacaatttatcctagagacaaggacaagcgctgggagggcgtcaacatggaacgcttcgccgaggaagcagatgtcgttatagttggcgccgggccagccggactgtccgctgcggttcggttaaaacagctcgccgtagcccacgaaaaggatatccgagtttgtttagtcgaaaaagcagcacagatcggcgcccataccctgagtggggcatgccttgatcccggagccttcaaggaactctttcctgattggaaggaaaagggagcgcctttgaacacgccagtgactgaagatcgctttgggattcttactgagaaataccggatcccagtgccgattctgccaggcttaccgatgaataatcatggcaattatatcgtcaggctgggccacttggtgtcatggatgggggaacaggcggaagccctcggagtggaagtctacccgggatacgccgctgctgaggtgctattccacgacgatggtagcgtcaaaggaatcgctactaacgacgtagggatccagaaagatggggcacccaaagctacttttgagcggggactggagttgcacgcaaaggtaacaattttcgcggagggctgccatggccatctggccaagcagctttacaagaagttcgatttgcgggctaactgcgagcctcaaacctacggaattggtctgaaggagttgtgggtaatcgatgagaagaattggaagccggggcgagtggaccacaccgtgggttggcctctcgaccggcatacatatggtggtagctttctgtaccacctgaacgaaggagagccgctcgtggcactgggcctggttgtgggcctcgactatcaaaatccatatctctccccctttcgggagtttcagcgttggaaacaccatcctagtatccgccccactcttgagggtggcaagagaatcgcgtatggcgctcgcgcattgaacgaaggggggttccaatcaatacccaagctgacatttcctggaggcctgctgataggatgctcgccaggctttatgaatgtccctaagatcaaaggtacccacacagcaatgaaatcagggatcctcgcagcggaatctatattcaaccagctgacatccgagaatcttcagagtaagaccataggtctccatgtcaccgagtatgaggacaatctgaagaactcttgggtctggaaggaattatattctgtgcggaatattcggccctcctgccacggcgtgctgggtgtttacggcggcatgatctacaccggaattttctattggattctcagaggcatggagccatggacactcaaacacaaagggagcgactttgagaggctgaagcctgcaaaagactgtactccaattgagtaccccaagccagacgggcagatttcatttgacttgcttagctctgtggccctgagtggaactaaccatgagcacgaccaacccgcgcatttaaccctgagagatgattccatccctgtgaaccggaacctgtctatttatgacgggccagagcagcgcttctgtccagcaggcgtgtacgagttcgtacctgtcgagcagggcgatggttttagactgcagatcaacgcacaaaattgtgttcactgtaagacttgcgatataaaagacccgtcccaaaatattaactgggtcgttccagaaggaggcggcggcccagcctacaacggcatgtag

SEQ ID NO: 186453 - DNA, 1287 bp, Artificial Sequence
  Description of Artificial Sequence: Synthetic coding sequence
atggaccccagcgtgaccctgtggcagttcctgctgcagctgctgcgagaacagggaaatgggcatattatatcctggacatctcgtgacggcggcgaattcaagctcgtggacgccgaggaggtggccagattgtggggcctaagaaaaaataaaacgaatatgaattacgacaaactctcacgcgccctgagatactactacgataagaacataattcggaaagtgagcgggcagaaatttgtctataagtttgtttcctacccagaagtggccggatgctcaaccgaagactgcccaccccagcccgaggtatccgtcacctcaacaatgcccaacgtagccccggccgcgatccacgcagccccaggagacactgttagtggaaaacctggaactcccaaaggcgctggcatggccgggcctggaggactggcacggtccagccggaacgagtatatgcgttctggcctgtactcaacattcaccatccagagcctgcagccccagccacctccccaccccagaccggccgttgtgttgcccagtgctgcgccagccggagctgcggcacccccttcaggatcacgatcaacctcaccaagtccactggaggcatgcttggaagctgaagaagccggactgccgttacaagtgattctaactcctcccgaggcgccaaatctgaaatccgaggaactcaatgtcgagccgggcctcggccgggcccttcccccagaggtcaaagtcgagggacccaaggaggaattggaagtggcgggagaaagagggtttgtacctgagacaaccaaagctgaacccgaagtgcctccgcaggaaggtgttccggctagactgccagcagtggttatggatacggcaggacaggcaggcggacatgctgcttccagtcccgagatcagccagcctcagaagggccgtaagcctagagacctggagctccccctgtccccatcattgctcggcggacctggtccagaaagaactcccggttcagggtcaggatccggtctccaggctcccggcccagccctaacgccttcgctgctgccaactcacaccttgacccccgtgctgcttaccccttcatcactccccccttccattcacttctggtcaaccctgagcccaattgccccccggtcccccgccaaactgtccttccagtttcctagctccggctctgcccaagtgcacatcccatcaattagtgtggatggcctgtccacacctgtcgtgctcagtcctgggccccaaaaaccttag

SEQ ID NO: 186454 - DNA, 1836 bp, Artificial Sequence
  Description of Artificial Sequence: Synthetic coding sequence
atgcccgagatcgtggacacctgcagcctggccagccccgccagcgtgtgtagaacaaaacatctacacctccgttgtagcgtggacttcacacgcagaacactgacaggcaccgccgctctgacagtccaatcccaggaagacaatttacgcagtctggtcctcgatacaaaggatctgactattgagaaagtggttattaatggccaggaggtgaagtacgctctgggagaaaggcagagctataaaggctcaccaatggaaatctccctcccaattgccctctctaagaaccaagagatcgtgatcgaaatatcattcgagacaagtccaaagtccagtgctttgcagtggcttacccccgagcagacgtctggcaaggagcacccatatctgttctcacagtgccaggccatccattgcagagctatcctgccttgccaagatactcctagtgtcaaactgacatatacagctgaagtgtctgttccgaaggagttagtggcactgatgtctgccatccgggacggcgaaacaccagaccccgaagatccgagtcgcaagatttataaatttatccagaaagtccccatcccatgttatctgatcgccctcgtagtgggagccctcgaatccaggcagatcggaccacggactctggtgtggtctgaaaaggagcaggtcgagaagtcagcctatgaattcagtgaaacagagtcgatgcttaagatagcagaagacctcggcggcccttacgtttggggacagtatgatctgctcgtgctccccccgtcgtttccttacggcggtatggagaatccttgtttgacgttcgtgacccccactctgctggccggagataagagtctgtcgaatgttattgcccatgagatttcacacagctggactggcaatctagtgacaaataagacatgggaccacttttggctcaatgaaggccacactgtatatctggaacgccacatttgtgggcggttgttcggcgaaaagttccgtcattttaacgctttgggcggatggggcgaattgcagaattcggttaagacgtttggtgagactcatcccttcactaagctggttgtggacttgacagacattgaccctgatgtggcttactcttctgtaccctacgagaaaggctttgccctcttattctacctcgagcaactgctgggcggtccggagatatttcttggatttcttaaggcctacgtcgaaaagttttcttataagtcaattaccaccgacgattggaaggacttcctgtattcttatttcaaggataaggttgacgtgctgaatcaggtggactggaacgcttggctgtactctcccggcctccccccaattaaacccaactacgatatgactcttaccaatgcttgtatcgccctcagccagcgatggatcactgcaaaagaggatgatctgaacagcttcaacgccacagacctcaaagatctgtcgtcgcaccagttaaacgaatttttggcccagaccttacaacgtgctccactgccccttggacacatcaaaaggatgcaggaggtatataatttcaatgccatcaacaattctgagatccgctttcgttggcttcggctgtgtattcagagtaagtgggaggatgcaattcccctggcgctaaagatggctactgaacaaggtcgcatgaaattcacgaggcctctgtttaaagatctggccgcctttgacaagagccacgatcaggccgttagaacataccaggagcataaagccagcatgcatcctgtcaccgccatgctcgtgggaaaggatttgaaggtggattag

SEQ ID NO: 186455 - DNA, 117 bp, Artificial Sequence
  Description of Artificial Sequence: Synthetic coding sequence
atggagagcgccatcaccctgtggcagttcctgctgcagctgctgctggaccagaagcatgagcatctgatctgttggacctctaacgacggcgagttcaaattgctgaaagcctag

SEQ ID NO: 186456 - DNA, 483 bp, Artificial Sequence
  Description of Artificial Sequence: Synthetic coding sequence
atggagagcgccatcaccctgtggcagttcctgctgcagctgctgttagatcaaaaacacgagcacctcatatgttggaccagcaacgatggcgaatttaaacttctgaaagcagaagaggtagccaaactctggggcttacgcaagaataagaccaatatgaattatgacaagctgtccagggccctgcgatattactacgacaagaacattataaaaaaggtgatcggccagaaatttgtttacaagttcgtttcatttcccgaaatcctcaaaatggacccacacgccgttgaaatctcccgggaatctcttctgctacaggacagcgactgtaaggccagccctgagggaagagaagctcacaagcacggcctcgccgcattgcggtccacctcacgcaatgagtatatccatagcggtctgtactcaagcttcactattaatagcctccagaatcccccagacgcctttaaggcatag

SEQ ID NO: 186457 - DNA, 1218 bp, Artificial Sequence
  Description of Artificial Sequence: Synthetic coding sequence
atggacagcgccatcaccctgtggcagttcctgctgcagctgctgcagaagcctcagaataagcacatgatctgttggacaagcaacgatggccagttcaagttactccaggccgaggaggtggcccgcctgtggggcataagaaagaataaacccaatatgaactacgacaaactgagccgggctttgaggtattattacgtaaagaacattatcaaaaaagtgaacggacaaaagttcgtttacaagttcgtatcgtatcccgagattctcaatatggatccaatgactgtcggccgaattgagggtgattgcgaatccctcaatttttccgaagtgagtagctcgtcgaaggacgtagagaatggcggaaaggacaaaccaccgcagcctggggccaagacatctagccggaatgactacattcattccgggctgtacagctcttttacactcaactctcttaattcttctaatgtcaagctgtttaagttgataaagaccgagaatccagctgagaagttagcagaaaaaaaaagccctcaggaacccaccccatcagtgattaagttcgtgactacaccttctaaaaaaccacccgtggaacccgttgccgcgaccatttccatcggcccaagtattagcccctcctccgaggaaacaatccaggcgctggagacacttgtctcccctaagctgccatctcttgaagcaccgaccagcgcctccaacgtgatgactgccttcgccaccactccccccatctctagtattccacccctgcaagaaccgccgcgtacacccagcccccccctctcatcccacccagacatcgacacagatatcgattccgtggcctcccaaccaatggagctgcccgagaacctgtccctggaacctaaagaccaagattctgtcctgctggagaaagacaaggttaataattccagtagatctaaaaagcctaagggtctggagctggccccaaccctggtgatcacatcgtccgacccgagccctctcggcatccttagtcccagcctgccgacagcttcactcactccggctttttttagtcaggttgcctgctccttattcatggtgtcgcctctactatcttttatctgcccatttaaacagattcagaatctgtacacgcaggtgtgcttcctgctgcttcgctttgtgctggagcggctctgtgtcacagtcatgtag

SEQ ID NO: 186458 - DNA, 1296 bp, Artificial Sequence
  Description of Artificial Sequence: Synthetic coding sequence
atggacagcgccatcaccctgtggcagttcctgctgcagctgctgcagaagccccaaaacaagcacatgatttgctggacatccaacgatgggcagttcaagttactgcaggccgaggaagtcgcgagactctggggcatacggaagaacaagcctaacatgaactatgacaaactgtctagagctctgagatactactatgtcaaaaatatcatcaagaaggttaacggtcagaagttcgtgtacaagtttgttagctacccagagatcctcaacatggatcccatgactgttggacgaattgagggggattgcgagagcctgaacttttccgaggtttcttcctctagcaaagacgtggaaaatgggggcaaggacaaaccacctcaaccaggggcaaagacctcatcacgcaatgattatatccactctggactctactccagttttacactgaactctctcaatagctcgaatgtgaaactttttaaacttataaagactgagaatccagccgagaaattagctgaaaagaagtctccacaggaacctactcccagtgtaataaaatttgtaacaactccatccaaaaagcctcctgttgaacctgtcgccgcgaccatcagtatcggtccatcaatcagtccgtccagtgaggagactatccaagccctcgagacactggtcagccctaagttaccatctctggaagctccaacttccgcatccaatgtcatgactgccttcgcgactactccacctatttctagtatcccgcccctccaagaacccccgcgcaccccaagtcctcccctgagttcccatcctgacatcgatacagacatagactcagtggcttcacagccaatggagttgcctgagaacttgtctcttgaacctaaagatcaggacagcgtcttgctcgagaaggataaagtaaataattctagcaggagcaaaaagccaaagggtctagaactagccccaaccctggtgattacttcaagtgacccatcccccttgggtatactgtcaccatctttacccaccgcatctctgacacctgcctttttctctcagacaccgataatcctaaccccctctcccttgctcagttccatccacttctggagcacactgtcaccagtcgcacccctgtctcctgccaggctacaaggcgctaataccctgtttcagtttcccagcgtccttaattcgcatgggcctttcaccctgagcggccttgatggacccagcacacctggcccttttagcccagacctgcaaaaaacatag

SEQ ID NO: 186459 - DNA, 1566 bp, Artificial Sequence
  Description of Artificial Sequence: Synthetic coding sequence
cggccccaggacccccggcggcggtgccgggtgcggggccggggcggacggggggccagatcaaggggcgggggcaggtgcggcagactacgtgccccaggaggactcggtctcgcggcggccgccttttacggatctgccgccggcgtggcagctgcggcagccccatcttcttcctttcagagagaagaagaggccgagggcggggaggctcatcgcgtgcgcggtggcgataggggcggcgcgccacgggcagcctctctgattgccatggatagcgccatcacactctggcagttcctcttgcagctcctgcagaagccccagaacaagcatatgatttgctggacgtccaatgacggacaatttaaactgttacaggccgaggaggtagcccggctgtggggcatccgaaagaataaacccaatatgaattacgacaagctgagcagagcactgagatactactatgtgaaaaacattatcaagaaggtgaatggacaaaagttcgtgtataagttcgtgagctatcctgagattctgaatatggacccgatgaccgtggggagaattgaaggcgattgtgagagtcttaattttagcgaggtcagctcgagctcgaaggacgtggaaaatggaggaaaggataaacctcctcaaccgggtgccaagacaagtagcagaaatgactacattcactctggcctatattcctcctttaccctaaacagtctgaatagctccaatgtgaaactgttcaagctaataaaaaccgaaaatccggcagagaagctggctgaaaaaaagtcgccacaggagcctactcctagtgtcattaaattcgtcactacaccgagtaagaaacctccagtggaaccagtcgcagctacgattagtattggcccctccatctcgccctcatctgaggaaacgatccaggccctcgagacactagtttcccccaaattgccaagtctcgaagctccaacttctgcttccaacgttatgaccgcctttgccacaacaccccctatatcgtcaataccccccttgcaggagccacctagaactccttcacctcctctcagctcacaccccgacatcgacacagacattgattccgttgcatcgcaaccaatggaattaccagagaacttgtccctcgagccaaaggaccaggactctgttctgcttgagaaggacaaagtcaataattcttctaggagtaaaaaaccaaagggattggaactagccccaactctggtgatcacatcctcggatccttcccccctgggaatccttagcccatcactgccaaccgcttcccttacacccgcgttcttctctcagactccgatcatattaactccttcccccttgctgagctcaattcatttctggagcacactctcaccggtcgcacccctgtcaccagcaaggctgcagggagcgaatacacttttccagtttccatcagtgctcaatagtcacgggccattcaccctgagcggtctcgatggccctagcacccctgggccattttcccccgaccttcagaagacttag

SEQ ID NO: 186460 - DNA, 807 bp, Artificial Sequence
  Description of Artificial Sequence: Synthetic coding sequence
atgaacggcaccgccaaccccctgctggaccgggaggagcactgccttaggctcggcgagtccttcgagaagcggccccgggccagtttccatactatcagatacgattttaagccagccagcatcgacacttcatgtgaaggtgaactgcaggtgggcaagggcgatgaggtgacaattacccttcctcacatccccgggtctacacccccaatgaccgtgtttaaggggaacaagcgcccctatcagaaggattgtgtgctcattataaaccatgacacgggggaatacgtgctcgagaagctctctagctcaattcaggttaagaagaccagagcagaggggagctcaaaaattcaagctcggatggagcagcagcccacacggcctccgcagacctcccagccccctccgccaccacctcctatgcccttcagagcacccacaaagcctcctgtgggcccaaagactagcccactaaaggataacccctccccagaaccccagctcgatgatatcaagcgtgagctccgcgccgaagtggacatcatcgagcagatgtcctcgagctccgggtcaagttcctccgatagtgaatcaagcagcggtagcgacgatgatagcagctcaagcggcggagaagataatggccccgcctccccaccccagccgagccatcagcagccttacaattccagacccgctgttgcaaatgggacgtcccggcctcagggcagcaaccaattgatgaatactctccgcaacgatcttcaactttcagaatctgggtcagactcagacgattag

SEQ ID NO: 186461 - DNA, 504 bp, Artificial Sequence
  Description of Artificial Sequence: Synthetic coding sequence
atgaagagccagctgcactgccacatcagcctggccgagggcagctctaaaattcaagccaggatggagcagcaacccactagaccacctcagacatcccaaccccctcctccacctccacctatgccctttagagctcccactaagcctcccgtgggaccaaaaacctccccactgaaggataatccatccccggaaccccagctcgatgacataaagcgcgagttgagagctgaagtggatatcatcgaacagatgagttcaagcagcggtagcagctcctcagatagcgaatcaagctcaggatcagacgacgattcaagttcatctggcggtgaggacaatggcccagcctctccaccccaaccaagccaccagcaaccctataactctaggcctgctgtggctaacggcacctcaagaccccaggggagcaatcagctgatgaacacattgcggaatgatctccagttgagtgaatccggaagcgatagtgatgactag

SEQ ID NO: 186462 - DNA, 2979 bp, Artificial Sequence
  Description of Artificial Sequence: Synthetic coding sequence
atggcccggggcggcgccgcctgcaagagcgacgcccggctgctgcttggccgcgatgcactacgcccagcaccagccctccttgcccctgctgtcttgcttggcgcagctctcgggcttggacttggcttgtggctggggtgccgagccggcaggcagcggacaagacaccagaaagatgacactcagaacctattgaagaacctggagagcaatgctcagactccttccgaaacaggctccccgagccgcagaaggaagagagaagtccagatgtcaaaggacaaagaggcagtcgatgagtgtgaaccaccttccaactctaatataacggcttttgccctgaaggcaaaagtgatctacccaattaaccaaaaattccggccacttgcagatggttcaagtaacccatccctccatgagaacctaaaacaggctgttttgccccatcagcccgtggaggccagcccctctagctccctgggcagcctgtcacagggtgaaaaagatgattgctcttcatcatcatcagtccattccgctaccagcgacgaccgattcctctcaagaacattcctcagggtaaatgccttcccagaagttctggcctgtgagtccgttgatgtggacttatgtatttatagtctgcatttgaaggacttgctacatctggacaccgctctgcgacaggaaaaacacatgatgttcatacagatcttcaagatgtgcctccttgaccttctgcccaagaaaaagtctgatgatgaactgtaccagaaaattctgtcaaagcaagagaaggacctggaggaactcgagaaggggctacaggtcaagctctctaacaccgagatgtccggcgcaggagacagcgagtacataactttggctgacgttgaaaagaaagagcgtgaatattcagagcagctgattgacaacatggaggccttctggaagcagatggcaaatatccaacatttcctcgtggaccagttcaagtgctcttcctcaaaggctcggcagttaatgatgactctgaccgagaggatgatcgcagcagagggtctgctgtgtgattcccaggagttgcaagccctcgatgcattggagagaacaatggggagggcacacatggcaaaagtcattgaatttctcaagcttcaggtccaggaagaaaccaggtgtcgtttggctgcaatttcgcatggtctagagcttctcgcgggcgaaggtaagctgagcggacggcaaaaggaagagctgctcactcagcaacacaaggcgttctggcaggaggctgagcgattttctcgagagttcgttcagcgcggcaaagacctggtcactgccagtttggcccaccaggtggaaggtactgctaagctgacccttgcacaggaggaagaacagcgatcctttctggccgaggcccagccgaccgctgaccccgaaaagttccttgaggcttttcacgaggttctggaacggcagaggctgatgcagtgtgatctggaagaagaggagaacgtccgcgccaccgaagcggtggtggccctctgtcaggagctctatttttctactgtagacacatttcaaaagtttgtggacgcgctgtttctacagactctgccaggtatgaccggcctccctcctgaggagtgcgactatttgcggcaggaggtccaagagaacgccgcctggcagctcggaaaaagtaacaggttccgtagacagcaatggaaactcttccaggagttattagagcaagaccagcaggtgtggatggaggaatgtgctctctcatcggtgctgcagacccacctccgcgaagaccacgaaggtactataaggggggtgctcgggcgcttgggaggcctgaccgaggagtccacgcgctgcgtgttacaagggcacgatctgctgctcagatcggcattgaggaggttggccttgaggggaaacgctcttgcaactcttacccagatgaggctctctggcaaaaagcacctgctgcaggaattgcgggaacagagggccctggaacaaggctcctctcagtgcctcgacgagcaccagtggcagctcctgagggctcttgaggcccgagtgttagaggaggcttctcgtttagaggaggaagcacagcaaactaggttgcagctgcagcagagactacttgccgaagcccaagaagtgggacagctgctccagcagcacatggagtgtgctattgggcaggcccttctcgtgcacgcccgcaatgccgcaacaaagtcacgcgcaaaagatcgggatgatttcaaacgcacccttatggaggccgccgttgagtcggtatacgtgacatccgcgggagtgtcccgcctggtgcaggcgtattatcagcagatcggacggattatggaggaccacgaggaaaggaaacttcagcacctcaaaaccctacagggcgaaaggatggaaaattataagcttcgcaagaagcaggagttgtcaaacccatcttccggctccaggaccgcaggaggggctcacgagacgagccaggccgtgcaccagaggatgctctctcaacagaaacgatttcttgctcagtttccagtccatcaacaaatgcgcctccatgctcaacaacaacaggcgggtgtgatggatctcctggaggctcagcttgaaacgcagctacaggaagctgaacagaactttatcagcgaactggctgcgctggcccgcgtgccactggcagagagtaagctgttaccagccaaaagaggcctactggagaagccattgcggactaaacgcaagaagccactgccgcaggaacgcggagatctcggagtgcccaataacgaggatctggcttctggcgaccagacatcaggttctttgtcttctaagcgactatcccagcaggagtcagaagccggtgactccgggaattcaaaaaagatgcttaagcggcgaagcaacctgtag

SEQ ID NO: 186463 - DNA, 2979 bp, Artificial Sequence
  Description of Artificial Sequence: Synthetic coding sequence
atggcccggggcggcgccgcctgcaagagcgacgcccggctgctgctcggccgagatgccctgaggccagctcctgctttgcttgcccccgccgtgctgctgggagctgctctgggactcggcttgggtctgtggttggggtgccgggcaggcagacagaggactcgccatcagaaggacgatacgcagaatctattaaagaatctagaaagcaacgcacagactccctcagagacgggaagcccaagcagaaggaggaagcgcgaggttcagatgagcaaagacaaggaggcagtggatgaatgtgagcctccttccaactctaacataactgcgtttgctttaaaagccaaagtgatctatcccatcaatcagaagtttaggcctcttgcggatggctccagcaatccaagccttcacgagaacctaaagcaggccgtgctcccacatcagcctgtcgaggcaagcccgtcttccagcctgggctccctctctcagggagagaaagacgactgcagcagctcgtcatcagtgcactctgcaacctcggacgataggttcctttcaagaacatttctgcgcgtgaacgcattcccagaggtgttggcttgcgagagtgtagatgttgatctatgcatctatagtctgcacctaaaggacctgctgcatctggataccgcactgaggcaagagaagcatatgatgttcatccagatttttaagatgtgtctcctcgatttgcttcccaaaaaaaaaagcgatgacgaactgtaccaaaagatcttgtccaagcaggaaaaagacttagaggagttggaaaagggcttgcaggtcaaattgtcgaacaccgagatgagcggggcaggagactcagagtacattaccttagccgatgtagagaaaaaggaaagagagtacagtgaacaactgatcgacaacatggaagctttttggaaacagatggcgaacatccagcacttcctggtggaccagtttaaatgctcttccagtaaagcacggcagttaatgatgacgttgactgagagaatgatcgctgccgaaggcctactctgcgacagccaagagcttcaggctctggatgcgcttgaacgcactatgggaagagctcatatggctaaagtgattgagttccttaagctccaggtccaagaagaaaccaggtgccggctagctgcaataagccacggtttagaattgttagctggtgagggtaagttgagtggacggcaaaaagaagagctgctaactcaacaacacaaggccttttggcaggaggcggaaaggttttctagggagttcgtccaacggggtaaggacctggttactgctagtttggcacaccaagtggaaggaaccgccaagctgacactcgcccaggaggaggaacagcggtcattcctcgcggaagctcagccgacagccgaccctgaaaagttcctcgaagctttccatgaggtcctcgagagacaacgcctgatgcaatgtgacctggaagaggaagagaacgtgcgagctacagaagccgtggtggcgctgtgccaggaactgtacttttctaccgtcgatacatttcagaagtttgtagacgcactttttcttcaaacactgcccggcatgactggcttgcctccagaggaatgcgactatctccggcaggaagtgcaagagaatgctgcatggcagctgggtaaatctaaccgattcaggagacaacagtggaaattgttccaagagttgctggagcaagatcagcaggtgtggatggaggagtgtgcccttagctcagtgctccaaacacatctgcgggaggaccacgagggcaccattaggggcgtcttaggaaggctgggcggtctgactgaggagagtacacggtgcgtcctgcaaggccatgacctgcttctgaggagcgcactgcgtagactggccctgaggggtaatgctctagccactctcactcagatgaggctcagtggcaagaaacatcttctccaagagctgagggagcagcgcgccctggagcagggatcctcacagtgtctggatgagcatcagtggcagctcctgagggccctggaggctcgggtcctcgaggaagcttcgagattagaagaggaagctcagcaaacacgcctgcagttgcagcagaggctccttgccgaagcacaagaggtagggcagctactgcagcagcacatggaatgcgcaatcggccaggcactcctggtacacgcgcggaatgcagcaactaagtcgagggccaaagatagagatgatttcaagcggaccttgatggaagccgctgtggaatccgtttacgtgactagcgcgggagtcagccggctggtccaggcatactaccagcagataggacgtattatggaggatcatgaggaaagaaaactgcagcatttgaagaccctgcagggtgagcgaatggagaattacaagcttaggaagaagcaggaactctccaatccctctagcggctccaggaccgccggtggtgcacacgagacatcacaggcagtgcaccagcggatgttgtctcaacagaagcgctttttagcgcaatttccagtccatcagcagatgagactgcatgctcagcagcagcaagccggagtgatggacctccttgaagcccagctcgagacccagctccaggaggccgagcagaactttatcagcgaactcgcagcactcgcgagagtgcccctcgccgagtcaaagttactcccagccaaaaggggcttactcgaaaaacccctacgcacaaagcggaaaaagccgctacctcaggaacggggcgacttgggtgttccgaacaacgaggatctggcctccggtgaccaaacttccggcagcctaagttcgaaaagactgtctcagcaagaaagcgaggccggtgattctggcaatagtaagaagatgctcaagagacgatccaatttgtag

SEQ ID NO: 186464 - DNA, 3687 bp, Artificial Sequence
  Description of Artificial Sequence: Synthetic coding sequence
atgatctggcccaaggtggagtgctgccacttcaagaccgccgtggaggccccgctgggcatgaagctggacaagaaaatggaggtgtttatcccactgtccacctctgcagcctctagtggcccttgggcccattctttgtttgcttttattcccagctggcctaagaagaacctgttcaagcgtgagagtccaatcacgcatagactatacggtgacatctcccgggaggttcagggcacttccgagaacggagttatctttcagaagtgcgctctcgtctcaggttcaagcgaggctcagaccgcgcggatatggttgctcgtgaacaataccaagaccacttcatcggccaaccttagcgaactactcctgctggactcaatcgccggcttaacgatctgggatagtgtgggaaaccgaacgtccgagggattccaggccttttcaaaaaagtttctgcaagtcggcgacgcattcgcagtatcgtatgctgctactctgcaagctggggatttggggaatggtgaaagtctgaaattacccgcccagttgacttttcagagtagctcccgaaatcgaactcaactgaaagtgctcttcagcataaccgccgaggaaaacgtgaccgtgctgccgcaccacggtctgcacgcagctggatttttcatagcattcctgctatcccttgtactcacatgggccgccctgtttctgatggttcgataccagtgcctcaagggaaacatgctgactagacaccgagtgtggcagtatgagtcaaaactggaaccactacccttcacctcagcggatggagtcaacgaggacctttccctgaatgaccagatgattgatatcttgtcatccgaggacccgggaagcatgcttcaagccctcgaagaacttgagatcgccactctgaatcgggctgatgccgatctcgaagcttgtaggactcaaatcagcaaagacatcatagcactgctgctgaaaaacctgaccagtagtgggcatttatccccacaagttgaacgtaagatgagtgctgtgttcaaaaagcaatttctcctgctcgaaaatgaaatccaggaagagtatgaccgcaaaatggtggcactcaccgcagagtgcgatctcgaaacccgcaaaaagatggagaaccaataccaacgcgagatgatggctatggaggaggctgaagaactcctgaaaagagctggagagcgcagtgctgttgagtgctcaaacctcctgagaacactgcatggactggagcaggagcacttgagaaaaagtctggcactgcagcaggaggaagacttcgccaaagcccaccgccagcttgcagtcttccagcgaaacgaattgcactccattttctttactcagattaagagcgccatcttcaagggagagcttaagcccgaggccgctaaaatgcttctccaaaattactcaaagattcaggagaacgtggaggaactgatggatttttttcaagccagtaaacgctatcacctttcgaaaaggtttgggcaccgcgaatatctggtacagaatctgcagagcagtgaaacgcgggtgcaggggttgctgagcactgccgccgctcagctgacacatctaattcagaagcatgaacgcgctggctatctcgatgaagatcagatggagatgttgctggaacgggcccagactgaagtgttttctatcaaacagaagctggataatgatttgaagcaggaaaagaagaaactccatcagaagctaatcaccaaacgccgacgagaactactgcagaaacaccgggagcagcgccgcgagcaggcctccgtgggggaggcattccgaacagttgaggacgccggccagtatctgcaccagaaaaggtccctgatggaggagcacggtgccaccctggaagagctacaggagaggttggatcaggctgccctcgatgatctccgaactcttactctaagtttgttcgagaaagctaccgatgagttgcgacgtctccagaatagtgctatgacccaggagttacttaagcgtggagttccttggctgtttctgcaacagatcttggaggagcacggcaaggagatggctgcgcgtgccgagcaattggaaggagaagaaagggacagggatcaggaaggcgtccagagtgtcagacagagactaaaagacgatgcccccgaggcagttactgaggagcaggcggagttgcggaggtgggaacacctgatattcatgaagctctgcagtagcgtgttctctctgagcgaagaggagttacttaggatgcggcaggaagtccacggatgcttcgcacagatggaccgctcactagctctgcctaagatccgcgctcgggtgttgctgcaacagtttcaaaccgcctggcgggaggcggagttcgtcaaactggatcaggcagtcgctgccccagagcttcagcagcagagcaaagtaaggaaaagccggtcaaaatccaagagtaagggagaattgctcaaaaaatgtatcgaggataagatccacctgtgcgaagaacaggcgtctgaggacctggtcgagaaggtgagaggcgagttgctgcgagaaagggtacagaggatggaggcccaagaaggtgggttcgcccaaagccttgtggcattgcagttccagaaagcctcacgggtgaccgaaactttatcagcttatacagcactactttctatacaggacctcctattggaagagttgtctgcaagcgagatgctgacaaagagtgcatgtacacagatcttagagtcgcattctcgggaactgcaggagctggaaagaaaactagaggatcagcttgtgcaacaggaagccgctcaacagcaacaagccctcgcttcctggcaacagtgggttgccgacggtcccggaattcttaacgagccgggcgaagtggacagtgagaggcaggttagcaccgtcctgcaccaggccctgtcaaaatcacagacacttctggaacagcaccagcaatgtctccgggaagaacagcagaattccgtcgtgctggaggacttgcttgaaaacatggaagccgacactttcgcgaccctctgtagtcaggagctgagactcgcatcttacctcgcgcgtatggccatggttcctggcgccactctgaggcggctcctcagcgtggtgcttccaacagccagccagccacagctgttagccttacttgacagcgccacagagagacatgtggaccatgccgccgagtcagacggaggtgccgagcaggcagatgttggaagaaggagaaagcaccagtcttggtggcaggcacttgatgggaagttgagaggtgacctgatcagtagaggactcgagaaaatgctctgggccaggaaaagaaagcagtccattcttaaaaagacatgcttaccgctcagggagaggatgatcttcagcggaaaaggatcttggccgcacctatccctggagcccattggagagcttgccccggtccctattgtgggggccgagacaatcgacctgctgaacactggagaaaagttgttcatattcagaaatccgaaggagcccgagatctctctccacgttccacctcgaaagaagaaaaatttcctcaacgctaagaaggcaatgagggcactgggcatggactag

SEQ ID NO: 186465 - DNA, 3927 bp, Artificial Sequence
  Description of Artificial Sequence: Synthetic coding sequence
atggaccccagcggcagccggggccggcccacctgggtgctggccggtggtctgctcgctgttgcccttgcgctcgggggacgaggatgtctgggcgcgtcttcaagaccccggtggcgtccacttggagcccaacctccccgcgatccccaggtcgctcctcgctctggaccaggactgaggatccctcctggcagatctggggcagggcctgagtcctccacgcaggacctaccttgtatgatatggcctaaggtcgagtgttgccactttaaaacagccgttgaagccccgctcggcatgaagctggataaaaaaatggaagtttttatccccctctccacgtctgcagccagctccggcccttgggcacactccttgtttgccttcattccaagttggcctaaaaagaacctctttaaacgcgagagtcctatcacacatagattatatggtgacattagtcgcgaggtccagggaaccagcgaaaatggagtcatattccagaaatgcgctctggtctccggcagttccgaggcccagactgcacgaatctggcttttggttaataacaccaagaccacttcatctgctaacttgtcagaactgctcctgctggactccatcgctgggctcactatctgggacagtgtagggaatcgtaccagtgaaggtttccaggcctttagtaagaagttcctgcaggtgggtgacgcattcgccgtttcatatgctgccaccctccaagctggggatctcgggaacggagaaagtctcaaactgcctgcccagctgacattccagtcatcttctcgaaacagaacccagctgaaggtgttgttctctattacagccgaggagaatgttacagtacttccccatcacggtttacatgccgccggcttcttcatcgctttccttctttccctggtgcttacctgggccgctctatttctgatggtgcgctatcagtgtctgaaaggaaacatgcttaccaggcacagggtgtggcagtacgaatctaaactggagccgctgccctttaccagcgcggatggtgtgaacgaagacttgagtctgaacgaccagatgatagatatcctgtcttccgaagatcccggcagcatgctccaggccctcgaagaactggagatcgcgaccctgaaccgcgcggatgccgatctggaagcctgccgcacacagatctcaaaagatattatcgccttactgctcaagaatttaacctctagtggccacctgtcgcctcaggtggagcgcaagatgtccgctgtcttcaaaaagcagtttcttctgttggagaatgaaatacaggaggagtacgatcgtaagatggttgccctaacagctgagtgcgatctcgagaccaggaagaaaatggaaaatcagtatcagagagaaatgatggcaatggaggaagctgaggagctgctgaagcgcgcaggggaacgctctgccgtggaatgcagtaatctcttgcggacgttacatggtctcgagcaggagcacttgcggaagtctttagccctacagcaagaagaggactttgctaaggctcacagacaacttgccgtgtttcagcgcaatgaactgcattctattttctttacccagatcaagtcagctatttttaagggcgaacttaaacctgaggcagctaagatgctcctgcagaattattcaaagatccaggagaacgtggaagaactaatggatttctttcaggcaagcaagagatatcacttgtccaagaggtttggacatcgtgagtacctcgtgcagaatttgcaaagctcagaaactagggtccagggactgctgagcacggctgctgcgcaactgactcacctgatacaaaagcatgagagggctgggtatttggatgaggatcagatggagatgctattagagcgggcacagactgaggtcttctcaattaagcagaaattggacaacgacctcaagcaggaaaagaaaaagcttcaccaaaaactgataacaaagaggcgcagggaactgcttcaaaagcatcgcgagcaacgtcgtgagcaagccagcgtcggggaggcatttaggaccgtggaagatgccggccagtatctgcaccaaaagagaagcctaatggaagagcacggtgcaacgttggaagaactacaggaacggctagaccaagccgccctggatgatctgagaactctgaccctgagcctgtttgaaaaagccactgacgaacttcgtaggctgcagaatagtgctatgacccaggaacttctaaagaggggtgtcccctggctgtttttgcagcagatccttgaggaacatgggaaagaaatggctgcccgcgcagagcagctcgagggagaggagcgcgatagagatcaggaaggggtgcaaagtgtgaggcagcgcctaaaagacgacgcccccgaagccgtgactgaagagcaggctgagcttcgccggtgggagcatttgatcttcatgaagttatgcagttcagtgtttagtctgagcgaggaagagctccttcgtatgaggcaggaggtgcacgggtgtttcgcccagatggaccgtagccttgctttacctaaaattagggcaagggtgctgctccagcagttccagacagcgtggcgagaggcagaatttgtcaaacttgatcaggcagtggcagcccctgaactgcagcagcaatccaaagtcagaaagtcccgctccaaatctaagagtaaaggagagttgctcaaaaagtgcattgaggataagatccacttatgcgaagagcaggcctcagaggaccttgtggagaaagttagaggggaactgttacgggagagggtgcaacggatggaggcccaggagggggggttcgcccagagcctggttgccctacaatttcagaaagcatcacgggtcaccgagacactctctgcttacacagcccttctttcaatccaggatctgctcctggaagagctatcagcttccgagatgctgaccaaaagcgcgtgtacgcaaatcctcgaaagtcattctcgggagctacaagaactggagagaaaattggaggaccagctagtgcagcaggaagccgcacagcagcagcaggcactggccagttggcagcagtgggtcgcagacgggcctggaatcctaaacgagcccggcgaggtggacagcgagaggcaggttagtaccgtcctgcaccaggctctctccaaatctcagaccctgttggagcagcaccagcagtgcctgagggaagaacaacaaaactccgtcgtcttagaagatctcctagaaaatatggaagccgatacgtttgccaccctatgtagtcaggaactgcgcctcgcgtcttatctggcgaggatggctatggtgcccggggctaccttgcgcagactactgagcgtggtacttcccacagcgagtcagcctcagcttcttgccctgctggactccgccaccgaacgtcatgtggaccatgccgcggagtctgatggaggtgccgagcaagccgacgtcggacggcggagaaagcaccagtcgtggtggcaggccctggatgggaagcttcggggggacttgatatctagaggcctcgaaaagatgctctgggcccggaagaggaaacagtccatcctgaagaagacttgtctacccctgcgggagcgaatgatattttcagggaaagggagctggccgcacctttcattagaacccatcggagagctggccccggttccaatagtcggagcagagaccatcgatcttttgaatactggggaaaaattgtttattttccgcaatcccaaggagccagagatttcactgcatgtccctccaagaaagaagaagaattttctcaatgctaagaaagctatgcgggccctggggatggactag

SEQ ID NO: 186466 - DNA, 3741 bp, Artificial Sequence
  Description of Artificial Sequence: Synthetic coding sequence
atggaccccagcggcagccggggccggcccacctgggtgctggccggagggctgctggcagtcgctcttgctctgggaggaagaggatgtctcggagccagctctagacctcgatggcgacctctgggtgcccaacccccaagagacccgcaggtggcaccccgctccggacctggacttcgaattccacctggcagatcaggggcagggccggaaagtagtacccaggacctaccatgtatgatctggcccaaagtggaatgctgtcattttaaaaccgccgtggaagcccctctgggcatgaagctggataaaaaaatggaggttttcatccccctttctacttcagccgcaagctccggcccgtgggcccatagtctgttcgcctttataccgtcctggcccaaaaagaacctctttaaacgagagtctcctatcacacaccgcctgtatggtgatatctcacgggaggtgcagggaactagcgagaacggcgtcatattccaaaaatgcgccctggtaagcggctccagcgaggcacaaacagccagaatctggttactggtcaataatacaaagaccacatcctctgctaaccttagcgagctcttgctcctggattcaattgccggactcaccatatgggatagcgtgggaaaccgtacctctgagggattccaagcattttccaaaaagttcctgcaggtgggggatgcgttcgctgtgagttacgccgcaactcttcaagccggagatctggggaatggcgagtcccttaaactccctgcccagttgaccttccagagctcgtcccgcaacaggacacagttgaaagtgctttttagcattaccgccgaagaaaatgtgacagtcttgcctcaccacgggcttcacgcagccggattcttcattgcctttctgttgtcccttgtccttacctgggccgcactcttcctcatggtccgctaccaatgcctgaagggaaatatgttaacgagacatagagtctggcagtatgaaagtaagctggagcctctaccatttaccagtgccgacggcgtgaacgaagatctgagcctcaacgatcagatgatcgacatcctgagctccgaagatcccgggtctatgctccaggcacttgaagaactcgagatcgccacgcttaaccgcgctgacgctgatctagaagcctgccgaacccagatcagcaaagacattattgcgcttcttcttaagaatctcacgtctagcggtcacctgagcccccaggtggagagaaaaatgtccgcagtttttaagaagcagttcctgctgctggagaatgagattcaggaagaatacgacagaaaaatggtggctcttaccgccgaatgcgatctggagaccagaaagaagatggaaaatcaatatcagcgcgaaatgatggcgatggaagaagccgaggaattgctgaagcgggctggcgagcgcagcgctgtggagtgctctaacttattgaggacacttcacgggctggaacaagagcacttgaggaagagcctggcactccagcaggaggaggattttgccaaggcccatcgacaactggcagtgtttcaacggaatgaactgcactctatatttttcactcagatcaagagtgcaatctttaagggtgaattgaagccagaggccgcaaaaatgttgcttcagaactactccaaaatacaagaaaatgtcgaggaactaatggactttttccaggccagcaagaggtaccatttgtctaagcgctttggccaccgcgagtacttagttcaaaatctgcagagttccgagaccagggtgcaggggctgctgtctactgcggcggcgcagctgacgcatctgattcagaaacatgaaagagccgggtaccttgatgaagatcagatggaaatgctcctcgagagggcccagacagaggtgttcagtatcaagcaaaaactcgacaacgacctgaaacaggaaaagaaaaaacttcatcagaagctcattaccaagcgacggagagaactgctgcagaagcaccgggagcagcgaagagagcaggcaagcgtgggggaggcattcagaacggtagaagatgccgggcaatacctgcatcaaaaaagaagtctgatggaggagcacggggctaccctggaagagctgcaggagcgacttgatcaggcagctcttgacgacctgcgaacactgaccctgtccctttttgagaaggctacagacgaactccgccgcctccaaaattctgccatgactcaggagctgctaaagcgtggagttccttggctgttcctacagcagatccttgaagaacacggcaaagaaatggccgcccgtgccgaacagttggaaggagaagagcgggacagggaccaggaaggcgttcagagtgtgcggcagcgcctcaaggacgacgcacctgaggctgtgactgaagaacaggccgaacttcggcggtgggagcacttgattttcatgaaattgtgttcatctgtgtttagcctgagcgaggaggaacttcttcgcatgcgccaggaagttcacggatgcttcgcccagatggaccgctccttggccctcccaaagatccgggcacgcgttttattgcagcagttccagacggcctggagggaggctgagttcgtgaaattggaccaggccgtggcagccccagaactgcagcagcagtccaaggtcaggaaatcccgttcaaaaagtaagtctaaaggtgagctgctcaagaaatgtattgaggataaaatacatctatgcgaagagcaagcttccgaggatctggtggagaaagtgcgcggtgaactgctacgggaacgcgtccagcgcatggaggcacaagagggcggcttcgcacagagccttgtggctctccagttccagaaggcctcaagagtaactgagacgttgagcgcatacacagccttgctttcaatccaggacctcctgctggaagagcttagtgccagtgagatgctgaccaagagcgcctgcacacagatactagagtctcactctagagaattgcaagaactggagcgcaaactggaagatcaattagttcagcaggaggccgcgcaacaacagcaagccctggcatcctggcagcagtgggtggcggacggcccaggtatactaaatgagcccggtgaggtggactcagaacgacaagtcagcacagtcctccatcaagcattaagcaagagtcagactctacttgaacagcatcagcagtgccttcgggaagagcaacagaacagtgtggtgctggaggatctgcttgaaaatatggaggccgacaccttcgccactttgtgtagtcaggagttaagattagccagctatctcgcccgcatggccatggtgccaggcgctacattacgtcgactgctttccgtggtcctccccacagcctctcaaccacaactgctggctcttctggactcagctactgagaggcacgtggatcatgcagccgagagcgacgggggcgccgagcaggctgatgttgggagacgacgaaaacaccagtcctggtggcaagccctcgatggcaaacttagaggcgatctgattagtagagggctggaaaagatgttatgggcccggaaacgcaagcagagatccggtaatcaagagtcattctggcaatacctggtgggtactccagaaattgggctgattgaatggatgagtgagaaatag

SEQ ID NO: 186467 - DNA, 882 bp, Artificial Sequence
  Description of Artificial Sequence: Synthetic coding sequence
atgttcatcagcctgtgggagttcttctacggccacttcttccggttctggatgaaatggttactgaggcagatgactggtaaatgcgaactgcagcgaatcttcgatacttatgtgggcgctcagcggacacacaggattgagaacagcttgacctatagcaaaaataaggttctgcaaaaggcaacccatgtggtgcagtctgaggttgacaagtacgtcgacgatatcatgaaagaaaagaacattaatccggagaaggacgcttcttttaagatctgtatgaagatgtgcctgctccagatcactggatataaacagctgtatctggacgtggaaagcgtccgcaagagaccttacgatagcgacaatctgcaacacgaagaactgctcatgaagctctggaacttactcatgccaacaaagaagttgaatgctcgaatttcaaagcagtgggctgagatcggatttcagggcgacgaccccaagacagacttccgagggatgggtatactggggctgattaacctggtgtattttagcgaaaattacaccagcgaggcgcaccagatactctcaagatcaaatcatcccaagttggggtactcttatgccatcgtcggaattaacctgacggagatggcctactccctgctgaagagcgaggctcttaagtttcacttatataatttggtgcccgggattccaacaatggaacactttcatcagttctactgctacttagtgtacgagttcgataagttctggtttgaggaggagcccgagtctataatgtacttcaatctgtatagggaaaaattccacgagaaaataaagggtctgctgctcgattgcaatgtggcactgaccctcaaggtttag

SEQ ID NO: 186468 - DNA, 507 bp, Artificial Sequence
  Description of Artificial Sequence: Synthetic coding sequence
atgttcatcagcctgtgggagttcttctacggccacttcttccggttctggatgaagtggttgttgcgccagatgacaggcaagtgcgagcttcagcggatcttcgacacttatgtgggggcacagagaacccaccggatcgagaacagtctcacctatagtaaaaacaaggtgttgcagaaggcgacacatgtggtccaatctgaagtggacaagtatgtagacgacatcatgaaggaaaaaaatatcaaccctgaaaaagatgctagttttaaaatctgcatgaagatgtgtttgctccaaattacagggtataagcagttatacttggacgttgagagcgttaggaagaggccttatgatagtgataatttacagcatgaagagttactaatgaagctctggaacttgctcatgcccaccaagaaattaaacgcgagaatctcaaagcaatgggctgagattggcttccagggagatgatccaaagacagatttcaggggatag

SEQ ID NO: 186469 - DNA, 108 bp, Artificial Sequence
  Description of Artificial Sequence: Synthetic coding sequence
atgttcatcagcctgtgggagttcttctacggccacttcttccggttctggatgaagtggctgctccggcagatgacaggaaagtgtgagcttcagaggatcttctag

SEQ ID NO: 186470 - DNA, 1866 bp, Artificial Sequence
  Description of Artificial Sequence: Synthetic coding sequence
atggccgccctgaaggaggaccggagctacggcctgagctgcggccgtgtctctgacggtagcaaggtctccgtttttcacgtgaaactcactgactcagctctgagggcttttgagtcttaccgggctagacaagactccgtatccctgcggcctagcatcaggtttcagggtagccaggggcacattagcatacctcagcctgactgccccgctgaagcacggacattttcattctacctctccaatattgggcgggacaacccacaaggaagctttgattgtattcagcagtatgtgtcatcacatggggaagtgcatttggattgtctggggagcatccaagataagatcacagtgtgtgcgacggatgactcttaccagaaagcgagacagagcatggcacaggctgaggaggagactaggtcccggtctgcaattgttatcaaggccggcggcaggtatttaggcaaaaaagtgcagttccgcaagccagctccaggcgccaccgatgcagtcccctcccggaagagagccacacccatcaacctggctagcgccatcaggaagagcggggccagcgccgtgagtggcggatctggagttagccaacgtccatttagagatcgcgtacttcacctgctcgcattgcgaccatacaggaaggccgagctgctcctgagactgcagaaagatggccttacccaggccgataaggacgctctggacggattactccaacaggtggctaatatgagtgcgaaagacggaacatgtaccctacaggactgcatgtacaaagatgtgcagaaggattggcccggctattccgagggagaccaacagctgttaaagcgcgtgctggtaagaaagctgtgtcagccccagtccaccgggagtttgctaggcgatccagccgcttcttctccacccggagagcgaggcaggtcggcgtcacctccccagaaaagactccaaccgccagatttcattgacccccttgctaacaaaaaaccgcggatctcccattttacccagcgggctcagcccgctgttaacgggaaactcggcgtgcctaatggaagagaggccctgttaccaaccccaggaccccctgcctccaccgacacactttctagcagcactcatctgccccccagactggagccacccagggcccacgacccgctggctgacgtgtccaatgatcttgggcattcgggcagagattgtgagcacggcgaggccgccgcccctgccccaacggtgagactcggactccctttgcttaccgattgtgctcagcccagcaggccacacggctcaccgtcccgcagcaagccaaaaaagaagtctaagaaacacaaagataaggaacgggcagcagaggacaagccaagagctcagctgcctgattgcgcacctgcaactcacgcaacgccgggggctcctgcagatacccccgggttgaacggcacttgctctgtgtccagcgtgcccacctcgacctcagaaactcccgactatctcctcaagtatgcagctatatcgtccagtgagcagcggcagtcctacaaaaatgatttcaatgccgaatactctgagtatcgcgatctccatgccaggatcgagcggattacccggcggtttacgcagctggacgcgcaattgagacagctgtcacagggtagcgaagaatacgaaacaacacggggccagattctgcaggaatatcggaagattaagaaaaccaacaccaattactcgcaggaaaagcatagatgtgagtacctacatagtaaactggctcacatcaaacgcttaatagctgagtacgaccagagacaactgcaggcgtggccgtag

SEQ ID NO: 186471 - DNA, 90 bp, Artificial Sequence
  Description of Artificial Sequence: Synthetic coding sequence
atccaccggctggtggtggccttccaggacagcgtgagcctgcggccttccatcagatttcaagggtcccaaggtgaaatgtctctgtag

SEQ ID NO: 186472 - DNA, 1194 bp, Artificial Sequence
  Description of Artificial Sequence: Synthetic coding sequence
atggaggagctgcaggagcccctgcggggccagctgcggctgtgctttacgcaggccgctcggactagcttgctgcttctgcgcctgaacgatgctgcattacgggccctacaggaatgccagcggcaacaggtgaggccagtgatcgcattccagggccacagggggtacctaagattacctggtccggggtggtcatgccttttcagttttatcgtatctcagtgctgtcaagagggggccgggggcagcttggatcttgtatgccagaggttcctccgatctgggccaaatagcctccactgcctcggttcccttcgcgaacgcctcattatatgggccgctatggactctattcctgccccatccagtgtacagggtcataacctgacagaagacgcccgccacccagagtcctggcagaacaccgggggatattctgaaggcgacgccgtgagtcagccacaaatggcactcgaggaggtttctgtgtctgatccactggcgagcaaccaggggcaaagtctccccggatcctccagggagcatatggcccaatgggaagttaggagtcagacacatgtgcctaatcgtgaaccagtccaggctcttccatcttctgccagcagaaaaaggctggacaaaaaaagaagcgtgccagttgccacagttgagctggaagagaagcgcttcaggacgttacctctggttcctagcccactgcagggcctgacaaaccaagacctgcaggagggcgaggattgggagcaggaagacgaggacatggacccccgtctggagcacagctctagcgtccaggaagacagcgagtccccatctccagaggatattccggattacttattacagtatcgagccatccactcggctgaacagcagcacgcatatgaacaggatttcgaaacagactatgccgagtaccgcatccttcacgccagggtgggaactgcctctcagcgctttattgaactgggtgctgaaatcaagagagttaggcggggaaccccggagtacaaagtgctcgaagataagatcatccaggaatacaagaagtttcggaaacagtacccaagctacagggaggagaagcggcgttgcgagtacctgcatcagaagctgtcacatatcaaaggccttatcctggagttcgaggagaagaatcgcggctcatag

SEQ ID NO: 186473 - DNA, 2889 bp, Artificial Sequence
  Description of Artificial Sequence: Synthetic coding sequence
atggacaccgacctgtacgacgagttcggcaactacatcggccccgaactggacagtgacgaggacgacgatgaactcgggagagagaccaaggatctcgacgaaatggacgacgatgacgacgacgatgatgtgggcgaccacgacgatgatcaccctgggatggaggtggtactgcacgaggtttacggccccgaagttgaaaccatcgtgcaagaggaagacacccaacctttgaccgagccaattattaagcctgtcaagaccaagaagttcactctgatggaacagaccctcccagtgacagtctatgagatggactttctggccgacctgatggacaacagcgagctcattcgcaacgtaaccctatgtggccatctgcatcacggcaagacttgttttgttgattgtttaatcgaacagactcatccagagatccgtaaacggtacgatcaggacctgtgttacacagacatcctgttcacagaacaggagcgcggggtggggatcaaatccacacctgtcactgtggtgcttcccgacactaaggggaaaagctacctgtttaatatcatggataccccggggcacgttaatttttcggatgaggtgacggcagggctgcgtatctcagacggggttgtcctgttcatcgatgccgccgaaggtgtgatgcttaatacagaacggcttattaagcatgccgtgcaggagaggctggcagtgacagtgtgcataaacaaaattgataggctaatcctggaactgaagctgccacccaccgatgcatattataagttgcgacacattgttgatgaggtgaatggcctaatttctatgtattcaaccgacgaaaatctcatactgtcgcccttacttggaaacgtttgcttttcatcctctcagtattccatatgttttaccttaggtagctttgcgaagatttacgcggacacattcggtgatatcaactatcaggaattcgctaagcgcctgtggggggatatctatttcaacccaaagaccaggaagtttaccaaaaaggccccgacaagcagctcccaaagatccttcgtggagttcatacttgagccactttataagatactggcgcaggtggtgggggacgtggatacgtctctcccgcgcactctggacgagctcggtattcatttaaccaaggaagaacttaaactaaatattcgaccacttctgaggttagtgtgtaagaaattttttggagagtttactgggttcgttgacatgtgtgtgcagcacatcccctcccccaaggtgggagcaaaacccaaaatcgagcatacctacactgggggtgtggatagcgatctgggcgaggcgatgtctgattgtgatcctgacggacccctaatgtgccacactacgaagatgtacagcacagatgacggcgttcagttccacgcttttggacgagttctcagcggaaccatacacgcaggccagccagtgaaggtattgggagaaaattacaccctggaagacgaagaggattctcaaatttgtacagtgggtcgactgtggatttcagttgccaggtatcatatagaggtcaaccgcgtccctgcggggaattgggttctcatcgagggagtggaccagccaattgtgaaaacagccaccattacagaaccacgtgggaatgaggaagctcagatcttccgtcccttgaagtttaacacaacctccgtaattaagattgcagtcgagcctgttaatccctccgaattgcctaagatgcttgacggtctgaggaaagtgaacaaatcttatcctagtctcactacaaaagtcgaggagtcaggcgaacacgtcatcctgggaaccggtgagttgtaccttgactgcgtgatgcacgacctgaggaagatgtattccgagatcgatataaaggtcgccgatcccgttgttactttctgcgagaccgtggtggaaacttctagtttaaaatgtttcgccgagacccccaacaagaagaacaagatcaccatgatagcggagccacttgagaagggtctggctgaggacatagaaaatgaggttgttcaaattacctggaacaggaagaagctaggggagttcttccagaccaaatacgattgggatttgctggcggcacggtctatttgggcatttgggcctgatgcaacaggccccaacatcttagtcgatgacaccctgcctagcgaagttgacaaagctcttctgggctctgtcaaagattcgattgtacagggattccaatggggaacccgtgaggggcccctttgtgatgaattgattaggaacgtcaaatttaaaatcctggatgcggtcgttgcccaggaacctcttcatcgcggcggcggtcaaatcatccctaccgcccgacgtgtcgtctactccgcattcctgatggccacaccacggctaatggaaccttattactttgtggaggtgcaggcacccgctgactgcgtttctgccgtctataccgtgttagctagacggaggggccatgtcacccaggacgcccccataccgggaagtcccctgtacactatcaaagcctttatccccgcgatagactcctttggctttgagacagatcttaggacccatacccagggccaagcctttagcctatccgtttttcaccattggcagatcgttcccggtgacccactggacaagtctattgtaatcaggcctctagaaccacagccagctccacatttagcccgcgaattcatgataaaaaccagacggagaaagggtttgtctgaagatgtgagcattagcaaattttttgatgaccctatgttgctcgagctagccaaacaagacgtggttctgaattaccccatgtag

SEQ ID NO: 186474 - DNA, 2814 bp, Artificial Sequence
  Description of Artificial Sequence: Synthetic coding sequence
atggacgacgacgacgacgacgacgacgtgggcgaccacgacgacgaccatcccggcatggaagtcgttctccatgaagacaaaaaatactatccaactgcggaagaggtctacgggcctgaggtggagacaattgtgcaagaggaggatactcagcctttaacggagccaataatcaaacctgttaaaaccaaaaaattcaccttgatggaacagacactgccagtcactgtgtacgaaatggattttctcgccgatctgatggacaattctgagctgattcgaaacgtaacgctctgcggacacctccatcacgggaagacttgttttgtggactgcttgattgaacaaacccatccagaaattcggaaaagatatgaccaggacctctgctacactgacattctgtttactgaacaggaaaggggggtggggatcaaatccacccccgtgactgtggtcttacctgacacgaaaggcaagagttatttgttcaatattatggacaccccgggccacgtgaacttctcggatgaggtgaccgccgggctgagaatttccgatggtgtcgtgctcttcatcgatgccgccgaaggagtcatgttgaatacggaaagactgatcaaacatgctgtacaggaacgacttgcagttacagtttgtataaacaaaatcgaccggctgatcctcgaattgaagctgcctccaaccgatgcttattacaaactgcgacacatagtggacgaggtcaatggacttattagtatgtatagcacagacgaaaatttgatcttgtcacccctgctcggcaacgtgtgcttttcctctagccagtattccatttgttttaccttgggatcgtttgcaaaaatttatgccgacacttttggcgatattaactaccaggagtttgcaaaacggctgtggggcgatatttactttaaccctaagaccagaaaatttacgaagaaggcacccacatccagctctcagcgatctttcgtggaatttatcctggaacccctatacaagattctcgcacaggtggtgggagatgtggacacttccctcccgaggactttggatgagctgggaattcaccttacgaaagaggaactgaaactaaatattagaccactcttgcgcctggtgtgcaagaaattttttggcgagtttactgggttcgtcgacatgtgtgtccagcacattccgtcccccaaggttggagccaaacccaagatcgagcatacatacacaggtggcgtggactctgacttgggcgaggctatgagtgattgtgaccctgacggcccattgatgtgtcacaccacaaaaatgtacagcacagatgatggagtgcagtttcacgctttcggccgagtgctcagtggcacaatccatgccggacagcccgtgaaggtcttaggtgaaaactatacgctcgaagatgaggaagatagccaaatctgcaccgttgggcgattgtggatcagcgtggctcgttatcacatcgaagtgaatagggtgcccgctgggaactgggtcctgattgagggagtggaccaacccatagtgaagaccgccaccatcactgagccccggggcaacgaagaagcgcaaatctttcgcccactgaaatttaacacaacctcggtgataaagattgccgtcgagccagtgaatccaagtgagcttcctaagatgctggacggcttaagaaaagtgaacaaatcctaccccagcctgactacaaaggttgaggaatccggcgagcatgtcattctagggactggggaactctaccttgattgtgtgatgcatgacctgagaaaaatgtactccgagatcgacatcaaggtggccgatccagtggttactttctgcgaaacagtagttgagaccagcagcctcaagtgtttcgccgagacccccaacaagaaaaataagatcaccatgatcgctgagcctctggaaaagggtctagcagaagatatcgagaatgaagtagtgcagatcacgtggaatagaaagaagttgggggaatttttccagacaaaatacgattgggacctcttggccgcacgaagcatttgggcctttggaccagacgccacaggaccgaacatcctggttgatgataccctgccatcagaagtggacaaagcactgctgggcagcgtgaaagactcaattgtacaggggtttcagtgggggactagagaaggaccgctctgcgacgagctgataagaaatgtcaaattcaaaattttagatgcagtcgtagctcaggaaccactgcaccgggggggcggccagatcatcccaaccgcacgacgagtcgtttactccgcattcctgatggccacccctcgcttgatggagccatattacttcgtcgaggtgcaggccccagctgactgcgtgtcagctgtgtataccgtcctggcacgtagacgagggcatgttacccaggacgcaccaatccccggcagtccgctgtatactattaaagccttcattcctgccatcgatagctttggtttcgagaccgatcttcgcacgcatacgcaaggccaagccttctcactctccgtgttccatcactggcagatcgtgcccggagaccctctggataagtctatcgtgattcgccctctagaaccccaaccagctccccatttagcacgggaatttatgattaagacacgaagaagaaaagggctgagcgaggacgtctctatctcaaagttctttgacgaccccatgctgctcgaactggccaagcaggatgtggttctcaattatccgatgtag

SEQ ID NO: 186475 - DNA, 2919 bp, Artificial Sequence
  Description of Artificial Sequence: Synthetic coding sequence
atggacaccgacctgtacgacgagttcggcaactacatcggccccgagcttgattctgatgaagatgacgacgagttaggtcgagaaactaaggaccttgacgagatggatgatgacgatgatgatgacgatgtaggtgaccacgatgatgaccacccagggatggaagtggtgcttcacgaagataagaaatattatcccacggccgaggaggtttacgggccagaggtcgagactattgttcaagaagaagacacgcaaccattgacggagcccattataaagccagtcaaaacaaaaaagtttactctcatggaacagacactgcccgttactgtgtacgagatggattttctagctgacctaatggacaactctgagttgatccggaacgttacattatgcggccatctccaccatggaaaaacctgtttcgtggattgtttaattgagcagacgcaccctgagattagaaagcgctatgatcaggacttgtgctatactgacatactgttcacagaacaagaacgcggcgtggggatcaaaagtacccctgtgaccgtggttctcccggataccaaggggaaaagctacctctttaatattatggacacaccggggcatgtgaacttcagcgacgaagtgacagccggactgcggattagcgatggagtggtgctcttcattgacgccgctgagggggttatgctgaataccgaacgactgatcaagcacgccgttcaggagcggttggctgttaccgtttgcatcaataagattgataggctaatcctcgagttaaagttgcctccaaccgacgcttactacaaactcagacacattgtcgatgaggtgaacggccttattagtatgtacagtaccgatgaaaacctgatactgagtcctctactgggtaatgtgtgcttcagcagctcacagtacagcatttgctttaccttaggatccttcgctaaaatttacgccgatacattcggagatatcaactatcaggaattcgctaagcgactttggggcgatatttacttcaacccaaagacaagaaagttcaccaagaaagcaccaacgtccagctcccagcgctctttcgttgaattcattctagagcccctgtataaaatcctcgctcaggttgtgggtgacgtggacacaagtttgccgagaacccttgatgagttgggcatccatctgactaaagaggagctaaagctgaacatccggccactactacgcttggtatgtaagaaatttttcggcgagttcaccgggttcgtggacatgtgtgtgcagcatattccgtcaccgaaagtcggagcgaaacctaagattgaacacacctataccgggggcgtagactccgatcttggcgaggccatgtctgactgcgatcccgacggaccactgatgtgccatacaacgaagatgtattcaaccgacgacggcgtgcaattccatgcttttggcagggtgctgagcggaaccattcacgccggacagccggtcaaggtgctaggcgaaaactatacattggaggacgaggaggattcacaaatttgcactgtgggccggctttggatttccgtcgctcgctatcatatcgaggtgaatcgggtgcccgctggtaactgggtactgattgagggggttgaccaacccatagtgaagacggccacgattaccgaaccccgcggcaatgaagaagctcaaatatttcgacccctgaagttcaatactacgagtgtaatcaagatcgcagtggaacctgtgaacccatctgaacttccaaagatgctggatgggctgcgcaaggtgaacaagagctacccctctctgacaactaaagtagaggagagtggcgagcacgtgatcctagggacaggtgaactttatctcgattgcgtcatgcacgacctacgcaaaatgtattcggagatagatataaaagtggcagatcccgtggtcactttttgtgagactgtagtagaaaccagttctcttaagtgtttcgcagagacccctaataagaaaaacaagatcacaatgattgcagaaccgctagaaaagggactggccgaagacattgagaatgaggtggtgcagataacatggaataggaaaaagctgggtgaattttttcaaacaaagtacgattgggacctactagccgccaggtctatttgggctttcgggccagatgccaccgggccaaatatactggtagacgatactctgccgagtgaagtggataaggccctcctggggtctgtgaaagactctatcgtgcaggggtttcaatggggtacccgggaggggccgttgtgtgacgaactgattcgcaatgttaagttcaagattctggacgccgtggtggctcaggaaccactgcacaggggaggaggacagattattccaactgccaggagggtggtctactcagcctttctgatggctaccccccgtctcatggaaccctactacttcgttgaggtgcaggctcctgccgactgtgttagcgcagtatacacagtcctcgctcggcgtcggggacatgttacccaagacgcacctatccccgggagtcccctctatactatcaaggcgtttatcccggcaatcgacagctttggcttcgaaactgacctgcggacccacacacagggtcaagccttttccctgtccgtgtttcaccattggcagatcgtccctggtgatccactcgataaatctatcgttatccgaccgctggaaccgcagcccgcgccccaccttgctagagaattcatgattaaaaccagacggcgtaaaggcctttctgaagatgtgagtataagcaagttcttcgacgatcctatgctgctggagttggctaagcaggacgttgtgcttaattaccctatgtag

SEQ ID NO: 186476 - DNA, 1923 bp, Artificial Sequence
  Description of Artificial Sequence: Synthetic coding sequence
atggccgccggcggcaccggcggcctgcgggaggagcagcggtacggcctgagttgtggtaggctaggccaagacaacattaccgttctgcacgtgaagctgacagagaccgccataagagccctcgagacctaccagtcccataagaatctgatcccatttcgcccgtctatccaattccagggtctgcacggcctggtgaaaatccccaagaacgacccacttaatgaggtgcataactttaatttctatttatccaatgtagggaaggataaccctcaaggtagttttgattgcattcaacagacgttttcttcatctggagccagtcagttgaattgcttgggtttcattcaagataagatcactgtgtgtgccacaaacgatagctatcagatgacccgggaacgtatgacccaagcagaggaagagtctcgcaacagatcgaccaaggtgatcaagccaggagggccgtacgtgggcaagagggtgcagatccggaaagccccccaggcagtaagtgatacagtgcccgagcgcaaaagatccacacccatgaacccagccaacactatcagaaaaacccatagttcttctaccataagccagcgaccttaccgggaccgcgttatccatctcctcgcgctgaaagcttataagaagccagaactcctggctcgcctgcagaaggatggcgttaatcaaaaagacaagaattctttgggcgccattctacagcaagtggcgaatctgaatagcaaagatctttcttatactttaaaggattatgttttcaaagagctgcagcgcgattggccaggatatagcgagatcgacaggagatccctggaatccgtgttatctaggaaactaaacccctcccagaatgctgctgggacctctagatctgagagcccggtgtgctcttctcgggacgccgtgtcctcaccccaaaagaggctgttggatagtgaattcattgatcctctgatgaacaagaaagcccgcattagccacctgaccaatcgggttcctccaaccctaaacgggcatcttaatcccaccagcgagaaaagcgcggccggcctcccccttcccccagctgccgccgcgatacctaccccccctcctctcccctctacctatctgccaatttcacatccaccccagatcgtcaactctaatagcaactcaccttctactcccgaagggcgaggcactcaggatctgccagtagactcgtttagtcagaatgatagcatttatgaagatcaacaggataaatacacatctaggacatccctcgaaaccctccctcccgggtctgtcttgctgaagtgtcctaagcccatggaggaaaaccatagcatgagtcacaagaagtctaaaaaaaagtccaagaaacacaaggaaaaagaccaaattaagaagcatgacatcgaaaccattgaggaaaaggaagaagacctgaaacgggaggaggagattgccaaactgaacaattcttcaccaaatagttctggaggggtgaaagaggattgcacggcctccatggaaccctccgccattgagctgcccgattacctgattaagtatatcgccattgtgagttacgaacagcgccagaattacaaggacgacttcaacgccgagtatgacgagtatagagccttgcacgcccggatggagactgtggcacgcaggtttataaaactggacgcccagcggaagcggctgagtccagggtctaaagagtaccagaacgtgcacgaggaagtgctgcaagaataccagaagatcaaacaatcctcccctaattaccacgaggagaaatacaggtgcgagtatctgcataacaagctggctcatatcaagcggctaataggagagttcgatcagcaacaggcagagtcatggagctag

SEQ ID NO: 186477 - DNA, 1173 bp, Artificial Sequence
  Description of Artificial Sequence: Synthetic coding sequence
atggccgccggcggcaccggcggcctgcgggaggagcagcggtacggcctctcgtgcggccgcctcggccaggataatataaccgtcctccatgtgaaactcaccgaaacagcaattagggctctggagacataccaatcccacaaaaacctgatcccctttcgaccaagcatccaattccagggcctccatggcctggttaaaattccaaaaaatgatcctctgaatgaggtgcataactttaatttctatctttctaacgtgggaaaggataatccccagggctccttcgactgcatccagcagacattttcctcttcaggggcgagtcagcttaactgccttgggtttatacaggataagattacggtgtgcgctacaaacgattcataccagatgacccgggaaaggatgacacaaattgtgaactccaactctaattcaccaagcacacctgaggggagagggacacaggacctcccagtggactccttttcccaaaacgattctatttatgaggaccagcaggacaaatacacatcgaggacatccctagaaacactgccccctggttccgtgttattgaaatgccctaagccaatggaggaaaatcacagtatgagccacaagaagagcaaaaagaaaagtaagaaacataaggagaaagatcagattaaaaagcatgatatcgaaacgattgaagagaaggaggaagaccttaagagggaggaagaaatcgccaagctcaacaatagttcaccaaacagcagcggtggtgtgaaagaggattgtaccgcttccatggagccttctgcaatagagctgccagactacctcataaagtacattgccattgtcagttatgagcagagacagaattacaaggatgatttcaacgcggaatatgatgaatacagggcattgcacgcaaggatggaaactgtggctagacggtttataaagctggatgctcaaaggaagagactttcccccgggtctaaggaataccagaatgttcatgaagaggtcctccaggagtaccagaaaattaagcaaagcagcccaaattaccacgaggaaaagtatcggtgcgaatacttgcacaacaaacttgcacacatcaaaaggctcattggcgagttcgaccagcaacaggcagagtcctggtcctag

SEQ ID NO: 186478 - DNA, 1644 bp, Artificial Sequence
  Description of Artificial Sequence: Synthetic coding sequence
atgcggcagaagcggaagggcgacctgagccccgccgagctgatgatgctgacaatcggcgacgtaatcaagcagctcattgaggcccacgagcagggcaaagacattgaccttaataaggtcaaaactaagacagccgccaaatatggactgtctgcgcaacctcggttagtggacattatcgccgccgttcctccccagtacagaaaagtcctgatgccgaaattgaaggcaaagcccatccgcaccgctagcgggatcgcagtggtggccgtgatgtgtaagccccacaggtgccctcacatctcattcacgggaaacatttgcgtttattgccccggtgggccggactctgattttgaatattcaacacagtcttacactgggtacgagccaactagcatgagggctatcagggcacggtacgatccattcctgcaaacacggcatcggatcgagcagctgaaacagctgggacattcagtcgataaggtggagttcatcgttatgggggggaccttcatggcactgccagaggagtatcgcgactactttatccgaaacctgcacgacgccctcagtggacacacttccaataacatctacgaggctgtgaagtatagcgaacgctcattgacaaagtgcatcgggattaccattgagactcggcccgactattgcatgaagcgacatctgagtgacatgctgacatacgggtgtactaggctggaaataggggtccagtccgtgtatgaggacgtagcacgagatacaaaccgtgggcatactgtgaaggcagtgtgcgagtccttccacctggctaaagactcagggttcaaagtggtggcccacatgatgccagacttacctaacgtgggtctggagagagacattgagcagtttacagaattttttgagaacccggcatttcgcccagatggtctgaaactgtaccccactcttgtcattagggggaccggattgtatgagttgtggaagagtggtcgatacaagtcttatagccccagcgaccttgtggaactagtcgcgcgcatcctggcattggtaccgccttggacacgagtttaccgcgtgcaaagagatatacccatgcctctcgtgtcttctggtgtcgagcacggaaatttgcgggagttggcccttgctagaatgaaggatctgggtattcagtgcagggacgttcgaaccagggaggtgggaattcaggaaatccatcataaggtgaggccatatcaggtagagttggtaaggcgggattacgtcgccaacggaggctgggaaacgtttctgtcttatgaagaccccgaccaagatattcttatcgggctgctccgactgagaaaatgttctgaggagacattcagatttgagctgggaggtggggtttccattgtccgagagctgcacgtctatggatctgtggttccagttagctctagagatcctactaaattccagcaccaggggtttggcatgcttttaatggaagaggccgagcgtatagccagggaggaacatggcagcggcaaaattgccgtcatatccggcgtcggcacgaggaactactataggaagatcggctatcggttgcagggtccctatatggtaaagatgctcaagtag

SEQ ID NO: 186479 - DNA, 1368 bp, Artificial Sequence
  Description of Artificial Sequence: Synthetic coding sequence
atgtgcaagccccaccggtgcccccacatcagcttcaccggcaacatttgcgtctactgcccaggaggcccagatagcgactttgagtatagcacacagtcttacaccggctatgagccgaccagtatgagggctatcagagcacggtacgacccttttctgcagacacgccacaggattgagcagttaaagcagctgggccactctgtagacaaagttgagtttattgttatggggggaacctttatggctctccccgaagagtatcgggattacttcataagaaatctgcacgatgccctgtctggccacaccagcaacaacatctacgaggcagttaaatattcagaaaggtctctgactaaatgtattggcatcacaatcgaaacccggcccgactactgcatgaagcggcatctttcagacatgcttacatatggctgtactagattagaaattggcgtacaatcagtgtatgaggacgtcgcacgggatacgaatcgcggacacacagtgaaggccgtatgtgaaagttttcatctcgctaaagactctggatttaaggtcgtcgcccacatgatgccagacctgccaaacgtgggtctggaacgtgacatcgaacagtttaccgagttctttgagaaccccgcttttcgccccgatggactcaagctctaccctaccctcgttatcagaggcaccggactttatgaactctggaaaagtggtcgttacaaaagctatagtccatctgatttggtggaactggtggcaaggattttggctctggtgcctccatggacgagggtgtacagggtccagagagacatccccatgccacttgtcagctccggagtggaacacggtaaccttagagagctggcactagctcggatgaaggacttaggcattcaatgccgagatgtgcgcaccagggaggtggggatacaggagatccatcacaaagttcgcccatatcaggttgagctggtgaggagagattacgtagccaatggcggttgggagacctttttgtcgtatgaggaccccgatcaggacatcctgatagggcttctgaggctgcgtaagtgcagtgaggagaccttccgtttcgagctgggcgggggggtgtccatcgtgcgagaattacatgtgtacggttccgtcgttcctgtgtcatcgcgggatcctacaaaatttcaacatcaaggcttcgggatgttgttaatggaggaggccgagcgcatcgcgagagaagagcacggttccggaaaaatcgctgtgatcagcggcgttgggacccgtaattactatagaaagattggctatcgccttcagggtccttatatggtcaagatgctgaagtag

SEQ ID NO: 186480 - DNA, 342 bp, Artificial Sequence
  Description of Artificial Sequence: Synthetic coding sequence
atgatgctgaccatcggcgacgtgatcaagcagctgatcgaggcccacgagcagggcaaagacatcgacctgaataaggtgaagacaaagactgcggccaaatatggtttatcagcccagcctcggctagtggacataatagccgctgttccacctcaatatcgaaaggtcctgatgcctaagttgaaggctaagccgatcagaacggcttcagggatcgccgtagtagcggtgatgtgtaagccgcatcgctgtcctcacatctctttcaccggcaatatttgcgtgtactgcccgggcggcccagatagtgattttgaatactctacccagtcctattag

SEQ ID NO: 186481 - DNA, 1602 bp, Artificial Sequence
  Description of Artificial Sequence: Synthetic coding sequence
atgatgctgaccatcggcgacgtgatcaagcagctgatcgaggcccacgagcagggaaaagatattgacctcaataaggtcaagacaaagactgctgcaaagtacggactttccgcacagccaagactggtagacatcatcgccgcagttcctcctcagtacagaaaggtgctcatgcccaaactcaaggcaaaacctatccgcacagcatcggggattgcagttgtggccgtgatgtgcaagcctcatcgctgccctcatatctctttcacaggcaacatttgcgtgtactgcccaggagggccagattccgacttcgaatactcaacccagtcttacacagggtacgaacctaccagcatgagagcgattagagcacgctacgaccccttcctgcaaacccggcatcggattgaacagctgaagcagctgggccactcagtggacaaggtcgagtttattgtgatgggtggaacgtttatggccttaccggaagaatacagagattacttcattaggaatctgcatgacgcactgtcgggccatacctcaaacaacatttacgaggctgtaaaatactctgagcgatcacttacaaaatgtatcggaataacgattgagacaagacctgactactgtatgaaaaggcacctgtccgatatgcttacctatgggtgcactcggctggagatcggtgtgcagtctgtttatgaagacgtcgctcgcgatactaaccgcggccacactgtgaaggccgtgtgcgagagcttccatctagcaaaggactccggcttcaaagtggtagcccacatgatgcctgatctgcccaacgtgggcttggaacgtgacatcgaacagttcacggaattcttcgagaacccagcctttcgccctgatggtctgaagttatatcccactttagtgatccggggaactggactgtatgagctgtggaagtcaggaagatataaatcctactccccctctgatctagtggagttagttgcgaggattcttgctttagtgcccccgtggacaagggtctacagagtgcaacgcgatatacctatgcctcttgtcagttctggcgttgagcacggcaaccttcgggaactcgcactggctcgaatgaaggatctggggatacagtgccgggacgtgcgaaccagagaggtgggtatccaggagatccaccacaaggtgaggccttatcaggtggaattggtcagacgcgattatgtagccaatggtgggtgggaaactttccttagctacgaggacccagaccaggacattctcattggcctcctacgactacgaaaatgctctgaagagactttcagatttgagctgggtggcggggtgtcaatagttcgtgagctacacgtctacggcagcgtggttcctgtctcctccagggaccccactaaattccagcaccagggttttggcatgctgcttatggaggaagcagaacggatcgccagggaggagcatggaagcggcaagatcgcagtcatttcaggagtaggcacccgcaactactaccgtaaaatcggctatagactgcaggggccttacatggtgaagatgctgaaatag

SEQ ID NO: 186482 - DNA, 576 bp, Artificial Sequence
  Description of Artificial Sequence: Synthetic coding sequence
atgatgctgaccatcggcgacgtgatcaagcagctgatcgaggcccacgagcagggcaaagacattgacctcaataaggtgaaaactaaaaccgctgccaagtatggtctgtccgcccagccgcgccttgtcgatatcattgctgctgtgccgccccaatatcggaaggtgctgatgcctaaattgaaggcaaagccaatcagaaccgcatcggggatcgcagttgtagccgtgatgtgtaaaccgcacaggtgtccccatattagctttacgggtaatatttgtgtttattgtccgggcggacccgacagcgactttgaatattcaacacagtcgtacactgggtatgaacctacttctatgcgggccattagagccaggtatgaccccttcctccagacccgacatcgtattgagcagctaaagcaactcggccactcagtggataaagtggagtttatagtcatgggcggaactttcatggccctgcctgaggaatatcgcgattactttattcgtaacttacacgatgccctgtctggacacacaagtaataacatctatgaggccgtgtag

SEQ ID NO: 186483 - DNA, 1287 bp, Artificial Sequence
  Description of Artificial Sequence: Synthetic coding sequence
atgagcacccaccagttctaccggaagtacatgtgccccaccagcatgagagccattagagcacgctacgacccattcttacaaacccgccatcgaatcgaacagctgaaacagctgggacattcggtggataaggtggagttcattgttatgggaggaactttcatggctctgcctgaggagtacagagactatttcatccgcaatctacacgatgctctgtcaggacatacgtctaacaacatctacgaggccgtgaaatatagcgagcggtcgttgacaaagtgcatcgggatcaccatcgaaactcgtccagactattgtatgaagcggcacctgagtgacatgctcacctacgggtgtactcggctggaaatcggggtgcagtctgtttacgaggatgtggctcgtgacaccaacagagggcacactgttaaggctgtgtgcgagagctttcatttggctaaggattcggggtttaaggtggttgcgcacatgatgcccgatctgcctaacgtggggctggaaagggatatagagcagtttacagaattttttgagaatcctgcctttaggcccgacggactgaagctctacccgactctcgtaattcgcggcaccggcctatacgaactatggaagtctggtcggtacaagagttactcaccttccgacttagtggagttggtcgccaggatcttggccttagtgcctccatggactcgtgtatatagagtccagcgcgatatccctatgcctctggtgtcatccggcgttgaacacggcaatctgagagaacttgcactggcccgtatgaaggacctaggcattcagtgcagagacgtgcgaaccagagaggtaggaatccaggaaatacaccataaagtcagaccttaccaggtggagttggtgcgccgagattacgtcgccaatggaggatgggaaacattcctgagctatgaagaccccgatcaggatattctgattggactgctccggctgcggaaatgctcagaggagacttttcgcttcgagctcggtggtggcgtgtcaatagttcgtgagctgcacgtgtacggttcagtcgtccccgtctctagtagagatccaaccaaatttcagcaccagggttttggtatgctcctaatggaggaagccgaacgcattgccagagaagaacatggatcggggaagatcgcggtgatctcaggcgtgggcaccaggaattattacaggaaaattggatacagactacaagggccatacatggtaaagatgctaaagtag

SEQ ID NO: 186484 - DNA, 1257 bp, Artificial Sequence
  Description of Artificial Sequence: Synthetic coding sequence
atgtgccccaccagcatgcgggccatccgggcccggtacgaccccttcttgcagactcgacaccggatagaacagctcaaacagctcgggcattccgtcgacaaggtggaatttatagtgatgggcgggactttcatggccttgccggaagagtaccgtgattactttatccgtaatctgcacgatgcactgtctgggcatacaagcaacaatatttatgaagccgtcaagtacagcgagaggtcactcaccaaatgtattgggatcacaatcgagacacggcccgattattgtatgaagaggcatttgtcggacatgctaacctatgggtgtacacggcttgagatcggagtgcagtctgtttatgaagacgtagcccgggacaccaacagagggcacacagtcaaggccgtctgcgagtctttccacttggcaaaggattcgggattcaaggttgtggcacatatgatgcccgacctgccgaatgtggggcttgagcgggatatcgaacaatttaccgagttttttgagaacccggcttttcgacccgacgggctcaagctgtatccaaccctagtcatccggggcaccgggctgtatgagctctggaaatccgggaggtacaagagttatagtcccagcgatctggtggagctcgttgctaggattttagccctggtgcccccatggacaagggtttaccgtgtgcagagggacatccccatgcccctagtgtctagcggagtggagcacggcaaccttagagagctagccctcgcacgcatgaaagatctgggcatccaatgcagggacgtacggacccgagaggtgggtattcaggaaattcatcataaggttagaccataccaagtggaactggtgcgccgagactatgtagcaaacgggggctgggaaactttcttgtcctatgaggatcctgatcaggacatactgataggcttgctgcgactgaggaagtgttccgaggaaaccttccggtttgaactgggagggggcgtcagcatcgtccgggagctgcacgtgtacgggagtgtggtaccagtgtcatccagagaccctactaagtttcagcatcagggatttggcatgttactcatggaggaggccgaaaggatcgccagggaggaacatgggagcggcaaaattgccgtaatctcaggggtcggcacccgaaattactatcgtaaaattggttacagacttcagggaccatatatggttaagatgctgaaatag

SEQ ID NO: 186485 - DNA, 1275 bp, Artificial Sequence
  Description of Artificial Sequence: Synthetic coding sequence
atggccgccgtggccacctgcggcagcgtggccgccagcaccggctccgcagtcgccacagcttcaaaatcaaatgttacctctttccagagacggggtccacgcgccagtgtcacgaatgatagtggtccaaggcttgtgagcatcgccggaaccagaccctccgtgcgaaatggtcagctgctcgtgtcaactggcctgccggcgttggaccagctgcttggcgggggactcgcggttggcactgtgctgctcatcgaggaggataaatataacatctactctccccttctgtttaagtatttcttagccgaggggattgtcaatgggcataccctgctagtcgcttctgccaaagaggatccagccaacattctgcaggagctgcccgcccctctgttagatgacaaatgtaaaaaagagtttgatgaagacgtatacaaccacaaaacaccagagagcaatatcaaaatgaaaatcgcatggcggtaccagcttttaccgaaaatggagatcggccccgtttctagtagcaggtttggccactactatgatgccagtaaacggatgccccaggaactcatcgaggcatccaactggcatgggttctttctgcctgaaaagattagctccaccctgaaggtggaaccatgttccctgacaccagggtatacgaaattactgcagtttatccagaatatcatatacgaggaggggttcgacggatcaaacccgcaaaagaaacagagaaacattctgagaattggaattcagaacctgggatccccactctggggggatgacatttgttgcgccgaaaacggcggcaatagccattcactcaccaagtttttatatgtactgagagggctcctccggactagtttgagtgcatgtattattactatgcccactcacctcatccagaacaaggcgataatcgcacgcgtaacaaccctgtccgatgtcgttgttggcctggaatcattcattgggtcagagagggagactaatcccctctacaaggattaccacggcttgattcatattagacaaattccaaggctgaataatctgatatgcgacgaatcagatgtgaaggatcttgcctttaaattaaaacgcaaactgttcactatcgagagactccaccttcctccagatctgagtgataccgtaagtcgtagttctaaaatggatctggccgaaagcgccaagaggttaggccctgggtgtgggatgatggcaggcgggaagaagcacctggacttctag

SEQ ID NO: 186486 - DNA, 1431 bp, Artificial Sequence
  Description of Artificial Sequence: Synthetic coding sequence
atggccgccgtggccacctgcggcagcgtggccgccagcaccggctctgccgttgctaccgcttctaagtctaatgtgaccagttttcagcgccggggccctagagcttctgtgacaaacgattccggcccgcggctcgtttccattgcaggtacccgtccctcagtgaggaatggccagttgctggtgtctaccggactgccagccctggaccagcttctgggggggggactagccgtgggcacggtgctgctgatcgaagaagacaagtacaatatatacagccctctcttgtttaaatactttttagcagaaggcatcgtaaatgggcacactttgttagtggcttccgctaaggaggatccagccaacatcctccaggaactccccgctcctttgcttgacgataagtgtaagaaggagtttgacgaagacgtttacaaccacaaaactcctgagtctaacatcaaaatgaagatagcatggcgctatcagctgctgcctaaaatggagcagataggacccgtttcctcaagtcggttcggacattactacgatgcaagcaaaagaatgccacaagaactgatcgaagcttcaaattggcacgggttttttctccctgagaagatatcctcgacgttgaaagtcgaaccatgctcgctcactccgggctatacgaagctgctgcagttcatccaaaacatcatttatgaggaaggcttcgacggctccaatccccagaagaagcagcgcaacatcttgaggattggcattcaaaacttagggtctccactttggggagacgacatttgttgtgctgagaacggcggcaacagccactctctgacaaaattcctctatgtgttgcgaggcctccttaggacttcattgtctgcatgcattattactatgcctactcacttgatacaaaacaaagccattattgcccgcgtgaccacgctgtcagatgtcgttgttggcctggaatcattcataggctccgaacgcgagaccaatcctttatataaagactaccacgggctcatccacatccgacaaatcccaaggctgaacaatctgatctgtgacgaatccgatgtaaaagacctagctttcaaactgaagcgaaagctgtttacaattgagtgggttcaggacaactacctgaggcaggaacggaacatctatcctcccgggttctcctaccttttaaagcaaaaggacagtgcctggggcgagggctcccttcagcattcaactttcctgatgtcttttctggctaaagcaaccgcttttgctagcaggctcgtcagacactcagaacctctcaaacagaacggcagcggaagaatccgtcaggctgctggaccacgcctctggcacgacggacgccgtcaagaagctccagggctgctgggtattcctccctag

SEQ ID NO: 186487 - DNA, 1608 bp, Artificial Sequence
  Description of Artificial Sequence: Synthetic coding sequence
atggccgccgtggccacctgcggcagcgtggccgccagcaccggcagtgctgtcgccactgcttctaaatcaaatgtcacttcatttcagaggagaggccccagagcgagcgtgacaaatgattccggtccacggttggtgtccattgccggcacgagaccttccgttcgaaacggtcagctcctagtctcaacgggtctgcccgcattggaccagcttctcgggggcgggctggccgttggaacagtgctgttaatcgaggaggataaatataacatttatagccccctcctttttaaatactttctggccgaaggcatcgttaacggacataccctcctggtcgcgtcagcaaaagaagatccagcaaacatactgcaggagctgcctgctcctttgctagatgataagtgcaaaaaggaattcgatgaggatgtgtataaccacaagactccggaatcaaatatcaagatgaagattgcttggaggtatcaactcctgcccaagatggagattggacccgtgtcctcctctcggtttggtcactactacgatgcatccaagcgcatgccgcaggaactgatagaagcatccaactggcatggcttttttctccctgagaaaatctcaagtacattgaaagtagagccctgctcgctgactcccgggtacaccaaactgcttcaatttattcaaaacatcatatacgaggaagggttcgacgggtccaatccccagaaaaaacaaaggaatattctgcgcataggaatccagaatctggggtctcctctctggggggacgacatctgctgcgccgaaaacgggggtaatagtcacagtctaaccaagtttctgtacgtacttcggggcttgctacgaacgtctctgtctgcttgcattatcaccatgccaacgcatctaatccaaaacaaagcaattatcgctagagtaaccaccctgtctgatgttgtggtaggactcgagtcctttattggctcagaaagagagacaaatcccctttataaggactaccacggactgatccacataaggcagatcccccgactcaataatctgatttgcgacgagtcagatgttaaggacctcgctttcaagttaaaacgcaaactgttcaccatagaggcaggggtgcagtggcatgatctgggatcacggcagccccggctgctgggctcttctaattcccccgcatctgctagcttggtcgccggaattaccggagctcaccatcacacccagctaatctttgtattcttggtggagatggggttccatcacgtgggacaagccggcctggagctgttaacgtcaggcgacagttccgcgagcgctagccaatccgccgggatcacaggaatgtcatatcgagcaaggcctagggcattatacttcaaggagaacaagagcaaggttggggcacgccagctgctggaaaccagggaagaacacctgtcaagtcggttacttattcttacccaggccgaaaggctttgcatgggccggcgattctttaccgcctttcacatctttaatgagctgccgtgcaagggcgactgtatttgcctacagacctgtcagacccagtag

SEQ ID NO: 186488 - DNA, 840 bp, Artificial Sequence
  Description of Artificial Sequence: Synthetic coding sequence
atggaggccgtggtgaacctgtaccaggaggtgatgaagcacgccgaccccaggatccagggctacccactcatgggatccccactcttaatgacctccatcctcctcacctatgtgtacttcgtgctgtctcttggtcctaggataatggccaacaggaagccgtttcagctgcgaggcttcatgattgtttataacttttccttagtggctctgtccctgtatatagtgtacgagttcctgatgtccggctggctctctacatacacatggaggtgcgatcccgtggactacagtaactcaccagaggcacttcgaatggtgagagtggcttggctctttttgttcagcaagttcatagaacttatggacactgtcatcttcatcctgcgtaagaaagacggccaagttacttttttacatgtgttccaccatagcgtgctgccatggtcctggtggtggggggtcaaaatcgctcctgggggtatggggtcattccatgccatgatcaatagtagcgtgcatgtcatcatgtacttgtactatggactgagtgctttcggcccagtcgctcaaccctacttatggtggaagaaacatatgactgccattcagttaattcagttcgtgctggtgagcctccatatcagtcagtattacttcatgtcctcctgcaattaccagtatcctgtgattatacacctcatctggatgtatggcacaattttcttcatgttattttcaaatttctggtaccattcctacaccaaaggaaagcgcttgccccgggctctgcagcaaaacggcgcccctggcatcgccaaggtaaaagcaaactag

SEQ ID NO: 186489 - DNA, 759 bp, Artificial Sequence
  Description of Artificial Sequence: Synthetic coding sequence
atggaggccgtggtgaacctgtaccaggaggtgatgaagcacgccgacccaaggattcaggggtaccccctgatggggtctcccttattaatgactagcatcctgctcacttacgtgtattttgtactcagcctaggtcctcgaatcatggctaatcgaaagcctttccaactgcgtgggttcatgattgtttacaatttctcactggtggcgctgagtttgtacattgtctacgaaatggtccgtgtggcttggctcttcctcttttccaaatttattgaactgatggatacagtaatctttatccttaggaaaaaagatggacaagtgaccttcctccatgtttttcaccattccgtgctcccttggagttggtggtggggcgtgaaaatagcacccggagggatggggagtttccatgctatgattaactcttccgtccacgtaatcatgtacctgtactacgggcttagcgccttcgggccggttgcccagccctatctgtggtggaagaagcatatgactgccattcagctgatccaattcgttctggtgagcttgcatatctcacagtactacttcatgtctagttgcaactaccagtaccccgtcatcatccatctgatttggatgtacggcaccatcttttttatgctcttttccaacttttggtaccatagctacacaaaggggaaaagactcccacgggcgctgcaacaaaacggtgccccggggatcgcgaaagttaaagcaaattag

SEQ ID NO: 186490 - DNA, 891 bp, Artificial Sequence
  Description of Artificial Sequence: Synthetic coding sequence
atggagcacctgaaggccttcgacgacgagatcaacgccttcctggacaacatgttcggacctagggattctagagtcaggggatggtttatgctggactcatacctgccaaccttctttctaacagtcatgtacttactgagcatatggctgggtaacaagtatatgaaaaaccgtcccgccctgtcccttcgcgggattctgacactttacaatctgggaatcactctgttatctgcttacatgctggccgagctcattctgagtacttgggaggggggctataatcttcaatgtcaggaccttacatccgccggggaggccgacatccgggtggcgaaggtactgtggtggtactatttctcgaagtctgtggagtttttggacactatcttttttgtgctcaggaagaaaacttcacaaattaccttcctccacgtgtatcatcacgccagtatgttcaatatatggtggtgcgtccttaattggatcccatgtggccaatcgttctttgggcccactctcaacagtttcatccacattctgatgtacagctactatggcctgagcgtgtttccatccatgcacaagtacctctggtggaaaaagtatcttactcaagcccagttggtgcagtttgttcttacaatcactcatacgatgtctgctgtggtcaagccatgcgggtttccctttggatgtcttatctttcaatcttcctatatgctcactcttgttatcctgtttcttaatttctatgtacagacttacaggaaaaaacccatgaaaaaggatatgcaagagccacctgcgggcaaggaggtgaagaatgggttttctaaggcgtatttcactgccgcaaacggagtgatgaataagaaggcacagtag

SEQ ID NO: 186491 - DNA, 813 bp, Artificial Sequence
  Description of Artificial Sequence: Synthetic coding sequence
atggtgaccgccatgaacgtgagccacgaggtgaaccagctgttccagccttacaacttcgagctctctaaggacatgagacccttcttcgaggagtattgggccacaagtttccccatcgctctcatctatctggtgttgatcgcagtgggtcagaattacatgaaggaacggaaaggatttaatctgcagggaccccttatcctttggagtttctgtcttgcaatcttctctatcttgggagccgtccgaatgtggggtatcatggggaccgtgctgcttactgggggccttaaacagacagtctgtttcatcaactttatcgataacagcacagttaagttctggtcttgggtgttccttctgtcgaaagtgatagagctgggtgacacggcattcattatcctaaggaaaaggccgcttattttcatacactggtaccatcattctacagtactcgtttataccagtttcggctataaaaacaaggtccctgcgggaggatggttcgtgacaatgaattttggggtgcacgccatcatgtacacttattataccctcaaggctgctaacgtaaagccaccaaagatgctgcccatgttaattacaagcttgcagatcctacagatgttcgtcggggcaattgtaagtatcctgacttatatttggcgacaggaccagggctgccatacaaccatggagcatctgttttggagcttcattctgtatatgacctactttatcttgttcgctcacttcttttgccaaacatacatcagaccgaaagtgaaggctaaaactaagtctcagtag

SEQ ID NO: 186492 - DNA, 945 bp, Artificial Sequence
  Description of Artificial Sequence: Synthetic coding sequence
atgggcctgctggacagcgagcccggcagcgtgctgaacgtggtgtcgacagccttgaatgacacagtggaattctataggtggacctggtccattgcagacaagagagtagagaactggcctctgatgcaatccccatggccaacactgtctatcagcacattgtacctgctgttcgtctggctgggccccaagtggatgaaagaccgggaacccttccagatgcgcctggtccttatcatttacaatttcggaatggttcttctcaacttgtttattttccgggagctgtttatgggatcttacaacgccggatatagctacatctgtcagtctgtggattattcgaataatgtccacgaggtgagaattgctgccgccctatggtggtacttcgtcagcaaaggggtggaatatctagacaccgtttttttcatcctccgaaagaagaataatcaggtgtcctttctgcatgtgtaccaccactgcactatgtttaccctgtggtggattggtatcaagtgggtggccggaggacaagccttctttggggcgcagctaaacagctttatccatgtgattatgtattcctattatgggctaactgcttttggtccttggatacagaaatacctctggtggaaaagatacctcactatgctgcagctgatccagtttcacgttaccatcggtcacacagccctttcactgtataccgactgtccattcccaaagtggatgcactgggcattgatcgcctatgcgatatcctttatctttctgttcttgaacttttacattaggacctacaaggagcccaaaaagccgaaagcgggaaagactgccatgaacggcataagcgcaaatggcgtaagcaagagcgaaaaacagctgatgattgagaatggcaaaaaacagaaaaacggaaaagccaaaggggattag

SEQ ID NO: 186493 - DNA, 900 bp, Artificial Sequence
  Description of Artificial Sequence: Synthetic coding sequence
atggagcacttcgacgccagcctgagcacctacttcaaggccctgcttggcccccgcgatacccgagttaaggggtggttcctactggataattacatacctacatttatttgcagcgtcatctatttgctgatagtctggctgggtccaaaatacatgcgaaataaacagccattcagctgtaggggcatcctggtagtttataacctgggcttgacattgctgtcactgtacatgttctgcgaacttgtgactggtgtgtgggaaggaaagtataacttcttttgccaaggtactaggacagcaggcgaatctgacatgaagatcatcagggtactctggtggtactacttcagcaaactgattgaattcatggataccttctttttcattttgcgcaagaacaaccaccagattactgtgctgcacgtgtatcatcacgcttcgatgctgaatatttggtggtttgtgatgaactgggtcccgtgcggacactcatacttcggcgcaaccttaaactccttcattcatgtgctgatgtatagctactacgggctttcctccgtaccctctatgcgtccttacctctggtggaagaagtatatcacccaggggcagttactgcaatttgtgctgacgataattcagacatcctgcggggtgatttggccctgcacgttcccacttggatggctttattttcagataggctacatgatcagcttgattgcactttttaccaatttttacattcagacctacaacaaaaagggcgctagtaggagaaaggaccacttgaaggaccaccaaaacgggagcatggcagctgtgaatggtcataccaatagtttctcacctttagagaataacgtgaaacctcgcaaactacggaaagattag

SEQ ID NO: 186494 - DNA, 267 bp, Artificial Sequence
  Description of Artificial Sequence: Synthetic coding sequence
atggagcacttcgacgccagcctgagcacctacttcaaggccctgctgggtcccaggggaattagctcatcagtgcttaggatggggcccccattacatacagtcgtgggatggcttcagcagctccaagcagcccatagcgaggaagaagagaagatgttccacctgtgcggcttcaaacataaagaggtggtctctcagtcttcactccccgccgtaatacctcagaactcactagcaaccattgcatcccatgcaccagcctag

SEQ ID NO: 186495 - DNA, 870 bp, Artificial Sequence
  Description of Artificial Sequence: Synthetic coding sequence
atggagcacttcgacgccagcctgagcacctacttcaaggccctgctgggacctcgcgataccagagtgaaaggctggttcctgttggacaactatatacccactttcatttgctctgtaatttacctgctgattgtgtggcttggccctaaatacatgaggaataagcagcccttttcctgcagggggatactggtggtgtacaaattctgcgagctggtcacaggcgtgtgggaaggcaaatataattttttctgccaaggaactagaacagcaggcgaatctgatatgaaaatcatccgggtcctgtggtggtattatttctccaaacttatcgagtttatggacaccttcttcttcattctaaggaagaataaccaccaaattactgtcttgcacgtgtatcatcatgcgtcgatgctgaacatttggtggttcgtaatgaattgggttccatgtggtcactcttatttcggcgccactttaaattcttttatccatgtgctgatgtatagttattacggtctgagttccgtgcctagcatgaggccctacctctggtggaagaagtacatcacgcagggacaactgttgcaattcgtgctgactatcattcagacctcctgtggtgttatttggccttgtacctttcccctgggctggctctattttcagatcggctacatgatttctctaattgccctgtttaccaatttttatatccagacgtataataaaaaaggggcatccagaaggaaagaccacctaaaggaccaccaaaacggatcaatggcagctgtcaacggccatactaactccttctcgcctctggaaaataacgttaagccccgaaaactccgcaaagattag

SEQ ID NO: 186496 - DNA, 981 bp, Artificial Sequence
  Description of Artificial Sequence: Synthetic coding sequence
atggagcacttcgacgccagcctgagcacctacttcaaggccctgctgggccccagggacacacgcgtaaaggggtggttcctgcttgacaactacattccgacctttatctgcagtgttatttatttgctgatcgtatggcttgggccaaaatatatgcgaaataaacagcccttttcgtgtagaggtattctggtggtgtacaatttgggactgacactattgagcctctatatgttctgcgaaagcaaacgggaacagccgcgcaggtcagcttgtgcctccagaactgacccatcaacacagcagcagttaccagagaaccgacttgtaaccggagtgtgggagggtaagtataacttcttctgccaaggcacaagaactgcgggagagtccgacatgaagattatccgcgtcttatggtggtactattttagtaaattgattgagtttatggatacctttttcttcatcctgagaaaaaacaaccatcagattaccgtccttcacgtctaccaccatgccagcatgctaaacatctggtggtttgttatgaactgggtaccctgcgggcactcttattttggcgcaaccctaaactctttcatacatgtgttgatgtacagctattatggcctgagctcagtcccttcaatgcgcccctacctatggtggaaaaaatatattacacagggccaacttctccaatttgttctaactataattcagacctcgtgtggcgtcatctggccatgcaccttccctctcggctggctttacttccaaatcggttatatgatcagcttgattgcgctgtttactaatttttatattcagacctacaacaagaagggcgcaagccgccgcaaggaccatcttaaggaccaccagaacggtagtatggcggctgtgaacggccacaccaattccttctcacctcttgaaaacaatgtgaaaccccgcaagctgcggaaggactag

SEQ ID NO: 186497 - DNA, 900 bp, Artificial Sequence
  Description of Artificial Sequence: Synthetic coding sequence
atggagcacttcgacgccagcctgagcacctacttcaaggccctgttgggccccagagacaccagagtaaaaggctggtttctgctagataactacatccccaccttcatctgttctgtgatttacctgctcattgtgtggttgggtcctaaatacatgcgcaacaagcagcctttcagctgcagagggatccttgtggtgtacaacctgggactcaccctattgtccttatacatgttctgtgagttggtaaccggcgtctgggagggcaaatataatttcttctgtcagggaactcggaccgcaggcgagtcagacatgaagattatccgtgtgctctggtggtactacttttctaagctgatcgaatttatggatacatttttttttatattaagaaaaaacaatcatcagataacagtgctgcacgtataccaccacgcctccatgctaaatatatggtggttcgttatgaattgggtcccgtgtggtcactcttattttggagccactcttaactctttcattcatgtcctgatgtactcatattatggcctgtccagcgttcccagcatgcgcccttacctgtggtggaaaaaatatatcacacaaggccagcttcttcagttcgtcttaacaataatccaaacgagttgcggcgtcatttggccatgcacatttccattaggctggttatattttcagatcggttacatgatttccctaatcgccctgttcaccaatttctacatccagacgtacaacaagaagggcgcttcaaggagaaaagaccacttgaaggatcatcagaatgggtcgatggcagcagtcaatggccacactaacagcttttcgccgctggaaaataacgtgaagccgcgcaagctgaggaaggattag

SEQ ID NO: 186498 - DNA, 798 bp, Artificial Sequence
  Description of Artificial Sequence: Synthetic coding sequence
atgaacatgagcgtgctgaccctgcaggagtacgagttcgagaagcagtttaacgaaaacgaagcaatccaatggatgcaggaaaactggaaaaagtctttcctgttctccgccctctacgccgccttcatattcggaggaaggcacctgatgaacaagcgggcgaaatttgagctccgcaagcctcttgtcctgtggtcactgacgttggccgtgttctcaattttcggggcgctcaggaccggggcctacatggtgtacatccttatgactaaagggttgaaacagagcgtgtgcgaccagggattttacaacggtccagtgagcaaattttgggcctacgctttcgtgctgtctaaagcaccagaactcggtgatactatttttattattctgcgaaagcagaaattaatatttctccattggtatcatcacattaccgtgctcctatattcctggtactcatacaaagatatggttgcggggggcggatggttcatgactatgaactacggtgttcacgctgttatgtatagttactacgcactgcgcgccgcgggcttccgcgtgtctcgcaagtttgcgatgttcattaccctgagccaaatcactcagatgctgatgggctgtgtggtgaactatctggtgttctgctggatgcagcacgaccagtgtcactctcattttcaaaacatattttggagttcactgatgtacctctcatatctcgttctcttctgccacttcttctttgaggcctacataggtaagatgagaaaaaccaccaaggctgaatag

SEQ ID NO: 186499 - DNA, 798 bp, Artificial Sequence
  Description of Artificial Sequence: Synthetic coding sequence
atgaacatgagcgtgctgaccctgcaggagtacgagttcgagaagcagttcaacgagaatgaggccatacagtggatgcaggaaaactggaagaaatcattcttattcagcgccctttatgctgcctttatctttggagggcggcacttaatgaataagagggccaaattcgagcttcgtaagcccctcgtcctctggtctctgactctggcagtttttagcatcttcggagccctccgaacaggcgcgtacatggtttacattttaatgaccaaggggctgaaacagtccgtttgtgaccagggcttctacaatgggcccgtcagcaaattctgggcctacgcctttgtattatctaaggcaccggagctgggcgatactatatttattatactccggaaacaaaagctgatttttctgcactggtatcaccatataaccgtgttgctgtattcctggtactcatacaaagacatggtggcaggcggcggttggttcatgacgatgaattatggagtgcacgctgtcatgtactcttattatgctctgagggcggctggtttcagggtttctcgaaaatttgccatgttcattactctctcacaaattacccagatgctcatgggatgcgtggttaattacttagtgttttgttggatgcagcacgaccaatgtcactcccattttcagaatattttttggagcagcttgatgtacctgtcttatcttgtgctcttttgtcacttcttcttcgaggcctatattggcaagatgcgaaagaccacgaaggccgagtag

SEQ ID NO: 186500 - DNA, 327 bp, Artificial Sequence
  Description of Artificial Sequence: Synthetic coding sequence
atgaacatgagcgtgctgaccctgcaggagtacgagttcgagaagcagttcaatgaaaatgaggccatccagtggatgcaggagaactggaaaaagagctttctattctctgccctctacgccgccttcatatttggtgggcgccaccttatgaacaaaagagccaaattcgagctgaggaagcctctggtgctgtggtctttaaccctggctgttttttccatttttggagcattgcgtacaggcgcctatatggtgtatattctgatgacaaagggtctcaagcagtctgtgtgcgaccaagggttttacaacgggcccgtctag

SEQ ID NO: 186501 - DNA, 414 bp, Artificial Sequence
  Description of Artificial Sequence: Synthetic coding sequence
atgaacatgagcgtgctgaccctgcaggagtacgagttcgagaagcaattcaacgaaaacgaggctatacagtggatgcaggagaactggaaaaagagcttcctgttttccgccttgtacgccgcatttatttttggagggagacatctgatgaataagcgcgccaagtttgaacttcggaagccattggtgttgtggtctctgactctggctgtgtttagcatatttggggctcttaggacaggggcttacatggtctacatcttgatgactaaagggctgaaacagtccgtttgtgatcaggggttttacaatgggccggtctccaaattttgggcctatgccttcgtcctgagcaaagcccccgaactgggagacacgatctttattattctgaggaagcagaagctctag

SEQ ID NO: 186502 - DNA, 846 bp, Artificial Sequence
  Description of Artificial Sequence: Synthetic coding sequence
atggccttcagcgacctgaccagccggaccgtgcacctgtacgacaattggattaaggacgcagatccccgtgtggaggattggctgttgatgtcgagcccactgccacagacaattctcctggggttctacgtgtattttgtcacgagccttgggcctaaactgatggagaatcggaaaccattcgagctgaaaaaagcgatgataacatataactttttcatcgtgttgttctccgtctacatgtgttatgagttcgtcatgagcgggtggggcataggttactcttttaggtgtgacatcgtagactactcaaggtccccgacagcacttaggatggctaggacctgttggctgtattacttttcgaagtttatcgaactgctggacaccattttctttgtcctccgcaaaaagaatagtcaggttacatttctccacgtgttccatcacaccattatgccctggacctggtggtttggggtaaaattcgcagctgggggattaggaacctttcacgctctgctaaacactgctgtacacgtggtgatgtattcctactacggcctatctgcgctgggtccagcttaccagaaatacctgtggtggaaaaaatacctcacatcattgcagctcgtacagttcgtaatcgtagctattcacatctctcagttcttttttatggaagattgcaagtatcagttccctgtttttgcctgcataatcatgtcatattcgttcatgttcctgctcctgtttctgcatttttggtatcgggcctatacaaaagggcaaagactgcccaagactgttaaaaacggcacatgcaagaacaaggataactag

SEQ ID NO: 186503 - DNA, 846 bp, Artificial Sequence
  Description of Artificial Sequence: Synthetic coding sequence
atggccttcagcgacctgaccagccggaccgtgcacctgtacgacaattggatcaaggacgctgaccctagagtggaagattggctgttaatgagtagtcccctcccacagactatcttgctcgggttctatgtctatttcgttacgagcctgggccccaagctgatggaaaaccgaaagcccttcgagctgaagaaagctatgattacctataacttcttcatcgttttattttctgtgtacatgtgttatgagtttgtcatgtcgggatggggcatagggtacagttttagatgtgacattgtcgattactcgagatcacccaccgccctgcgtatggcccgcacatgttggttatactacttttcaaaatttatcgaactgctcgacacgatcttctttgtcttgcggaagaagaatagtcaagtgacgttcctgcacgtgttccatcacacaatcatgccctggacttggtggttcggggtgaagttcgcagccggcggcctggggaccttccacgccctgctgaataccgccgtgcacgtagtcatgtatagctactatggattgagcgcattaggaccagcgtaccaaaagtatctgtggtggaaaaaatatttaacctctctgcaactggtgcaatttgttatcgtggcaatccacataagccaatttttttttatggaggactgcaagtaccagtttccggtctttgcttgcatcatcatgtcctacagcttcatgtttctgctgctattcttgcatttctggtaccgggcatatacaaagggacagcgcctgcccaagactgtcaagaatggcacatgcaagaacaaagataactag

SEQ ID NO: 186504 - DNA, 498 bp, Artificial Sequence
  Description of Artificial Sequence: Synthetic coding sequence
atggccttcagcgacctgaccagccggaccgtgcacctgtacgacaattggatcaaagacgcagatccccgcgtcgaagactggttgcttatgtcctctccattacctcagactatcttgctgggcttctatgtgtacttcgtgacttccctcggcccaaagcttatggaaaacagaaaaccctttgaactcaaaaaggccatgataacgtacaatttcttcatcgtactgttttccgtatacatgtgttacgagtttgtgatgtccggatggggcatcggctactccttccgatgtgatatcgtggattattccaggtcgcccacggccctgcggatggccagaacctgctggctctattatttctccaaattcatcgaactgctggataccattttctttgtgctgcggaagaagaactcacaggtgacctttctgcacgtgttccaccacaccataatgccctggacctggtggttcggcgtgaaatttgcctag

SEQ ID NO: 186505 - DNA, 846 bp, Artificial Sequence
  Description of Artificial Sequence: Synthetic coding sequence
atggccttcagcgacctgaccagccggaccgtgcacctgtacgacaactggatcaaggatgctgacccgcgagtcgaggactggctgcttatgagtagccccctcccacagaccattctgctgggcttttacgtatatttcgtcacctccttggggccaaaactgatggagaatcgtaaaccattcgaactcaaaaaagctatgattacatacaatttctttatcgtgctatttagtgtgtatatgtgctacgagttcgtgatgagtggctggggcatcggttacagctttcggtgtgacatagttgattacagtcgatctcctacagcactgcgaatggcccgcacatgttggttgtactatttttccaagttcatcgaacttttagatactatcttttttgtcctgcggaaaaagaattcccaggtcacatttctacatgtcttccaccatactataatgccttggacctggtggttcggagtcaaattcgcggccggggggctgggtacatttcatgccctgctcaatactgccgttcacgttgtgatgtattcatattatggattgagtgccctcggaccagcctaccaaaagtatctgtggtggaagaaatatctgacctctcttcagctggtgcagtttgtgatcgtggccatacacatttcccagtttttctttatggaagactgcaagtaccaatttcccgtgttcgcttgcattattatgtcctattccttcatgtttttattgctttttcttcatttctggtaccgcgcttacaccaagggtcagagactgcccaagacagtcaagaacggcacctgtaagaacaaggataactag

SEQ ID NO: 186506 - DNA, 498 bp, Artificial Sequence
  Description of Artificial Sequence: Synthetic coding sequence
atggccttcagcgacctgaccagccggaccgtgcacctgtacgacaattggatcaaggatgccgatcccagagtcgaagattggcttttgatgtcaagccccctgcctcagaccatactgctcggtttttacgtctattttgtgacgagtctggggcccaagctcatggagaataggaaaccatttgagcttaagaaggctatgatcacgtacaacttctttatcgtcctgttctcagtgtacatgtgctacgagtttgtgatgtcgggatggggcataggctatagctttaggtgcgacatagttgattactcaagatcacccacagcactgagaatggcgcgtacctgctggttgtactacttctctaagtttatcgaactgttagataccatttttttcgttctgcgaaagaaaaattcgcaggtgacattcctacatgttttccaccacaccattatgccatggacctggtggtttggtgtcaaatttgcttag

SEQ ID NO: 186507 - DNA, 921 bp, Artificial Sequence
  Description of Artificial Sequence: Synthetic coding sequence
atggccgccgccgccgccgccgccgccgccgccggcgccgccggcgggcgtggcagcggccccgggcggaggcgacacctagtacctggtgctggcggggaggcaggcgagggggcccccggcggggctggagactatggaaacggcctggaatcggaggaactggagcctgaggagctcctcctggaacctgaaccggaacccgaacccgaagaagagccccctaggccgagggccccccccggggcaccagggccagggcccgggtccggagcccctggaagccaagaggaggaggaggagccaggactggtggagggagatcccggcgatggcgcaatagaagaccccgagctagaggccatcaaggcgagggtgcgcgaaatggaagaggaggctgagaagcttaaggagctccagaacgaagtggagaagcagatgaacatgtcccccccccctggtaacgcagggcccgtgataatgtccatcgaagaaaagatggaagcggacgcacgcagcatttacgtgggaaacgtagactacggggccacagccgaggaactagaggcacattttcacggctgcggtagcgtgaatcgggtcactattctttgcgacaagttctcaggccacccgaagggatttgcttatatcgaattttccgacaaggaaagtgttcggacttcactggctctggatgagtcactgtttagaggcaggcaaattaaggtgattcctaagcgcaccaaccgtcccgggatatctaccacagaccgcgggtttcctcgtgcccggtacagagcacgtactaccaactacaattcctctcgctcaagattttactcaggattcaactcccggccccgcggtcgggtatacaggggccgggcccgcgccacatcttggtacagtccttattag

SEQ ID NO: 186508 - DNA, 1407 bp, Artificial Sequence
  Description of Artificial Sequence: Synthetic coding sequence
atggccatcgccaccagcgtgtacgtggtgcccccccccgcccggccttgcccaacctcgggccccccagcaggtccttgtcctccctctcccgatctcatctataagatacccagagccagcggtacccaattggctgcccctcgcgacgcccttgaagtctacgatgtccctccaacagcactccgcgttccctcttctggtccgtatgactgtcctgctagcttcagccaccccttgactagggtcgcgcctcagccccccggagaggacgacgccccatatgatgtacccctgacgcccaaaccacccgcagagttggagcctgatctggagtgggaaggtggacgggagcccggaccgcctatttacgcagcacctagtaatctcaaacgggcttctgccctgctgaatctttatgaagcccccgaggagctcctcgctgacggagaagggggcggaaccgacgaaggtatctatgacgtccccttgctgggaccggaagcccctccgtcgccagagccacccggggcattagccagtcatgaccaggacactctggctcaactgctggcccggtccccgccgccccctcatcgtcccaggctcccttccgccgagtccttgtcacgtagacccctgcccgccctgcccgtgccagaagcaccgtcgccatccccagtgcccagtcccgcaccaggccgcaaaggatctatccaagataggcccttgccccctcccccaccccgcctgcctggatacgggggtcccaaggttgagggcgacccggaagggcgagagatggaagatgaccccgccgggcaccacaacgaatatgagggaatcccgatggccgaggaatacgactacgtgcacctcaaggggatggataaggcgcaaggatcccgcccccccgaccaggcatgtacaggggaccctgagctacccgagcggggcatgccagccccccaggaggctttatcccccggggagcccctggttgtgtccacaggcgaccttcagctgctttacttctacgcaggtcagtgccaatcgcactatagcgcccttcaggccgccgtggctgcacttatgagtagcacacaggctaatcagcctcccagactgttcgtacctcactctaagagggtggtggtagccgctcaccggctcgtgtttgtgggtgacaccctggggcgccttgctgcatcggcacctctgcgcgcacaggtgcgcgctgcaggtacggctctcggccaggccctgcgggccaccgtgcttgctgtcaagggggccgccttggggtatccaagtagccctgctatacaggagatggtgcagtgtgtgacagaactcgccgggcaggccctgcagttcaccactttgctgacaagtctcgctccatag

SEQ ID NO: 186509 - DNA, 1179 bp, Artificial Sequence
  Description of Artificial Sequence: Synthetic coding sequence
atggccatcgccaccagcgtgtacgtggtgcccccccccgcccggccatgtccgacttctgggcccccagccggcccatgtcccccaagtccagacctgatttataagatccccagagcctccggaacccagctggccgcgcctcgggacgctcttgaggtttacgatgttccaccaaccgcactgagagtgccttcttctggcccctatgactgcccagcatctttctcccacccccttacaagggtcgccccacagcccccgggggaggatgacgcacctcctagccctgagccaccaggcgccctggccagccacgaccaggacactctggcccagctgctggctcgctctcctccaccgccacaccggccacgcctgccgagcgcagaatccctgagccgaaggccactgccagcattgcccgttcccgaagcccccagcccctcacctgttccatcaccagctcccggacggaagggttccattcaggacagaccgctgccccctccgccgcctcggctgcccggctacgggggtcccaaagtcgagggcgatccagagggtagggaaatggaagatgatcctgcaggacaccacaatgagtatgagggaataccaatggccgaagagtatgactacgttcatttaaagggcatggataaggcccaggggagcagacccccggaccaggcttgtactggtgacccagagctgccggaaaggggcatgccagccccacaggaagccctcagtcccggtgagcccttagtcgtgagcaccggcgatcttcaattgctgtacttctatgccggtcagtgccagtcccactactcagccctccaagccgctgtggctgccctgatgtcgagcactcaggccaaccagccacctagactcttcgtgccacactctaagcgcgtggtggtggcagctcaccgcctcgtgtttgtgggtgacacactgggtcggttggctgccagcgcaccacttcgggctcaggttcgcgctgctggaaccgctctgggccaggcattacgggctactgtgctcgccgtgaagggagccgcattaggctacccctcgagccccgctattcaggaaatggtccagtgtgtgactgaattagccggacaggccctgcagttcacaacgctgctcaccagcttagccccctag

SEQ ID NO: 186510 - DNA, 1326 bp, Artificial Sequence
  Description of Artificial Sequence: Synthetic coding sequence
atgagcgagcgggaggtgagcaccgcccccgccggcaccgacatgcccgccgcgaagaagcaaaaactatcgtcagacgagaattctaaccccgacctttcgggcgacgaaaatgatgacgccgtgtctattgaaagtggcactaacactgagaggccagacacccccacgaacacacccaatgcacccggtcgtaaaagttggggcaagggaaagtggaagagcaaaaagtgcaaatattcttttaagtgcgtcaacagtctcaaagaggatcacaaccagcctctgttcggagttcagtttaattggcactccaaggagggtgatcctctggtgttcgccaccgttggcagcaaccgggttacgttatacgagtgtcacagtcaaggggagatccgactgttgcagtcttacgtagatgccgatgcggacgaaaatttttacacatgcgcctggacctatgacagcaatacctcgcaccccctcctggcagtcgccgggagtcgaggcatcatcaggatcattaaccccatcaccatgcaatgtatcaagcactacgttggccacgggaatgccatcaacgagttaaagtttcatccccgcgatccgaatctgcttcttagtgtctccaaggatcacgccctgagactgtggaatatccagaccgacacattggtggccatatttgggggtgtggaaggccatagagatgaggtgttgagcgctgattacgacctgcttggggagaaaattatgtcctgtggaatggaccatagtctcaagctgtggcgcattaattccaaacgtatgatgaatgcaattaaggaatcctatgactacaacccgaataagaccaacagaccatttatcagtcagaagatacactttcctgatttttcaacccgggatattcaccggaattatgtcgattgtgtgcggtggctgggagacctcattctgtccaagtcatgcgagaatgctatcgtttgttggaaacctggaaagatggaggacgatatcgataagattaagccttccgaaagcaacgtcaccatcctgggcaggttcgattatagtcagtgtgacatttggtatatgagatttagcatggatttttggcagaaaatgctggcactgggcaatcaggttggcaaactgtatgtgtgggatctagaggtggaagatcctcacaaggcgaaatgtactacgctgacccaccacaagtgcggtgctgccatacgacaaaccagtttcagccgggacagcagtatcttgatcgccgtctgtgacgacgcctcgatatggaggtgggatcgtttgcgttag

SEQ ID NO: 186511 - DNA, 1203 bp, Artificial Sequence
  Description of Artificial Sequence: Synthetic coding sequence
atgagcgagcgggaggtgagcaccgcccccgccggcaccgacatgcctgccgcaaagaagcagaagctgagttccgacgaaaattctaatccggatttgtccggagatgaaaatgacgacgctgtctcaatcgaaagcggcaccaataccgaaaggcctgacacccctacgaatacaccgaacgcaccaggccgcaagtcctggggcaaaggtaagtggaagagcaaaaagtgcaagtatagctttaaatgcgtaaacagcttaaaagaggaccacaatcagcccttgttcggcgtgcagttcaactggcattctaaggagggcgatcctttggtctttgcaacagtcggttccaaccgtgttaccctctacgagtgccattcccagggggaaattagactgctgcaatcttacgttgatgcagatgccgatgaaaacttttatacatgtgcttggacttatgactctaatacaagtcacccactactggcagtcgcggggtcacgcggtatcatccgcatcattaaccccatcacgatgcagtgcatcaaacattatgtcggccacggaaatgcaatcaacgaactcaaatttcacccaagggatcccaatctgctgctgtccgtgtccaaagaccacgccctgcgcttatggaatattcagactgacactttggtggctattttcggcggggttgaagggcaccgggacgaagtcctgtctgccgactacgacttacttggggagaaaataatgagttgtggtatggatcacagcttgaagttatggcggattaactccaagaggatgatgaacgccatcaaggagagctacgactacaaccctaataaaactaaccggccctttatttctcaaaaaatccactttccagacttcagtacccgtgatatccatcgcaactatgtggattgcgtcaggtggcttggggacttgattctcagcaagagctgtgagaacgcgatagtgtgttggaagcctggcaaaatggaggacgacattgacaagatcaaacccagtgagtccaatgtcacaattctcgggaggttcgactactctcagtgtgatatctggtacatgagattctctatggatttctggcagaaaatgttagctctcggcaatcaagtgggtaaactatacgtgtgggacctggaggtcgaggacccacacaaagccaagtag

SEQ ID NO: 186512 - DNA, 1401 bp, Artificial Sequence
  Description of Artificial Sequence: Synthetic coding sequence
atgagcgagcgggaggtgagcaccgcccccgccggcaccgacatgccagccgccaagaagcaaaagctgagcagcgacgaaaacagtaaccctgacctctccggcgatgagaacgacgacgctgtctccatcgaatctggcactaacacagaaagaccagacacacccacaaacacccccaatgccccagggaggaaatcctggggcaagggcaagtggaagtcgaagaaatgcaagtacagttttaaatgcgttaacagcctgaaagaggatcacaaccaacccctgtttggcgtgcagttcaattggcacagcaaggagggcgacccccttgttttcgcgactgtcggttcaaaccgagttactctctacgaatgccactcccaaggcgaaattagattactgcagagctacgtggacgcagatgctgacgaaaatttctacacatgcgcttggacatacgactctaacacttctcatccactcctcgctgttgctggttcacgaggcattattcgcattatcaatcccattactatgcagtgtattaagcactatgtcggacacggcaatgccattaacgagctgaagttccatccacgcgacccaaacctgctgttgagcgtgtctaaggatcacgcactgaggctatggaacatacagactgatacactggtagctatatttggaggcgtcgaaggtcatagagacgaagtcctgtctgcagattacgacttgctgggagaaaaaattatgtcctgcggtatggatcattcattaaagctgtggcgaattaatagtaaacggatgatgaatgcaataaaggagagttacgactataatccaaacaaaactaatagaccatttatatcacagaaaattcactttcccgattttagtacacgagatatccataggaactacgtagactgcgtcagatggttaggggacctgatcctctctaaatccggcagggccattttacattctcaccagcagtgcatgagagatcctgtctcccccaacctgagacagcatctttcctgtgagaacgctattgtctgttggaaacctggcaagatggaggatgacatcgacaagattaaaccgagcgagtccaatgtcactatactgggccgattcgattactcccagtgcgacatttggtatatgcggttttctatggatttttggcagaaaatgctagctctgggtaatcaggtcgggaagctgtacgtctgggatctcgaagttgaggatcctcacaaggccaaatgcactacacttacccatcacaagtgcggtgctgccatccgccagacaagtttttctcgggattcaagtatcctgattgcagtatgtgatgacgcttctatttggagatgggaccggctaagatag

SEQ ID NO: 186513 - DNA, 471 bp, Artificial Sequence
  Description of Artificial Sequence: Synthetic coding sequence
atgagcgagcgggaggtgagcaccgcccccgccggcaccgacatgccagcagccaagaagcagaagctgtcatccgacgaaaactctaatcctgacctgagtggcgacgaaaatgacgacgccgtgtccattgagtccggcacaaatacggaacgccctgatacccctacaaacacccccaacgctccagggcggaaatcttggggcaagggaaagtggaaaagcaagaagtgtaagtacagcttcaagtgtgtaaactccctcaaggaggatcacaatcagcctctcttcggggtgcaatttaattggcactccaaagagggggatccccttgtttttgctaccgtgggttctaatagagtgaccttgtacgagtgccattcgcagggtgagatacgtctgcttcagtcttacgtggacgccgacgctgatgaaaacttttatacttgtgcctggaaatgctatcagtag

SEQ ID NO: 186514 - DNA, 660 bp, Artificial Sequence
  Description of Artificial Sequence: Synthetic coding sequence
atggacaactacgccgacctgagcgacaccgagctgaccaccctgctgaggaggtataatattccccatgggcccgtcgtggatctgaacagtactcgcggtgacgcagatatgtatgacctcccaaaaaaagaggatgccttactgtatcagtctaaaggttataatgatgattactatgaggaaagctatttcacgaccagaacctatggcgagcctgaaagcgccggccctagcagagcagtgaggcagagtgtaactagcttcccagatgctgatgccttccatcaccaagtccacgatgatgatttactcagctccagtgaagaggaatgcaaagatagagagcgccctatgtacggccgggactcagcataccagagtatcacgcattatcgccctgttagcgcgtcacgtagcagcctcgacttaagctactatccaacatcaagttctacctcctttatgtcaagtagtagttctagctccagctggcttactaggcgggccattagaccagagaaccgggccccaggcgcagggttaggccaggatagacaggtgcctttgtggggccaactgctcctctttcttgtattcgtgattgtgttattttttatttaccacttcatgcaagcagaggagggcaatcctttctag

SEQ ID NO: 186515 - DNA, 765 bp, Artificial Sequence
  Description of Artificial Sequence: Synthetic coding sequence
atggacaactacgccgacctgagcgacaccgagctgaccaccctgttacggaggtacaatatcccacatggcccagtggttggaagtacacgacggctttatgaaaagaaaattttcgagtacgaaactcagcgccgcagactcagtccgcccagctcatcagctgcctcttcttactcatttagcgacctaaactccacgcggggggatgcggatatgtatgatcttcccaaaaaggaagacgcactgttataccaaagcaaaggctacaatgatgattactacgaagaaagttattttaccaccagaacatacggggaacccgagtctgcgggcccatcccgcgcagtgagacaaagtgtgacaagttttcctgacgctgatgctttccaccaccaggttcacgacgatgacctcctgtcctcttctgaagaagagtgtaaggaccgggagcggcctatgtatggccgtgatagcgcctaccagtcaattactcactatagacccgtaagtgccagcaggtcctcgctcgacctgtcatattaccccacatcttcttccacctcctttatgagctcttcctcttctagctcttcctggctgacaagacgcgccatccgacctgaaaaccgggcgcccggcgctggattgggacaggaccggcaagtgccattgtggggtcaactgcttctgttcttagtgttcgtcattgtgctttttttcatctatcactttatgcaggctgaggaggggaacccattctag

SEQ ID NO: 186516 - DNA, 441 bp, Artificial Sequence
  Description of Artificial Sequence: Synthetic coding sequence
atgaccaccaacgccggccccctgcacccctactggccccagcacctgagactcgacaatttcgttcccaacgatcgcccaacatggcatatactcgcagggctttttagcgtgaccggcgtgctggtcgtaaccacctggctgctatccggcagggctgcagttgtgccactgggtacttggcgtaggctgagcctgtgttggttcgctgtatgcgggttcattcacctggtaattgagggttggtttgtgctttattacgaagatttgctaggggatcaggccttcttgtcccagctgtggaaagaatatgcgaagggtgacagtcgctatatactcggagataatttcactgtatgcatggaaaccattacggcctgcctgtggggccccttgagcctgtgggtggtgatcgctttcctgcggcaacaccctctgtag

SEQ ID NO: 186517 - DNA, 483 bp, Artificial Sequence
  Description of Artificial Sequence: Synthetic coding sequence
atgaccaccaacgccggccccctgcacccctactggccccagcacttgcgcctagacaattttgttcctaacgatcgccccacgtggcatatcctggctggcctgttcagtgttaccggcgtcctggtggttacgacctggttactctctggccgagcagccgtggtgcccctcggaacctggcgtagactttcgctgtgctggttcgcagtatgtggattcatacatctcgtgattgaaggctggttcgtactgtactacgaagacctactgggggatcaagccttcctcagccaattgtggaaggagtacgcaaagggtgattcgcgatacatactgggtgacaatttcaccgtctgtatggagactataacagcatgtctctggggccccctatctctatgggtggtgattgcttttctgcgacagcaccccctacgtttcattcttcagttggtggtttcagtcggccagatttactag

SEQ ID NO: 186518 - DNA, 693 bp, Artificial Sequence
  Description of Artificial Sequence: Synthetic coding sequence
atgaccaccaacgccggccccctgcacccctactggccccagcacttaaggctggacaattttgtgcccaacgaccggcctacctggcacatcctggccggtctcttcagcgtaacaggcgtgttggtggtcacaacctggttgctatccggaagagccgccgttgtccccttaggtacatggagacgcctgtcactatgttggtttgcagtctgtggctttatccatctcgtcatagaagggtggttcgtgctctactatgaagacttgcttggcgatcaggctttcctgagccagctgtggaaagaatacgctaaaggggattcccgctatatcctgggcgacaattttacagtctgcatggaaacaattaccgcctgcctgtgggggcctctgtccctgtgggtggtgatcgccttcctacggcagcaccctctgcgctttatactacagcttgtggttagtgttggtcaaatctacggcgatgtcctgtactttctgacggaacatagggatgggttccagcacggagaactgggtcaccccctgtatttctggttttactttgtcttcatgaatgcactctggttagtgctccccggcgtgctggtgctggatgctgtcaagcacctaactcacgctcagagtacactggacgccaaggctaccaaagcaaagagcaaaaagaattag

SEQ ID NO: 186519 - DNA, 873 bp, Artificial Sequence
  Description of Artificial Sequence: Synthetic coding sequence
atgtgcctggccggctgcaccccccggaaggccgccgcccccggcaggggagccctgcctcgcgctagactgccaaggactgcccctgccgccgccaccatgtttcaaccggctgccaaacgtgggtttacaatagaatccctggtggctaaggatggcggaacgggcggaggcaccggagggggtggcgccggttcccatctcttggcagcagcagcttctgaagagccccttcgccccaccgccttgaattacccccacccctccgcggccgaagcagcctttgtgtctggtttccctgctgctgcagccgcgggggctggccgaagcctttatgggggacccgagctggtgttccctgaggccatgaaccacccggccctgacagtgcaccctgcccaccaattgggagcatcgccactccagccgccacatagctttttcggggcccagcacagggatcccctccatttctatccatgggtgctgagaaacaggtttttcggccatcgcttccaggcgtcagacgtgccccaagatggactgttgctacacggccccttcgccaggaagcccaaacggatccgaacagctttcagcccttctcaactgctcaggcttgagcgcgctttcgagaagaatcattatgtggtgggcgctgaacgaaaacagctcgctgggtccctctctctctcagagactcaggtgaaagtgtggttccaaaaccgccggaccaagtacaagcggcagaagctggaggaagaaggacccgagtcagagcagaaaaaaaagggcagccaccacatcaaccgctggcgtattgctactaagcaggctaatggggaggacatcgacgtgacttctaacgactag

SEQ ID NO: 186520 - DNA, 759 bp, Artificial Sequence
  Description of Artificial Sequence: Synthetic coding sequence
atgttccagcccgcccccaagcggtgcttcaccatcgagagcctggtagccaaagatagcccattacctgccagcagatctgaggaccccattcgtcctgccgccttgtcatacgccaactcctctccgatcaatcccttcttaaatggctttcactccgcggcggcggctgccgccggccgcggggtttactcaaacccagacctagtcttcgccgaagccgtgtcgcacccccccaaccctgccgtaccagtacatcccgtgccaccgcctcatgccttagccgcacacccactgccctcatctcattccccccatcctctgtttgcaagccagcagcgggacccgtcaaccttttacccctggcttatccaccgctatcgttatctcggccacaggttccaggggaacgacacgtccccggagagctttctgctccacaatgccctcgcccgtaaaccaaagcggattcgaaccgcctttagcccgtctcaacttttgcggctggaacacgcctttgagaagaaccattacgtggtaggcgcagagagaaaacagctggcccattctttaagccttaccgaaactcaggtcaaggtgtggtttcaaaatcggcgcacgaagtttaagagacagaaactagaagaagaaggcagtgactcacagcagaagaagaagggcacccatcacattaatagatggcggatcgcgaccaagcaggccagccccgaggagatcgatgtgactagcgacgactag

SEQ ID NO: 186521 - DNA, 510 bp, Artificial Sequence
  Description of Artificial Sequence: Synthetic coding sequence
atgttccagcccgcccccaagcggtgcttcaccatcgagagcctggtggcgaaagacagtccactccccgccagtcggagcgaagatcccatcagaccagccgctctgagctacgcaaatagtagcccgattaaccccttcttaaatggattccactctgctgccgcggctgccgcaggacggggagtgtattcaaatcccgacctggtcttcgctgaggccgtgtcacatccccccaatccggcagtcccggttcatcctgtgccccctccccacgctctggctgcacatccgttgccatcctcgcacagtccacatcccttatttgcgagtcaacaacgtgacccctccacattctatccgtggttaattcacagatacagatacctgggtcaccgcttccagggcaagagcatggtctcagagccaaaaaataaggtccagaaggccgaggccggcggacggcggctgagatttgcgacaaaagagaagagagatgccccctactag

SEQ ID NO: 186522 - DNA, 957 bp, Artificial Sequence
  Description of Artificial Sequence: Synthetic coding sequence
atggccatcaagagcatcgccagccggctgcggggcagccggcggttcctatctgggttcgtagctggcgccgtggtgggcgcagccggcgccggcctcgcggctcttcaattctttagatctcagggcgcagagggcgcgttgaccggtaagcagcccgatggcgacgctgacaggaaacactgcaagtttaagcccgatccgaacatcccacccaccttctccgccttcaacgaggactatgtagggtctggctggtctcggggccatatggccccggcaggtaataacaagtttagcagcaaagcaatggccgagacattctacctgtccaatattgttccacaggattttgacaataattccgggtactggaaccggatcgaaatgtactgtcgggaacttaccgagcgtttcgaggacgtttgggtggtgagtggtcctctcacactgcctcaaactcggggcgatgggaagaagatcgtttcctaccaagtgataggagaggataacgtcgcagtgccaagccacctatataaagttattctggcccgacgctccagcgtaagcaccgagccccttgctctaggagcgtttgtcgtgcccaacgaggccattggatttcagccccagcttactgagtttcaggtctccttgcaggatctggaaaagctgtccggcctggtcttctttccacacctggatcgcacgtctgacatcaggaatatctgctctgtagacacttgtaagttgttagacttccaggagtttacattatatttatctacacggaagatcgaaggggctcgatctgtcttacgcctcgagaaaatcatggagaacctgaagaacgctgagatagaaccggatgattatttcatgtctcggtatgaaaaaaaactggaagagttaaaggctaaggaacagtccggaactcagattcggaaaccatcctag

SEQ ID NO: 186523 - DNA, 1107 bp, Artificial Sequence
  Description of Artificial Sequence: Synthetic coding sequence
atggccatcaagagcatcgccagccggctgcggggcagccggcggttcctgagtgggttcgttgccggagcggttgtgggcgctgctggcgccggactcgcagcgcttcagttctttagatctcagggtgccgaaggagctctgaccggcaaacagccagatggaagcgcggagaaggcagtcctggagcaattcgggtttccactgacggggacagaagcacgatgctacactaaccacgcactgagctatgaccaggctaaacgtgtgcctcgttgggtcttagagcacatcagtaagagcaaaatcatgggagatgctgaccgaaagcattgcaagtttaagcctgacccaaatattcctcccacgttcagtgcgtttaacgaggactatgtagggagtggatggagtagaggccacatggcccctgcaggaaacaataaattctccagtaaggccatggcggagacattctacttgagcaacatcgttccccaggatttcgataacaactctggatactggaataggatcgaaatgtactgccgagaactgaccgagaggttcgaggacgtatgggttgtgtcagggccactgaccctgccccagacccgcggcgacggaaagaagattgtttcatatcaggtcatcggtgaggacaatgtggccgtgccatcccacctctacaaggtgattcttgctcgcagatctagcgtttccaccgaaccattagccctcggggctttcgtggtccctaatgaagcaatcggttttcagccccagctgacagaatttcaggtgtctctgcaggatctggaaaagctctctggactcgtgtttttcccacatctcgatcggacaagcgacattagaaacatctgttcagtggacacgtgcaagcttctcgatttccaagagttcacgctatacctgagtactcgcaaaatcgaaggggcaagaagcgtcctcagattggagaagatcatggagaacttaaaaaacgctgagattgagcccgacgattatttcatgtccaggtacgagaagaaattagaagaattgaaagccaaggagcagagcggtacgcagatcagaaaaccaagctag

SEQ ID NO: 186524 - DNA, 450 bp, Artificial Sequence
  Description of Artificial Sequence: Synthetic coding sequence
atggcccccgccggcaacaacaagttcagcagcaaggccatggccgagaccttttacctgtccaacattgtcccgcaggactttgacaataattctggctactggaacagaatcgagatgtattgtcgtgagctcacagaacgcttcgaggatgtctgggtcgtttccggtccccttactctgccacagactcggggggacggtaagaagatcgtcagctatcaggtaatcggcgaggataatgtcgcagtgccctcccatctgtacaaagatcatgccggatgctgcgtggaaagccccctcgggaccaggacaagcgaggaggccactgcccgcatccaggagcgtgatgacgggggctctgaccagaggtctggattagtcgagctgggcatttatttcgagggccgagccaacagaatctcgggccggatcggttgtcgcgtgtag

SEQ ID NO: 186525 - DNA, 819 bp, Artificial Sequence
  Description of Artificial Sequence: Synthetic coding sequence
atgggctacttcctgaagctgtacgcctacgtgaacagccacagcctgttcgtttgggtgtgcgacagatcatacaaacggtcctttcgacccatgattcttaataaaattaaagagctgtccagaaatcagttctccactatgtcccacctccgcaaagatagccagccttcctcacctggagacgatgccatggatcgcagtgggctgccggacctacaggggagattcgagctctctggcaagaaccgtcaataccccctcgacgccttagaacctcaaccttccataggagacatcaaggatatcaagaaagcagccaaaagcatgcttgatcccgcacacaaaagtcacttccatcccgttaccccatcccttgtctttttgtgttttatcttcgatgggctccaccaggctctgctatcggtgggagtgtctaaaaggtccaacaccgttgtgggcaatgagaatgaggaacgaggcaccccttacgcttctagattcaaggacatgcccaactttatcgctttggagaaaagctccgtgctccgccactgctgcgatctgctgatcgggattgcagctggcagcagtgacaagatttgtacatcttcccttcaggttcaaagacgtttcaaagccatgatggcgtctatcggtaggctcagccatggggaatccgcagatctgctgatttcctgcaatgccgaatccgcgatcggttggatttcaagcaggccatgggtgggggaactgatgttcacactcctgttcggagactttgagtccccattgcacaaactgagaaagtctagctag

SEQ ID NO: 186526 - DNA, 894 bp, Artificial Sequence
  Description of Artificial Sequence: Synthetic coding sequence
atgcgggccctgcgggccggcctgaccctggccagcggcgccggcctgggagcagttgtggaaggatggcgccggcgcagagaggacgcccgtgctgctcctgggttgctgggtagactgcccgtcttgcctgtggcggcagcagccgagctgccacctgtcccagggggtcctcggggcccaggcgaacttgcaaagtacggtctgcctggactcgcacagttaaagtcacgggagtcctatgtcctttgctacgatccccggactcggggcgctctgtgggtggtcgaacagctgcgtcccgaacggctgagaggggacggcgaccgtcgtgagtgcgactttcgcgaggacgatagcgtgcacgcttatcacagagctaccaacgctgactacagagggtccggcttcgatagggggcatctcgcagcagccgccaaccataggtggtctcagaaggccatggatgacacattttacctatcaaacgtcgccccccaggttccccacctcaatcagaatgcatggaataaccttgagaagtattcgcgatctctgactcgttcctaccagaacgtttatgtgtgtaccggcccgctcttcctgccaaggaccgaagccgacgggaagtcatatgtaaagtaccaggtgattggtaagaaccacgttgcagtccctacacatttttttaaggtgcttattctcgaagccgccgggggccagatcgagcttcgaacctacgtaatgcccaacgctccagtggatgaagcaatcccacttgagagatttctggtgccgatcgagtcaatcgaacgcgccagtggtttattgtttgtgccgaatatcttagcgcgtgctggcagccttaaagctatcaccgccggctccaaatag

SEQ ID NO: 186527 - DNA, 2847 bp, Artificial Sequence
  Description of Artificial Sequence: Synthetic coding sequence
atggtgttcctgcccctgaagtggagcctggccaccatgagcttcttactgtcctccctcctggccctgctgacggtctcgactccatcgtggtgccaatccaccgaggcctctcctaagcggagtgatggcacaccatttccctggaacaagatcagactgcctgaatatgtgatcccagtacactatgatctgctgatccacgcaaacctgaccacacttaccttttggggcaccactaaggtggaaattaccgcgtcgcagcccacctctaccatcattctccactctcaccatttacagattagcagggcaacattgcggaagggcgcaggcgagcgtctatctgaagaacccctccaggtcctcgaacatccacgccaggagcaaatcgccctcttggcaccagaaccattactggtgggcctaccctataccgtggtaattcactatgcgggcaatctgtccgaaacctttcatgggttctataaatctacatatagaacaaaagagggtgagttgcgcatcctcgcctcaacccagtttgaaccaactgcagcccgaatggctttcccctgctttgatgagccagcctttaaagcaagcttcagtattaaaattagacgcgaacccaggcatctggccatctccaacatgcccttagtgaagtctgtcacggttgccgagggtctcattgaggaccatttcgatgttaccgtaaagatgtcgacgtaccttgtggccttcattatttctgatttcgaatcagtctcaaagatcaccaagtctggagtaaaagtaagtgtgtatgctgtgcccgataagattaaccaagccgattacgcgctcgatgctgccgttaccttactggagttctatgaggactactttagcattccctatccattacctaagcaggacctggcggcaatccccgatttccaatcaggagccatggaaaactggggtctgaccacctaccgggagtccgccctgcttttcgatgcagaaaagtcaagcgctagttccaaattgggcatcaccatgactgtggcccacgaactcgcccaccagtggtttggcaacctggtcaccatggagtggtggaacgatctgtggcttaatgaagggtttgccaaattcatggagttcgtgtcggtttctgtgactcatcccgagctgaaagttggggactactttttcggcaaatgcttcgacgccatggaggtagacgcactgaactcctcccaccccgtgtctacacccgtcgagaatccggctcagattagagagatgtttgatgatgtgagttatgataagggcgcttgcattttgaatatgctgcgcgagtatctatccgcagatgccttcaaatctgggatcgtgcagtatttacagaaacatagttacaagaacaccaagaacgaagacctgtgggactctatggcaagcatctgccctaccgatggagtgaaggggatggacggtttctgctctcgttcccagcatagcagctccagttcccattggcatcaggagggtgtggatgtgaagacaatgatgaacacctggacccttcagaaaggctttccactaattacaatcacagtgcgggggcgcaatgtacatatgaaacaagaacattacatgaagggttccgatggagctccggatactggatatttatggcatgtccccctgacttttattacctccaaaagtgacatggtgcaccggttcctgctcaagaccaagacagacgtgctgattctccccgaggaggtcgaatggattaagttcaatgtcggcatgaacgggtattacatagtgcattacgaagacgacggatgggactctctgacgggtttgttgaagggtacacacacggccgtgtcgtctaacgacagagcatcactgattaacaacgcctttcagctggtatctatcgggaagctcagtatcgagaaagccttggatttgtcactgtacttaaaacatgagaccgagatcatgcccgtctttcaaggccttaacgagctgatcccaatgtacaagctaatggagaagagggacatgaacgaggtggagacccaattcaaggcttttctgatcaggttgctccgcgatcttattgacaagcagacctggacagatgagggatctgtgagcgagcggatgctgagaagtcagctgttgctgctggcctgcgtgcataattatcaaccttgcgtacagcgggccgaaggctattttcgcaagtggaaagagagtaatggcaatctaagcctgcccgtggacgtgacacttgccgtgtttgcagtgggggcgcagtcaactgaaggatgggacttcctgtatagtaagtaccagttctcactgtcctccaccgagaagtcacaaattgagttcgcgctttgtagaacacagaataaagaaaagcttcagtggctgctcgacgagtcgtttaagggcgataagattaagactcaggaatttccccagatcctgaccctgattgggcgcaatccagtgggctaccctctggcttggcagttcttgcgcaagaattggaacaagctggtccagaaatttgaactgggcagttcttccattgcccatatggtgatggggacaacaaaccagttttccacgagaacccgcctggaggaggtgaaagggttcttctcctcactgaaagagaatgggagtcagctccgctgtgtgcagcagacaattgaaacgatcgaagagaatatcggctggatggacaagaactttgataagatcagagtgtggcttcagagcgaaaaacttgagcacgatccagaggccgacgctaccggatag

SEQ ID NO: 186528 - DNA, 2826 bp, Artificial Sequence
  Description of Artificial Sequence: Synthetic coding sequence
atggtgttcctgcccctgaagtggagcctggccaccatgagcttcctgctgtccagcctgctcgctctgttgaccgtctctaccccaagctggtgccagagcactgaggccagtccgaagaggtctgacggcaccccatttccgtggaacaagatcagactgcctgaatacgtgattccggtccactatgacctgctcatccatgcgaaccttacgacactaacattctgggggactacaaaggttgaaatcaccgcctcccagccgactagcacaatcatcctccattcacaccatctgcaaatctctagagctacattacgcaaaggtgccggcgagaggctgtcagaagagccactgcaagtcttggaacacccgagacaggaacagattgctctcctcgcaccagagcccctgctggtgggcttaccttatacggtagtcattcattacgctggtaacttgtcggaaaccttccacggattttataaaagcacttaccggaccaaagaaggcgaactgagaattctggcctcaacgcaatttgaacccactgccgccagaatggccttcccatgtttcgacgagccggctttcaaggcttccttttctattaaaataaggagggagccacggcatctcgccattagcaacatgccactggtgaagagtgtcacagtggctgagggcctaatcgaagaccactttgatgtgacggtcaagatgtccacttacctggtggcatttattattagcgactttgagagtgtgtccaagattacaaagtctggagtaaaagtgtctgtctacgccgtcccagacaagattaatcaagccgattacgccttggacgctgcagttactctactcgaattctatgaggactacttctcaattccataccctttaccaaagcaggacctcgcggccatcccagattttcagtcaggggctatggaaaattgggggctaaccacatatcgagagtctgcattgctgtttgatgccgaaaagtcttccgccagctcaaaactggggatcactatgacggtcgctcacgaactcgcccaccaatggttcggaaacctcgtaaccatggagtggtggaatgatctgtggctaaacgagggcttcgccaaatttatggagttcgtgtcagtaagcgttacccaccccgagttaaaggtcggcgattacttttttgggaagtgttttgacgctatggaggtggatgctcttaatagttctcacccagtttctacacccgtcgagaatcccgcccagattagggaaatgtttgacgatgtgtcgtacgataaaggagcctgcatactcaacatgctgcgcgaatacctatctgccgatgccttcaagagcggaatcgtgcagtatctgcagaagcactcctacaaaaatacaaagaacgaggacttatgggactcaatggcctcgatctgtcccaccgacggtgtgaagggcatggacgggttttgtagcagaagccagcactcctccagtagcagtcattggcaccaagaaggggtggatgttaagactatgatgaacacatggacgctgcagaagggttttcccctcatcaccatcaccgtgagaggtcggaatgtgcatatgaaacaggagcattatatgaaaggaagtgacggagcacctgatacgggatatctatggcacgtgcccctgacatttatcacatctaaatcagacatggtgcatcggtttctactgaagaccaagaccgatgtgcttattctgccagaagaagttgaatggattaaatttaatgtgggtatgaatggctattacatcgtacattacgaggatgatggttgggacagcttgaccgggctactcaaaggaacccacaccgccgtctcaagtaacgatcgggcatccctcattaacaatgcattccaattggtgtcgatagggaaacttagtatcgaaaaagccctcgatctcagtctgtatttaaagcacgaaaccgaaatcatgcctgtgttccaaggcttaaatgaattgatccccatgtacaagctcatggaaaagcgggacatgaacgaagtggaaacccaatttaaggccttcctcatccgactcctgcgggacctaatcgataaacagacttggaccgatgaagggtccgtgtctgagcgaatgctgcgcagtcagctgttgctgctggcatgtgttcacaactatcagccttgcgtacagcgggcggaaggttacttcagaaaatggaaagagtcgaatggaaacctcagcctacccgtggatgtgactcttgccgtattcgcagttggtgcgcaatccacagagggttgggacttcctatattcaaaataccagttttcactttcctcgacagagaaatcacagattgaattcgccctatgccggactcagaacaaagaaaagttacagtggctattggacgagtcctttaagggcgacaaaattaagactcaagagttcccccagatcctgacgttgatcggcaggaaccccgtcggctacccgctggcgtggcagtttctgcgaaagaactggaacaagctcgtgcagaagttcgaactcggatcctcctccatcgctcacatggttatgggcacgactaaccagttctcgacgcgcactagattggaagaagtgaagggcttttttagcagcttgaaagagaatggttctcagttgaggtgcgtgcagcagactatagagaccatcgaggaaaatatcggctggatggacaagaactttgacaaaattcgagtttggttacagtcagaaaagctcgaacgcatgtag

SEQ ID NO: 186529 - DNA, 2826 bp, Artificial Sequence
  Description of Artificial Sequence: Synthetic coding sequence
atggtgttcctgcccctgaagtggagcctggccaccatgagcttcttgctgagttctctgttggccttgctgaccgtctccacgcccagttggtgccagagcacagaggcctcacctaagcggagcgacgggaccccgttcccctggaacaagattcgtctgccagagtatgtgatcccagttcattacgacctgctgatacatgccaatcttactaccctgacattctggggcacgactaaagtagagattaccgcttcacaacccaccagcacaatcatactgcactcccaccatttacagatctctcgcgccaccctgaggaagggagctggcgagagattatcagaggaaccgctccaggtccttgaacacccaaggcaggagcagattgctctgctcgcacctgagccattactggtgggcctcccctacacagtggtgattcactacgcgggcaatctctccgagacttttcacggcttctacaagtcgacatatagaacgaaggagggtgaactgcggatcctcgcttccacccagtttgaaccaactgctgcgagaatggcctttccgtgctttgatgagcccgcctttaaggcgtccttcagtatcaagatcaggagggagcctcgtcacctcgcaataagtaatatgcccctggttaagtccgttaccgtggccgaggggctgatagaggaccacttcgatgtgacggtgaagatgagtacttatctggtggcttttattatttcagacttcgaaagtgtcagcaagattacaaagagcggcgtgaaggtgagcgtttatgccgtccctgacaaaattaatcaggcggactacgctctggatgctgccgtgacccttctcgaattctatgaggattacttttccataccttatcctctccccaagcaggatttagccgccatccctgattttcaaagcggagcaatggaaaactggggactgacaacttatagagagagcgccctcctttttgatgcagagaaaagtagtgcctcctcaaagctgggcattacaatgacggtggcgcacgaactggcccatcaatggtttggaaacctcgtgacaatggagtggtggaatgatctttggctgaacgaggggtttgctaagttcatggagttcgtctccgtttcagtgacccacccagaattgaaggttggcgactactttttcggcaaatgctttgatgccatggaggtcgacgccttgaatagtagtcatcccgtgtctacaccagttgagaaccccgctcagatccgtgaaatgtttgatgacgtgagctacgacaaaggagcctgtatactcaacatgctgcgcgaatacctgtcagccgacgcatttaaatcaggaattgtccagtatcttcagaagcactcttacaagaataccaagaatgaggacctgtgggattctatggcaagtatctgtcctacagatggggtcaaaggaatggatggcttttgttcccgctcacagcactcctcttcgagctctcactggcatcaggagggcgtcgatgttaaaaccatgatgaatacttggacactgcagaaagggtttccccttatcactattacagtgcggggacgcaatgtgcacatgaaacaggaacactacatgaagggatccgacggagccccagacacagggtatctctggcacgtgcctctgactttcattactagcaaaagcgacatggtgcaccggttccttctgaaaactaagactgatgtgctaatcctgccagaagaggtagaatggattaagttcaacgtcgggatgaacgggtattacatcgtccactacgaagacgacggctgggacagtctgactggcctgctgaagggaacccacactgccgtgtctagcaatgatcgtgcatcattgattaacaatgccttccagctggtgtcgattggcaaactgtccatcgaaaaagctctggatctatctctgtatctgaagcacgagacggagatcatgccagtatttcagggtttgaatgagttaattccaatgtataaattaatggagaagagggacatgaacgaagtcgagacccaatttaaggcctttttaattaggttactacgagacctgatcgacaagcagacttggactgacgagggcagcgtgtcagaaaggatgttgcggtctcagctgctgttgctagcatgtgtccataactaccagccttgtgtccagagagcggagggctacttcaggaagtggaaggaatccaacggcaatctctcactgcccgtagatgttactttggccgtatttgctgtcggcgctcagagcactgaagggtgggattttctgtacagtaagtaccagttctcactgtcttccacagagaaatcacaaattgaattcgcactgtgtcgcacccagaataaagaaaagctgcagtggttgctggacgaaagtttcaagggagacaagattaaaacccaggaatttccccagatcctgacgctgatcggtaggaaccccgtggggtacccgctcgcgtggcaattcctgcgaaagaattggaacaaactggttcagaagttcgaattgggcagttcctccatcgcacacatggttatggggaccacaaatcaattctccacgcgaacacgtttggaagaggtcaaaggcttcttcagctctctgaaagagaatgggagccaactgcgttgcgtgcagcagactatcgagacgattgaggagaacattggatggatggataagaatttcgataagatccgggtttggctgcagagtgagaagcttgaacgcatgtag

SEQ ID NO: 186530 - DNA, 390 bp, Artificial Sequence
  Description of Artificial Sequence: Synthetic coding sequence
atggtgttcctgcccctgaagtggagcctggccaccatgagcttcctactgtcctcattactcgccctcctaacagtgtccaccccctcctggtgccagagtaccgaggcatccccaaagcggtcagacggaacacccttcccctggaacaaaatccgtttaccagaatacgtgatcccagtacattacgatctactgattcacgccaaccttacgaccctgaccttctggggcacgactaaggtggagattactgcctcacaaccaacctcaacgatcatcctgcactcacaccacctgcagatcagtcgagccacgcttagaaagggagctggcgagcgcttgtctgaagagcctctgcaggtgctggaacatccaaggcaggagtag

SEQ ID NO: 186531 - DNA, 2748 bp, Artificial Sequence
  Description of Artificial Sequence: Synthetic coding sequence
atgttccacagcagcgccatggtgaacagccaccggaagcccatgttcaacatccaccgcggcttttactgtctcaccgccatcttacctcaaatttgcatttgtagccagttttccgtcccctcttcttaccattttaccgaagaccccggggccttccctgtcgcaactaacggtgagcgatttccttggcaggaactcagactgccttccgtcgtaatcccccttcactatgatctgtttgtgcaccccaacctcacatcattggatttcgttgccagtgagaaaatagaagtgctagtctcaaatgcaacgcagtttatcatccttcatagcaaggacctcgagatcaccaacgctactctgcaatcagaggaagattccagatatatgaaacctggcaaagagctgaaagtgctgagttaccccgctcacgagcaaattgccctgttagtccccgaaaaactcactcctcacttgaagtattatgtggccatggacttccaggccaaactcggggacggctttgagggtttttacaaaagcacatacagaacacttgggggtgagaccagaattcttgctgttacagactttgaacccacccaagctcgaatggcattcccatgcttcgacgagcctctgttcaaggccaacttcagtattaaaattaggagggagagcagacatatcgccttatctaacatgcctaaagttagcatatacgcctctcccgacaaaagaaaccagacccactatgcccttcaggcaagcttaaaactcttagacttttatgagaaatactttgatatttactatcccctgtcaaaactagatttgatcgccattcctgacttcgcccccggcgctatggagaattggggactgataacttatagggagacaagcctgttatttgaccctaagacaagctcagcgtcagacaaactgtgggtaactagagtgatcgctcatgaactggcccaccagtggttcgggaatctcgtcaccatggagtggtggaacgatatttggttgaaagaaggctttgcaaaatatatggagttaattgcagtgaacgctacataccccgagctgcagtttgacgactattttctgaatgtttgttttgaggtaattacaaaggacagtctgaatagctcaaggcccatctctaagccagctgagactcccacacaaatccaggagatgttcgatgaggtcagttacaataagggcgcctgcattctcaacatgctgaaggattttcttggagaggagaaatttcaaaagggcattatacagtatctgaagaagtttagctacaggaacgcgaagaacgacgatctgtggtcatccctgagtaatagctgcctggaatctgacttcacctccggcggggtctgtcacagtgatccaaagatgaccagtaatatgctggcattcttaggcgagaacgccgaggtcaaggaaatgatgaccacgtggacgctgcagaaggggatccctctattagttgttaaacaggatggctgcagcttaaggcttcagcaagagagattcctgcagggcgtttttcaggaggatcctgagtggcgcgcccttcaggagcggtacctttggcatatcccattgacctattccacgagttcgtctaacgtcattcaccgtcacattcttaaatctaagaccgacacccttgatttgcccgaaaaaaccagttgggtaaaatttaacgtggatagcaacggatactatatcgtgcattacgagggacatggatgggatcagctgatcactcaacttaaccagaaccacaccctgttgcgtccgaaggacagggtgggcctaatacacgacgtgttccagttagtgggggcaggacgattgactctggataaggccttggatatgacttactatctgcaacatgagacatcttcccctgccctgctggaaggcctgtcttatcttgaatcattttaccacatgatggataggaggaacatttcagacatttccgaaaaccttaaacgctacctgctccaatactttaagcccgtcatcgatagacaatcttggtcagacaagggcagcgtatgggataggatgctcaggtccgctctgttaaagctggcatgcgatctgaaccacgccccctgtattcaaaaagccgccgagctgttttcccaatggatggaatcatccggtaaactcaacatacctacggacgtactgaaaatagtgtatagcgtgggcgcgcagacaacggcggggtggaactacttgctggagcagtacgagctgagtatgtcgtctgccgaacagaacaaaatcctctacgcattgagcacatcaaaacaccaggagaaactccttaaacttatagagctgggcatggagggcaaggtgataaagacacagaaccttgcagcactcctgcacgctatcgccagaagacctaaaggccagcagctggcatgggattttgtgcgcgagaattggactcatctcctgaaaaagtttgacctagggtcgtacgacatacgtatgatcatcagcggtacaactgcccatttctcctccaaagataaactccaggaggtgaaactcttcttcgagagcctagaggcccagggtagccatctggacatttttcagacagtcttggagaccataactaagaacataaagtggctcgagaagaacctgcccaccctccgcacgtggttgatggtaaacacatag

SEQ ID NO: 186532 - DNA, 2883 bp, Artificial Sequence
  Description of Artificial Sequence: Synthetic coding sequence
atgttccacagcagcgccatggtgaacagccaccggaagcccatgttcaacatccatcgggggttttactgtctgactgccatcctgcctcagatatgtatttgcagtcagttttccgtccccagctcataccactttaccgaggacccaggagcattcccagttgccactaatggagaacgcttcccatggcaggaactaagactgcctagtgtggtgattcccttacactatgatttattcgttcaccccaatttaacctcgctcgactttgtcgcttcagaaaaaattgaagtgctggtgtccaatgcaacccaatttatcatcctgcattccaaagatttggaaataactaacgcaacactccagtctgaagaagattccagatacatgaaacccggcaaggaactgaaggtcctctcttacccagcgcatgagcagatcgctctcctggtgcccgagaaactcaccccccatttaaagtattacgttgctatggacttccaggccaagttgggtgacggcttcgaagggttctataaatccacctataggaccctggggggtgagactcgcattttggctgttaccgacttcgagcctacgcaagctcggatggcattcccgtgcttcgacgagccattgtttaaagctaacttttcgataaaaattcgcagggagtctcggcatattgccttaagcaatatgcccaaagttaagaccattgagctcgagggaggcctgctagaggatcatttcgagaccaccgttaagatgtccacatatcttgtggcctacattgtttgcgattttcatagcctgtctggatttactagtagcggagtcaaagtatcaatttacgcgtcccctgataagagaaaccaaacccactatgccctccaggcttctctgaaattactggatttctatgaaaaatactttgacatctactatcccttaagtaagctagatcttatcgccatcccagactttgcccctggagctatggagaattggggcttgattacatatcgcgaaacttcgctgctctttgacccaaaaacctcatctgcttcagataagctctgggttaccagagtgattgcccacgaactcgcccaccagtggttcggcaatctggttaccatggaatggtggaacgacatctggctgaaggagggttttgcaaagtatatggagttgattgcggtgaacgctacttatccagagctgcagtttgatgactactttttaaatgtgtgttttgaagtcataacaaaagacagtttaaattcatccagacctatctcgaaacccgccgagaccccaacacagatccaagagatgttcgatgaggtatcatataataaaggcgcctgcattctgaacatgctgaaggattttctgggcgaggaaaaattccagaagggaattattcagtacctgaagaaattcagctaccgcaacgccaagaatgatgacctctggtcaagtctctccaattcttgcctggaatctgatttcacatccggaggcgtttgtcattcagatcctaaaatgaccagcaacatgctcgcctttttgggagagaacgccgaggtcaaggagatgatgacaacctggaccttgcagaagggcattcccctgctggttgtgaaacaggatggctgctcgttgagactgcagcaggagaggttcttgcagggtgtgttccaagaagaccccgagtggcgggctctgcaggaacgctacctttggcacattcctctgacttactcaaccagcagctccaatgtgatccatagacatattctcaagtctaagaccgatactctggaccttccggagaaaacgagctgggtgaaatttaatgtggactccaatggttactacatagtccattacgaggggcatggatgggatcagttgatcactcagctgaaccagaatcacaccctgttgcggccgaaggatagagtcggtttgattcacgatgtcttccaactcgttggcgctgggaggctcacactcgacaaggccttggatatgacctattatctgcagcatgagacctccagccctgctctgctggaagggctgtcatatctggagagcttctaccacatgatggataggcggaacatctctgacatctcagaaaatcttaagcggtacttactgcaatactttaaaccagtgattgacaggcagtcctggagtgacaaaggctccgtgtgggatcgtatgctccggtcggcccttttgaagttagcttgtgacttgaaccatgccccctgcatccagaaggccgctgaactattttctcaatggatggaatcttctgggaaattgaatattccgacagatgtgctgaagatagtatactctgttggcgcccagaccactgccggatggaattacttgctggagcagtatgagttgagtatgtccagtgccgagcagaacaagatcttatacgcactcagcaccagcaagcaccaggagaagctgctcaagctcattgagctgggcatggagggcaaagtgattaagacgcagaatctagccgctctgctccacgcaatagcccgacggccaaaggggcagcagctggcatgggattttgttagggagaactggactcatttgctcaaaaaatttgatcttggctcgtacgacattaggatgattattagtggaaccacggcccacttttcttccaaggataagctacaagaggttaaactattttttgagtcccttgaggcccaagggtcccacctggacatttttcagactgtcctggagactattaccaagaatataaaatggctggaaaaaaatctgccgactctgcgtacctggctgatggtgaacacctag

SEQ ID NO: 186533 - DNA, 1053 bp, Artificial Sequence
  Description of Artificial Sequence: Synthetic coding sequence
atgttccacagcagcgccatggtgaacagccaccggaagcccatgttcaacatccataggggcttttactgtcttacagcaatactgcctcagatctgcatttgctcacagttttcagtgccttcatcgtaccatttcaccgaagaccccggagcattcccagtggccaccaacggagagaggtttccatggcaggagctgagattgccttccgtggtgattccactgcactacgacttgttcgtgcacccaaatctgaccagtctcgacttcgtggcttcggagaaaatagaggttctggtttccaatgcaacacagtttatcatcctccactccaaggatctggagatcacaaacgccactctgcagtccgaggaagactccagatacatgaagcctggcaaggaactgaaagtactctcataccccgcccacgagcagattgcactgcttgtcccagaaaaactaacgcctcatctgaaatactatgtggccatggattttcaagctaaattgggcgatgggtttgagggtttctacaagtctacctacaggacgttaggtggcgagactaggatcctagccgttaccgatttcgagccgactcaggctaggatggctttcccttgttttgacgagccactgtttaaggctaatttctctattaaaataagacgcgagtctcgacacattgcactgtccaacatgcctaaagtaaagacgatagaactggagggcggattactggaagatcattttgaaactactgtcaagatgtcaacatacctggtcgcctacattgtctgcgatttccactctctgagcgggttcacaagctcaggcgtgaaggtgtcaatctatgcaagccccgacaagcgcaatcagacacattacgcgctccaggcttcacttaagttactggatttctatgaaaagtacttcgacatttactatcctctgtccaaactcggcatgtttaagtttcatataatcgtctttatctttgcacataaaacctgtttcgaccttttcccattatccctttctatgtag

SEQ ID NO: 186534 - DNA, 2085 bp, Artificial Sequence
  Description of Artificial Sequence: Synthetic coding sequence
atgttccacagcagcgccatggtgaacagccaccggaagcccatgttcaatatccacaggggcttttattgcctgaccgctatcctgccgcagatttgcatctgtagtcagttttccgtgccttctagctaccacttcactgaagatcccggagcgttccccgtcgcaacaaacggagagagattcccttggcaggagctgaggttaccaagcgttgtcattcccttgcactacgacctctttgttcatcccaatctaactagtttagacttcgttgcctctgaaaagatcgaggtgcttgtcagtaatgcgacccaattcatcatcttacattccaaggacctggaaatcaccaatgccactcttcagagcgaggaggattccaggtacatgaagccaggtaaagaacttaaggttttgtcgtaccctgcccacgagcagatcgccttgctggtaccagaaaaactcacaccgcacttaaaatattacgtggccatggactttcaggctaaattgggcgatggctttgaggggttctacaagagtacttacaggacactcggcggggagacacgaatcttagctgtgacagatttcgagcctactcaagcaaggatggcctttccttgtttcgatgaacccctgtttaaggccaacttttcaatcaagattcgacgtgaatccagacatatagcattgagtaacatgcccaaggtgaagacaatcgaattagaggggggtctgttggaagatcatttcgagaccaccgtgaagatgagcacatacctggttgcttacatcgtatgcgactttcacagcttaagtgggtttacatctagcggcgttaaagtctcgatttatgccagccctgataaaaggaaccaaacccattacgccctgcaagcatcccttaagttgctcgacttctatgagaaatattttgatatttattaccccctgagcaagttagatttaatcgctattccagacttcgctccaggtgctatggaaaattgggggcttattacctaccgtgagactagtctgcttttcgatcccaagacctcctcagcctctgataaattatgggtgacaagagtaatcgcacacgagttggcacaccagtggttcggcaatctcgtcaccatggagtggtggaatgatatctggctgaaagaagggtttgccaaatatatggaactgatcgccgtgaatgccacttaccctgagcttcagttcgacgactacttcctgaatgtgtgctttgaagtcatcacgaaggactcactcaactcctcaagaccaattagtaagcccgccgagacaccgacccaaattcaggagatgtttgacgaggtgtcctataataaaggcgcctgtatactcaatatgctgaaagattttcttggtgaggagaaattccagaaagggattatccaatatcttaagaaattttcctatcgcaacgcaaagaacgacgacctgtggagctctcttagcaactcctgtttggagagtgactttacaagtggaggggtgtgtcatagcgacccaaagatgaccagcaacatgctcgccttccttggtgagaatgcagaggttaaagaaatgatgactacgtggacgctccaaaagggaatcccactgctggtcgtaaagcaggatgggtgtagtctgcgcctccagcaggaacgcttccttcagggcgtgtttcaggaggaccctgagtggcgggctctgcaggagcgctacctatggcacattcccctgacttactcaactagttcatcgaacgtaatccataggcacattctcaagagcaaaaccgacacccttgatctccccgaaaagacttcatgggttaagttcaacgttgacagcaatggctactatatagtccattatgagggccacggttgggatcaactgatcacccagctaaatcagaaccatactttgctgcgacccaaggatcgggtcggcctgatacatgatgtgtttcaattagtgggcgcaggccggctcacactggacaaagccctggatatgacgtattacctgcagcacgaaacctccagcccttag

SEQ ID NO: 186535 - DNA, 1452 bp, Artificial Sequence
  Description of Artificial Sequence: Synthetic coding sequence
atggaggagggcggcggcggcgtgcggagcctggtgcccggcggcccagtccttttagtgctgtgtgggctgctcgaagcttccggtggcggaagagcccttcctcaactgtcagatgatataccattcagggtgaactggcctgggactgaattctcattgcctacaacaggggttctctacaaggaagataattatgtaattatgaccaccgcccacaaagagaagtacaagtgcatcttgcctctggttaccagcggtgatgaggaggaggagaaggattataagggccctaaccccagggagctcctcgagcccctcttcaagcagtcatcctgttcctaccgcattgagtcctattggacttacgaagtgtgccacgggaaacatatccgccagtatcatgaggagaaggagacaggtcagaaaataaacatccacgaatactacctgggtaatatgcttgcaaagaatttgctgtttgaaaaggaaagggaagccgaggaaaaagagaagagcaatgagatacccacaaaaaacattgaaggtcagatgacgccttattaccccgtgggtatggggaatggcaccccctgtagcttgaaacaaaaccgacctcgctcgtcaacagtgatgtatatctgtcatcccgaatccaagcacgaaattctgtcagtggctgaagtcacgacatgtgagtacgaggtggttatcctgacaccactgctgtgctcccatcctaaatatcgcttcagagcctccccagtcaacgatatattctgtcagagtctgccgggctccccttttaagcccctgaccttgcgccagttggaacagcaagaagaaattctccgcgtgccgttccgtagaaacaaagaggaggatttgcagtccacaaaggaggaacggttcccagctattcacaaatccatcgcaatcggcagccagccggtattgacagtagggaccacccatatctctaaacttacggacgatcagctgattaaagaatttctcagcggatcatattgcttccgtggtggagtgggatggtggaaatacgaattttgttacggaaaacacgtgcaccaataccatgaagataaggattcaggaaagaccagtgtcgtcgttgggacttggaatcaagaagagcatatagaatgggctaaaaaaaacactgcacgggcgtaccacttacaggatgatggaacccagacggtgaggatggtctcgcacttttacggtaacggagatatttgcgacataaccgataagcctcgccaggtgactgtcaagctcaaatgcaaggagtccgattcacctcatgccgtgactgtgtatatgctggaaccccatagctgccagtacattttgggcgtcgaaagccctgtgatttgcaagattctggacaccgccgacgagaacggattactctccctgccaaactag

SEQ ID NO: 186536 - DNA, 1290 bp, Artificial Sequence
  Description of Artificial Sequence: Synthetic coding sequence
atggaggagggcggcggcggcgtgcggagcctggtgcccggcggccccgtcctgcttgtactttgtgggttgctcgaagcctccgggggtggccgcgcccttccccagctcagcgacgacattcctttcagagtgaattggccagggactgagttctcgctgcccacaaccggcgtgctctataaggaagataattatgtcatcatgacgacagcacataaggagaagtacaagtgtattcttccactggtgacctcaggagacgaggaagaagagaaagattacaaaggacctaaccccagagaactgctagagcctcttttcaaacagtcttcttgttcctacaggatcgaaagctattggacctacgaggtttgtcacgggaaacacatcagacagtaccatgaggaaaaggaaacagggcaaaagatcaacatccatgaatactatctgggtaacatgctggctaaaaatctgctattcgagaaggaacgtgaagccgaggagaaggaaaaatcaaacgaaattcccacgaagaacatcgaaggacagatgaccccttactacccagtaggcatgggaaatggcaccccctgttccctgaagcaaaataggcctcgtagttccacagtcatgtacatctgccatccagaatctaagcacgaaatcctctctgttgccgaggtaaccacttgtgagtacgaagtagtgattcttaccccccttctatgctcacatcctaagtacaggtttcgcgcctcacccgtgaatgacattttctgccaaagccttccaggctcaccctttaaacccctgacacttagacaactggagcaacaagaggagattctaagagtgcccttcagacgcaacaaagagggtgtcggatggtggaagtacgagttttgctatgggaagcacgtccaccaataccatgaagacaaggactccggaaaaacttctgtggttgtgggcacttggaatcaagaggaacacattgagtgggctaaaaaaaacaccgctagagcgtaccacctgcaggacgacggcacacagacggtgcgcatggtgagccatttttacggcaatggggacatctgtgatattacagacaagcccaggcaggtaactgtgaagttaaagtgcaaagagagcgattctccccacgccgtcacagtctacatgctggagcctcattcatgccaatatattcttggagtagagtcaccggtgatctgtaaaatcctggacaccgctgatgagaacggactgctctctctgcccaactag

SEQ ID NO: 186537 - DNA, 1374 bp, Artificial Sequence
  Description of Artificial Sequence: Synthetic coding sequence
atggaggagggcggcggcggcgtgcggagcctggtgcccggcggccctgtgctcttggtgctgtgcggactattggaagcgagcggtggcgggcgcgctctgccacagctctcagacgacatccctttcagagtgaactggccagggacagagttcagcctaccaaccacaggggtgctatacaaagaggataactacgtaatcatgactaccgcccataaggagaagtataagtgtatccttccattggttacctctggagacgaagaagaggaaaaggactataaagggccgaatcccagagaattgttagagccgctgttcaaacaatcgagttgtagttaccggatcgaatcttactggacctacgaggtgtgtcacgggaaacacatccgtcaatatcatgaagagaaagagactggtcagaagatcaatatccatgaatactatttggggaacatgcttgccaagaatctgttatttgaaaaagaacgggaggccgaggagaaggagaagagcaatgagatccctactaaaaatattgaagggcagatgactccttattacccagtcggcatgggcaacggaaccccgtgctcacttaagcagaatcggccccgcagctcaacagtcatgtacatctgccatccagagagtaagcacgagattcttagcgtcgccgaggtcacaacctgcgaatacgaggtggtcatcctgacgcccctgctgtgctctcatcctaagtatcggttccgcgcgtcaccagtgaacgacatattctgtcaaagtctgcctgggagcccgttcaagcccctcacactccgccagctcgaacagcaggaggagatacttagggtgccctttcgcaggaacaaagaagaggatctgcaatcaacgaaagaggagcggttccccgccatccacaagagcatcgcaatcggctcccaacccgtgctgacagtcggaactactcacatttccaagctcactgatgatcagctgatcaaagaatttctttcaggtagttactgtttcagggggggcgtcggctggtggaagtacgagttctgctatggtaagcatgtacatcagtaccacgaggataaagactctggaaaaaccagcgtggtcgtgggcacctggaatcaagaagagcacatcgagtgggctaagaagaacacagcacgggcctatcatctccaagacgacggtactcagacagtgcgttgcaaagaatctgactcccctcacgccgtaaccgtctacatgttggaaccacactcttgccagtatatactcggggtggagtcacctgtaatttgcaaaattctagatacagccgacgaaaatggccttctgtctctgcccaattag

SEQ ID NO: 186538 - DNA, 2715 bp, Artificial Sequence
  Description of Artificial Sequence: Synthetic coding sequence
atggagtggggcagcgagagcgccgccgtgcggcggcaccgggtgggggtcgaacggcgggagggggccgctgcagcccccccaccggaaagagaggccagagcccaagagcccctcgtggacggctgctctggtggaggacggacccggaagagaagccctggtggctcagggggggcctcccgaggcgcgggcacagggctatctgaagtgcgcgcagccctggggctggccttatacctgatcgcccttcgcacacttgtacaactgtcactgcagcagctggtgcttagaggcgctgcgggacatcggggtgagtttgacgcactgcaggcaagagattatctggaacacatcacctcaattgggccaaggaccaccggatcacccgaaaacgagattctcaccgtgcactacttgttagaacagatcaagctgattgaggtacagagtaacagcctgcacaagatcagtgtagacgttcagaggcccacaggaagcttctctattgacttcctcgggggatttaccagctattacgacaacattacaaacgtggttgtgaagcttgaaccaagggacggcgcccagcacgcagtcctcgcgaactgtcactttgactcagtggcaaacagtccaggagcgtccgacgatgcggtttcttgttctgtgatgttggaagtgctacgagtgctgagcacttcatctgaggcgctgcaccacgctgttatcttcctcttcaacggtgcagaagagaacgtactgcaagcctcccacggatttatcactcagcacccatgggcctccttgattcgggcattcatcaatttggaagctgcaggggtcggggggaaagagctggtgtttcagaccggccccgaaaacccatggctagtgcaagcctacgtgagcgcggcaaaacatcccttcgcgtcggtcgtggcccaggaagtttttcagagtggcatcattccatccgacacagatttcagaatatacagggatttcggcaatatccccggcattgacctcgccttcatcgaaaacggctatatttatcacacaaagtacgacaccgctgacaggatcctgacagacagtatccagcgtgcgggtgataatatcctcgcagttctgaagcatctagcgacatccgatatgcttgctgccgctagtaaatatcggcacggaaatatggttttctttgatgtcctaggcctattcgtgatagcttacccttctcgcattgggtcaatcatcaactatatggtggttatgggcgtggtcctttacctgggcaagaagttccttcaaccgaaacacaagaccggtaactacaaaaaagactttctttgtggcctgggaatcacattaatttcttggtttacgtcgctggtcactgtgctaatcatcgcagttttcatatcattgatcggacagagcctgtcctggtacaatcatttctatgtatctgtctgtctctacggaacagcaaccgttgcaaaaatcattcttatccacaccttggctaagaggttttactatatgaatgcctcagcccaatacctgggagaagtttttttcgacatttctctttttgtgcactgctgtttcctagtaaccttgacgtaccagggtctgtgtagtgcattcatctcagctgtgtgggttgccttcccccttcttaccaagttgtgcgttcacaaggactttaagcagcatggcgcacaaggcaagttcattgccttctacctgctgggtatgtttataccatatctctatgctttataccttatctgggcagttttcgagatgttcactcctattttaggccggtccggctcggaaatcccacctgatgttgttctggcctctatcctcgctggctgcactatgatcctttctagttacttcattaatttcatctaccttgctaaatcgacgaaaaaaaccatgctcaccctgacattggtgtgtgccatcacttttctcctggtctgctctggtacttttttcccttatagttccaatccggcaaaccctaaaccaaaaagagttttcctacagcacatgacacggaccttccacgatcttgagggaaatgccgttaaaagagacagtggaatctggattaacggattcgactacactggcattagtcatataacgcctcacatcccagaaatcaatgattctatccgcgcccactgcgaggaaaacgcccccctgtgtgggttcccctggtacctgcccgtccacttcctcattagaaagaactggtatttacctgccccagaggtgagccctcgcaacccaccccatttcaggctgatcagtaaggagcagacgccttgggattccattaaactaacatttgaagctaccggtccttctcatatgtccttttatgtgcgggcacataaaggatcaacattgtcacaatggagcctcgggaacggaacccccgtcacctcaaagggaggagattatttcgtgttttactcccacggcttacaggcctctgcatggcaattctggatcgaggtccaggtatctgaggagcaccctgagggcatggtgaccgttgccattgcagcccactatttatcgggggaagacaaacgcagccctcaactcgatgccctgaaagaaaagttcccagactggaccttcccttctgcttgggtctgtacctacgacctgtttgtcttctag

SEQ ID NO: 186539 - DNA, 1056 bp, Artificial Sequence
  Description of Artificial Sequence: Synthetic coding sequence
atgctggaggtgctgcgggtgctgagcaccagcagcgaggccctgcatcacgcggttattttcctgtttaacggcgctgaggaaaatgtgctccaagcgagccacgggtttattactcagcatccttgggcctccctcatccgcgcattcattaatcttgaggccgccggcgttggaggaaaagaactggtcttccaaaccggcccagagaatccttggttggttcaggcctacgttagcgcagccaaacatccatttgcctccgtcgttgcacaagaggtattccaatccggaatcatcccaagcgatacagactttcgcatttatcgagacttcggcaatattcccggaatcgacctggccttcattgagaacggatatatctaccacacaaagtacgacaccgcagaccggattttaactgattccatccaaagggcgggcgacaacatcctagccgtcctcaaacatcttgccaccagtgacatgctcgccgcggcctcaaaatacagacacggtaacatggttttcttcgatgtcctcgggctctttgtcatcgcatatccctctcgaataggaagtatcattaactacatggtggtgatgggggtggtcctgtacctcgggaagaaattccttcagcccaagcacaaaacgggcaactataagaaggattttttatgtgggcttggaatcaccctgattagctggttcacaagtctggtcaccgtgctgatcattgcagtattcatctctctgataggccaatcgctgtcctggtacaaccacttctatgtttccgtttgtctatatggaactgccaccgtggctaaaatcatcctgatccatacgctcgccaaacgcttctattatatgaacgcttcagcacaatatctcggcgaagtattcttcgacatctcactattcgtacattgttgcttcctcgttacattgacctaccagggtctgtgctccgcatttataagcgcggtgtgggtggcattccctctgctgacaaagctttgtgtgcacaaagacttcaaacaacatgattag

SEQ ID NO: 186540 - DNA, 2715 bp, Artificial Sequence
  Description of Artificial Sequence: Synthetic coding sequence
atggagtggggcagcgagagcgccgccgtgcggcggcaccgggtgggagtggagagaagagagggcgcggctgccgcacctccaccagaaagggaggctcgcgcccaggaacctctggtggatgggtgctcgggcggtggcagaacacgcaaacgatcacccggcggcagcggcggcgccagtcggggggctggaactggactgagcgaggtgcgagccgccttaggtctggccctctacctcattgccttacgtacgctggttcaattatcattgcagcaactcgttctacgcggagctgctggacatcgaggggagtttgatgccctacaagcaagggattatctggagcatatcacaagcatagggccgagaactaccggtagccccgagaatgaaatcctcacagttcattatctgctggagcagattaaacttatcgaagttcagtccaacagccttcataagatttcagtagatgtgcaacgacccactggctccttctcaatcgactttttgggcggctttaccagctactatgataacattaccaatgtggtcgttaaactagagccacgggatggagcgcagcatgccgtgctcgcaaattgtcattttgactctgtagcaaattcccccggcgccagcgacgacgctgtaagttgctctgtcatgctggaagttctgcgagtgctgtcgaccagctcggaggccctgcatcatgcggtgatatttttgttcaatggcgcggaggagaacgttctgcaagcaagccacggattcataactcagcacccatgggcatcgctcatcagagcatttattaacttagaagccgcaggggtcggaggcaaggagctggtttttcaaactggccccgagaacccatggctcgttcaggcttatgtgagcgctgctaaacacccatttgcgtctgttgtggcgcaggaagtgttccaaagcggcatcattccatccgacactgactttcgtatataccgggattttggtaatatccctgggattgatctggcatttattgagaatggttacatctaccacaccaaatatgacactgctgacaggatccttaccgatagcatccaaagagcaggggacaatatcctagcagtcctgaagcatttggccacttcagatatgcttgccgccgcaagcaagtaccgacatggtaacatggtgttcttcgacgtacttggtctctttgtcatagcatacccttctaggataggctctatcataaattatatggtcgtcatgggagttgttctctatctgggaaaaaaatttcttcagccaaaacacaaaacgggtaattacaagaaggatttcctgtgcggccttggaattactctcatttcttggttcacttccttagttaccgtcctgatcatagctgtgttcatcagccttatcggccagtctttatcttggtacaaccacttttacgtgtctgtctgcctctacggcacagctactgttgctaagataattttgattcataccctggccaagaggttctactacatgaatgcatccgctcagtacctcggggaggtgtttttcgacatatctctcttcgttcactgctgcttcctcgttacgctgacgtaccaggggctctgctccgcttttattagcgccgtctgggttgccttccccttgctgacgaaactctgcgtacataaggatttcaagcagcacggggcccagggcaagtttatcgctttctaccttctcggaatgtttattccctacctctatgccttatacctgatctgggcagtatttgagatgttcaccccgatcctggggagatcagggtctgagattccacccgatgttgttctcgcgagcatattggccggatgtaccatgatcctttccagctacttcataaacttcatctatcttgccaagagcaccaaaaaaactatgttaaccctcactctagtgtgtgcgatcacattcctgctggtctgttcgggcactttcttcccttactcatctaatccagctaatcctaaacccaagcgcgtgtttctccagcacatgacacgtactttccatgatctagaaggcaatgccgttaaaagggactctgggatctggatcaatggcttcgattatacaggaatttcccacatcaccccgcacatccccgaaataaacgatagcattcgggctcactgtgaagaaaatgcgcccctgtgcggtttcccttggtaccttcccgtccactttctgattagaaagaactggtatttgccagccccggaagtctcccctaggaatcccccacactttaggctcatcagcaaagaacagactccttgggactctatcaagctaaccttcgaagcgacaggtccaagtcatatgtccttctacgttagggctcataagggaagcacattatctcagtggtcactcggaaacggcacgcctgtgacatccaaggggggggactatttcgtcttctatagtcatggtctgcaagctagtgcctggcaattctggattgaagtacaggtgtctgaagagcatcctgaaggcatggtaactgtcgccatcgccgcccactatctgtcaggggaggataaaaggtctccccagctcgatgccctgaaagaaaagttccctgactggaccttcccctccgcttgggtgtgtacctatgacttgttcgtcttctag

SEQ ID NO: 186541 - DNA, 1260 bp, Artificial Sequence
  Description of Artificial Sequence: Synthetic coding sequence
atggtggtgatgggcgtggtgctgtacctgggcaagaagttcctgcagcccaagcacaaaaccgggaattataagaaggacttcttgtgtggactgggcatcacactcatctcctggtttacatcactggtgactgtgctcatcatagcagtattcatatctttgattggtcaaagcttaagttggtacaaccacttttacgtttcagtatgcctgtatgggactgccaccgttgccaaaatcatcctgatacatactttggctaaaagattttactacatgaacgcctcggctcagtatttgggtgaggttttcttcgatatctccttattcgttcactgctgctttttggtgaccctgacctaccaaggtctgtgtagcgcttttatcagtgctgtgtgggtagcctttcctctgctcaccaaattgtgcgtgcataaagatttcaaacagcatggtgctcagggtaagtttatcgctttctacctgctaggaatgttcatcccgtatctgtacgcactctacctgatctgggcagtgttcgaaatgttcacacctatactcggacgatccgggagcgaaattcctccggatgtcgtactggcgtcaatcctggctggctgtacaatgattcttagtagctatttcatcaatttcatctacctggccaagtccactaagaagaccatgttgacacttaccttagtatgtgccattactttcttactcgtgtgttccgggactttttttccatatagcagcaaccccgccaatcccaagccaaagagagtgtttttacagcatatgacgcgcacttttcacgatctggagggcaacgccgtgaaacgtgactctggaatctggatcaacggttttgactacacaggcatttctcacataacgccacacatcccggaaattaacgactcgatcagagcacactgtgaagaaaatgcccccctatgcggatttccctggtatctgccggtccacttcctcatccggaaaaactggtatttgcccgcccccgaggtctcaccgaggaatcctccccactttagactcatcagtaaggagcagacgccttgggattctatcaaactgactttcgaggcaaccgcctgtctgcccatactgcaaatactcgatctgccagccagtacaatcatgacaaaaccctatgttctgctctgctcatccccccagcgtgtaaacaccttctccgttgtgagttggcagtggcatccatctcataaatag

SEQ ID NO: 186542 - DNA, 786 bp, Artificial Sequence
  Description of Artificial Sequence: Synthetic coding sequence
atggccgccgccgtgccccgggccgccttcctgagccccctgctgcccttactgttaggctttctgctgctttcagcccctcacggtggctctgggctccacaccaagggtgccttgcctttggatactgtaacattttacaaggttattccgaagtctaagtttgtacttgtgaaatttgacacccaatatccttacggggagaagcaggacgaatttaaacgcctggccgagaattctgcttctagtgatgatctactagtcgccgaggtaggcatctccgactatggtgacaagctcaacatggaactatcagagaaatataagctggataaggagagctatccggtgttctacctgttcagagacggtgacttcgagaatcctgtgccctacacaggggcagtgaaggttggcgctattcagcgctggctgaaaggccagggggtctacctgggcatgcctggatgccttccggtgtacgatgccttagctggagagtttattagagcctccggggtggaggctagacaggctctgctgaagcaaggccaggataacctctcctccgtgaaggaaactcagaagaaatgggccgaacagtacttaaagataatgggcaaaattctggaccagggagaagacttccctgcatccgagatgacacggatcgccaggctgattgagaaaaacaaaatgagcgacggtaagaaagaggagttgcagaaaagcctcaatattcttacggccttccagaaaaagggcgccgaaaaggaagaactgtag

SEQ ID NO: 186543 - DNA, 162 bp, Artificial Sequence
  Description of Artificial Sequence: Synthetic coding sequence
atggccgccgccgtgccccgggccgccttcctgagccccctgctgcctctccttcttggcttccttttgctcagtgctcctcacggcggatccggcctgcacaccaaaggagctctgccactggacactgtgaccttttataaaatcatggtcacctcgtag

SEQ ID NO: 186544 - DNA, 2925 bp, Artificial Sequence
  Description of Artificial Sequence: Synthetic coding sequence
atgcggcgggccggcatcggcgaggacagccggctgggcctgcaggctcagcccggagcggaaccctcacctgggcgagccggaacagaacgttcactcggaggcacccagggcccaggccagccgtgttcatgccccggggcaatggcctctgctgttcgaggcagccgtccatggcctcgactgggacttcagctgcagttcgcagcactgctgcttggaacgttgtctcctcaggtgcatacattaaggcctgagaatctactcctcgtttcaacccttgacggctctttgcacgccttgtcaaaacagacgggtgatctgaagtggacgttgagagacgatcccgtgatcgaaggcccaatgtacgttacagaaatggccttcctttccgacccagctgacggaagtctgtacatcttaggtacccagaaacagcaggggctaatgaagctgccctttaccatccccgaactggtgcatgcgtccccctgcagatcttctgacggagtgttttacactggccgcaagcaggatgcctggttcgtagtggaccctgagtctggagagacacagatgaccttaaccactgagggtcctagcacaccacgtctgtacatcggtagaacgcagtacactgtgaccatgcacgacccgcgcgcacctgctttgcggtggaacacaacctatcgacgttactcagcaccgccaatggacggctccccaggcaagtacatgtctcacctggctagttgtggcatgggcctgttacttaccgtagatcccgggagcggcaccgtcttgtggactcaggatctgggcgttccagtgatgggagtgtacacatggcaccaggacgggttgagacaacttccccacttgaccttggcccgtgacacactgcactttctagcactgagatgggggcacatccggctgccggccagcggccccagggatacagctaccctcttcagcaccctggacacacaacttttaatgaccctctacgtggggaaagacgaaactgggttttacgtaagtaaggccctggtacacacaggggttgctcttgtgcccagaggcttgactctcgctcccgcggatggtcctactacggacgaagtgacactccaggtctccggggaacgtgaaggctcaccctccaccgccgtgcgctatcccagcggctctgtcgctctcccttcccagtggttgcttattggacaccatgagctccctcccgtgctgcatactaccatgctcagagtccatccaacactgggctctggaaccgcagaaacccggccccccgaaaacactcaggcgcccgcctttttcctcgagctcctctccttatctcgggagaaactgtgggactccgaactgcaccccgaggaaaagacacctgactcttatctggggctggggccccaggacctccttgcagccagcttgaccgctgtgctgcttggcgggtggatactcttcgtcatgcgccagcagcagcctcaggtggttgagaaacaacaggaaaccccccttgcccctgctgatttcgctcacatttcccaggatgcacagtccctgcattcgggtgccagccgccggtctcaaaagcgcctgcaatctcccagcaagcaagcccagcccctggatgaccctgaggccgagcagctgacggttgtgggcaaaattagcttcaaccccaaggacgtcctgggccggggcgccggcgggaccttcgtttttcgcggacagttcgaaggtcgggccgtagctgtaaagcgactcctgagagaatgcttcggcctggtgcggagagaagttcagttgctgcaggagtctgacaggcacccgaatgtcctcaggtatttctgtacagaaagaggaccacagttccactacatcgcccttgagctgtgccgggcctcactacaggaatatgtcgagaatccagaccttgatcgggggggcctggaacctgaagtcgtgctgcagcagctgatgtcaggattagcgcaccttcacagcctgcatattgttcacagggatctcaaaccaggcaatatcctgatcactgggcccgatagccagggtcttggcagggtggtgctgagcgattttgggctgtgtaagaaacttccagcggggagatgctcgttttccctgcactctgggattcctgggaccgaaggctggatggcccctgagcttctgcagctgctgccaccagacagccccacaagcgccgtcgatattttctcagcaggatgcgtgttctactatgtgttgagcggcggctctcacccatttggcgacagcctgtatagacaggcgaatattctgacaggcgcaccctgccttgctcacttagaagaggaggtccatgacaaagtagttgcacgggatcttgtcggcgcgatgctttctccactgccacagcccaggccatccgctccacaggtgctggcacaccctttcttctggagccgcgctaagcaactgcagtttttccaagacgtgtctgattggctggaaaaggagagcgaacaggagcccctggtgcgcgcactggaggcgggtggctgtgccgttgttcgagataactggcatgagcacatctccatgcctctacagactgacctccgcaagttccgcagctacaagggtacaagtgttagggacctgctgagagccgtgcgaaataaaaaacaccactatagggagctccccgtagaggtccgacaggccctcggacaggttcccgacggcttcgtgcaatacttcactaaccgctttcctagactcctgctacacacccacagggctatgagaagctgcgcttctgagtcgctgttcttgccttattatcctccagatagtgaggctcggcgcccatgccccggcgccactggccggtag

SEQ ID NO: 186545 - DNA, 2625 bp, Artificial Sequence
  Description of Artificial Sequence: Synthetic coding sequence
atggccagcgccgtgcggggcagccggccctggccccggctgggcttacagttgcagtttgcggcccttctcctgggaacactgtcccctcaggtacacaccttgcgccccgagaatctcctgttagttagcactttggatgggtctttgcacgcactgtcaaagcagactggagacctgaaatggaccttgagagatgatccagtgatcgaaggaccgatgtatgtgactgagatggctttcctttccgatcctgccgacggcagcctgtacattctcggaacgcaaaaacaacagggtctgatgaaactgccgttcaccattccagagttagtacatgcatctccttgtcgttcaagtgatggagtgttttacacgggaagaaagcaggatgcttggtttgtcgtggaccctgaatcgggtgagacccagatgacattaaccactgagggcccttctactcctagactgtacattggcaggacacagtataccgttactatgcatgatcccagagcacctgcattgaggtggaacaccacttacaggcgctactctgctccgccaatggacggctcccccggaaagtacatgtctcatttggcctcttgtggaatgggtcttcttctcaccgtggacccaggatccgggaccgttctttggactcaggatttgggcgttccggttatgggagtttatacttggcatcaggacggactacgtcagttgccccatctgaccttggcaagagacaccctgcacttcctagcgctcaggtggggacacatccgtcttcctgcctccggtcccagagacactgccaccctgtttagcactctggatactcagctgctcatgaccctttacgtcggtaaagacgagacagggttttatgtgagcaaagccctagtacacacaggagtggcccttgttcctcgcggtctcacgctggcacccgcagacggccccacaacagacgaggtcacgctgcaggtaagcggagaaagagagggttcaccctctacagctgtgcgctacccgagcggcagtgttgccttgccatctcagtggctgctcatcggtcatcacgagctgccccccgttctgcacactacgatgctccgcgtccacccaaccctcggctccgggaccgcagagacacgccctcctgaaaatacccaggcacccgccttttttctcgagcagcagccacaagtggtggagaaacagcaggagacacctttagcaccagctgatttcgctcacatcagtcaagatgctcagtcactccattctggggccagtcggcgtagtcaaaaaaggctgcaatctccctctaagcaggcccaacctctagatgatcctgaggccgagcaattgactgtcgtgggaaaaatttcattcaatccaaaagatgtcctggggcgcggagccggagggaccttcgtcttccggggacagttcgaggggagggccgtagccgttaaacggctgttgagggaatgcttcggcctggtgagacgtgaagtgcaactcctgcaggagtctgaccggcaccccaatgtgctgcgctacttttgtaccgagcggggccctcagttccattatatcgcactggaactttgccgggcatccctgcaggaatatgtggagaatccagacctggatagggggggtctcgagcctgaagtagtgctacagcagctgatgtctggcttggcccatttgcattcattgcacatcgtacaccgggacctcaagcctggaaacattctgataacaggccctgactcgcaagggctggggcgagtggtactgtctgacttcgggttatgcaaaaagttacctgcaggccgttgttccttcagtttgcattcagggattcctggaactgaaggctggatggcccctgaactgttgcagttgctgcccccagacagccctacatctgccgttgacatttttagtgccgggtgcgttttttactacgtactgagtgggggctcacacccatttggcgacagcctttatagacaggcgaatatactcacgggagccccttgtctggcccatctggaggaggaagtccacgataaagttgtggcacgagatctcgtcggtgccatgctgtctccccttccccagccaagaccttcagcccctcaggtcttggcccatccatttttttggtcgagggccaaacagctccagttctttcaggacgtaagtgattggctcgaaaaagagtctgagcaggagccgcttgttcgagccctggaagccggggggtgcgccgtggtgagggacaattggcatgagcacatttcaatgcctctacagactgacctgaggaaatttagatcttacaaaggcacaagtgtccgtgaccttttacgagcggtgagaaataagaaacatcattaccgagagctgcctgttgaggtcaggcaggcccttgggcaggttcccgacggattcgtgcagtactttactaacagatttccgagattgcttctacacactcacagagccatgcggagttgtgccagtgagagtctgtttttgccttattacccccctgactctgaggccagaagaccttgtccgggcgctaccggacgttag

SEQ ID NO: 186546 - DNA, 354 bp, Artificial Sequence
  Description of Artificial Sequence: Synthetic coding sequence
atgagccagaagcaggaggaggagaaccccgccgaggagaccggcgaagaaaagcaggacacacaggaaaaggagggaattctgcccgagagagctgaagaggccaagctaaaagctaaatacccctccctaggccagaaacccggcggatccgacttcttgatgaagcgccttcagaaaggacagaaatatttcgatagtggcgactacaacatggctaaggcaaagatgaagaataagcagctgccctcagccggcccagacaagaacttggtgacaggcgaccatatcccaactccccaggacctacctcagaggaagagtagcctggttacgtctaaacttgccggttag

SEQ ID NO: 186547 - DNA, 414 bp, Artificial Sequence
  Description of Artificial Sequence: Synthetic coding sequence
atgagccagaagcaggaggaggagaaccccgccgaggagaccggcgaggagaagcaagacacccaggaaaaagagggcatattgccagaacgggccgaagaagctaaacttaaggctaagtaccccagtctcgggcagaagccaggtgggtctgactttctgatgaagcggctgcagaagggcgactacaagagcctccattggtccgtgttgctgtgtgctgacgaaatgcagaaatactttgactctggcgattacaatatggcgaaggccaagatgaaaaacaagcagctaccatcagccggcccagataaaaatctagtgacgggtgatcacatccccaccccacaggatctgcctcagagaaaaagcagccttgtgactagtaaactcgccgggggacaagtggaatag

SEQ ID NO: 186548 - DNA, 423 bp, Artificial Sequence
  Description of Artificial Sequence: Synthetic coding sequence
atgagccagaagcaggaggaggagaaccccgccgaggagaccggcgaagaaaagcaggacacccaggaaaaggagggcattcttcccgaacgggccgaagaggccaaacttaaggccaaataccccagcctaggacagaaacctggtggatcggatttcctcatgaaaagattgcagaaaggcgtgtggggcatcgtctcatatccgctgagcttagagctcaaagaagttctgagaatgaaatcagtggagcagaagtactttgactctggtgactacaacatggctaaggctaagatgaaaaacaaacagctgcctagcgctggcccggacaagaatctggtgacaggcgatcacatcccaacccctcaggatctgccacaacggaagtcctcccttgtgacctccaaactggccgggtag

SEQ ID NO: 186549 - DNA, 354 bp, Artificial Sequence
  Description of Artificial Sequence: Synthetic coding sequence
atggccggcggcctgggctgcgacgtgtgctactggttcgtggaggatacacaggagaaggaaggaattctccctgagcgcgctgaagaagcgaaacttaaagcgaaatacccttctctgggacagaaacctggcggtagtgacttcctcatgaaacggttacagaaggggcagaaatatttcgatagcggggattataacatggcaaaggccaagatgaaaaataagcaactcccctccgctggccccgataagaaccttgttactggggaccatattcccactccccaggatctgcctcagaggaagagcagcctggtgacgagtaagctcgcgggtggccaggtcgagtag

SEQ ID NO: 186550 - DNA, 402 bp, Artificial Sequence
  Description of Artificial Sequence: Synthetic coding sequence
atggccggcggcctgggctgcgacgtgtgctactggttcgtggaggacacgcaggaaaaagagggaatccttcccgaaagggctgaggaggcaaagcttaaagcaaagtacccctccttgggccaaaagcccgggggctccgatttccttatgaagcgcctccaaaaaggcgattacaagtccttgcattggtccgtactcttgtgcgccgacgaaatgcagaagtactttgactctggtgattacaacatggccaaggctaagatgaagaacaagcaactcccatcagcagggccagataagaatctcgtaactggcgatcacatcccaacaccacaggacctgccccagaggaagagttctctggttacctcgaaactggcaggtggacaggtcgaatag

SEQ ID NO: 186551 - DNA, 318 bp, Artificial Sequence
  Description of Artificial Sequence: Synthetic coding sequence
atgagccagaagcaggaggaggagaaccccgccgaggagaccggcgaggaaaaacaggatacacaggaaaaagaaggcattcttccggaaagggctgaggaggctaagctgaaagcaaagtatccatctctggggcagaaaccaggcggaagcgactttctaatgaaacgcctccagaagggggtctggggaatcgtctcttatccactatctctagagctgaaggaggtcctgcggatgaagagcgttgaagtgttacttgacccgtttctggaggtgttgctcttaaatcggagccgcggagaatttgaaatctag

SEQ ID NO: 186552 - DNA, 435 bp, Artificial Sequence
  Description of Artificial Sequence: Synthetic coding sequence
atgagccagaagcaggaggaggagaaccccgccgaggagaccggcgaagagaagcaagacacccaggagaaggagggtatacttcctgaacgcgctgaggaggctaaactcaaggcaaagtatccatcacttggacagaagcctggaggatccgactttctgatgaagcggctgcagaaaggcgtctgggggattgtttcttatcctctgagtttggagcttaaggaagtcttgcgcatgaagtctgtggagcaaaaatactttgatagcggcgattataacatggccaaggcaaagatgaagaacaaacaactgccaagcgctggtccagacaagaatttagtgacaggggaccatatccccacgcctcaagacctgcctcagcgcaaaagctctctggtcacaagcaaactcgccgggggccaggttgagtag

SEQ ID NO: 186553 - DNA, 366 bp, Artificial Sequence
  Description of Artificial Sequence: Synthetic coding sequence
atgagccagaagcaggaggaggagaaccccgccgaggagaccggcgaagaaaagcaggacacccaagaaaaggagggcatcctgccagaacgcgctgaagaggcaaaattgaaggccaagtacccgtccctggggcaaaagccaggaggctcagatttcctgatgaagcgtctgcagaaaggccagaaatatttcgactctggcgactacaatatggcaaaggcgaaaatgaagaataaacagctgccctccgccggcccagataagaacctggttacaggggaccatatccccacccctcaggatcttccacagcgtaagtctagtctggtgacgtccaaactggctggaggtcaggtcgagtag

SEQ ID NO: 186554 - DNA, 402 bp, Artificial Sequence
  Description of Artificial Sequence: Synthetic coding sequence
atgagccagaagcaggaggaggagaaccccgccgaggagaccggcgaggagaagcaggacacacaggagaaggagggcatcctgcctgagcgcgccgaagaggccaagctaaaggcaaaataccccagcctgggacaaaagcccggcggctctgattttcttatgaaaagactgcaaaaaggggactataagtccctgcactggtcggtattgctctgcgcagatgagatgcagaagtactttgattctggggactataacatggccaaagcaaagatgaaaaataagcaactcccatccgctggccctgacaagaatctagttactggtgaccatatcccgaccccccaggacctgcctcagcgcaagtctagcctggtaacaagcaaactcgcaggctag

SEQ ID NO: 186555 - DNA, 318 bp, Artificial Sequence
  Description of Artificial Sequence: Synthetic coding sequence
atgagccagaagcaggaggaggagaaccccgccgaggagaccggcgaggaaaagcaggacactcaggagaaagaaggaatcctgcccgaacgtgcagaggaggctaagctcaaagcaaaatatccctctctgggacagaaacctggtggttctgactttctgatgaagcggctgcaaaaaggcgtttggggaatcgtttcataccccttgtctctggagttaaaagaagttctcagaatgaaatccgttgaagttctccttgatcccttcttagaagtcctgttactgaacagatctcggggtgagtttgaaatctag

SEQ ID NO: 186556 - DNA, 342 bp, Artificial Sequence
  Description of Artificial Sequence: Synthetic coding sequence
atggccggcggcctgggctgcgacgtgtgctactggttcgtggaggacacccaggagaaggagggtatactccccgagcgagcagaagaagccaagttaaaagcaaaatatccttctttgggccagaaacccggcggatcagacttcctcatgaagcgactgcagaaaggacagaagtatttcgactccggggactataacatggcaaaggccaagatgaagaacaaacaactgcctagtgccgggcccgacaagaatctggtgactggagaccacatccctactccacaggatttaccgcagcgcaagtccagcctggtcacttctaagttggccggatag

SEQ ID NO: 186557 - DNA, 1173 bp, Artificial Sequence
  Description of Artificial Sequence: Synthetic coding sequence
atgatcagcctgcccggccccctggtgaccaacctgctgcggttcttgttcctgggactgtcagctcttgccccaccttctcgggcccagctgcagctgcacctgccagccaacaggctgcaagcggtggagggcggtgaagtggtcctgccagcttggtatactctgcacggcgaggtgtcttcaagtcagccatgggaggtcccttttgtcatgtggtttttcaaacaaaaagaaaaagaagaccaagtcttgtcatatattaacggggttaccacaagtaaaccgggagtgtcactggtgtactctatgccaagcagaaatcttagcctgagactggagggcctccaagagaaagactctggcccgtattcctgttcagtgaacgtgcaggataaacaagggaaaagtagaggccatagtattaaaactctcgagctgaacgtactggtgccacctgcaccccctagctgcaggcttcagggagtcccgcacgttggtgcaaacgtcaccttgtcctgtcagagtccgcgctctaagccagccgtgcagtaccagtgggatagacagctgccttcattccagacattttttgcgcctgccctggatgttattagaggcagcctcagcctgacaaatttgtcatcctcaatggcaggcgtatatgtctgcaaggcgcataatgaagtcggaactgcccagtgcaacgtgactttggaggtaagcaccggcccgggtgcagccgtagtagccggggccgtggttggcacacttgtaggtttgggattactggccggacttgtcctcctctatcacagaagaggcaaagccctggaagagcctgctaacgatattaaagaggacgccatcgccccaaggacccttccttggcccaaaagctctgatacaattagcaagaacggtaccctgtccagtgtgacctccgcacgcgctcttcggccaccacacggccctcctcggcctggtgcgctcactccaactcccagtctctcttcacaagctctcccaagcccacgcctgccaacaaccgacggtgctcaccctcaacctatatccccaattccaggtggcgtgtcttccagcggcttgagtaggatgggtgcagtcccggtgatggttccagctcagtcacaagcgggaagcctggtgtag

SEQ ID NO: 186558 - DNA, 426 bp, Artificial Sequence
  Description of Artificial Sequence: Synthetic coding sequence
atgatcagcctgcccggccccctggtgaccaacctgctgcggttcctcttcctggggctgtccgcattggatgtcatacggggatcgctgtccctgacaaacttgtcctcatctatggccggggtatatgtgtgtaaggcccataacgaggtgggtaccgcacagtgcaacgtaacccttgaggtgtccacggggccaggtgcagctgtcgtggcaggggcagtagtgggaactcttgtcggattaggcctactcgctggtctggtcctgctctatcatcggcggggaaaggctctggaggaaccagctaatgatattaaagtcagatctccactgggactttctttcagcgcgcccaaaatggaatggttatggaagtggcgggatgcccatttctaccgagatagttatctgagtaagtggtag

SEQ ID NO: 186559 - DNA, 2613 bp, Artificial Sequence
  Description of Artificial Sequence: Synthetic coding sequence
atgaccgccgacaaggagaagaagcggagcagcagcgagcggcggaaagaaaagagcagagatgctgcgcgctgtaggagaagcaaggagactgaagtgttctacgaacttgcccacgaactgccattaccacatagcgtgtcctctcacttagacaaggcctctattatgcgattggctatcagctttcttcgcacacacaagctgctaagctctgtgtgttcagaaaatgagagtgaggcagaagcggaccagcagatggacaatctgtaccttaaagccctcgagggatttatcgccgtggtcactcaggatggcgacatgatcttcttgtcagagaatatcagcaagtttatgggactcacgcaggtagaactaaccggacattcaattttcgacttcactcatccctgtgaccatgaagaaatccgggagaacctgagcctcaagaatgggagtgggtttgggaagaaatccaaggacatgagcactgagcgcgacttttttatgagaatgaaatgcaccgtaactaaccgcggaagaacagtgaatctgaagagcgcgacatggaaggtgcttcactgcacgggccaagtgaaggtgtataataactgccctccgcacaactctctttgtgggtataaagaacctctgctgtcctgtctgattatcatgtgcgagcctatccagcatccctcacacatggatatacctttggactccaaaactttcctctccaggcacagcatggatatgaagtttacatactgcgacgatagaataacagaactcattggatatcatcccgaggagcttctgggccgctctgcatacgaattctaccacgcccttgattcagagaatatgacaaagtcccaccagaacctttgtaccaaagggcaggtggtgagcggacagtatcgtatgctcgcgaagcacggagggtatgtttggcttgaaactcaggggaccgttatttataatccccgcaatctgcagccacagtgcattatgtgcgtaaactacgtcctaagcgagatcgaaaagaatgacgtcgtgttcagcatggaccagaccgagagtctgttcaagccccacttgatggcaatgaattccatatttgactctagcggcaagggagccgtgtcagaaaagagtaactttctttttacaaaattgaaggaagagccggaagagctcgcccaacttgcgccgacccctggggatgctattatttccctcgacttcggcaaccaaaactttgaggaatccagcgcgtatggaaaggctatcttacctccatcacagccctgggccacagagcttcgcagccatagtacacaaagcgaggctggctctctccctgcttttacagtcccacaggcagctgcacctggatctaccaccccatccgccacctctagcagctccagttgcagcacacctaattctcctgaggattattatacctccctggacaacgatctgaaaatagaggtgatcgagaagcttttcgcgatggatactgaagcgaaagaccagtgttccacacagacagatttcaacgagctggaccttgaaacattagccccatatataccgatggacggagaggattttcagcttagtcccatttgcccagaagagaggcttttagccgagaacccccagtcaacgccccagcactgttttagcgccatgactaatatcttccagccattggcccctgtggctcctcatagccctttcctgctggacaagttccagcagcagctggagtccaagaagactgagcccgaacatcgcccaatgtcttctatcttttttgatgccggctctaaagctagccttcccccctgctgtggacaggcttccactccactgagcagcatgggtggcagaagcaatacccagtggccccctgaccctcccctgcacttcggaccgacgaagtgggccgtcggcgatcagaggacagaatttctaggcgctgccccattaggacccccagttagccctccccatgtgtccacctttaagactcggtctgccaaaggtttcggtgccaggggccctgacgtgctgagccccgctatggtggccctctcaaacaagctgaagctgaagcgacagttggaatacgaggagcaggcttttcaggatctgtctggaggggacccccctggtggcagtacatctcacttgatgtggaaaaggatgaagaatcttaggggggggtcctgtccattgatgcctgataaacccctatccgcaaacgtccccaacgacaagttcacacagaatccaatgcggggactcggtcatccccttagacatctcccactcccacagccccccagcgcgatcagccccggagagaactcaaaatcgcgttttcccccacagtgctatgctacacagtaccaggactattcgctgagctccgctcacaaggttagcggtatggcctcccgattgctggggccctcctttgagtcttacctgctgcccgaactgaccaggtacgactgcgaggtgaacgtccctgtgcttggcagttctaccctgctgcaggggggggaccttttgagggcattggatcaggcgacgtag

SEQ ID NO: 186560 - DNA, 780 bp, Artificial Sequence
  Description of Artificial Sequence: Synthetic coding sequence
atgaccgccgacaaggagaagaagcggagcagcagcgagcggcggaaggagaagtctcgcgatgcagcaagatgccggcgaagtaaagagacagaggtcttttacgaactggcacacgagctccctctcccgcatagcgtctcttcacatctcgacaaagccagtatcatgcggttggccattagttttctgcgaacccacaaactgctttccagcgtctgctccgaaaatgagtcagaggcagaggccgaccagcagatggataacttgtacctcaaagccctggaaggctttattgcagtcgtgactcaggacggggatatgattttcctttccgagaacatatctaagttcatggggctcacacaggtcgaactaaccggacactctattttcgacttcactcacccttgtgaccacgaggaaatcagagagaatctctcactgaagaacgggagcggctttggcaagaagtccaaagatatgtccactgagagagatttttttatgcggatgaaatgtacagtaaccaatcgggggcgaactgtcaacctgaagagcgctacatggaaggtcctccactgcaccggccaagtgaaagtgtacaacaactgtcctccccataattctctctgcggttacaaagagccactcctatcctgtctcatcatcatgtgcgagccaatccaacacccctcccacatggatattccactagattctaagactttcctatctcggcacagtatggacatgaagtttacttattgtgacgactag

SEQ ID NO: 186561 - DNA, 537 bp, Artificial Sequence
  Description of Artificial Sequence: Synthetic coding sequence
atggtgagcgtgcccaccacctggtgcagcgtggccctggccctgctggtggctctgcacgagggtaaaggccaagcagcagccacgctggagcagccagcttcttccagccacgcacaagggacccacctcagactccgccgctgcagttgcagttcctggctggataaagaatgcgtgtacttctgccacctggatatcatttgggtaaacacgcccgagcagaccgctccatatgggctgggaaatccgcctagacgaaggcggcgctctctccctagaaggtgccagtgtagttccgccagagatcctgcttgcgcaacattttgcttgcgacgcccatggaccgaggctggagccgtcccttctcgaaaaagccctgcagacgtctttcaaacaggaaaaacaggcgccactacaggcgagctgcttcagagattgagggacatttccactgtgaagtccctgtttgctaagcgacagcaggaagccatgagggaacccaggagtacacatagtagatggcgaaagcgctag

SEQ ID NO: 186562 - DNA, 660 bp, Artificial Sequence
  Description of Artificial Sequence: Synthetic coding sequence
atggagcccggcctgtggctgctgttcggcctgaccgtgaccagcgccgccgggtttgtgccctgttcccagtctggtgatgctggtcgcagaggagtgtcccaggcccccacagccgcgagatccgaaggagattgtgaggagacagtagccggcccaggcgaggagactgtcgccggtcctggcgagggcacagtggctcccacagcgctgcagggcccgagccctggctctcctgggcaggagcaggctgctgaaggcgcacctgaacatcataggtcacgccgctgcacttgcttcacttacaaggacaaagagtgcgtttattactgtcacttagacattatctggatcaacacgcccgaacaaacagtgccatacggcctgtccaattaccgaggcagctttagagggaaacggtccgccggtccacttccgggaaatttgcagctgagccaccggccccacctccggtgtgcgtgcgtgggacgatacgacaaggcgtgcttacacttctgcactcagacattggacgtgagttcaaatagtcgaactgccgaaaaaaccgacaaggaggaagagggcaaggtgcgcggtgcaaaccggggactttgccagagaaggctgaagtcccgcactaataaggctagccgcctatag

SEQ ID NO: 186563 - DNA, 717 bp, Artificial Sequence
  Description of Artificial Sequence: Synthetic coding sequence
atggagcccggcctgtggctgctgttcggcctgaccgtgaccagcgcagcaggatttgttccttgctcccagagcggggatgccggaagaagaggcgtttcccaggcaccgactgctgcgcgctccgagggagactgtgaggaaaccgtggctgggccaggcgaggagaccgttgcaggtcctggcgaggggaccgtggctccaacagccctccagggaccatccccagggtcccctggccaggaacaggcagccgagggggcccccgagcatcaccgaagtagacggtgtacttgtttcacctataaagacaaggaatgcgtgtactactgccatttggacattatatggattaacacacctgaacaaacagtgccctatggactgagcaactaccgagggtcattcaggggtaagcggagcgctggacccctgcctggcaatctgcagttgagccaccggcctcacctccgttgtgcctgcgttgggcgttacgataaggcatgtctgcacttctgtacacagaccctggacgtgagtagcaatagccggaccgctgaaaaaacggacaaagaggaggaagggaaggttgaggtcaaggaccagcaatccaagcaggcattagatctgcatcacccaaaactgatgcccggctctggactggccttggctccctctacatgtccaaggtgcttgtttcaggaaggcgccccctag

SEQ ID NO: 186564 - DNA, 579 bp, Artificial Sequence
  Description of Artificial Sequence: Synthetic coding sequence
atggagcccggcctgtggctgctgttcggcctgaccgtgaccagcgccgccgggtttgtcccttgtagtcagtccggggatgccggccgcaggggcgttagtcaggccccgaccgccgctcgctctgaaggcgattgtgaggaaactgttgccggacctggtgaggaaactgtagccggcccaggagaaggtaccgttgctcccaccgcattacagggtccctcccccgggtcacctggtcaggaacaggccgcagagggagcgccagagcatcacaggagccggaggtgcacatgtttcacttacaaagacaaagagtgcgtctactattgtcatctggacattatctggattaacacacctgagcagaccgttccttacggattgagcaattacagagggagcttcagaggtaaaaggtcagccggccctcttccaggtaacttgcaactgtctcaccggcctcatctacggtgcgcatgcgttgggcggtatgataaggcctgccttcacttctgtacccagactctcgatgtttcacggctgaagagtcggaccaataaggcatctaggctatag

SEQ ID NO: 186565 - DNA, 717 bp, Artificial Sequence
  Description of Artificial Sequence: Synthetic coding sequence
atggagcccggcctgtggctgctgttcggcctgaccgtgaccagcgcagcagggtttgtgccctgcagtcagtccggtgacgcgggacgcaggggggtaagccaggctcctacggccgcccgatctgagggggattgcgaggagaccgtggccgggcctggagaggaaacggtggccggcccaggcgaaggcacagttgccccaacagccctgcaaggcccttcccccgggtcacctgggcaagaacaagccgcagaaggagcccctgaacatcacaggtcgcgaaggtgcacatgttttacatataaagacaaggaatgcgtatattattgtcaccttgatattatatggattaacacgcccgaacaaacggtgccatacgggctgagcaattatcgcggtagcttccgggggaaacggtctgccggcccacttcctggcaatttgcaactcagtcaccggcctcacctgagatgtgcatgcgttggacgctacgacaaggcttgtttgcacttctgtacacagaccctggacgtatcatcaaatagccgcacagccgagaagacagacaaggaggaggaggggaaggtggaagtgaaagaccagcaatccaagcaagcgctagatctccaccatcccaaactcatgcccgggtccggcctagctctggctcccagtacgtgtccaaggtgcctgtttcaggagggggcaccatag

SEQ ID NO: 186566 - DNA, 675 bp, Artificial Sequence
  Description of Artificial Sequence: Synthetic coding sequence
atggagcccggcctgtggctgctgttcggcctgaccgtgaccagcgctgccgggtttgttccttgttcgcagagtggggatgcgggccggagaggggtcagtcaggccccgacggctgcccgctctgaaggagattgcgaggaaaccgtcgccgggcccggtgaagagaccgtggccggtccaggcgagggtaccgtggctcctactgctctgcaaggaccatctcccgggagtcccggtcaggaacaggcggccgagggcgctcctgagcatcatagaagcaggaggtgtacctgtttcacatataaagataaggagtgtgtgtattattgtcaccttgatatcatttggattaatactcctgagcaaactgtcccctatgggctgagtaattacagaggtagctttcggggaaaacgctctgctggacctcttcccggaaacctgcaactgtcacaccgcccgcatctgaggtgtgcctgtgtggggaggtacgacaaggcgtgtctgcacttctgcacccagacactagatgtatctcggcaggtggaagtcaaggaccagcagagtaaacaggccctggatctccatcaccctaaactcatgcctggctctggcctcgccttggcgccctccacatgccctcgatgcctgttccaggaaggcgctccatag

SEQ ID NO: 186567 - DNA, 2304 bp, Artificial Sequence
  Description of Artificial Sequence: Synthetic coding sequence
atggaggccctgcgggagagcgtgctgcacctggccctgcagatgtctacttataagagagccactttggacgaggaagacctagttgatagcctgtcagagggcgacgcatatcctaatggcttgcaggtcaattttcactccccgcggagcggccaacgctgctgggccgctcggacccaggtggaaaaacgactggtggtattggtcgtcctcttagctgccggcctcgttgcttgcctggccgccctagggatccaatatcaaacacgatctccctctgtttgcctatcagaagcatgcgtgagcgtcacatcctccatcctgtcttctatggacccaactgtggatccctgtcacgatttctttagttacgcctgtggcggctggataaaggcaaatcccgtccctgatgggcactcacgctggggaacctttagcaacctgtgggaacataaccaggcgattataaagcatctgctggagaatagcacagcgagtgttagtgaagccgaaaggaaagcgcaggtatactaccgcgcctgcatgaacgagacacgaattgaagagctgagggctaaacctttaatggagctaattgagcggctaggtggctggaacattactggcccctgggcaaaggacaattttcaggatacgctccaggtggttaccgcgcattatcggacgagcccattctttagcgtgtatgtgtcggccgactccaaaaatagcaacagcaatgtcatccaagtagaccagtctggcttgggactaccctcgagggattactatctaaataagaccgagaatgaaaaggtcctcactggatacctgaattatatggtccagttgggtaaactgcttggtggcggtgacgaggaagccattcggccacagatgcagcaaattttagatttcgaaacagcactcgcaaacatcactatcccacaggagaagcgtcgtgacgaggagcttatctatcataaggttactgccgcagagctgcaaacccttgctcctgcgattaattggctgcccttcctaaataccattttctatccagtcgagatcaacgaaagcgaaccaatcgtggtgtatgacaaagagtaccttgaacaaataagcactctcataaataccacagaccggtgcctgctcaataactacatgatatggaacctcgtgcggaaaacctcgtccttcctcgatcagagatttcaggatgccgacgaaaagtttatggaggtgatgtatggaacaaaaaagacttgcctacctcggtggaaattctgcgtttccgatactgagaacaacctgggatttgccctggggcccatgtttgtgaaggcaaccttcgcagaagacagcaagagcatcgctacagaaatcatcctggagattaagaaggcctttgaagagtcacttagcacgctgaagtggatggacgaagaaacgaggaagtccgccaaggagaaggccgatgccatctataatatgattggctaccccaattttattatggaccccaaagagctcgacaaagtcttcaatgactacacggctgttccggacctgtattttgagaacgccatgcgcttcttcaatttttcctggcgggtcaccgctgaccagctgcggaaagcacctaaccgtgaccagtggagtatgaccccccctatggtcaatgcttactatagccctaccaagaacgagattgtttttcctgctggaatcctacaggcaccattttacacaagaagctcccccaaggctttgaatttcggcggcatcggggttgtggtgggccatgagctgacccacgccttcgacgaccaagggagggagtacgacaaagacggaaacctgcgcccgtggtggaaaaattccagtgtcgaggccttcaagaggcaaacagaatgtatggtcgaacagtactcgaattactcagtcaatggtgagcctgtgaacggtcgtcatactctgggagagaatatcgccgacaatggcggattaaaggccgcttacagggcctatcaaaactgggtgaagaagaatggtgcagagcatagcctccctacactggggctgacaaacaatcaactgttcttcctgggctttgcccaggtttggtgttccgtgcgcactcccgagagttctcacgagggtctcatcactgacccgcatagtccgtctcgattccgggttatcgggtcgctaagtaactctaaggagttctcggaacactttcgctgtcctcctggtagtccaatgaacccaccgcataagtgcgaagtctggtag

SEQ ID NO: 186568 - DNA, 2277 bp, Artificial Sequence
  Description of Artificial Sequence: Synthetic coding sequence
atgcccctgcagggcctgggcctgcagcggaaccccttcctgcagggtaagagaggccctggcctgacatcatctccacccctactgccgccatcactgcaagtcaatttccatagcccacgaagcggccagagatgctgggcagcgaggacccaggtggagaaacgcctcgtcgtcctggtagtgttgctggcagcaggactggtggcctgtttggctgccttgggtattcagtaccagacccggtccccctcagtatgcctcagcgaggcatgcgtgtcagtgacttctagcatcctctccagcatggacccgacagtggacccttgtcatgactttttctcttacgcctgcggcggttggattaaagccaatccagtgcctgacggtcacagccgctggggaaccttctccaatttatgggaacacaaccaagcaatcattaaacacctgttagagaatagcaccgctagcgtgtccgaagctgagcgaaaagctcaggtatactatcgggcctgtatgaatgaaacacgaatcgaggagctgcgggccaagcccctcatggaattaatcgaaaggcttgggggctggaacataaccggcccgtgggcaaaggacaattttcaagacactttgcaagttgtcacggcgcactaccgaaccagtccattcttctcagtttatgtttccgccgactctaagaactccaatagtaacgtgatccaggtcgatcagagtggattgggactaccaagtcgcgactactatctgaacaagaccgaaaatgaaaaggtcctgacgggctacctgaactacatggtgcagctgggcaaattacttggtggtggagacgaggaggcgatccgcccacaaatgcagcagatcttggatttcgagaccgcgctggcaaacataaccatccctcaagagaagcgccgggacgaggagctgatctaccataaagtaaccgccgcggaattacaaacccttgcccccgccatcaattggttgcccttcctgaatactatcttctatcccgttgaaatcaacgagtcagagcctattgtcgtatacgacaaggaatacctggaacagataagcaccctgatcaatactaccgacaggtgtctcttaaacaattacatgatttggaacctcgtgagaaaaaccagttcctttttagatcagagatttcaggatgctgatgaaaaatttatggaggtcatgtatggcaccaaaaagacatgtctccctcggtggaagttctgtgtgtctgacaccgaaaacaatctcggctttgccctgggccccatgtttgtaaaagcaacgtttgcggaagactccaaatcaattgccaccgagatcatcctggagatcaaaaaagctttcgaggagtctctgtcaacactgaagtggatggacgaggagacacgcaaatctgccaaagaaaaggctgatgccatatataacatgatcggttacccaaactttatcatggatcccaaagaattggacaaagtcttcaacgactacactgccgtgccagatttatacttcgaaaacgccatgcggttctttaacttttcctggagggtcactgcagatcagctgcgcaaggcccctaacagagaccagtggagtatgactcctcccatggtgaatgcttattatagtcccactaaaaatgagatcgtcttcccagctgggatcctgcaggcgcctttttacactcgctcaagccctaaagccctgaacttcggtggaatcggtgtggttgtcggtcatgaactgacacacgcctttgacgatcaagggcgggagtacgacaaagacggtaacttgaggccttggtggaagaacagctcagtagaggcatttaagcggcagaccgagtgtatggtcgagcaatactccaattatagtgtgaacggtgaacctgtcaacggccgacacactctcggggagaatatcgctgataatgggggcctgaaagctgcataccgcgcgtaccagaactgggttaagaagaatggagctgagcactctctccccacactcgggttaaccaataaccagcttttttttttgggttttgcccaagtctggtgctccgtacgaaccccggagtcttcccacgaaggccttattacggacccccactctccatcacggtttcgagttattggctctctcagcaactccaaggagttctctgagcacttccggtgtcctcccggctcaccaatgaatccgccccataagtgcgaagtttggtag

SEQ ID NO: 186569 - DNA, 2313 bp, Artificial Sequence
  Description of Artificial Sequence: Synthetic coding sequence
atgcggggcgtgtggcccccccccgtgagcgccctgctgagcgccctcggaatgtccacttacaaaagagccaccctcgacgaggaggatcttgtagattcactctctgaaggtgacgcatatcctaatggccttcaggtgaactttcacagtcccaggagcgggcagaggtgctgggcagcaagaactcaggtggaaaaaaggctcgtcgtgctggtggtattattggcggctggccttgtagcctgccttgcggccctgggcattcagtaccagactaggagcccttcagtgtgtttgtctgaggcatgcgtctccgtgactagctccattctgtcctcaatggaccccacggttgacccctgtcacgatttcttcagctatgcttgtggaggctggatcaaggccaacccagtaccagacggtcactctcggtggggaacattttcaaatctctgggagcacaatcaggccatcatcaaacatctgctcgagaattcgacagctagcgttagcgaagccgagcgcaaggcacaggtctactatagggcttgcatgaacgagaccaggatcgaggagctcagggccaagccacttatggagctcattgaaaggcttggaggatggaatatcaccggtccgtgggcaaaagataatttccaggacaccctgcaggtcgtcaccgcacattatcgcacctcaccattcttcagtgtgtacgtttctgccgacagcaaaaactctaactccaacgttatccaggtggaccagtcaggtttaggactgcctagcagagattattatctgaacaaaactgagaatgaaaaggtcttgacagggtacctgaactacatggtgcagctgggcaagctactggggggcggagacgaggaagccattcgcccccagatgcaacaaatactggacttcgaaacggcactcgcaaacattaccatcccacaggaaaagcgacgagatgaagaattgatctaccacaaagtgactgccgcggaactgcagactttagcacccgccattaactggctcccgtttctcaataccatcttctatcccgtcgaaataaatgagagtgagccaattgtggtgtacgataaagaatatctggagcagatctctaccctcatcaacaccacagacagatgccttctcaacaactatatgatctggaacctcgtgagaaaaacgagttctttcctggaccagagatttcaggacgctgacgaaaagttcatggaggtcatgtacggaaccaaaaaaacatgtcttcctcggtggaagttttgcgtgagcgacacagaaaacaatcttgggtttgctttggggcctatgtttgtgaaggcgacgtttgcagaggattcaaaaagcattgcaacagaaatcatccttgaaataaagaaagcgttcgaagaaagcttatcaactctgaagtggatggatgaggagactaggaagtctgccaaggagaaggcagatgcaatatataatatgatcggctaccccaattttatcatggaccccaaagagcttgataaggtgttcaacgattacacagccgtgccggatctgtacttcgagaacgcaatgagattttttaacttctcgtggcgggtgactgcggaccagcttcgaaaggctcctaaccgcgatcaatggagcatgaccccccccatggtaaatgcctactactcaccaacaaagaacgagatcgtgtttcctgcgggaattctccaagctccattttatacccgttccagtcctaaagcattgaattttggcggcataggcgttgtggtcggtcatgagttaacccatgcttttgacgaccagggaagggagtatgacaaggacggaaacctgagaccttggtggaaaaacagtagcgttgaagcctttaaaaggcagaccgagtgcatggttgaacagtacagcaattacagcgtcaatggcgaacccgtgaacggaagacataccctgggggagaatattgccgataacggcggcctgaaggccgcgtaccgcgcctatcagaattgggtgaaaaaaaatggtgccgaacatagtttgcctactctgggactcaccaataaccaactttttttcctcgggttcgcacaggtatggtgttccgtgcgcacgcctgaatcctcacacgaggggctgatcaccgatccccactccccctcacgattccgggttataggatccctctcaaatagcaaagaattctccgagcattttagatgcccccctggcagcccaatgaatcccccacacaagtgcgaggtgtggtag

SEQ ID NO: 186570 - DNA, 2265 bp, Artificial Sequence
  Description of Artificial Sequence: Synthetic coding sequence
atgatgagcacctacaagcgggccaccctggacgaggaggacctggtggatagtctttcagagggtgatgcttacccaaatgggttgcaggttaattttcacagcccacggtcaggtcaacgctgttgggctgccaggactcaggttgagaagcgtctggtagttcttgtcgtcctgctcgccgcgggtctggtagcctgcttggccgctctcggtatccaataccaaacccggtcacctagcgtctgtctgagtgaggcgtgtgttagtgttacttcgtcaatcctttcctcaatggaccccacggttgatccatgccacgatttcttttcgtatgcttgcggaggctggattaaggcgaatccagtgccggatgggcactctcggtggggaacattcagcaacctttgggagcataatcaggctataattaaacacctgctcgagaacagtacagcttctgtgtctgaggccgaacgcaaggcacaggtgtattatcgggcttgcatgaatgagaccagaattgaagagctgcgcgctaaacctttgatggagctgatagaacgcctcggggggtggaatataacaggtccctgggccaaagacaacttccaggatactctccaagtagtgaccgctcactaccgaactagcccctttttctcagtgtacgtgtccgccgattccaagaattctaacagcaacgtgattcaagtcgatcagtccggcctgggactcccgagtagggattattacctgaataaaaccgaaaacgaaaaagtgctgaccggatacctgaactatatggtgcagctggggaagctgctcggcggtggtgacgaggaagccatacgcccacagatgcaacagatcctggattttgaaacagctcttgccaacattaccattccacaggaaaagagacgcgacgaggaattaatttatcacaaggttacagccgcagagctgcagacgctggctccagcaatcaactggctaccatttctgaatactatattttaccccgtggaaattaatgaatccgagcctatagttgtctacgacaaagagtacctcgaacagatcagcactctgataaacactactgatagatgtctgttaaacaattacatgatctggaacctggttcgcaagacctcatccttcctggatcagcgcttccaggatgccgatgaaaagtttatggaagttatgtacggcacaaagaaaacttgtttgccacgctggaagttttgtgtttctgatactgagaataacctgggtttcgctctgggccctatgttcgtcaaggctacatttgcggaggactcaaagagtatcgcgacagagattattttagaaataaagaaggcatttgaggagagtctgtctaccctgaagtggatggacgaggagaccaggaagagcgctaaagagaaagctgacgctatctataacatgattggataccccaacttcattatggaccccaaggagcttgacaaggtgttcaacgattacaccgcagtccctgatctttacttcgagaacgccatgcggttctttaatttctcatggcgggtgacagcagaccagctgagaaaggcccccaatcgcgaccagtggagtatgacaccgccaatggttaacgcatactattcccctaccaaaaatgagatcgtgttcccagcaggcatactgcaggcccccttttatacacgttcatcccctaaggccctaaacttcggcggcataggagtagtggtggggcacgagctcacgcacgcttttgacgatcagggaagggagtacgacaaggacggtaacctgcgtccttggtggaagaatagctctgtcgaggcctttaagaggcagacagaatgtatggtcgagcagtattccaactattcagtcaacggggaacctgtaaatggccgacatactctgggagagaatattgcggataatggcgggctgaaagcggcgtacagagcttaccagaactgggttaaaaaaaatggggccgaacactccctccctacattgggtctcaccaacaaccaactcttctttctggggttcgcccaagtgtggtgcagcgtgcggacacccgaaagcagtcacgaaggtctcattaccgatcctcattcaccttccaggttccgggtaattggatctctctccaactccaaggaattctccgagcattttaggtgtccccctggatcacctatgaaccctcctcacaaatgtgaagtgtggtag

SEQ ID NO: 186571 - DNA, 2217 bp, Artificial Sequence
  Description of Artificial Sequence: Synthetic coding sequence
atgcggggcgtgtggcccccccccgtgagcgccctgctgagcgccctcggcatgtctacttacaaaagagctacactggatgaggaggacctggtagatagcttgtctgagggcgatgcatacccaaacggacttcaggtgaattttcactcgccccggtccggccaacggtgctgggccgcccgaacccaggtggagaaaagactggtggtcctggtggtgctgttggccgccggacttgtggcgtgtttagcggcactcggtattcagtatcaaacaaggagccctagcgtgtgcttgtctgaagcatgtgtcagtgtgacatcatccatcctatcttcgatggatccgacggtagacccctgccatgactttttttcctatgcctgtggcggctggatcaaagctaatcccgtccccgatggccacagccgatggggcactttctcaaatttgtgggaacacaaccaggccattataaagcacctacttgagaacagcacggccagtgtgagcgaggcagaaagaaaagcccaagtctactaccgtgcctgcatgaatgaaactcgaatagaggaactgcgcgctaaaccactgatggaactgattgagaggttaggcggttggaatatcactggaccttgggcaaaggacaatttccaggatacactccaggtggtgaccgcgcactatcgcacttctcccttcttttccgtatacgtctctgctgattccaaaaattccaattctaacgttatccaggtcgaccagtccggtcttggcctcccaagccgagattactatctcaataaaaccgagaacgagaaagtactgacaggctacctgaattacatggtgcagttaggcaagttattgggaggcggtgacgaggaggcgattcggcctcaaatgcagcagatattagactttgaaaccgccttggccaatatcacaattccccaggaaaagaggagggacgaagagctgatttatcacaaagtgacggccgccgagctccagacactcgcccccgccatcaactggttaccattcttgaacaccatcttctatcccgtggagattaacgaatcagagcctatcgttgtgtatgacaaggaatatctcgagcaaatctctactctgatcaacacaactgaccggtgcctgctgaacaactacatgatctggaaccttgttaggaaaacatcctcgtttctggatcaacggtttcaggacgccgatgagaagttcatggaagtaatgtatgggaccaaaaagacttgcttgcctagatggaaattttgtgtgagcgacaccgaaaacaacttagggtttgccctgggccccatgtttgtcaaagcaacgttcgccgaggattccaaaagtatcgcgacagaaattatcctggagatcaagaaggccttcgaggagagcctatctaccctgaaatggatggacgaggagacacggaaatccgccaaggaaaaggccgacgccatctacaacatgatcggctacccaaatttcatcatggatcccaaggagttggacaaggtattcaacgactatactgcagtgcccgatttgtatttcgaaaacgctatgagattttttaacttctcgtggagggtgaccgctgatcagctgcgaaaagcacccaatcgggatcagtggagcatgactcctcccatggtgaacgcttactattccccaaccaagaatgagatcgtgttccctgcaggcatactccaggccccattttataccagatcttcccccaaggctctaaattttgggggtataggagtcgtggtcggtcacgagctgacccacgcgttcgacgaccagggcagggaatatgacaaggatgggaacttgcgaccttggtggaaaaattccagtgttgaggcctttaaacgacagacagaatgcatggtggaacagtactctaattacagcgtcaacggggagccagtgaacgggaggcatactcttggtgagaatattgcagacaatgggggtttaaaggccgcatacagggtttggtgttctgtgcggacccccgagtcatctcatgagggcttgattacggatccacattctccaagtaggtttagggtaattgggagtcttagtaatagcaaggagttttcagaacattttcgctgcccaccgggctcaccaatgaatccccctcataaatgcgaggtttggtag

SEQ ID NO: 186572 - DNA, 2328 bp, Artificial Sequence
  Description of Artificial Sequence: Synthetic coding sequence
atggagcccccctacagcctgaccgcccactacgacgagttccaggaagtgaagtacgtgtcccggtgtggagctggcggggctagaggcgcttcactgccccctgggtttccactgggagcagcacgcagtgcaacaggagcccggtccggccttccacggtggaaccgacgcgaagtgtgtttgttgtcaggactcgtttttgccgccgggctctgcgccatattggctgccatgctcgcattaaaatacctggggccggtggctgctgggggtggggcttgtcccgagggttgtccggaacgcaaggcattcgccagagccgccagattccttgcagctaacctggacgccagcatagacccttgtcaagacttctactcctttgcctgtggcggttggctccggcgacacgctatcccggacgacaagctcacatacggcacgatagctgcaattggcgaacagaatgaggagcgactaagaagactgctggccagacctggagggggaccaggaggggcggctcagaggaaagtgcgggcatttttccggtcatgcctcgatatgcgtgaaatcgagcggttggggccaaggccaatgctggaggttatcgaagattgcgggggatgggatttgggtggggctgaggagagacctggagtcgccgcccgctgggatctcaatagactgctgtataaagcacagggcgtatactcagctgctgctctcttctctctgaccgtgagtttagatgacagaaactccagtcgctatgtaatccgcatcgatcaagatgggttgactctgcccgagaggaccctgtacctggcacaggacgaagattctgagaaaattctggccgcatatcgggttttcatggaaagggtcctgagtcttttaggtgccgacgccgtggagcagaaggcacaggaaatcctacaggtagagcagcagctggcgaatatcaccgtgagcgagcacgacgatctgcgtagagacgtgagtagcatgtataataaagtaacactgggacaacttcagaagatcactccgcacctcagatggaagtggctcttggatcaaatttttcaagaggatttcagcgaggaggaggaagttgtactactggccacagattatatgcagcaggtgagtcaacttattagatcaactccacatcgcgttttacacaactatcttgtgtggcgcgtggtggtggtgctgagcgagcacctctcccctcccttccgggaggcactgcatgagctggcccaggagatggaagggtcagataagccccaggaattggccagagtttgtctcggacaggccaatcgccactttggcatggctctgggcgccctgttcgtgcacgagcacttcagcgccgctagtaaggccaaggtccagcaactcgtggaggacatcaagtatattctgggtcaacggctggaagagctggactggatggatgctgagacacgagccgcggcccgcgcaaaacttcagtacatgatggtgatggtagggtacccagacttcctcctcaaaccggacgcagtggacaaggagtacgaatttgaagtgcacgaaaagacatatttcaagaacatactcaactccatcagatttagcattcagctgtctgtgaagaagatcaggcaggaggtggataagtcgacctggctgctaccaccccaggccctgaacgcctactatctcccaaacaaaaaccaaatggtgtttccagctggcatactgcagccaactctgtatgaccctgacttccctcagagtttgaattatgggggtatcgggactatcatcgggcatgaattaactcatgggtacgatgactggggcggacagtacgaccgctccggaaatcttctccactggtggacagaagcctcgtacagtcggtttctgcggaaagccgagtgtatagtgcgcttgtacgacaacttcacagtttacaatcagcgcgtgaatggcaagcacaccttgggcgagaacatcgcagatatgggggggctgaagctggcctaccacgcctatcagaaatgggtgagagagcacggaccggaacatcctttgccacggctcaagtacacacacgaccagctgttcttcattgcattcgcacaaaactggtgtattaaaaggagatcacagtccatctatctccaggttctgactgacaaacacgccccggaacactacagagtcctcggcagtgtctctcaatttgaagagttcggcagagcatttcactgtccaaaagacagcccgatgaacccagcacataaatgctctgtgtggtag

SEQ ID NO: 186573 - DNA, 2322 bp, Artificial Sequence
  Description of Artificial Sequence: Synthetic coding sequence
atggagcccccctacagcctgaccgcccactacgacgagttccaggaggtgaagtacgtgtctcgctgcggagccggcggggctcgcggcgccagccttccacccggattccctctgggagccgcccgatcagccacaggtgctagatccggccttcccaggtggaatagacgtgaagtatgcctacttagcgggctggttttcgcagccgggctgtgtgcaatcctagccgccatgcttgccttgaaatatctcgggcccgtggcagcggggggaggcgcctgtccagaaggctgtcctgagaggaaagcattcgcgagggcagctagattcctggcggccaacctggacgctagcatcgacccgtgccaagatttttactcctttgcttgtgggggatggctgcgacggcacgctattcccgacgacaaactgacgtacgggaccatcgccgcaatcggtgagcagaatgaagagcggctgaggcgactgttggcacggccaggcggagggccgggcggcgccgcccagcgcaaagtccgagccttctttagatcttgcctggatatgcgggaaattgaacggctagggcccagacctatgttagaggttattgaagactgtggcggctgggacctgggtggggcagaggagcgtcccggggttgccgccagatgggacctcaatcgactgctgtataaggcccagggtgtgtattctgcggcggccttgttctccctgacagtgagtcttgacgacagaaacagctcccgctacgttatacgcatagatcaggacgggttgactctgccagagaggacactgtacctggcccaggacgaagactctgaaaagatccttgcagcttatcgtgtttttatggagcgggttctgtctctgctgggtgccgatgctgtggaacagaaggcgcaggaaattctgcaggtggagcagcagcttgctaatatcacggtgtccgagcacgatgatcttaggcgcgacgtcagcagtatgtacaacaaagtcaccctgggtcagctgcaaaaaatcaccccccatctgcgctggaaatggctgctcgatcagatctttcaggaggatttcagtgaggaagaggaggtggtcttgctggctacggactacatgcaacaggtgtctcaactgatacggtctacaccacaccgcgtgctacataattatctcgtgtggcgggtggtagtcgtgctgagcgagcacctcagccccccttttcgggaggcactgcatgaactggcccaggaaatggaaggatccgataagcctcaagaactcgcccgggtttgcttaggacaagccaacagacacttcggtatggccttgggagccctctttgtacatgaacacttttcagccgcttctaaggcaaaggttcagcagcttgtggaggatatcaagtatattctggggcagaggctggaggagttggactggatggatgctgagacacgggcggctgcaagggcaaagcttcagtatatgatggtcatggtggggtaccctgatttcttgcttaaacctgacgctgtggacaaggaatacgaattcgaggtccacgagaagacgtactttaagaatatccttaactccattaggttttctatacagctgtccgttaagaagattcggcaagaagtcgataagtggctgctccccccccaggccttgaacgcgtactatcttccgaataagaaccaaatggtgtttccggccggaatccttcagccaaccctttacgacccagacttcccccaatcgctgaattacggcggcatcggcacaatcatcggccacgaactcacccacggctatgacgactgggggggccagtatgaccgctcgggcaatctccttcactggtggacagaagcctcttactcgcggtttttaagaaaagcagaatgcatagtcaggctatacgacaactttacagtatacaatcagagggtaaatggaaaacatactctgggtgaaaatatcgccgatatgggcggtttaaaactcgcctaccatgcataccagaaatgggttcgcgagcacggccctgagcacccactcccacgactgaagtacacgcatgatcaattgttcttcattgcctttgcccagaactggtgtatcaagcggcggtctcagtcaatctacctgcaagtcctcacagacaaacacgcccctgagcactatcgcgtgctcgggagtgtcagtcaattcgaagaatttggaagggcctttcattgccccaaggacagtccgatgaatcctgctcataagtgctctgtgtggtag

SEQ ID NO: 186574 - DNA, 1284 bp, Artificial Sequence
  Description of Artificial Sequence: Synthetic coding sequence
atggagaccctgtgcctgcgggccagcttctggctggccctggtgggatgcgtcatttccgacaaccctgagcgttattctaccaacctaagtaaccacgtcgatgactttaccacgttccggggcacagagctaagtttcctcgtgaccacccatcaaccaacaaatctggtactgccttcaaatggaagcatgcataattattgcccccaacaaacaaagatcacttctgcttttaagtatatcaatacagtcatctcatgtactatctttattgtgggaatggtcggtaacgccaccctgctcaggattatttaccaaaataagtgcatgaggaacggccctaatgccctgatcgcctctttggccctgggcgatctgatatacgtggtgattgatttaccgattaatgtgttcaaattactcgctggacgttggccttttgaccacaacgatttcggcgtgtttctttgcaaactgttcccattcctgcagaagagttcagtgggtatcacagtcctgaatctttgcgccctctctgtagaccgataccgggcggtagcaagttggtcccgagtccagggcataggaatcccgctggtgacagcaatagagatcgttagcatctggattttgagcttcatcttggcaatacctgaggccatcggattcgtgatggtgccattcgaataccgcggagaacagcacaaaacctgcatgctaaatgcaacttcaaaattcatggaattttatcaggatgttaaggattggtggctctttgggttctacttctgcatgccgctggtttgtactgcgatattctataccctgatgacctgtgagatgctaaatcgccgcaacgggtctctgaggattgcactgagcgagcacctgaaacagaggcgggaggtagccaaaaccgtgttctgtctcgtggtgatcttcgcactttgctggtttcctctgcacctgtcccggatactcaagaagacagtgtataatgaaatggacaagaatagatgcgagctgctttcgtttctgcttctgatggactacatcggcattaatctggctaccatgaactcttgcatcaatcccatcgctctctatttcgttagtaaaaagtttaagaactgcttccagtcctgcctgtgttgttgttgctaccaatccaagagcctgatgacttccgttcctatgaacgggacaagtattcaatggaaaaaccatgaccaaaacaaccataatacagatagaagcagccacaaggactctatgaactag

SEQ ID NO: 186575 - DNA, 486 bp, Artificial Sequence
  Description of Artificial Sequence: Synthetic coding sequence
atggagaccctgtgcctgcgggccagcttctggctggccctggtgggatgcgtgatttctgacaacccagagaggtatagcactaatctgtctaatcacgtggatgattttactacctttcgggggacagagctcagttttctggtgaccacacaccagccaacaaatctggtactgcccagcaatgggtcaatgcacaattattgcccccaacagacaaagatcacatccgcattcaagtatattaacaccgtgattagttgtacgatattcatagtgggtatggtgggaaatgctaccctgttgagaattatctaccaaaataagtgtatgaggaatggacctaatgccctcatcgctagcctcgcgctgggagacctgatatatgtggtgattgatttgcccatcaatgtgtttaaggtgcagtctagctgtctattagagagttgttccggcaactgggacagcttcggcaattgtcattag

SEQ ID NO: 186576 - DNA, 957 bp, Artificial Sequence
  Description of Artificial Sequence: Synthetic coding sequence
atggagaccctgtgcctgcgggccagcttctggctggccctggtggggtgtgtcataagcgataaccctgaacgctattccactaatttatcaaaccatgtggatgacttcaccacgttccgaggcaccgaactgagctttttggtgactacgcatcagcccacaaacctggtgctacctagcaacggatcgatgcacaattactgcccccagcaaacaaagataactagcgcctttaaatatatcaacacagtcatttcctgcaccatctttattgtgggcatggtggggaatgctacactgctgaggataatttaccaaaataagtgtatgagaaatggccctaatgccctcattgcgtctctcgcactcggcgatttaatttatgtggtgattgaccttccaatcaacgtctttaagttttatcaggacgtgaaggattggtggttgtttgggttttacttctgtatgccactggtctgcaccgcaatcttttatactctaatgacctgtgagatgctgaatcgacgcaatggatccctgaggatcgcactaagcgagcatcttaagcagcgaagggaagtcgctaaaaccgtgttttgtctcgtggttatttttgcattgtgttggtttcctcttcatctgagtcgaatcctgaagaagacagtgtacaacgagatggataagaatcgctgtgaactgctctctttcctgctgctgatggactatattggtattaatctggctacaatgaatagttgtattaaccccatcgccctgtactttgtatccaaaaagttcaaaaactgttttcagagttgtttgtgctgctgctgttaccaatctaagtctctgatgacaagcgtgccgatgaatggaacgtctatccagtggaaaaaccatgaccagaacaatcacaatacggatagatccagccacaaagactccatgaattag

SEQ ID NO: 186577 - DNA, 564 bp, Artificial Sequence
  Description of Artificial Sequence: Synthetic coding sequence
atggagaccctgtgcctgcgggccagcttctggctggccctggtgggatgcgtcatttcggataaccccgaacgttacagcaccaacctctccaaccacgttgacgatttcaccactttcagagggacagagctgagctttctggtgaccacgcatcagcctaccaatttggtcctcccttctaacggctcaatgcataactactgccctcaacagactaaaattacctccgccttcaagtatataaataccgtgattagttgcacaatattcattgtgggaatggtgggaaacgcaaccctcctgcggattatctaccagaacaagtgcatgaggaatggccctaatgccttgatcgcatccctcgcactgggggatctgatttatgtggtaatagatctacccataaacgttttcaaactgctggccggcaggtggccttttgatcacaacgattttggggtgttcttgtgcaaattgtttcctttcctgcagaaatcatctgtcgggattaccgtcttgaatctgtgcgctctgagcgtggatcgcaaaaccgagatgtag

SEQ ID NO: 186578 - DNA, 957 bp, Artificial Sequence
  Description of Artificial Sequence: Synthetic coding sequence
atggagaccctgtgcctgcgggccagcttctggctggccctggtgggttgtgttatatcagataacccagaacggtacagcacaaacttgagcaatcacgtagatgacttcacgacatttcgtggcacagaactgtcctttttagttactactcaccagcccacaaacctggtattaccttccaacggcagtatgcacaattattgccctcagcaaaccaaaattacctctgcattcaagtacatcaacacagtgatatcatgcaccatcttcattgtgggaatggtcggaaatgcaaccctgctgcggataatttaccagaacaagtgcatgcgcaatggacccaacgctttgatcgctagcctcgcacttggagatttgatatatgtagtgattgaccttccaattaacgtatttaaattctatcaggatgttaaggattggtggttatttggcttctacttttgtatgccactcgtgtgcaccgctatcttttacacgctgatgacctgtgagatgctgaatcgcagaaacggtagcctgcgtatagccttgagtgaacacctgaaacaacgaagagaagttgccaagacagtcttctgtcttgtcgtgatcttcgcattgtgttggttccccctccatctcagcagaattctgaagaagactgtctataacgaaatggataagaatcgctgcgaactactctcctttctgctgctgatggactacatcggcatcaatttggcgactatgaattcttgcatcaatcccatcgccctttacttcgtgagtaaaaaatttaagaattgttttcagtcctgcttgtgctgttgttgttaccagtctaagagcctgatgaccagtgtgcccatgaacggcacaagtatccagtggaagaatcatgatcagaacaaccataataccgatcgcagttcccataaggattccatgaattag

SEQ ID NO: 186579 - DNA, 1179 bp, Artificial Sequence
  Description of Artificial Sequence: Synthetic coding sequence
atggaggagcagcagcccgagcccaagagccagcgggacagcgcccttggcgctgcagccgccgctacgccgggtggcctctccctttccctgtcccctggcgccagcgggtcttcgggcagtggaagcgatggggattcagtgcctgtttctcctcagccagcccccccttctccacccgccgccccctgtttacccccactggcccaccaccctcatctgcctccccaccctccgcctccacctcctcagcacctggctgcacccgctcaccagcctcagcccgcagcccagttgcatcgaactacgaatttttttatcgataacatactgcgacccgattttgggtgcaagaaagagcagccaccaccccaactgctcgtcgctgccgccgcacggggaggcgcaggtggaggcggccgcgtggagcgcgatagaggtcagacagcagcaggcagggaccctgttcatcctctgggtacgagggcgcccggcgcggcctcattgctgtgtgcccccgacgcaaactgtgggccacccgacggctctcagcccgccgccgccggcgccggagccagcaaggcgggaaatccagcggccgccgccgccgcggctgccgcagctgttgctgcagcagccgcagctgccgctgccaagccctcggacacaggaggtggaggaagcggaggtggcgccggatcccccggggcccagggaaccaaatatcccgagcacggcaaccctgccattctcctcatgggttctgcaaatggagggcctgtcgttaaaacagattcccagcagccgctggtctggcccgcttgggtgtactgtaccagatactccgaccgtccatccagcggccccagaactcgcaaattgaagaaaaagaagaatgaaaaggaagacaagcgcccccgaacagctttcacagccgagcaattacaaagattgaaggccgagtttcaggcgaaccggtacatcactgaacaaagacggcaaactctcgcccaggagctgagtttgaacgaatcccagatcaaaatctggttccagaataagcgagctaaaattaaaaaagccactggaatcaagaacggccttgcattgcatctgatggcacagggactttataaccatagcactaccaccgttcaggataaggatgagtcagaatag

SEQ ID NO: 186580 - DNA, 1002 bp, Artificial Sequence
  Description of Artificial Sequence: Synthetic coding sequence
atggaggagaacgaccccaagcccggcgaggccgccgccgccgtggaggggcagagacaaccagagagcagtcccggaggcggttctgggggcggggggggaagtagcccaggtgaggcagacactggaaggaggcgcgctctgatgctgcccgccgttctgcaagcacccggtaaccaccagcacccgcatcgcatcacaaatttcttcattgataatatcctgcggcctgagtttggccgccgtaaagatgctggtacatgctgtgcgggcgctggggggggcaggggggggggcgctggtggcgagggtggcgcctctggcgcagaagggggaggcggcgccggcgggtccgagcagttactaggttccgggagtagagagcccaggcagaaccccccatgtgcccccggggccgggggacccctacccgccgccgggtccgactctcccggcgatggcgagggcggatccaagaccctgtcactgcacggcggggccaagaagggaggcgacccagggggcccgctggacggaagtctgaaagccagagggttgggcgggggcgacctcagcgtatccagcgatagtgactccagtcaagccggcgccaatctgggcgcccagccaatgctctggcctgcctgggtgtattgcacccgctacagcgatagaccttcttcgggaccgagatcccgcaaacctaagaagaagaaccccaacaaagaagataagcgaccccgcaccgcattcaccgccgaacagctgcagcggctcaaagcagagtttcagacaaatcgatacctgaccgagcagagacggcagtcactggctcaggagttatcactgaacgagagtcagatcaaaatctggttccagaacaagagagctaaaataaagaaagcgaccggtaataagaacaccctggccgtccacctcatggcccaggggctatacaaccactctactactgctaaggagggaaagtctgattccgaatag

SEQ ID NO: 186581 - DNA, 2184 bp, Artificial Sequence
  Description of Artificial Sequence: Synthetic coding sequence
atgcccccccccgccgacatcgtgaaggtggccatcgagtggcccggtgcctaccccaaactgatggagattgaccagaagaagccattgtccgctatcattaaggaggtgtgcgatgggtggtcccttgctaatcacgagtactttgctctccagcacgccgacagttcaaacttctacattacagaaaagaatagaaacgagattaagaacggaacgatcctcaggttgaccacatctccagcccagaatgcccagcaattgcacgagagaatacagagctcaagcatggacgctaaacttgaggcactgaaggacctcgcgagcttaagccgcgacgtgacttttgcacaggagtttatcaatctcgacggtatctcgttgctcacccagatggtagagtccggcaccgagcgttaccaaaaattgcagaaaataatgaaaccatgcttcggagacatgctcagttttaccttgaccgcctttgtggaattaatggaccatgggatcgtttcctgggacacattctctgtggctttcattaagaaaattgcatcctttgttaacaagtcagctatcgacatctcgattcttcagaggtctctggccatcctggaatctatggtcttaaacagtcatgacctgtatcaaaaggtggcgcaggaaattaccatcgggcagcttatccctcaccttcaaggttcagaccaggagattcagacttatactatcgccgtcattaacgcactatttctaaaagcccccgacgagcgccgacaggagatggccaacatcctcgctcaaaaacagctgcgctccattatccttacacacgtgattagggctcaacgcgcaataaataacgagatggcccaccagctctacgtgctgcaggttctcacatttaatttactggaggacaggatgatgacaaaaatggacccccaggaccaggcccaaagggacattatctttgagctgcgacggatcgcctttgacgcagaaagtgaaccaaataactcgtctggaagcatggagaagcggaagtctatgtacacgcgggactataagaaattaggctttatcaatcacgtgaaccccgccatggattttacccagaccccgccaggaatgttggcactggacaacatgctgtatttcgccaaacatcatcaggatgcatacatccggattgtgctggagaactcatcccgggaagacaaacatgaatgtccctttggtagatcctccattgagctgaccaaaatgctgtgcgaaatcctcaaagtgggggagcttcccagcgagacctgtaatgatttccatccaatgtttttcacccatgaccgctcttttgaagaatttttctgtatctgcattcagctcctgaacaaaacctggaaggagatgagggctacaagcgaggactttaacaaagtgatgcaggtcgtcaaggaacaggtaatgagggctctgactaccaagccttcatcactggatcagtttaagtccaaactccagaatctctcatacactgagatcttaaaaatccggcagtccgagcggatgaaccaggaggacttccagtcccgtccgatcctcgaactgaaggagaagatccaacccgaaattttggagctgatcaaacagcagcggctgaaccgcctggtcgagggaacgtgctttagaaagctgaacgcccgccgtagacaagataaattctggtactgtcggctctcccccaatcacaaagttttacattacggtgatttagaggaatcgccccaaggtgaagtaccacatgatagcttgcaggacaagctccccgtcgctgacatcaaggctgtggtgacagggaaagactgcccgcacatgaaggagaagggcgctctgaagcagaacaaggaggtgctagagctggccttttctatcctatatgatagcaactgtcagttgaattttatagctcccgataagcatgaatattgcatttggactgatggactgaacgctctgttaggaaaagacatgatgtctgacttgacgcggaacgatctggatactctactctccatggagatcaagctgagactcctggatctcgaaaacatccagattcctgatgcaccgcccccaatccccaaggaaccgtccaactacgacttcgtttatgattgcaattag

SEQ ID NO: 186582 - DNA, 1290 bp, Artificial Sequence
  Description of Artificial Sequence: Synthetic coding sequence
atgagcgagcaccagaaggagcagaccctggacacccccagcctgcggacagttactctcacggtcagagtgcacggatttattctggaagtcagtaaaaccaaaaacccgcctattcctgacacattttggccacctagatgggatcatcggccctcacctgggggggagactaatgcatattgtcagatgaaccacgtgaacccagccatggattttactcagactccacctgggatgctggcactggacaacatgctgtacttcgctaaacatcaccaagatgcttacattaggatcgtcctggaaaatagtagccgcgaggataaacacgagtgcccatttggccgctctagtatcgaattgactaagatgctgtgtgaaatcttgaaagttggagagctgccttcagaaacctgcaatgactttcaccctatgttcttcacgcatgacagaagtttcgaggagtttttctgcatctgcatccagctgctcaacaaaacttggaaggagatgagagccacaagtgaggacttcaacaaggtgatgcaggtggtgaaggagcaggtgatgcgggccttgaccacaaagccctccagccttgatcagttcaaatcaaagttgcagaatttaagctatactgaaattttaaaaattcgacaatccgagagaatgaaccaggaggacttccagtcccgccctattctcgaactgaaggaaaagatacagcctgagatcctggagctgattaaacagcagagactaaataggctggtcgaaggcacctgcttccgtaagcttaacgctaggcggaggcaagacaaattctggtattgcagactctcaccaaaccataaagtcttacactacggagatttggaagagtctcctcaaggggaagtgcctcatgattctctgcaggacaaactccccgtggccgacatcaaggccgtggttactgggaaggattgtccccacatgaaagagaagggggcactcaaacagaacaaggaggtcctggagcttgccttttctatcttatatgattccaactgccaattaaacttcattgcgcctgataagcacgagtactgtatctggacggacggactgaacgccctcctgggaaaagacatgatgtcagaccttaccaggaatgacctggatacacttctgagtatggaaataaaacttagacttctggacctggagaatattcaaatacctgacgcccctcctccgatccctaaggagccgagcaactacgacttcgtatatgattgtaactag

SEQ ID NO: 186583 - DNA, 1896 bp, Artificial Sequence
  Description of Artificial Sequence: Synthetic coding sequence
atggacgccaagctggaggccctgaaggacctggccagcctgagccgggacgtcaccttcgcccaggagtttattaatctggatggaatctcgctgctgactcagatggtcgagtccggaaccgaacggtatcagaagttacaaaaaattatgaaaccttgctttggagacatgctgagttttaccttaacagcctttgtcgagctaatggaccacgggatcgtgagctgggataccttctcagtcgccttcattaagaaaatcgcaagctttgtcaacaagagtgccattgacattagtattcttcagcggtccctggcaatcctggaatctatggttcttaacagtcatgatctgtaccagaaggtggcccaagagatcactattggtcagctcatcccccacctgcagggttcggatcaggagatacagacatatacgatcgccgtcatcaatgccttgtttttaaaagcccctgacgaaaggcgacaagagatggccaacatcttggctcagaagcagttgagaagcatcatattgactcacgtgattagagcccagagggcaatcaataatgagatggctcatcagctttacgtactgcaagtgcttacctttaatctactcgaagataggatgatgaccaaaatggacccccaggaccaggctcaaagggatattatatttgagttgcggcgtattgcattcgacgcagagtcggaacccaacaatagctctggctctatggagaagcggaaatctatgtatacgagagactataaaaagcttggtttcattaatcatgtcaatccagctatggattttacacagacccctcctggcatgctggccctggataatatgctctattttgccaaacaccatcaggacgcatacatacgtattgtgctggagaatagttccagggaggataaacacgagtgcccttttgggcgctccagcatcgaattgaccaaaatgctctgcgaaatcctgaaagtgggggaactaccctctgaaacttgcaacgatttccacccaatgttttttactcacgataggtcgttcgaagagtttttctgcatctgcatacagttgctcaacaaaacctggaaggagatgcgcgcaacaagcgaggatttcaacaaagtgatgcaggtcgtgaaagagcaagtcatgagagctctgaccacaaaaccctcgtccctggatcagttcaagtctaagctgcagaacctgagctataccgagatcctcaagattcggcaatcagaacggatgaaccaggaggatttccaatctaggcctatccttgagctgaaagaaaagatccaacctgagatccttgaactcattaagcagcaacgattgaacagactggttgaaggcacctgcttcaggaagctcaatgcacgtcgcagacaggataagttctggtactgtcgactgtcacccaaccacaaagtgctgcattacggtgacctcgaggaatctccccaaggggaggtgccccatgacagtctccaggataagttgccggtagctgatatcaaagccgtcgtgaccgggaaggattgcccccatatgaaagaaaaaggcgcactgaagcagaataaagaagtgcttgaactggcattctccatcctttacgatagtaattgtcaactgaatttcattgcccccgataaacatgagtattgtatttggacagacgggttgaacgccttgttgggtaaagatatgatgagcgacctgactaggaacgacctggataccttgctgtctatggagattaagctgaggttactggatctggagaatattcagatcccggatgccccacccccgatccccaaggagccctccaattacgatttcgtttacgactgcaactag

SEQ ID NO: 186584 - DNA, 744 bp, Artificial Sequence
  Description of Artificial Sequence: Synthetic coding sequence
atgcaggtggtgaaggagcaggtgatgcgggccctgaccaccaagccaagtagcctggaccaatttaaaagcaaactgcagaacctctcttatactgagatcctgaagatcaggcagtcggagaggatgaaccaggaggactttcagtctagacctatacttgaactcaaggagaagatccagcctgagatcctggaacttattaagcaacaaagactgaatagactggtagaaggtacctgctttcggaagctgaacgctagaagacgacaggacaagttctggtactgccgattatccccaaaccacaaggtgctgcactatggagacctggaagagtcgcctcagggagaagtgccacatgatagcctgcaagataagctgcccgtggcagacattaaggccgtggtcacaggaaaggattgtccacatatgaaagagaaaggagccctgaagcagaacaaggaggttctggagctcgctttttcaatcttatatgactctaattgccagcttaatttcattgcaccagacaaacacgaatactgtatttggactgacgggcttaatgccctgctcgggaaggacatgatgtcagatctgacgcgaaacgatttggacaccttactgtcaatggagattaaattaaggttactcgatcttgagaatatccagatacctgacgccccacctcctattcccaaggagccaagtaattatgatttcgtctacgattgtaactag

SEQ ID NO: 186585 - DNA, 744 bp, Artificial Sequence
  Description of Artificial Sequence: Synthetic coding sequence
atgcaggtggtgaaggagcaggtgatgcgggccctgaccaccaagccaagctcactggaccagtttaaaagcaaactgcagaatctgagctatactgagattttaaaaattagacaatcggagagaatgaaccaggaagacttccagagccgcccgatactcgagttaaaagagaagattcagcccgaaatcctcgaattaatcaaacaacaaaggctgaaccgcctggtggaaggtacatgttttcggaagttgaatgcgaggcgcagacaggacaagttctggtactgtcggttgagtccgaatcacaaagtgctgcactacggggatctcgaggagtctccccagggcgaggtgccacacgactccctccaggacaagctgccagtggctgacattaaggctgtagtcacagggaaggattgcccccacatgaaagagaaaggggccctgaagcagaacaaggaagtgctggaactcgccttctcgatcctttatgacagtaactgccaactgaatttcatcgcacccgacaagcacgagtattgcatttggaccgatgggttgaacgcactgttggggaaggacatgatgtctgacctcacaaggaacgacttagacacactgttatcgatggagatcaaattgcggctgctggatttggagaacatccagattccagacgccccccctcctatccccaaagagcctagcaactacgacttcgtgtacgactgcaactag

SEQ ID NO: 186586 - DNA, 2184 bp, Artificial Sequence
  Description of Artificial Sequence: Synthetic coding sequence
atgcccccccccgccgacatcgtgaaggtggccatcgagtggcccggtgcatatccgaagctcatggaaattgatcaaaaaaagccactgtccgctatcataaaggaggtctgtgacggctggagcctggccaatcacgagtacttcgctctgcagcacgctgattcctctaacttctacattactgaaaaaaataggaatgagatcaaaaacggcacaatactgaggctgactacttcacctgcacagaacgcccagcaactgcatgagcgtatccagagctcttccatggatgcgaagctggaggctcttaaggacctggccagcctgtcacgggacgtgaccttcgcgcaggagtttattaatctcgacggcatctcccttctgacccagatggttgaaagtggcaccgaaagatatcagaaattgcagaaaattatgaagccctgcttcggagatatgctgtctttcactctgacagcgttcgtcgaactgatggaccacggcatcgtctcatgggatacatttagcgtggccttcatcaaaaagatcgctagtttcgtgaacaagtccgccatcgacataagcattttgcagagaagtcttgcaatcctcgagagcatggtgctgaatagtcatgacctgtatcagaaggtcgcccaggagattaccattggtcaactgattccccatctacagggaagcgaccaggagattcagacctacactattgccgtgatcaacgctctgttcctaaaagcacctgatgagaggcgccaggagatggctaacattttagcccaaaagcagctgcgttcaatcatccttactcacgtgatcagggcacagcgagccattaataacgaaatggctcaccagctgtacgtgctacaggtgctgacatttaatctacttgaagataggatgatgactaaaatggatccgcaggatcaagctcaacgggacatcatcttcgagctgagacgcatagctttcgacgctgagtctgaaccaaataactcttccggttccatggaaaaacgcaaaagcatgtacacacgtgattataagaagcttggatttatcaatcatgttaacccagctatggactttacgcagactccgcccggaatgctcgcattggataacatgttgtattttgcgaagcatcatcaggatgcttacattcggattgtgctggaaaatagttctcgggaggataagcatgaatgccccttcgggcgcagctccatcgagctcaccaaaatgctgtgcgagattctgaaggtgggcgaacttcctagcgaaacttgcaacgacttccatcccatgtttttcactcatgacagatctttcgaagagttcttctgcatctgtatacaattgctcaataaaacatggaaagaaatgagagccacatcagaggatttcaataaagtgatgcaggtggttaaggaacaggtgatgagggctttgacaaccaaaccgtccagtctggatcagttcaagagcaaactgcagaatctgagctacaccgagatattgaaaattcgccagtccgaacgcatgaatcaggaggacttccaatccagaccgatattggaactgaaggagaagattcagcctgaaattcttgagctgatcaagcagcagcggctaaaccgcctggtggaaggaacttgtttccgcaagttgaacgcgagacgcaggcaggataaattctggtattgtcggctgtcacccaatcacaaggttctgcattatggtgacctggaggagagcccgcaaggggaggtaccccatgactctttgcaggataaactgcccgtagccgacatcaaggcagtcgtgaccggaaaagactgtcctcacatgaaagaaaaaggcgctctgaagcaaaacaaagaagttttagagctggctttctctattttgtacgacagtaattgccagctgaatttcatagctccagacaagcacgagtactgtatatggacagacggcctaaatgcactgctcggtaaggatatgatgagtgatctgacccgaaatgacctagacaccttattgtccatggagatcaagctcagattactggatctcgagaacatacagattcccgacgcacctccacccatcccaaaggagccctcaaactacgattttgtgtacgactgcaactag

SEQ ID NO: 186587 - DNA, 180 bp, Artificial Sequence
  Description of Artificial Sequence: Synthetic coding sequence
atgcccccccccgccgacatcgtgaaggtggccatcgagtggcccggcgcctatccaaagttgatggagatcgatcagaaaaagccactaagcgccatcatcaaagaggtctgcgacgggtggtcactggccaatcatgagtattttgctctgcagcacgccgattcctcgaatttttag

SEQ ID NO: 186588 - DNA, 2184 bp, Artificial Sequence
  Description of Artificial Sequence: Synthetic coding sequence
atgcccccccccgccgacatcgtgaaggtggccatcgagtggcccggggcataccctaagctgatggagattgatcaaaaaaaaccactcagcgccataatcaaggaagtatgcgatgggtggagcttggcaaatcatgagtacttcgcgctgcagcacgcggacagctccaatttttacattaccgagaagaatagaaatgaaattaagaatggcaccatcctgcggctgaccacgtcacctgcccagaacgcccagcaactgcacgaaagaattcagtcttcttccatggacgcgaagctggaggctctgaaggatcttgccagtctgagtcgcgatgttacctttgcgcaggaatttatcaacctggatggcatcagcttgctcacgcaaatggtggagtcaggaactgagagatatcagaagttgcagaagatcatgaagccctgctttggcgacatgcttagtttcaccctaaccgcatttgttgaacttatggaccacggaattgtaagctgggatactttttcagtggcctttataaagaaaattgcatccttcgttaacaaaagtgctatcgacatcagtattctgcaacggagtctggccatcctggagtctatggtgctgaatagccatgatctttaccagaaggtggcccaggagatcacaatcgggcagttaattccacaccttcagggctccgaccaggaaatacagacctatacaatcgccgtgatcaatgcgttgttcctgaaggccccggacgagcgtcgtcaggagatggccaatattttggcccaaaagcagctgagatcaattatcctgactcacgttattagggcccagagagccatcaataacgagatggctcaccagctatacgtactgcaagtgttgaccttcaacctattggaagacaggatgatgactaagatggatccacaggatcaagctcagagggacatcatctttgagctccggcgaatcgccttcgatgcagaatcagaacctaacaacagtagcggcagcatggaaaagcggaagagtatgtacactagagattacaagaagctggggtttatcaatcatgtcaaccccgcaatggatttcacgcagactcccccggggatgctggcactggacaacatgctgtacttcgccaagcaccaccaggatgcatacattagaatcgtcctcgaaaacagttcacgtgaagacaaacatgaatgtccctttggccggagcagtatcgaattaactaagatgctctgcgagatcctcaaggtgggagagctcccctccgagacctgcaacgatttccacccgatgttttttacccatgatcgttcgtttgaggaatttttctgtatttgtatccaattgctaaacaaaacttggaaggaaatgagagccactagcgaggattttaacaaagttatgcaagtggtgaaggaacaggtgatgagagcactcactactaagccgtctagcctggaccagttcaaatcaaagctacaaaacttgtcttacaccgagattctcaaaattcgccagtccgaaagaatgaaccaggaagactttcagagtcgacccattctcgaactcaaggagaagattcagcccgagatcctggaacttattaaacagcagcgcctgaatcggctcgtggagggcacctgcttccggaaattgaacgcacggagacggcaagacaagttctggtattgtcggcttagtccaaaccataaggtgttacactatggcgacctggaggaatccccccagggagaggtgccacacgactcattgcaggataagttaccggtggccgacattaaggccgtcgtcactgggaaggattgtccacacatgaaggaaaaaggcgccctgaagcagaataaggaggttctggagctggcatttagtatcttatacgacagtaactgccagctgaattttatcgcccctgataagcacgagtactgcatatggactgatgggttaaatgccctgctcggtaaggatatgatgtccgatctcacaaggaatgacctggacaccctgctttctatggaaataaaattgagactgcttgacctggagaacattcagatccccgatgcccctccaccaatcccaaaggagccatccaactatgactttgtgtacgactgcaattag

SEQ ID NO: 186589 - DNA, 246 bp, Artificial Sequence
  Description of Artificial Sequence: Synthetic coding sequence
atgcccccccccgccgacatcgtgaaggtggccatcgagtggcccggtgcctacccaaaactgatggagatcgaccagaaaaaacccctgagcgctatcataaaggaggtgtgcgatggttggtctctggccaatcatgagtattttgcactacaacatgcggattcctccaatttctacattacggagaaaaacaggaatgagataaagaatggcacgattcttagactaaccacctccccttag

SEQ ID NO: 186590 - DNA, 450 bp, Artificial Sequence
  Description of Artificial Sequence: Synthetic coding sequence
atgcccccccccgccgacatcgtgaaggtggccatcgagtggcccggcgcatatcccaagctcatggagatcgatcagaagaagcctctgtctgccatcatcaaggaagtatgtgacggctggtctctggcaaatcacgaatactttgccctgcagcatgctgatagcagcaatttttatattaccgagaagaaccggaatgaaattaaaaatgggactatccttagactgacgacaagccccgcgcaaaacgctcagcagctacatgagcgaatccagtctagcagcatggatgccaaacttgaggccctcaaggacctggcctccctgtcgagggatgtgactttcgcccaggagtttattaacctcgatggcatttccctgttgacacagatggtggagtctgggactgagcggtatcagaagttgcagaaaattatgaagccttag

SEQ ID NO: 186591 - DNA, 2163 bp, Artificial Sequence
  Description of Artificial Sequence: Synthetic coding sequence
atgcccccccccagcgacatcgtgaaggtggccatcgagtggcccggcgctaatgcacagctgctcgagattgatcaaaaaaggccactggccagtattatcaaagaggtttgtgacggctggtctctaccgaacccagagtactatacactgcgctatgccgatgggccccagttatacattactgagcaaacccgctcagatattaaaaatgggacaattcttcaactcgccataagtccaagcagagccgcccgccagctaatggaacgaacgcagtctagtaacatggaaaccagactcgacgctatgaaagagctggctaagctttccgccgatgtaacctttgctacagaatttatcaacatggatggaatcatcgtgttaactcgcttagtggagtccggcacaaaactgttgagtcattacagtgagatgttagcctttacccttaccgcatttctcgaactgatggaccacggtatcgtctcttgggacatggtgagtatcacattcatcaaacaaatcgccgggtacgtcagtcaacccatggtggatgtcagcatcttgcagcgatcactcgctattctggagtctatggtgctgaacagccagtctctgtaccagaaaattgcagaagaaattaccgtgggccaactcatctcccatttgcaggtctcaaaccaggaaatccagacatatgctattgccctgatcaacgctctattccttaaggcacctgaggacaaaaggcaggacatggctaacgccttcgcacagaagcacctcagaagtattattctgaaccatgtaatcagaggcaaccggccgataaagactgaaatggcccatcagttatacgtgctgcaggtgctcacattcaatctgttggaggagaggatgatgacaaagatggaccccaatgaccaggcacagagggacatcatttttgaactgcgccgcattgctttcgacgctgaatccgatccatcaaacgcgccaggctctgggactgaaaaaaggaaggcaatgtatactaaagattacaaaatgctggggttcaccaaccatattaaccctgcaatggacttcacgcagaccccccccggaatgctagccttggacaacatgctgtatctggcaaaggtgcatcaggacacttatattagaatcgtgctagagaacagctccagggaggacaaacacgagtgtcctttcggcaggtctgctattgaattaaccaaaatgctttgtgagattctgcaagtgggtgaactcccaaatgaagggaggaacgactatcatcctatgttcttcactcacgatagggcttttgaggagctttttgggatttgcatacagctgctgaacaaaacatggaaggagatgcgggccaccgctgaagactttaataaagtgatgcaggttgtgcgggaacaaattacacgggccctaccgagcaaacccaattctctcgatcagttcaaaagcaagctgaggagcctgagctattctgaaatactcaggttacgccaaagtgaaaggatgtctcaggacgatttccaatcccccccaatcgtggagctcagagagaagatccaaccggaaattctggagttgattaaacagcagcgcttaaaccgactgtgcgagggaagctcctttagaaagatcggcaaccggcgtagacaggaacgcttttggtactgcagactggcattgaaccataaggttttacactatggagacctggacgacaaccctcagggggaagtgacttttgagtccctccaggaaaaaattcccgtcgctgatattaaggccatcgttacagggaaggactgtcctcatatgaaggagaagtctgcacttaagcagaacaaggaagtactcgagctcgctttcagcatcctgtatgatcctgacgagaccttgaacttcatagctcccaacaagtatgagtactgtatttggattgacgggcttagtgccctcttagggaaagatatgtcctctgagcttactaagagtgatttagatacgctgttatctatggagatgaaacttaggcttctcgatttggaaaacatccagattccagaagcacctcctcctattcctaaggagcctagcagctacgattttgtctaccattatggctag

SEQ ID NO: 186592 - DNA, 2157 bp, Artificial Sequence
  Description of Artificial Sequence: Synthetic coding sequence
atgcccccccccagcgacatcgtgaaggtggccatcgagtggcccggagcaaacgcccagttgctggaaatcgaccagaagcgcccacttgcctctatcatcaaggaggtctgcgatgggtggagcctccccaaccccgagtactataccttgaggtacgccgatgggccccagctgtatatcactgaacaaactagaagtgatatcaagaacggaactatcttgcagttggcaatctccccatccagagcagcccgacagttaatggagcgaacccagagctcaaatatggagacccgcctagatgccatgaaagagttagctaaactaagtgccgacgtcaccttcgcaactgagttcattaatatggatggtatcattgtgctcacgaggttggtcgaaagtgggactaagctcttgtctcacgagatgctcgccttcacattgaccgcttttctcgagctgatggaccacggaatcgtctcttgggatatggtttccatcacctttatcaagcagattgccgggtacgtgtcacagcccatggtggacgtgtccatcctgcaaaggtctctggcaatactggaatctatggtcctaaatagccagagcctgtaccagaagattgctgaggagatcacggtggggcaattaatctcccacctgcaagtgtcaaaccaggaaattcaaacctatgcaatcgccttgatcaacgctctcttccttaaggcccctgaggataagaggcaggacatggcgaacgccttcgcacagaaacacctcagaagtatcattctgaatcacgtgatacgagggaatcggcctattaagaccgagatggctcatcaactgtatgttcttcaagtcttgacctttaacctgctagaagagaggatgatgacgaagatggatcctaatgatcaagctcagcgggacatcatctttgagctgcgtagaatcgcattcgacgcagaaagtgacccatccaacgcacccggctccggaacagagaagagaaaggccatgtacacaaaggactataagatgctgggtttcactaatcacattaaccctgcgatggacttcacccagacgcctcccgggatgctcgcccttgataatatgctctacttggccaaggtgcaccaggatacttacatccggatagtgcttgagaattcttcacgggaagataaacacgaatgtccattcgggagatccgcaatcgagctgactaagatgctgtgcgaaattcttcaagtgggggaactccccaatgagggacgcaacgattaccacccaatgtttttcacccacgacagagcatttgaggagctgttcggtatttgtatacagctgctgaataagacttggaaggagatgcgggccactgccgaggacttcaataaagtcatgcaagtggttcgcgaacagatcacccgggctctaccttcaaaacccaacagcttagatcagttcaaatccaagctgcgcagcctgagctatagcgagattctcagactcagacagagcgaacggatgtctcaggatgactttcaatctccccccatagtcgagttacgcgaaaagattcagcccgaaatccttgagctcataaaacagcagcgactgaacagactgtgcgaggggtcttcgttccggaaaatcggcaaccggcgaagacaggaacgcttctggtattgcagattagcccttaaccacaaagttctgcactacggggacctggacgataatccccagggggaggtaacattcgaaagcctgcaggaaaaaatacccgtggcagacataaaagccattgtcactgggaaggattgcccccacatgaaggagaagtctgcccttaagcagaataaggaggtgctcgaacttgccttcagcatcctctacgatcctgacgagaccttgaacttcatcgcccccaacaaatatgaatactgtatttggattgatgggctctccgccctgctgggtaaggacatgtcgagtgagttgaccaaatccgatctggacaccctcctctccatggagatgaaactgcgccttctggacctagagaatatccagattcccgaggcccccccacccatccctaaagagccctccagttacgactttgtgtatcactacggatag

SEQ ID NO: 186593 - DNA, 1899 bp, Artificial Sequence
  Description of Artificial Sequence: Synthetic coding sequence
atggagcggacccagagcagcaacatggagacccggctggacgccatgaaggaactagctaagctgtcagccgacgtcactttcgctacagagttcatcaatatggacgggattatcgtcctgacaaggctggtggaatccggaacgaagttgctgtcccactatagtgagatgttagcgttcaccctgacagctttcctggagctgatggatcatggcattgttagctgggatatggtgtccatcacgtttatcaaacagatcgcgggttacgtatcacagcctatggtggacgtgtccatcctgcaacgaagcctggccattctggaatctatggtgctgaattctcagtctctgtaccagaagatagccgaggaaatcacagtggggcaacttatttcacatctacaggtgtccaatcaagaaattcaaacctatgctattgctttaatcaacgctttgtttctgaaagctcctgaggacaaacgacaggacatggccaacgcgtttgcccaaaaacacctgcggagcatcattcttaatcacgtgattagagggaatcggcccataaaaaccgagatggcacatcagctatatgtgcttcaggtgctcaccttcaacctactcgaggagaggatgatgaccaagatggatccaaatgaccaggctcagagagatattatctttgaacttaggcgcattgcctttgatgctgaatcagacccaagtaatgcccccggctccggaacagaaaagaggaaggctatgtatacaaaagactacaaaatgctgggcttcactaaccacattaatccggccatggacttcacacagacgccacctgggatgttggccttggacaacatgctgtacctggctaaagttcaccaggacacctacatccgaatcgtcctggaaaatagcagcagggaagataagcatgagtgtcctttcggaaggagtgcaatagaacttacaaagatgctctgcgagattctgcaggtgggcgaacttcctaacgaggggcgaaacgattaccatcctatgttctttacccacgatcgagcctttgaggagcttttcggaatctgtattcagcttctcaacaaaacatggaaggaaatgagggcaacggcggaagatttcaataaagtcatgcaagtggttagagaacagattacgagagctctgccatctaagccaaactctctggatcagttcaagtccaagttgcggtctctgagctacagtgaaatcctcagactgcgccagtcagagcgcatgagccaggacgatttccagtcacctccgatcgtggaattaagggaaaagatccagccagagattctggagttaatcaagcagcagagactgaacaggctctgtgaaggatccagtttcaggaaaatcggaaacaggcggaggcaggaaagattttggtactgccgattggccctgaatcataaggtgctgcactacggtgatcttgacgacaatccccagggcgaagttacctttgaatctctgcaggaaaaaattcccgtagcagatatcaaggccatcgtgacgggaaaggactgccctcacatgaaggaaaaatcagcccttaaacagaacaaggaggttctggagctggccttctccatactatatgaccctgacgaaacccttaactttatagccccaaacaaatacgagtactgcatctggatcgacggcctctcggcactgctgggtaaggatatgtcatctgagctcactaagtcggatttggatacactgctatcaatggaaatgaagttaaggttactggacctagagaatatccagattcctgaagcccccccaccaattcccaaggagccaagctcatacgattttgtataccactacggttag

SEQ ID NO: 186594 - DNA, 2163 bp, Artificial Sequence
  Description of Artificial Sequence: Synthetic coding sequence
atgcccccccccagcgacatcgtgaaggtggccatcgagtggcccggagctaacgctcagctgctcgagatagaccagaagagacccctggccagcatcatcaaagaagtgtgcgacggctggtcactccccaacccagagtactatacccttaggtacgcagatggcccccagctgtatatcacagaacaaacgaggtccgatattaagaatggaactatcctgcagctggcaattagcccttcacgtgccgcacggcagctgatggagaggactcagtcaagtaatatggaaaccaggctggacgccatgaaggaactggcaaagctgtcagccgatgtgacatttgccacagaatttatcaacatggatggaattatagtgcttacacgattagtggagtccggaacgaagctgctgtcacattattccgagatgcttgcattcactttgacggcctttcttgaactgatggaccacggaatcgtgtcctgggatatggtgagcattactttcatcaaacagattgcagggtatgtgtcacagccaatggttgatgtgagcatactccagagaagtctcgccatcctggagagtatggtgctgaatagccagtcattatatcagaagattgccgaggaaattaccgttggccagctgatctcacacttacaagtgtctaaccaggaaatccagacctatgctatagcactgataaacgctctttttcttaaggcacctgaggataaacgccaggacatggcaaacgcattcgctcagaaacacctgcgtagtattatcttgaatcatgtgatccgcgggaaccgcccgataaagacagaaatggcacatcagctgtatgtgttgcaggttttaacgttcaatctactggaggaaaggatgatgacaaaaatggaccccaacgaccaggctcaacgcgacattatcttcgagctacgaagaatcgccttcgacgcagagagcgatcccagcaatgcaccaggatccggcacagagaaacgcaaagctatgtacaccaaggactacaaaatgttagggtttacgaatcacattaaccccgctatggatttcacacagacaccgccaggcatgctagccttggataacatgttgtatctggcaaaggtccatcaagatacctatattcgcatcgtgctcgagaattccagccgtgaggacaaacacgagtgcccattcggccggagcgccattgagcttacaaagatgctgtgtgaaatattacaggtaggcgagcttccaaatgagggaagaaacgactaccaccccatgttttttactcatgatagggccttcgaggaactgttcggcatatgcatccagttgctgaacaagacatggaaagagatgagagcaacagctgaggacttcaacaaggttatgcaggtcgtgcgagaacaaatcactagagccctgccctccaaacctaactctctggaccaattcaagagcaaactcagatcactcagctacagcgagattcttcgattgcgccagtctgagaggatgagtcaggatgactttcagagcccgccaatagtggaactacgggaaaagatccagcctgagatcttagaactaatcaaacagcagcggctgaaccgcctctgtgaaggctctagcttcagaaaaatcggtaataggagacgccaagaacgtttctggtattgtaggttggcattgaatcacaaggtgcttcactacggcgaccttgatgacaatccccagggcgaagtgacattcgaatcccttcaggaaaaaattcctgttgccgatattaaggcaatcgtgaccggcaaagactgtcctcacatgaaagagaaaagcgctctcaagcagaataaggaggtacttgaactggctttctccatattgtatgacccagacgagaccctgaatttcattgctcccaacaagtacgagtactgcatttggatcgacggactgtcagcccttcttggcaaagatatgagttcagagctgactaaaagcgatctggacactctgttaagcatggaaatgaagctgcgccttcttgacctagagaatatccaaatccccgaggctccgcctccaattcctaaggagccctcgtcctacgatttcgtgtaccactacggctag

SEQ ID NO: 186595 - DNA, 804 bp, Artificial Sequence
  Description of Artificial Sequence: Synthetic coding sequence
gaggagatcaccgtgggccagctgatcagccacctgcaggtgagcaatcaggaaattcagacctatgctatagccctgataaatgcactcttcctcaaagctcccgaagacaaaaggcaggacatggctaatgcctttgcacagaaacacctaaggtcaattatcctgaatcacgtcatccgcgggaacaggccaatcaagactgaaatggcccaccaactatacgttttgcaggtgctcactttcaacctgcttgaggagagaatgatgaccaaaatggatccaaacgatcaagcacagagagacatcatattcgagcttcggcgtatcgcattcgacgccgaaagcgacccctcgaacgctccagggtctgggacagagaaacgaaaggctatgtatacgaaggactataagatgctgggctttacaaaccacatcaatccagccatggacttcacccagaccccccccgggatgctcgcccttgataacatgctctacctggctaaggtccatcaggacacatacatacggatcgtcttagagaattcttcgagagaagataagcatgagtgccccttcggaagatcagcaatcgagcttactaagatgttgtgcgagattctgcaagttggcgagcttcctaacgaaggccggaatgactatcatcctatgttctttacacatgacagagcctttgaagagctctttgggatctgcatccagctgctgaataaaacctggaaggaaatgcgggccaccgcagaagacttcaataaagtgtctgtttcgggcttgttgtag

SEQ ID NO: 186596 - DNA, 2199 bp, Artificial Sequence
  Description of Artificial Sequence: Synthetic coding sequence
atgcccccccccagcgacatcgtgaaggtggccatcgagtggcccggcgccaatgcccagctgctggagatagaccaaaagcgacccctagctagcatcatcaaagaagtgtgtgatgggtggagtctacccaaccctgaatactatactttgagatacgctgacgggccccagttgtacattaccgagcaaactagatctgacatcaaaaatgggacgatcctacagctcgcaatctcgccaagccgcgcagcacgccagctgatggaaagaacccagtcatcaaacatggaaaccagacttgatgccatgaaagagttagccaagctctccgccgacgtcaccttcgcgaccgaattcattaatatggatggaatcatcgtgctgacccgacttgttgagtctggaacaaaactgctcagtcattactcagaaatgctggcttttacactgactgcttttcttgagctcatggatcacgggatcgtctcctgggacatggtatccataacattcattaagcagatcgcaggttacgtctcccagcctatggtagacgtatctattctgcaaagaagcctggctattttagagtctatggttttgaacagtcagtcgctctatcagaagattgctgaggagatcaccgtcggtcaattaatatcacacttgcaagttagtaatcaagagatccagacctacgccattgccctgattaatgctttgtttctgaaagccccagaggacaagagacaagacaaacacttaaatcccctggatctgcccgtgacagatatggccaacgcttttgctcagaagcacttacggagcattatcctgaatcatgtcatccggggtaaccgccctattaagactgagatggcgcatcagctgtacgtgttgcaagttttgaccttcaaccttctggaagagcgcatgatgactaaaatggatcctaacgaccaagctcagcgagacataatctttgagctgaggcggatcgcattcgatgccgagagtgacccctcaaatgcgcctgggtcgggtactgagaagcgcaaggcaatgtacacaaaagattataaaatgctgggattcacgaatcacatcaatccagccatggatttcacccagacgccccccgggatgctcgctctggacaacatgctgtacctggcaaaagtgcaccaggacacttacattcgtattgtgctggagaactctagtcgtgaggacaaacacgagtgcccctttggcagatctgccatcgaactgacaaaaatgttgtgtgagattcttcaggttggggagctcccaaacgaagggaggaatgactatcatccaatgttctttacccacgacagggcctttgaagaattgtttggaatctgcatccagttgcttaataagacctggaaagaaatgagggcaaccgcggaggatttcaataaggtgatgcaggtggtccgggagcagattacccgcgccttaccttcaaagcccaattcactcgaccagttcaaatctaaacttaggagtctgtcatactcggagattttacgactgcgacagagcgagcgtatgtctcaggatgactttcaaagcccccctatcgtggaacttcgagagaagatccagccagagatacttgagttgatcaagcagcagcgcctgaatcgattatgcgagggctcttcattcagaaagatcggtaatagaaggagacaggaaaggttctggtattgtcggctggctctaaatcataaggtcctccactatggcgacttagacgacaacccccaaggagaagtgaccttcgagagtctgcaggagaagatcccggtcgccgatatcaaggcaattgtgacaggcaaggattgtccgcacatgaaagagaaaagtgcactgaaacagaataaggaagttctggagctggcgtttagcatcctgtacgacccagatgaaacccttaacttcattgcaccgaacaagtacgagtactgcatttggattgatggactgtccgcgctactgggaaaggacatgtcaagtgaactgacaaagtccgacttagacaccctcctgagcatggaaatgaaattgcggctgctggacctggaaaacatccagatccccgaggcgcctccacccattcctaaagagccgagttcctacgatttcgtttaccactatgggtag

SEQ ID NO: 186597 - DNA, 1614 bp, Artificial Sequence
  Description of Artificial Sequence: Synthetic coding sequence
atggtggacgtgagcatcctgcagcggagcctggccatcctggagtctatggttcttaacagtcagtccctataccagaagatcgcagaggagattaccgtcgggcagctcatcagccatctccaagtgtccaatcaggagatccagacttacgccattgcgctgataaatgccttgtttctgaaagcccctgaggacaagcgccaagacatggcaaatgcatttgctcaaaagcacttaaggtccatcattctgaaccacgtcataagggggaataggccaattaagacagagatggcgcaccagctttacgttctgcaggtgctcacattcaaccttctagaagagagaatgatgaccaaaatggatcccaacgatcaagcacagagggacatcatcttcgagctccgaaggatagccttcgatgccgaaagtgatccttcaaacgccccggggtctggaacagaaaaaaggaaggccatgtacacaaaagactacaagatgctaggtttcaccaaccacatcaatcccgctatggactttactcagacaccgcccggcatgttggccctggacaacatgttgtatctggcaaaggtgcaccaggatacctatattcggatcgtgctggaaaattcatcccgcgaggataagcacgagtgtcctttcggaagaagcgcaattgaattgaccaaaatgctttgtgagatcctccaggtaggagagctgccgaacgagggcaggaacgattaccacccaatgttcttcacgcacgacagggctttcgaagagctctttggcatttgcatccaactactgaacaagacatggaaggagatgcgcgctaccgcagaggattttaacaaagtgatgcaggtggtgagagaacagatcacccgtgccctgccatccaaacctaattcactggatcagtttaaatctaagctcagatccctgtcatattcagaaattttgaggctcaggcaatcagaaagaatgtcacaggatgattttcagtcgccccccatcgtcgaactgagggaaaagatccaacctgagattctggaactcatcaaacagcagcggttgaatcgcctgtgtgaagggtccagcttcagaaagattgggaataggagaaggcaagagcgattttggtactgcagactggccctgaatcacaaagtcctgcactatggagatctcgacgataatccacagggggaggtcacgttcgagtcgctacaggagaagatacctgtcgctgatatcaaagcaattgtaaccggaaaagactgcccgcatatgaaagagaaatccgccctgaaacaaaacaaagaagtcctcgaacttgcattcagcattctgtatgatcccgatgagactctgaacttcatcgcaccgaacaaatatgagtactgcatctggatagatggccttagtgctcttctcggcaaagatatgagtagtgaactcaccaagtctgatctagacactttactgtctatggagatgaaactgaggctgctggacctcgaaaacattcagatcccagaggctccccctccaattcccaaagaacctagctcttacgattttgtctatcactacggatag

SEQ ID NO: 186598 - DNA, 1017 bp, Artificial Sequence
  Description of Artificial Sequence: Synthetic coding sequence
atgcccccccccagcgacatcgtgaaggtggccatcgagtggcccggtgctaatgcccagctgctggaaattgaccagaagagaccactggcatctatcatcaaggaggtgtgcgatggatggtcattgccaaatccagagtactacaccctgcgctacgccgatggaccacagctatacatcacagaacagacacgctcagacattaagaatggaaccatcctgcagctggctatctcccccagccgagccgccagacaactgatggaaagaacacagtcgtcaaatatggagactcgattggacgccatgaaggagctcgctaaacttagcgccgacgtcacattcgccaccgaattcattaacatggatgggattatcgtgctcactcggttggtggagagcggtactaagctgctctcacactactctgagatgctggcatttacactgaccgctttcctcgagcttatggaccatggaattgtaagctgggatatggtgtctatcacctttatcaagcagatcgcggggtacgtaagccaacccatggtagacgtttcaatcctgcagagatccctggccatcctggaatctatggtcctaaactctcagtcactctaccagaagattgccgaagagattacagtgggacagctgataagccatctacaggtctccaaccaagagatccagacctatgcgatagctctcataaacgccctctttctgaaggctccagaggacaagaggcaagacatggccaatgccttcgctcaaaaacacctgagaagtataattttgaaccacgttatacgcggcaatcgccctattaagaccgaaatggcgcaccagctttatgtcttacaggttctgacatttaatctcctggaagaaagaatgatgaccaaaatggaccccaacgatcaagcccagcgtgatataatatttgagctgaggcgcatcgccttcgatgcagaatccgaccccagtaatgccccagggtctggcacttag

SEQ ID NO: 186599 - DNA, 852 bp, Artificial Sequence
  Description of Artificial Sequence: Synthetic coding sequence
taccaccccatgttcttcacccacgaccgggccttcgaggagctgtttggaatttgcatccagctgctgaataagacgtggaaggagatgcgagcaaccgcagaagatttcaacaaagtgatgcaggtggtgcgggagcaaatcacgcgggccctgcctagcaaaccaaatagtctcgaccaatttaaatcgaaacttagatcgctatcttacagcgaaattctgcgcctccgccaaagcgagcggatgtctcaggacgattttcagagcccaccaattgttgaactgagagagaagatacaacctgagatcctggagctcatcaagcaacagaggcttaaccggctgtgcgaaggctcaagcttccggaagatcggcaatcgccgccgccaggaacgattctggtattgtagactcgccctgaatcataaggtactgcattacggcgatctggacgacaaccctcagggagaggtgaccttcgagtctctccaggagaagaacatcaaagcaatcgtgactggcaaggactgcccccatatgaaggaaaaatctgccttgaaacagaataaggaggtcctggagttggcattttctatcctgtacgatccagatgagacccttaacttcatcgcacccaacaagtacgagtattgtatctggatcgatggcttgtctgcactcttgggaaaggatatgagtagcgagctcactaagagcgacctggataccttactaagtatggagatgaagctccgacttctggatctcgaaaacatccagattccagaagccccacctcccattcctaaggagccttcttcatacgactttgtttatcattatggatag

SEQ ID NO: 186600 - DNA, 1359 bp, Artificial Sequence
  Description of Artificial Sequence: Synthetic coding sequence
atgcacgtgatccggggcaaccggcccatcaagaccgagatggcccatcagctgtatgtgttgcaggtcctgacctttaatcttctcgaagaaagaatgatgacgaaaatggatccaaacgatcaggcacagagggatattatcttcgagctgaggcggatcgcctttgatgctgaatctgatccaagcaatgcgcccggatctgggacagagaaaaggaaagcgatgtataccaaagattacaagatgctagggtttacgaatcacatcaacccagctatggacttcacccaaaccccacccggaatgctggcccttgataatatgctttacctagcgaaggttcatcaggatacctacatcagaattgtcctggaaaattcctctcgcgaagataaacatgagtgcccatttggcaggtccgcaattgagttgaccaaaatgttgtgcgagatactgcaagtcggagagctccccaacgaaggccgcaatgattatcacccaatgttcttcactcatgatagagcttttgaagagctctttggaatctgtattcagctgctgaataaaacctggaaagagatgcgggctacagcggaggatttcaacaaggtcatgcaggtggtccgcgaacagatcacacgcgctctgccctcaaagccaaattctctggatcaattcaaatcgaagctgcggagtctaagctactccgaaattctccgcttacgtcaatcagaacggatgtcccaggatgatttccagtcgccccctattgtggagctgagagaaaaaatccaacctgaaatcctggaactgatcaagcagcagaggctgaatcgactatgcgagggatcctcttttaggaaaattggcaaccggaggcggcaagaaagattttggtattgtcgcctggcccttaaccataaggtgttacactacggagatctggatgataatccccagggcgaggtgacattcgagtccctgcaggagaaaatcccggttgccgacattaaggcgatcgtgacaggcaaagactgcccccacatgaaggagaaatctgcactgaaacagaacaaggaggttctggagctggcattcagcatactatatgatcctgacgaaactctcaattttatcgcccccaacaaatatgaatactgtatttggatcgacggcctctccgctttgctcggtaaagacatgagcagcgagttgaccaagagtgatctcgataccctcctgagtatggaaatgaagctgcggctcctagatctggagaacatacaaattcccgaggccccgccacccattccgaaagagccctcaagctacgacttcgtttaccactacggatag

SEQ ID NO: 186601 - DNA, 2322 bp, Artificial Sequence
  Description of Artificial Sequence: Synthetic coding sequence
atggcccggagcagcagcctgggccgggagtgcggcaccccccggtctggcctcggcaagggaggtccccctaggcctcagggcccccaggccagatgtacgctcggccgacggtgtacagtgtctggcaagtgccgcagaccccgaccaagctggactatggctcctccccgtaatgtcgtcaagatcgcgattaagatgcgggatgccatcccacagctgatacaattagatcaagcaaagcccctcgccgcggtgctgaaagaggtatgtgacgcatggagcctgacccacagtgagaggtatgccctgcagttcgccgatggccatcggaggtatatcacagaaaataatagggccgaaatcaagaatggctctatcctgtgcttgtccacggcccccgacctggaggcagagcaattacttggcggtctccagagcaatagcccagagggacgcagggaggctcttagacgcctggtgcctttggcctcagacatgatctttgctcgggaagtgatctcaaggaacggtttgcagatactcggcaccatcattgaagacggagatgacttaggtgaggtgttggctttgagtctgcgagcgtttagcgagcttatggagcacggtgttgtgagttgggagacacttagtatacctttcgtgcgaaaagtggtgtgctacgtgaacatgaacctgatggacgcctctgtcccacctctggccctgggactgttagagtcagtcactctaagctcccctgcgctgggacaattggtcaaaagcgaggtgcccctagatcgtctgttagtgcaccttcaagtcatgaaccagcagctacaaacaaaagctatggctctgctcactgctctcctgcagggtgccagcccagtcgaacgaaagcacatgctggactacctctggcagcggaatctgaggcagttcatttataaaaatatcattcattcagcagctcctatgggagatgaaatggcccatcatctatatgttctgcaggctttgatgttggggctactggagcctagaatgcggacccctcttgacccatattcccaagagcaaagggagcaactacaggtgctcaggcaggctgctttcgaggttgagggagagtctagcggggctggcctaagcgctgatcgccgacgctcattgtgtgctagggagtttaggaaactgggattctctaatagcaaccccgctcaggatcttgaaagggtgccaccagggcttctggcactggacaacatgctatatttttcccggaatgcacccagtgcatatagcagattcgtgctggagaacagctctcgagaagataagcacgagtgcccattcgctagggggtccatccagcttaccgttctgctctgcgaactcctgcgggtgggggagccttgttccgagactgctcaagatttttcacctatgttctttggccaggatcagtcatttcacgaacttttctgcgtgggcattcagctcctgaataagacatggaaagaaatgagggccacgcaggaggactttgataaggtcatgcaagtggtccgagagcagctggcccggaccttggccttaaagccgacaagtctcgagctgtttcgaacaaaagtaaatgcattgacatacggggaggtgctgcgcctgcgacaaacggagaggctacaccaggaaggaaccctggcaccaccaattcttgagctgcgcgagaagttaaaacctgagcttatgggtctgatccgccagcaaagacttctacgactgtgcgagggcacattgttcaggaagatttcctcacggaggcgccaggataagctgtggttttgttgcctgagccctaatcataaactgctccagtacggagacatggaggaaggcgcttcgccacccacacttgaaagccttcctgagcagctacctgtcgcggatatgagagccttattgacaggcaaggattgcccacacgtgcgcgagaaaggatccggcaagcagaataaagacctttacgaactggccttttccatctcttatgatcgtggggaggaagaagcttacctgaacttcattgccccatcaaaacgggaattttatctgtggaccgatggactctcagccctgcttgggtccccgatgggtagcgagcaaacaaggcttgacttggaacagttattgaccatggagacaaagctccggcttctggaactcgaaaatgttcctattcccgagagacctccccccgtgccccccccacccacgaattttaatttttgttacgattgtagtattgctgagccgtag

SEQ ID NO: 186602 - DNA, 2511 bp, Artificial Sequence
  Description of Artificial Sequence: Synthetic coding sequence
atgagcaagctgagcttccgggcccgggccctggacgccagcaagcccttaccggtcttccgatgtgaggacctcccagacctgcatgagtacgcctccatcaatcgagcagtgcctcagatgcccactggaatggaaaaagaggaagagtcagagcaccacctccagagggcgatctccgcacagcaggtgtacggtgaaaagagggacaatatggtcatccccgttccagaggccgaatctaacatcgcttactatgagtcgatatatcccggcgaatttaagatgcctaagcaattaatacatatccagccttttagcctcgatgctgagcagcctgattatgacctggattcggaagatgaagttttcgtcaataagctcaaaaaaaagatggatatttgccctcttcagttcgaagagatgatcgatcgcctcgaaaaggggtcggggcagcaacccgtctcccttcaagaagccaagctgctgctgaaggaggacgatgagctgattcgcgaagtttacgagtattggattaaaaagcgtaagaactgtcgcgggccttccctgattcctagcgtcaaacaggaaaaaagagacggatcctccacaaacgacccgtacgttgcatttagaagaaggaccgagaagatgcagactcggaaaaacaggaaaaacgacgaagcatcatacgaaaagatgcttaagctaaggcgagatctgtctagagccgttaccatcctggagatgattaaacggagagaaaagtcgaagcgcgagctactgcacctgactctggagattatggagaaacgatataatctaggtgactataacggtgaaattatgtccgaggtgatggcacaaaggcagcccatgaagcctacatacgcaatcccgattattcccataaccaacagctcgcagttcaaacaccaggaggctatggatgttaaagagtttaaggtaaacaagcaggacaaggctgacctgattcgccccaaaagaaagtacgaaaaaaagccaaaagtgctcccttcctcagccgcggccacgcctcaacagacatctcccgccgcactgccagtatttaatgccaaggacctgaaccagtacgacttcccaagctccgacgaggagcccctaagccaggtcttgtcaggctctagtgaggccgaagaggacaacgaccctgatggacccttcgctttccgccgtaaggccggctgtcaatactatgccccacatctcgaccagacaggaaactggccgtggacatcacccaaagacgggggcctgggtgatgtcaggtataggtactgcctgaccactttgaccgtgccacaacggtgcatcgggtttgcgcgcagaagagtcggtagaggcggtcgagtcttgctggacagagcacactccgattacgattccgtgttccaccacctcgatctcgaaatgcttagtagccctcagcattctccagtcaatcaattcgcaaacacatcagaaacaaataccagcgataaatcgttctctaaggacctatctcagatcttagtcaacatcaagagctgtcggtggcgccactttagacctagaaccccctccttgcatgacagtgataatgatgaattatcatgtcgaaaactctatagatccataaaccgaacgggaactgcccagcccggaacccaaacatgttcaacctcaacgcaatccaagagctcgtctggaagcgcccacttcgccttcactgccgaacaataccagcagcatcaacagcagctggctctgatgcagaaacagcagttagcgcagatccaacaacagcaggccaacagtaactcttctactaatacctcccaaaatctcgcgagtaatcagcagaaaagtggttttcgcctgaatattcagggactggaaagaaccctccagggatttgtgtcaaagaccctagactctgcaagcgctcagttcgccgcaagtgcactggtcacatcagaacagctcatggggtttaaaatgaaagacgacgtggtcttggggatcggcgtaaatggcgtactgcccgccagtggggtgtacaaagggctgcaccttagctccacaacacctaccgccctagtgcatacatctccatcaactgcagggtccgctcttttacagccctccaatatcacacagacgtcatcaagccacagcgcattgtcacatcaggtaaccgccgccaactcggccaccactcaagttctgattggtaacaatataaggctgaccgtgcctagctccgtggctacagtcaattcaattgcccctatcaacgcccgccatattccacgaactctctcagctgtcccatcaagcgctctgaaactcgcagcagccgcgaattgccaagtgtctaaggtgcccagctctagtagtgtggattcggtgcccagagaaaatcatgagagcgaaaaaccagccttgaataacattgccgacaacacggttgccatggaagtgacttag

SEQ ID NO: 186603 - DNA, 2442 bp, Artificial Sequence
  Description of Artificial Sequence: Synthetic coding sequence
atgagcaagctgagcttccgggcccgggccctggacgccagcaagccacttcccgtcttccggtgcgaagatcttccagatctccacgaatacgcctccattaaccgcgctgtccctcaaatgcctacaggcatggaaaaggaggaggaaagtgagcaccacctccagagggcgatatcagctcaacaggtgtatggtgaaaagcgggacaacatggttattccggtgcccgaggcggagtctaacattgcttactacgaatcaatttatcctggcgaatttaaaatgcccaagcaactcatccacattcagcccttcagcctcgacgccgaacaaccagactacgacctcgacagtgaggacgaggtgttcgtgaacaaactaaagaagaaaatggatatttgtcctttgcagtttgaagaaatgattgatcgactcgagaagggaagtgggcagcaacccgtctccctgcaagaggccaaactcctactgaaggaagacgacgagctgattcgtgaagtttatgagtattggatcaagaagcgaaaaaactgcagagggccttccttaattccttccgtcaaacaggagaagcgcgacgggagctctactaatgacccgtatgtagccttcaggcgtcgaacagaaaagatgcaaaccaggaaaaatcgtaaaaacgatgaggcttcatatgagaaaatgctaaaactaagacgcgatttgtcccgggccgtcactatcctggagatgattaagcgacgggaaaagagcaaaagagagttgcttcatctgacgttggagatcatggaaaaaaggtacaatctgggagactacaatggggaaataatgtccgaggtcatggcacagaggcaaccaatgaaacccacctacgcaatccccataataccgatcaccaattccagccagtttaaacaccaggaggccatggatgttaaagagttcaaagtgaacaaacaggataaagccgatctaatcaggccaaaacgcaagtacgagaagaaacccaaagtgctgccgtcctccgctgcagccacgccacagcagacgagtccagctgcactcccggtgtttaatgccaaagacctgaaccagtatgacttcccatctagtgacgaagaaccactatctcaggtgctttcaggaagttctgaggcggaggaagataatgatcccgacggcccgttcgccttcaggcggaaggcagggtgccagtactacgctccgcatctggaccaaactggcaattggccttggacatcccctaaggatggcggtctgggtgatgttcggtacagatattgtctgactactctgacggtacctcagcggtgcattggctttgcacgcagacgcgtgggacgcgggggtagagttctccttgatagagcccatagcgattatgactcagtgtttcaccacttagatctggagatgctgagttccccccagcactccccagtgaaccaattcgcaaatacttccgagaccaataccagcgacaaatctttctccaaggacctcagccagatcttagtgaatatcaagtcttgccgttggagacacttccgcccccggacaccttcccttcacgattccgataacgatgaactctcctgcagaaagttgtatcgatctattaacaggacaggcactgcccaacccggtacacagacttgttctaccagcacacagtcaaagtcttccagcgggtcagcccacttcgcctttacagcggagcagtatcagcagcatcaacagcaattggccctgatgcagaaacagcaactcgcccaaattcagcagcagcaggccaattccaattcatcaacgaatacaagtcagggttttgtgagcaaaaccctggactccgcttcagcccagtttgccgccagtgccttagtcacttccgaacagttgatgggattcaagatgaaagacgacgtggtccttggtattggcgtgaatggcgtcctacccgcctccggggtgtacaagggcctgcatttatctagcacaacgccaacagctctggtccacacctcccctagtaccgccggcagcgccctgctgcagccttctaacatcacccagaccagttcaagccatagcgccttaagccatcaggttacggcagctaactcagcgaccacgcaggtcctgatcggaaataatatccgcctaactgtgcccagttctgtagccaccgtcaactccattgccccaattaacgcgcggcatatacctagaacattaagtgccgtaccgagttcggcgctgaagctggcagccgctgccaactgtcaggtttccaaggttccttcttcctcctccgtggactcggtcccccgtgagaaccatgagtctgaaaaacccgctctgaacaatatcgctgataacactgtcgctatggaagtgacatag

SEQ ID NO: 186604 - DNA, 2292 bp, Artificial Sequence
  Description of Artificial Sequence: Synthetic coding sequence
atggagcaccacctgcagcgggccatcagcgcccagcaggtgtacggcgaaaagcgggacaacatggtgatccctgttcctgaagccgaatcaaacatcgcctattatgaatcaatctaccctggagaattcaagatgcccaagcagctgatacatatccagccattcagtctagacgcggaacaaccagactacgacctcgatagtgaagatgaagtgttcgtgaataagctgaaaaaaaagatggatatttgtcctctacagtttgaggagatgatcgataggctggaaaaagggtcaggccagcagcctgtttccctgcaggaggccaaactcctcctgaaagaggatgatgaattgatcagggaggtgtacgagtattggatcaaaaaacgtaagaattgcagaggccccagtttgattccatccgttaagcaggaaaagcgggacggctccagcaccaacgatccatatgtggcgtttcggcgaagaacagagaagatgcagacaaggaagaaccgcaagaatgacgaagcatcctacgaaaaaatgctaaaactcagacgggatctgtcacgcgcagtcactattcttgagatgattaaacgccgcgaaaagtcaaagagggagctcttgcacctgacccttgagattatggagaaacgatataacctgggcgattataatggagaaataatgagcgaagtgatggcccagcggcagcccatgaaacctacttatgcaatcccaatcattcccattacaaattcttcccagtttaaacaccaggaagctatggacgtgaaggaatttaaggttaataagcaagataaagctgatttgatccggcccaagcggaagtacgagaagaaaccgaaggttctgccctcgtccgccgctgccacaccgcaacagactagtccagccgctctccctgtgtttaatgctaaagatctgaaccaatatgatttccccagctccgacgaagaacctctgtcacaggtgctgtcaggctcaagcgaggcagaagaagacaatgaccccgatgggcccttcgcttttcgcaggaaagcggggtgtcagtactatgccccacacctggaccagactgggaattggccctggacgagccctaaggacggcggcctcggcgacgtcagataccggtattgcctgactacgttgacggtgcctcaacgttgtatcgggtttgccagacgccgggtcggcagggggggtcgggtgctcctggacagggctcattccgactacgacagcgtgttccatcacctggatctggagatgctcagtagtcctcagcactcgcccgtcaatcagtttgcaaacacctctgaaactaatacatcagataagagcttcagtaaggatctttcccagatcctggtaaatatcaagtcttgccgctggcggcactttcgaccccgtacacccagcctgcacgacagcgacaatgatgagctaagttgtcggaaactgtatagatcaataaatcgaacaggcaccgctcagcccggcacacagacctgctctacgagcacccagtctaaatctagttcaggctctgcacatttcgctttcacagctgaacagtatcaacagcatcaacagcagttagctttaatgcagaagcaacagttagcccaaatccagcagcagcaagcaaactccaattcctctactaatacttctcagggattcgttagtaaaaccctggactccgcgagcgcccagttcgccgcttctgccctggtcacctcagagcagctcatgggcttcaaaatgaaggatgacgtcgtgctgggcattggcgtgaacggagtgttaccagcctccggggtctataagggcttacacctcagcagcacgactcccactgcgctggtacatacaagtcccagcacagcaggctcggcactgctgcagccttctaacataacacaaactagctcaagtcactcggccctgtcccatcaggtcacagctgcaaattcggctaccacccaggtgctgatcggcaataacatccggctgaccgtgccaagctctgtggcaaccgtcaacagtatagctccaatcaatgcccggcatattccccgcaccttatccgccgtgccttcctctgccctcaagctcgccgcagctgccaattgccaggtctctaaagtgccttcctcctcttcagtggactctgtgcccagagagaaccatgagtctgaaaagcccgcactcaacaacatcgcggataatactgtagcaatggaggtcacttag

SEQ ID NO: 186605 - DNA, 2424 bp, Artificial Sequence
  Description of Artificial Sequence: Synthetic coding sequence
atgagcaagctgagcttccgggcccgggccctggacgccgccaagccgctgcccatatatagaggcaaggacatgcccgatctcaatgattgcgtttccattaatagagctgtccctcaaatgccaaccggcatggaaaaagaggaagaatctgaacaccatcttcagagggctatcagcgcacaacaggtattccgtgagaaaaaagaaagcatggtgatccccgtccccgaggccgaaagcaacgtcaactactataatcggctatataaaggtgagtttaaacagccgaagcagttcattcatatccagccattcaatttggataatgagcagcccgattacgacatggatagcgaagacgaaacactgctgaaccgattgaaccgcaaaatggagatcaaaccactacagtttgaaattatgatcgaccgattggagaaggcctcttccaaccaactggtcaccttgcaggaggcaaagttgcttctgaatgaagacgactatctaattaaagccgtgtacgactattgggtgcggaagaggaaaaactgtcgggggccttctttgatcccacaaattaagcaggagaagcgtgacgggtccactaataacgatccgtacgtcgcctttcgccgtcgtacggaaaagatgcagaccaggaaaaatagaaagaacgacgaggctagctacgaaaagatgctgaagctccgtcgagaattctctcgtgcgataactatcctcgaaatgatcaagcgccgcgagaaaactaaaagggaactgttgcacctgactttggaggttgtagagaagcgctaccacctcggcgattatggcggcgagatcctgaacgaagtcaagatttctagatcggaaaaggaactatatgccacaccggctacactccacaacggaaaccaccataaggttcaagagtgcaaaaccaaacacccccaccatctttcattgaaagaagaagctagcgatgtcgtcaggcagaaaaagaaataccctaagaagcccaaggccgaggcactaatcacctcccagcagcccaccccagaaaccctgcctgtgattaataagtcagacataaagcagtacgattttcatagctctgacgaagacgagtttcctcaagtgttaagtccagtcagcgagccggaagaggagaatgaccctgatgggccctgtgcgtttcggcgcagggcaggctgtcagtactatgcccctcggcttgaccaggctaaccactcctgcgagaatagcgaattagccgatctggacaagctgcgctatcgacactgcctgactaccctcacggttcctaggcgatgtatcggttttgcccgacgaaggattgggcgtggggggagagtgatcatggaccgtatctccaccgagcacgatccagtgctaaaacaaattgacccagaaatgcttaattccttttcatcttcaagtcagacaatagacttctcctcaaactttagtcggaccaatgcctccagcaagcactgtgaaaacagactgtctctgtctgaaatactgagcaatatccggagttgccgactgcaatgttttcagcctagattgctgaatctccaggactcagacagcgaggagtgcacgagccgaaagccgggtcagacagttaacaataagagagtgagtgccgcttctgtggccttactgaatacttcaaaaaatggcatctccgtcactggaggcataaccgaagagcagtttcagacacaccagcagcagcttgtccagatgcaacggcagcagctggcccagttgcaacagaaacaacaatctcaacactcctctcagcaaactcaccccaaggcccagggtagcagtacatcagactgcatgtcgaaaaccctggactccgcctccgcccactttgcggcctccgctgtggtgtctgctcccgtaccctcccgttccgaggtcgccaaagaacagaatacaggccataataacattaatggcgtggtgcagcctagcgggacctccaaaacattgtacagcacaaatatggccctttccagctcacctgggatttctgcagtacaactcgtaaggacagtggggcatactactaccaaccacctgatccccgctttatgcacctcatcacctcagacacttcctatgaacaatagttgtctaaccaatgccgtgcacttaaataatgtatctgttgtgtctcccgtgaatgtgcacattaatacacgcacctctgcgccctctcctactgcccttaaactcgccaccgtagctgcttcaatggaccgcgtcccgaaagttacaccaagctccgccatttcttcaattgcccgggaaaaccacgagcccgaacggctgggattgaacggcatcgcagagacgaccgtggccatggaagtgacatag

SEQ ID NO: 186606 - DNA, 315 bp, Artificial Sequence
  Description of Artificial Sequence: Synthetic coding sequence
atgagccacaccatcctgctggtgcagcccaccaagcggcccgagggccggacttatgctgactatgaatctgttaacgagtgcatggaaggcgtctgtaagatgtacgaagagcacctgaaaagaatgaatcccaatagtccttccattacctacgacatcagccagctgttcgattttatcgatgatttggctgacctgtcgtgcctggtgtatcgggctgacacacagacgtatcagccttacaacaaggattggatcaaagagaagatctatgtgctcctgagaaggcaggctcagcaggccggaaaatag

SEQ ID NO: 186607 - DNA, 2253 bp, Artificial Sequence
  Description of Artificial Sequence: Synthetic coding sequence
tacagcaagatggagatccccaacccccccaccagcaagtgcatcacctattggaaaaggaaggtgaaaagcgaatacatgcggttgcgtcagctgaagagactgcaagctaatatgggcgcaaaagccctgtatgtagctaattttgcaaaggtgcaagagaagacccagattttgaatgaggagtggaagaagctgcgggtgcagcccgtgcaatcaatgaagcctgtctctggccatccctttctgaagaaatgcaccatcgaaagtatttttcctgggtttgcctcacaacatatgctgatgaggtccttgaacacggtggcactggttccaatcatgtactcatggagtcccctccagcagaacttcatggtggaggacgagacagttctctgtaatattccttatatgggagacgaagtcaaggaagaagacgagactttcatcgaagagttgattaacaactatgatgggaaggtccacggcgaagaggagatgatcccaggatccgtgctgatttcagacgctgtctttctggagttagtggacgccctcaatcagtatagcgatgaagaagaagagggacacaatgataccagcgacggcaagcaggacgattctaaggaagacctgcccgtgacgcggaaacggaagcggcacgctattgagggtaacaagaagagctccaaaaaacagtttccaaacgatatgattttttctgcgattgcctctatgttcccagagaacggtgtacccgacgatatgaaggaacgttacagagagctgaccgaaatgtcagatcccaatgccttgcctcctcagtgtaccccgaacatagacggacccaacgccaagagtgttcagcgagaacaaagtttacactccttccataccctgttctgtaggcgctgctttaagtacgactgctttctacacccattccatgcaaccccaaatgtgtataaaaggaagaacaaagaaataaaaatcgaacctgagccttgtggcacggattgctttctgctgttggagggcgctaaggagtatgcaatgctgcacaatcctcggtctaagtgctccgggcggagacgtagacggcaccatattgtctcagcttcctgttcaaacgcgtcagcatctgccgtggctgagacgaaagagggcgactctgacagagacacaggtaacgactgggcctcctcctcaagtgaggcaaacagcaggtgtcagactccgaccaagcagaaggcatctccagctcccccccagctttgtgtcgtggaagccccgtctgaaccggtggaatggacaggcgctgaagagtctttatttcgagtgtttcatggtacctatttcaataacttctgtagcatcgcccgccttctgggtaccaagacctgtaagcaggtgtttcagtttgcagtgaaagaaagtctgatccttaagctgccgactgatgagctgatgaaccccagtcagaagaagaaacgtaaacacagattgtgggcagctcattgcaggaaaatccagctgaagaaagacaattcttcgacacaagtctataactaccagccatgtgaccatcctgaccgaccctgtgacagcacatgtccctgcatcatgactcagaacttctgtgaaaagttttgtcagtgcaatccagactgccagaacagatttccaggttgccggtgcaagacccagtgcaacacgaaacagtgtccatgttatctcgcggttcgcgaatgcgatccggacctgtgtcttacgtgcggcgcaagtgagcactgggactgcaaagtcgtgtcatgtaagaactgtagcattcagcgaggtctgaagaagcatctactgctggctcctagtgacgttgctggatgggggacattcattaaggagagtgttcagaagaatgagttcataagcgagtattgcggtgagctcatttctcaggatgaggccgatcggcggggcaaggtgtacgacaaatatatgtcctcctttctttttaatttaaataacgattttgtggtggacgctacacggaagggaaacaagatcaggtttgccaatcatagtgttaaccctaactgttacgctaaagtcgtgatggtgaacggtgaccaccgcatcggcattttcgcaaagcgggccatccaggccggggaggagttgtttttcgattatagatattcacaggccgacgccctgaagtacgtggggattgagagagagaccgatgtgctatag

SEQ ID NO: 186608 - DNA, 2124 bp, Artificial Sequence
  Description of Artificial Sequence: Synthetic coding sequence
atggagatccccaacccccccaccagcaagtgcatcacctactggaaaaggaaggtgaagtcagagtacatgcgcctccgacaacttaaacggcttcaagcaaacatgggagcgaaagctctctatgtggcaaactttgccaaagtgcaggagaaaacccagattctcaacgaggagtggaagaaacttagagtccagcctgtgcagagcatgaagccagtatccggccaccccttcctcaagaaagtggaggacgagaccgtactttgcaacatcccatacatgggagacgaggtaaaagaggaagatgagacgttcatagaagagttgatcaataactatgatggtaaggtgcacggggaagaagaaatgattcccggctccgttctgattagcgacgcagttttcctggaattggtggacgcccttaatcaatatagcgacgaagaggaagaaggccataatgatacctcggacgggaaacaggacgacagcaaagaggacctgcccgtaactcggaagaggaagcggcacgctatagagggcaacaagaagtcttcaaagaagcagttccccaatgacatgatcttttcagccattgcttctatgtttccagagaatggcgtgccagatgacatgaaggaacggtatcgtgaacttaccgagatgtctgaccctaacgccctgccaccccagtgtaccccaaatattgacggacctaatgctaagtctgtccagagagagcagagcttgcatagctttcacaccctcttctgcagaagatgtttcaaatacgattgctttctccatccctttcacgcaactcccaatgtttataagagaaagaataaggaaattaaaatagaaccagagccctgcggaactgattgcttcctcctgcttgaaggcgccaaggaatacgcaatgctgcacaacccaaggtcaaagtgctctggacgtagaaggcgtcgtcaccacatagtcagcgcctcctgctctaatgctagcgcttccgctgtcgccgagacaaaagaaggtgacagtgaccgcgacacagggaacgactgggcttcatctagctcagaggccaattcaagatgtcagacacccactaaacagaaagcatcaccggcgccaccacaattgtgcgtagtggaggcaccttccgagcccgtggagtggacaggagcagaggaatccctgttccgggtatttcacggcacctactttaacaacttctgctccatcgcaaggttacttgggaccaagacgtgtaagcaggtctttcagttcgccgtaaaggagagcttaatcttaaagctgcccaccgacgaacttatgaacccttctcagaagaagaagcgtaagcacaggctgtgggcagcgcactgtcgtaaaatccagctgaagaaagataattcaagcacacaggtctataactatcagccatgcgaccatcccgacagaccatgcgactccacatgtccatgcatcatgacccagaacttttgcgaaaaattctgccaatgcaatcctgactgtcaaaatcggttccccggctgcagatgtaaaacacagtgcaataccaagcaatgcccatgttacctggcagtgagggagtgtgacccagacctctgtctgacctgcggagcctctgagcactgggattgtaaagtcgtctcctgcaagaattgtagcattcagcggggactcaagaagcatcttctgctagcaccgagcgacgttgccggatgggggacattcatcaaggaaagcgtgcagaagaacgagttcatctcggaatactgcggagagctaataagtcaggatgaagccgatcggaggggaaaagtatacgacaagtatatgagcagtttcttgttcaacctaaacaatgattttgtagtggacgcgaccagaaaaggaaacaaaatccggttcgcgaatcactccgtgaaccccaattgctatgctaaagtggttatggtcaacggggatcatcgaattggcatctttgccaagcgcgcaatacaggcaggagaagagttgttcttcgattacaggtactcacaggcggatgcgctgaagtacgtcgggatcgagcgcgaaacggatgtcctgtag

SEQ ID NO: 186609 - DNA, 2244 bp, Artificial Sequence
  Description of Artificial Sequence: Synthetic coding sequence
atggagatccccaacccccccaccagcaagtgcatcacctactggaagagaaaagttaagtctgagtatatgcgcctgcgtcagctcaaacggcttcaggctaacatgggtgcaaaggcactctatgtcgctaattttgcaaaagtacaagagaaaacacagatcctgaatgaagaatggaagaaactgagagtgcagcccgtgcagagtatgaagcccgtgtcgggacatccattcttaaagaaatgcacgatcgagtctattttcccaggttttgcttctcaacatatgctcatgagaagcctgaatacggtggcactggtcccgatcatgtactcttggtctcctcttcagcagaacttcatggtggaagacgaaacagtgctgtgcaacatcccctacatgggcgatgaggtgaaagaggaggacgagaccttcatcgaagaacttattaataattatgacgggaaagtacacggggaagaggagatgattccaggctctgttctaatctctgacgccgtgttcctggaactcgtggacgccctaaaccagtactctgacgaggaagaggaaggccataatgacacatcagatgggaaacaagacgatagtaaagaggatttgccggtgactagaaagaggaagcggcacgctattgagggcaataagaaatccagcaaaaaacagttcccaaatgatatgatcttcagtgcaatcgccagcatgttcccagagaacggcgtcccagatgatatgaaagagagatatcgggagttgactgaaatgtctgaccccaatgcactgcccccccagtgtacccctaatattgacggccctaacgcaaagtccgtgcagcgcgagcagagcctgcattccttccatacattattctgtcggcgctgttttaagtatgactgctttctgcatccattccacgctactcccaatgtatataaacgcaaaaataaagaaatcaagattgagcctgaaccctgcggtacagactgtttcctgctcctagagggagccaaggagtacgcaatgctacacaatccaagatctaagtgctcaggccgaagaaggaggcgccaccatatcgtctcagcctcatgctccaacgcaagcgcctctgccgtggccgagaccaaggaaggggattccgacagggacactgggaacgactgggcatcatcctcttccgaagccaattctcgatgtcagaccccaaccaagcagaaagcctctcctgcccctccacagctctgtgtcgttgaagccccaagcgaaccagtggagtggacgggcgcggaggagtctctttttcgagtctttcacggcacctattttaacaacttctgtagcattgccagattgctgggaactaagacctgcaagcaggttttccagtttgcagtgaaggagagcctgatcctcaagctgccgacggacgagctaatgaacccatcccagaaaaagaaaagaaaacaccggctgtgggctgcacactgtcgaaagattcagctaaaaaaggataatagttccacgcaggtgtacaattatcagccgtgtgaccacccagaccgcccctgcgattcaacatgtccttgcatcatgactcaaaacttttgcgaaaaattttgtcagtgtaatcccgattgccagaatagatttcctgggtgtcgatgcaagacgcagtgtaacacgaaacaatgcccctgttatctcgccgtgagagagtgcgacccagacctgtgtctgacatgcggagcatctgagcattgggactgcaaggttgtgtcttgcaagaactgcagtatacaacgaggacttaaaaagcaccttctgctggcgccctctgatgtcgctggatgggggacgttcatcaaagagagcgtacagaagaacgagtttatctctgagtactgcggggagcttatcagccaggacgaggcggaccgccgtggcaaggtgtatgacaagtatatgtcttcatttctcttcaatctgaataatgactttgtggtagatgctacgaggaaaggcaataaaattaggtttgctaaccacagtgtgaaccccaattgttacgccaaagtcgtgatggtgaacggtgaccataggatcgggatttttgcaaaaagggccattcaggccggagaggaattgtttttcgactacagatatagccaggccgatgcccttaagtatgtgggaatcgaacgggagaccgatgtgctctag

SEQ ID NO: 186610 - DNA, 1827 bp, Artificial Sequence
  Description of Artificial Sequence: Synthetic coding sequence
atggaggaggccagctgccccacctgcagcgtgaacgaggcctgcgagtggactccctttagtcagaaggaaatgattccagggagtgtcctgatctccgatgccgttttcctggaactggttgatgccttgaaccagtatagcgacgaagaagaagagggccacaacgataccagcgacggcaagcaagacgatagcaaagaggatctgcccgtaactcgtaagaggaagcggcacgccatcgaaggtaataagaagtccagcaagaaacagtttcccaacgatatgatcttttccgccatcgcttcaatgtttcccgagaatggcgtacctgacgatatgaaagagcgctaccgggagttaaccgagatgagcgaccctaacgctttgcccccccagtgcacaccaaacatcgatggccctaacgcaaaatccgtgcagagggagcagtcactgcacagtttccacacgctgttctgtagaagatgctttaagtacgactgttttctgcatccatttcacgccacacccaacgtgtataaacggaagaataaggagattaaaattgagcccgaaccctgtgggacagattgtttcttgttactggaaggcgctaaagaatatgcaatgttacataaccccagatcgaaatgctcgggcaggagacgcaggcggcaccacattgtctcagccagctgttctaatgcctccgcttccgccgtggccgagacgaaggagggtgatagcgatcgggacacgggaaatgattgggcttctagctcgagcgaagccaattccaggtgccagacaccaactaagcagaaggcctccccagccccaccgcagctgtgtgttgtcgaagctcctagtgagcccgttgagtggaccggggcggaagagtccctgttccgcgttttccacgggacatattttaacaatttctgttctatcgccaggcttctcggtacgaaaacatgcaaacaggtgttccagttcgccgtaaaggaaagcctcatcctcaaactaccaactgacgagctcatgaaccccagccagaagaaaaaacgcaagcatagattgtgggctgcccactgtcgcaagatccagcttaagaaagacaatagtagtacacaagtgtacaactaccaaccatgtgaccaccccgatcggccctgcgactctacctgtccttgcatcatgacccaaaacttctgtgaaaaattttgtcaatgcaaccccgactgtcaaaacaggtttccggggtgccgctgtaagactcaatgcaacacaaagcaatgtccttgttatttggccgtgagggaatgcgaccctgatctctgtctgacttgtggcgcttccgagcattgggattgtaaggtagtttcatgtaaaaattgctccatacagcgggggctaaaaaaacatttactgttggcaccaagtgatgtcgcaggctggggtacctttattaaggaatcagtccagaaaaatgagtttattagcgaatactgtggcgagctgatttcacaggatgaagctgacagaaggggcaaggtctatgataagtacatgagcagctttctgtttaatctaaacaatgacttcgttgtggacgcgaccagaaaggggaacaagatcaggtttgctaaccatagtgtgaatccaaactgttatgctaaggtggtgatggtgaatggtgatcaccgaataggcattttcgccaagagagcaatccaggcgggggaagaactgtttttcgattatagatacagccaagctgacgctcttaaatatgtcgggattgagagagaaactgatgtgttatag

SEQ ID NO: 186611 - DNA, 2256 bp, Artificial Sequence
  Description of Artificial Sequence: Synthetic coding sequence
atgggccagaccggcaagaagagcgagaagggccccgtgtgctggcggaagagggtcaaatcagagtacatgcggctgcgccaactgaaacgcttccggcgagcagacgaggtaaaaagtatgttctcttccaatcgacagaaaatcttggagcgcacggagatccttaatcaagaatggaagcagcggcggatacaaccggttcacatactcacctccgtgtcctcactgagaggcacccgcgagtgtagcgtcacctccgatcttgactttccaacccaggtcatacccctcaaaactttgaatgcagtggcctctgtccccatcatgtattcatggtctcctctgcagcagaattttatggtcgaggatgaaaccgttcttcataatataccatacatgggcgatgaagtgctggatcaggatggcaccttcatcgaagaactaatcaaaaattatgatgggaaagtccacggcgatagagagtgtgggttcattaacgacgaaatattcgtggagctcgtaaatgccttgggtcaatataatgatgatgacgacgatgatgacggggacgatcccgaggaaagagaggaaaagcagaaagacttagaagaccacagggatgataaggagtcacggcctccccgaaagtttccttctgataagatcttcgaggcaattagctctatgtttccagacaagggaaccgctgaggaattaaaagagaaatacaaggagctaacggagcagcagctgccaggtgccctgccgccggaatgcacaccaaatatcgacggccccaacgccaagagtgtacagcgggaacagagtctgcattcattccacaccttgttttgtcgaagatgttttaagtatgactgcttcttgcatcggaagtgcaactactcttttcacgcaacccctaacacttacaaaaggaaaaataccgagaccgcactggacaataagccgtgcggccctcagtgttaccagcacttagaaggcgccaaagagttcgccgcagccctgaccgccgaacgcataaaaacacctccgaagaggccaggcggacggaggcgagggagattaccaaacaatagctcccgaccatctacgccaactataaatgtgctggaatcgaaagacacagactctgaccgggaggctgggactgagactggtggggagaataacgataaggaggaggaagagaagaaagatgaaacttccagtagctctgaagccaatagccgctgccaaactcccataaaaatgaagcctaacatcgagccacctgagaacgtggagtggtccggcgcagaagcttccatgtttcgcgttctgatcggaacttattacgataacttttgcgccatagccagattgattgggaccaagacgtgccgccaagtctatgagtttcgagtgaaggaaagttctataatagcccctgcacctgcggaagacgtggacacccccccacgaaaaaagaaacggaagcaccgcctgtgggcagcccactgccgaaagatacagctgaagaaagacggaagctcaaaccacgtgtacaattatcagccgtgtgaccatcccagacagccatgcgattcctcttgtccgtgcgttatcgctcaaaatttctgtgagaaattttgccagtgtagtagcgagtgccagaaccggtttcctggatgcagatgcaaggcccagtgcaataccaaacaatgcccctgttacctagccgtgagggagtgtgacccagatctgtgccttacatgtggcgcagcggaccattgggatagcaagaacgtctcgtgtaagaattgctctatacagcgggggtctaaaaaacacctactccttgctccgtctgatgtggctggctggggcatattcatcaaggatccagtgcagaaaaacgaatttattagcgagtactgcggggaaataatctcgcaggacgaggcagacaggcgcggcaaggtatacgacaaatatatgtgcagtttcctgttcaatctcaataacgacttcgtagttgatgcgaccaggaagggaaacaaaatccggtttgcgaatcactcggttaacccaaactgttacgctaaggtcatgatggtgaatggtgaccaccgcatcggtatttttgcaaaacgagccattcagacaggtgaggagttgttcttcgactatagatatagtcaagccgatgcccttaagtacgtgggaatcgagagagagatggagatcccatag

SEQ ID NO: 186612 - DNA, 2124 bp, Artificial Sequence
  Description of Artificial Sequence: Synthetic coding sequence
atgggccagaccggcaagaagagcgagaagggccccgtgtgctggagaaagcgggtaaaaagtgagtatatgaggcttaggcagctgaagcggttcaggcgggctgatgaagtgaaaagtatgtttagcagtaacagacagaaaattctggaaaggaccgagatactcaatcaagagtggaaacagcgaagaatccagcctgtccacattctaaccagtgttagcagtctgcggggtacccgagaggtcgaagacgaaacggtgttgcataacattccctacatgggggatgaggtcctggatcaggacggaacattcatagaagaacttataaagaattacgatggcaaagttcatggggaccgagaatgtggctttattaacgacgagatttttgttgagttggtgaacgccttgggacagtataatgacgatgatgacgacgacgatggcgatgacccagaagaacgagaagagaagcagaaggacctggaggaccaccgtgacgacaaagaatctcggccgccccgtaaattcccctctgataaaatctttgaggcaatctccagcatgttccccgacaagggaaccgcggaggagttaaaagagaagtacaaagaactcacagagcaacaactgccaggcgcactgccacccgaatgtaccccaaacatagatggtccgaacgccaagtccgtgcagagggagcagagtcttcattcctttcatactttgttttgtaggagatgcttcaagtacgattgcttcctccacccctttcacgccacccccaacacatataagagaaagaacacagagacagcccttgacaataaaccatgcggaccccagtgctatcagcacttggagggcgccaaagagtttgccgccgccttgactgccgagaggatcaagacaccccctaaaagaccaggtggccgccgcagggggcggcttcctaacaatagttctaggccttctaccccaactattaatgtgctggagagcaaggacaccgacagcgatagggaggccggaactgaaactggcggcgagaataacgataaggaagaagaagaaaagaaggatgagacctcctcctcttctgaagcaaattcccggtgccaaactcccatcaagatgaagccaaatattgagcctcccgaaaacgtggagtggagcggtgccgaggcgtccatgtttcgagtcttgatcggcacctactacgataatttctgcgccatagctcggctgatcgggaccaaaacctgtagacaagtatacgagttcagggtaaaggagagcagtatcatagcgcctgcgccagcagaggacgttgatacaccaccgagaaaaaaaaaaagaaaacaccgcctttgggctgcccactgtagaaaaatacagttgaagaaagacggttccagtaaccacgtttataactatcagccatgtgaccatcctcggcaaccctgcgacagcagttgtccctgcgttatagcccagaacttctgtgaaaaattctgccagtgttcatcggaatgtcagaatcgcttccctggctgccgctgcaaagcacaatgcaatacaaaacagtgcccctgttatttggccgtccgggaatgtgatcctgacctatgtctcacctgcggtgccgccgatcactgggatagtaaaaacgtgtcatgcaagaactgttctatacaaaggggctccaaaaagcacttattattggctccttccgacgtggccggctggggcatcttcatcaaagatcctgtccagaaaaacgagtttatttcagagtactgcggcgaaattatttcgcaagacgaggcagaccggcgcggtaaggtgtacgataaatacatgtgcagtttcctcttcaatctgaacaatgattttgtggtcgatgcaacaagaaaaggcaacaagatccgcttcgcaaaccactctgtgaatcctaattgctatgcaaaggttatgatggtcaatggcgatcatcgaatcggaattttcgcgaagcgggcaatacagacgggcgaagagctgttctttgactatcggtacagtcaggctgacgcactgaagtatgtgggcattgagagggagatggaaatcccttag

SEQ ID NO: 186613 - DNA, 2241 bp, Artificial Sequence
  Description of Artificial Sequence: Synthetic coding sequence
atgggccagaccggcaagaagagcgagaagggccccgtgtgctggagaaaaagagtgaagagcgagtatatgcggttgcgccagctgaaaagatttcggagagctgatgaagtgaagtctatgttcagcagtaaccggcagaaaatcctggaacgcactgaaattcttaaccaggagtggaagcaaagaaggatccagcccgttcacatcctgacgtccgtatccagcttgcgcggcacacgcgagtgtagtgtgacaagcgacctggacttcccaacacaagtcattcccctcaaaaccttaaatgcggtggcaagcgtgcccatcatgtacagctggagcccattgcagcagaatttcatggttgaggacgaaactgttctccacaatatcccctacatgggcgacgaggtcctggatcaagacggaacctttatagaggagttgattaaaaattatgacgggaaagtgcacggagatagggagtgcggatttattaatgacgagatctttgttgagctggtcaatgccctaggacagtacaacgatgatgatgacgacgacgacggagacgacccggaagagagggaagaaaagcagaaagatctggaggatcacagggatgataaggaatcccgacctccacgcaaatttccctctgacaagatttttgaagccatctcgagcatgtttccggataagggcaccgctgaggagctcaaagagaagtacaaggagcttacggagcagcagctgcctggcgctttacctccagaatgcactcctaacattgatggaccaaatgccaaatctgtacagcgggagcaaagcctgcacagcttccacacactcttttgcaggaggtgcttcaaatatgactgtttcctacatcctttccatgcgacacctaacacgtataagcggaagaataccgaaactgccctagacaataagccctgcgggccccagtgctaccaacacctcgagggcgcaaaagagttcgcagcagcattaaccgcggagagaatcaaaacaccaccaaagaggcccggaggacgcaggcgagggcggcttcctaacaactcatcaagaccctccaccccaacgatcaacgtgctggagtctaaagacaccgactcagacagggaggcaggtacggaaactggaggagagaataatgataaggaggaagaagagaaaaaggacgagacctctagcagctccgaagcaaatagtaggtgccagacaccaatcaagatgaagcctaacattgagcctcccgagaacgtcgagtggagtggagccgaggcatccatgtttcgtgtgcttatagggacctactatgacaatttttgcgctatcgccaggctgatcggcaccaaaacatgtagacaggtttatgaattcagagtgaaggagtccagtatcattgcgccagctccggccgaagatgtggacacgcccccgcggaaaaaaaaaaggaaacacaggctgtgggccgcccactgtaggaagatccagcttaaaaaggatggatccagcaaccacgtgtacaactaccaaccctgcgatcacccccggcagccatgcgattcctcatgcccctgcgttattgcccagaatttctgcgaaaagttctgtcagtgtagttcagagtgccaaaatcgcttcccaggatgccgatgcaaagcacagtgcaacactaagcagtgcccatgctaccttgcagtccgggaatgcgacccagacttgtgcctaacctgtggcgctgcagaccactgggactctaaaaacgtcagctgcaaaaattgttccatccaacggggctccaagaagcacctattgctcgccccttcagacgtcgccggctgggggatcttcattaaagatccagttcagaagaatgaattcatttcagagtactgtggagaaatcattagccaggatgaggccgaccggcgaggcaaggtatatgataagtatatgtgttcgtttctgtttaacctgaacaacgattttgtggtcgatgcgactagaaagggtaataaaattagattcgccaatcactccgtgaaccctaattgttacgccaaggtgatgatggttaatggggatcacaggattggaatctttgccaaaagggcaatacaaactggcgaggaactgttttttgattatagatactctcaggccgacgcccttaaatacgtgggcatcgaacgagagatggagataccatag

SEQ ID NO: 186614 - DNA, 678 bp, Artificial Sequence
  Description of Artificial Sequence: Synthetic coding sequence
atgtacagctggagccccctgcagcagaacttcatggtggaggacgagaccgtgctccacaacatcccgtacatgggtgatgaggtgctggatcaggatggaacgttcattgaggagctcataaagaattacgacggaaaagtacatggcgaccgtgaatgtggattcatcaatgacgagatttttgtggaactcgtcaacgcactgggccaatacaatgatgacgacgatgacgatgacggggatgatcccgaggaaagggaagagaaacaaaaggatctggaggaccaccgggacgataaggagtcacgacccccccgcaagtttccgtctgacaagatttttgaagcgatctccagtatgtttccagataagggaactgcagaggagctcaaagaaaagtacaaggagttgacagagcagcagcttcccggggctcttcctcccgagtgcaccccaaacatcgacgggcccaatgccaagagcgtccaaagagaacagtcgttacattctttccacaccttgttctgtagacgctgcttcaagtatgactgtttcctgcaccctttccacgctacccccaatacctacaagcgcaagaacaccgaaaccgcactggacaataagccatgcggaccccagtgctaccagcatctgccgctgttacctcggaactag

SEQ ID NO: 186615 - DNA, 2088 bp, Artificial Sequence
  Description of Artificial Sequence: Synthetic coding sequence
atgggccagaccggcaagaagagcgagaagggccccgtgtgctggcgaaaaagggtgaagagtgaatacatgagacttaggcaactgaaaaggtttcgcagagcggatgaggttaagtcgatgttttcgtctaatagacagaaaatcttggagagaaccgagatcctcaaccaggaatggaaacagaggcgtatccagccagtacacatcctgacatcgtgtagcgtgacctcagacctcgattttcctacccaggtgatccccttaaagacccttaacgccgtggctagtgttcctattatgtactcctggagccctcttcagcaaaattttatggtggaggatgagaccgtgctgcacaatatcccgtacatgggcgacgaggtgctggaccaggacggaaccttcatagaagaactgatcaagaactacgacgggaaggtgcacggtgaccgcgaatgtggatttatcaacgacgaaatctttgtggagctcgtgaatgccctgggacaatacaatgatgatgatgacgacgatgacggcgacgatccagaggagcgggaggaaaaacagaaagatcttgaagatcatcgcgacgataaggagtctcgccctcccaggaagttccccagcgataaaattttcgaggcaattagctcaatgttccccgataagggcacagctgaggagcttaaagagaagtacaaggagctcacagaacagcagctgccaggcgcactgccccctgagtgtacacccaatattgatggaccgaatgccaagtctgtgcagcgggagcaatctttacatagctttcacaccctcttctgccggcgctgcttcaaatatgattgcttccttcacccatttcatgccacacccaacacatacaagcgtaagaacaccgaaactgccttagacaacaagccctgtggccctcagtgctatcagcacctggagggtgcaaaggagttcgcagcggcactgaccgctgagagaatcaagaccccacctaagcgcccaggcggaagacggcgcggtagactgccaaacaacagctccagaccaagcacaccgacaatcaacgttctggaaagtaaggacaccgatagtgatcgagaagccgggacggagaccggaggggagaacaatgataaagaggaagaggagaaaaaggatgaaaccagctctagtagtgaagctaacagccggtgccagacccccataaagatgaagccaaacatcgaacctcccgaaaacgtcgagtggagcggcgccgaagctagcatgtttagggtgctgattggcacctactacgataatttctgcgcaatagcacggctcattggcaccaaaacctgcagacaggtgtatgagttcagagtgaaagagtcgtccatcatcgcccctgcaccagctgaggatgttgacaccccgccgagaaagaagaaacgaaagcatcggctttgggccgcccattgccgaaagatccagctgaagaagggtcaaaacagatttcccggatgtcgctgtaaagcacagtgtaacactaaacagtgtccctgttatttggctgtgagagagtgcgatcccgatctttgtctgacttgcggagcagctgatcactgggattcaaagaacgtctcttgtaaaaactgcagcatccagcgcggttcaaaaaaacatctcttgttggctccaagtgatgtcgcgggctgggggattttcattaaagatccggtgcagaagaatgagttcatctcggaatattgtggagaaattatctctcaggatgaagccgacagacgcgggaaggtatacgataaatacatgtgctccttcctgtttaacctaaataacgacttcgtggtcgacgccacccgtaagggcaataaaatccgattcgctaaccactcagtcaaccctaattgttatgcaaaagtgatgatggttaacggagaccaccggatcggcatcttcgctaagcgcgctatacagacaggggaggaacttttttttgattacaggtacagtcaagccgatgcactgaagtacgtgggaatagagcgcgaaatggaaatcccgtag

SEQ ID NO: 186616 - DNA, 2088 bp, Artificial Sequence
  Description of Artificial Sequence: Synthetic coding sequence
atgggccagaccggcaagaagagcgagaagggccccgtgtgctggcgcaaaagagtgaaaagcgagtatatgagacttcggcagcttaagaggttcaggcgcgcggacgaggttaagtcaatgttctcttccaatcgtcaaaagattttggagagaaccgaaattctgaaccaagagtggaaacagcgcagaatccagccagttcatatcctgactagctgcagcgtcacatccgacttggacttcccgacccaggttattcccctgaaaaccctaaacgctgtggcttccgtaccaataatgtactcatggtcccctcttcagcaaaattttatggtggaagatgagactgtgctgcacaacatcccttacatgggggatgaagttttagaccaagatggaaccttcatcgaggagctgatcaaaaattatgatggaaaagtgcatggggaccgagaatgcgggtttattaacgatgaaatctttgtcgaactggtgaatgcattaggccagtacaacgatgacgatgacgacgacgacggggacgatcctgaagaaagggaagaaaagcaaaaggatctcgaagatcatcgtgacgataaagaatcacggccgcctcgtaagttcccctctgacaagatttttgaagcgatctcatcaatgttcccagacaaaggaacagccgaggaactgaaagaaaagtacaaggagctgactgagcagcaactgcccggtgccctgccgcccgaatgtacaccaaacattgatggcccaaacgcgaaatctgtccaacgcgagcaatccctgcactcatttcatacattgttctgtcgacggtgctttaagtatgattgcttcctgcatccatttcacgcgactcctaacacctacaagcgaaagaacaccgaaactgctctagacaataaaccctgcgggccccagtgctatcagcatttggaaggcgctaaagagtttgccgctgcactaacagcggagagaataaaaaccccgccaaagagaccaggaggtcgtcggcggggacggctgcctaacaactcgtcccggccatccacacctactatcaatgtcctcgagtccaaagatactgacagcgatcgggaggccgggactgagaccggtggcgaaaacaacgacaaagaggaggaggaaaagaaagacgaaacctcgtcatcttccgaagctaattcgcggtgccaaacccccataaagatgaaaccaaatatcgaaccccctgaaaatgtcgagtggtccggggcggaggccagtatgttccgcgtcctgatcggtacatattacgataatttttgcgccatcgcccgtctgatcggaaccaaaacatgtaggcaagtgtatgaattccgcgtgaaggagtcctcaattatcgccccagcaccagctgaggatgtagacactccccccaggaaaaaaaaaaggaaacatagactgtgggcggcccactgccgcaaaattcagctcaagaagggacagaacagatttcccggctgtcgctgcaaggcgcagtgcaatacaaaacagtgtccttgttatctggccgttcgggagtgcgaccccgatctttgcttgacatgtggtgccgcagatcactgggattcaaagaacgttagctgcaaaaactgctctatacaaagaggttcaaagaagcatcttttgcttgcccccagtgacgtggctgggtggggtatctttatcaaggatccagtacagaaaaacgagttcatttcggaatattgtggtgaaataatctcccaagacgaagctgacaggcgcggaaaggtctatgacaagtatatgtgctcttttctttttaatttgaataatgacttcgtggtggacgctacacgcaaaggcaacaagattaggttcgctaatcactctgtcaatcccaattgttacgccaaggtgatgatggtgaacggggatcacagaatcggcattttcgccaagcgtgcaatacagacaggagaagagctgtttttcgactaccggtacagccaggcagacgctcttaaatacgtcgggatcgagcgcgaaatggaaatcccctag

SEQ ID NO: 186617 - DNA, 2214 bp, Artificial Sequence
  Description of Artificial Sequence: Synthetic coding sequence
atgggccagaccggcaagaagagcgagaagggccccgtgtgctggcgcaaacgagtcaagtcggagtatatgcgccttcgtcagttaaaaagatttcggagggccgatgaggtcaaaagcatgttttccagcaatagacagaagattctcgagcgcacagaaatcctcaatcaagaatggaagcagcgacggatccagcccgtgcacattcttacctcctgttcagtaacatccgatctcgactttcccactcaggtcatcccacttaagacactaaacgcagtcgcctcggtgcccattatgtacagctggagtcccctgcaacaaaacttcatggtggaggacgagactgtccttcataatataccctacatgggcgatgaagtccttgatcaagatggaaccttcattgaggaattgatcaagaactatgacggcaaggtacatggagaccgggaatgtggcttcatcaatgatgagatctttgttgaactcgttaatgcactgggacagtataatgacgacgacgacgacgatgacggggacgacccggaggaacgggaggagaagcagaaggatttagaggatcatcgcgacgacaaggaatctcgcccaccacggaagtttccatctgacaaaatcttcgaagctatctcctccatgttcccagataagggaaccgctgaagaattgaaagagaaatacaaggagctgacagagcaacaactgcccggggccctgcctcccgagtgtacgccaaacatcgatgggccgaacgctaaatccgtgcagagagaacagagcctgcattccttccataccctgttctgcagacgatgctttaaatatgactgcttcctgcacccctttcatgctacccccaacacgtacaagaggaagaacacagaaacagcactggacaacaagccgtgtgggccccaatgctatcagcatctcgaaggtgcgaaggagtttgctgccgctttgacagccgagcggataaagacaccacctaaacggcctggtggacggcgtagaggacgactgcccaacaactcaagccgcccctctactccaactatcaacgtgctagagtctaaggacaccgattcagatagggaggccggaaccgagacagggggcgagaataacgataaagaagaggaagaaaagaaagatgaaacaagttcgagcagcgaggcaaactctagatgtcaaacccccattaagatgaaaccaaacatcgaacctcccgagaacgtggagtggtcaggcgccgaggcctctatgttccgggttctaattgggacttactacgacaacttctgcgcaattgccagattgattggcactaagacctgtcgtcaggtttatgagttcagagtgaaagagtcctccataatcgctcctgcgcctgcggaagatgtggatactccacctcgtaaaaaaaagagaaagcatcgcctttgggcagcccattgcaggaaaattcaactgaagaaagacggcagcagcaatcacgtctacaattatcaaccatgtgaccaccctagacagccatgcgactccagctgcccctgtgtcattgctcagaatttctgcgagaagttttgccagtgcagttctgaatgccagaatcgtttcccaggatgtaggtgcaaagctcagtgtaacactaagcagtgtccatgttacctggcagttagggagtgcgacccagatctctgtctcacatgcggggctgcggatcattgggactccaagaacgttagctgtaagaactgctccattcagcgggggtcaaaaaagcatcttttactggccccatctgacgtggctggatggggtatctttatcaaggatcccgtgcagaaaaatgaatttatctctgagtactgtggcgagataatttcacaagatgaagcagaccggaggggtaaagtttacgataagtacatgtgcagctttttatttaatctcaacaacgatttcgtggttgatgctacccgaaaaggaaacaagattcgtttcgcaaaccattctgtgaaccccaactgctatgctaaagtgatgatggtgaacggggaccatcgcataggaatatttgcaaaacgcgctattcagacaggtgaagaactgtttttcgattatagatacagtcaagcagacgctctcaaatatgtaggcattgaaagagagatggagatcccctag

SEQ ID NO: 186618 - DNA, 939 bp, Artificial Sequence
  Description of Artificial Sequence: Synthetic coding sequence
atggccgccctgtacgcctgcaccaagtgccaccagcggttcccctttgaagcgctctcccaagggcaacagctgtgtaaagagtgtaggatcgctcatccagtcgtcaagtgtacatattgtaggacagaataccaacaggagcggctggagtgcaatggaaccatttcggcccattgcaatctgcacctaccaggcagcagcgatagtcccgctagtagttccagggtagctggaattacagggatcaagacgaacactatttgtaaaaaatgcgcccagaacgtgcagttgtacggaacccccaagccctgccagtactgcaatattatagctgcattcatcggtaacaagtgccagcgctgtactaattcggagaagaaatacggccccccctactcttgcgagcagtgcaagcaacaatgcgcattcgacagaaaagatgatcgtaagaaagttgacgggaagctattgtgttggctttgtacactcagctacaagagggtcctgcagaagacaaaagaacagcgcaaacatctttccagcagcagccgtgccggacaccaggaaaaagaacaatattcacgcctgagcggcgggggtcattacaacagcttcagtccagacttggccttggacagccccggcacagatcatttcgtaattatagctcagttgaaggaagaagtcgccacactgaagaagatgctgcaccagaaagaccagatgattctagagaaggaaaaaaaaattacagagctgaaagctgacttccagtaccaagagtcccaaatgcgagccaagatgaatcaaatggaaaagacacataaggaggtaacagaacagctccaagcaaagaatagggagctactaaaacaagcggctgccttgtccaagagcaagaagtcagaaaaatctggtgcaatcacctctccatag

SEQ ID NO: 186619 - DNA, 861 bp, Artificial Sequence
  Description of Artificial Sequence: Synthetic coding sequence
atggccgaggacggcgaggaggccgagttccacttcgccgccctgtatatatccggacagtggcctcggctccgggctgataccgatctccagcggctcggctctagcgctatggcgcctagccggaagttctttgtgggaggtaactggaagatgaacggcagaaaacagtctctcggtgaactgattggtaccctgaacgcagccaaggttcctgccgacacagaagtcgtatgtgccccaccaacagcttacattgatttcgctagacaaaagctcgatccgaaaattgccgtggctgcgcaaaactgctataaagtgaccaacggggcgttcacaggggaaatctcccccgggatgatcaaggattgtggagctacctgggtggtccttggccactccgagcgtcggcatgtttttggtgagagcgatgaactcatcgggcagaaggtcgcacatgctttagcagaggggctgggggtaatcgcctgcatcggagagaaactcgatgagcgggaagccggtatcacagagaaggtggtattcgagcaaaccaaggtgatcgccgacaatgtgaaggactggtccaaagtggtcctcgcctacgaaccagtgtgggcgatcggaacggggaaaacagctacccctcaacaagcccaggaggtgcatgagaagctgcgcggttggctaaaatctaacgtttctgacgcagtagcgcagtccacaagaataatttatgggggcagcgtaaccggcgctacctgtaaggagcttgcctcccagcccgatgtggacgggttcctcgttggcggcgcctcactcaaacccgaatttgttgatattattaatgccaaacagtag

SEQ ID NO: 186620 - DNA, 1305 bp, Artificial Sequence
  Description of Artificial Sequence: Synthetic coding sequence
atgagcatcgagaagatctgggcccgggagatcctggacagccggggcaaccccactgtagaggttgacctgtacacggccaagggcctttttagggccgctgtgccttccggcgcctccaccggtatctacgaggctctggaactcagggacggtgataaacagagatatctgggaaaaggggtgctcaaagcggtggaccatatcaacagtaccatcgcccccgctttgattagttccgggctgagtgttgtcgaacaagagaagctggataatctgatgttagagctggatgggactgagaataaaagcaaatttggggcgaatgccattcttggggtttcattggccgtttgtaaagcaggggccgcagaaagggaactcccattatatcggcacattgcgcagctcgccggcaatagcgacctgatcctgccagtccccgcgttcaatgtgattaatggcggatcgcacgctggaaacaaactggcgatgcaggaattcatgattcttcccgtaggagccgaatccttcagggatgccatgcgtttaggagccgaggtctaccacacactgaagggcgttatcaaagataagtacggaaaggacgccacaaacgtgggtgacgaaggagggttcgctcccaatattctggaaaacagtgaggcactcgagttggtgaaagaagcaatagataaagccggctacaccgagaaaatcgtgattgggatggatgtcgcggcaagtgaattctaccgggatggtaaatatgatctcgactttaagtcacccacagacccctccaggtatatcaccggggatcagctgggagccttataccaagacttcgttcgcgactatcccgttgtatccatcgaggaccccttcgaccaggatgactgggccgcctggtctaaattcacagcaaacgtcggaatccagatcgtgggtgacgacctgacggtcactaatccgaagcgcatcgaacgcgctgtcgaagagaaagcctgcaattgtcttctcctgaaggtgaatcaaataggcagtgttactgaagccatccaagcttgcaaactcgcccaagaaaatggatggggagtgatggtgagtcaccgaagcggtgagaccgaggataccttcattgcagacttggtggtgggactgtgtacggggcaaatcaaaacgggggcaccgtgcagatccgaaagattagccaaatataatcagcttatgagaatagaggaggagttgggggatgaagctcgcttcgcaggtcataattttcgaaacccatctgtgctctag

SEQ ID NO: 186621 - DNA, 1176 bp, Artificial Sequence
  Description of Artificial Sequence: Synthetic coding sequence
atgagcatcgagaagatctgggcccgggagatcctggacagccggggaaatccaacggtggaagttgacctctatacagccaaaggtctgtttcgcgccgctgtccccagtggagcttccaccggtatctatgaagccctcgaattgagggatggtgataaacaaaggtacctaggcaaagccaagtttggggctaatgcaatactcggcgtatctctggccgtgtgtaaggctggcgccgccgaacgcgaacttcccctgtacaggcacattgcccaactagccggcaacagtgatctcattctgcctgttccagcgtttaacgtcataaatggtgggagccacgccgggaataaacttgccatgcaagagtttatgatcttaccagtcggtgccgagtccttccgcgacgctatgaggcttggagcggaggtctaccatactttaaaaggagtgattaaggataagtacggcaaagacgcaaccaacgtaggcgatgaaggcgggttcgcccctaacattttggagaatagtgaagccctggagctggtcaaggaggctatcgataaagccggatatacagagaagattgtaataggtatggacgtggcagcctccgagttttaccgggacggtaagtacgacctcgactttaaaagccctaccgatcctagccggtacataacaggggaccaactgggtgccctgtaccaggattttgttcgtgactaccctgtcgtgagcatcgaagacccatttgaccaggatgactgggctgcatggagcaagttcaccgccaatgtgggtattcaaatcgtgggtgatgacctgaccgtcactaaccctaagcggatcgaaagggctgtggaagaaaaagcctgtaactgtctgctgctgaaagttaatcagatcggtagcgttacagaggctattcaggcatgcaaactggcccaggagaatggatggggtgtgatggtgtcgcaccgctcaggagaaacggaagatacattcattgccgatctggtagtcggcctgtgcaccgggcaaattaaaaccggcgcaccttgtcgatcagaacgacttgctaaatacaatcaactgatgaggatcgaagaagagctaggggatgaggcacggtttgcaggtcacaacttccgaaatccctcagttctctag

SEQ ID NO: 186622 - DNA, 1305 bp, Artificial Sequence
  Description of Artificial Sequence: Synthetic coding sequence
atgagcatcgagaagatctgggcccgggagatcctggacagccgggggaacccgacagtggaggtggatctgtacaccgcgaaagggctattccgggccgccgttccttcgggcgcgtctactgggatctatgaagccttggaactaagagatggagacaagcaacggtacctcggcaaaggtgtgttgaaagccgtcgatcacataaactccaccattgcgcccgccctaatcagcagcggtctctcagtggtagaacaagagaagctcgataacctcatgctggagttggatggcaccgagaacaagtcaaagtttggggccaatgccatcctgggagtgtctctagccgtttgtaaggctggcgctgccgagcgtgagttgccgctgtacagacatattgcccagctagccgggaattcggaccttattcttcctgttccagcctttaacgtgataaacggaggatcgcacgccggtaacaaactagccatgcaggagtttatgatattacccgtgggagccgagtctttccgcgacgcaatgcgcctgggagccgaggtataccataccctcaaaggtgtgatcaaagataaatatggcaaagacgcgactaacgtgggcgacgaaggcggatttgcgcccaatatattggaaaacagtgaggcattggagctcgttaaggaagcgattgataaagccgggtacacagagaagatagtaattggaatggacgttgcggcctctgagttctatcgggatgggaaatatgatctggactttaagagccccacggatccttcacggtatatcaccggagaccagttgggcgcactgtatcaggactttgttagggattatccggtcgtgtccatcgaggaccctttcgatcaggacgactgggctgcctggagcaagttcacagccaacgtcggcattcagatcgttggtgacgaccttacagttaccaacccaaagaggatagaacgtgctgtcgaagaaaaggcttgtaattgccttctgcttaaggtgaatcagattggcagcgtcaccgaggccatccaggcgtgcaaattggcacaggagaacggttggggggtgatggtatcacacaggtctggagagactgaggatacctttatagccgatctagtggtcggactgtgtaccgggcagattaagacaggagccccgtgcaggagcgagaggctggctaaatacaaccaactgatgagaatcgaagaagagttgggcgatgaggcaaggtttgctgggcacaactttaggaacccttctgtcctttag

SEQ ID NO: 186623 - DNA, 1176 bp, Artificial Sequence
  Description of Artificial Sequence: Synthetic coding sequence
atgagcatcgagaagatctgggcccgggagatcctggacagccgggggaaccccacggtggaggtggacctgtacactgcgaaaggtcttttccgcgctgcagtgccatccggcgcttcgaccggcatttacgaggccctagagctgagagacggagacaagcaacgatatctaggaaaggctaaattcggtgccaatgcgatactcggcgtctccctggcagtgtgtaaggccggggccgccgaacgtgaactccctctgtatcgccacatcgcccagctcgccggcaactcagatttgatactccctgtcccagcattcaacgtgataaatggcggcagccatgccgggaacaagctggccatgcaagagttcatgatcttacccgtcggggctgagagctttcgtgacgcaatgcgtctgggcgctgaggtgtaccacacactgaaaggtgtgatcaaggataaatacggtaaagacgcaaccaatgtgggtgacgaggggggatttgcaccaaatatcctggaaaacagcgaggctctggagctggtgaaggaggccattgataaagccggttacactgaaaagatcgtcattggcatggatgtcgctgcctcagagttttacagggacggcaagtatgatctggatttcaagagccctactgaccccagccggtacattacgggggatcagcttggggcactctaccaggacttcgtacgagattatcctgttgtgtcgattgaggaccccttcgaccaggacgactgggctgcttggtcaaaatttacagcgaacgtagggattcagattgtaggtgatgacctgactgttacaaaccccaagcgtatcgagagagctgttgaggagaaggcgtgtaactgcctgctgcttaaggtgaaccagatcggttccgtgacagaagcaatccaggcctgtaaactcgcacaagagaacgggtggggcgttatggtatcccatagaagcggggaaacagaagatactttcatcgccgacctcgtggtcggactgtgcaccggccaaatcaagaccggcgctccctgcagatcggaacggctggccaaatacaatcaacttatgcgaatcgaggaagaactgggtgacgaggccagattcgccggacacaacttcagaaacccttcggtcctgtag

SEQ ID NO: 186624 - DNA, 1176 bp, Artificial Sequence
  Description of Artificial Sequence: Synthetic coding sequence
atggccatgcagaagatcttcgcccgggagatcctggacagccggggcaatccgacagtggaagtcgatctgcacacagcaaaagggcggttcagggcagctgttcctagcggggctagtaccgggatttacgaggccctggagctaagggatggggataagggcagatatcttggaaaggctaaatttggcgcgaatgcaatcctgggcgtgagtctggccgtgtgtaaagccggggcagctgaaaaaggagtccctctctatcgacatatagctgacctcgccgggaatcctgatctgattttacccgttccagcttttaatgttatcaatggcgggagtcacgctggcaacaaacttgctatgcaggaatttatgatcctgcccgtgggtgcctcctcattcaaggaggccatgcggataggagctgaagtctatcatcacttgaaaggtgtaataaaggcgaaatacggcaaagatgccaccaacgtcggagatgagggtggtttcgctccaaatatcctggaaaataatgaagcccttgagctcctgaagacagccatacaggccgctggataccctgacaaagtggttataggcatggacgtagcagcaagcgaattctatcgcaacggaaagtacgacctcgacttcaaaagccctgacgatcccgctaggcacatcacaggtgagaagttgggggagttatacaagagtttcataaaaaactatcccgtggtctcaatagaggatcctttcgaccaggatgactgggcaacttggacttcatttctgtctggcgtcaacatacaaattgtgggagatgatctgactgtgacaaacccaaagagaattgctcaggctgtcgagaagaaagcatgcaattgcctactcttaaaggtcaatcagatcggtagcgtcaccgagagcatccaggcctgtaagctcgcacaaagtaacggttggggtgtcatggtttcccacagatccggcgagaccgaagatacctttattgctgacctggttgtgggactgtgtacaggccaaatcaaaacgggagctccatgccgctccgaacgcctagctaaatacaaccagctgatgagaattgaggaagcccttggagacaaagctattttcgccggccgtaaatttaggaatcccaaggcaaagtag

SEQ ID NO: 186625 - DNA, 1305 bp, Artificial Sequence
  Description of Artificial Sequence: Synthetic coding sequence
atggccatgcagaagatcttcgcccgggagatcctggacagccgggggaatccaaccgtggaggtagacttgcacaccgcgaaagggaggttccgggcggctgtgccctctggcgcatccactgggatatacgaggcccttgagctcagggacggggataagggccggtacttaggcaagggtgtcctgaaggctgtggagaacataaataatacactaggccccgctttactgcagaaaaaactgtcagtggtggatcaggaaaaggtcgacaaattcatgatagagttggacgggaccgagaacaagtccaaatttggcgctaacgctattctaggcgtatcactcgcagtgtgcaaggctggcgctgcagagaagggcgttccactgtatcgacatatagccgaccttgccggtaatccagacctgatccttcccgtcccggctttcaacgtcattaacggaggctcacacgctgggaacaagctggctatgcaagaattcatgatcctcccagtgggggccagctcctttaaagaagctatgcgtatcggtgcagaggtgtatcaccatctgaagggtgtgataaaagccaaatacggaaaggacgcaactaacgtcggcgatgaaggtgggttcgcccctaatatcctcgagaataatgaggcccttgagttgctcaagacagcaattcaggcagcaggctaccccgacaaagtggtgatcggtatggacgttgctgcgagcgagttctacagaaacggaaagtacgatctggattttaagtccccagacgaccccgccaggcacattacgggcgagaagttgggggaactgtacaagagctttatcaaaaattacccggtggtgtctatcgaagacccctttgatcaggacgactgggcaacctggaccagttttctgagcggcgtgaacatccagatcgtcggtgacgatttgaccgtgacaaaccctaagcgcatagcacaggccgtggagaagaaggcttgcaattgtctcctactgaaggtcaaccagatcggctctgttactgagagcatacaggcttgtaagctggcgcagtctaatggttggggcgtgatggtttcccaccgctcaggagagactgaagacaccttcatagcagacctcgtggtgggcctgtgtaccggtcaaattaaaactggagcaccctgcaggtccgaacgcttagccaagtataaccagctgatgcgcatcgaggaggctttgggcgataaagctatcttcgcgggacgcaagtttaggaatccaaaggccaagtag

SEQ ID NO: 186626 - DNA, 1305 bp, Artificial Sequence
  Description of Artificial Sequence: Synthetic coding sequence
atggccatgcagaagatcttcgcccgggagatcctggacagccggggcaatcctaccgtagaagtggaccttcatacggcgaaggggaggttcagggcggccgtcccatctggtgcgtccacaggcatttacgaggccttggaactcagagatggggataaaggccgctatctgggcaagggtgtactgaaggccgtcgagaacatcaataataccctcgggcccgctttgttgcagaagaagctgtccgttgtggatcaggagaaagtggacaagtttatgatagagctggacgggacggagaacaaaagtaagtttggtgccaatgccattctaggcgtcagcctcgccgtatgcaaagccggcgcagctgaaaaaggggtgcctctgtatcggcatattgccgacctcgctgggaatccagatctaattttgccagtgcccgcattcaatgtgattaatggtgggtcccatgccggcaataaacttgccatgcaggagttcatgatcttgccagtcggcgcaagtagcttcaaggaggcgatgcggataggcgctgaggtgtaccaccacctcaaaggagtgatcaaggctaagtatggaaaggacgccaccaacgtcggcgatgaaggagggttcgcccctaacatattagagaataatgaggctctcgagctcctcaagacagccattcaggcggctggttacccagataaggttgttatcggcatggatgttgctgcttctgagttttatcgcaacggcaaatacgacctcgacttcaagagtcctgacgaccccgctagacacattactggggagaagctcggcgagctgtacaagagcttcataaaaaattacccggtggtatcaatcgaggatccttttgatcaggatgactgggccacctggacatcattcctgagcggcgtgaatattcagattgttggcgacgacctgacagtgacgaatcccaagaggatcgctcaggctgtggaaaagaaagcctgcaactgtttgctgctcaaggtaaatcaaatcggatcagtgacggaaagcatccaggcctgcaagttggcccagagcaacggctggggcgtcatggtgtcacatcgttcaggggaaaccgaggatacttttatagccgatttggtggtggggctgtgcacaggccaaataaagaccggtgcaccatgccggtctgagcggttggctaagtataaccagctgatgagaattgaggaggccctcggtgataaggccattttcgctggccgcaagttccggaaccctaaggcgaaatag

SEQ ID NO: 186627 - DNA, 852 bp, Artificial Sequence
  Description of Artificial Sequence: Synthetic coding sequence
atggccatgcagaagatcttcgcccgggagatcctggacagccgggggaatccaactgttgaagtggacctgcacaccgcgaaggggagattcagagccgccgtccccagtggtgcctccacgggtatttacgaggcgctcgagttgcgcgatggcgacaaaggacggtacctgggcaaaggcgtgttaaaagccgtcgaaaatatcaacaacactctgggtcctgcattgctgcaaaagaagctgtctgtcgttgaccaggagaaggtggacaaattcatgatagagctcgacggaactgaaaataaatctaaatttggcgctaacgcaatcctgggcgtctccctggccgtatgcaaagccggcgctgccgaaaagggcgttcctctgtaccgccacatcgccgatttggcaggcaatcctgacctaatcctgcccgtccctgcctttaatgtgattaatggaggttcccatgcgggcaataagctcgctatgcaggaatttatgatcctgcccgtgggcgcttcctcatttaaggaagccatgaggattggagcagaagtctatcaccacttaaagggggttattaaagccaagtatggtaaagatgccacgaacgttggagatgagggagggtttgctcctaacatactcgagaacaacgaggctctggagttgctgaaaactgcaattcaggccgcaggttacccggacaaggtggtgatcgggatggacgtcgccgcttcagagttttacagaaatggaaagtacgacctggatttcaaaagtcccgacgatccggcgcgccacatcactggcgagaagctgggtgagctctacaaatcgttctag

SEQ ID NO: 186628 - DNA, 465 bp, Artificial Sequence
  Description of Artificial Sequence: Synthetic coding sequence
atggccatgcagaagatcttcgcccgggagatcctggacagccgggggaaccccaccgtggaggtggatctccacacggctaaggggcgttttagggcggcagtcccatccggagcttcaaccggcatttacgaggccctggaattacgcgatggggataagggcaggtatctgggcaagggggtcctcaaggccgttgagaatattaataatacgctcggtcccgctctcttgcagaagaagctgtctgtggtggatcaggagaaagtggacaaattcatgatcgaactggacggcacagagaacaagagtaaatttggagctaacgccattctgggagtgagcttggccgtgtgtaaagccggtgcggctgagaaaggcgttcccttatacagacacatcgccgatttggccggcaatccggacctgattctgccggtgcctgccttcaatgtgattaattag

SEQ ID NO: 186629 - DNA, 447 bp, Artificial Sequence
  Description of Artificial Sequence: Synthetic coding sequence
atggccatgcagaagatcttcgcccgggagatcctggacagccggggtaaccctacagtagaggtggacctccataccgcgaaagggcggttccgcgccgcagttcccagcggggccagcaccggcatctatgaggctttagaacttcgcgatggtgataaaggcaggtatctcggaaaaggtgtgctgaaagcagtcgagaacattaacaacactctgggccccgcgctgctacagaagaagctgtctgtggttgaccaggagaaggtcgacaagttcatgattgaactcgatggaacagagaacaaaagcaagtttggggcaaatgcaattctgggggtgagcctggcggtctgcaaggctggcgcagccgagaaaggggttcctttgtatcgtcacatcgcagatcttgccggaaatcccgatcttatactgccggttccttag

SEQ ID NO: 186630 - DNA, 1332 bp, Artificial Sequence
  Description of Artificial Sequence: Synthetic coding sequence
atggtgcggggccggatcagccggctgagcgtgcgggacgtgcggttccccacatcactggggggtcacggtgccgacgctatgcacactgatcccgactacagcgccgcttacgtggttatcgagacagacgcagaagatgggataaaaggttgcggcattaccttcacccttggcaaaggaaccgaggtcgtcgtctgtgctgttaatgccctggctcaccatgttctcaacaaggatctgaaggatatcgtcggtgacttccgcgggttctataggcagttaacaagcgatggccagctgaggtggataggacctgagaagggggtggtgcatctcgccacagccgcagtgctgaatgccgtgtgggatctgtgggctaagcaggaaggcaagcccgtgtggaagcttttggtcgacatggacccccggatgttggtgtcgtgtatagatttccggtacattacggatgtgctcaccgaagaggatgcactggagatactacagaagggacagattgggaaaaaagaaagggagaaacaaatgttggcccaggggtatcccgcgtataccacctcttgcgcatggctgggatatagcgatgacactctcaagcagctgtgcgctcaggcgcttaaagacggttggaccaggtttaaggtcaaagtgggcgccgacctccaggacgacatgcgacggtgccaaattatcagggacatgataggtccagagaaaaccctgatgatggatgccaaccagagatgggacgttcccgaagccgtagaatggatgagcaagctggctaagtttaaaccgctgtggattgaggagccgaccagtcctgatgatatactcggacacgctactatcagcaaagccttagtgcccctcggcattgggatcgcaacaggagagcagtgccacaatcgcgttatatttaagcagctgctccaggccaaggctcttcaattcctgcagattgacagttgtcggctgggatccgttaacgagaatctgtcagttctcctgatggcaaaaaagttcgaaattccagtgtgcccccatgcaggcggagtgggactctgtgaactcgtccaacacctgatcatctttgattacatttctgtcagtgcatccctggagaaccgagtctgtgaatatgtagaccaccttcacgaacacttcaaatatccagtgatgatccaaagggcctcttatatgccaccaaaagaccctggctattcgaccgaaatgaaggaggagagcgtgaaaaaacatcagtatcccgacggggaggtgtggaaaaaattgctgccagcacaggaaaactag

SEQ ID NO: 186631 - DNA, 642 bp, Artificial Sequence
  Description of Artificial Sequence: Synthetic coding sequence
atgcggcggtgccagatcatccgggacatgatcggccccgagaagaccctcatgatggacgccaaccagcgttgggatgtacccgaagcggtggaatggatgtccaaactcgctaagtttaagcccctctggatcgaagagcccacatcaccggatgacattctgggccacgctacaatatctaaggctcttgttccgctcgggataggtatcgcaacaggggagcagtgtcataatagggtaatcttcaaacagctactccaggccaaggcactgcaattcctgcagatcgactcctgtaggctcggctcagtcaacgagaatttaagcgtactgttaatggccaaaaagtttgaaatccccgtgtgtccgcatgccggaggtgtcggcctctgtgagctggtccagcatttaatcatatttgactatatatcagtaagcgcttcacttgagaacagggtgtgcgaatatgtcgaccatttgcatgaacactttaaatacccggtgatgattcaaagagcttcttacatgccacctaaagacccagggtattccactgaaatgaaagaagagagcgtgaagaagcaccagtatccagacggggaagtctggaagaagttactcccagctcaagagaattag

SEQ ID NO: 186632 - DNA, 1353 bp, Artificial Sequence
  Description of Artificial Sequence: Synthetic coding sequence
atggtgagcgccgacgccatggtgagcgccgacgccatggtgagcgctgatgcaatggtctccgcggacgccatggtgtcggccgacgccatggtgtccgccgacgccatggtcagcgcagatgccatggtcagcgctgacgcgatgcatacagacccagactattccgccgcttatgtggtgattgaaactgatgccgaggacggcatcaagggatgtggaattactttcacattgggcaagggtacggaggtggtagtctgcgctgttaacgcattggcacatcacgtgctaaacaaggatctgaaagatatcgttggcgattttcggggcttttataggcagctgacctcagatggccaactcaggtggatcggccctgagaaaggtgtcgtgcatctggcgactgccgccgtccttaacgccgtttgggacttgtgggcaaagcaggagggtaagccagtctggaagctgcttgtcgacatggacccccgcatgctggtctcttgcatagatttcaggtacattacagatgtattgacagaagaggacgccctggaaattttgcaaaaggggcaaataggcaagaaggaacgtgagaagcagatgctcgcacagggataccctgcatacactacatcatgcgcctggctgggatacagcgacgacacactcaagcagctgtgtgcacaggctcttaaagatgggtggactcggttcaaggtgaaggtaggcgctgacctgcaagatgatatgaggcgatgccaaatcatccgggacatgattgggccggagaagacactcatgatggatgctaatcagcgctgggacgtgcctgaagctgtagagtggatgtccaaactggctaagtttaagcccttatggatagaggaacccaccagcccagatgacattttgggccatgctacaatctccaaatgtcacaacagagtcatttttaagcagctcttgcaggccaaagccctgcagtttctgcagattgatagctgcagactcggcagtgtaaatgaaaatttgagtgtcctgcttatggccaagaagtttgagatacccgtatgtcctcacgccggcggcgtggggctgtgcgagttggttcagcatctcatcattttcgactatatcagtgtgtctgcaagccttgaaaaccgcgtgtgcgagtacgttgaccacctgcacgagcatttcaagtaccctgtcatgatccaacgggcgtcttatatgcctcccaaagatcctggttatagtacagaaatgaaggaggagtccgtgaaaaaacatcagtatcccgacggcgaggtgtggaagaaactgctgcctgcccaggaaaactag

SEQ ID NO: 186633 - DNA, 1086 bp, Artificial Sequence
  Description of Artificial Sequence: Synthetic coding sequence
atgcagaagatggagagccggggcgtggagctgcccagcctgtgggagaaggctttgaaactgatagggcccgagaaaggagtggtccatctagccactgctgccgttcttaatgctgtgtgggacctatgggccaagcaggaaggcaaaccagtttggaagctgcttgtggacatggaccctaggatgctcgtgtcctgtatagattttcgatacattaccgacgtcctgacagaagaggacgccctcgagatcctacagaaaggccagattgggaaaaaggagagggagaaacagatgctcgcccaggggtaccctgcatacactaccagttgtgcctggcttggatactccgatgatactctgaagcaactctgcgcccaggctctgaaagacggctggacaagattcaaagtcaaggtcggcgctgatctgcaggacgacatgcgcagatgtcagatcatccgggacatgatagggcccgaaaaaaccctgatgatggacgccaatcaacgatgggatgttcccgaagccgtcgagtggatgtctaagctggctaaatttaagcccctttggatcgaggagccaacatctcccgatgacatcctggggcatgctacaatctcaaaagcactcgtgccattgggtatcggcatcgcaactggcgagcagtgccacaaccgtgtgatcttcaagcagctgcttcaggcaaaggcacttcagtttctacagattgacagctgtcgactcgggtctgttaacgaaaacttgagtgtgctgctgatggctaagaagttcgaaattcccgtttgccctcatgctggcggtgtagggctatgtgaactagtgcagcacctgataatctttgattatatctctgtgtccgctagcctcgagaaccgggtctgcgagtatgtggatcatcttcacgagcactttaagtacccagtgatgatacagcgggcatcttatatgccccctaaggacccgggttacagcaccgagatgaaggaagagtcagttaagaaacaccaatatccagacggcgaggtgtggaagaagctattgccagcgcaagagaattag

SEQ ID NO: 186634 - DNA, 429 bp, Artificial Sequence
  Description of Artificial Sequence: Synthetic coding sequence
atggtgcggggccggatcagccggctgagcgtgcgggacgtgcggtttccaacatccctgggggggcacggtgctgacgcaatgcatacagatcctgactacagcgcggcctacgtggttattgagactgacgcggaagacgggatcaaagggtgcgggattacctttactttaggcaagggtactgaggtcgtggtatgtgctgtaaatgccctggcgcatcacgtgctgaacaaggatctgaaagatatcgttggagatttcagaggtttctaccgccagctgacctcggacggtcagttgaggtggataggcccggaaaagggggtcgtgcatctcgcaacagctgccgtccttaacgcggtatgggacttgtgggcaaagcaggaggggaagcctgtttggaagttgttagtcgacatgggctag

SEQ ID NO: 186635 - DNA, 1392 bp, Artificial Sequence
  Description of Artificial Sequence: Synthetic coding sequence
atggccaccgtgaccgccaccaccaaggtgcccgagatccgggacgtcacaaggattgaacgcatcggggcacatagtcatataagagggctgggccttgatgacgccctcgaacctagacaggctagccaggggatggttggccagctggccgccagacgtgcggcaggggtggttctggagatgatccgcgaaggcaagattgcaggcagggcagttcttattgcaggccaacctggaacgggtaagaccgccatcgccatgggaatggctcaagcactgggacccgacacccccttcactgctatcgccgggtctgagatcttctccctggagatgtctaagaccgaggcactaactcaagctttcagacggagtattggggtgaggattaaggaagagaccgaaattattgaaggcgaggttgtcgagattcagatcgatcggcctgctactggcaccggatcaaaggtaggcaagctaacccttaaaacgactgagatggaaacaatctatgatctgggaactaagatgatcgagagtcttacaaaagataaggtccaggcaggggatgttattaccattgataaagccacagggaaaatcagtaaactgggcagatcgtttactagggccagggattacgacgcgatggggagccagacaaagttcgtgcagtgccccgacggggagctgcaaaagcgcaaggaagtcgtccataccgtcagcctgcatgagatagacgtaattaacagccgtactcagggcttcctggcattattttctggggatactggagagatcaagtccgaggtgagggagcaaattaatgctaaggtcgctgagtggagagaagaaggaaaggcggaaattattcccggggtgctgttcatcgatgaggtgcacatgctcgatattgagtccttcagctttttaaacagggccctggagagcgatatggcccctgtgctcattatggctactaatcgcgggatcacccggatccgcggaacatcataccagtcaccacacggcattcccattgatttattggatcggctgcttatagtgtctacaaccccctactcagaaaaggacaccaaacagatccttcgtattcgctgcgaagaggaggacgttgagatgagcgaggatgcatacaccgtcctcacccgcataggtctggaaacctccttaagatacgccatccagctgataaccgcggcatctctggtgtgcagaaaacgaaaaggcactgaagtgcaagtcgatgacatcaaaagggtctatagcctctttctcgatgaaagtcgatctacccagtacatgaaggagtatcaggacgcattcctgttcaatgaactgaagggggaaactatggatacctcatag

SEQ ID NO: 186636 - DNA, 855 bp, Artificial Sequence
  Description of Artificial Sequence: Synthetic coding sequence
atggccaagagcctgctgaagaccgccagcctgagcggccggaccaagcttctgcatcagactggcctgagcttgtattccacaagccacgggttttatgaggaagaggtgaaaaagacactgcaacagttccctggtgggtcgattgatctgcagaaagaagacaacgggattggtattcttactttaaacaacccgtcacggatgaatgctttttctggtgtgatgatgctacagctgctcgagaaagtcatcgaactggagaattggaccgagggtaaggggttaatcgtgcggggagcaaagaacaccttctcttctggctcggatctcaatgccgttaagtctctgggactgcagagacgactcccgctgatctctgttgctctggtgcaaggctgggccttgggagggggggccgagtttacgactgcctgtgacttccggttaatgactccagagtcgaaaattcgtttcgtgcacaaagagatggggattatcccctcatggggtggaaccacacgccttgtcgagattataggttcccgccaggcgctcaaggtcctgtcaggagcgttaaaacttgacagcaagaacgccttaaatattggaatggttgaagaggtgcttcagagctctgacgaaaccaagtctctggaagaagcacaggaatggttgaaacagttcatccagggcccccctgaggtgatccgcgcccttaaaaaaagtgtgtgcagcggcagggagttgtacctggaagaggccctacagaacgagcgcgacctacttggcacggtgtggggcggccctgccaatttggaggccatagcaaaaaaaggcaaatttaataaatag

SEQ ID NO: 186637 - DNA, 438 bp, Artificial Sequence
  Description of Artificial Sequence: Synthetic coding sequence
atggccaagagcctgctgaagaccgccagcctgagcggccggaccaagcttctgcatcagacaggcttatcgctgtactcaacaagccatggcttttacgaggaggaggtgaagaaaacgttacaacagtttcccggaggctccatcgatctacagaaagaagataatggcatagggatactgaccttgaataatccatctcggatgaatgcgttctccggagtgatgatgctccagctgttggagaaagtgattgagctggaaaactggaccgaaggaaagggactgatcgttcggggtgcaaagaacacctttagctctggctccgatctgaatgccgtgaagtcgctcggtaccccagaaacgtcctttaataaatgttgcgcagggtcacgattgggcataggttggaggtctcgtatttactattccatgtag

SEQ ID NO: 186638 - DNA, 441 bp, Artificial Sequence
  Description of Artificial Sequence: Synthetic coding sequence
atggccaagagcctgctgaagaccgccagcctgagcggccggaccaaacttctgcaccagacagggttgagcctctactccacaagccatgggttttatgaggaagaggttaaaaaaacattgcagcagttcccaggaggaagtatcgacctccagaaggaagacaacggtattggcatccttaccctaaacaatcccagtcgaatgaatgccttctcgggcgtcatgatgctgcagttactggagaaagtcatagaattggaaaactggaccgaaggaaaaggcttgattgtaaggggcgccaaaaacactttctcctctggatctgaccttaacgctgtgaagtcgttgggaacacctgaagagaccagcttcaacaaatgttgtgccggcagcaggctgggcattgggtggcgtagccgaatttactattccatgtag

SEQ ID NO: 186639 - DNA, 438 bp, Artificial Sequence
  Description of Artificial Sequence: Synthetic coding sequence
atggccaagagcctgctgaagaccgccagcctgagcggccggaccaagcttctgcaccagactggcctctccttgtatagcactagtcacggattttacgaggaagaagttaagaagacgctgcagcagttccccgggggctctatcgatctgcagaaagaagacaatggtattggaatactgacactgaacaatccaagtagaatgaatgctttctccggtgtaatgatgctccagctgttggagaaagttatcgagttagagaactggacggaaggaaagggtctcattgttcgtggggcaaagaacacttttagttcgggttccgacctgaatgccgtaaagtctctggggacacccgaaacgagttttaacaagtgctgcgcgggaagcagacttgggattggttggcgatcacggatctattatagcatgtag

SEQ ID NO: 186640 - DNA, 642 bp, Artificial Sequence
  Description of Artificial Sequence: Synthetic coding sequence
atgaacgccttcagcggcgtgatgatgctgcagctgctggagaaggtgattgaacttgaaaattggaccgagggaaaaggtctcatcgtgcgtggcgccaaaaacacgttttcctccggcagcgatctgaacgccgtgaagagcctcgggaccccagaagagtcctgcagatggaacacagagtttctgtacacccttcacccagtgagtccatttatcaatatcctgtacagctatggatggaacggtcgcatgcacgtccatgcaaaacacttaaataagatctacgaggtaaagaagcagcgaggtaaaatcctgctggggctgtcccgtctgcccctcatatcagtggcacttgtgcagggatgggccctgggaggcggagcagagtttacaacagcttgcgatttcagactcatgactcccgagagtaaaatcaggtttgtacacaaggaaatgggaatcatcccgtcctggggaggcactacccgccttgttgagatcattggctctcgtcaggccttaaaagtcctctccggcgctcttaaactcgattctaaaaacgcgctgaacattgggatggttgaggaggtgcttcagagctctgacgaaacaaaatcccttgaagaggcccaggagtag

SEQ ID NO: 186641 - DNA, 906 bp, Artificial Sequence
  Description of Artificial Sequence: Synthetic coding sequence
atggccaagagcctgctgaagaccgccagcctgagcggccggaccaagctgctgcaccaaaccggcctatctttatactctacttcccacgggttttatgaagaggaagtgaaaaagacccttcagcagtttcccggtggctctattgacctgcaaaaagaggacaacggcattgggatcctaaccctgaacaatccttcccgcatgaacgcattctctggcgtgatgatgctgcagctgttggaaaaagtcatcgagctcgaaaactggactgagggaaaaggattaatagtcaggggcgccaagaataccttctccagcggcagcgacctcaacgcggtgaaaagccttggaactcccgaggacgggatggcagtctgtatgttcatgcagaacactctgacacgcttcatgaggctgccactaatctcagtggccttagttcagggatgggcgttgggcggaggagccgagtttactactgcatgtgacttcagactaatgactcctgagtcaaagatcagattcgttcacaaggaaatggggattattccgtcctggggaggcaccacccgactggtggagatcattggatcacgtcaagccttaaaggttctgtccggagcgttaaagttagacagcaagaacgctcttaatatcgggatggtggaggaggtgctgcaaagttcagacgagactaagagtctggaagaggcccaagagtggttaaagcaattcatccagggaccacctgaggtcatccgggcacttaagaaaagtgtgtgtagcggcagagaattgtacttagaggaggccctgcagaacgagcgcgatcttctgggaactgtgtgggggggccccgcaaatctagaagctatagctaagaaaggcaaattcaataagtag

SEQ ID NO: 186642 - DNA, 681 bp, Artificial Sequence
  Description of Artificial Sequence: Synthetic coding sequence
atgatgctgcagctgctggagaaggtgatcgagctggagaactggacagagggtaaaggactgatcgtacggggagccaaaaacacatttagttcgggatccgacttgaatgcggttaagtcacttggaactcctgaagatgggatggcggtgtgcatgtttatgcagaatactctgacacgcttcatgaggctgcctctcatctccgttgccttggtccagggatgggcactagggggaggcgcagaatttactaccgcctgcgatttccggctcatgactcctgaaagtaagataagatttgttcacaaggaaatggggatcatcccctcttggggtgggacgaccagattggtcgagatcattggcagtcggcaggctctgaaagtcctctccggggctttaaaactagatagtaagaatgctctcaatatcggcatggttgaagaggtcctccagtcatcagacgagacaaagagtctggaggaagcccaggaatggctcaaacagttcattcagggaccccccgaagtgatacgggccctaaagaagtccgtgtgtagcgggcgtgagctttatctcgaggaggctctgcagaatgaaagagatctgctcggcacagtctgggggggtcctgccaacctggaagcaatagccaagaaagggaagtttaacaaatag

SEQ ID NO: 186643 - DNA, 906 bp, Artificial Sequence
  Description of Artificial Sequence: Synthetic coding sequence
atggccaagagcctgctgaagaccgccagcctgagcggccggaccaaactactgcaccagacaggactatctttatattcgacctcccacggtttctacgaggaggaggtcaaaaagaccctgcaacagtttccaggaggctctatcgatttacagaaagaagacaacgggattggaatacttacgctaaataatcccagccgaatgaatgcattttccggcgtgatgatgctccagctactggagaaggtgatagagctggaaaactggaccgaaggtaaaggcctcattgtacgcggcgctaagaacacattctcaagcggctcagatctgaatgccgtgaagtcattaggtacccctgaggacggaatggcggtctgcatgttcatgcagaatacactgacacggttcatgcgccttccccttatcagcgtggccttggttcaaggatgggcccttggtgggggtgccgagtttactacagcatgcgacttccggctgatgacccctgagtctaagatccgatttgtgcacaaggagatgggtataatcccatcctggggaggtacaacgcgcttggtcgaaattattggaagccgacaagcactaaaggtgctcagtggagctctgaagctggatagtaagaacgcgcttaatattggcatggtggaagaagtactccagagttccgacgaaacaaagagcctggaagaggctcaggaatggcttaaacagttcattcagggtcctccggaggtgattcgggccctgaagaaaagcgtgtgttcaggccgggaactgtacctagaggaggcactccagaacgaaagggatctgttgggaaccgtctgggggggcccagctaacctggaagccattgctaaaaagggcaagttcaacaagtag

SEQ ID NO: 186644 - DNA, 906 bp, Artificial Sequence
  Description of Artificial Sequence: Synthetic coding sequence
atggccaagagcctgctgaagaccgccagcctgagcggccggaccaagctgttgcaccagacgggcctgtctctgtactctacctcccacgggttctacgaggaggaagttaaaaagacactgcagcagtttcccgggggttccattgatctgcaaaaggaggacaacggtatcggcatcctcactctgaacaatccgagcagaatgaacgccttttccggagtgatgatgctccaactcctggagaaggtcatcgagctggagaattggacagagggcaagggcctcattgtgaggggggcaaaaaacacctttagcagtggcagtgacctcaatgcagtcaaatccctgggtacgcctgaggatggaatggcggtctgtatgtttatgcagaacacccttactaggttcatgcgcctgcctttaatttccgtcgcactcgtgcagggatgggcacttggtgggggtgccgagttcacaacagcttgcgattttaggctcatgacgcctgagtctaagattcggtttgttcataaggaaatgggcatcattccctcttgggggggcacaacccgcctggttgagatcatcggttcaagacaggctctgaaagtccttagtggagctttgaagctggattcaaaaaatgcactgaatatcggaatggtagaagaagtgctccagagcagcgacgaaactaagagcctcgaggaagcccaagagtggctcaaacaatttattcagggaccccctgaggtgattcgggccctgaagaagtccgtatgtagcggtcgagaattatacctcgaagaagcattgcagaatgagcgggacttgttgggcaccgtgtggggcggcccggccaatctcgaagcgattgctaagaagggcaagttcaataaatag

SEQ ID NO: 186645 - DNA, 408 bp, Artificial Sequence
  Description of Artificial Sequence: Synthetic coding sequence
atggccaagagcctgctgaagaccgccagcctgagcggccggaccaaactactgcaccagacaggactctctctctattccacttctcatggcttctatgaggaagaagtgaagaagaccctccaacagtttcctggggggagtattgatctgcagaaagaagacaatggtatcggcatcctgactctcaacaacccctcgcgaatgaatgccttcagcggcgtcatgatgctccaactcctcgagaaagtgattgaattggagaattggactgagggaaaggggctaatcgtaagaggcgctaaaaatactttctcctctggctccgacctgaacgcagtcaaatcattaggcactcccgaggacggcatggcagtatgcatgtttatgcagaacactcttacctag

SEQ ID NO: 186646 - DNA, 924 bp, Artificial Sequence
  Description of Artificial Sequence: Synthetic coding sequence
atggccctgaagcaggagatggccaagagcctgctgaagaccgcctctttgagcggtcgtacaaaactattacaccagaccggacttagtctatattctacatcccatggtttctacgaggaagaggtgaagaagaccctgcagcaatttcccggcgggtccatcgatttgcaaaaagaagacaatgggatcggcatactgaccctcaataaccccagcaggatgaacgctttcagcggagtcatgatgctccagctcctggaaaaggtgatcgaactagagaactggaccgaagggaagggcctgatcgtgaggggcgctaagaacaccttcagctctggaagtgacctcaatgcagtgaagtccctaggtactcccgaagatggcatggctgtatgtatgttcatgcagaatacgctgacccgattcatgcggctgcctttgattagtgtggcgcttgtccagggctgggctctgggcgggggcgcagagttcactaccgcttgtgactttaggctgatgacaccggaatcgaagattcgctttgtgcataaagaaatgggtatcataccatcttggggcggcaccacacggctcgttgagataattggctccagacaggctcttaaggttctgtctggtgccttgaagctcgactctaagaacgcccttaacatcggaatggtcgaggaggtccttcaaagctctgatgagaccaagagtctcgaggaggctcaggagtggctgaagcaattcattcagggaccacccgaggtgatccgggccctaaaaaagagcgtgtgttctggacgagagctctatctggaagaggcgcttcaaaatgagcgtgatttactagggacggtgtggggaggcccagcaaacctcgaagctattgccaagaaagggaaattcaataagtag

SEQ ID NO: 186647 - DNA, 456 bp, Artificial Sequence
  Description of Artificial Sequence: Synthetic coding sequence
atggccaagagcctgctgaagaccgccagcctgagcggccggaccaagctgctccaccagacaggactctctctgtacagcacatcccacggtttctatgaggaggaagttaagaagaccctccagcagttccccggcggatcaatagacctgcaaaaggaagacaatggcatcggaatcctgacattaaacaatccctccaggatgaacgccttctccggcgtgatgatgctccaactcctggaaaaagtgatagagttggaaaactggaccgaaggtaaaggactgattgtccgcggcgccaagaacacattctcatcaggatctgacctgaatgccgtgaagtccttagggaccccagaggatggcatggctgtctgcatgttcatgcagaacacattgacaagattcatgcggttacctctgatcagtgtcgccctggtgcagggctggtag

SEQ ID NO: 186648 - DNA, 378 bp, Artificial Sequence
  Description of Artificial Sequence: Synthetic coding sequence
atggccaagagcctgctgaagaccgccagcctgagcggccggaccaaactgctccaccaaactgggctcagcctttactccacctcacatggcttttatgaggaggaggttaaaaagacgctgcagcagttccctggcgggtccatcgatctccaaaaggaggacaatggcattggcatcttgactctgaataacccaagtcgtatgaacgcattctccggcgtgatgatgttgcagctgctggaaaaggtgatcgaattggagaattggacagagggtaaaggcttgatcgtccgaggggcaaagaacacgttctcctccggctccgatttaaatgccgtcaagtcccttggcacccccgaggccaattttctttag

SEQ ID NO: 186649 - DNA, 213 bp, Artificial Sequence
  Description of Artificial Sequence: Synthetic coding sequence
atgatgctgcagctgctggagaaggtgatcgagctggagaactggactgaagggaaaggattgatcgttcgcggcgcgaaaaacaccttctcctcagggtccgacctgaacgctgtgaagtctttgggaacaccagaaacctcatttaacaagtgctgcgcaggttcaaggctgggcataggctggaggagccgcatatattattcgatgtag

SEQ ID NO: 186650 - DNA, 873 bp, Artificial Sequence
  Description of Artificial Sequence: Synthetic coding sequence
atggccgccctgcgggtgctgctgagctgcgtgcggggccccctgcggccccccgttcgctgtcctgcctggcgccctttcgcatctggagcgaattttgagtacatcattgccgagaagcggggaaagaacaacacagtgggcctgattcagttgaatagacccaaggcgctgaatgccctctgtgatggactgattgatgagctgaaccaggcgcttaaaaccttcgaagaggatcccgctgttggagccattgtgctgactgggggggacaaggcatttgctgccggagccgacatcaaagaaatgcagaacctcagtttccaggattgttactcctccaaatttttgaagcactgggaccacctgactcaagtcaaaaagcctgtgatcgcagctgtgaacgggtacgcttttggtggcggctgcgagttggcaatgatgtgcgatatcatctatgctggcgagaaggcacagttcgcacagcctgaaatcctcattggtacaataccgggcgctggggggacgcaacggctcacacgggccgtgggcaagtcactggccatggagatggtcctaaccggcgatcgcatctccgcccaagatgccaagcaggcgggtctggtctctaaaatttgtcccgtggagaccttggtcgaggaggcgatccagtgtgctgaaaaaattgcctccaatagcaaaattgtggtcgcaatggccaaggagagcgttaatgcagctttcgagatgaccctgacagagggctccaagctcgagaaaaaactgttctattcgacgtttgcaacagatgatcgaaaggaagggatgaccgctttcgtggagaagagaaaagccaacttcaaagaccaatag

SEQ ID NO: 186651 - DNA, 2271 bp, Artificial Sequence
  Description of Artificial Sequence: Synthetic coding sequence
atgagcttcgtggccggcgtgatccggcggctggacgagaccgtggtgaacagaatcgctgctggtgaggtcattcagaggcccgcaaatgccatcaaggaaatgatcgaaaactgtctggacgccaagtcaactagcattcaggtcattgtgaaagaggggggactcaaattgatacaaatccaggacaatgggactgggattcggaaagaggatctagacatcgtatgcgagcggtttaccacaagcaagcttcaaagcttcgaagatttggcgagcatttccacctacggcttcagaggggaagcactcgcatcaatctctcatgtggctcatgtcaccattaccaccaagaccgccgacggcaagtgtgcatatcgggccagctatagtgacggcaagctcaaagcgcctccaaagccatgcgcaggaaatcagggcacgcagatcactgttgaagatcttttctacaacatcgccaccagacgaaaggcactgaagaacccatccgaggaatacggcaaaatactggaagtggtcggcaggtactcagtacataatgccggcatttcgtttagcgtcaagaagcagggagaaactgtagctgatgtgcgaacccttccgaacgcctcaaccgtggacaatattaggtccatcttcgggaatgctgtctcccgggagctgatcgagattgggtgtgaagataagacgctagcgttcaaaatgaacggttacattagtaacgcaaactacagcgtgaaaaaatgcatattccttctgtttattaaccacagactggtcgagagtacctcgctgcggaaggccattgaaaccgtatacgccgcgtatctgcctaagaatacacatcctttcttgtacctgagtctggagatcagtccccagaacgttgacgttaacgtgcaccccacaaaacatgaggttcattttctccacgaagagtccatcctggaaagagttcagcaacacatcgagtcaaaattgctcggaagtaattcgagccggatgtacttcactcagaccctgttgcccgggcttgcaggacccagcggtgagatggtcaaatctacaacttcattaactagcagttcgacttcgggtagttctgacaaagtgtatgcgcaccagatggtgaggaccgattccagggaacagaaactagatgcgtttctgcagccactgtctaagcccttgtccagtcagccacaagcgatcgtaaccgaagacaagacggacattagtagcgggcgagcaaggcagcaggacgaggaaatgcttgaattgccagctcctgccgaggtggcggccaagaaccaaagcctcgagggcgacaccacaaaagggacctccgagatgagcgaaaaacgcgggccaaccagctcaaacccccgaaaaaggcacagggaggactcagacgttgagatggttgaggacgatagccgcaaggagatgacagccgcctgtactccacgtaggaggatcattaatctcacaagcgtgctatcgctgcaagaagagattaacgaacaaggacatgaggtactacgagagatgttgcacaaccacagctttgttggatgcgtaaatccacagtgggcgttagcccagcaccaaactaaattgtacctgctaaatactactaagctcagcgaggaactattttaccagattctgatctacgacttcgccaacttcggcgtgcttaggctgtccgagcccgcaccactcttcgatctggctatgctggccctggacagccccgaaagtggatggaccgaagaggacgggccaaaggagggcctggccgaatacattgtcgagtttctgaaaaagaaagcagagatgctagcagattacttttcgctcgagatagacgaggagggcaacctgatcggcttgcccctgttaattgataattatgttccacctttggaaggcctccccatctttattctgcgcctagccactgaagtgaattgggatgaggagaaggaatgcttcgagtctttgtcaaaagaatgcgctatgttttactcaatccgcaagcaatacatcagtgaggaatctaccctgtcagggcagcagtccgaggttcctggaagcatcccaaactcatggaagtggaccgttgaacatatcgtttataaggcactccggagccatattctaccacctaagcactttacagaagatggaaacatattacagctggcaaatttgccagacctgtataaagtttttgagcggtgctag

SEQ ID NO: 186652 - DNA, 1884 bp, Artificial Sequence
  Description of Artificial Sequence: Synthetic coding sequence
atggccttcggcggcggcctggagctggccctgggctgccactacagaattgcacacgcagaggcccaagtgggcttaccagaggttactctgggccttctccctggagcacgaggcacccaactgctgccccgcctcacaggggtgccagccgccttagatctgattacttctgggcgtcgcattctggctgatgaggcgctgaagctgggaattctggataaggtcgtcaattcagatccggtagaagaggccatcagatttgcacagagagtctccgaccaacctcttgaatcaaggcgtctgtgtaacaaacctattcagtctctgcctaatatggactcaatcttttccgaagccttgctcaagatgagacggcagcatcctggatgtctggctcaggaggcatgtgtgcgagccgttcaagccgccgtccagtacccatatgaggtgggtattaaaaaagaagaagaactttttctctacctgttgcagtctggccaggcaagggccctccagtacgcgtttttcgcagagaggaaagctaataagtggtccacaccatccggggccagttggaaaacagcttcagcgaggcctgtgtcaagcgtgggcgtggttggcctgggcactatgggacgcggtattgtcatctctttcgctcgcgctcggatccccgtcatcgctgtagactctgataagaatcaactcgcgaccgcaaacaagatgatcacctctgttttagaaaaggaagcttctaagatgcaacagagcggccatccctggagcgggcccaaacctcgcctgaccagttcagtaaaggagctcggcggtgtcgacttagtgatcgaggctgttttcgaggagatgagcctgaagaagcaagtttttgccgagttgtccgccgtttgcaaacccgaggccttcctatgtaccaatacaagtgccctggatgtagatgagattgccagctctaccgaccggcctcatcttgtgatcggcacacattttttctcccccgcccatgtcatgaaattactagaggtgattccatcccagtattcgtcccctactaccatcgcgaccgtgatgaacttgagtaagaagattaagaagattggtgtggtggtaggaaattgcttcggatttgtcggcaacaggatgttgaacccctattacaatcaggcttattttctgctcgaagagggtagtaaacctgaggaggtcgatcaagtgctcgaggaatttggatttaagatggggcctttccgagtcagtgatctggcgggattggacgtgggctggaaatccaggaaggggcagggactgaccggtcccacacttctgccggggaccccagccaggaaacgcgggaacaggaggtactgtcccattcctgacgtcctgtgtgagcttggacggttcggacagaagacaggcaaaggctggtaccagtacgataaacctcttggccggattcataagcccgatccttggctgagcaagtttttgtcgcgttatcggaagactcatcacattgaaccaagaactatctcacaggatgaaatccttgaaaggtgcttatacagtctcatcaatgaagcctttaggattttaggggagggtatcgcagcctctcctgaacacatagatgttgtctatctacatgggtacggctggcctagacacaagggcgggcccatgttctacgcctctacagtcggcttgcctacagttctggagaaattgcaaaaatattatcgccagaatcctgacattccacaacttgagccatcagactatctgaaaaagcttgctagtcaaggcaaccctccactcaaggagtggcagagcctggccggaagcccatcctcgaagctttag

SEQ ID NO: 186653 - DNA, 1464 bp, Artificial Sequence
  Description of Artificial Sequence: Synthetic coding sequence
atggccgagtacacccggctgcacaacgccctggccctgatccggctgcgcaatccccccgtcaacgccatcagcacgaccctcctgagggacattaaggaaggcctgcagaaagccgtcattgaccacacgatcaaggccatcgtaatctgtggggccgaaggcaagttttccgccggtgcagacatccgaggattttctgctccacgcaccttcgggctgacattaggtcatgtggtggacgagattcagcggaatgagaagcccgtggtggccgctattcaaggtatggccttcgggggcggcctggaattggcccttgggtgtcattaccggatagctcacgccgaggctcaggttggactgcccgaggtcactttaggactcctccccggcgctcgtggaacgcagctcttaccccgactcacaggggtccctgccgctctcgacctgatcacctcgggcagacggattctcgctgatgaagctctgaagctgggaatactggataaagtcgtgaactccgatccagttgaggaagctattaggtttgcgcagagagtgagcgaccaacccctggaatcccgaaggctgtgtaataagcccatacaatccctgcctaacatggacagcatcttcagtgaagctctgctaaaaatgcgacgccagcatcccggatgcctggctcaagaggcctgcgtccgcgccgtgcaggctgctgtccagtacccctacgaggtcgggatcaaaaaggaggaagagctgtttctgtacctgctgcagtcagggcaagcacgggccctgcaatacgccttctttgccgagcgcaaggccaataaatggtcaactccatctggggccagttggaagactgcttctgcaaggcctgtctcgtcggttggggtggtgggccttgggacaatgggaagggggatcgtgatctctttcgcaagagctaggatcccagtgatcgccgttgatagtgataaaaaccagcttgccactgcaaataagatgattactagcgtcctcgagaaagaggcttccaagatgcagcagagtggtcacccctggagtggacccaagccacggctaactagtagcgtgaaggagctcggcggggtggacctggttatcgaggcggtgtttgaggagatgtctctaaaaaagcaggtgttcgctgagctctccgccgtttgtaagcccgaggcatttttatgtacaaatacaagcgctctggatgtggacgaaattgcttcttcaactgatagaccccacctcgtaattgggacacattttttctcccctgcccatgtcatgaagttgctggaggtgatccctagccagtactccagtcctaccacaatcgccaccgttatgaacttgtctaagaagatcaaaaaaataggagtcgtggtaggcaactactctgtgagtaaaaaaaaaaagaaaaaaaaaaaatag

SEQ ID NO: 186654 - DNA, 6102 bp, Artificial Sequence
  Description of Artificial Sequence: Synthetic coding sequence
atgttcaagggcctgagcaagggcagccagggcaagggcagccccaagggatcccctgctaaaggaagtccgaaaggcagtccaagccgccacagccgggctgccacccaggagctggccctactgatctccagaatgcaagccaatgctgatcaggtggagcgcgacatcctcgaaactcaaaagagactacagcaagatcggctcaattctgaacaaagccaagctctgcagcaccagcaggagacaggccgcagtctaaaggaagcagaagtgctgttgaaggacctctttttggacgtcgacaaggccagacgtctcaaacacccacaagctgaagagattgaaaaagatattaaacagctccatgaacgggtgacccaggaatgcgccgagtaccgggcactctacgaaaaaatggtgctgccacccgacgtgggaccacgcgtggactgggcgcgagtgctcgaacagaagcaaaagcaggtgtgtgctggacagtatggtcctgggatggctgagcttgagcaacagattgccgaacataatatcctccaaaaagagatcgatgcctatgggcagcagctgaggtcactcgtaggaccggatgccgctacaattcgctcacaatatcgggatctgttgaaggctgcaagctggaggggccagagtctagggtctctctacacacacttacaaggctgcacccgccagctttccgcactggctgaacagcagcggaggattctgcagcaggactggagcgatctgatggccgaccccgctggagtacgcagagagtacgagcatttcaagcagcacgaactgctcagccaggagcaatccgtaaatcagctcgaagacgacggtgagaggatggtagagctccgacatcccgcagtgggtccaatacaggcccaccaagaggcactcaagatggaatggcagaacttcctcaatctgtgtatttgtcaggagactcaacttcagcatgtggaagattacagacgctttcaggaggaagctgatagtgtgtctcagaccctggcaaagttgaattccaacctcgatgcgaaatacagcccagcccctgggggaccccccggagccccaactgagcttcttcaacaactggaagccgaagagaagcggctggccgtgacagagagggccaccggcgatttgcaacggagatctagagatgtggcaccccttccccagagaagaaaccctcctcaacagcccctccatgtggactccatttgcgactgggattccggcgaggtccagctgctccagggcgaacgatacaagctggtggacaacacagaccctcatgcatgggtcgtgcagggtccaggcggagagaccaagcgcgccccagctgcatgcttttgcatccccgcacctgaccccgacgccgttgcccgggcctcccgcctcgcctcggagctgcaggccctgaagcagaaactcgccacggtgcagtctcgacttaaggcaagcgcagtagagagtcttcgcccaagtcagcaagcacctagtggcagtgaccttgccaatccgcaggcccagaaattgctgacacagatgacacgtttggatggtgacctcggccagattgagcgacaggtcctggcttgggcacgagccccactgtcaagacccacgccactggaggacctggaggggcggattcattcacacgagggcaccgcacagagactgcagtccctgggtactgagaaagagacagctcagaaggagtgtgaagcatttctgtccaccagaccggtggggcccgccgccctccaattgcccgtggccctcaactcggtgaaaaataaattctctgacgtgcaggtgttatgttccctgtacggggagaaggccaaagcagctcttgatctggagcgccaaattcaggacgcggatcgtgtaatccgagggtttgaagccacactcgtgcaagaagccccaataccggcggaacctggggccctgcaggagcgagtctccgagttacagaggcagaggcgagaactcctggaacaacagacatgtgtgctgaggcttcacagagctctaaaggcctctgaacacgcctgtgctgctcttcaaaataacttccaagagttctgccaggatctgcctaggcaacagaggcaggtacgagctctcaccgataggtatcacgcggtgggtgaccaactggatctgagggaaaaagtagtccaggatgccgccctcacttaccaacagttcaaaaactgcaaagacaacctgtcctcctggttggagcatctcccaaggtctcaagtcaggccgagcgacggtccctcccagatagcctataagctccaggcacaaaaacggctcacccaggaaatccagagtcgagaacgtgacagggctaccgcaagtcatctttcacaggcactgcaggccgcactgcaggactatgagttgcaggctgacacttatcggtgcagcttagagcccacactagctgtgagcgcgcccaagcgaccgagggttgccccgctgcaggagtcaatacaagcccaggaaaaaaacctcgccaaggcatacaccgaggtggccgcggcccagcagcagctcctgcagcagctagaattcgctagaaagatgctggaaaaaaaagagttaagcgaggacatcagacgtacgcacgatgctaagcagggaagcgagtccccggcccaggccggacgtgaatctgaggcgctgaaagcccagctggaagaggagaggaagagagtggcccgcgtgcagcatgagctggaggctcagagaagtcaactactgcagcttaggactcagcggcccctggaacggttggaggaaaaggaagtagtcgaattttatagggacccacagttggagggctccctgtctcgagtcaaagcacaggtggaggaggagggaaagcggcgcgctggcctgcaggcggacctggaagtggcagcgcaaaaggttgtgcagttagagagcaagcgcaagaccatgcagcctcacctgctcacaaaggaagttacccaggtggagcgtgaccccgggctggattcacaggccgcgcaattacggatccagatccagcagctccgtggtgaagacgctgtgatttccgcccgcctggaaggcctcaaaaaggagctgttagccctggagaaaagggaagtggacgttaaggaaaaggtagtggtgaaagaagtagtaaaggtagagaaaaatctggagatggtgaaggcagcccaggccctccgattgcagatggaggaagacgccgcacgtcgtaaacaggcagaagaggcggtagccaagctacaggcgcgaatcgaggatctggagagagccatctccagcgtggaacctaaggtgatcgtcaaggaagtgaaaaaggtggaacaggaccctggcctgctacaggagagctctagactaagatccttgctggaggaggagcggaccaagaatgcaacgctggctcgtgagctcagtgatctgcactccaaatattccgtggtcgaaaaacagcgcccaaaggtgcaactccaagagagagtgcacgagatattccaggtcgaccctgaaacagaacaggagatcactcgccttaaagccaagctgcaagagatggctggtaagaggagcggggtagaaaaagaggttgagaaactgctgccggatctggaggtcttaagagcacagaagcccactgttgagtacaaagaggtgacccaagaggtcgtgaggcatgagcgtagcccggaagtccttcgggagatcgatcgcctgaaagcacagctgaatgagctggtcaacagccatggcaggtcacaggagcagctaatccgcctccagggggaacgcgatgaatggcgtcgcgaaagagccaaagtcgaaacaaagaccgtatccaaagaagtggtgagacatgaaaaggatccggttctcgaaaaggaggcggagaggctacgccaggaagttagggaggctgcgcagaagcggcgggccgctgaggacgccgtgtacgagctacaatctaaacgtctcctgctggagaggcggaagcctgaagagaaggtggtcgtccaggaggtagtcgtgactcagaaagaccccaagttacgggaggagcacagccgcttaagtgggagcttggatgaggaagtcggccggaggcgccagttagaacttgaggtccagcagttacgagccggggtggaggaacaggagggccttctctcgttccaggaggatcgttccaaaaaacttgcagtggaacgagagttgcgtcagctgaccctccgtatccaggaactggaaaaaaggccacccaccgtccaagaaaaaataattatggaggaagttgtgaaactggagaaagatcccgacctggaaaaaagtacggaagccctgcgatgggaccttgaccaggaaaagacccaggtgaccgaacttaatcgcgaatgtaaaaatctgcaggtgcaaattgacgttctgcaaaaggccaagtcccaggaaaagacaatctacaaagaggtcatccgggtgcagaaagatcgagtgttggaagatgagcgggcacgggtgtgggagatgctcaatagagaaagaaccgctcggcaggccagggaagaagaggcaagacgactacgagaaagaatcgaccgcgctgaaactcttggacgaacatggtcaagagaggaatccgaactgcaacgcgcgcgagaccaggccgaccaggagtgcggtcggctgcagcaggaactcagagctttagagcgtcagaagcaacaacaaacacttcagctccaggaagaatccaagctgcttagccagaagacagaatcagagagacagaaggccgcccagcggggccaggaactgtcaagattggaagccgccatcctgcgcgagaaggaccaaatatatgaaaaagagcggactcttagggatctgcatgctaaggtgtcccgagaggaattaagccaggaaacccagacccgcgaaactaacctcagcaccaagatctctattctagaaccggaaacaggtaaggacatgtccccgtatgaggcgtacaaacgcggcataatcgacagggggcagtatttacagctgcaggaactggaatgtgactgggaggaagtgactacaagcggtccgtgcggagaggagtcagtgttgttggataggaagtccgggaagcagtactccatcgaagctgccctgcgctgtcggcgcatttcaaaggaggaataccacctatacaaggacgggcacctgcctattagcgagtttgccttgttggttgccggggagacaaagcctagtagctctctttccatcggctccatcattagcaaaagcccattggcctcaccagcgcctcagagcacctctttctttagcccaagcttttcccttggcctgggtgatgactccttcccaatcgctgggatttatgataccacgacagacaataaatgttccatcaagaccgctgtcgccaagaacatgctggaccccatcacagggcagaagctcctggaggctcaggccgcaactggcggcattgtcgatttgttgagccgcgagagatatagtgtgcacaaagccatggaacgcggactgatcgagaatacgtcgacacagcgcttgttgaatgcacaaaaagcctttacaggcatcgaagatcctgtgaccaagaagagacttagtgtgggagaggcagttcagaagggatggatgccccgagagtctgttttaccccatctgcaggtgcagcatctcacgggtggcctcattgaccccaagcgaacgggacgcattcccattcagcaggcgctattgtccggtatgattagcgaggagctggcacagctgctccaggacgagtccagctacgaaaaggacctaacagatcctatctcgaaagagcgactctcctataaggaagcaatgggaagatgtagaaaggatcccctctcggggctcctgctgctccctgccgctctagaaggctatcgctgctaccgctcagcgtccccaactgtgccgagatcactgaggtag

SEQ ID NO: 186655 - DNA, 2061 bp, Artificial Sequence
  Description of Artificial Sequence: Synthetic coding sequence
atgcagctgggcgagcagctgctggtgagcagcgtgaacctgcccggagcacatttctatcccctcgaatccgctcgtggaggcagtggcgggtccgcaggtcatctgcctagcgcggccccatccccacagaagctggacctcgacaaggccagcaaaaagttttctggatctttgagctgtgaggccgtatcgggagagcctgcggccgcgagcgcaggagcacccgcggcaatgctgtcagataccgatgccggcgatgctttcgcttccgcagccgcagtagccaaacccgggccccccgacggaaggaaaggcagtccttgtggcgaggaggagttgccgtcagctgcggccgctgccgccgcagctgcagccgcagctgcagccacagccagatacagcatggattccctctcttctgagcggtactacctgcaatcgccaggaccgcaggggagtgaactggccgctccttgctccttgttcccctaccaggcagcggcaggtgcccctcacggccccgtgtaccctgcccccaacggcgccaggtacccatatggatctatgctccctccaggtgggtttccagccgcggtgtgtccaccaggtcgagcccagtttggaccgggcgccggagccgggtccggggccgggggatcttctggggggggggggggacctggtacataccagtactcacagggcgcacccctgtatggcccctacccaggtgcggcagctgcgggaagctgcggaggcctgggcgggttgggcgttcctgggagcggtttcagagcacatgtctatctctgtaatagacccctgtggcttaaattccatagacatcagacagagatgatcatcacaaagcaaggtagacgcatgtttccgtttctgtccttcaatatcaacggccttaaccctactgctcattacaacgttttcgtcgaggtcgtactcgccgacccaaatcactggcgctttcagggaggcaagtgggtgacatgtggaaaggctgataacaatatgcagggaaacaaaatgtacgtgcatcccgagagccctaataccgggtctcactggatgaggcaggagatttcctttggtaagttgaagctgacgaacaataaaggcgccaacaataacaatactcaaatgattgtgttgcagtccctgcacaagtaccagcccagacttcacattgtcgaagtaaccgaagacggtgtggaggacctgaatgagccctccaaaactcaaacctttacattttccgaaacgcaattcatcgctgtcacggcctaccagaatacagacatcactcagctgaagatcgaccacaacccgtttgctaagggattccgagataactatgactcctctcaccagattgtgcctgggggacgatacggcgtgcagtctttttttcctgaaccttttgtcaataccttgcctcaggctaggtactataatggggagcggaccgtccctcaaacaaatggactgctgagcccacagcaaagcgaagaggtggctaaccccccacagcgctggctcgttacccccgtgcaacaaccggggacaaataaactggatatatcaagttacgagagcgaatatacatcatccacactgttgccctacggaatcaagtcactccctctgcagacctcccatgcgcttggctactatcctgaccccactttccccgccatggccgggtggggaggtcgtggctcttatcagaggaagatggctgctggcttgccatggacctctcggacctcccccacggtgttttctgaggatcaactgtccaaagaaaaggtcaaagaagaaataggatctagctggatcgagaccccaccctccatcaagtccctagacagcaatgattctggggtttacacctccgcttgcaagcgaagaaggctgtcgccatctaattcgtctaatgagaactcccccagcatcaaatgtgaggacatcaatgctgaagaatattccaaggacacttctaaggggatgggaggttattatgcgttttatacaacaccctag

SEQ ID NO: 186656 - DNA, 2118 bp, Artificial Sequence
  Description of Artificial Sequence: Synthetic coding sequence
atgcagctgggcgagcagctgctggtgagcagcgtgaacctgcccggcgcacacttctaccctctggagagtgctagaggtggtagtgggggaagcgccggacacctcccaagcgcggctccctcaccacagaaactggacctcgacaaagcttccaagaagttctccggttctctgagctgcgaggccgtctccggtgaacctgccgccgcctctgccggggcacctgcggctatgttgtccgatactgacgctggcgacgcatttgcctcagctgcggcagtggccaaaccaggccctcctgatggccgcaaggggtccccttgcggtgaggaggagttaccctcagcagcagctgccgccgcagctgctgctgctgccgccgccgcaacggctcgttattctatggattctttatcatcagaacgctattatcttcagagtccaggtccccaagggtcagaactggccgctccttgcagcctcttcccctatcaggcagccgccggagcccctcacgggcccgtgtacccagcccctaacggtgccagatacccgtacgggtccatgttaccacccggcggatttcctgctgccgtttgtccccccggtcgggctcagttcggacccggagcgggggcagggtcgggcgctggcggcagctccggtggcggcgggggccccgggacttaccagtactctcagggtgcgccgctctacgggccctaccctggggcggctgcagccggttcctgtggtggtctggggggactgggtgtgccaggctccggatttcgcgcacatgtgtacctgtgcaacagaccgctgtggctaaagtttcacagacaccagaccgagatgatcatcacaaagcaaggcaggcggatgtttcctttcctaagcttcaatattaacgggctcaaccccactgcccattataacgtcttcgtagaggtagttttagcagatcccaatcactggcggtttcagggaggaaaatgggttacgtgcggcaaagcagacaacaacatgcagggcaataaaatgtacgtgcacccggagtcccctaacaccgggtcgcattggatgcgccaggaaatatcgttcggaaagcttaaattaaccaataataagggtgcaaataacaataatactcagatgatcgtccttcagtcacttcataaataccagcctaggctccacattgtcgaggtgacagaggacggggtcgaagacctgaatgaaccttcaaagacccaaacttttacatttagcgagactcagtttatcgcggtcacggcttaccagaatacagacattacacaattgaaaatagatcacaatccctttgcaaagggtttccgggacaattatgattctatgtacacagcctccgaaaacgaccgcctgacaccctcccccacggattccccgcggagccatcagattgtgccaggcggccggtacggtgtccagtcgttctttcccgagccattcgttaacaccctgccacaagcccgttactataatggggaacgaactgttccccaaaccaacggtttactgtcaccacagcagtcagaggaggtcgccaaccctcctcaacgctggctggtcacacctgtacagcagcctggcacaaacaaactcgatatcagcagctatgaaagcgagtacacaagcagcacactgctcccttacggcatcaagtctctgcccctgcagactagccatgctctaggatattaccccgacccaacatttccggctatggccggatgggggggccggggcagctatcagaggaagatggctgctggcctgccatggacctcaaggacatccccaactgtgttctcagaagaccagctgtcaaaggagaaagtgaaagaagagatcggttcatcttggattgagacacccccatcgattaaaagcctggactccaatgattctggcgtgtacacctccgcgtgtaagcgtcgcaggttgtcgccttctaatagctcaaatgaaaactccccctctattaaatgcgaggacatcaatgcggaggaatactccaaggatacttccaaaggcatgggcgggtattatgcattttacaccacaccttag

SEQ ID NO: 186657 - DNA, 1713 bp, Artificial Sequence
  Description of Artificial Sequence: Synthetic coding sequence
atggacagcctgagcagcgagcggtactacctgcagagccccggcccacagggatccgaactggctgcaccttgcagcctgtttccttatcaagctgccgcaggcgctccacacggccccgtataccccgcccctaacggcgccaggtatccttacgggtccatgctgcctcctggcggcttcccagctgcggtctgtccccccgggagggctcagtttggacccggggctggcgcagggagtggagctggagggagttctggagggggtggcgggcccggaacctatcagtactcgcaaggtgcgcctctgtatggtccctaccctggtgccgccgccgctgggtcctgcggcggactcggagggctgggcgtaccaggctctgggttccgagctcacgtgtatctttgtaatcggccattatggctgaagtttcatcgccaccagacagagatgattattacaaagcaaggacgacgcatgttccccttcctctctttcaatataaatggcttgaacccaaccgcccactacaacgtcttcgtggaggtggtgctcgcagatcccaaccattggaggttccaaggaggaaagtgggtcacctgtggtaaggccgacaataatatgcagggaaataagatgtatgttcaccccgagtcaccaaacactggctcccattggatgcgacaggagatttcattcggaaagctcaaactgaccaataataaaggggcaaacaacaataacacacagatgatcgtgttacagagtttacataaataccagcctcggcttcacattgttgaggtgaccgaggacggcgtggaagatttgaacgagccctccaaaacccagactttcacgttctccgaaacccagttcatcgcggtgaccgcttaccaaaatacggacattacgcagctgaaaatagaccacaatccctttgcaaaaggctttagagataactacgacagtatgtatactgcatccgagaacgacaggctgacccccagcccaaccgactcccctagatcccatcaaattgtaccaggcgggagatatggcgtccagagctttttccctgaaccatttgttaataccttgccacaggccagatactacaacggagaacgtacagtcccgcagactaacgggctgctgtcacctcagcagtctgaggaggttgccaatcccccccagagatggctggttacacccgtccagcagccaggtacaaacaagctcgacattagtagctatgagtcagagtatactagttctaccctccttccctacggaatcaagagtcttccactacagaccagtcatgctctgggctattatccggatcctacctttcctgccatggcgggttggggaggccgcggttcttatcagcgcaagatggcggcaggtctgccatggacgagcaggacttcacccaccgtgttttcagaagaccagctgagtaaagaaaaggtcaaagaagaaattggttcctcgtggatagagactccccccagtattaaatccctcgattctaacgatagtggagtgtacacctcagcatgcaagcggaggaggctcagcccaagcaactcctctaacgagaacagtccctcaatcaaatgtgaggacataaacgccgaggaatactccaaggacacctcgaagggaatgggaggatactatgcattctatacaactccgtag

SEQ ID NO: 186658 - DNA, 1233 bp, Artificial Sequence
  Description of Artificial Sequence: Synthetic coding sequence
atgttccccttcctgagcttcaacatcaacggcctgaaccccaccgcacactataatgtgttcgtggaggtggtgctagctgatcctaaccactggaggtttcaaggcggcaagtgggttacatgcggcaaggccgacaacaacatgcaagggaacaaaatgtatgtgcatccggagagtcctaataccgggagccattggatgcgtcaggagatatcattcggtaagttaaaattgaccaacaataaaggcgctaataataataacacccaaatgatcgtcctgcaatccctgcacaaatatcagccacggctgcacattgtggaggtgaccgaagatggagttgaggatttgaacgaaccctcaaagacgcaaacatttacctttagcgaaacacagtttatcgccgtcaccgcctaccagaatactgacatcacacagcttaagatcgatcataacccattcgcaaagggcttcagggataattatgactctatgtacaccgccagcgagaatgaccggctgacaccaagtcctacagatagtccacggtctcatcagatcgtccctggtgggcgatacggagtgcaatccttcttccctgaacccttcgtgaatacactgccccaagcgaggtattataacggagagcggacagtaccgcaaaccaacgggttgctgagccctcagcaaagtgaggaggtggccaaccccccacagaggtggcttgtgaccccagttcagcagcccgggaccaacaagcttgacatttcctcatacgagtcagaatatacctcctcgactttgctaccttatggaataaaatccttgccactgcagacgtcccatgccctcgggtattaccctgaccccacctttcctgctatggcaggatggggcgggagaggcagctatcagcgcaagatggcagccggattaccttggacgtccagaacaagcccaacggttttttccgaggatcagctctcgaaagagaaggtgaaggaagagattggaagcagctggatagaaacacccccaagtattaaaagtttagattccaacgactccggcgtgtatacctctgcttgcaaaagaagaaggctttcaccctccaacagctcgaatgagaactctccctccattaagtgcgaagacatcaatgccgaggagtatagcaaagatacatcgaaaggcatgggcgggtattacgccttctacacgactccctag

SEQ ID NO: 186659 - DNA, 1269 bp, Artificial Sequence
  Description of Artificial Sequence: Synthetic coding sequence
atgggccaggccggctgcaagggcctgtgcctgagcctgttcgactataagacagagaaatacgtaattgcaaagaataaaaaagtagggctactgtatagactgttgcaggcctctattctggcttacttagtggtgtgggtctttcttatcaaaaaaggttatcaagatgtagacacaagtttacagtccgccgtaatcacaaaggtgaaaggagttgccttcactaacacttccgatttaggccagcggatctgggatgtggctgattacgtcattccggctcaaggggagaatgtgttcttcgtggtaaccaatctgatcgtgacacctaaccagcgtcaaaatgtatgcgcggaaaacgaaggcattccagatggcgcttgttccaaggattctgattgtcatgcgggtgaagccgtcaccgccgggaatggcgtgaaaactggacgttgcctcaggcgggagaatctcgcaagaggtacatgcgagatctttgcctggtgccctctggagacgagcagtcgccctgaagagcctttcctcaaagaggcagaagactttacgatcttcattaaaaaccacatcaggtttccgaagttcaactttagcaaatccaacgtcatggacgtgaaagaccgcagttttctgaagagctgccacttcgggcccaagaaccattattgtccaatttttcgactggggtccgtcatccgctgggcgggctctgattttcaggacattgctctcgaaggaggggtgattgggatcaacatcgaatggaactgtgaccttgacaaggcagcatccgagtgtcacccacactactccttctcacggttggataataaactgagcaagtcagtgtctagcggctacaacttcagatttgcaagatactaccgcgatgccgccggggtggagtttaggaccctgatgaaagcatatggcatcaggttcgatgttatggttaatggcaagggcgctttcttttgcgacctggttcttatttacctgattaagaagagggaattctatcgggacaaaaagtatgaggaagttcgtggcctggaagatagctcccaggaggccgaagatgaagcctccggtctcgggttgagcgagcaactcaccagcggccccggactgcttgggatgccagagcaacaggagctgcaagaacctccggaggcaaagcggggcagctcaagccaaaaagggaacggatcagtgtgtccccagctcctggagcctcatcggtctacatag

SEQ ID NO: 186660 - DNA, 564 bp, Artificial Sequence
  Description of Artificial Sequence: Synthetic coding sequence
atgagcgagatggccgagctgagcgagctgtacgaggagagcagcgacctgcaaatggatgttatgcctggcgaaggcgatctcccacagatggaggtgggatcaggtagtagagaattgtccttgcgaccttctcgcagcggagctcagcagttggaggaggaggggccaatggaggaagaagaagcccagcctatggctgccccagagggtaagcggtcgctggctaacggcccgaacgccggcgagcaacctggacaggtagcaggagctgacttcgagagcgaagatgaaggcgaagagtttgatgactgggaggacgactacgactatccagaagaggaacagctcagcggagctgggtacagggtaagcgccgccctcgaggaagctgacaaaatgtttcttcgtaccagagagcctgcattggatggcggtttccagatgcactacgagaagacaccattcgaccagctggcctttatcgaagaactgtttagcctcatggtcgttaaccgtttaaccgaggaactgggctgcgatgaaatcatcgaccgcgagtag

SEQ ID NO: 186661 - DNA, 711 bp, Artificial Sequence
  Description of Artificial Sequence: Synthetic coding sequence
atgagcaagctgcccgccgacagcagcgtgccccagaccggcgccgccaatggagatcgcgatgtgcctcaggctgaggtaggcagaggacgtagagagcctgcccccgcacaaccggaggaggccggagagggtgcgatggccgccgcccgcggagggcctgttccggctgctagagagggacgcatggctgctgctcgcgcagctcccgccgccgcggcaaggggcgcacctgtggcagccgcggcccttgcacgggccgcggctgccgggcgggagtctcctgctgctgctgcagcacgggaggcccgcatggcagaagttgcacggctcctcggagagccggttgacgaggagggcccagagggaaggccccggagccgccatggcaatggggggctcgccgctctgccctatcttcgcctccggcacccattatctgtgctggggataaattatcagcaatttctgcgtcactatctcgagaactaccccatcgcacccggtagaatccaagagttagaggagaggcggcggagattcgtggaagcatgcagggccagagaggccgcgtttgacgcagagtatcagagaaacccgcatagagtcgatttagacattttgacttttaccatagcgttgactgccagcgaggtaataaatccactgattgaggaattgggctgcgataaattcattaatcgggagtag

SEQ ID NO: 186662 - DNA, 564 bp, Artificial Sequence
  Description of Artificial Sequence: Synthetic coding sequence
atgagcaagctgcccgccgacagcagcgtgccccagaccggcgccgctaacggtgaccgagatgtgccgcaggccgaggtcggtagaggcagacgagagcctgctccagcacaacccgaggaggctggggaaagccctgccgcggccgcagcccgcgaggcccgaatggctgaggtggcacggctgctgggggagcccgtggacgaagaaggccctgaaggtaggccccgcagccggcacgggaatggaggcctggcagcactaccctatttaagattgcggcaccccctcagcgttctgggcattaactatcagcagttccttcgccactacctcgagaattatcctattgcacccggaaggattcaagagcttgaggaaaggcgccgtcgctttgtcgaggcttgcagagcacgcgaggccgctttcgacgctgaatatcagagaaatcctcatcgggtggacctcgatatcctcacattcactatcgctctcaccgcttctgaagttatcaatcctctgatcgaggagcttggatgcgacaagttcatcaatcgcgagtag

SEQ ID NO: 186663 - DNA, 1002 bp, Artificial Sequence
  Description of Artificial Sequence: Synthetic coding sequence
atgaagatggacgtgagcgtgcgggccgccggctgcagcgacgacctgtcttccggtgaggcagatgtagatccaaagctgctggagttaacagcggacgaagagaaatgcaggagcatcagacgacagtacaggcagttgatgtactgcgtccgccagaatcgggaggatatcgtgagctctgcgaacaactcattgaccgaggccctggaagaagccaatgtgctctttgacggagtcagccgcacaagagaagccgccctagacgcacgcttcctggttatggcgtccgacctcggcaaagaaaaggcaaaacagctgaattcagatatgaatttctttaaccaactggctttttgtgacttcctctttttgttcgtgggtctgaactggatggagggcgacccagataagctctctgattgtgacgactcaattgctctttccttctggaaagccattgaaaaggaggcaacaagctggatggttaaagccgagacctttcactttgtgttcggttcatttaaactggagcgatctgcgccaaaaccgaggctggagcaccagaaaaaggtacgtaagatggaggagaacggcaacatgccaacgaaactgcaaaagcttgatctgagctcatacccagaggcaacagaaaagaacgtcgagagaatattagggctgttgcagacctactttagaaagtacccagatacacctgtctcttattttgagtttgtgatcgacccaaacagcttctcacggacggtcgagaacattttttacgtctcgtttattgtgagggatggattcgctcgtattcgcttagatgaagacaggctgccgattctcgagccaatgaacgttaaccagatgggggagggaaatgacagttcatgtcatggacgcaagcagggtgtaattagtctaacccttcaggagtggaagaatatagtggcagcgtttgagatttcagaggccatgattacatactcctcatactag

SEQ ID NO: 186664 - DNA, 2931 bp, Artificial Sequence
  Description of Artificial Sequence: Synthetic coding sequence
atggagcggcggtggcccctgggcctgggcctggtgctgctgctgtgcgctcctctcccccccggggctagggccaaggaggttacactgatggataccagtaaggcacaaggggagctgggctggctgttggacccacctaaagacggctggtcagaacaacagcagatcctgaacggaaccccgctgtatatgtaccaagactgtcctatgcaagggcgcagggataccgaccactggctgcgcagtaactggatctaccggggcgaagaggcatcacgggtgcacgtggagctgcagtttaccgtccgtgattgcaaatcatttcctggaggggctggaccgctcgggtgtaaagaaacatttaacctgttgtacatggagagcgatcaggacgttggaatccagctcaggcgcccattgtttcaaaaggttacgactgtcgccgccgaccagagctttactataagagaccttgtctcagggtctgtgaagctgaatgtggaaagatgcagcctggggcggctcacaagaaggggcctatatcttgcttttcacaatcctggcgcatgtgtcgcactcgtctccgtgcgggtcttttaccagagatgcccagaaactctcaacggactagcacagtttcccgacactctgcccggcccagccggtttagttgaggtggcgggcacatgtttgccccatgcaagggcctcccccagacccagcggggcccctcgtatgcattgcagtcctgacggggaatggctggtgccagtcggcaggtgtcactgtgaacctgggtatgaagagggcggcagtggtgaggcatgtgttgcttgcccatccggctcttaccggatggacatggatacaccacactgtttgacctgtccacaacagtccactgcagagagcgaaggggccactatctgtacgtgtgagagcggccactaccgcgcaccaggagagggcccccaggtcgcctgtaccggaccaccctctgctcctcgtaacttatctttttccgcaagcggaacccaactgtcactgcgctgggaacctccggccgataccggaggacgccaagatgtccgctacagtgttagatgctcccagtgtcaggggacggcacaggacggggggccatgtcaaccctgtggagtgggagtccatttctccccaggggccagagggttaacaactcccgcagtgcacgtgaacgggttggagccatacgccaattacaccttcaacgtggaagcacagaatggagtcagtggtctgggctcttctggacacgcatcaactagcgtgtctatttcaatggggcacgcggagtccctgtcaggactgtcactgcgactggtgaaaaaggagccccggcaacttgagttgacgtgggcagggagccgacctcggtcccccggcgctaacctgacctacgagctgcacgtgctgaatcaggacgaagaacgatatcagatggtgctggagcctcgcgttttgcttacagaactccagccggatactacatacatagtgcgcgtgcgcatgctgacaccactggggcccggtcccttctcccctgaccacgaatttcgcacctcacccccagtctccagaggactgacaggaggggagatcgtggctgtaattttcggcttattgctgggtgctgcactgctactgggaatacttgtcttccgctcccgtcgagcgcaacgacaacgtcagcagcgccagagggacagggccaccgacgtggaccgagaggacaagctgtggctgaagccctatgttgacctgcaggcctacgaggaccccgcacagggggccctagatttcaccagggaactggaccccgcctggctgatggtggacacagttattggagaaggagagttcggcgaggtctacagaggcacccttcgtctcccttcccaagattgtaaaacggttgccatcaagaccctgaaggatacatctccaggtggccagtggtggaacttcctgcgggaagcgactatcatggggcagttctcccacccccacattcttcacttggaaggtgtcgttactaagagaaagcctatcatgatcatcactgaattcatggaaaacggagccctggacgctttcctgcgggagcgagaggatcagcttgttcctggccagctggttgccatgttgcagggcatagcatctggtatgaactacttgtccaatcacaattacgtccaccgagacctagccgcacgaaacatcttggtcaaccagaatctgtgttgcaaagtctcggacttcggcctgacccgcctcctagatgacttcgatggaacatacgagacacagggtggcaagattcccattagatggaccgcccctgaggccatcgcccacaggattttcaccaccgccagcgacgtatggtcctttggtatagtaatgtgggaggttctgtcatttggtgataaaccttacggagagatgagcaatcaggaagtcatgaaatccattgaggacggatacaggttaccccccccagtcgattgccccgctcctttgtacgaactgatgaagaactgttgggcctacgatcgggctaggaggccgcacttccagaagctgcaggcccacttggaacagctgctggccaacccacactcgctgcgcacaatcgctaacttcgaccctcggatgacactcaggctgcccagcctgagcggatcagatggaattccgtaccgcacagtgtcagagtggcttgaaagcatcagaatgaaaaggtatatcctgcacttccattccgccgggttggatacgatggagtgtgtcctggaactcacagccgaggacttaacacagatgggaatcaccttgcctggtcaccagaagcgcatcctctgctccattcagggattcaaggactag

SEQ ID NO: 186665 - DNA, 888 bp, Artificial Sequence
  Description of Artificial Sequence: Synthetic coding sequence
atggagacctgcgccggcccccaccccctgcggctgttcctgtgcagaatgcagctctgtctcgccctgttgctaggaccatggcgtcccggcaccgctgaggaagtgattctgttggattctaaagcctcacaggccgagcttgggtggactgctttgccctccaacggctgggaggaaatatctggggtggatgagcacgatagaccaatccggacctatcaggtgtgcaacgttctcgaacctaaccaagacaattggttgcagactggctggatctcaagaggcagaggccagagaatttttgtggaactgcaatttaccttgagggattgtagcagcattcccggcgcagccggtacgtgtaaggagacttttaacgtttactatctggaaacagaagctgatcttggccgcggacggcctcgccttggcggctctcgccctcgcaaaatagatactatcgcagccgacgaaagttttacccagggagacctgggtgagagaaagatgaagttgaacactgaggtaagagaaatcgggcctctcagtcgccgcggattccacctcgcttttcaagatgtgggcgcctgcgtagccctggtgagcgtcagagtttactacaagcagtgtagggccacagtgagagggttggccacatttcccgcaacagccgctgaaagtgcattctctacacttgtggaagtggccgggacatgcgtggcacactccgaaggcgagccagggtctcctcctcgcatgcattgtggagccgacggagaatggctggttcccgtgggtcgctgctcttgtagcgctgggttccaggagcgcggagacttttgcgagggcattcagctggcgggaggcaggggcgttggtgtgtag

SEQ ID NO: 186666 - DNA, 1632 bp, Artificial Sequence
  Description of Artificial Sequence: Synthetic coding sequence
atggtgaagaccggcgcccccaccgtgaccgtgaccaacctgaagccagcgactcggtatgtctttcaaatcagggctgcatctcccggcccatcttgggaagctcagagcttcaaccccagcatcgaagttcagacgctgggggaggctgcttcaggcagccgcgaccagtctcctgctatcgtcgtgactgtcgtcactatttctgcattgctggtgctcggatcagttatgagcgttctcgcaatctggagaaggccatgctcctacgggaagggtgggggggatgcccacgacgaggaggagctttactttcatttcaaagtacccactcggagaacctttttggacccacaaagctgcggggatctgcttcaggccgtccatctttttgccaaggagctggacgcaaagagcgttactctggagcggagcttaggggggggccggttcggcgagttatgctgcggatgtctgcagctccctgggagacaggaactacttgttgctgtgcacatgctgagagacagcgctagcgattcccagaggttgggatttcttgctgaagcgctcaccttgggacagttcgaccacagtcacattgtccggctggaaggggtggtgacccgcgggtccacgctgatgatagtcaccgagtacatgtcccacggagcacttgacggatttctaaggcgtcacgagggtcagctggttgccggccagctaatggggctgctgcccgggctggcgagtgctatgaagtatttgagtgagatggggtacgttcaccgtggactagccgccagacacgttttagttagctcggacctggtgtgtaaaatcagtggcttcgggcggggccctcgggaccgttcagaagcagtgtatacaactatgtctggccgctctcccgcactttgggccgcacccgaaacactccaattcggtcacttcagttctgcttcagacgtctggtcgttcggaataatcatgtgggaggtcatggcctttggcgaaagaccttactgggacatgtccgggcaagatgttataaaggccgtggaggacggcttccgcctgccgcctcctcggaactgccctaatctccttcaccgcttgatgctggactgttggcagaaggatccaggagagcgaccaagattctcgcaaatccactccatattaagcaagatggtacaggacccagagccgccgaaatgcgctctgacaacctgtcccagaccaccgactcccttggccgatcgggcattttcaacctttcctagcttcggctccgtgggtgcttggttggaggcactggacctatgtcgatacaaggacagcttcgctgcagccgggtatgggagcttagaggcagtggccgaaatgacagctcaggatctcgtctctctcgggatctctttagcggagcatagggaggccctgctgtctggaatctccgccctgcaggcccgagttttgcagctgcaggggcaaggagtgcaggataacaagaatctcagtgtgatctggtgcttgtttgaatggcagttgctggatcactgcattgccggcgtggagggcctcctgccaccaagttcgcggacgggagtatctcggatttgcgtgtag

SEQ ID NO: 186667 - DNA, 3027 bp, Artificial Sequence
  Description of Artificial Sequence: Synthetic coding sequence
atggagacctgcgccggcccccaccccctgcggctgttcctgtgccgcatgcagctatgtctggctcttctattggggccttggcgccccggtacagccgaagaggttatcctcctcgatagtaaggcaagtcaagccgagctgggttggacagcgctcccatccaatggctgggaagaaatcagtggggtcgatgaacacgaccggccgattagaacatatcaggtgtgtaacgttctcgagcccaaccaggacaactggctgcagactgggtggatttcccggggcagaggtcagcggattttcgtcgagctgcaatttacactgagagattgcagttcaatacccggcgcagccggaacgtgcaaggagactttcaacgtgtactatctcgaaactgaagccgatctgggacggggccgtcctaggctcggcggatctcgccctcgaaaaattgatactatcgccgcagatgagtcctttacccagggggacctgggtgaacggaagatgaagttgaataccgaggtgcgggagattggtcccctcagccgtcgtggatttcatttagcttttcaggatgtgggtgcttgtgtcgcgctggttagcgtgcgagtctattataaacagtgccgggcgactgtccgtggcctcgccacttttcccgcaaccgccgctgagtcagcgttttcaaccctcgtcgaggtcgctggaacttgcgtggcccactccgagggcgaaccagggtcccccccaaggatgcactgcggcgccgacggagagtggttggtacccgttgggcgctgtagctgttcagccggcttccaggagcgaggagacttctgtgaggcatgcccccctggattttataaagtgagcccacggcgccctctgtgcagcccatgcccagaacactcaagggccctcgagaacgcaagcacgttctgtgtctgccaagattcctatgcccgctcgcccaccgaccctcctagcgcatcctgcacacgccccccctctgcccctcgggacctgcaatatagtctcagccggtctccactggttctgcgactgaggtggctgccacctgcggactccggtgggcggtctgatgtaacctatagcctgttgtgcctgaggtgcgggcgcgagggccctgccggtgcatgtgaaccctgtggccctcgcgttgcattccttcctcggcaggccggcctccgcgagagagccgctacgctgctccacctgcgcccgggggctcggtatacagttagagttgccgctctgaatggggtgtcgggcccagcagccgctgcggggacgacgtacgctcaggttacagtgagtacaggtcctggcgccccctgggaagaagatgagatccgcagggaccgcgtagaacctcaatctgtgagcctctcttggagagaaccaatcccggctggcgcccctggggcaaatgacacagagtacgaaattcgatattacgaaaagggacagtccgagcagacttattctatggtgaaaaccggcgcccccacggtgaccgtcacaaatctgaaaccagccaccaggtatgtgttccaaatccgcgccgcttctcccggcccttcctgggaggctcagagctttaatcccagtattgaagtgcagaccctgggcgaagcagcttctgggtctcgcgatcaaagccccgccatagtagttactgtggtgaccatctctgcgctgctggtcctgggtagtgttatgtccgttttagcaatttggagaaggccatgtagctacgggaaggggggcggtgatgcccatgatgaagaggaactgtattttcacttcaaggttcccactagacgcacattcctggatcctcagtcatgtggtgacttactgcaagcggtgcacctgttcgcgaaggagctggatgcaaaaagcgtaacgcttgaaaggtctctcggaggaggtcggttcggagagttatgctgcggctgtcttcagctgccgggtagacaggaacttctcgtggcagttcacatgctccgggattcagccagcgattcccagagactgggctttttggctgaagctcttacgctcggacagtttgaccacagccacatagtacgcctggaaggggtggtaacacggggtagcactctgatgatcgtcacggaatacatgtcacacggcgcgctagatggtttcctccggcggcacgagggacagctggtcgccggccagctgatgggactcttgcccggtctggcctctgccatgaaatacctatccgagatgggatacgtccaccggggcttggccgcgcgccacgtgctcgtgtcttccgacctcgtttgtaagatcagcggttttggacgaggacctcgtgatcgatctgaggccgtgtacactactatgagtggaagaagtcccgccttatgggcagccccagagacacttcaatttggtcatttttcttccgcaagcgatgtatggagcttcggcattatcatgtgggaagttatggcatttggagaacggccttactgggacatgtcaggccaggacgtcatcaaggctgtggaggacggatttagactcccaccaccaaggaactgccccaacttactgcaccggctcatgctcgactgctggcagaaggacccaggtgagagacctagattttcccagattcatagtatcctgagcaagatggttcaggaccctgagccacctaagtgcgctttgactacgtgcccccggccccctactcccctggccgatagggccttttccactttcccatcattcggctccgtcggcgcatggctcgaggccttggatctttgtaggtataaagactcctttgcagcagccgggtacggctctttggaggccgtcgctgagatgaccgcgcaggacctggtatctctggggatttcgctcgccgaacatcgcgaggccttgctgtccgggattagcgcactgcaggcccgcgtcttgcaactacagggacaaggcgtccaggtatag

SEQ ID NO: 186668 - DNA, 3045 bp, Artificial Sequence
  Description of Artificial Sequence: Synthetic coding sequence
atggagacctgcgccggcccccaccccctgcggctgttcctgtgccggatgcagctctgcctggctctgttactgggtccgtggagaccgggaaccgctgaagaagtgatcctgttggatagcaaggccagccaggcagaactaggttggacagccctgcccagcaatggttgggaggagatttccggggtcgatgaacacgatcggccaatccgcacataccaggtttgtaacgtgctcgagcctaatcaggataactggctgcagactggatggatatcaagagggagaggccagcgaattttcgtagaactgcagttcacactgagggactgcagtagtatccccggcgcggccgggacctgcaaggagactttcaatgtgtactatttagagacagaggccgatctgggcaggggacgtccccggcttggcgggagccggccaaggaagattgataccattgccgcagatgagtccttcactcaaggagacctcggcgagaggaagatgaaacttaacacagaggtacgggagatcgggcctttgagccggcggggattccacctcgctttccaagatgtgggtgcatgtgtggccctggtgtctgtccgtgtgtactataagcagtgccgcgccacagtaagaggcctggctacctttccagccaccgcggcagagtctgcttttagcaccctcgtcgaggtggccggaacctgcgtggcccactccgagggcgagccaggatcgcccccccgtatgcactgtggagcggatggcgagtggctcgtgccagtcggacgctgttcctgtagtgcaggcttccaggagcggggagacttttgcgaagcttgtccccccgggttttacaaggtgtcccccagacggcccctttgtagtccatgccccgagcattctagagctctggaaaacgctagcaccttttgcgtgtgccaagattcctatgcccgttcaccaactgacccaccaagcgcatcttgcacccgcccccccagcgctccccgagatcttcagtattctctgtccagatctcctctggtgctgcgtctccgatggcttccacccgccgatagtggcggacgctcggacgttacttattccctgctgtgtttacgctgcggcagggagggccctgccggcgcgtgcgagccctgcggacctcgggtcgctttcctacccagacaggcgggactccgggagcgggcagccaccctgctgcacctgaggcccggcgcccgatacaccgtgcgagttgccgccctgaacggtgttagcggacccgcggccgccgctggaaccacctacgcgcaggttactgtgtcaactgggcccggggccccgtgggaagaggatgaaatccgaagagacagggtagagccacagtctgtctccttgagctggcgggagcctattcccgccggagcgcccggcgccaatgacacggagtacgagatcagatactatgagaaaggccagtcagaacagacatatagtatggtcaagaccggtgcccccacagttactgtgacaaacttaaaaccggctactaggtacgtgtttcagattcgggccgcttcgcctggtccgtcctgggaggcacaatccttcaatccttcaatcgaggttcagacattaggggaggccgcgagtggctccagggaccagagccccgcgattgtcgtcaccgtcgtcactattagtgccctgctggtgttgggatctgtcatgtcggttctcgcgatttggcgcaggccctgctcatatggaaagggcggcggagacgcccacgatgaagaggagctctacttccactttaaagtgccgacccgaaggaccttcttagatccccagagctgtggtgacctgttgcaagctgtgcatctcttcgcaaaagagctcgacgccaagagtgtcaccctagaaaggtcacttgggggcggacggtttggagaactgtgttgtgggtgcctgcaactgccgggccggcaggagctgctggtggcagttcatatgctgagggattcagcgagcgattctcaacggctcggcttcctagccgaagctctcaccctgggacagtttgatcactcacatatagtccggcttgaaggcgtggtcacgcgggggtctacactcatgatagtaactgagtacatgtcgcacggcgcgttagacgggttcctcaggagacacgaaggccagctggtggcaggtcagttgatgggcctgcttcccgggttagccagcgcaatgaagtatctttccgaaatgggttacgtccatcgcgggctggccgcacgccacgtcctggtcagctccgatctggtttgcaagatcagcggatttggccggggacctagggatagatcggaggccgtctacactacgatgagcgggcggtccccagccttgtgggccgctcctgagacactgcaatttggtcatttctcttctgccagtgatgtttggagcttcggaattattatgtgggaggtaatggcctttggcgaacggccgtattgggatatgtcgggccaggatgttattaaggccgtggaagatggcttccggctgcctccccctcggaattgtcccaacttactccacaggctcatgctggactgctggcagaaagaccccggagaaagaccacgattctcacagatacactccatcctctcgaaaatggtccaggatccagaacccccaaagtgcgctctgacaacctgccctcgcccgcccacccccctcgccgatagagccttctctacatttcccagttttggaagtgtaggcgcttggctggaggccctcgacctgtgtcgttacaaggattcctttgcagcggcgggatacggctctctggaggcggtcgccgagatgactgcacaggacctggtgagcctgggcatttctctagctgaacatcgagaggccctgctgagcggaatctccgcactgcaggcccgcgtcttacaactccagggccaaggagtgcaggtcatcattaagacctgcctctag

SEQ ID NO: 186669 - DNA, 468 bp, Artificial Sequence
  Description of Artificial Sequence: Synthetic coding sequence
atggtgaagaccggcgcccccaccgtgaccgtgaccaacctgaagccagcgaccaggtatgttttccaaattcgggcagcatcaccaggcccaagctgggaagcgcagtctttcaatccgtccattgaggtgcaaacactgggggaagcagcctccggaagtagggaccagtctcccgcgatagtagtgacggtggtgactatcagtgctctcttggtcctcggcagtgtgatgtccgtcttagccatctggcgccgcccatgtagctacggcaagggagggggagacgctcatgacgaggaagagctgtacttccactttaaagtccctacacgacgtaccttcttggatccacaaagttgtggcgacctccttcaggcggtacacctgttcgccaaggaactggacgccaagtctgttaccctcgagcgttccctcggcggcggacttgagacctcccctcattag

SEQ ID NO: 186670 - DNA, 2931 bp, Artificial Sequence
  Description of Artificial Sequence: Synthetic coding sequence
atggagctgcaggccgcccgggcctgcttcgccctgctgtggggctgcgctctcgctgcagcagctgcagcccaaggaaaggaggtggtgctgctcgatttcgcggctgctggtggcgaactaggatggctgacccacccctacggcaagggttgggatctcatgcagaatatcatgaatgacatgccaatttatatgtattcagtatgcaatgtgatgagtggcgaccaggataactggctacggaccaattgggtttaccgaggcgaagccgaacgtatcttcattgaactgaaattcaccgtgagagattgtaattccttccccggaggagccagctcatgtaaggagacatttaatctttactacgccgaatcagaccttgactatggtactaacttccaaaagaggctgttcaccaaaattgataccatcgcccctgatgagattaccgtgtcttccgatttcgaagccaggcatgtcaagctgaacgtggaggaaaggtcggtcggacctttgaccaggaaaggcttttacctggcattccaggatatcggcgcttgcgtggctctgctgtctgtgcgcgtctactataaaaagtgcccagagttgcttcaaggcctcgctcactttccggaaactattgctggctctgatgcaccatccctggccacggtagctgggacctgcgtggaccacgcggtcgttcctcctggaggtgaggagcctcgtatgcactgtgccgtggacggagagtggttggtccctattggacagtgcctctgccaggccggctacgaaaaggtggaagatgcttgccaggcttgctcccctgggtttttcaagtttgaagcatccgaatctccctgcctggagtgccccgagcatactctgcccagcccagagggcgccacctcatgtgaatgtgaggagggatttttccgagctcctcaagaccctgcgtcaatgccctgcaccagacccccttccgccccgcattacctgacagccgtcggaatgggagcaaaagtcgaacttcggtggacccctccccaggacagcggtggtcgcgaagatattgtctactctgtaacatgtgagcagtgttggccagagagcggtgaatgcggtccttgcgaggcctccgtccgctactctgaacccccacatgggctgaccagaacttctgtcaccgtgagtgatttggagccccatatgaactacacatttaccgtggaagccaggaacggcgtatccgggctggtcaccagcagaagcttcaggactgcctctgtctcaataaaccaaactgaacccccaaaagttaggttagaagggaggtctaccactagtctctcagtgagctggtctatcccacctccacagcagtcgcgagtttggaagtacgaggttacgtaccgcaaaaagggagattcgaatagttataatgtccgtcgcacagaagggtttagcgtgacattagacgacctagcaccagatactacttatttggtgcaagtccaggctctgacccaggagggccaaggtgctgggagtaaggtccacgaatttcagactctgagccccgagggttctggaaacttggcagtaatagggggggtggccgtgggcgtggtactgctgttggtgttggctggagtgggtttctttatccatagaaggcgcaaaaaccagcgcgctaggcagagtccagaagacgtttactttagtaaatccgagcagctgaagcccttaaaaacgtatgtagacccgcatacgtacgaggacccaaaccaggcagtcctgaaatttactacggagattcacccttcctgcgtgactaggcaaaaggtcataggagcaggagagttcggagaggtgtacaaaggcatgctgaaaacatcgtccggtaaaaaagaggtaccagtggctattaagacgctgaaggctggctacaccgaaaagcagcgcgtagacttcctcggggaggctgggatcatggggcagttcagccaccacaatattatccgactggagggcgtgatttcgaaatataagccgatgatgatcatcacagagtatatggagaacggtgctctggacaaattcttgagggaaaaagacggggagttctccgttttgcaactggttggcatgctgcggggaattgccgccggcatgaagtacttagcaaacatgaattacgtgcatcgagacctggccgcccgcaacatcctggtcaactccaatcttgtctgcaaggtttctgatttcggtctgtctcgggttcttgaggacgacccagaagccacctatactacaagcggcggcaagatacccatcagatggaccgcccccgaggccatttcataccgcaaatttacaagcgcaagtgatgtgtggtcctttggcatcgttatgtgggaggtaatgacctacggggaacgcccctattgggaactcagtaaccatgaggtgatgaaggcaattaatgacggttttaggcttcccacccctatggattgtccgtcagccatctaccaacttatgatgcagtgctggcaacaagaaagagcccgaaggcctaaatttgcggacattgttagcatcctagacaaactcattagggccccagactctctgaagactttggcagacttcgatccacgggtgtcgattagacttccaagtaccagtgggagcgagggggtgcccttcagaactgtgtccgaatggttagagtccattaagatgcagcagtacacagagcattttatggccgctggctacacagccatagaaaaagtcgtgcagatgaccaatgacgacataaagcggataggtgtacggctccccggacaccaaaagcgcatagcctactccctgttaggcttaaaagatcaggttaacaccgtggggattcccatctag

SEQ ID NO: 186671 - DNA, 2952 bp, Artificial Sequence
  Description of Artificial Sequence: Synthetic coding sequence
atggactgccagctgagcatcctgctgctgctgagctgcagcgtgctcgacagctttggagagctgatcccccagccctctaacgaagtcaatctcctcgatagtaagactattcagggcgagctgggctggatcagttacccaagccatggctgggaggaaatcagcggggtggacgagcattatacacctatacgcacataccaggtatgcaatgtgatggaccactctcagaataattggttgaggactaactgggtaccgaggaactccgcccagaagatctatgtcgagttgaaattcacccttcgagattgcaatagcatccccctcgtgctcggcacttgtaaggagacattcaacctctactacatggagagtgatgacgaccacggcgttaagttcagagagcaccagttcaccaaaattgacacgatcgcggctgatgagtcctttacgcagatggacttaggtgatcgaatcctgaaactgaataccgagatacgtgaggtgggccccgttaataagaaaggcttctatctggcgtttcaagacgtcggcgcttgcgttgctttggtgtcagtgagagtttactttaagaagtgccctttcaccgtgaagaacctagccatgtttccagacacagttcctatggatagtcagtcactggtcgaagtgaggggctcttgcgtaaacaatagcaaggaggaggaccccccccgcatgtattgttccactgagggtgagtggctcgtaccgataggcaagtgttcatgtaacgcaggatacgaggagcggggctttatgtgtcaagcatgccgcccaggcttttacaaagcactcgatgggaatatgaaatgtgctaagtgcccgcctcattcctcgacgcaggaggacgggtctatgaattgcaggtgcgaaaacaactacttccgcgccgacaaggaccctccatcaatggcatgtacccgaccccctagttcgcctcggaatgtaatcagcaacataaatgaaaccagtgtaatcctggattggagctggccattggacactggaggcaggaaggatgttacctttaatattatatgcaagaaatgcggatggaatatcaaacagtgcgaaccttgttcacctaatgtgcgcttcctccccagacagttcgggctgacaaacaccaccgttacggtcactgacttgttggctcatacaaattacactttcgagattgacgctgtgaacggggtatcagaactctcatcgcctcctcgtcaattcgctgccgtgtccataacaaccaaccaggctgcgccttcgcctgtgctaaccatcaaaaaagaccgtacatctaggaacagcatttccctctcctggcaggagcccgagcatcctaatggcattattctcgattatgaagttaagtactacgaaaaacaagaacaggaaacatcctatacaatactgagagctcgcggtaccaatgtgaccattagctcccttaaaccagatactatctacgttttccagatccgcgccagaacagccgccgggtacggaactaattctaggaaattcgaattcgagacaagcccggatagtttcagcatctccggagagtccagccaggtggtcatgatcgccatatccgcagcagtagccataattttgctcacagttgtgatctacgtgctgatcggccggttttgtggttataagagtaagcatggggctgatgagaaacggttgcatttcggtaatggccacctgaagctacctggcctcagaacctatgttgatccccacacgtatgaggatcctacacaggccgtgcacgaatttgcgaaagagttagacgccacaaacatttctatagataaggtggtgggtgcaggtgagtttggagaagtgtgcagcggcaggctgaagctgccttcaaagaaggagatctctgtagctattaaaacattaaaggtgggttacaccgaaaaacagaggagagacttcctgggcgaagctagcatcatgggtcagtttgatcatcccaacattatccgcctggagggggtggtgacaaaaagcaaacctgtgatgatcgttactgagtatatggagaacggctctctcgatagctttctgcgcaagcacgatgctcaatttaccgtgatccaacttgtcggcatgttgagagggattgcatcagggatgaagtacctctccgacatggggtatgtgcaccgtgatttagcggctcggaacatcctaataaactctaaccttgtttgtaaggtatcagactttggcctctctagagtgctggaagatgacccggaggctgcatacacgacccgcggtggcaagattcctattcgatggacttcaccagaggcaattgcctaccgcaagttcacatctgcatccgacgtgtggtcctatggcatagtactttgggaggtcatgtcatatggcgaacgaccttactgggaaatgagcaatcaggatgtgattaaggcagtggatgaagggtacagacttcccccacccatggattgccccgctgccctctatcagctaatgcttgactgttggcaaaaggaccgaaacaaccggccgaaattcgagcagatcgtgtccatccttgataagctaattaggaaccccggctcactgaaaatcatcacatcagccgctgctagaccatccaacctgctcctggatcagtctaacgtcgacattactacgtttagaaccaccggagattggctgaacggggtctggactgcacattgcaaagaaatctttaccggcgtcgaatattctagctgcgacaccatcgccaaaatctcgacagacgacatgaagaaggttggcgtaacagtggtcggcccccagaagaaaattatctcctctataaaagccctagaaacacagtccaagaacggcccagtccccgtttag

SEQ ID NO: 186672 - DNA, 1620 bp, Artificial Sequence
  Description of Artificial Sequence: Synthetic coding sequence
atggactgccagctgagcatcctgctgctgctgagctgcagcgtgttagactcctttggagagctcatcccacagccgtcgaatgaagtcaaccttttagatagcaaaactatccagggtgaacttggatggatatcttatccatcccatggttgggaggagatcagcggcgtggacgagcactatacgcccattcggacttaccaggtgtgcaacgtaatggaccatagccagaacaattggctgcggacaaactgggttccacggaattcagcccaaaagatttatgtggaactgaagtttacattgagagactgcaatagcattccacttgtactcggcacttgcaaggagactttcaatctctactacatggaaagtgacgatgatcacggggttaaattcagagaacaccagttcactaaaattgatacgattgcagctgacgagtccttcacacagatggacctgggagatcgaattctcaaactgaatacagaaatcagagaagtggggcctgtgaataagaaaggattctatcttgctttccaagacgtcggggcatgcgtggctctcgttagtgtccgtgtgtattttaaaaaatgtcccttcaccgtgaagaacttagctatgttccctgatacagtgcccatggactcccagagcctggtcgaagtccgggggtcctgtgtaaacaattccaaggaggaggacccccccaggatgtactgcagcacggaaggcgaatggctcgttccgattggcaaatgctcttgtaatgcgggatatgaagagcgcggcttcatgtgccaggcttgtcggccgggattctacaaggccctggacggcaatatgaagtgtgccaagtgtcctccccacagctccacacaggaggacggttccatgaactgtcggtgtgaaaataattactttcgcgcggataaggatcccccaagtatggcatgcactcgcccaccttcttccccccgcaacgtgatctccaacattaacgagacaagtgtgatcttggactggtcatggccattagatactggtggtagaaaagacgtgacattcaacatcatttgtaaaaaatgcgggtggaatattaaacagtgtgagccatgctcacccaatgtacggttcctgcctcgccagttcggtcttacaaataccaccgtgacagtgactgacctgctcgcccacacaaactatactttcgagatagatgcggtcaacggtgtcagcgagctgagttcccctcccagacaattcgcggccgtgagtattacaactaaccaggcggcgccttctcctgtactgaccattaaaaaggacagaacaagtcgcaactcaatatcgctgtcctggcaggagccggagcaccctaatgggattatactggattacgaggtaaagtactacgagaaacaggagcaggaaacctcttatacaatactgcgcgctaggggcacaaacgtcactatttccagtctcaagccagataccatctacgtcttccaaattcgcgcacgcacagcagccggctacggcactaattccaggaagtttgaatttgagacatccccggattgcatgtactatttcaatgctgtgtag

SEQ ID NO: 186673 - DNA, 3114 bp, Artificial Sequence
  Description of Artificial Sequence: Synthetic coding sequence
atgcggggcagcggcccccggggcgccggccggcggcggccccccagcgggggaggtgacacccccatcactccagcctctctggccgggtgttactcagcccccagacgcgcgcccttgtggacttgcctgctgctgtgtgccgcgcttcgtaccttgctcgcctctccaagtaatgaagtaaatctgttagatagccgcacggtgatgggggatcttggctggattgcattccccaaaaacggttgggaggaaatcggggaagtggacgagaactatgcacctattcatacctatcaggtgtgtaaggtcatggagcaaaatcagaacaactggctgttaacaagctggatttccaatgagggggcctctagaatcttcatcgagctcaagttcacacttagggactgtaactctttgcctggcgggcttggaacatgtaaagaaaccttcaacatgtattactttgagtccgacgatcaaaacgggcgtaatatcaaggagaatcaatacattaagatagacaccattgcagcagacgagtccttcaccgaattggatctgggggatagagtcatgaaactgaatactgaagtcagggacgtagggccactgtcaaagaaaggcttttatttggccttccaagacgtgggtgcatgcatcgccctggtatccgtaagggtttactacaaaaagtgtccgtctgttgttagacacctcgccgtatttcctgatacaatcaccggggcggactcatctcagctcctggaggtctcaggctcgtgcgtgaaccactctgttacagacgaaccacccaagatgcactgctcagcagaaggggaatggctcgtcccaataggaaaatgcatgtgcaaggcaggatacgaggaaaaaaacggaacttgccaggtgtgtcgtcccggattctttaaggctagcccccatatacagagctgcggaaagtgtccaccccattcttacactcacgaggaagcatctacgtcctgtgtgtgtgaaaaagactatttccgccgggaatccgaccctccaacgatggcatgtacaaggccaccttcggccccacggaacgccatcagtaacgtgaatgagacctctgtcttcctggagtggatcccaccagcagacactggcgggcgcaaagatgtctcctactacatcgcttgtaagaaatgcaactcccacgccggcgtctgcgaagaatgtggcggacacgtcaggtacttaccccgccagtccggcctcaaaaacacatctgtcatgatggttgatctgttagcccatactaattacaccttcgagattgaggctgtaaacggcgtgagcgacctgtcccctggcgcacgccagtatgtcagcgtgaatgtgaccacgaatcaagcagcaccctcgcccgttaccaatgttaaaaaagggaagatagctaaaaactctatctccctaagctggcaggaacccgaccgacctaacggtataatcttggaatatgaaattaagtactttgagaaggatcaggagacatcatacactatcatcaaatctaaagaaactacaattactgctgagggattgaaacccgcatctgtgtacgtttttcagatacgtgctagaactgcagcggggtatggagtgtttagtaggcgtttcgaatttgagaccacccctgttttcgctgcaagttcagaccagagtcaaataccagtcattgctgtctcagttacagtgggggtgatcctcttggctgtggttattggggtgctgctcagcggctcatgctgcgaatgtggctgtggccgtgctagctcactgtgtgctgtggcgcatccatcgttgatctggcgctgtggctatagcaaagctaaacaagaccccgaggaggaaaagatgcacttccacaatggacacattaagctgccgggagtgaggacatacatcgacccccacacatatgaggacccaaaccaggcagtccatgagtttgcaaaggaaattgaagccagctgcattacgattgagcgcgtgattggggcaggtgaatttggtgaagtgtgtagtggtaggctgaaactccctggcaagcgggagctgcctgtcgccattaagacactgaaagtcgggtacacagagaaacagagacgggacttcctcggggaagctagtattatgggccaattcgatcacccgaatattatacacctggagggtgtagtgactaaaagcaaacccgtgatgatagtgactgaatacatggagaacggcagcctcgacacatttctgaaaaagaacgacggtcagttcaccgtcatccaattggttggcatgttgagagggatctccgctggaatgaagtatctttcggacatgggttatgtccatcgcgacctggcagccaggaacatcctcatcaatagtaacctggtctgtaaagtgtcagatttcgggctgtcacgagtgttagaggatgaccctgaagccgcttacactactcgtggtggaaagatccccattcgctggacagccccagaggcaattgcgttccgcaaattcacctccgcgagcgacgtctggtcctatggcatcgtcatgtgggaggtggtcagctacggtgagagaccatattgggagatgactaaccaggacgttatcaaggcagtggaggaggggtacagactgccatcgccaatggattgtcctgcagccttgtatcagctaatgcttgattgctggcaaaaagagaggaattctcgacccaaatttgacgaaatcgtgaacatgttggacaagctgattcggaacccaagctcgctgaaaaccctggtaaatgcgtcgtgcagggtttctaacctgctggccgagcacagcccccttggatctggcgcctaccgttctgttggtgagtggttagaagctatcaagatggggagatacaccgaaatatttatggagaacggctactcaagcatggacgctgtcgcgcaggtgacgttggaggacctacggcgtctgggagtgacattggttggccatcagaaaaaaattatgaatagcttacaagagatgaaagtccaactcgtgaacggcatggttcctctgtag

SEQ ID NO: 186674 - DNA, 3048 bp, Artificial Sequence
  Description of Artificial Sequence: Synthetic coding sequence
atgcggggcagcggcccccggggcgccggccggcggcggcccccctcaggcggcggagatacacctatcacccccgcctcactggcaggttgttactccgctccacgaagggcacctctgtggacatgcctgctgctgtgcgctgcgctacgcacgctgctggcctctccttccaacgaggtgaacctgctggacagcaggaccgtgatgggcgacttgggatggatagctttccccaagaacggctgggaagagattggcgaggtggatgagaactatgcgccgatccatacctaccaggtgtgcaaggttatggagcagaatcagaacaactggctgctgacttcctggattagtaacgagggagcttctcgtattttcattgaacttaagttcaccctgagagattgcaactccctacccggagggctcggcacttgcaaggaaactttcaacatgtattatttcgaaagcgacgatcaaaacggcaggaatataaaagaaaaccagtatatcaagatcgacaccattgccgctgacgaaagcttcacagagctggaccttggggacagagtcatgaaactcaatactgaggttagggacgtgggccccctgtctaaaaagggcttttatctggcgtttcaagacgttggggcatgcatcgctctggtgagcgtgcgcgtgtactacaaaaagtgcccctccgtggttcgccaccttgccgtgtttcccgacacaataactggggccgattcatcgcagttgcttgaggtgtctggatcctgcgtgaatcactccgtcactgacgaacccccaaagatgcactgcagtgctgaaggagaatggctggttcctatcggcaagtgcatgtgtaaggcagggtatgaggaaaaaaacggcacctgtcaggtgtgtcgtccaggcttttttaaggcgagcccgcacatccagtcctgcgggaagtgtcccccacatagctatacacacgaggaggcctctacatcctgtgtgtgtgaaaaagattacttcagacgcgagtcagatccacctacaatggcctgcactagaccgccctccgcacctcgaaatgccataagcaacgtcaacgaaacaagtgtcttcctcgagtggataccaccggccgataccggtgggaggaaggatgtgtcttattatattgcctgtaaaaagtgtaatagccatgccggagtgtgtgaagagtgcggaggacacgtccggtacttgccacggcaatctggcctgaagaacacctctgtgatgatggtagacttgctagcccacacaaattacacattcgagatagaggccgtgaatggggtgtccgatctcagcccaggggcgcgccagtacgtttcagtgaatgtcacaaccaaccaggcagctccgtcacctgttaccaacgtcaagaagggtaagatcgctaagaacagcatttccctgtcttggcaggagccggacagacccaatgggataatactggaatatgagatcaaatactttgaaaaggatcaagaaaccagctacacaatcatcaaatccaaagagaccacaatcaccgcggaaggccttaagccagctagtgtttatgtgttccagatccgtgctcgtacagccgccggatatggagtgttctcccgaaggttcgaattcgagaccacacctgtattcgccgcaagctcagatcagagtcagatccctgtcatagccgtttcagtaaccgtgggcgtgatcttgctggctgtggtcattggcgtgttactgtctggccgccgttgtggatattcgaaagcaaagcaggaccctgaggaggagaagatgcattttcacaatggtcacattaaactgcccggagttcggacctatatagatcctcatacgtacgaggaccccaatcaggccgtgcacgaattcgctaaagagatcgaggcgagctgcatcactatcgaacgggtgataggggcaggagagtttggagaagtctgctcagggagactgaagctgcccggaaagcgtgaactgccagtggctataaagactttaaaggtgggttacaccgagaaacagagacgtgatttcttgggagaagccagcattatgggccagttcgaccatcccaatattattcacctggagggtgtggtgacaaagtccaagccagtgatgattgttaccgaatatatggaaaacgggagcctcgacacatttctgaaaaagaacgatgggcaattcacagtcattcagctcgtcggcatgttacgggggatcagcgctggaatgaagtatctgtcagacatgggctacgtgcacagggacttggctgcacgtaacatcctgattaatagtaatctggtgtgtaaagtctccgatttcggactttctcgagttctagaggacgatcctgaggccgcttacacaacgcggggaggcaaaatccctatccggtggacagcaccagaggccatcgcatttagaaaattcaccagcgcaagcgacgtgtggtcatacggcatcgtgatgtgggaggtagtgtcttatggcgagaggccatattgggagatgaccaaccaggacgtcatcaaggccgtcgaggagggatatcggcttccttcaccgatggattgtcccgccgcactgtatcagctgatgctggactgctggcagaaggagcgcaactctagacctaagtttgatgaaatagtcaacatgctcgacaaactgatccgaaacccttcttctctgaaaacactcgtaaacgcctcttgcagggtgtctaaccttctggccgaacattctccccttggaagcggggcttacaggtccgtcggcgagtggctagaagccatcaagatggggagatacacagagatcttcatggagaacggctactccagtatggacgccgtggcccaagtgaccctagaagacctgcgaaggctaggggtgacattggtagggcatcagaagaaaataatgaattcattacaggaaatgaaagtccagctggtcaacggcatggtccccctctag

SEQ ID NO: 186675 - DNA, 3015 bp, Artificial Sequence
  Description of Artificial Sequence: Synthetic coding sequence
atgcggggcagcggcccccggggcgccggccggcggcggcccccctccgggggaggcgacactccaattacccctgctagcctagctgggtgctattctgctcccaggcgggcgcccctttggacctgcttattgctgtgtgcagcactccgaaccctacttgcgagtccaagcaacgaggtcaacctcctggacagcagaacagtaatgggagatttggggtggattgcttttcctaaaaacggttgggaggaaatcggcgaagtggacgaaaattacgcacccatccacacataccaggtctgcaaggtaatggagcagaaccagaataattggcttctgacttcttggatttccaacgagggcgcaagcaggatttttattgaactcaagtttacccttagggactgtaacagtttacctggaggtctgggaacatgcaaggagacattcaacatgtactattttgagtccgacgatcagaacggccgtaatatcaaggagaaccaatacataaaaattgatacaatcgccgccgatgagtcgttcacagaactggaccttggtgacagagtcatgaagctcaacaccgaagtccgggacgtcggccctctgagcaagaagggtttctatctggcgtttcaggatgtgggcgcttgtattgcactggtttccgtgcgggtctattataagaaatgcccttctgtggtcagacatttagccgtgtttcctgataccatcacaggcgcggatagctctcagttgctcgaagtgtctggtagctgtgtcaaccatagcgtgacggatgaacccccaaagatgcactgcagtgctgagggggaatggctggtgcccatcggtaaatgcatgtgcaaagcggggtatgaagaaaaaaacggaacttgtcaggtctgcagaccaggcttctttaaagcctcgccccacattcagagttgcggcaagtgcccaccacactcctatactcatgaagaggccagtacctcctgtgtttgcgaaaaggattattttcggagggaaagcgatcctccgactatggcctgtacccgtccacctagtgcccccaggaacgcaatctccaatgtgaatgaaacatccgtgtttctggaatggatcccgcccgctgacacaggcggacgaaaagatgtttcctattacattgcttgcaaaaagtgtaactcgcacgcgggcgtgtgcgaggagtgtggggggcatgtacggtaccttcctcgacagagcggcctgaagaatacttccgtgatgatggtggacttgctcgcgcacacaaactacactttcgaaattgaggcagtcaatggcgtgtccgacctttcgccaggagcacgccagtacgtttctgtcaacgtaacaaccaaccaggccgctccatccccagtgaccaacgtgaaaaaaggtaagatagccaaaaacagcatttcattgtcctggcaggagcccgatagacctaacgggatcattcttgaatacgagattaaatatttcgaaaaggaccaggagacgagttatacaatcattaaatctaaggagacgacaatcaccgcagaaggtctcaaacctgcctctgtgtacgttttccagattagggccaggacagcagctggttatggtgtattctccaggcgctttgaatttgagacgacgccggtgtctgtcgccgcatcaagtgaccagtcgcagattcccgtgattgcggtcagcgtgactgtgggcgtcattttgctggccgttgtgattggagtgctcctgtctggctcgtgttgtgaatgtggctgcggccgcgcaagttccctttgcgcagttgctcatccttccctgatttggagatgtggttacagcaaggcaaagcaagatccggaagaggagaaaatgcatttccacaacggacatattaagctgcccggtgttagaacatatatcgatccacacacctatgaagatccaaaccaagcggtacatgagttcgctaaagagatcgaagctagttgtatcacaattgagcgggtgattggcgccggtgagttcggagaagtgtgttccgggcgcttgaaacttccaggcaaaagagagctccctgtggcaataaagactttaaaagttgggtacactgagaaacagcgacgcgacttcctgggtgaggcatctataatgggtcagttcgaccacccaaatatcattcacctggaaggggtcgtaacaaagagtaagcctgtgatgatcgtcactgaatacatggaaaacggatccttggacacctttctcaaaaaaaatgatggacagttcaccgtgattcagttagttggaatgctgcgtgggataagcgcaggcatgaagtacctcagcgacatgggatacgtccatagggatttggcagcaaggaacattttaatcaatagcaacctggtatgcaaagtctcagacttcggactgtcacgcgtgctggaggacgatccagaagccgcgtacactacacgcggtggtaagatacccatccgttggacagcccctgaggcaatcgcttttcggaagttcacatcggcaagcgacgtttggtcctacggcattgtgatgtgggaggtcgtgtcttacggggaaaggccctactgggaaatgacaaaccaagatgtgattaaagcagtagaagaaggttatcgactgccatcacccatggactgccccgccgctctttaccaactgatgctcgattgctggcaaaaagaaaggaatagcagaccaaaatttgatgaaattgttaacatgctggacaagctcattaggaatccttcctcactgaagacgctggtgaacgcttcttgccgcgttagcaacctgcttgcggagcacagcccccttggatcaggtgcataccgttctgtgggagaatggctggaggcaatcaaaatggggaggtacactgagatcttcatggagaatggttactcgtcaatggacgcagtggctcaggtgactctggagtag

SEQ ID NO: 186676 - DNA, 3018 bp, Artificial Sequence
  Description of Artificial Sequence: Synthetic coding sequence
atggcccccgcccggggccggctgccccccgccctgtgggtggtgacagccgcagccgctgccgccacttgtgtcagcgcagctcggggcgaggtgaacctcctcgatacatcaaccatacatggggattgggggtggctgacctatcccgctcatggctgggacagtatcaatgaggtcgatgagagctttcagcctattcacacctaccaggtgtgtaatgttatgagcccaaatcagaataattggctgcgcaccagttgggtgcctcgcgatggcgcccgccgagtctacgctgaaatcaaatttaccctgagggattgcaatagtatgccaggtgtgctcgggacttgtaaggaaacctttaacctgtactacctggagtccgatagggatttgggcgcctcaacgcaagagtcgcagtttctgaaaatagacaccatcgcagcagatgaaagttttacaggagccgacttaggcgtcagacggctgaaactgaacacagaggttaggtcagttgggcccctctcaaaacgggggttctatctggcgtttcaggatattggggcttgcctagccatcctgagtcttagaatctattataagaaatgcccagccatggttcgcaatctggcggcattcagtgaggccgtcacgggtgcagatagcagcagcctagtggaagtgcgcgggcagtgcgtccgccacagtgaggagagggacaccccgaagatgtactgcagcgctgagggggagtggctagtgccgatcggaaaatgtgtgtgctcggcagggtatgaggaaaggagagatgcctgtgttgcctgcgaactggggttttataaatctgcaccaggcgaccagctctgcgcgcgttgtccaccccacagccatagtgctgccccggcggcccaggcttgtcactgcgatctttcctactatagagccgctttagacccgccaagttccgcctgtactcggcccccgtctgcacctgtgaacctgatctcttctgtcaacgggaccagtgtgactctggaatgggctccgcctcttgatcccgggggacgatctgatataacctataacgctgtttgtcgcagatgtccatgggcactatctaggtgtgaggcatgcggcagcgggactaggttcgtgccacaacagacctcgctggtgcaagcctcactactcgtggctaatctattggcacacatgaactacagcttctggatcgaagccgtgaacggagtgagtgacctgtctccagaaccacggagggctgccgttgtgaatataacaacaaaccaggctgctccaagtcaagtggtggtgatccgccaggaaagggcggggcagacatccgttagcctgctctggcaagaaccagagcaacccaatggcattatcttagagtatgagataaaatattacgaaaaggataaagagatgcagtcttattcaacgctaaaagctgtgaccactagagccaccgtgtccggcctcaaaccgggaacacggtacgttttccaggtgcgcgcacgcactagtgccggctgtggtcgcttttctcaggctatggaggtagaaaccggaaaaccaaggcccagatatgatacgcgcacgatcgtttggatctgccttaccctcatcacaggactggttgtcctgttgctgttattgatctgcaaaaaaagacactgtggctatagcaaggctttccaggacagtgatgaagagaagatgcactatcagaacggtcaggcccctcccccagttttcctgccactgcaccacccccccgggaagctgcccgaaccacagttctacgcggagccacacacctacgaggagcctggccgcgctgggaggtcattcactagagagattgaagccagccgcatccatatagagaagatcataggctccggcgacagtggagaggtctgctacggccgtctccgcgttcctggacagcgagacgttccggtagcaattaaagcactcaaagctggatacacagagcggcagcgccgcgattttctgagtgaagcctccattatggggcaattcgaccacccgaacattatacggctggaaggcgtagtcaccaggggacgactagctatgatcgtgacagagtacatggaaaacggatccctcgatacctttctccggactcacgatgggcagttcaccatcatgcagcttgtgggcatgctgcgtggcgtaggcgctggcatgcggtatctctctgaccttggctatgtgcaccgggacctagctgcccgcaatgtgctggtggatagtaatctggtttgcaaagtgagcgattttggactgtcccgcgtccttgaggatgaccccgacgccgcttacactactaccggagggaagattccgattagatggaccgcccctgaggcaatcgcctttcgtacattttcctctgcttcggacgtctggagtttcggcgtggttatgtgggaagtgttggcctacggggagagaccatactggaatatgacaaatagagacgttatctccagtgttgaagagggatatcggctcccagcaccgatgggatgtccccacgcccttcatcagctcatgctggattgttggcacaaggaccgggcacaacgccctagattctcgcagatcgtcagcgtgcttgacgcccttatcaggtcacctgagtctctgcgggcaactgctacggtgtccagatgccccccccctgcatttgtaagatcctgctttgacctcaggggtggtagcgggggaggcggcgggttaaccgtgggggattggctcgactctataaggatgggacgctatagagatcacttcgccgcgggcggctactcctcccttggaatggttctccggatgaacgcacaagacgtgcgtgccctgggtatcaccctgatggggcaccaaaagaagattctgggatccatacaaactatgcgagctcagttgacctcaactcagggacctcgcaggcacctgtag

SEQ ID NO: 186677 - DNA, 1488 bp, Artificial Sequence
  Description of Artificial Sequence: Synthetic coding sequence
atggcccccgcccggggccggctgccccccgccctgtgggtggtgaccgcagcagccgcggccgcgacatgcgtgtctgccgcaagaggggaagtaaaccttctggacacatcaacaatacatggcgactggggatggctgacctatcccgcccacgggtgggattccataaatgaggtggatgagtccttccaacctatccacacttaccaagtgtgcaacgtgatgtcgcccaaccagaataactggctcagaacttcatgggtcccacgtgatggcgccagaagagtgtacgcggagatcaaattcaccttaagggactgcaatagtatgcccggagtgcttggcacctgcaaggagacatttaatctctactatttggaaagcgatagggatctgggcgcttctactcaggagtcacagttcttgaagattgataccatcgctgccgacgagtcgttcacaggcgccgacctgggagtcagacggcttaagctgaatactgaagtgcggtctgttggtcccctctctaaaagaggcttctacttggcctttcaagatattggtgcctgtctggctattctgtcactgcggatttactataagaagtgtcccgcgatggttaggaacctcgccgccttcagtgaagctgtcaccggtgcggatagcagtagcctggtcgaagtgcgcggccagtgcgtgaggcacagcgaggaacgcgatacacccaaaatgtattgtagtgcggagggggagtggttggtgcctattggcaagtgtgtatgcagcgcaggttacgaggagagacgtgatgcctgtgttgcatgcgagcttgggttttataagtcggccccaggggatcagctttgcgccaggtgcccccctcactctcactcagccgctccagcggcacaagcctgtcattgtgacctgtcatactaccgcgcggccttggacccgccaagcagcgcgtgtaccaggccaccctctgctcctgtgaacttgattagcagcgtgaacgggacctcagtaactctggagtgggctcctccccttgatcccggcggacgatctgatattacttataacgccgtatgtaggaggtgcccgtgggctctgtctcgatgtgaggcctgtggttccggcacaaggtttgtgccccagcaaacaagcttggtccaggcatccctcctggtagcgaacttgttggctcacatgaactactcattctggattgaagccgtgaacggcgttagcgatttgagccccgagccccgacgggccgctgtggtcaacataaccactaatcaagctggccgcaggcgcaattcagtcccacaacggcccgggccacccgcatcgccagctagtgacccaagcagagaccagtcctccgcgggtgacgtcctgtgggcgttccgccaggtgccactttggccctgcgctccccaccaagaccccgagctcgaagcccttcattgtctgtag

SEQ ID NO: 186678 - DNA, 1488 bp, Artificial Sequence
  Description of Artificial Sequence: Synthetic coding sequence
atggcccccgcccggggccggctgccccccgccctgtgggtggtgaccgccgccgctgccgccgccacatgtgtgtcagctgcaaggggagaggtgaatctcttggatacatccactatccacggagattggggatggttgacatatccggcccatggctgggatagcatcaatgaagtggacgagtcctttcagcctatccacacgtaccaggtgtgtaatgtgatgtcccccaaccagaacaactggctgagaactagctgggtacccagggacggggcacgcagagtgtatgccgaaatcaaattcactctccgggactgcaattcaatgccaggcgtgttaggcacatgtaaagagactttcaatttgtactaccttgagagcgatagggatctgggtgcatcgacccaggaatcgcagttcttaaaaatcgacaccatcgccgccgatgaatcctttaccggggccgacctgggcgtgcggagactcaagctcaacaccgaggtgcgctctgtggggccgttgagcaagagaggcttttaccttgcttttcaggatatcggcgcatgtcttgccatcctctctctccgcatatactataaaaaatgtcccgccatggtccgcaacctggcagctttctcagaagctgtgactggggccgactcatcaagtttggtggaggtacgaggccagtgtgtgagacatagtgaggagcgagatacccccaagatgtactgttctgccgaaggagaatggctggtgccaatcgggaagtgtgtctgttcagctggttacgaagaaaggcgcgatgcatgcgtagcctgcgagttgggcttctataagtcagcgcccggggaccagctttgtgcccgatgtcctcctcacagtcattccgcagcccctgcagcccaggcctgtcactgcgacctcagctactaccgcgccgccctggatcccccctctagcgcctgcacacggccacctagcgctcccgtcaaccttataagctcagtgaacggtacatcggtgaccctggaatgggctccaccgctggacccgggggggcggtctgacattacatacaacgcagtgtgtcgacggtgcccctgggccctctctcgctgtgaggcatgcgggagtgggactaggtttgtgcctcagcagacctccttggtgcaggcctctcttcttgtggctaatctgctagcacatatgaactacagtttctggattgaagccgtgaacggggtaagtgatctgtctcccgaacctcgaagggccgcggtggtaaacatcactaccaaccaggctggaaggcggcggaattctgtgccccagcgacctgggccccctgcttcacctgcgtccgacccctcccgcgaccagagctcggccggcgacgtgctgtgggcattcagacaagtgcccctttggccctgcgcccctcatcaggatcctgagttggaagcactgcactgtctgtag

SEQ ID NO: 186679 - DNA, 2955 bp, Artificial Sequence
  Description of Artificial Sequence: Synthetic coding sequence
atggccctggactacctgctgctgctgctgctggccagcgccgtggccgctatggaggaaaccctaatggatacacggactgccactgcagagctggggtggactgcgaatcctgcctcaggttgggaggaggtctctggttacgacgaaaacctgaatactattagaacctaccaagtttgtaatgtcttcgagccgaatcagaacaactggttattgaccacctttattaaccgcagaggcgcacaccgaatatatactgagatgcgatttactgtgcgagactgctctagcttgcccaatgtcccagggtcatgcaaggagacctttaacctctactactatgagactgacagcgtaatcgccaccaagaagtctgctttctggagcgaggcgccctaccttaaggtggatacaatcgccgccgatgagtcttttagccaggtggattttggcggaaggctgatgaaagtgaatacagaggtccgcagctttggcccattgacacgaaatgggttttatctggcttttcaagattacggggcctgcatgtctttattgtctgtgagggtcttttttaaaaagtgtccatcaatcgtccagaacttcgctgtgtttccagagacaatgacaggcgccgagagcaccagccttgtgatagccaggggtacatgcattccaaacgcggaggaagtggatgtcccaatcaaactctactgtaacggtgatggtgagtggatggtgcctatcggtcgatgcacctgtaaaccgggttacgagccagagaactccgtggcctgcaaagcctgcccagctgggacttttaaggcttcacaagaagccgaggggtgtagccactgcccatccaactctcgctctccagctgaagcgtcccccatttgtacatgtcggactggctactacagagctgactttgacccccccgaggtcgcgtgcacaagcgtgccatccgggccacggaacgtaatctccatcgttaatgaaactagcatcattctggagtggcacccaccacgggaaacaggtgggcgcgatgatgtcacctacaacataatctgcaaaaagtgccgggctgaccggcgcagctgttccagatgcgacgataacgtagagtttgtgccaaggcagcttggtctaacagagtgccgagtgtccatctccagtctgtgggcccatactccgtacacatttgatattcaagccataaacggagtatcaagcaagagcccctttcctccgcagcatgtatccgtgaacatcaccacgaaccaagccgcacccagtaccgttccaatcatgcatcaggtttccgctacaatgagaagtatcactctctcatggccccaaccagagcagccaaacgggatcattctggactacgagatccgctactatgaaaaagagcacaatgagttcaacagttctatggcgaggagccagacgaacacagctaggatcgacgggctgcgcccaggcatggtatatgtggttcaggtacgcgcccgaaccgtagccgggtatgggaagttttcgggtaagatgtgctttcagaccttgaccgacgacgattacaagagtgaattacgtgagcagctccccctgatcgcagggtctgctgcagccggagttgtgttcgtcgtctccctggtggcaatcagtattgtctgcagtcggaaaagggcctacagtaaggaggcggtttatagtgacaaactgcagcactattctacaggaagggggtctcccggaatgaagatctatatcgaccccttcacctatgaggatcccaatgaagccgtccgcgaatttgccaaagaaatcgatgtttcgtttgtgaaaatcgaggaggtgataggcgccggagagtttggcgaggtctataagggtcgactgaagcttcctgggaagcgagagatctacgtggccatcaaaaccttgaaggccggctatagcgagaagcaacggagggacttcctgtccgaagcctctataatgggccaattcgaccaccccaatattataaggcttgagggagtggtgactaagtctaggccggttatgatcattactgaatttatggagaacggggcactggattcattcctgcgtcagaacgatggtcaatttactgttatccagctagttggtatgctcaggggtattgctgcaggaatgaaatacctcgcggaaatgaactacgtccatcgggacctcgctgccagaaacatcctggtgaatagcaacctggtgtgtaaggtcagcgattttggtctctcccgctatctgcaggatgacactagcgacccgacttacacgagtagccttggcgggaagattcctgtccggtggacagccccagaggccatcgcctaccgcaagtttacaagtgccagcgacgtatggagttacggcatcgtcatgtgggaggtcatgtcattcggcgagcgtccttactgggacatgagcaatcaagacgtcatcaacgctattgaacaggactatcggctacctccacctatggactgtcccgccgcgctgcatcagttgatgctggactgttggcagaaggatagaaattccagaccccgtttcgctgagatagtgaacaccctagacaagatgataagaaacccagctagtctgaagactgtggcgaccatcacggcagtgccctctcaacccctgttagaccgttccatcccagatttcactgcattcactaccgttgacgactggttgagtgccattaaaatggtgcagtaccgggacagtttccttaccgcgggattcacctcattgcagctcgtgactcaaatgacgtctgaggatctgctgcgaattggcataaccctagctgggcaccagaagaaaatcttgaatagtatccattcaatgcgggtccagatctctcagagtccaactgctatggcttag

SEQ ID NO: 186680 - DNA, 1638 bp, Artificial Sequence
  Description of Artificial Sequence: Synthetic coding sequence
atgcaccaggtgagcgccaccatgcggagcatcaccctgagctggccgcaacctgaacaaccaaacgggatcatacttgactacgaaattcgatattatgaaaaggagcacaacgagttcaacagctccatggcccggtcccagactaacaccgcccgcattgatggccttagaccgggtatggtttatgtagtgcaggtccgggcaaggaccgtcgcaggatacggcaagttttcagggaagatgtgttttcagacgctcaccgatgatgattacaagtccgaactgcgggaacagctccctcttatcgccggctctgctgccgctggtgtggtgttcgtggtgtcattggtggcgatttccatagtgtgcagcagaaagcgagcatactccaaggaggcagtctattctgacaaactgcaacactattccacaggccgtgggtctccaggcatgaaaatctacatcgatcctttcacctatgaggaccccaacgaagctgttcgtgagttcgctaaagagattgacgtttcatttgtgaagattgaagaggtcattggcgcgggcgaattcggcgaagtgtacaaagggaggctgaaattgcccgggaagcgtgaaatctacgtggccatcaaaaccctgaaagccgggtatagtgagaagcaacggagggacttcctgtcggaggccagcataatggggcagtttgaccatcctaacattattagacttgagggcgtagtcactaaatcacgtcctgttatgatcattacagagttcatggagaatggagcacttgactcttttctgaggcagaatgacggtcagttcactgtgattcagctggtgggaatgctgagaggtatcgctgcaggaatgaagtatcttgccgagatgaattacgtgcacagggatctggccgctagaaacatcctagtgaattctaatctggtgtgtaaagtatccgactttgggcttagtcgctatctgcaagatgacacaagtgaccccacgtacactagctccctgggcgggaaaattcccgtgcgttggacagcgcccgaggcaatcgcttaccgcaagtttacatccgcctcagacgtgtggagctacggcatcgtgatgtgggaggtgatgagcttcggtgagcggccttattgggatatgagtaatcaggatgtgattaacgccatcgagcaagactatagattgccacctccaatggattgtcccgcagcactgcaccagttgatgcttgactgctggcagaaggaccggaatagtcgtcccagatttgctgagatcgttaataccctcgacaaaatgattcggaaccctgccagcctcaagacagttgcgaccatcacagctgtccctagccagcccctactcgaccgtagtatacctgatttcacggcatttaccactgtggatgattggctgtccgcgatcaagatggtgcaatacagagatagctttctgacagctgggttcacctccttgcagcttgtcacacaaatgacctccgaagacctgctccgcatcggcatcaccctggctggtcaccaaaagaaaattctcaatagtattcactcaatgcgagtccaaattagtcagtcccctacagcaatggcatag

SEQ ID NO: 186681 - DNA, 2997 bp, Artificial Sequence
  Description of Artificial Sequence: Synthetic coding sequence
atggcccgggcccggcccccccccccccccagccccccccccggcctgcttcctctgcttccaccactgttactcctgcccctcctgctactgcctgctggctgtagggctctcgaagagaccctcatggacacaaagtgggttaccagcgagcttgcttggacatctcatcctgagagcggttgggaggaggtttcgggatacgacgaggccatgaacccgatcagaacctaccaggtctgcaacgtgcgcgagtcaagtcagaacaactggttgcgcactgggtttatctggagaagggatgtccagagggtgtacgtggaattgaagtttaccgtccgggattgtaactctataccaaatatccccggtagctgcaaggaaacttttaacttgttttattacgaggcggacagtgacgttgcctcggcgagcagtcccttctggatggagaatccttatgtgaaagtggacaccatagctccggatgagtccttctcccgattggacgcaggccgggtcaacacaaaagttagaagtttcggcccactctctaaggccggattctatttggcatttcaagatcaaggggcttgcatgtcattgatttcagtgcgcgctttctataaaaagtgcgccagcaccactgcaggcttcgcactattcccagagacacttactggcgccgaacctacatcactcgttattgcacctggaacatgtattccaaatgccgtggaggtgagcgttccactcaagctctattgtaacggcgatggggagtggatggtcccagttggagcgtgtacctgcgctaccggccacgaacctgccgctaaggaaagccagtgtaggccttgccctcccgggtcgtataaagcaaagcagggggaggggccctgtcttccatgccctccaaatagtaggactacctcgcctgctgcctcaatttgcacttgtcataataatttctatcgggccgacagtgactccgccgactctgcctgtaccaccgtgccctctccgccccgcggcgtgatttcaaacgtcaacgagacttcactgattctcgagtggagcgagcctagagacttgggaggaagggacgatctgctgtacaatgtgatatgcaagaaatgccacggagctggcggcgcctcggcatgttccaggtgcgacgacaacgtcgagtttgtgcccagacaactgggattaaccgaacgcagggtccatatttcacacctgttggcgcataccagatacacatttgaggtgcaagctgtgaatggcgtgtcaggcaaatcacctctgcccccacgctatgccgccgtgaatatcaccacaaaccaggcagccccctccgaagtccccactcttaggctgcattcttccagtggctccagtctgactctgagctgggcacctcccgagaggcccaacggcgtgattttagactatgagatgaaatatttcgagaagagtgagggaatcgcttcaaccgttacttcacagatgaacagcgtgcaattggatggcttacggcctgacgcccggtatgtggtacaagtacgggctcggactgtggctggttacggccagtattcaaggcccgccgagttcgaaacaacgtcagagaggggctcgggtgctcagcagctccaagaacagctgcctctgatcgtcggtagtgccacggcgggacttgtgttcgttgtggccgtggtggttatcgccatcgtgtgcttgagaaagcaacggcacggttccgacagcgagtacactgagaagttgcagcaatatatagccccggggatgaaagtttacatcgatccattcacttatgaggatcccaacgaggcagtcagggagtttgcgaaggagattgacgttagctgcgtgaaaatagaagaggtgatcggggcaggagagtttggagaggtgtgtcgtggcagacttaaacagccgggcagacgggaagtgttcgtggccataaaaaccctcaaggttggttacactgagcgccaacgccgtgatttcctgtccgaggcaagtattatgggccagttcgaccaccccaatatcataaggctggaaggagtggtgactaaaagccggccggtgatgatccttacagagttcatggaaaattgtgctttggactcattcctccggttaaacgatggtcaattcacggtcatccagttggtgggcatgctgcgcggcattgccgccggcatgaagtatctgagcgagatgaattatgtccatcgtgatcttgctgcccgtaacattcttgtgaatagcaatctagtgtgtaaggtgagcgatttcggactttccagattcttagaggacgatccttccgaccctacctatacttcatcactgggcggcaagatcccaatcagatggactgctccagaggccattgcttaccgcaagttcacttcagcgagcgacgtgtggtcttatgggatcgtgatgtgggaggtgatgtcttacggtgagcgaccttactgggatatgtccaaccaggacgtgatcaatgcagtcgagcaggattaccgattaccacccccaatggattgccccaccgctctgcaccaacttatgctcgactgctgggttagggatcggaatttgcgccccaaattctcccaaattgtaaataccttagataagctgattagaaatgccgcttcactgaaggtcatagcatccgcacagtccgggatgtctcagcccttattagataggaccgtcccagattacaccacctttacaaccgtaggagactggctggatgcaatcaagatgggccgttacaaagaaagctttgtgtccgctggcttcgcctcctttgacttagtcgcccaaatgaccgccgaggatcttctgcggatcggggttactctggccgggcatcagaaaaagatcctgtcctcaatccaggatatgagattgcagatgaatcagactcttccagtacaggtgtag

SEQ ID NO: 186682 - DNA, 3066 bp, Artificial Sequence
  Description of Artificial Sequence: Synthetic coding sequence
atggccaccgagggcgccgcccagctgggcaaccgggtggccggcatggtctgtagtctgtgggtacttttacttgtgagtagcgtcctggccttggaagaagtcctgcttgatactaccggggaaacaagcgagattgggtggctcacctacccacctgggggatgggatgaagtgtctgttctcgacgaccaacgccggttgactcgcacttttgaagcttgccacgtggcgggtgctcctcctggcactggacaggacaactggctgcagactcacttcgtggagagaaggggggcacagagggcgcacatacggctgcacttcagtgttcgggcttgcagctctctcggagtatcaggcggcacatgcagagaaaccttcacgctgtactacagacaagccgaggaacccgacagcccagacagcgtcagctcttggcacctgaagagatggactaaggtagataccatcgcagctgatgagtcattcccatcatcttcatcatcatctagctctagtagcagcgctgcgtgggccgtcgggcctcatggtgccgggcagagggctggccttcaactgaacgtaaaggagcggtccttcggacctctgacgcagcgtggcttctatgtggcttttcaggacacaggagcatgtctcgccctcgttgctgtgcgcctcttttcctacacttgtcctgcggtacttcgcagcttcgcatcattccccgagacacaagccagtggcgcaggcggcgcctcgctggtagccgcagtgggcacatgcgtggctcatgccgaacccgaggaggatggtgtgggaggccaagcagggggttctccgccaaggctgcactgcaacggtgagggaaaatggatggtggccgttggcgggtgtcgttgccagccgggatatcaaccggccagaggcgacaaggcatgtcaggcctgccccagaggactgtacaaatctagcgctggcaatgctccctgcagcccatgcccggcaagatctcacgcacctaacccagctgcacctgtatgcccctgcctggagggattctaccgcgccagcagcgacccccccgaagccccatgtacagggccaccctcagctccccaagaactctggttcgaggtacagggaagtgcgctcatgctgcactggagactcccgagagaattaggcggaaggggggacctcctattcaatgttgtttgtaaggagtgtgaaggtcgccaggagccagcctctggtgggggcggaacatgccacaggtgcagagatgaggtgcacttcgaccctcgccagcgaggactgacagagagtagggttttggtgggcggactgagagctcacgtcccttatatcctcgaggtgcaagcagtcaacggcgtcagcgagctgtcacctgacccccctcaggccgccgctataaacgtctcgacctcccatgaggtgccaagtgcagtgccggttgtacatcaagtcagccgcgcttctaattcaatcacagtgagctggcctcagcctgatcagacaaatggcaacatcctcgattatcagctccgctactacgaccaggctgaagacgaatctcacagcttcaccctgacaagcgagactaatacagccaccgtaacccaactgtcccccggccacatttacggttttcaggttcgagctcggaccgcggccggccacggtccctatggggggaaggtgtacttccaaacgctgccgcagggcgagctgagctcacagctccccgagagactgtccttggtgatcggcagtatactgggcgctctggcattcctgctgctcgcagcaattaccgtgctggccgtggtgttccagaggaaacggagagggaccgggtatactgaacagctccagcagtattccagcccaggactgggtgtgaagtactacattgacccaagcacctacgaggatccgtgccaggctatacgggagttggcgagggaggttgatccggcatatataaaaatagaggaagtgatcggcacaggctcattcggcgaggttcgccaaggaaggctgcagcctaggggccggcgggaacaaacagtggcaatacaagctctgtgggccggaggcgccgagtctctgcagatgacttttcttggtcgggcggccgtcctgggccagttccagcatcctaacattttgcggctggagggggttgttactaaaagtagacctctaatggtgctgactgagttcatggaactggggccccttgatagtttcctgcggcagcgcgaaggccaattcagctccctgcagctagttgctatgcagcgcggtgttgcagccgccatgcaatacctcagtagtttcgctttcgtacaccggagcctttccgcacactcggtgttggtcaactcgcatctggtttgtaaagtcgcccggttaggacattctcctcaggggcctagctgtctgcttcgatgggccgctcccgaggtgattgcacatggtaagcacacaaccagttccgacgtttggtcctttggcattttaatgtgggaggtcatgtcttacggggagagaccatattgggatatgtctgagcaggaggtgctgaatgccattgaacaggagtttcggcttccgccacctcctggatgccctcctgggcttcacctgttgatgctcgacacctggcaaaaggaccgcgcccggagacctcattttgaccagctggtcgctgcctttgacaaaatgatcaggaagcccgatacactgcaggccgggggtgacccgggagagagaccttctcaggctctgctgacccccgtagccctggatttcccatgcctggactccccccaggcatggttaagcgccatagggttggagtgttaccaagacaacttctctaagtttgggttgtgtacattctctgacgtcgcccagctgtccctggaagatctgcctgctctgggcataaccctagctggccaccagaagaagctgcttcaccatattcagctcctgcaacaacacctccggcaacagggctccgtggaggtctag

SEQ ID NO: 186683 - DNA, 2235 bp, Artificial Sequence
  Description of Artificial Sequence: Synthetic coding sequence
atggccaccgagggcgccgcccagctgggcaaccgggtggccggcatggtatcagtcgggggctgcagatgccagcccggttatcagcccgcaagaggcgataaggcatgtcaggcatgcccccgcggactttataagagttccgctggcaatgctccgtgttccccatgtcctgctagatcccacgctccaaatcccgccgcgcctgtgtgcccctgtctcgaagggttctatagagcttcaagtgatccacccgaggctccatgcacaggccccccttctgcgcctcaagagctatggtttgaggttcagggcagcgctttaatgctccattggagactgccacgggagctcggtggtcgcggtgacttacttttcaacgttgtgtgcaaggagtgcgagggccgtcaggaacccgctagcggaggggggggcacttgtcacagatgtagggacgaagtgcacttcgacccccgccaacgcggcttgaccgagtcccgggttctagtcgggggcctgcgagcccacgtgccttacattcttgaagtccaggccgtcaacggagtctctgaattgtcccccgaccccccacaggccgctgccattaacgtgtcaacatctcacgaggttcccagcgctgtgccagtggtgcatcaggtgtccagggcatccaactccatcactgtcagctggccgcagccagatcagactaacggaaatattttggactaccagctacgatactatgatcaagccgaagacgaatcgcactcttttaccctgacttctgagaccaataccgcgaccgtgacccaattgtctcccgggcatatctacggttttcaggtccgggccaggaccgccgccggccacgggccatatgggggcaaggtctactttcagacattaccgcaaggagaattgagctctcaattgcctgaacgactgtcattagtaatcggatctatcctgggggccctggcattcttgctcttggctgccattacggtcctggccgttgtttttcaacgcaagcgccgaggtactgggtacacagagcagctgcagcagtacagttcccccgggctcggagttaagtactatatcgatccttccacgtatgaagatccttgtcaagccattagagagctcgctagagaggttgatcctgcctatattaaaatagaggaggtgattggcacaggctcgtttggcgaggttagacagggacgcctccagccacgcggaaggagggagcagaccgtagctatccaggctttgtgggccggcggagccgagagcctccagatgaccttccttggccgggctgccgttctggggcagtttcagcaccccaacattctccggctcgaaggagtggtgacaaaaagcagacctctgatggtgttaacagagttcatggaactcgggccgctggactcttttttgagacagcgggaggggcagtttagcagcctacaactcgtggccatgcagcgcggggtggccgcggctatgcagtatctttcaagcttcgctttcgtccaccgctctcttagcgcccactctgtattagtgaacagccatctcgtctgcaaggtcgcccgtctgggccattcgccacagggtccctcttgtttgctgagatgggcagcaccggaggttatagcgcatgggaagcacaccacatcttctgatgtgtggagcttcggcattttgatgtgggaggtcatgagttatggggagcggccatactgggatatgagcgaacaggaggtcttaaacgcaatcgagcaggagtttagactcccgccgccgccagggtgtcccccagggcttcaccttttaatgctagatacttggcagaaggaccgggcccgccgtcctcacttcgaccagctcgtggctgcattcgacaagatgatcaggaaacccgataccctccaggccggcggggatcccggggaaagaccgtcacaagcgctcctgactccagtggctcttgacttcccctgtcttgacagcccccaagcttggctgtccgctattggtctcgagtgttaccaagataatttttccaagtttgggctctgcaccttcagcgatgtcgctcagttgtcattggaggatttaccagctcttggaataactctggccgggcatcagaagaagctgctccatcacatccagctgctccagcagcatttaaggcaacagggctcagttgaagtgtag

SEQ ID NO: 186684 - DNA, 3066 bp, Artificial Sequence
  Description of Artificial Sequence: Synthetic coding sequence
atggccaccgagggcgccgcccagctgggcaaccgggtggccggcatggtgtgtagcctctgggttctcctgctcgtctcatccgtactggcacttgaggaagtgctcctggacacaacaggtgagacctctgagattgggtggctgacctatccgcctgggggttgggatgaagtcagtgtgctagatgatcaacggcgattgactagaacttttgaggcctgtcacgtagcgggagcacctcccggcactgggcaggataactggctgcagacgcactttgttgagcgcagaggggcccagagagctcatattcgcctccacttctcagtacgggcttgcagcagtctgggcgtttctggcggcacctgtcgggagactttcacactatattacagacaagcggaggagcccgactctccggacagtgtttcatcatggcacctaaagagatggactaaggttgacactatcgccgccgatgagtcgttcccctccagcagttctagcagcagttcatcttcatcggccgcctgggccgtggggccgcacggggccggccaaagagcaggtctccaacttaacgtgaaggagcggagcttcggccctctgactcaacggggcttttatgttgcttttcaagatactggggcctgccttgccctcgtagccgttcggttgttctcctatacttgtccagccgtgctgagaagcttcgctagctttcctgagacacaagccagcggtgctggtggggcctcacttgttgccgccgtggggacatgtgtggcgcatgccgagcctgaggaagatggagtcggtggtcaggctggtggatctcccccgcgactgcactgtaacggcgagggcaagtggatggttgcagttggggggtgccggtgtcaacccggataccagccagcccgcggcgataaagcatgtcaggcgtgtccccggggactgtacaagagctccgccggcaatgcaccatgctctccctgccctgcccgcagccacgcccccaatcctgccgccccggtgtgtccttgtctggaagggttttacagagcctcctccgacccgcctgaggcgccatgcaccggtcctccctccgctccccaggagctgtggtttgaggtgcagggatcagctctcatgctgcattggagattgccccgggagctgggtggcagaggtgacctgcttttcaatgtcgtgtgcaaggagtgcgagggacgccaggagccagcctccggcggaggaggaacatgtcatagatgccgggacgaagtgcatttcgatccacggcagagaggattaactgagtctagagttctggtcggcgggctgcgggcacacgtaccctatatcttggaggttcaggcagtgaatggagtcagcgagttgagtccggatccaccccaggccgccgccatcaatgtctccacttcccacgaagtaccgagtgccgtaccagtggtgcaccaggtgagcagggcaagcaacagcatcactgtgagctggccacagccagaccagactaacggaaacatactcgactaccagttgaggtactacgatcaggcagaggacgagagtcacagttttactcttaccagcgaaaccaacacggccacagtgacacagctgtcccccggacacatatacggcttccaggtgcgggctagaaccgccgcaggacatggcccctatggaggcaaggtgtactttcaaacactgcctcagggcgagttgtcttctcaactacctgaaagactgagtcttgtgatcggctctattctgggagctctagccttcctgctgttagcagcgatcacagtgcttgccgtcgtattccaaagaaagcgaaggggaacaggatatacagagcagcttcagcagtactcctcacccgggcttggcgtgaagtactacatagacccatctacctacgaagatccctgtcaggccatccgcgagcttgccagggaagtggacccggcctacattaagatcgaagaagtcattggaaccggctcattcggagaagtcagacaaggtaggctgcagccacgcggacgaagagagcaaactgtggcgattcaggcgctgtgggccggcggggccgagtctctgcagatgacttttctggggcgggctgcagtattagggcagtttcagcatcccaatattcttagacttgagggagtggtcaccaaatcacgccctctcatggtattaacagagttcatggaactgggtcctttagacagctttctgcgacagagagagggccagttcagttcacttcagctggttgctatgcagcggggagtagccgcagccatgcagtatttaagttccttcgcatttgtgcataggtctctgagcgcccactctgttctcgtgaactcccatctggtgtgcaaagtggccaggctcggccactctcctcagggcccttcctgccttctaaggtgggccgccccagaggtcatcgcccacggtaaacataccacctcaagtgatgtctggtcttttgggattctgatgtgggaggtaatgagttacggggaacgcccatactgggatatgagcgaacaggaggtgctcaatgccatcgaacaggagttccgattacctccaccccccgggtgtcccccaggactgcatctgttgatgctcgacacttggcagaaggacagagcaaggaggccccattttgaccagctggtagcagctttcgacaagatgattcgtaaacctgatactcttcaagcggggggcgatcccggcgaaagaccctcccaggccctgctgacacctgtggccctggatttcccgtgtctggacagtcctcaggcatggctgtcagccattgggctggagtgctaccaagataacttctccaaatttggtctgtgcacattcagtgacgtggcccagttgtctctagaggatctgccagcgctcggcatcactctcgctggccaccaaaagaaactgcttcatcatatacagctactgcagcagcatttaaggcagcaggggagcgtggaggtgtag

SEQ ID NO: 186685 - DNA, 654 bp, Artificial Sequence
  Description of Artificial Sequence: Synthetic coding sequence
atggccggccggaccgtgcgggccgagacccggagccgggccaaggacgatatcaagaaggtaatggccaccatcgagaaggtccggaggtgggagaagagatgggtgaccgtaggagacacaagcctgcggatctttaaatgggtgcctgtcgtggatccccaggaggaagaaagaagaagagccggtggcggcgcagagaggagcaggggacgcgaaaggagagggaggggggcaagcccccggggcggtggcccgctgatccttctcgacttaaacgatgaaaactccaatcaatcatttcactccgagggttccctgcagaaagggacagagccttcccccggcggaacaccacagcccagcaggcctgtcagcccagccggccctccagaaggggtgcctgaggaagcccaaccccctaggcttggccaggagagagacccagggggaattaccgccggttctacagatgagccacctatgttaaccaaggaagagccagtgcccgagctgctcgaagccgaagctcctgaagcgtatcccgtatttgagcctgtgccaccagtgccggaggcagcacagggcgatactgaggattctgagggtgcgccacctctgaagcgcatatgccctaatgcccctgatccatag

SEQ ID NO: 186686 - DNA, 717 bp, Artificial Sequence
  Description of Artificial Sequence: Synthetic coding sequence
atggccgccgcccccctgctgctgctgctgctgctggtgcccgtgcctctgctgcctctgttggcacagggacccggaggagccctgggaaacaggcatgcagtctactggaatagctcgaaccagcacctccgccgagagggctatacggtgcaggtgaatgtaaacgactatctggacatctactgcccccattacaacagtagcggcgtgggccccggggcgggcccaggacctggcggtggagccgagcagtacgtgttatatatggttagtcgaaacggctacagaacgtgtaacgcttctcaggggttcaaacggtgggagtgtaatcggccccacgcaccccattcccctatcaagttcagtgaaaagttccagagatattcagcctttagcctaggctatgaattccatgccggtcacgagtattattacatctcaacccccacccacaatctccactggaagtgcctgaggatgaaagtgtttgtctgctgtgcgtcaacgagtcacagtggggagaagcctgtgccaaccctccctcagttcacgatgggccccaacgttaagattaacgtcctagaggacttcgagggggagaatccccaggtccccaagctagagaaatccattagcggaacttcacccaaacgcgagcatctgccgctggcagtgggtatcgcgttctttctgatgacattcctagcgtcctag

SEQ ID NO: 186687 - DNA, 639 bp, Artificial Sequence
  Description of Artificial Sequence: Synthetic coding sequence
atggccgccgcccccctgctgctgctgctgctgctggtgcccgtgccactgctgccactcctggcccagggaccaggcggagccctgggaaacaggcacgctgtttactggaattccagcaaccaacatcttaggcgggagggctacaccgtgcaagtgaacgtgaacgattaccttgatatctactgtcctcactacaactcttctggtgtgggcccaggcgccggaccaggacccggaggcggagcagaacagtacgttctgtacatggtatctcggaatgggtacaggacttgtaatgcctcacagggatttaagaggtgggagtgcaatcggccccacgccccccattcgcccatcaaatttagcgaaaagtttcagcgctacagcgcattcagtctgggatatgagttccacgcaggtcatgagtactattacatctccacgccaacccacaacctccattggaagtgcctgcgaatgaaggtcttcgtttgctgcgcatcgaaagattttgagggcgagaatcctcaggtgcctaaactagaaaaatcaatcagtgggaccagccctaaaagagagcacctgccgttggccgtgggcatagcattcttcttaatgacttttctggcctcatag

SEQ ID NO: 186688 - DNA, 702 bp, Artificial Sequence
  Description of Artificial Sequence: Synthetic coding sequence
atgcggctgctgcccctgctgcggaccgtgctgtgggccgccttcctgggctctcctttgcggggaggttccagcctgcgtcacgttgtgtactggaacagcagtaacccatccctcaggagagagggttataccgtacaggttaatgttaatgactacttagatatctattgcccgcattataacagcagcggagtggggcccggagcgggcccaggccccggaggtggcgccgaacagtacgtgttgtacatggtgtcccgcaacggctaccgcacttgtaatgccagccaggggtttaaaagatgggagtgtaataggcctcatgcacctcattctcctatcaaattttccgaaaagttccagaggtactccgccttttccttgggatacgaatttcacgctgggcatgaatattactatataagcactcccacacataatttacactggaagtgcttacggatgaaagtattcgtgtgctgtgcctcaacctcacactccggcgaaaaaccagtacccaccctgccccagtttacaatggggcctaacgttaaaattaacgtgctcgaggacttcgagggtgagaacccacaggtccctaagctagagaaaagcatttctggcaccagtccaaagcgggaacacctgcctctcgctgtaggaatcgcctttttcttgatgacttttcttgcctcctag

SEQ ID NO: 186689 - DNA, 582 bp, Artificial Sequence
  Description of Artificial Sequence: Synthetic coding sequence
atgcggctgctgcccctgctgcggaccgtgctgtgggccgccttcctgggttctccccttagaggaggatcaagtctgcgacacgtcgtgtattggaactcatctaaccctcgattgctgagaggagatgccgtcgttgaactggggcttaacgactacctagatattgtctgtccccactacgaagggcctggtcctccggaaggtcctgagactttcgcactgtatatggttgactggccaggctacgaatcttgccaagccgagggcccgagagcatataagcgttgggtgtgctccttacctttcggccatgtgcagttctctgaaaaaattcagaggtttactccgttcagcttaggatttgaattcctccccggtgaaacttactattatatctcggtgcccacacccgagtcgagcgggcagtgcctgcggctccaggtcagcgtgtgctgcaaggagaggaacttgcctagccacccgaaggagcctgagtcgtcccaggacccactagaggaggaaggttcactgctccctgcccttggggtcccaattcagaccgataaaatggagcactag

SEQ ID NO: 186690 - DNA, 606 bp, Artificial Sequence
  Description of Artificial Sequence: Synthetic coding sequence
atgcggctgctgcccctgctgcggaccgtgctgtgggccgccttccttggttcaccactccggggaggaagtagtctgagacatgtggtgtattggaattccagcaatccccgcctcctcaggggtgatgctgtggttgagttgggcctgaatgattacctcgacattgtctgtccgcactatgaggggcccggccccccagagggccctgagacctttgctctgtacatggttgactggccgggatacgagagctgccaggcggaagggcccagagcgtataagagatgggtctgcagtctgccattcggacacgtgcaattctcagagaagattcagaggttcacccctttttcgctgggatttgagtttctgcccggggaaacatactattacatctccgtgcctacacccgagagttcaggccagtgtctgagacttcaggtgtccgtatgctgcaaggagagaaagagtgagtccgcacaccctgtgggcagcccgggcgaaagcggcactagcggttggagaggcggcgatacccccagccctttgtgtctcttgttgctcttgctgttgctaattctgagactgctgcgaatcctctag

SEQ ID NO: 186691 - DNA, 624 bp, Artificial Sequence
  Description of Artificial Sequence: Synthetic coding sequence
atgcggctgctgcccctgctgcggaccgtgctgtgggccgccttccttggatctcccctccgtggcggctcaagcctgcgacacgtggtgtattggaactctagcaaccctcgtttactgcggggggatgccgttgtggagcttggcttgaatgactatttggacatcgtctgccctcattacgaaggccctggcccaccagaaggtccagaaaccttcgcactatatatggtggattggcccggctatgaatcttgccaggcagagggcccaagggcatacaagcgttgggtctgtagcctgccattcggtcacgtccagttttccgaaaaaatccagagatttaccccctttagccttggctttgagtttctccccggagagacctattattacatctcagtacctactcctgagagctccggtcagtgtctgagattacaggttagtgtctgctgcaaggagcgaagggcgcgtgtcctgccacggagtccagggggtggcggtattcctgcggcttgtactggcggtgccaacagtgatcggcaggatggtgccttaatgggagagatcagagggtccgaggtcacccttgccggtgcatgcccactgatcactgggtag

SEQ ID NO: 186692 - DNA, 1083 bp, Artificial Sequence
  Description of Artificial Sequence: Synthetic coding sequence
atgagcgacagcaaggagccccggctgcagcagctgggcctgctggtaagtaaagtgcctagctctatctcccaagagcagtccagacaggatgctatttatcagaacctcacgcaactgaaggcagctgtgggtgagttatcagaaaaatcaaagcttcaggagatctaccaggagttaacccagttaaaggccgccgtgggggagttgccagagaagagtaagcttcaggagatatatcaggagttgacacgcctaaaggccgccgtcggagagctaccagaaaagagcaagttgcaggagatatatcaggaactaacgtggctgaaggccgcggtcggcgaactgccggagaagtccaaaatgcaagagatttaccaggagctcacacggcttaaggccgcggtaggtgagctgcccgagaagtcaaagcagcaagaaatctaccaggaactcacccggctcaaagccgctgttggggagttgcctgaaaaatcgaagcagcaagaaatttaccaagaactgacccgactcaaggccgcagtcggggagctaccagagaagtctaagcaacaggaaatttaccaggagctcacccagctcaaagctgctgtggaacggctgtgccacccttgtccttgggagtggactttctttcaaggtaactgctacttcatgagcaattctcagcgtaattggcacgacagtataaccgcctgtaaggaggtcggggcccagttggttgttattaaaagtgccgaggagcagaacttccttcagttacagagcagcaggagcaatagattcacttggatggggctctctgacttgaaccaggagggtacttggcagtgggtggacggaagtcctttactgccaagtttcaaacagtactggaatagaggggaaccaaataacgttggcgaggaagattgcgccgagttttctggcaatggttggaatgatgacaagtgtaacctcgctaagttctggatctgtaagaagagcgccgcttcttgctctcgggatgaggagcagtttttaagcccggctcccgccactccgaatcctccgcccgcctag

SEQ ID NO: 186693 - DNA, 888 bp, Artificial Sequence
  Description of Artificial Sequence: Synthetic coding sequence
atggagaagatgagccggcccctgcccctgaaccccaccttcatcccacccccctatggcgtgctgcgctctctcctagagaacccactaaaactaccgttgcaccacgaggatgcttttagtaaagataaagataaagagaagaagctagacgacgagtccaacagccctaccgtgccgcaatccgcgttcctcgggcccacactgtgggacaaaacactcccctatgacggcgacacctttcagctggagtatatggatctggaagagttcctttctgagaatggaattcctccaagccctagtcaacacgatcacagtcctcatcctccgggcctgcagcctgcatcttcagccgccccaagcgtcatggatttgtcttccagagcgtccgcccctctccatcctggcattccaagccctaactgtatgcagtcgcctatcagacccggccagcttctgcctgctaatagaaatactcccagtccgatcgatcccgacacaatccaggtgcccgttgggtacgagcctgaccctgctgaccttgccttgtcctctatcccaggccaggaaatgtttgaccctcgaaaacgaaagttctctgaagaggaactgaagccgcagccaatgatcaagaaggctcgaaaagtcttcatacccgacgacctgaaagacgacaagtattgggcgcggcggcgcaagaacaacatggcggctaagcggtcacgagacgctagacggctcaaggagaatcaaatcgccatccgggcctctttcctggagaaggagaattccgctctccgccaggaggtcgcagacttacggaaggaacttggtaaatgtaagaatattttagctaagtacgaggccagacatggccccctgtag

SEQ ID NO: 186694 - DNA, 780 bp, Artificial Sequence
  Description of Artificial Sequence: Synthetic coding sequence
atggccgccgccgcccagctgagcctgacccagctgagcagcggcaaccccgtctacgaaaaatattaccgtcaggtggataccggcaacaccggtcgggtcttagctagcgatgcagctgcgttcctcaaaaaaagtgggctgccagaccttatactggggaagatctgggacttggcagatactgatggcaagggcattctcaacaagcaggaattttttgtggctctacgtctggtggcctgtgcacagaatggccttgaggtgtcactctccagcctgaatctcgcggtacctccgccccgattccatgatacttccagtccccttctgatctctggcaccagcgcggcagaactcccttgggccgtgaaacctgaagataaggccaaatacgatgcaatatttgacagcctatcccccgtgaatgggtttttgtctggagataaagtcaagcccgttctgctgaactccaagctgcctgtcgacattctgggacgcgtgtgggagctgagtgatatcgatcatgatggcatgttggatagagatgagttcgccgtgacggaatctcattctgtaacgcaagctggtgtacagtggcgagacctttcttcgctgcagccgagacctcccggatttaaactgttctttcacctgagtctgctccggagttgggattatcgccatgctcccccacccccagccaacttctatatattctcccgagattcagtaagcccttgtctgcccgattggagtcgagcccctgacaataggtag

SEQ ID NO: 186695 - DNA, 2289 bp, Artificial Sequence
  Description of Artificial Sequence: Synthetic coding sequence
atggccgccgccgcccagctgagcctgacccagctgagcagcggcaaccctgtatacgagaaatattaccggcaggttgacaccggcaatactggtcgggtgttggcctctgatgctgccgctttcctgaagaaatctggactgcccgacctaatcctcgggaagatttgggatcttgccgataccgacggaaaaggcatactcaacaaacaggaatttttcgttgccctccggctcgtggcttgcgcccagaacggcctggaagtttccctgtctagcctgaatctggctgtccctccaccacggtttcatgacacaagtagccctcttcttatcagcgggacttctgcagcagagctcccttgggcagtgaaacctgaggacaaagcgaaatatgacgccatttttgattccctgagtcccgttaacgggttcctgtcgggtgacaaggttaaacccgtcctcctcaacagtaagttaccagttgacatactggggagagtctgggaacttagcgacatcgaccacgacggaatgttggatagggacgagttcgccgtggccatgttcctcgtatattgcgccctcgagaaggagccagtacccatgagcctgccccccgccctagtcccgcctagcaaaagaaagacgtgggtagtctctccagccgagaaagctaagtatgacgagatatttctcaaaaccgataaggatatggatgggttcgtatccgggctggaggtacgggaaatttttctcaaaaccggtctgccgtccactttgctggcgcacatatggtctttatgtgacacaaaggattgcggaaaactttccaaagaccagtttgcactcgcctttcatctgatctctcaaaagttgatcaaaggcatcgatcctccgcatgtactgacacccgaaatgataccccctagtgacagagcctctctccagaagaatatcattggatcaagtcctgtggctgatttcagcgcgattaaagaactcgatacacttaataacgaaatagtggatctgcagagagagaaaaataatgtcgaacaggatctcaaagagaaagaagacactatcaaacagaggaccagtgaggtccaggatttgcaggacgaggtccagcgagagaatactaacctgcagaaactccaagcgcagaaacaacaagtccaagagttgctggacgagctcgacgaacaaaaggcacagcttgaagagcagttgaaggaagttaggaaaaagtgtgccgaagaagcccagttagcccgcagttcgccagaactgctcccttctggggtgaccgatgaaaacgaggttacgaccgctgtgaccgagaaagtctgctctgaactggacaacaatcgtcatagcaaggaagaggaccccttcaatgtggactcttctagcctcacagggcccgtggcagacaccaatctggacttcttccagtctgaccccttcgtgggcagcgatcccttcaaggacgacccgtttggtaagattgacccgtttgggggcgatcccttcaaggggtcggatccgttcgctagcgattgctttttcagacagtccaccgatcccttcgcaacctcatccacagacccattctctgctgccaataatagttctattacgtccgtggagaccctcaagcacaacgacccattcgcccccggaggaacagtagttgccgcaagcgactcagcgaccgaccccttcgcctccgtgttcggcaacgaatcgtttggcgggggcttcgcagacttctccacactgagcaaagtcaacaacgaagatcccttccgctctgccacgtcctcttctgttagcaacgtggtaatcaccaagaacgtattcgaggaaacttctgttaaatctgaagatgaaccacctgccctccccccaaaaatcggcacacctactagaccatgtcctctgccccctggaaagcgcagcatcaacaagctcgacagccctgatccattcaaactcaatgacccatttcagccttttcccgggaacgattcacctaaagagaaagatccagagattttttgcgacccattcacaagtgccaccacaaccaccaataaagaggctgacccctccaacttcgccaacttctctgcatacccaagcgaagaagacatgatcgagtgggccaagcgtgagtccgagcgagaagaggaacaaagactcgctcgcctcaatcagcaggaacaagaagacctggaattggctattgcccttagtaagagtgagatatcagaggcatag

SEQ ID NO: 186696 - DNA, 2691 bp, Artificial Sequence
  Description of Artificial Sequence: Synthetic coding sequence
atggccgccgccgcccagctgagcctgacccagctgagcagcggcaatccagtctatgagaaatactacaggcaggtcgacactggaaacacagggcgcgtgcttgccagcgatgccgcggccttcctgaagaagtccggtctgcccgacctgatcctgggcaaaatttgggatcttgcagatactgatggcaagggtatcctcaataaacaggagttctttgtggcgttacgactcgttgcatgcgcacagaacggcctggaggtatcactgtcctctctcaatctcgcggtccctcccccccgcttccatgataccagcagccctctgttaatctccggcacatccgcagctgaactgccctgggcagtgaaacccgaggataaagccaagtacgacgccatctttgactcccttagtcctgtcaacggtttcctgagcggagacaaggttaaaccagtgttgctcaactccaaactgcctgtggatatcctgggacgggtgtgggagctctctgacattgatcacgacggcatgttagatagagatgaatttgctgtggctatgtttctggtatactgcgctttggaaaaggaacctgtcccaatgtccctaccacccgccctggtacctccatccaagcggaagacttgggttgtatccccagccgaaaaagctaagtacgatgagattttcctgaagaccgacaaggacatggacggctttgtgagtggtttggaagtgcgcgaaatctttcttaaaacaggcctgcctagcacgcttttggcacacatttggtccttgtgcgatacaaaggactgtgggaagctcagtaaggaccagttcgccctggccttccacctgattagccaaaaactgatcaaaggcatcgacccgccccatgtgcttactcccgagatgattccccctagcgatagggcttcactccagaagaatatcatcggcagctccccagttgctgatttcagtgctattaaagaactcgacactctgaataatgagatcgtggatctccagagagagaaaaataacgtggagcaggatttgaaggaaaaggaagacacaatcaagcagcgtacctcagaagtccaggatctgcaggacgaggtgcagagagaaaatacgaatctccagaagctccaggcccagaagcaacaagttcaggaattgctggacgagctggacgaacaaaaggctcagctggaagaacagctgaaagaggttaggaagaaatgcgccgaagaggctcagttgatttcctctctgaaagccgaactgactagtcaggaatctcaaatcagcacttacgaagaagagctggcgaaggctagagaagaattgagccgactgcagcaggagacagccgaactggaggagtccgtggagagtggaaaagcacagctggaacctttgcagcagcatctacaggacagccagcaagaaatttctagcatgcagatgaaattaatggaaatgaaggatctggaaaatcataacagccagcttaactggtgctcctcaccccattctattctggtgaacggagcgacagattactgttctttaagcacctcttccagcgagacagctaacctcaacgagcatgttgaaggacagagtaatcttgaatcggaaccaatacaccaggagtcgcccgctagaagctcccctgaactccttccgagcggcgttacggacgagaatgaagtgaccacagctgttacagagaaagtatgcagtgaattggacaataacaggcatagcaaggaggaggatcccttcaacgtggactcttccagcctcacaggacctgtggctgatactaatttggatttttttcagtccgatcctttcgtgggaagtgatccctttaaggacgacccatttggcaagatcgacccattcggtggcgatccttttaaaggatccgatcccttcgctagtgattgcttttttcggcaatctaccgatcccttcgccaccagctctacagatcccttctcagcagctaacaactcatctattacgtctgtagaaacgttgaaacataacgacccattcgcacccgggggaaccgtagtggctgcctcagatagtgctactgaccccttcgcgtctgtgttcggcaatgagtcttttggtgggggctttgccgatttttctactctctcaaaggttaacaatgaagatcctttcaggtccgccacctccagcagcgtctctaatgttgtgatcacaaagaatgtgtttgaggaaactagcgtcaaatctgaggatgagccccctgcactcccacctaaaatcgggactccaaccagaccatgcccgctgccacctgggaaacgctccataaataagcttgatagtcctgaccccttcaagctgaacgacccgttccagcccttcccagggaacgattcccctaaagagaaagacccagaaatcttttgcgacccgtttacatccgcgactactactaccaataaggaggctgaccctagtaactttgccaattttagtgcctatccttccgaggaggatatgatcgagtgggctaaaagagagtctgaacgcgaggaagagcagcgcttggcccggctaaatcagcaggaacaagaggatcttgaattggcaatcgctctatctaagagtgagattagcgaggcatag

SEQ ID NO: 186697 - DNA, 1722 bp, Artificial Sequence
  Description of Artificial Sequence: Synthetic coding sequence
atgatcctgatggtgcgggactgcctgaagagccagcaccgggaccctcactgcgacccctccgataagagagaaaaaaataatgtagaacaggaccttaaagagaaggaagataccatcaagcagagaacctccgaagtgcaggatctccaggacgaagttcagcgggagaacactaatctgcaaaaactccaagctcagaagcagcaggtacaggaactactggacgagttggatgagcagaaggcacagttggaggaacagttgaaggaggtccggaagaagtgcgcagaggaagcccagctaatttcgtctctcaaggccgaactaacatcacaggagagccagatctcaacatacgaggaagagctggcgaaggcccgtgaggagctctcaagactgcagcaagagaccgccgaactcgaggagtcagttgaaagcggaaaggcacagctggagcccctccagcagcatctgcaggactcccagcaggagatcagttctatgcaaatgaagctgatggagatgaaggacctagaaaaccataactcccagcttaactggtgctcatctccccacagcatccttgttaatggagcaacagattactgcagcctgtctacgtctagctcagagaccgctaacttaaatgaacacgtagaaggccagtctaacctggagagtgagcctatccatcaggaatcccctgctagaagctcacctgaacttctgccctctggcgtcaccgatgaaaacgaggtgaccacggctgttactgagaaggtttgcagcgagctggacaacaacaggcacagcaaggaggaggacccttttaatgttgactcctcatcactaacaggcccggtggccgatactaacctcgatttctttcagagtgatccattcgtagggtctgatcccttcaaagacgacccattcggaaaaattgatccttttggcggcgaccccttcaagggctcagacccttttgcgtctgactgcttttttaggcaatcaaccgatccattcgcaactagtagcaccgatccattcagcgctgctaataactcctccattacctccgtggaaacactgaaacataatgatccttttgcaccgggaggcaccgtggttgcggccagcgactctgccactgacccctttgcgagtgtgtttggaaatgaatcgttcggcggaggcttcgcagatttctccaccctgtccaaagttaataacgaagacccatttagatccgcgaccagctctagcgtttccaacgtcgtgatcacaaagaatgtgttcgaggaaacgtccgtcaagtcagaggatgagcctcccgcccttcccccaaagatagggacccccaccagaccctgtccgctccctccgggcaagcggtcaattaacaagttggacagcccggatcccttcaaactgaatgacccattccagcccttcccagggaacgatagccctaaggagaaggaccccgaaatattctgcgatccatttacctccgccaccacaacaacgaacaaggaagctgatccttcaaacttcgcgaattttagcgcatatccttctgaggaagatatgattgagtgggccaaacgggaatcagagcgcgaggaggagcagcgactggcgagactgaaccagcaggagcaggaggacctggagttggcaattgccctttcgaagtccgagatctcagaggcgtag

SEQ ID NO: 186698 - DNA, 2469 bp, Artificial Sequence
  Description of Artificial Sequence: Synthetic coding sequence
atgaacggccacatcagcaaccaccccagcagcttcggcatgtacccgtcccagatgaatggatacggatcatcccccaccttcagccagacagaccgagaacacggatctaagacttcagcaaaggcactctatgagcaaagaaagaattacgcccgggactccgtgagttccgtgtcagatatctcacagtatagggttgagcatctgaccacctttgttctggatcggaaggacgctatgattacagttgatgatggcatccgaaaactgaagctcttagacgcaaaaggcaaagtttggactcaggacatgatcttacaggtggacgaccgtgccgtctctctaatcgatctggagagcaaaaatgaactggaaaatttccctctgaacacaatacagcactgccaagcagtgatgcactcctgtagttatgactccgtactggcgctggtctgcaaggagcccacccagaacaaacctgacctacatctgtttcaatgtgatgaggtgaaagcaaacctgattagtgaagatatagagtcggccatttctgacagcaaaggcggcaagcagaagcgccgacctgacgccctcaggatgatctccaatgctgatccctcaattccgccaccgccaagagctcccgcacccgcacctccagggaccgtcacacaggttgatgttagaagccgcgtcgctgcatggtccgcctgggccgcagaccaaggcgacttcgagaagccacggcagtatcacgagcaggaagagactccagagatgatggctgctagaatcgacagagacgtgcagatcctgaatcatatcctagacgacatcgagttttttatcacaaagctccagaaggccgctgaggctttttccgagctgtccaaacggaaaaagaacaagaaaggcaaacgcaaaggaccaggggaaggagtgctcacactacgagcgaaaccccctccccctgatgaattcctcgattgcttccaaaagtttaaacacgggttcaatctgctcgccaagttaaagagtcacatccagaacccaagcgccgctgacctcgtccattttctcttcacgcccctgaacatggtggtgcaggcgacaggtggtccggaactcgctagtagtgtgctgagccctctgctgaataaggatactatcgattttctcaattacaccgtgaacggggacgagcggcagctgtggatgagtctgggggggacctggatgaaagctcgcgccgagtggccgaaggaacaatttatacccccttacgtaccccggttcagaaacgggtgggagcctcccatgctcaattttatgggcgctactatggagcaggatctttatcagcttgccgagtccgtggccaatgtcgccgagcatcagcgcaaacaggagatcaagcgcctctcaacggagcacagctcagtctccgagtatcatcctgccgatggttatgcattcagttccaacatttatactcggggatcccacctagatcagggggaggctgcagtggccttcaagcctacttcaaaccgtcatatcgatcgaaattatgagccactcaagacacaacccaaaaaatatgctaaatccaagtatgatttcgtcgccaggaacaatagcgagctgagcgtactgaaggacgacatcctggagattctggatgatcgcaaacagtggtggaaggtccgtaacgccagcggtgactcagggtttgtgcctaataatatcctcgatatagtgaggcctcctgagagtggactaggcagggccgaccccccctacacgcacacaatccaaaagcagaggatggagtacgggcccaggccagctgataccccaccagctccatccccacctcctaccccggcgcctgtgcccgtgcctctacctcccagcacacccgctccagttcccgtttccaaggtcccagcaaatattacgcggcagaactcctcaagctctgactctggaggtagcatcgttcgggactcccagaggcacaaacagctgcccgtagatagaaggaagtcacaaatggaggaggtccaagacgagctgatccacagactgacaatcgggcggagtgcagcccagaaaaaatttcacgtgccaagacagaatgtgcctgtcataaatattacgtacgactcgaccccggaggacgtaaaaacctggcttcagtccaaggggttcaacccggtcactgtgaactccctcggtgtgctgaatggcgcacaactattcagcctgaataaggatgagctcagaacagtctgtccagaaggagctagagtgtattctcaaataacagtgcagaaggccgctcttgaagactcttctggatcctcagagctccaggagatcatgaggagaaggcaggagaagattagcgctgcagcttctgactctggagtggagtctttcgacgagggctccagccattag

SEQ ID NO: 186699 - DNA, 366 bp, Artificial Sequence
  Description of Artificial Sequence: Synthetic coding sequence
atgaacggccacatcagcaaccaccccagcagcttcggcatgtaccccagtcagatgaatggctatggtagctcccccactttttctcagactgatcgagaacatgggtcaaaaactagcgcaaaggccctgtatgagcagagaaagaactacgcccgggattccgtgagcagtgtttctgatatttcacagtatagagtggagcacctcacgacgttcgtgctcgatcggaaagacgcaatgatcacagtggacgacggaatccgcaaactaaagctgctcgacgctaagggcaaagtgtggacacaagacatgattctccaagtcgacgaccgagccgtgtccttgattgacctggaatcatag

SEQ ID NO: 186700 - DNA, 207 bp, Artificial Sequence
  Description of Artificial Sequence: Synthetic coding sequence
atgaacggccacatcagcaaccaccccagcagcttcggcatgtacccttcccagatgaacggatacggtagttccccaaccttttcccagactgaccgcgagcatggaagcaaaacaagcgctaaagccttgtatgagcaaaggaaaaactacgcccgggattctgtgagctctgtgagcgatatctctcagtacagggtggagtag

SEQ ID NO: 186701 - DNA, 1689 bp, Artificial Sequence
  Description of Artificial Sequence: Synthetic coding sequence
atgatggccgcccggatcgaccgggacgtgcagatcctgaaccacatcctcgatgatattgagttctttatcacaaagctacagaaagctgctgaagctttcagtgagctttctaagaggaaaaaaaataagaagggcaagcggaagggccccggcgagggagttctcacccttagagccaagccccccccacccgacgagtttctggattgcttccaaaagtttaagcacggtttcaatcttttagcgaagttaaagtctcatattcaaaaccctagtgccgccgatctcgtgcactttctgttcactccactcaacatggtagttcaagcaaccgggggtcccgagttggcttctagcgtgctgtctcccctcctgaataaagataccatcgacttcctgaattacactgtcaatggagacgagcgccaactttggatgtctttaggcggaacatggatgaaggcccgcgccgagtggccaaaggaacaattcataccgccctatgtcccacgatttagaaatgggtgggaacctcccatgctaaatttcatgggtgccaccatggagcaagatctgtaccaactcgcagaaagtgttgccaacgttgctgaacatcagagaaaacaggagattaaacgcttatcaaccgagcactcctctgtctcagagtatcatccagcagacggatacgctttttctagcaacatatatactagaggttctcacctcgaccagggtgaagccgccgtcgcttttaagccgacgagtaatcgccatatcgaccgaaactacgaaccattgaagactcagccaaaaaagtacgctaagtcaaaatacgactttgttgctcgtaataactctgagctatccgtactcaaggacgatattctggaaatattggacgataggaagcaatggtggaaggtaagaaacgcctccggggacagtggttttgttcccaataatattttagacattgtgcgccctccagagtcaggacttggacgagctgatcccccttacacacatactatccagaaacagagaatggagtacgggccgagaccagctgatacaccacccgctcctagcccacctcccacaccagccccggtcccagtccccctgcccccctccacccccgctccggtcccagtaagcaaggtgcccgccaacataactcgacagaactccagctcatcagactcaggcggctcaatcgtgcgagactctcagcggcataaacagctgcccgtggacaggaggaagagccaaatggaagaagtccaagatgagttaatccaccgtctcacgatcggcagatctgctgctcaaaaaaaatttcatgtgccaagacagaacgtccccgtgatcaacattacatacgacagcacccccgaggatgtgaaaacgtggctccagtccaagggcttcaacccggtgacggtgaatagcctcggagtgctcaacggggcacaactttttagtctaaataaagatgagctgaggaccgtttgccctgaaggagccagagtctattctcagataacagtccagaaggccgctcttgaggacagttcaggatcctctgagctgcaggagatcatgcgaagacggcaagaaaaaatatcagcagccgcatccgacagcggagtagagtcattcgatgaaggcagcagccattag

SEQ ID NO: 186702 - DNA, 1689 bp, Artificial Sequence
  Description of Artificial Sequence: Synthetic coding sequence
atgatggccgcccggatcgaccgggacgtgcagatcctgaaccacatcttggatgacattgaattctttatcaccaaacttcaaaaggcagccgaggcattttcggagctgtcaaagcgaaaaaagaataaaaagggtaaaagaaagggaccaggagagggcgtcctaaccctgagagccaaaccacctcctcccgatgagttcctcgattgcttccagaaattcaaacatggattcaacctgcttgcaaagctgaagtctcatattcagaacccgtctgccgcagatctagtgcatttcctgttcacacctctgaacatggtggtgcaggctactggtggccctgaattggcctccagcgtgttatcaccactactgaataaagatactatcgactttctcaactacaccgtaaatggagacgagcggcagctgtggatgagtctcggagggacttggatgaaagcccgagctgagtggcccaaggagcagttcattccaccatacgtccctaggttcagaaatggctgggaaccaccaatgctgaacttcatgggagctaccatggagcaagatctataccagctggcagagagtgtcgcgaacgtcgccgagcaccagagaaaacaggagatcaagaggcttagcactgaacactcaagcgtgagtgagtatcatccagcagacggctacgcatttagcagcaatatttatacgcgcgggagccatctcgaccaaggtgaagcagcggtcgcattcaaaccgacgtctaaccgccacatcgatagaaactacgagcctctgaagacacagcccaagaaatatgccaaaagtaaatacgactttgtagctcggaacaatagcgagttgtctgtcctcaaggatgatattctggagattctggatgaccggaagcagtggtggaaagtgcgcaacgccagcggtgacagcggctttgttcccaacaacattctggatattgttcgtccgcctgagtctggtctaggtagggccgaccccccttacactcacaccatccagaagcagagaatggagtacggcccaaggcctgccgatacaccaccggcgccctctcctcctccaactccagcgcccgttcccgtccccctgcccccatccacacctgccccagttcctgtgagcaaggtcccagcgaatattacccggcagaatagttctagctctgacagcgggggctccattgtacgagacagccagcggcataagcagcttcccgtcgataggcgaaagagccagatggaggaggttcaagatgagttgatccatcgattgactattggaagaagtgccgctcagaaaaaattccatgtcccacggcagaatgtgccggtgatcaatattacttatgacagtacaccggaagatgtgaagacttggctccagagtaagggattcaatccagttacagtgaattccttgggcgtgctgaatggggcccagttgttttctctgaacaaagatgagctgcggaccgtatgccctgagggggcccgtgtctatagtcaaataacggtgcagaaggctgctttagaagacagttctgggagctccgagcttcaggagatcatgcgcaggagacaggagaaaatttccgcagccgcatctgacagtggagtggagtcatttgatgagggaagtagccactag

SEQ ID NO: 186703 - DNA, 2076 bp, Artificial Sequence
  Description of Artificial Sequence: Synthetic coding sequence
atgaacggccacatcagcaaccaccccagcagcttcggcatgtacccatcacaaatgaacggttatggctcaagccccaccttctcacagaccgacagagaacacggctcgaaaacctccgccaaagctctgtacgagcaacggaaaaactacgcacgagactcggttagcagtgtatcagatatctctcagtatagggtggaacacttgaccactttcgttctggataggaaggatgcgatgatcacagtagatgatggcatacgcaagctcaaacttctagatgctaagggcaaagtttggacacaggatatgatcctgcaggttgatgaccgtgccgtatctcttatcgaccttgagtccaaaaacgaactcgagaatttccctctgaacacaatccagcactgtcaggcagtgatgcattcttgttcatatgacagtgtgcttgctctcgtttgcaaagagcctactcagaataaaccagatctgcacctgtttcagtgtgatgaggtcaaagctaacctcatatctgaagatatcgaaagcgcaatcagcgacagcaaaggcggcaaacaaaagaggaggccagacgccctaagaatgataagcaacgcggaccccagtatccccccaccccctcgcgcgcccgccccggccccccctggcacggtcacccaggttgacgtcagaagccgcgttgcagcatggagcgcttgggctgcggaccagggggacttcgagaaacccagacaatatcacgaacaggaagagacgcccgaaatgatggctgctcgaattgacagggacgtgcaaatactaaatcacatcctcgatgacatcgagttctttatcacaaagctgcagaaagccgcagaagccttcagcgaactcagtaagagaaaaaaaaacaaaaagggaaagcgcaagggtcctggcgagggggttctgacattgcgggctaagccacctcctccagatgagtttctggattgttttcagaagttcaaacacgggtttaatctgctggccaaactgaaatcccacattcagaatccctctgccgccgacttggttcattttctgtttaccccactaaatatggtcgtccaggccacaggtggacctgagctggcaagctctgtgctgagcccactgcttaacaaggataccattgactttctcaattatacagtcaacggggatgagaggcagctttggatgagcctcggtggaacgtggatgaaagctcgtgccgagtggcctaaggagcagttcatccccccgtacgtccctcgctttcgtaatggatgggaaccaccaatgctcaacttcatgggggcaactatggaacaagatctgtatcagctggccgagtcggtggctaatgtggctgaacaccagagaaagcaggaaattaaaaggttgtcaactgagcactccagtgttagcgagtaccacccagccgatgggtacgccttcagctctaatatttatactagggggtctcacttagaccagggtgaggcagccgtggcattcaaacccacctctaaccggcacattgatagaaattatgaaccactaaaaacccaacctaagaagtacgcaaagtccaaatatgactttgttgcccgcaataattccgaactttcagtgttaaaggacgatattctcgagatcctggacgatcggaagcagtggtggaaagtaaggaacgcaagtggcgatagcggatttgtcccgaacaacattttggatatagtcagacccccagagagcggtctgggcagagctgatcctccctatacccataccattcaaaagcagagaatggaatatggacctcgtcccgccgacacaccccccgcacccagtcccccaccaaccccagcccccgttcctgtcccgctacctccctccacacctgccccagtacccgtctccaaagtgccagctaacattactagacagaattcctcttctagcgactccgggggaagcatcgtccgagattctcagcgacacaagacctccgggggccctaaagaaattagtgacggagggtcagccaggtag

SEQ ID NO: 186704 - DNA, 207 bp, Artificial Sequence
  Description of Artificial Sequence: Synthetic coding sequence
atgaacggccacatcagcaaccaccccagcagcttcggcatgtacccaagccagatgaatggctacggaagctctcccacttttagtcagacagatcgggagcacggcagcaaaacgtccgcaaaggctctgtatgagcagcgcaagaattacgcacgggactcagtgagtagcgtcagcgacatctcccagtatcgggtggagtag

SEQ ID NO: 186705 - DNA, 2469 bp, Artificial Sequence
  Description of Artificial Sequence: Synthetic coding sequence
atgaacggccacatcagcaaccaccccagcagcttcggcatgtaccccagccagatgaatggttacggcagctctccgacttttagccaaacagaccgcgaacacgggtcaaaaacgtccgcaaaggccttgtacgagcagaggaaaaattacgcacgggattcagtctcttctgttagtgacatcagtcagtatagagtggagcacttgacaacttttgtcctggatagaaaagacgcaatgatcaccgtcgatgatggtattaggaaattaaagctactagacgcgaagggtaaagtgtggactcaggatatgatcctgcaggtggacgaccgagccgtgtccttgatcgatctagagtcaaagaacgagctcgaaaatttccccctcaataccatccagcactgccaagctgtcatgcattcttgcagttacgattctgtcctggccctggtttgcaaggagcccacgcaaaacaagcctgatctgcacctgttccagtgcgacgaggtcaaagccaacctgatttcagaggacattgagagcgcaatctctgactcaaagggcggaaagcagaagcgcaggccggatgctttgcgaatgatctccaatgctgatccttcaattcctccccccccacgggccccagccccagccccacctggaacagtgacccaggttgatgtcaggagccgcgtcgccgcttggtctgcatgggctgccgaccaaggggatttcgagaagccaagacagtaccacgagcaagaggaaacgcccgagatgatggctgcacggatcgaccgagacgttcagatccttaatcatatccttgatgacatcgagtttttcatcaccaaactccagaaggcagcagaggctttctccgagctgtctaagcggaaaaagaacaagaaaggcaaacgcaagggacctggcgagggcgtgttgactttacgcgcaaaacctcctcctccagatgaatttctagactgcttccagaaattcaagcatgggttcaacctgctggccaaattaaagagtcacattcaaaacccctccgcagctgatctggtgcatttcctttttactccccttaacatggttgttcaggccaccggcggccctgagcttgcctcctctgtgttatcccccttattaaacaaagacactattgattttctgaattacactgtgaatggcgatgagagacagctctggatgtctctgggaggaacctggatgaaggcccgtgccgaatggccgaaggaacaattcatccccccctacgtcccacggtttcgcaatgggtgggaacctcctatgttgaactttatgggagctacaatggaacaggacttataccagttagctgagtccgttgccaatgtcgccgaacaccagcgaaagcaagagatcaaacgactgagcaccgagcactctagtgtgagtgagtatcaccccgccgacggttacgctttcagctctaatatttacactcggggatcacacctagatcagggcgaggcggcggtggccttcaaacctacatcaaaccggcatattgatcgtaattacgaacctctcaagacacagcctaaaaagtacgctaaaagcaaatacgactttgtggcaagaaataactctgagctgagcgtgttgaaggacgacatcctggaaatccttgacgatcgcaagcagtggtggaaggtgcgaaacgcttcaggcgattctggctttgtgcccaacaatattctcgatatcgtgcggcccccagaatctggcctcggacgcgcagatcctccatatactcataccattcaaaagcagcgcatggagtacgggcctcgacctgcggacactccgccggctccatccccccctcccacacctgcccctgtccctgtgccactgccaccatcgactcctgcccctgttcccgtcagtaaggtgccagctaatataactcggcagaacagctcgtcgtctgactctggcgggtccatagtccgagacagtcagcgccacaaacagttgcccgtggaccggaggaagtcacaaatggaggaggttcaagatgagctgattcacagactcactattggcaggtcggccgcccaaaagaaatttcacgttccccgtcaaaatgtccctgtaataaacatcacttatgactctactccagaagacgtgaaaacgtggctgcaaagcaagggcttcaacccggtgaccgtcaatagcttaggtgtcctaaacggagctcaattattctccctgaacaaagatgaattgagaaccgtctgcccggaaggcgcaagggtatacagccagatcaccgtccagaaagctgctttagaagattcctcaggtagcagcgagctccaggagatcatgcgtagaaggcaggagaagatctccgccgccgccagcgacagcggagtcgagagctttgacgaaggatccagccattag

SEQ ID NO: 186706 - DNA, 2469 bp, Artificial Sequence
  Description of Artificial Sequence: Synthetic coding sequence
atgaacggccacatcagcaaccaccccagcagcttcggcatgtacccctcccagatgaatggttacggcagcagccccacattcagtcaaacagatcgtgaacacggctcaaagacctccgccaaggccctctacgaacagagaaagaactacgcccgggattcagtttcctccgtgtccgacatcagtcaataccgggtcgaacacctgactacattcgtgctcgatagaaaggacgctatgattaccgtggacgacggcatccgaaagctgaaactgctggacgcaaagggaaaagtctggacccaggatatgatcctgcaagtcgatgaccgcgcggtcagtctcattgacttggagtcaaaaaatgaactagaaaattttccactcaacacgatccaacactgtcaggctgtgatgcattcttgtagctatgattcggtccttgccctggtctgcaaggagcccacgcaaaacaaacctgacctccatctgttccagtgtgacgaggtcaaggccaacctgatatccgaggatatcgagtcggccatcagcgactctaagggcggcaagcaaaagaggcgtcctgatgcactgagaatgatctccaacgccgacccctcaattccaccgccacctcgcgccccagcgcctgccccacctggcactgtgactcaggtggacgtgcggtctagagtggctgcctggagtgcctgggccgccgaccaaggtgacttcgaaaagccaagacagtaccacgagcaggaagagactccagagatgatggccgctcgaatcgacagggatgtgcagatcttgaatcacatcctagatgacatcgagttcttcattactaagttgcagaaagccgctgaagcttttagtgagcttagcaagcggaagaaaaataagaagggcaagcgcaaggggccaggagaaggcgtgctcaccctgcgtgctaaaccgccaccacctgacgagtttcttgactgttttcagaaattcaagcatggatttaatctgttagccaaacttaagagccacatccaaaatccatccgcagcggatctggtccactttttgttcacgcctctgaacatggtggtccaggctaccggaggcccagaacttgctagctcggtgttgagcccattgctgaacaaggataccattgactttttgaattataccgttaatggggatgagcggcagttgtggatgagtctgggaggcacatggatgaaggcccgggctgaatggcccaaggaacagtttattcccccttacgtccctcgcttccgtaacggctgggagcctcccatgcttaactttatgggtgcgactatggagcaggatttatatcagttggcggagtccgtggctaatgtggcagaacaccagagaaagcaggaaattaaacggctttctaccgaacactcctccgtatctgaatatcacccagccgacgggtatgccttttcatcaaacatttatacacgcggaagtcacctggaccagggagaagccgctgtggccttcaagccaacgtccaatcggcatatcgatcgaaactacgaacctctgaagacacaacctaagaagtatgccaaatccaaatacgattttgtggcgcggaacaactctgaactgtctgttctgaaggacgatattctggagatcttggacgatagaaagcagtggtggaaggtcaggaatgcctctggcgactctggtttcgtgccaaacaatatactggacattgtacgtcctccagaaagcggtttgggaagagctgacccaccatacacacataccatccaaaagcagcgcatggagtacgggccacggccagctgatactccacccgccccgagtccgcctcctacacctgcccctgtacccgtgccgctacctccctccaccccagccccagttccagtgtcaaaggtgcctgcgaatataacgcggcagaatagttcttctagcgactctggcggctctatcgttagagatagtcagagacataagcagctgcctgtggacagacggaaaagccaaatggaggaggtacaagatgagctgatccataggcttactatcggcagaagcgccgctcagaaaaaattccatgtgccccgtcagaacgtgccagtgatcaatattacttacgattcaacacccgaggacgtgaagacgtggctgcagagcaagggtttcaatccagtgactgttaattcactgggggtcctcaacggagcgcaactgttctcgttaaacaaagacgagctccggaccgtgtgcccagagggtgcaagagtctatagccagatcaccgtgcagaaagctgcccttgaggatagctcgggaagctcagaattgcaagaaatcatgaggcgtcggcaggagaaaatctccgcagcggcatctgacagtggcgtggaatcctttgatgaaggtagctcccattag

SEQ ID NO: 186707 - DNA, 204 bp, Artificial Sequence
  Description of Artificial Sequence: Synthetic coding sequence
atgaacggccacatcagcaaccaccccagcagcttcggcatgtacccttcccaaatgaacgggtacggcagctctcccaccttcagtcagactgaccgggagcacggatcgaagaccagcgccaaggccctttacgagcaacgcaagaattatgcgagagactccgtttccagcgtgagcgatataagtcagtatagagtttag

SEQ ID NO: 186708 - DNA, 387 bp, Artificial Sequence
  Description of Artificial Sequence: Synthetic coding sequence
atgaacggccacatcagcaaccaccccagcagcttcggcatgtacccctctcagatgaacggttatggcagtagccccactttctcccaaacagacagagaacatggcagcaagacttcagcaaaagctctgtatgagcagcggaaaaactacgcgagagacagcgtatctagtgtttctgacattagccagtaccgtgtcgagcacctgaccaccttcgtgctggaccggaaggacgctatgataaccgtggatgacggcatccggaagctgaaacttctggacgccaagggcaaggtgtggacacaggacatgatccttcaggtggatgatcgggcagtgtctctcattgatctggagtccaaaaatgagctcgagaatttttag

SEQ ID NO: 186709 - DNA, 996 bp, Artificial Sequence
  Description of Artificial Sequence: Synthetic coding sequence
atgcggttccggttcggcgtggtggtgccccccgccgtggccggcgcacggcccgagctactcgtcgtgggctcgaggcctgagctgggccgctgggaaccccggggagctgttcgcctgagacccgcaggtaccgcggccggagatggtgccctggccctgcaggaacccggactctggctgggcgaggtggagctcgctgctgaagaagctgctcaggacggcgctgagattggagctacacctaagttaccaagtactattttcccttggttcgtcctgcgccagggtcttatcctcggcaatggaccacaccatgaccgatgctgtacttataacgaaaataatttggtggacggtgtctactgtctccctattgggcactggattgaggccacgggacacaccaacgagatgaagcataccaccgatttctacttcaatatagccggacatcaagcaatgcactactcacgcatcctgccaaatatttggctcggatcgtgtccgaggcaagtcgagcacgtgactatcaagttgaagcacgagctgggaattaccgctgtgatgaatttccaaaccgaatgggacattgttcaaaactcatcaggatgcaaccgctatccagaacctatgacacccgataccatgatcaaattgtaccgcgaggaaggactggcctacatctggatgccgacacccgacatgtctaccgaaggtcgtgtccagatgctcccgcaagcggtatgcctcctccatgccctgctggaaaaagggcacatcgtatacgtccattgcaacgctggtgtgggcaggagcactgctgccgtgtgtggctggctgcagtatgtaatgggctggaatctgcggaaagtacagtattttctaatggccaagcgccccgccgtttatatcgatgaagaggcacttgccagggcgcaggaggacttctttcagaagtttggaaaagtgaggagtagcgtgtgctcgctgtag

SEQ ID NO: 186710 - DNA, 996 bp, Artificial Sequence
  Description of Artificial Sequence: Synthetic coding sequence
atgcggttccggttcggcgtggtggtgccccccgccgtggccggcgccaggcccgaactgctggtagtgggcagtagaccagaactggggagatgggagccgcgaggcgccgtccgactcaggcccgcagggaccgcagctggagacggggcccttgctctccaggagccgggactgtggctgggggaggttgaactggctgctgaggaggctgcccaggacggggctgagccaggcagagtggacacgttctggtataaattcctcaaacgggagccaggtggagagctgtcttgggagggcaacggaccccatcacgataggtgctgcacatacaatgaaaataatctggtagatggcgtgtattgcctaccgatcggacattggatcgaagcaaccgggcacactaacgagatgaagcataccacggatttctacttcaatatcgcggggcaccaggctatgcattacagtcggatcttgccaaacatatggctcggcagttgcccgcgccaagtcgagcacgtgactatcaagctgaaacacgagctgggcatcaccgccgtaatgaactttcaaactgagtgggacattgtacaaaattcaagtggctgtaaccggtacccagaacccatgacccccgatactatgatcaaactgtaccgggaggaaggtctcgcatatatttggatgcctactcccgatatgtcaaccgaaggccgggttcagatgcttccacaggctgtgtgccttctccacgctctgttggaaaagggtcacatcgtctatgtgcattgtaacgctggagtggggcgctcaacagcagccgtctgtgggtggttgcagtacgtgatgggatggaacttgcgcaaggtccagtactttctgatggctaaaagacccgccgtgtacattgacgaggaggcgctggcccgggcacaagaagacttcttccaaaagtttggaaaggtgaggtcaagtgtctgttctctctag

SEQ ID NO: 186711 - DNA, 954 bp, Artificial Sequence
  Description of Artificial Sequence: Synthetic coding sequence
atgcggttccggttcggcgtggtggtgccccccgccgtggccggcgcccgacccgagcttcttgtggtcgggagtcgccctgaattaggccgatgggagcctagaggtgccgtaagacttagacctgccggcaccgctgcgggggatggagcgctggccctgcaggaacccgggttgtggttaggcgaagtggaactcgctgccgaagaagccgctcaggacggcgctgagcccgggcgggtggacaccttctggtacaagtttctaaaacgagagccggggggagagctctcttgggagggcaatgggccacaccacgaccggtgttgtacctataacgaaaacaacctggttgacggcgtgtactgtcttcccatcggccactggatagaagccactgggcatacgaatgaaatgaagcacaccaccgatttttattttaacatcgcgggacaccaggcgatgcattattctcggatcctgccaaacatttggctcggatcatgcccccgacaggtcgagcatgtgacaatcaagctgaagcacgaactaggtatcacagcagttatgaacttccagactgagtgggacattgtacagaattcatccggatgtaatcggtacccggaacccatgacccccgatacaatgatcaagctgtacagagaagagggactggcttacatttggatgcccacgcccgatatgtcaacagaaggcagggttcaaatgctgccccaggctgtgtgtctcctgcacgcattgttagagaaaggtcatatagtgtacgtccattgcaatgcgggcgtggggaggagcacagccgccgtgtgcgggtggctacagtacgtgatggggtggaacttgcgtaaggtacagtatttcctgatggctaagcgtcctgcagtctacatcgacgaggaggccgcttcccaggacacctttcctctctag

SEQ ID NO: 186712 - DNA, 714 bp, Artificial Sequence
  Description of Artificial Sequence: Synthetic coding sequence
tgagacaccttctggtacaagttcctgaagcgggagcccggcggcgagctttcttgggagggaaatggaccccaccatgacagatgctgcacttacaacgaaaacaacctcgtcgacggcgtctactgtctgcctattggccattggattgaggcaactggccatacaaatgagatgaagcatacaaccgacttctacttcaatatcgcagggcaccaggccatgcactacagtcgcatcctgccaaatatctggctgggatcctgccccagacaggtcgaacacgtgactattaaactcaagcatgagctcggaataacagcagtgatgaacttccagactgaatgggatattgtccagaattcgtcaggctgtaatcgctaccccgagcctatgactcctgataccatgataaaactgtaccgcgaggaagggcttgcctacatttggatgcctacccccgacatgagtacggaagggcgagtgcagatgctgccgcaggcagtgtgcttgctccatgccctcctggagaagggccacatcgtttatgtgcactgcaatgcgggtgtggggaggagtactgcagccgtctgcgggtggctgcagtatgtcatgggatggaacctccgcaaagtgcagtatttcctgatggccaagaggccagccgtatacattgatgaagaggctgcttctcaagatactttccctctttag

SEQ ID NO: 186713 - DNA, 513 bp, Artificial Sequence
  Description of Artificial Sequence: Synthetic coding sequence
tgaaacggcccccaccacgaccggtgctgcacctacaacgagaacaatctggttgatggggtatactgcctgcccatcggccattggatcgaagccaccggacacacaaatgaaatgaaacacacaacagacttttactttaatatcgcgggccaccaagccatgcactattcccgtatcctccccaacatctggttaggaagctgccctcgtcaggtcgagcatgttacaataaaactcaaacatgaacttggtatcactgcagtgatgaactttcagacagaatgggacattgtgcaaaattcatcgggatgtaatagataccccgagcctatgacgcctgacaccatgatcaaattgtacagggaagagggcctggcatacatctggatgcctacaccggacatgtcaacggaggatgagaaaagaacagccgacatgtgttgttcaggaatgtgggaggagaccgcggacttcgggctgggtattctggattacctcaagcagaagtag

SEQ ID NO: 186714 - DNA, 813 bp, Artificial Sequence
  Description of Artificial Sequence: Synthetic coding sequence
atgcggttccggttcggcgtggtggtgccccccgccgtggccggcgcacggcccgaattgctggttgttggctcgcgaccagaactgggacgatgggaaccacgaggcgccgttcggttgaggcctgcgggcacggccgccggcgacggggcactggctctgcaggagcccggactttggctgggcgaggtggagttggccgctgaggaggcggcacaagatggggcagaacccggacgcgtcgataccttctggtacaaatttttaaagcgagaacctggaggggaactcagctgggaaggcaatggaccccaccatgaccggtgttgcacatacaatgagaataatctggtggatggcgtgtattgcctccctataggccactggatagaggccacaggccacacgaacgaaatgaaacataccacggacttctatttcaatatagccggacatcaggcaatgcactactcccggattctgcctaacatttggctggggtcgtgtcctcgccaggtggaacacgtgaccatcaaactgaaacacgaactgggaataacagcggtgatgaattttcaaactgagtgggacattgtgcagaacagttccggatgcaatcggtaccccgagcctatgaccccagacaccatgatcaagttatacagggaagaaggtctcgcatatatttggatgcccaccccagacatgagcactgaggatgagaaaaggaccgcagacatgtgctgctccggtatgtgggaggagactgcagacttcggacttggcatacttgactatctgaagcaaaagtag

SEQ ID NO: 186715 - DNA, 945 bp, Artificial Sequence
  Description of Artificial Sequence: Synthetic coding sequence
atggcccccccccaggtgctggccttcggcctgctgctggccgccgctacagcaacctttgcggccgcacaggaggaatgcgtctgtgagaattacaagctggcagtgaattgtttcgtcaacaataatcgccaatgtcagtgtacctccgtaggcgctcaaaacaccgttatctgcagtaagcttgccgccaaatgtctggtgatgaaagccgagatgaatggctccaagttggggcgtcgggccaaaccagagggcgctctccagaacaacgacggcttgtatgatccagactgcgatgagtctgggctttttaaggcgaagcaatgtaacggcaccagcatgtgctggtgtgtgaacaccgccggcgtccggagaactgataaggatactgagataacatgcagtgagagggtgaggacctactggatcattatagagctgaagcataaggcgcgggagaagccatacgacagcaagtcactgcgcactgccttacagaaggagattacaacccggtatcagctggacccaaagtttatcacctctatcctgtacgaaaacaacgtaattaccatcgatctggtacaaaacagcagccaaaagacccaaaatgacgtcgatatcgcagacgtggcgtactatttcgagaaggatgtgaaaggtgagagcctgttccacagtaagaagatggacctcaccgtcaacggcgagcaactcgacctggatccgggtcagaccttgatctattatgttgatgaaaaagcccctgagttctccatgcaggggctgaaggccggcgtgatagctgtgatcgtcgtggtggtgattgctgttgtcgccggcatagttgtattggtgatctcaaggaaaaaacgcatggcaaaatatgaaaaggcagagataaaggaaatgggagaaatgcaccgggaactgaacgcctag

SEQ ID NO: 186716 - DNA, 474 bp, Artificial Sequence
  Description of Artificial Sequence: Synthetic coding sequence
atgctggtgctgctggccggcatcttcgtggtgcacatcgccaccgtcatcatgctctttgtttctactattgccaacgtttggttggtgtcaaacaccgtggatgcttccgtcggcctttggaagaattgcactaacatctcatgctccgacagcctctcctacgcatcagaggatgctctgaaaacagtgcaggcgttcatgattctgtccatcattttctgtgttattgcgttgctggtgtttgtttttcagctgttcacgatggagaaaggcaatcgattcttcctctcaggagccacgactcttgtctgttggctgtgtatcctggtgggtgtaagcatttatacaagccattacgcaaatcgtgacggcacccagtaccatcatggatattcctacatcctaggctggatctgcttttgcttcagtttcatcattggcgttttgtatcttgttttgagaaaaaagtag

SEQ ID NO: 186717 - DNA, 426 bp, Artificial Sequence
  Description of Artificial Sequence: Synthetic coding sequence
atgctggtgctgctggccggcatcttcgtggtgcacatcgccaccgtcatcatgttgttcgtgagcaccatcgcaaacgtctggttggtttcgaataccgtggacgccagtgttggcctctggaagaattgcaccaacatatcatgtagcgattcactgtcttatgctagcgaagatgcactaaagactgtccaagcttttatgattttatctatcatattctgcgtgattgcactgttggttttcgtttttcagctattcactatggagaaaggtaacaggttctttctgtctggcgccacaacgctggtttgctttataatgagaatcgtgatggagcgctcaattacaacggccatccccaccagctgggccggaagcgccagtgcaagcgccagctcatcagccttctctatttggagctag

SEQ ID NO: 186718 - DNA, 12 bp, Artificial Sequence
  Description of Artificial Sequence: Synthetic coding sequence
atgctggtgtag

SEQ ID NO: 186719 - DNA, 504 bp, Artificial Sequence
  Description of Artificial Sequence: Synthetic coding sequence
atgctggtgctgctggccttcatcatcgccttccacatcaccagcgccgcacttttgttcattgctaccgtcgacaacgcatggtgggtgggagacgaattcttcgcggatgtgtggagaatttgcaccaacaacaccaattgcacggtaatcaacgattcgttccaggagtacagcaccttgcaggcagtacaggctaccatgatcctctctaccattctatgttgcatcgccttctttattttcgtgctgcaactctttaggttgaaacagggtgagaggttcgttttgacctcaatcatacagttaatgtcttgcctctgtgttatgattgccgctagtatttatacagaccgtagagaagacattcacgataaaaacgctaagttttatccagttactcgggaagggagttacggttactcttatattttggcatgggtcgccttcgcatgtacgtttatctctggcatgatgtacctgatactgcgcaagagaaagtag

SEQ ID NO: 186720 - DNA, 504 bp, Artificial Sequence
  Description of Artificial Sequence: Synthetic coding sequence
atgctggtgctgctggccttcatcatcgccttccacatcaccagcgctgcactgctttttatcgcaaccgtcgacaatgcatggtgggtgggagacgaattctttgcagatgtatggcgtatatgtactaataacactaactgcacagtcatcaatgacagctttcaggagtactccactcttcaggctgtgcaggctaccatgatcctgtccacaatcctgtgctgcatcgcgttttttatttttgtgctgcagctgtttaggctgaaacagggcgaaagattcgtcctgacatccataatccagttgatgtcttgtctttgcgttatgatcgcagccagcatctataccgataggcgtgaagacatccatgacaaaaacgccaagttttaccctgtcacccgcgaaggaagttacggctattcctacatcctggcctgggtggccttcgcttgtacgtttatttcaggcatgatgtacctgattcttcgtaaacgtaaatag

SEQ ID NO: 186721 - DNA, 492 bp, Artificial Sequence
  Description of Artificial Sequence: Synthetic coding sequence
atgagcctgctgctgctggtggtgagcgccctgcacatcctgatcctcatcctgctgttcgtagccacactggataaatcctggtggaccctccctggcaaagaatctcttaacctgtggtacgattgtacatggaacaacgacaccaaaacatgggcttgctctaacgtgagcgagaatggttggctgaaggccgttcaggtgttaatggttctgagcttaattctctgctgtctttctttcatattgtttatgttccagctgtatactatgcggagggggggcctgttttatgccaccgggctttgtcagttgtgtacttctgtggcggtctttaccggcgcactgatttacgcaatccacgctgaagagatcttggaaaaacatcctagaggtggaagctttggatactgcttcgccttagcatgggttgcttttccactcgctttggtgtccggaatcatctacatccatctccgaaagcgtgaatag

SEQ ID NO: 186722 - DNA, 2034 bp, Artificial Sequence
  Description of Artificial Sequence: Synthetic coding sequence
atgaccgccagccccgactacctggtggtgctgttcggcatcaccgccggtgcgacaggggctaaactcggatcagatgagaaagaacttattctcctattctggaaggtggtggacttggctaataagaaggtgggtcagctgcacgaagtgctcgtgaggccagaccaattggaacttaccgaagactgcaaggaagagaccaagatcgatgttgagagcctcagttccgccagccaactggatcaggccctgagacagttcaatcagtctgtcagtaacgaactgaatatcggggtagggacttcattctgcctgtgcactgatggtcaactgcacgtgcgccagatcctccatcccgaggcatctaaaaaaaatgtgcttcttcctgagtgtttctactcattcttcgacctcagaaaggagtttaagaaatgttgcccagggtcccccgacatcgataaactcgacgtcgcaacaatgaccgagtacttaaacttcgaaaagtctagttcagtgtccagatacggggccagccaggtggaggacatgggaaacattattctagccatgattagtgagccatacaatcacaggttctccgacccagagagggtcaattataaatttgaatccgggacatgttccaagatggaattaatagatgataacaccgtcgtgcgagcaagagggttgccatggcagtcctccgatcaagatatcgcgcggttcttcaaggggttaaatattgccaaagggggtgctgcactgtgcctcaatgctcaaggcaggcggaacggagaggcattggtgaggttcgtgtccgaagaacacagggatctggcgttgcagcggcataagcatcatatgggaacccggtatatagaggtgtacaaagccaccggtgaggatttcctgaagattgctggaggaacaagcaatgaggtagctcagtttttgtcaaaagagaaccaggttattgtacgaatgagaggcctcccctttaccgctactgccgaggaggtcgtggcattcttcggacaacactgccctatcactggtgggaaagaaggtatcctgttcgtgacctatccagacgggagacctacaggagacgcgtttgtactctttgcatgtgaagagtacgcccagaacgcactgaggaagcacaaggatctgttaggcaagagatacatagagctgttccgcagtaccgctgcagaggtccaacaggtcctgaataggttcagctccgccccgttaatccctctgccaacacctccaataatacctgtgttgccacagcagtttgtacctcccactaacgtgagagactgtatcagacttcgtggactcccttacgccgcaacgatagaggatattcttgatttccttggagagttcgccaccgatattcggactcatggcgtccatatggtgctcaatcatcagggtcgacccagcggcgacgccttcatccagatgaaaagcgccgacagggccttcatggctgcccagaagtgtcacaaaaagaatatgaaggaccgttacgttgaagtcttccagtgctctgcagaagagatgaactttgtgttgatgggcggcaccctcaatcgcaacggactatcccccccaccatgcctttcccccccaagctatacctttccggctcccgcagccgtaatccctacggaggccgcaatataccaacctagcgtgattttgaatccccgagccctgcagccatccacggcatattatccagctgggacccagctcttcatgaattacacggcttactatccaagcccacccgggagccccaatagccttggctatttccctaccgcggccaatctgagcggagtgccaccacagcccgggaccgtcgtgaggatgcaggggcttgcatacaatacgggtgtcaaggaaatattgaacttcttccaggggtaccagtatgcaaccgaggacgggctcatccatactaacgaccaggcccggactcttcccaaagagtgggtctgtatctag

SEQ ID NO: 186723 - DNA, 1980 bp, Artificial Sequence
  Description of Artificial Sequence: Synthetic coding sequence
atgaccgccagccccgactacctggtggtgctgttcggcatcaccgccggcgcgacaggcgcaaaactgggctccgacgagaaggagctgatcctgctgttctggaaagtcgtggacctggccaataagaaggtgggtcaactgcacgaagtgcttgtgcgaccagatcagctcgagctgacagaggattgcaaggaagaaaccaaaattgatgttgaaagtctgagtagcgcatctcagcttgatcaggccctgagacagtttaatcagtcagtttcaaacgagttgaacatcggcgttggtactagcttttgtttatgtaccgatgggcaacttcatgtaaggcaaatattgcaccccgaggcgtcgaagaaaaacgtgttattaccagaatgtttctacagtttcttcgatctgaggaaagagttcaaaaagtgctgcccaggttcgccagacatagacaagctggatgttgccactatgacagagtacctcaacttcgaaaaatcaagcagcgtatctcggtacggtgcctcccaagtggaagatatgggtaacattatcctggccatgatcagtgagccttacaatcatagattttctgatcctgaacgtgtcaattataagtttgaatctgggacttgtagcaaaatggaactgattgacgataacacggtggtccgcgcgagaggcctcccctggcagtcttcagaccaggatatcgcccgattcttcaaaggcctcaatatcgcaaaggggggcgccgcactctgtctcaacgcccaaggacgcagaaacggcgaagcgcttgttcgttttgttagcgaggagcatcgtgacctagcccttcagcgacataagcatcacatggggacgcgatacattgaggtctataaggccacgggagaggatttcctgaaaatcgcaggcgggacaagcaatgaggtggcccaattcctgtccaaagagaatcaggtaattgtgaggatgagaggccttccattcactgcaacagcggaggaggttgtcgccttcttcggacagcactgtcctataacgggaggaaaggaagggattctgtttgtcacataccctgatggtaggccgactggagacgccttcgtgctgttcgcctgcgaggaatacgcccagaatgcactcaggaaacataaagacttgctgggcaagcgttacattgagctctttcgctcaactgcagcagaggtgcagcaagtcctcaatcgattctcttccgccccactaatccccctacccactcctccgattatcccagtgctaccccaacaatttgttcctccgaccaacgtgagggattgtattcgactacgggggctcccgtatgccgccacgatcgaagatatcttggacttcctaggcgagtttgccaccgatataagaacacatggtgttcacatggtgctcaaccatcaggggaggccctcaggggacgctttcattcagatgaaaagtgccgaccgcgcattcatggccgcgcagaaatgccacaagaaaaacatgaaagaccgatatgtggaggtgtttcagtgtagtgccgaggagatgaactttgtgcttatgggtggaactctaaaccggaacggcctctcccctcccccctgtttgagtcctccttcctacaccttccccgcacctgcagctgtaatacccacggaagctgccatttatcagccaagcgtaattctaaatccacgggcactccagccttctaccgcttattaccctgctggcacacaattattcatgaactataccgcttattacccttctccccccggaagtcccaactctctagggtacttccctaccgcggccaatctttccggagtccctccccagcccggcaccgtcgtgcgcatgcagggcctggcatacaacaccggcgtcaaggagattctgaattttttccagggctatcaatgcctcaaggacgtctggtag

SEQ ID NO: 186724 - DNA, 2046 bp, Artificial Sequence
  Description of Artificial Sequence: Synthetic coding sequence
atgaccgccagccccgactacctggtggtgctgttcggcatcaccgccggcgccactggggcaaaacttggatcagacgagaaagaacttattctgctgttttggaaagttgtggatctcgccaataagaaagtagggcaactgcatgaggtcctggtgagacctgatcagttggagctcacggaggactgtaaagaggaaaccaagatagacgtcgaaagcctctcctcggcaagtcagctggatcaggccctccggcagttcaatcagtccgtgtccaacgagctaaatataggcgtcggaacgagcttttgcttgtgtactgatggccagctgcacgtcaggcagatcctccacccagaggctagcaagaaaaacgtgttgctgcccgagtgcttctacagcttctttgacctgcgcaaggagtttaaaaagtgctgtccaggcagccccgatatagataagctggatgtagccaccatgacggaatatctgaactttgagaaaagttctagtgtaagcaggtatggagcatcccaagtcgaagacatgggcaacatcatattggccatgatcagcgaaccatacaaccacagattctcagatcctgagcgtgttaactacaaatttgaaagtggcacctgtagtaaaatggagctcatagatgacaataccgtagtgagagccagagggctgccctggcagtccagtgatcaggacattgctagattctttaaagggttaaatatcgccaagggcggggctgcactgtgtttaaacgcccaggggcggcgcaacggcgaggccctggtgcggtttgtcagcgaggagcatcgcgatctcgctctgcagcgacataagcaccacatgggcacccgttatattgaggtatataaggctactggtgaggacttcttgaaaattgcaggcggtaccagtaatgaagtggctcagttcctttccaaagagaaccaggtaattgtcagaatgcgcggactgccatttaccgccactgcagaggaagtggtggccttttttgggcaacattgtccaattactggcggcaaggaagggattctctttgtgacatatccggacggtcggccaacaggcgacgccttcgtcctgtttgcttgtgaagagtacgcgcaaaatgccctgcgaaagcacaaggacctgctgggcaaacggtatatcgaactctttcggtccaccgctgccgaagtgcagcaggtcttaaatcgcttctctagcgccccactcatacctctcccaaccccccctattattcccgtgttgccacagcaattcgtcccaccgactaatgttcgcgactgcattcgattacgaggactcccatatgcggctaccatagaggatattctcgacttcttaggcgaattcgctacagacattaggacacatggggtgcacatggtgttaaaccaccaaggtcggccatccggagacgccttcatccagatgaaatctgcagatcgagctttcatggctgcacagaagtgccataaaaaaaatatgaaggatagatacgtggaagtctttcagtgtagcgccgaggagatgaatttcgttttaatgggggggacactaaaccgaaatggtctaagcccaccgccatgcaagctgccgtgtctctctcctcctagctataccttccctgctccggccgcggtgatccctactgaagccgcgatctatcagccttccgttatcctgaatccccgagctctacagccgagcacggcatattacccagccgggacacagttattcatgaactacaccgcatactacccaagcccccctggtagtcctaatagcctgggatacttccccactgccgctaacctttccggcgtgccaccacaaccaggcaccgttgtgcgcatgcagggcctcgcctataatacaggtgtcaaggagattcttaatttttttcaggggtaccaatacgcaactgaggacggattaatccatacaaatgaccaagcacgtacgcttccaaaagagtgggtctgtatctag

SEQ ID NO: 186725 - DNA, 1827 bp, Artificial Sequence
  Description of Artificial Sequence: Synthetic coding sequence
atgaccgccagccccgactacctggtggtgctgttcggcatcaccgccggcgccaccggcgcgaaactcggttctgatgagaaggaactgatacttttattctggaaggtggtggacctggccaacaagaaagtgggtcagttacacgaggtcctggtgcggcctgaccagctggaactcactgaagactgtaaggaagagaccaagattgatgttgaatccctgagctctgcttcccagctggaccaggcactgcgccaatttaaccaatcagtatctaatgagctcaacataggagttggcacatctttctgcctgtgtacagacgggcagttgcatgtccgccaaattttgcacccagaggcttccaaaaagaatgtcctgcttcccgaatgcttctatagcttcttcgaccttcgaaaggagtttaaaaaatgctgccctgggagtccggacatcgataagctggatgtggcgacgatgactgaatacctgaactttgagaaatccagttcagtttctaggtatggtgcttcacaggtagaggatatgggtaatattatactcgccatgatctctgaaccatataaccaccggtttagtgatcctgaacgagtgaactataaattcgaatccggaacctgttcaaaaatggagctgatagacgacaacactgtagttagggcacgaggcctaccatggcagtctagtgatcaggatatcgccaggttttttaaaggactgaatatcgcaaaaggcggagctgcgctgtgtcttaacgctcagggtagaagaaatggcgaagccctggttcggttcgtgagcgaggaacatagggatcttgccctgcagcgccacaagcaccacatgggtacacgatacatcgaggtctataaagccaccggagaggactttctgaaaatagcgggagggacgtcaaatgaggtggcccagttcctctccaaggagaaccaagtgattgttcgaatgcgagggctcccattcactgccacggcagaagaagtagtggcattcttcggtcagcattgccccattacaggcggcaaagagggaatcctgtttgtcacataccccgatgggcggccaactggcgatgcctttgttttattcgcatgcgaggagtacgcgcagaatgctctgcgaaagcataaagatctccttggcaagcggtacatcgagctcttcagatcgacagccgctgaggtgcagcaggtactcaaccgcttttcaagtgcaccattgattccactgcccacacctccaatcatccccgtgctgcctcagcaattcgtgccacccactaatgtccgggactgtatcagattgcgaggcctgccatatgctgccacaattgaagatatcctggattttctgggggagtttgccaccgatattcgcacacacggcgtgcacatggttctgaatcaccaggggagaccctccggggatgccttcatccagatgaagtccgcagatagggctttcatggcggcccagaaatgccataaaaaaaatatgaaggaccgttatgtagaggtttttcagtgctccgcggaagagatgaatttcgtgctcatgggaggaaccctgaaccgcaacgggctgagtccccccccctgcaagctcccatgtctatcccccccgtcttatacttttccggcccccgccgctgttattcctactgaagcagctatttatcaaccctcagtcatcctgaatcccagggccttacagcctagcactgcctactaccccgccggcacgcagctgtttatgaactacactgcctattaccctagtgtctag

SEQ ID NO: 186726 - DNA, 2154 bp, Artificial Sequence
  Description of Artificial Sequence: Synthetic coding sequence
atgacccccccccccccccccccccccccccccggccccgaccccgccgccgatcctgccgcagatccatgcccttggcccggcagcctcgtcgtgttgtttggagccaccgccggcgcgctggggagggacctcggcagtgacgaaacggaccttattttgttggtttggcaggtggtagaaccccgctctagacaggttggtactctgcataagagcctcgttcgagctgaggccgctgcactctcaacccagtgccgagaagcctcgggcctgtcagccgatagcctcgccagagctgaacctctggataaagtgttgcaacagttcagccagttagtaaacggggatgttgccttgttggggggcggcccctacatgctctgcactgatggacaacagctgctgcgacaggtactccatcccgaggcatctagaaagaacctggtgctgcccgacatgtttttctcattctatgacctgagaagggagtttcacatgcagcatcctagcacgtgtccagcgcgtgacctgacagtggcaacaatggcccagggacttggtctagaaaccgacgctaccgaggatgattttggggtttgggaagtgaagaccatggtggcagttattctgcatcttctgaaggagcctagcagccagctgtttagcaaaccagaagtcattaagcaaaagtatgaaactggtccctgttctaaagccgacgtggttgactcagagacagtcgtgagagcacggggcttgccttggcagagttcggaccaagatgtggccaggttctttaaaggcctgaatgttgcccggggcggggtggcactctgcctcaacgctcagggcagacgcaacggggaggctcttattaggtttgtcgactcggaacagcgggatctggctctacaaaggcataagcatcatatgggtgtgaggtacattgaggtatataaggctaccggcgaggaattcgtgaaaattgccggagggacatctttagaagtggcacgcttcctttcccgcgaggaccaagtgattctacggcttcgcggcctccccttcagcgccggaccaacagacgtcttggggtttcttggccctgaatgtccggtgaccggaggcaccgagggacttctcttcgtgcggcatccagacggcaggccaactggagatgcattcgctctgtttgcctgcgaggaactggctcaagcggcgcttagaaggcacaaaggaatgctagggaaaaggtacatcgaactgtttagatccacagcagcagaggttcagcaggtcctcaatcgatacgcatcaggcccactgttgcccacgctgacggcgccacttctccccatcccgtttcccctagctccaggcaccggaagggactgcgtgagacttagggggttgccgtacactgcaacgattgaagatattctttcctttctgggcgaggctgctgccgacatccggcctcatggggttcacatggtgctcaatcagcaggggcggccatctggcgacgccttcatccaaatgaccagcgcagagagagctctcgccgcagcccagaggtgtcacaaaaaggtgatgaaagagagatatgttgaggtggttccatgttcgacggaggagatgagccgagtactcatgggggggactttagggcgatcaggcatgtctccaccgccctgtaagctgccctgcctgtctccaccaacgtacaccacctttcaagcaacgcccaccttgatccctaccgagaccgccgccctctatccttcttccgcgctcctgcccgccgcgcgcgtgcccgccgcgccgacaccagttgcgtactaccctggaccagcaacgcagctgtatttgaactatacggcctattacccaagtccccctgtgtcacccacaactgtgggttatttgaccacacctaccgcagctctggccagcgccccaacgagcgtgttgtcccagtctggggcactggtgcgtatgcagggtgtcccatacactgccggcatgaaagatctgttgtctgtcttccaggcgtatcagctcccggccgatgactacacctcgctgatgcccgtgggagatccgcctcgaaccgtgctccaggcaccgaaagagtgggtgtgcctgtag

SEQ ID NO: 186727 - DNA, 924 bp, Artificial Sequence
  Description of Artificial Sequence: Synthetic coding sequence
atgaacacccggaaccgggtggtgaacagcggcctgggcgccagccccgccagcaggcctaccagagacccacaggatcctagcggcagacagggcgaactgtcacccgtcgaggatcagagggagggtcttgaagcagccccgaaaggacctagccgtgagtcagtggtgcacgcaggccagaggcgcacaagcgcatacaccctgatagcccctaacataaatagacgcaacgagatacagaggatcgcggagcaggaactcgcaaatctggaaaagtggaaggagcagaacagagccaagcctgttcatctggtgccaagacggctgggcgggtcacagagcgagaccgaagttaggcagaaacagcaactccagctaatgcaatccaagtataaacagaaactgaagagggaagagtctgtccggattaaaaaagaagccgaggaggcagagttgcagaagatgaaagcaatccagagagaaaaatctaacaagctggaagagaagaagcgactgcaggaaaatctcagacgagaagcttttcgcgagcatcagcagtataaaactgctgaattcctttctaagctgaataccgaaagtcctgatagatctgcctgccagtcggctgtgtgtggtccccagtcgagcacctgggcgagaagctgggcctaccgtgacagcctaaaagcggaggaaaatcggaaattacaaaaaatgaaagacgaacagcaccagaagagtgagctgctcgagttgaaacgccagcagcaggagcaggaacgggccaaaattcaccagaccgaacacagaagagtgaacaacgcatttcttgatcgtctgcagggaaaatcacagccaggtggcctcgagcagagtggaggatgctggaatatgaactctggaaatagttgggggatctag

SEQ ID NO: 186728 - DNA, 1233 bp, Artificial Sequence
  Description of Artificial Sequence: Synthetic coding sequence
atgaacacccggaaccgggtggtgaacagcggcctgggcgccagccccgcgtcaaggcctactagggacccacaggacccctctgggcggcagggcgaactgagcccggtggaagatcagagagaggggttagaggctgcacccaaagggccatcccgggaatcagtggtccacgctgggcagagacggacttcagcctataccctgatcgctccaaacattaacaggcgcaatgagatacagaggatcgccgaacaggagctggcaaatcttgaaaaatggaaagaacagaaccgcgccaagcctgtgcacctcgttcctcgtagactcggaggttcacagtcagaaacagaagttaggcagaagcagcagcttcagctgatgcaatctaagtacaagcaaaagctgaaaagggaagagagcgtccgcatcaaaaaggaggccgaagaggctgaactgcaaaagatgaaggcgatccaaagggaaaaatctaacaaactggaggagaagaaaaggctccaagaaaatttgcgacgagaagcatttcgcgaacatcagcaatataagacagccgaattcctttcaaaattaaacactgagagccctgaccggagtgcatgtcaaagtgcagtttgcgggccccaatcctcgacttggaagctgcccatcctgccaagggaccatagttgggcacgaagctgggcttaccgggactcattaaaagccgaggaaaatcgaaaactgcagaaaatgaaagatgagcagcaccagaagagcgaattgctggaactaaagcggcaacagcaggagcaggagagagccaagatccaccagaccgagcacagaagggttaacaatgctttccttgatcgtctgcaaggcaagagtcagcccggcggccttgagcagtctgggggatgctggaatatgaacagtggcaattcttggggctccctcctggtatttagccgacacctgcgtgtgtacgagaagattcttacaccaatatggccctcttccaccgatcttgaaaaaccccacgagatgctgttcctgaatgtgattctcttctcgcttacagtgtttaccttaatctctaccgcacacacattggatcgtgccgtaagaagcgattggctcctcctggtgctgatttacgcatgccttgaagaactcatcccagagttaatattcaatctgtactgccagggcaatgccaccctgttcttctag

SEQ ID NO: 186729 - DNA, 1368 bp, Artificial Sequence
  Description of Artificial Sequence: Synthetic coding sequence
atgtggctggagatcctgctgaccagcgtgctgggcttcgccatctactggttcatcagtcgggacaaggaggaaactttaccgctggaagatggctggtggggacctggcacaagatctgccgctcgcgaggacgactctatcagaccgttcaaagttgaaacctctgatgaggagatccacgatttacaccagcgcatcgacaagttccggtttaccccccccctcgaggactcttgcttccactacggctttaattccaactatcttaaaaaagtaatcagctattggaggaatgagttcgactggaaaaagcaagtcgagattctgaacagatatccccactttaagactaaaatcgagggactggatatacacttcatccatgtcaagccccctcaattacctgccgggcacacaccaaaacccctactgatggtgcacgggtggccaggatccttttatgaattctacaagattatccccctcctgactgacccgaaaaatcacggcctgagtgacgaacatgtgttcgaggtcatatgtccctccattcccggttacggattttctgaagcctcatctaagaagggcttcaattccgttgccactgctaggattttctacaagctgatgttgaggctagggtttcaagagttctacatacaggggggagattgggggtcactgatctgcactaatatggcccaattggtgccctcgcacgtgaagggtctgcacctaaacatggctctggtgctatcaaacttttctactctcaccctgctcttaggccaacggtttggccgtttcctcgggctgacggaacgcgacgtcgagctcttgtatcccgtcaaggagaaagtgttctattcacttatgagagaatccgggtatatgcatattcagtgtactaaacctgacacagttggctccgcgctgaacgactcacccgtggggctagcagcctatatcctggagaaatttagcacctggactaatacagaatttcgatacttggaggacgggggattggaacgaaagttttccctggatgatcttcttacaaatgtcatgctctactggaccacaggtaccatcattagctcgcaacgattctataaggagaacttgggacaggggtggatgacacagaagcacgaacgcatgaaagtctacgtgcctaccggatttagcgcctttcctttcgaactactgcacacgccggaaaagtgggttcgatttaagtaccctaagctgatctcatattcttacatggtgcgtggcggacattttgccgcctttgaggaacctgaactgctggcccaagatattagaaagtttctgagcgtgctggaacgacagtag

SEQ ID NO: 186730 - DNA, 1368 bp, Artificial Sequence
  Description of Artificial Sequence: Synthetic coding sequence
atgtggctggagatcctgctgaccagcgtgctgggcttcgccatctactggttcatctccagagacaaagaagagactcttcccctggaagatggttggtggggcccaggcacaaggtccgccgcacgcgaggacgactccatcaggccattcaaagtggagacgtcagatgaagaaatccatgacctacatcagcgaatagataagtttcggttcacgcccccactggaagactcatgttttcattacgggtttaactcaaattatttgaagaaggtcattagttattggcgaaacgaatttgattggaagaagcaggtggaaatcctgaaccggtatcctcatttcaagactaaaatagaagggctggatatacactttattcacgtcaaaccacctcagctgccagcagggcacacccctaagcctctgctaatggtgcatggatggccagggtcgttctacgaattctacaagatcatccccctgttgacagatcccaagaatcacggcttatccgacgaacacgtgtttgaggtaatctgcccaagcatccccggttacggcttctccgaggcaagcagcaagaaagggtttaactctgtggctaccgctcggatattctataagctgatgctccggttaggatttcaggagttctatatccaggggggcgattggggtagcctaatttgtacaaatatggcacagctggttccttctcatgtgaaggggcttcacctcaatatggctctggttctgtccaacttcagcacattgacgcttcttctaggacagaggtttggcagattccttggcttgacagaacgtgatgtggagctactttacccagtcaaggagaaagtgttttacagcttgatgagggaatccggatatatgcatatccaatgcactaagccggacacggtgggctcagcgctgaatgattctcccgttgggctcgccgcctacatcctcgagaaattcagtacctggacaaacacagagtttcgctatttggaggacgggggactggaacggaagtttagtctggacgacctgttgactaacgtgatgctttattggaccactggaactattatctcctcccagcgcttctacaaggagaacctgggtcagggctggatgacccagaagcacgagagaatgaaggtgtatgtgcctacagggttttccgcgtttccctttgagctccttcatacacctgagaaatgggtaagattcaagtatccaaagctaatcagttactcctatatggttcggggcggccattttgccgcttttgaggaaccggagctcctggcacaggacatacggaaatttctgtccgtgcttgagcgtcagtag

SEQ ID NO: 186731 - DNA, 486 bp, Artificial Sequence
  Description of Artificial Sequence: Synthetic coding sequence
atgtggctggagatcctgctgaccagcgtgctgggcttcgccatctactggtttatcagcagggataaggaagagactttacctctagaggacggatggtggggcccaggaacacggtcagcggcacgtgaggatgactcaattaggccatttaaagtggaaacttccgacgaggaaatacatgatctgcatcagcggattgataagtttaggttcactcctccccttgaggacagctgctttcactacggttttaacagcaactaccttaagaaggtaatcagttactggagaaacgagttcgattggaaaaagcaggtcgaaatcttaaatcggtatccacatttcaagacaaagattgaagggctcgatatccatttcatccacgtaaagccaccgcaattacccgcggggcacacccctaaaccacttcttatggtacacggctggcccggcagcttctatgaattttacaagataatatag

SEQ ID NO: 186732 - DNA, 411 bp, Artificial Sequence
  Description of Artificial Sequence: Synthetic coding sequence
atgtggctggagatcctgctgaccagcgtgctgggcttcgccatctattggtttatttcccgagataaagaggaaacattgcctctggaggacggctggtggggccctggtactcggtccgcggcgagggaggatgatagtattaggccatttaaggtggaaacatccgatgaagaaattcatgatttgcaccaacgaattgacaagtttagatttaccccacccctcgaagattcttgctttcattatggtttcaattccaactacctgaagaaagtcatctcttattggcgaaacgaattcgactggaagaaacaggtggagattctcaacagatacccccactttaagacgaagatcgagggtctcgatatccatttcattcatgtcaaacccccccaactgccgtag

SEQ ID NO: 186733 - DNA, 1509 bp, Artificial Sequence
  Description of Artificial Sequence: Synthetic coding sequence
atgaagggcgagatcaccctgagccagtggatccccctgatggaggaaaattgtcgcaaatgctctgaaactgcaaaagtctgcctgccgaagaacttcagcataaaggaaatctttgacaaagctatctctgctcgaaagattaaccgaccaatgttgcaggcagccctaatgctaaggaagaagggattcacgacagccattctgaccaacacctggctggacgaccgagctgaacgggacgggctcgctcaactgatgtgcgagctgaaaatgcatttcgatttcctgattgagagttgtcaagttggtatggtcaaaccagaaccacagatctacaagttcctcttggacaccttgaaagcctctcccagtgaggttgtcttcctggatgatataggtgccaatcttaaacccgctcgagaccttgggatggtcaccatattagtgcaggacacagacacggctttgaaagaactcgagaaggtcacaggaattcaactgctgaacaccccggcccctttacccacatcctgcaacccgtctgatatgtcccatggatacgtcaccgtcaaaccacgcgtgagactgcatttcgtcgaattaggaagtggacctgcggtgtgcctttgccatgggtttccagagtcttggtactcctggaggtatcagatccctgccttagcccaggcggggtatcgcgtgcttgcgatggacatgaaagggtatggcgagagcagcgcaccacctgaaatcgaggaatattgcatggaggtgttgtgtaaagagatggtgacattccttgacaagcttggattatcacaggctgtgttcattggccatgattggggtggcatgctggtgtggtacatggcgctgttctatcccgagcgggtaagggccgtcgcctcgctgaacacacccttcattccagctaacccaaatatgtcccctctggaatccattaaggcaaaccctgtatttgattatcaactgtactttcaggagccaggggtggctgaagccgagttggagcagaatctctctcgcacatttaagagcctcttccgcgcaagtgacgaaagcgtgttgagtatgcataaggtgtgtgaggctgggggcctttttgttaactctccggaggagccttcgctgagtaggatggtgaccgaggaggaaatccagttctatgtccagcaatttaagaagagtggatttaggggaccgctcaattggtatcgcaacatggagcgaaattggaagtgggcgtgtaaatcactcggtcggaaaattctcatccctgcactgatggtaacagccgagaaggacttcgtgcttgtcccccagatgtcccaacacatggaagactggatcccgcatttgaaaagagggcatatagaggattgtggacactggacacagatggataaaccaacggaagttaatcaaatcctgatcaagtggctggacagcgacgcgagaaatccccctgtcgtgtctaagatgtag

SEQ ID NO: 186734 - DNA, 1470 bp, Artificial Sequence
  Description of Artificial Sequence: Synthetic coding sequence
atggaggagaactgccggaagtgcagcgagaccgccaaggtgtgcctccctaagaacttctcaattaaagagattttcgacaaggcaatttccgcccgcaaaatcaaccggcccatgctccaagcagcactgatgttgcggaagaagggattcaccacggcaatccttaccaacacctggcttgatgaccgcgcagaacgcgacgggctggcccagcttatgtgtgagctcaaaatgcactttgacttcctgatagagtcttgccaggtgggaatggttaaaccagaaccacagatctataaattcctcctggacacactgaaggcgagcccatctgaggtggtgttcctagatgatattggcgctaaccttaaacctgcgcgggatctcggcatggtaactatccttgttcaagatacagatactgcactcaaagaattggagaaagtcacaggcatacagctcctgaacaccccagctcctttgcccacttcttgtaatccatccgatatgtctcatggctacgtgactgttaagccgcgtgtgaggttacatttcgtggaactgggaagcggcccagctgtgtgtttgtgccacggcttcccagaatcttggtatagctggcgttaccagatacctgcattagcacaggcaggctaccgggtgctggccatggatatgaaggggtacggcgagagcagtgcacctccagagattgaagaatactgtatggaggtgttgtgcaaagagatggtgactttcctcgacaaattgggcctgtcacaggcagttttcatagggcatgactggggaggcatgctggtgtggtatatggcactgttctacccggagagagtacgtgccgttgcatcgctgaataccccatttattcctgccaaccccaatatgtcacccctggaaagcattaaagcaaacccggttttcgactaccagttatactttcaggagccaggggttgccgaggccgagttagaacagaacctgagccgcacatttaagtctctctttcgtgcttctgacgagtccgtgttaagcatgcataaggtgtgtgaggccggaggcctctttgtcaatagtccagaggaaccatcgctcagccggatggtcacagaggaggaaattcaattttatgttcaacaatttaagaaatctggctttagaggaccactgaactggtaccggaacatggagcgaaactggaagtgggcatgtaagagcttggggaggaaaatcctgattcccgccctcatggttaccgccgagaaggacttcgtgctggttccacagatgtcccaacacatggaagactggattccacacctgaaacgcggacacatcgaggactgcggtcactggacccagatggacaaacctactgaggtaaaccagattcttatcaaatggttggattcagatgccagaaaccctcctgtcgtgtcaaagatgtag

SEQ ID NO: 186735 - DNA, 1509 bp, Artificial Sequence
  Description of Artificial Sequence: Synthetic coding sequence
atgaccctgcgggccgccgtgttcgacctggacggcgtgctggcccttccagccgtgttcggtgttctaggtagaacggaggaagctcttgctctaccccgaggcttactcaacgatgccttccagaagggcggccctgaaggcgcgacaacaagactgatgaagggcgaaatcacactgtcgcagtggatccccctgatggaagagaattgtagaaaatgttccgaaacggcaaaggtatgcctccccaaaaacttctccatcaaagagatcttcgacaaagcgataagcgcaaggaagatcaatagaccaatgttacaggctgccctgatgctgaggaaaaaagcattctgtagcggctttaccaccgccatcctgaccaacacctggctcgacgatagagccgaacgcgacggactcgcgcagctcatgtgtgaactcaagatgcacttcgactttctcatagagagttgccaggtgggtatggtcaagccggaaccacagatttataaattccttttagacactctgaaagcctctcctagcgaagtggtgttcctcgatgacattggcgctaatcttaagcctgcgcgggacctaggcatggtcaccatacttgtgcaggataccgatacagctctcaaggagctcgagaaagtcacagggatccagctgctgaatactccagcccccctgcccacgtcctgtaaccccagcgatatgtcacatggatacgtcaccgtcaaaccccgagtgagactgcactttgtcgagttgggtagcgggcctgcagtgtgcctctgtcatggattccctgaatcttggtactcttggcgttaccagattccagcactggcccaagccggttacagagtgttggctatggatatgaaaggatacggtgagtcaagtgctccaccagaaattgaagagtactgtatggaagtgctttgtaaggagtccattaaggccaatcccgtatttgattaccagctctactttcaggagccgggggttgcagaagctgaactggagcagaatctgagtcggacattcaaatccctattccgtgcatcagacgagtctgtgctcagcatgcacaaggtgtgtgaggcgggcggactcttcgttaactctcctgaggagccctccctatcccgtatggtcaccgaagaggagattcagttttacgtgcagcaattcaagaagtccgggtttagaggccctctgaactggtatcgcaatatggagcgcaattggaaatgggcttgtaagtccctcggaagaaaaatcctcatccccgccctgatggtgaccgccgaaaaagacttcgtcctggtgcctcagatgtcacaacatatggaagattggattccccatttaaaacggggccacatcgaagactgtggccactggacccagatggacaaaccaaccgaagtgaaccaaatcctaatcaaatggctggacagcgacgcacgtaacccccccgtggtgtccaagatgtag

SEQ ID NO: 186736 - DNA, 1668 bp, Artificial Sequence
  Description of Artificial Sequence: Synthetic coding sequence
atgaccctgcgggccgccgtgttcgacctggacggcgtgctggccctgcccgccgtgttcggcgtgctggggcggaccgaagaggccctggcacttccgagaggtttgctgaatgatgcttttcagaagggggggcctgagggtgcaacaacacgactcatgaaaggggaaattacactgtcacagtggatcccactgatggaggagaactgccgaaaatgcagtgagacagcaaaggtttgtttaccgaagaatttcagtattaaggaaatatttgacaaagcgatcagtgcacgaaagataaatagacccatgcttcaagcagcactcatgctgcgtaagaagggatttacgacagctattttaacgaacacttggcttgatgatagggccgagcgggacggcctcgcccaactgatgtgcgaactgaagatgcactttgatttcctgatcgaatcatgtcaagtgggtatggtgaagcccgagcctcaaatctacaaattcctcctcgacacgctgaaggccagcccttcagaggtagtttttctggacgatataggggctaatcttaagcctgcccgcgacctgggtatggtgacgatcttggtccaggatacagacaccgccctgaaagagctcgaaaaggtaacaggtattcagttgctcaatactcccgccccactgcccacatcctgtaacccatctgatatgtcacatgggtatgtaaccgtcaagccccgagtgagattgcatttcgttgagctcggttcgggacctgctgtgtgcctctgccacggcttccccgaaagctggtacagctggcgatatcaaatcccggccttagcccaagccggttaccgagtgctggcgatggatatgaaaggctacggcgagtcctcagcaccccccgaaattgaagaatattgcatggaggtcttgtgtaaagaaatggtaacttttctagacaagctgggacttagccaggctgtgttcattggccacgattggggcggcatgctcgtttggtacatggctctgttctatcccgaacgcgttcgcgccgttgcctcactcaatactccattcatcccggcaaaccccaacatgtctccccttgagagcattaaagccaatcctgtgttcgattatcagctctattttcaggaacccggcgtggctgaagcggagctggagcagaatctgtcccggactttcaaatccctgtttcgtgcgtcagacgaatctgttctttctatgcacaaagtttgtgaggctggtggcctttttgtcaacagccctgaagagccatccttgtctcgcatggtgaccgaggaggagattcagttctacgtccagcaattcaaaaagtctgggtttaggggccctctgaattggtatcgcaatatggaacgcaattggaagtgggcctgtaaaagtctcggacggaagatcctcatccccgccctgatggttaccgccgagaaggatttcgtccttgtaccccagatgtctcaacacatggaagactggattccccacctcaagaggggccatatcgaggactgcggacactggactcagatggataaacctactgaggtcaatcagatcctcatcaaatggctggatagcgatgccaggaaccctcctgttgtttcaaagatgtag

SEQ ID NO: 186737 - DNA, 1653 bp, Artificial Sequence
  Description of Artificial Sequence: Synthetic coding sequence
atgagcaccagcagcctgcggcggcagatgaagaacatcgtgcacaattatagtgaagctgagatcaaagtccgggaagctacatctaatgacccttggggtccttcgtcttctctgatgagtgagatcgccgacctgacctacaacgttgtagctttctccgaaatcatgtctatgatatggaaaagactgaacgaccatggtaagaattggcggcatgtctataaagcaatgactctaatggaatacctgattaagacaggcagcgaacgagtgtcacaacagtgtaaagaaaatatgtacgcggtgcagacactgaaagacttccagtacgtcgatagggatgggaaggatcaaggagtcaacgtgagggagaaggcaaagcagctggtcgctctcctacgcgatgaggatcgcctccgtgaggagcgtgcccatgccctgaaaacgaaagagaagcttgcccaaacagccaccgcctcgtctgcagctgtggggtccggccccccaccagaggccgagcaagcctggccccagagttccggtgaagaggagctccagttgcagctggcactggccatgagtaaggaggaagcggatcaggaagagagaatcaggcgcggggatgatctgaggctccagatggcgattgaggagagcaagcgggaaactgggggaaaggaagagtcttctctgatggacttagcagatgtgtttactgcgcccgctcccgcccctactacagatccatggggggggcctgccccaatggccgcggcggtgcctacggcggccccaacatccgatccatggggtgggccgcctgtgccaccagccgccgatccttggggaggacccgcaccgaccccagccagtggagacccttggaggcccgctgcaccagccgggccatccgtagacccttggggcgggacgcccgctccagcagcaggggagggaccgacccccgatccctggggttcctctgatggcggagtgcccgttagcggccccagtgcctcggacccctggactcctgcacccgctttctcagatccctgggggggttcgcccgctaagccctcaacgaatggtaccacggccggtggcttcgatactgagcccgatgaattttccgattttgataggctgaggacagcgttacccacctctggctcatctgcaggcgagctggaactgttagccggggaggtaccagccagatccccgggagcgtttgatatgagtggcgtccgcggctcgctcgcagaagcggtgggttcacccccacccgcagctacccctacgcccacaccacccactagaaagactcctgagagtttcctaggacccaacgctgcactcgtggatttggacagccttgtaagccgccccgggcctacccctcctggcgcaaaggcctctaacccttttctgcctgggggaggtcctgccaccgggccaagcgttacgaatccctttcagcccgctcctcccgccaccttgactttgaaccagctccggctgagccctgtcccgcctgtacccggtgcccccccgacctatatcagccccctcggggggggtcctgggctgccaccaatgatgccaccaggccctccagcccccaatactaatccattcctcttgtag

SEQ ID NO: 186738 - DNA, 1731 bp, Artificial Sequence
  Description of Artificial Sequence: Synthetic coding sequence
atgagcaccagcagcctgcggcggcagatgaagaacatcgtgcacaattactccgaagctgagataaaggtgcgggaagccactagtaacgacccttggggaccgtcaagctcgctgatgtccgaaatcgccgacctcacttataacgtggtggccttcagtgaaattatgtcaatgatttggaagaggctgaacgaccacgggaaaaattggcgccatgtatataaggcgatgactctgatggaatatttgattaaaacagggtccgaacgcgtcagtcagcaatgcaaggagaatatgtacgctgtccagaccctcaaggatttccaatatgtagatcgcgacggcaaggaccagggcgtgaacgtgcgcgagaaggccaaacaactcgtcgctctgctcagggacgaggatcggttgagagaggagcgggcacacgccctcaaaacaaaggagaaactcgcacagacagccacagcttcatctgctgccgtgggcagtggtcctccacctgaagcagaacaggcttggccacagtccagcggggaggaggagctgcagcttcaacttgctctggcaatgtctaaagaggaggccgatcagccgcctagctgtggaccggaagacgacgcgcagttacagctggcgcttagccttagcagggaagaacacgacaaagaggagcggatccgaagaggggacgacctgcgcctacagatggcaatcgaagagtctaaaagagaaaccggtgggaaggaggagagctctctgatggacctagccgatgtctttaccgccccggcgcctgcccccaccacagatccctggggcggacccgcccccatggccgccgccgtacccaccgccgctcctactagcgatccctggggaggcccccctgtcccccccgctgccgacccttggggggggccggctcctacccccgcctccggagacccctggagaccagctgcacctgccgggccatccgtcgacccttggggcggtacacctgctccagctgccggtgagggtcccacccccgacccttggggcagctccgatgggggtgttcccgtgagcggaccctcagcctctgatccatggactcccgctcccgcattttccgatccctggggcggaagtcctgcgaaacctagcacaaatggaactacagccgcggggggattcgacaccgagcctgacgagttttctgactttgaccggctgcgcacagcactgcccacttctgggagctctgctggagagctcgaactgttggccggggaggtccctgccagatcccctggtgcgtttgacatgtccggcgtgcgagggtcactcgccgaggctgtgggtagcccgcctcctgccgccacgccaacaccaacccctcccacacggaagaccccggaatcttttctgggacccaatgccgcactggttgacctggacagtctggtttctcgccccggaccgacgccacccggcgccaaggctagcaacccatttctgccgggaggagggcctgctacaggaccttccgtgaccaatccattccagccagcaccaccagctacgctgaccctgaaccagctcagactttccccggtgccacctgtacccggcgctcctccgacatatatctcccccctgggcgggggaccagggctgccccccatgatgccccccggccctcctgccccgaatactaaccctttcctcctctag

SEQ ID NO: 186739 - DNA, 1989 bp, Artificial Sequence
  Description of Artificial Sequence: Synthetic coding sequence
atgggcgaccagagctggctgtggaaccaggccgcccccggcgtgagaagcccggtttttgcatgctcagtggagaagggtaacgtcccgctcgtcctcagcgagcacctggcccatagcagagatccggggagcggcgcagtccgctttctgatcagtccagaaccatgggcctctgccatactgggtacctcgggactgctcgcttcccccgtgctgccagccgcattggatgccgtcacttgccagcacctaccccagccctccagtggctctagaccgatttcgcccaggattggggctctgtgccctctcctgctgcagcctggaacaatgtctacatcttctttgcgccgccagatgaaaaacatcgtccataactacagtgaggccgagataaaggtcagagaggctaccagcaacgatccttggggcccatcaagttctttgatgtcagagatagcggacttgacctataatgtggtagcctttagcgaaattatgagtatgatctggaaaaggctcaacgatcacggcaagaactggcggcacgtgtacaaagcaatgacactgatggaatacttgatcaaaactggctccgaacgggtgtcacagcagtgtaaggaaaatatgtacgcagtccagactctgaaagacttccagtacgtggatcgtgacggtaaagaccagggggtaaacgtcagagagaaggctaaacagctcgtggcccttttgcgagacgaggaccgattacgggaagagcgcgctcacgccttgaaaactaaggagaagctggcccaaactgcgaccgcgtcttcagctgccgtcggaagcggccccccccctgaggctgagcaggcatggccccaaagctctggtgaagaggagctccagttacagcttgctctcgccatgagcaaggaagaggcagatcaggaagagaggattagacgcggtgatgacctgagactccagatggccattgaagagagcaaacgcgaaaccggagggaaagaggaatcatctctgatggatctggctgatgtctttaccgctcctgccccagctcccacgacggatccttggggtggccccgctcctatggcagctgcagtgccgaccgccgcccccacatccgacccctggggtggccctcctgttcccccagccgccgacccatggggcggaccagctccaacacctgcgtcaggggatccctggaggccagcggctcccgccggcccctccgtggatccctggggtgggaccccagcccccgccgcgggtgaggggccgactcccgatccatgggggtctagtgacggtggggtgcctgtgagtggcccctctgcctccgacccttggaccccagctcccgcattcagcgacccatggggcgggtcccctgctaagccctctacaaatgggacaaccgcagccggcggatttgacactgaaccagacgaattttccgactttgatcgactgcgtacagcccttcccaccagcggatctagcgccggcgagttagagctactcgccggggaggtaccagcaagatctcccggcgcctttgacatgtccggagtgaggggttccctcgctgaggctgtaggctctccaccgcccgccgccactcccacgcctactccccccactcggaagacacctgaatctttcctggggcctaacgcagcgcttgtggatctggactcactggtgagtcgcccaggtcccactccccctggcgccaaagcaagcaacccatttctacccgggggaggccctgcaaccgggccctccgtcaccaaccccttccagcctgcgcctccagccaccctgaccctgaatcagctacgtttatcaccggtgccccccgtcccaggcgccccccccacttatattagcccactgggaggcgggcctggcctcccccccatgatgccccctgggcctcccgccccgaataccaacccattccttctatag

SEQ ID NO: 186740 - DNA, 1611 bp, Artificial Sequence
  Description of Artificial Sequence: Synthetic coding sequence
atgagcgagatcgccgacctgacctacaacgtggtggccttcagcgagatcatgtccatgatctggaagaggctgaacgatcacggcaagaactggaggcacgtttacaaagccatgacattgatggagtatttgatcaagacaggatccgagcgtgtgagccagcagtgcaaggagaacatgtatgcggttcaaaccctcaaagatttccagtacgtcgacagagacgggaaggatcagggtgtgaacgtgcgagaaaaagctaaacagctggtggcgctgctccgggacgaagatagactcagagaggaaagggcccatgccttgaagactaaggagaagctggcacagaccgctacggccagctctgctgccgtgggcagcggccctccccctgaggcagagcaggcttggcctcagtccagtggagaggaggagctacaattacaattggcgctggcaatgagtaaagaggaggcagaccagccaccttcgtgtggacctgaagacgatgcacagttgcagttggctctctccttgtctcgagaggagcatgacaaggaagaaaggatccgcagaggagatgatctgagactgcagatggcaatagaagagtctaagcgggagaccggaggcaaagaggagtcgagcctcatggatctggcagacgttttcacggctccagcccccgcacccacaactgacccatgggggggacctgcccccatggctgccgccgtgccaactgcagcccctacttctgatccgtggggtggaccccctgttcccccagcggcagacccgtggggaggccccgctccgacacctgcgtcgggcgatccatggcggccagctgctccggccggcccaagtgtggatccatggggaggaacaccagctcctgctgcaggcgaaggtccgacacctgatccctggggttcttcagacggcggagttccagtctctggcccctcagcatccgatccttggacgcctgctccagcgttttccgatccgtggggaggatcccctgccaagcccagcacgaatggaacaaccgcaggtggctttgataccgagccggatgaattctccgacttcgatcggttgcgcacagccttgccgacctctgggagctctgccggagaactcgagctgctggcgggcgaagtgccagcccgaagcccaggtgcctttgacatgtctggggttagaggcagcctggcagaggctgtcgggagccctcctccagcggctactcccacccctaccccaccaactcgaaaaacccccgagtcttttctcgggcccaatgccgcgctcgtggatcttgattctcttgtatcccgaccagggcccacccccccaggggcaaaagcttctaatccctttctgccaggaggcggaccggccaccgggccgtcagtgactaacccgttccagccagccccccccgcgacacttactctaaatcaactgcgcctgtctccagtgccccccgttcctggggcgcccccaacatacattagccctctcggcggtggtcctggcttaccgccaatgatgccccccggcccgccggcaccgaacactaacccatttttgctgtag

SEQ ID NO: 186741 - DNA, 1926 bp, Artificial Sequence
  Description of Artificial Sequence: Synthetic coding sequence
atgaccaccagcagcatccggcggcagatgaagaacatcgtgaacaattactccgaagcagagatcaaagtgcgagaagccacttccaacgacccctggggcccctctagctccttaatgaccgagatcgcggacctgacatacaatgtcgttgcattttctgagatcatgagcatggtgtggaagaggttaaacgaccacggaaagaactggcggcacgtttataaggccttaactttgcttgactatctgattaaaactggaagcgagcgcgtggctcaacagtgccgcgaaaacatattcgctattcaaaccctgaaagactttcagtatattgacagagatggtaaggaccagggcatcaacgttagagagaaaagtaaacagcttgtggctcttctcaaggatgaggaacggctcaaggctgaacgggcccaggccctgaagacaaaagagaggatggcacaggtagccacaggtatgggctccaatcagatcacgtttgggagagggagctcacagcctaatctttcaacttcccattctgagcaggagtacggaaaagctggcggttcccctgcgagttaccatggctctccagaagcctccctgtgcccccagcatcggaccggtgcgccccttggacaatcagaggagctgcagccgcttagccagcgacacccattcctaccacacttgggactagctagccggcccaacggcgattggtctcagccatgtcttacctgcgatcgagccgcccgtgccacatctccgcgagtttcatctgaactggaacaggcgcgcccccagacctccggagaagaggaacttcaacttcaactagctcttgccatgagcagggaagtagctgaacaagaggagaggctgcggaggggcgacgacctgagactgcagatggcactcgaagagtctcgacgcgacactgtgaagatacccaagaaaaaagagcacgggagtctgccacaacagaccactctgctcgatctgatggacgccctgccgtccagcggccccgcagcgcagaaggccgaaccgtggggaccttcggcttccactaaccagacaaatccatggggcgggccagctgcgcccgcatctaccagtgacccatggccatcctttggtacgaaaccagccgcctcgattgacccttggggcgtccctactggggccaccgtacagagcgtgcccaaaaatagcgacccttgggccgccagtcagcaaccggcctcctccgccgggaagcgtgcttctgacgcctggggagctgtatcaacaactaagccagtatctgtgtcggggagcttcgaactcttcagtaacctgaatgggacaattaaagatgattttagcgagtttgacaacctacgcacaagtaagaaaacagctgagtccgtgacttccctgcccagtcaaaacaatgggaccacatcccccgacccattcgagtctcagcctcttaccgtggccagcagcaagcccagtagtgcacgaaagactcccgaatcctttttaggtcctaacgctgctctcgtcaacctcgactcactggtgaccagaccagcgccacctgctcaatcgctcaacccttttctggccccaggagctccagcaaccagtgcacccgtcaaccccttccaggtaaatcagccccaacccctaacactgaatcagctgagaggaagtcccgttttgggcacctcaaccagcttcggtcctggacccggcgtggaatcgatggcagtggccagtatgaccagcgccgcaccccagccagctctgggcgcaaccggcagttctctgactcccctcggaccagccatgatgaatatggtagggtcggttggtatccccccatctgctgcccaagccacggggaccacaaacccattcctgttgtag

SEQ ID NO: 186742 - DNA, 1755 bp, Artificial Sequence
  Description of Artificial Sequence: Synthetic coding sequence
atgaccaccagcagcatccggcggcagatgaagaacatcgtgaacaattacagcgaagccgagattaaagtcagggaggctacatctaatgacccttggggcccatctagctctttgatgactgagattgctgacctgacctataatgtagtagcttttagcgagattatgagcatggtctggaagcggttaaatgatcacggaaaaaattggcggcatgtgtacaaagccctgaccttgctagactacctcatcaagaccggatctgaaagagtggctcagcaatgcagggaaaatatttttgcgatccagaccctaaaggactttcagtacatagaccgcgacggcaaagaccaagggatcaatgtgagagagaagagtaaacaactggtcgcgctgctaaaggacgaagagcgcctgaaagccgaaagggcgcaagcactgaagaccaaagagcggatggcccaggtggccaccggcatgggatccaatcagatcaccttcggtcgggggtcctcgcagccgaacctgagtacctcccacagcgaacaagaatatggcaaggcaggcgggtctcctgccagttaccacggctcaaccagtccacgagtgtctagcgagctggagcaggctaggccccaaacaagtggggaggaggaactgcagctccagttggctctcgctatgagtcgcgaagtggctgaacaagaggagcgattgcgacgcggcgatgatttacgtctgcaaatggctctggaggagtccagaagagatactgttaagatccctaagaagaaagagcatggctctctgcctcagcagaccacactcttagatctgatggatgccttaccctcaagtgggcccgcagcccagaaggcagagccctgggggccatccgcctctacaaatcaaactaacccatggggcggcccggccgcccccgcttccacatccgacccgtggccatccttcggtaccaagcccgccgcgtctattgacccttggggcgtgcctactggagccacagttcagtcagttcctaagaattccgacccctgggctgccagccagcagccagcgagttctgctggcaaaagagcgagcgatgcttggggcgcagtctctacaactaagcctgtgtccgtatctgggtcctttgaactgttcagtaacttgaatgggacaattaaagacgatttctccgaatttgacaatctgcggactagcaaaaaaactgccgaatccgtaacctccctgcccagccaaaacaatgggacaacaagccctgacccctttgagtctcagcctttgactgtcgcatccagcaaaccatcatccgcccgtaaaacgccagaaagtttcctgggtcctaacgccgccttagtaaacctggattcccttgtgaccagacccgcacctcccgctcagtctctaaaccctttcctggccccaggcgctcccgcgactagcgcaccggtgaatccctttcaggttaaccagccgcaacccttgactctaaaccagctccggggatcaccagtactggggaccagtacctctttcggcccaggcccaggtgtcgagagcatggctgtagcatcaatgaccagcgcagcgcctcaaccggctctcggagcaactggtagctctttaacgccattgggcccggctatgatgaacatggtcggcagcgtcggcattcccccatctgcagcacaggctacaggaaccaccaacccatttctcctttag

SEQ ID NO: 186743 - DNA, 1071 bp, Artificial Sequence
  Description of Artificial Sequence: Synthetic coding sequence
atgagccgggaggtggccgagcaggaggagcggctgcggcggggcgatgacctacgtctccagatggctctcgaggaaagtcgcagggatacagttaagatacccaaaaagaaggagcacggttccttaccccagcaaacaacactgttggacctgatggacgctttgccaagttctgggcctgctgcccagaaggctgagccttgggggcctagcgcctctactaatcagacgaatccatggggtggaccagcagctcccgccagcacatctgatccctggccatctttcggcaccaagcctgctgcgagcatagatccctggggtgtccccaccggagctaccgttcaatccgtccctaagaactcagacccatgggcggctagtcagcaacccgcctcatcagcaggaaagagggcatcagacgcatggggcgcggtgagcacaactaaaccggtgtccgtctctggcagttttgagcttttttctaatctaaatggtaccattaaagacgatttcagtgagttcgataatctgcgaaccagcaagaaaactgccgagagcgtcacctccttaccctcccagaataatggaaccacatcccccgatccgttcgaaagccagccactgaccgtggctagctctaagccgtccagcgcacgcaaaactcccgagtcgttcctgggacctaacgcggcacttgtgaaccttgactccttggtgactcgtcctgcaccccctgcccagagcctcaacccttttttggctccaggagcgcccgcgacaagtgcccccgtgaatccgttccaggtaaatcagccacagcccctgactctgaatcaacttcgcgggtcaccggttctgggcaccagcacttcattcggcccaggtcccggggtggagtcaatggccgtggccagcatgactagcgcagctccccagcctgcactgggggctaccggtagctctctgactccactcgggccagccatgatgaatatggtgggatcagttggaatcccgccatccgccgctcaggcgacgggcacgactaatccttttctcttgtag

SEQ ID NO: 186744 - DNA, 1755 bp, Artificial Sequence
  Description of Artificial Sequence: Synthetic coding sequence
atgaccaccagcagcatccggcggcagatgaagaacatcgtgaacaactattctgaagccgagattaaagttagggaggcaaccagtaacgacccctggggacccagtagttcacttatgacggaaattgcagatcttacctataacgttgtagctttctcagaaattatgtcaatggtgtggaaacgattaaatgaccacggcaaaaattggcggcacgtttacaaggcgctaacattgctcgattatctcatcaagaccggctctgagagagtggcacagcagtgtcgggaaaacatttttgctatccaaacactgaaggacttccagtacatcgacagagatggtaaggaccagggtattaacgtccgggagaagtctaagcaactggtcgccttgcttaaggacgaagagcgcctcaaggcagagagagctcaagctttgaagaccaaggagaggatggcacaggtggcaaccggcatggggagtaaccagattacattcggtaggggcagctcgcagccaaacttgtctacctctcacagcgaacaggagtacggaaaggcaggtgggagcccagcgtcttatcatgggtccacctccccacgggtatcctccgagctcgagcaggcccggccccagactagcggggaggaagagttgcagctccagctggctctggctatgtcacgcgaggtcgcagagcaggaagaaagacttcgccggggagacgatctgcggctccagatggccctggaggaatcgcggagagacacagtcaaaatccctaaaaagaaggaacacggctcgctgcctcagcagactaccttactcgatcttatggacgccctcccatctagtgggccagccgcacagaaggcggagccatgggggccaagcgccagcactaatcagaccaatccatgggggggccccgccgctccggcatctacatcagatccctggccaagctttgggacaaaaccagctgcatctatcgacccatggggagtgccgactggggctaccgtccagagtgtaccgaagaactcagacccgtgggccgcatcccagcaacctgcatcgtctgcaggcaagcgggcctccgatgcctggggcgctgtgagtacgacgaaacctgtttcagtgtccgggtcatttgaattgttcagcaacctgaatggaaccatcaaggatgacttttcagagtttgacaacctccgcacgagcaaaaagacagctgagagcgtcacatccttgcccagccaaaataatggaacaacctcccccgatccgttcgagtctcaacctttaactgttgcatcttctaaacccagtagcgctcggaagacccccgagtctttcctcggtccgaatgctgcattggtgaatctcgattctctggtgacgaggccagccccccctgcccagagcctgaacccattcctcgcgcctggagcacccgcaacttctgccccagtgaacccttttcaggtcaatcagccacagcctctgaccttgaatcagctgcgcggttccccggtcctgggcacctccactagctttggaccagggccaggtgtggaaagtatggcagtggctagcatgacatcagccgcaccccaacctgcactgggcgcaactggaagctctttgacccctcttggcccagcgatgatgaacatggtcggttcagttggtattcccccgagtgccgctcaggctactggcaccaccaacccatttttgctttag

SEQ ID NO: 186745 - DNA, 1455 bp, Artificial Sequence
  Description of Artificial Sequence: Synthetic coding sequence
atgaccaccagcagcatccggcggcagatgaagaacatcgtgaacaactattcggaagcagagatcaaggtacgcgaagcaactagcaacgatccctggggaccaagctcatctctgatgacagagatagcagaccttacatataacgtagtggctttttcagagattatgagcatggtgtggaaacggttaaacgatcacggtaagaactggcgtcacgtatataaggccctgactctactagattacttgatcaaaactggctccgagcgcgtcgcccagcagtgtcgggagaacatctttgccatacagaccctgaaagactttcagtacatcgatagagatgggaaggatcagggtatcaatgttagggaaaagagtaaacaactggtggcactgcttaaggatgaggaacgactaaaggcagagcgcgcacaggcactgaaaacaaaggagagaatggcccaggtcgctacaggtatgggctcaaatcagatcacctttggccgggggtcatcccagcctaatctgtcaactagtcactctgagcaagagtatgggaaggcagggggaagcccagcatcctaccacggatcgccggaagcctccctgtgtccacagcatcggacaggggcacccctcgggcagagtgaggagctgcagcccttgagccagcgccacccttttcttcctcacctcggtctcgcgtctcggcctaatggcgattggagccagccatgcttgacatgcgatcgcgctgccagggccacctccccgcgtgtgtccagtgaacttgagcaggctagaccccaaaccagtggagaggaggaattacagctacaactggccctggcgatgtcccgcgaggtggcagaacaggaagagagacttagaagaggcgatgatcttcgcctgcagatggccctagaagagtctcggcgcgatacagtgaaaattcctaaaaaaaaagagcacggatcattaccacaacagactacactgcttgatctcatggatgccctgcctagcagcggtccagccgctcagaaagcagagccgtggggcccttcagcaagcacaaatcaaacgaacccatggggaggacctgctgctcccgcgtccacctcagacccctggccaagcttcggtacaaagccagccgcttcaatcgatccgtggggtgtgcctacaggcgctaccgttcagtccgtccccaagaactcagacccctgggctgcatcccaacagccagcttcttcggccggaaagcgcgcttctgatgcctggggggcggtctctactaccaaacccgtttctgtgtcaggatctttcgaattattctccaatttgaatggcactatcaaagatgatttctcagaatttgacaacttgcggacctcaaagaaaaccggaatgcaaggccttaccgggctgctgtttaccatggagatatag

SEQ ID NO: 186746 - DNA, 1500 bp, Artificial Sequence
  Description of Artificial Sequence: Synthetic coding sequence
atgaccaccagcagcatccggcggcagatgaagaacatcgtgaacaattactcggaggctgagattaaagttagagaggcaactagcaatgacccatggggtccaagctcatcactcatgacagagatcgccgatctcacttataatgtggttgcctttagcgagattatgtccatggtttggaagcggttgaacgaccacggaaaaaactggcggcatgtttataaagctctgacactgctcgactaccttataaagaccggctcagagagagtggcacagcaatgtcgggagaatatctttgcaattcagacattaaaggattttcagtatatcgatcgggacggtaaagatcaaggcatcaacgtgagagagaaatctaaacagctagtcgctttgctgaaggatgaagaaaggttgaaggccgaaagggcccaagcactcaagaccaaggaacgtatggcacaggtggcgacagggatgggctccaatcagatcacttttggacgagggtcaagtcaacctaatctgagcacatctcattctgagcaagaatatggaaaggccggaggctcaccagcaagctaccatggaagtacaagcccacgtgtttcgtcagagcttgagcaggcccggccacagactagtggagaggaggagctgcagctacagctggccctggcaatgtcaagggaggttgctgagcaggaagagcggttgaggcggggcgatgacctgcgactgcagatggccctggaggaatctcgccgtgatacagttaagatccccaaaaaaaaagagcacggatccctgcctcagcagacaacactgctggatttaatggatgctctacccagctccggaccagccgcccagaaggccgaaccgtggggccctagtgcttctaccaatcagacaaacccgtgggggggaccggcagctccagccagcacaagcgatccttggcccagctttggaaccaaaccagctgccagtatcgacccgtggggcgtgcctacaggcgcaacggttcaaagcgtgccaaagaattccgacccatgggcagcgtctcagcagcccgctagctctgccggcaagcgggcctccgatgcctggggcgccgttagtaccacaaagcctgtatctgttagcgggtcctttgagcttttttcaaacctcaatggaacaataaaagacgacttttctgaatttgacaacctacgcacctcaaagaagacggcggagtctgtgacttccttaccctcccagaataacggaaccacttcaccggacccttttgaatcacaaccgctgacagttgccagcagtaaaccgagctctgctcgtaaaactccagaatccttcttgggtccaaacgctgcccttgtaaacctggattcactcgtgacacgacccgctcctcctgcccagtctctgaacccgtttttggctcctggcatgcagggactcaccggactgctcttcactatggagatctag

SEQ ID NO: 186747 - DNA, 1899 bp, Artificial Sequence
  Description of Artificial Sequence: Synthetic coding sequence
atgaccaccagcgccctgcggcggcaggtgaagaacatcgtgcacaactatagcgaggctgagattaaggtgcgtgaagctacatctaacgacccgtggggacctccgtcctccctgatgtcagaaattgcggatttgacctttaacacggtggcctttaccgaggtgatgggcatgctttggcggcgcctcaacgacagtggtaaaaactggcgccatgtgtacaaggctcttactctgctcgattacttactcaagaccggaagcgaacgcgtggcacaccaatgccgagagaatttgtacacaatccaaacactgaaagacttccagtatattgacagggacggtaaagatcagggggttaacgtgagggaaaaagtaaagcaagtaatggcgctgcttaaagacgaggagcgtctgcggcaggaaagaacacatgccctgaagactaaggaacggatggccttggagggtattggcattggcagcggccaactgggattctcaaggagatacggcgaggactactctcggagccggggctcacctagctcatacaactcctccagctcctccccaaggtacacgagcgacctggagcaagcccgcccccagacctcaggcgaagaggagctgcagctccagttagccctggccatgagtcgtgaggaagctgagaaacctgtcccacctgccagccatagagacgaggacttacagctgcagctagcactcaggctcagccgtcaggagcacgagaaggaggtgcgttcttggcagggcgacggttcccccatggccaacggcgctggcgccgtcgtacaccatcaacgcgatagagagccggaacgagaggaaagaaaagaagaagagaaactgaagacaagtcagtctagcatactggaccttgcagacatttttgttcccgcactagccccaccctcaacccactgtagcgccgatccgtgggacattccaggattcagaccaaacactgaagcctctggatcctcctggggaccaagcgccgatccttggtcccctattccctccggaaccgttctaagccgctctcagccttgggatcttactccaatgctctcatcttctgagccctggggaagaactcctgtgttaccagccgggccccctaccaccgacccctgggccctcaatagcccccaccataaactcccctctactggagcagacccctggggtgctagcctcgagacctccgatactcccggcggggcgtctacattcgacccgtttgccaagccaccagagagcacggagacaaaggaagggcttgagcaagcccttccgtctgggaaaccaagctctcccgtcgaattggatctttttggggacccttcacctagttcaaagcaaaacggaactaaagagcctgacgccttagacctgggcatccttggtgaagcgctgacccagccaagtaaggaagcccgcgcgtgtcgcactcccgaatcatttctgggcccatcagcctcttccctggtcaacctggattccttggtgaaggccccccaggtggccaagactcggaacccttttctaactgggctgagcgccccatctccaacaaacccatttggagcaggggagcctggacgcccaaccctcaatcaaatgaggactgggtccccggcattgggcctggcgggagggccggtgggcgcccctttaggtagcatgacatactcggcttctttaccccttcctctaagcagtgtgcccgctggcctgacacttcccgctagtgtgagcgtgtttccccaagctggggccttcgcccctcagccactgttacctactccatcttctgcaggacccaggccgccaccacctcagacgggtacaaaccctttcctgtag

SEQ ID NO: 186748 - DNA, 957 bp, Artificial Sequence
  Description of Artificial Sequence: Synthetic coding sequence
atgaccaccagcgccctgcggcggcaggtgaagaacatcgtgcacaattattccgaggctgaaatcaaagtgagagaagctacatcgaacgacccatgggggccgcccagcagcctgatgtctgagatcgccgatctcactttcaatacggtggcctttactgaggtgatggggatgctctggagacgacttaacgattcaggtaaaaactggcggcacgtctacaaggccctgactctgctggattacctgcttaagacgggctcagaaagagttgcccaccaatgccgagagaatctgtatacaattcagacacttaaggactttcagtacattgaccgtgatgggaaggaccagggcgtcaacgttcgggagaaagtaaagcaagtcatggccctgctgaaagacgaagagaggctgcggcaggagaggacacacgccttaaaaaccaaagaacgcatggccctggaaggaatcggcattggcagcggacaacttggctttagccggcgctacggtgaggactattcccgatcaaggggttcccctagcagctacaactcttccagttcttctccaaggtatacatccgacttggaacaggcacggccacagacatctggcgaggaagaacttcagctccaattagcactcgctatgagccgcgaagaagctgaaaagcccgtccctcccgcaagtcatcgcgacgaggatcttcaactccaactcgctctgcgcctgtctaggcaagaacacgagaaagaagtgcgctcatggcagggagacggctcccctatggcaaacggcgctggtgccgttgttcaccaccagcgggacagggagcccgagcgagaggagcggaaagaggaagaaaaactgaaaacttctcaggccccaccaacatctgaaccaagacttcctctgcccagcaccgttttgcatccagggctaggatag

SEQ ID NO: 186749 - DNA, 1725 bp, Artificial Sequence
  Description of Artificial Sequence: Synthetic coding sequence
atggccctggagaccctgccccggctgtgccggcccgccgccgcccaggtcgggggctctccacaacggctcttgggcttgggtctgggccccagagagcctgcccttgagccgcatgttgaaccgaaagacgcagcggcattgctgactagacagccaatattacaggattgcgatctggccacagtcgcactgagccccccacctccagccggagccagagctactcatctgcaggtaagttctcatgatgatctcaggacacccgcccccggcgaagaacaccgtgcacagctccttcgagggcggaaccaggtggccttcacagaggtcatgggaatgttgtggaggagactgaacgatagcggaaaaaactggaggcatgtttacaaagccctcacactcctggattatctcttgaagaccggctcagagcgagtcgcgcatcagtgtagggaaaacttatacacgatacagacactaaaagatttccagtatattgaccgcgacggtaaagaccaaggcgtgaacgtccgcgagaaagttaagcaggtcatggccctgttgaaagatgaagagagactcagacaggagcggacgcacgccctaaagaccaaggaacgcatggctctggaagggataggcatcggtagtggacaactgggcttttcacgcagatacggcgaagactacagtcggagtagaggaagcccctcaagctataacagcagctcttcgagtccccgctacacctctgaccttgagcaggcccgcccacagacgtctggggaagaggaactccaactgcagttagcactggctatgagccgggaagaggccgagaaggaagttagaagttggcagggggatggcagtccaatggcaaacggagcaggggccgtcgtgcaccaccaaagggacagagaaccagagcgcgaagaacggaaagaggaggaaaaactcaagacaagtcagtcgtcaatccttgatctggcggacatcttcgtccccgctttagcccccccaagtacccactgttccgcggatccctgggatatcccaggtttccgcccaaatacagaggccagtggaagttcctgggggccttcagctgacccctggtcgccgattccaagtggtaccgtgctatcaaggtctcagccttgggacttgacccctatgctgtctagttccgaaccctggggcaggacaccagtcttgccggccggacctcccacgaccgatccatgggccctgaactctccccatcacaagttgccttcaaccggcgctgatccttggggagctagcctggagacatcggacactcccggaggagcttccacattcgatccctttgctaaacctcctgaaagtactgaaacaaaggaagggctggaacaggccctgcccagtggcaagccatcaagccctgtggaacttgatttattcggggatccctcgcccagtagcaagcagaacggcactaaagagccagacgctttagacctcggcatactcggggaagccctgacccaaccttcgaaggaggctagagcttgtcggacgcccgaatcctttttggggcccagcgcatccagccttgttaatctggacagcctcgtgaaagcgccgcaggtggccaagactcgtaacccattccttacagggctaagcgcccccccccgtttgcgcactcgcggctgggccggtaggcgatgttag

SEQ ID NO: 186750 - DNA, 507 bp, Artificial Sequence
  Description of Artificial Sequence: Synthetic coding sequence
atgaccaccagcgccctgcggcggcaggtgaagaacatcgtgcacaactatagtgaagcagagatcaaggtaagagaagctacaagcaacgacccatggggtccacccagtagtctcatgtctgagatagcagatttgacatttaataccgtggcattcactgaggttatgggtatgctgtggagacgactgaacgattcaggcaagaactggcgccacgtatacaaggcactgaccctcctggattacctgttgaaaaccggatcagaacgggtcgcgcatcagtgtagagagaatttatataccattcagaccctgaaagattttcagtatatcgacagagacggtaaggaccagggcgtaaacgtgcgggagaaggttaaacaggtgatggccctgctgaaagacgaagaacgactgagacaagagagaactcacgctttaaaaaccaaggagagaatggccctggagggaatcggtattgggagcggacagcttggtttttag

SEQ ID NO: 186751 - DNA, 36 bp, Artificial Sequence; identical to SEQ ID NO: 151353
  Description of Artificial Sequence: Synthetic coding sequence

SEQ ID NO: 186752 - DNA, 411 bp, Artificial Sequence
  Description of Artificial Sequence: Synthetic coding sequence
atgaccaccagcgccctgcggcggcaggtgaagaacatcgtgcacaactactctgaagcggagatcaaggttagggaagccaccagcaatgacccttggggcccgccttcaagcctcatgagtgagattgcggacctgacattcaataccgtggccttcaccgaagtgatggggatgctttggaggcgcctgaatgattccggcaaaaactggcggcatgtgtacaaggccctcaccctcctggattatcttctcaaaacggggagcgaacgtgtggctcaccagtgcagggaaaacctgtatacgatccaaactctgaaagatttccagtacatcgacagagatgggaaagatcagggagttaacgttcgcgagaaagtcaagcaggttatggcactcctaaaggattag

SEQ ID NO: 186753 - DNA, 156 bp, Artificial Sequence
  Description of Artificial Sequence: Synthetic coding sequence
atgaccaccagcgccctgcggcggcaggtgaagaacatcgtgcacaattattcagaggcggagatcaaggttcgggaggctacctcaaatgatccctgggggccacccagcagcctcatgtctgagattgcagatttgacattcaacaccgtttag

SEQ ID NO: 186754 - DNA, 327 bp, Artificial Sequence
  Description of Artificial Sequence: Synthetic coding sequence
atgaccaccagcgccctgcggcggcaggtgaagaacatcgtgcacaactactccgaggccgaaattaaggttagggaagctacatctaacgacccctgggggcccccctcttcattgatgtctgagattgcagacctgaccttcaacaccgtggccttcactgaagtgatgggcatgctgtggaggagacttaacgactctggaaaaaactggcgtcacgtgtataaggcgctcaccctcctggattatcttctgaagactggctccgagcgtgtggcgcaccaatgtagagagaacctctataccatccagaccctaaaggactag

SEQ ID NO: 186755 - DNA, 1983 bp, Artificial Sequence
  Description of Artificial Sequence: Synthetic coding sequence
atggccctggagaccctgccccggctgtgccggcccgccgccgcccaagtgggcggatccccacaaaggttgctgggcctgggcctggggcctcgcgaaccagctctggaacctcacgtcgagccaaaagacgctgctgccttgcttacacgccagccaatcctacaggactgcgatctggcgaccgtggctcttagtccgccgccccctgccggcgctagggctacacatctgcaggtttccagccacgacgatcttagaacgccggccccaggagaggaacacagagcccagctacttcgcggcagaaatcaggttgcgttcacggaagtgatgggcatgttatggaggaggctgaacgattctggaaaaaattggcgtcacgtgtacaaagccttaaccctgttggactatttactgaagacaggcagcgagcgtgtagcccatcagtgcagagagaacttatacacaatacagaccctaaaagattttcagtacatagatagagatggcaaagaccagggggtgaacgtccgggaaaaggtcaaacaggtaatggcccttctgaaagacgaggagcgtctccgccaagaacgcacacacgccctgaagaccaaagaaaggatggccctggagggcatcggaattggctctggacaactcggtttctctaggaggtatggagaggactattcgcggtctcgtggttccccaagctcctacaactcaagctcgtcctctccgaggtatacttctgacctggaacaagccagaccccagacctctggagaggaggagctccaactgcagctcgctctagcgatgagccgggaggaagctgaaaaagaagtcaggagttggcaaggtgatggcagccctatggccaatggcgctggcgcggtggtccatcaccagagggatagggagcctgaaagggaagagaggaaagaagaggagaaactgaagacaagtcagtccagtatactggaccttgcggatatcttcgtgccagccttggccccccctagtacccattgctccgcggatccctgggatatcccaggattccggcccaacacagaagcctccggaagttcatggggcccctctgccgatccctggtctccaataccctccggcacagtactgagtaggtcgcagccctgggacctgacccctatgttgtcgtcatctgagccttgggggcggacacctgtacttcctgccggcccccccaccactgatccttgggccctcaactcaccccaccacaaattacctagtaccggtgccgacccttggggggctagcctagaaaccagcgatacaccgggaggggcttcaacatttgatccttttgctaaacctccggaatcgacagagaccaaggagggacttgagcaggctctaccctcaggtaaaccatcttctccagtagagttggaccttttcggcgatccatcgccttcctcaaaacagaacggcaccaaggagcccgatgccttggatttaggaatcctgggtgaggccttgacccagccatctaaggaggcacgagcctgcaggactccagagtcctttcttgggccctctgcaagcagtctcgtgaatttagattctctggtgaaggctccacaggtggcaaagactaggaacccctttttgactggcttgtcggcccccagtccaaccaacccgtttggcgccggggaaccgggaaggcccactctgaatcaaatgagaacaggttctccagccctagggctggcaggggggcctgtgggcgcccccttggggtccatgacgtattccgcaagcctgcccctaccactgtccagcgtgccggctggactgaccctgcccgcaagcgtgtccgttttcccccaagccggcgcctttgcccctcagcctctgctccccacaccttcttcagctggtccgcgcccgcctcctccccagactgggactaatccgtttctgtag

SEQ ID NO: 186756 - DNA, 753 bp, Artificial Sequence
  Description of Artificial Sequence: Synthetic coding sequence
atgggcatgctgtggcggcggctgaacgacagcggcaagaactggagacatgtgtacaaagccctcacgttattagactatctgctgaagacaggtagtgagagggtggctcaccagtgcagagagaacctctacacgattcagactctaaaagatttccagtacatcgatagggatggcaaagatcagggagtgaacgtaagagaaaaggtgaagcaggtaatggccctcctaaaggacgaagagcgactgaggcaggaacgtacacatgccctcaagaccaaggagagaatggcactggagggcatagggataggctctggccagctcggtttctcgaggaggtacggggaggattattcccggtcgcgcggtagcccttccagctacaactctagttcctctagcccacggtatacctcggatctcgaacaagcgagaccccagacctccggagaggaggagctacaattgcaacttgccttagctatgtctagagaggaagccgagaaggaggtgcgatcgtggcagggggatgggtctcccatggcgaacggcgcgggcgctgttgtgcaccatcagcgcgatcgggaacctgagagggaagaaaggaaggaagaggagaaactgaaaacctcacaggtgctcggcaggactcaacggcccgtggacccacccggcggcctgttgcaaactcccggcctgaggagcccgcaagagccgagctgccctgaggcatccccaggaatttag

SEQ ID NO: 186757 - DNA, 429 bp, Artificial Sequence
  Description of Artificial Sequence: Synthetic coding sequence
atgagcctgctgcccgtgccctacaccgaggccgccagcctgagcaccggcagtacggtcaccataaaaggacgccctctggcttgtttccttaacgagccttatctgcaagtagacttccacacggagatgaaagaagagtctgacatagtgtttcatttccaggtgtgttttgggcgtcgcgttgtgatgaactctcgcgagtacggagcctggaaacagcaggttgagagcaagaatatgccattccaggacgggcaggagttcgagctttccatatccgttcttcccgacaagtatcaggtcatggtaaatggacagtcatcctatacctttgatcatcgaattaaacccgaggccgtgaaaatggtgcaggtgtggcgggacatcagtctgactaaattcaatgtgtcctatctgaagcgatag

SEQ ID NO: 186758 - DNA, 828 bp, Artificial Sequence
  Description of Artificial Sequence: Synthetic coding sequence
atgaacatgacccaggcccgggtgctggtggccgccgtggtgggcctggtggccgttctactctatgccagcatccacaaaatcgaggagggacaccttgccgtatattatcgaggtggcgccctcttaacttcacccagcgggccaggttaccatattatgctacccttcatcacgacattcagatcagtgcagaccacgctgcagactgatgaggtaaaaaatgtcccttgtggaactagtgggggtgttatgatctacatagaccgcattgaagtggtgaatatgttggccccgtacgcggtgttcgacatcgtcagaaattacacagctgattacgacaagacactcatattcaataagatccatcacgagttgaatcaattctgttccgcccatactttgcaggaggtctatattgaattgttcgatcaaatcgatgagaacttgaaacaagcgcttcagaaggatctcaaccttatggcccctgggctgaccatccaggcagtcagggtcacaaagcccaagatcccggaagccatacggcgaaactttgaactcatggaagccgaaaagactaaactactgatcgcagcccaaaagcaaaaagtcgttgagaaagaggccgagaccgagcgcaagaaagccgtcatcgaggccgagaagatcgctcaggtggccaaaatccgctttcagcagaaagtgatggaaaaggaaaccgaaaagcggatcagcgagattgaagatgcagctttcttggctagagagaaggcgaaagctgatgccgagtactatgctgctcacaaatacgcaacatctaataaatag

SEQ ID NO: 186759 - DNA, 699 bp, Artificial Sequence
  Description of Artificial Sequence: Synthetic coding sequence
atgatctacatcgaccggatcgaggtggtgaacatgctggccccctacgcagtatttgacatcgtgaggaattataccgccgattatgacaagacactgatcttcaataaaatccatcatgaactgaatcagttctgcagtgcacatactctccaggaagtctacattgagttgttcgatcaaatagacgaaaacctgaagcaggccctgcaaaaggacctcaacttgatggcacccggcctgacgatccaggctgtgagagtaactaagccaaaaatcccggaagcgatccgacgcaatttcgaactgatggaggcggagaaaaccaagttgcttattgccgcacagaagcaaaaggttgtggagaaggaggccgagacagagcggaagaaggcggtcatcgaagccgagaagattgctcaagtggcgaagattcggtttcagcagaaggttatggagaaggaaacagagaagcgaatctccgagatcgaagacgctgcgtttctggctcgcgaaaaggcaaaagccgatgctgaatactacgccgcccacaaatatgctacctctaataaacacaaactgacacctgagtatttagaactcaaaaaataccaggcaatcgcttctaattcaaaaatctattttgggtctaacattccaaatatgttctccatcagtcgctgtggcccaagaggttag

SEQ ID NO: 186760 - DNA, 1047 bp, Artificial Sequence
  Description of Artificial Sequence: Synthetic coding sequence
atgaacatgacccaggcccgggtgctggtggccgccgtggtgggcctagtggcggtactgttatatgcttctattcacaaaattgaagaaggacatctggcggtgtattaccgcggtggcgccctgttgacctccccaagcggccctgggtaccacattatgctgccattcattacaaccttcagatctgtgcagacaacattgcagaccgacgaggtaaagaacgtaccctgtggcacatctggcggggtgatgatctatattgatcggatcgaagtggtgaatatgttggctccatacgccgtgttcgatatagtgcgcaactatactgcggattacgataagacgcttatcttcaacaagatccaccacgaactcaaccaattctgttcagcgcatacacttcaggaggtctacatcgaactgttcgatcagatcgacgaaaacctgaaacaggctctgcaaaaggacctcaacctgatggcgccaggactgaccattcaggccgtgagagttacgaagccaaaaattcccgaggctatcaggcgcaacttcgaactgatggaagcagagaagacaaaactcctgatcgcagctcagaagcaaaaggtggttgagaaagaagccgagactgagcgcaaaaaagcagtgattgaggccgagaagattgcccaggtcgcaaaaatccggtttcagcagaaggtgatggaaaaggagacagaaaaacgcattagcgagattgaggatgccgccttcttggccagagaaaaggctaaggccgacgctgagtattatgcagcccacaaatatgctacatcaaacaaacacaaactgacacccgaatacctggaactgaaaaagtatcaggctatcgctagcaattccaaaatttacttcgggtccaatattccaaacatgttcgtcgacagttcctgtgcgctcaagtattctgacatcagaactgggcgcgagtcttcactcccatccaaggaggccctggaaccatcaggcgaaaacgtgatacagaataaagaatccacaggctag

SEQ ID NO: 186761 - DNA, 1047 bp, Artificial Sequence
  Description of Artificial Sequence: Synthetic coding sequence
atgaacatgacccaggcccgggtgctggtggccgccgtggtgggcctcgtggccgttcttctttatgcgtccattcataaaattgaggaaggacacctggccgtctattacagaggcggagcgctgcttacaagtccgtcgggcccagggtatcacataatgctcccttttattactaccttccggtccgtccagactacccttcagactgatgaggtaaagaacgtgccctgcggaaccagcggcggcgtcatgatttatattgaccgcattgaagtcgtcaatatgctggccccgtacgccgtctttgacattgtcagaaattataccgccgattatgacaaaacattaatcttcaacaaaatccatcacgagctgaaccagttctgctccgctcatactctgcaagaggtatacattgagctgtttgaccagatcgatgaaaatctcaaacaggctcttcagaaggatttaaatctgatggcaccagggttgacgattcaggcagtgagggtgacgaaacccaagatccctgaggccattaggaggaatttcgaattgatggaggccgaaaagaccaagttattaatcgcggcgcagaagcagaaagtggtggagaaagaggcggaaaccgagcgaaagaaagccgtgatcgaggccgagaagattgctcaagtggccaagatccgttttcagcagaaagttatggaaaaggaaaccgagaagcgaatcagtgagatagaagacgccgcctttctcgctcgggaaaaggccaaagccgatgccgagtattatgcagctcacaagtatgccacctccaataagcataagttaactcccgagtatttggaattaaaaaagtatcaggccattgcatctaacagtaagatctattttggaagtaatatccccaacatgttcgtcgactcctcttgcgcgttaaagtatagcgatatccgtacaggccgtgagtctagtctgccttccaaagaagccttggaaccaagtggcgagaatgtgatccagaacaaagagagcactggctag

SEQ ID NO: 186762 - DNA, 1020 bp, Artificial Sequence
  Description of Artificial Sequence: Synthetic coding sequence
atggcccagctgggcgccgtggtggccgtggccagcagcttcttctgtgcatccttattttctgctgtgcacaaaatcgaggaaggtcacatcggagtttattatagaggcggagctttgctgacaagtacctcagggccagggtttcacctaatgctaccattcattactagctacaagagcgtgcagaccactctgcaaaccgacgaagtgaagaacgtgccatgcgggacaagtggcggagtaatgatttattttgataggatcgaggtggtgaatttcctcgtgccgaatgccgtgtacgatattgtaaaaaattacaccgccgactacgacaaagctctgatatttaataaaattcaccacgagcttaatcaattttgctccgtccacaccttacaggaggtgtacatcgaattgttcgaccagatcgacgagaatcttaaattagcccttcaacaagacctcacctcaatggcccccgggctggtaatacaggcagtcagagtgactaaacccaacattccagaggcaataaggcgcaattatgagctgatggaaagcgaaaagacaaaattgctgatcgcagcccagaagcagaaagtagttgaaaaggaagcggagactgaaagaaaaaaagctctgatagaggcagaaaaagtcgctcaagtggcagaaatcacttacggccagaaagtgatggagaaggagaccgaaaaaaagatatccgagatagaagacgctgccttcttggcaagggagaaggctaaggccgatgccgagtgctacaccgccatgaagatcgcagaggcaaacaagcttaagcttactcccgagtacttgcagctcatgaagtataaggccattgcctctaactccaagatctactttggaaaagacatccccaatatgtttatggacagtgcaggttctgtgtctaaacagtttgaagggctggctgataagctatctttcggactagaggacgagccattagagacagcaacaaaggagaattag

SEQ ID NO: 186763 - DNA, 459 bp, Artificial Sequence
  Description of Artificial Sequence: Synthetic coding sequence
atggcccagctgggcgccgtggtggccgtggccagcagcttcttctgtgccagtctgttttcagctgtccataagatcgaggaaggccacattggggtctactaccgcggcggggctcttctgacttcaacttctggccctggctttcacctgatgctccccttcatcacaagctataagtctgtccagactaccctccaaacagacgaggtgaagaacgtcccctgtggtacaagcggtggtgtgatgatttacttcgaccggattgaggtggtcaacttcttggtacctaacgcggtgtacgatatcgtcaaaaactacactgccgactacgataaagccctgatcttcaataaaatccaccatgagcttaaccagttctgctcagttcacaccctccaggaggtgtacattgagttgttcggtctggaaaatgatttttctcaggaatcgagctag

SEQ ID NO: 186764 - DNA, 1020 bp, Artificial Sequence
  Description of Artificial Sequence: Synthetic coding sequence
atggcccagctgggcgccgtggtggccgtggccagcagcttcttctgtgcctcactgtttagcgctgtgcacaagattgaggagggccacatcggtgtgtactaccgcggcggtgcattattaaccagtactagcggcccagggttccaccttatgctgccctttattacctcttacaagagtgttcaaacaacgcttcagactgacgaggttaaaaacgtgccatgcggaacttctggaggcgtgatgatttattttgaccgaatcgaagttgtcaactttctcgtgcccaacgctgtctacgatatagtgaagaactatactgctgactacgacaaggccctgatcttcaataaaatccatcacgagctgaatcagttctgtagcgttcatacactgcaggaggtgtatatcgagttatttgaccagattgatgagaatttgaagctggctttacaacaggatctgacctcaatggcccccggcttagtgatacaggctgtgcgtgtgaccaaacccaatatcccggaagccattaggcggaattacgaattgatggagtctgaaaaaaccaaactactcatcgctgcccagaagcagaaggtggtagagaaagaggccgaaaccgagagaaaaaaggcactcatcgaagccgagaaggtggctcaggtggctgagattacttacggtcagaaggtcatggagaaagaaaccgaaaagaagatctccgaaatagaagatgcagcattcctcgccagggaaaaggctaaagctgacgcagagtgttataccgccatgaagatagccgaggcgaacaaattgaagttgaccccggaatatctccagctaatgaagtacaaggcaattgccagcaactcaaagatttactttggtaaggacataccgaacatgtttatggatagtgctggctcagtatcaaagcaattcgaaggcctagccgacaaactgtctttcggccttgaggatgaacccctcgaaaccgcaaccaaagaaaactag

SEQ ID NO: 186765 - DNA, 621 bp, Artificial Sequence
  Description of Artificial Sequence: Synthetic coding sequence
atggcccagctgggcgccgtggtggccgtggccagcagcttcttctgcgcctcccttttcagtgcggttcacaaaatcgaggagggacatatcggagtgtattatcgcgggggagccctactgacgtcgacctccggtcctggctttcatctgatgctgccttttatcacgtcctacaagtccgttcaaactacattacagacagacgaagttaagaacgttccatgtggaactagcggcggcgtcatgatttactttgatagaatcgaagtcgttaactttcttgttcctaacgccgtctacgacatagtcaagaattacaccgccgactacgacaaggccttgatatttaataaaatacatcacgagcttaaccagttttgttcagtgcacaccctacaggaagtgtatatagaattattcggtaaaaaggttagccccgagcatgcggtcctgaagcaaggaagctggaatccggcatctctgcattgccttaagcccggatgcttacagggagtaatggtcacttatgggcaggaaatgctgaaaaacttggtgctccgttcctggtcacaacggagctcatggaggatgttgattgcaatgcagcaggacccgtag

SEQ ID NO: 186766 - DNA, 459 bp, Artificial Sequence
  Description of Artificial Sequence: Synthetic coding sequence
atggcccagctgggcgccgtggtggccgtggccagcagcttcttctgtgcatctctgttcagcgctgttcataaaattgaagagggtcacatcggcgtgtactaccgaggaggcgcactgttgacatccacctctgggcctggctttcatctaatgttaccattcataaccagctacaagtccgtgcagacgacgttacagactgacgaagtaaaaaacgtcccctgtggcacatccggaggagttatgatctacttcgatcggatcgaagtcgttaattttttggttcccaacgcagtgtacgacatcgtgaagaattataccgctgactacgataaagcgctgatctttaataaaatccatcacgagctcaaccaattctgtagtgtccatacactgcaggaggtgtatatcgaactgtttgggctcgaaaatgacttttctcaggaaagtagttag

SEQ ID NO: 186767 - DNA, 4239 bp, Artificial Sequence
  Description of Artificial Sequence: Synthetic coding sequence
atgaccaccaagcggagcctgttcgtgcggctggtgccctgccggtgcctgaggggggaggaggagacggtaactactctggactattctcactgcagccttgaacaagtgcccaaggagattttcacatttgagaagacactggaagaactgtacctggatgccaaccagatcgaggaacttccaaaacaactgtttaactgccagagcctgcacaaactttccttgcccgacaatgacctgacaactctgcccgcaagcatcgccaatttgatcaacctgagggaattggacgtctccaagaacggaatccaggaattcccagaaaacatcaaaaactgcaaggtcctgaccatagtagaagcctctgtcaaccctatcagcaaactgccggatggcttctcacaacttttgaacttaactcagttgtacctgaatgacgcatttctagagttcctcccggctaattttggtagactgacaaaactccagatcttggagcttcgtgaaaaccagctgaagatgctcccaaagactatgaaccggctgacccagcttgaacgtctggaccttggtagcaacgaatttacagaagtgcccgaagtcctggagcaactttccggcctgaaagagttctggatggatgctaatcgtcttacgtttataccgggattcattgggtccctgaagcagttgacctatttggatgtgtcaaagaacaatatcgagatggtagaggagggaatatctacatgcgaaaacctgcaagatcttctgcttagctcaaatagtctgcaacaactgcctgaaaccattggttctttgaaaaatatcactactcttaaaatcgatgaaaaccagctcatgtatctgccggacagcattgggggtcttattagtgttgaagagttggactgcagtttcaatgaggtcgaggctttgccttcctcgattggccaacttacaaacttacggaccttcgcagcagatcacaattacctacaacaactcccacctgagattggttcttggaagaatatcactgtgttgtttctccacagtaataaattggaaacactgcctgaggaaatgggggacatgcagaagctgaaggtcatcaacctcagcgataatcgactgaaaaatctccccttttcattcacaaaactgcagcagctgactgctatgtggctaagtgataatcagtccaagcccctcatacctctccagaaagaaacagattcagaaacacagaagatggttctgactaattacatgttcccccagcagcctaggaccgaggacgttatgttcatctctgacaatgagtcattcaaccccagtttatgggaggagcagagaaaacaacgggcccaggtggccttcgagtgcgacgaggataaggacgaacgggaagcaccaccccgggagggcaatttgaagaggtaccccacaccctatcccgacgagctgaaaaacatggtcaaaaccgtacaaactatcgttcacagactgaaagacgaggagaccaacgaagacagtggcagggacctgaagccccacgaagatcagcaggacattaataaggatgtcggcgtcaagactagcgaaagcactaccacggtgaagtctaaggtagacgaaagggaaaaatacatgatcggtaacagcgtgcagaagatctctgagcccgaagctgagatctctccggggtcactgccagtgactgcgaacatgaaggcctctgaaaacctgaagcacattgtcaaccacgatgacgtgttcgaagagtcagaagaactgtctagcgatgaggaaatgaagatggcagaaatgcggccacccttaatcgagacttcgattaaccagcccaaggttgttgccctgtcgaataataagaaggacgatactaaggagactgattcactgagcgatgaggtaactcacaactcaaatcagaacaactcgaattgcagcagcccttcgcggatgtcggacagcgtgagtttaaatactgactccagccaagacacctctctgtgcagcccagtgaaacagactcacatcgacatcaattccaaaattcggcaggaggacgagaattttaactcattgctgcagaatggtgatattctgaacagtagtactgaagagaagttcaaagctcatgacaagaaagattttaacctacctgaatacgacctcaatgtggaagaaaggctcgtacttatcgagaagtcggtcgactcgacagcgactgcggatgatacccacaagttggaccacattaatatgaaccttaataaactcatcacgaacgatactttccagcccgaaattatggaaagatcaaagactcaggacattgtattgggcacttccttcctgtctataaactccaaagaagaaacggagcacctggagaacggtaacaaatacccaaatctcgagagcgtcaataaagtaaatggccactcggaggagacctctcagtctcccaaccggactgagcctcacgattccgactgtagcgtggatctggggatttctaagagcaccgaagacctatcccctcagaaatcgggccctgttggctctgtggtgaagtcgcacagtataactaatatggaaatcggcgggcttaaaatctatgacattctgtcagacaacggtccacagcagcctagcacaactgttaaaattacatcagctgtggacggcaaaaacattgttcggtcaaaaagtgctacgctgctctacgatcagccactgcaggtctttacgggatccagtagctcgtctgacctcatcagcggaaccaaagcgattttcaaattcgactctaaccataatccggaggaacctaacatcatccggggaccgactagcggaccacagtccgcccctcagatttacgggcctccacagtataatattcagtactccagtagtgctgcagtcaaggatacgctgtggcattctaagcagaaccctcagatagaccatgccagtttccctccgcagttacttccaaggtcagagtccactgagaaccaatcttacgctaaacactcagccaacatgaacttttccaaccataacaacgtcagagccaatacagcataccacctacatcagcggctggggcccgccagacacggcgaaatgtgggcgatttctccaaacgatcgtctgattcccgcggtgacgagaagcaccattcaaaggcagtcctcagtgtcctctaccgcctccgttaatttgggggatccagggtctacacgacgagctcagatacctgaaggcgactacctctcctaccgcgaatttcatagtgccggacgaaccccgcccatgatgcccggttcacagagacctctgtccgcccggacctattccatcgatggtcccaatgcgagtcgcccgcagtctgctaggcctagcatcaacgagataccagaacgcaccatgagtgtgtcagacttcaactactctcgcacaagcccttctaaacggccaaacgcgagagtaggctctgagcatagcctgctggaccctcctggaaaaagcaaggttccacgcgactggagagagcaggtcttgcgacacattgaggcaaagaagcttgaaaagaagcatccgcagactagctcctccggagacccctgtcaggacggaattttcattagtggacagcaaaattactcttcagcgactctgtcccacaaagacgtccctcccgactccctcatgaagatgcctttaagcaacggtcagatgggccaacccttgagaccccaggccaactacagccagattcaccaccctccacaggcatcggtggctcggcatcccagtcgggagcaactgattgactacctgatgttaaaagtcgcacaccaaccgccctacacccagccccactgcagcccacgccaggggcatgaactggccaagcaggagataagagtccgggtagaaaaggaccctgagctgggattcagtatttcaggtggcgttggaggacgagggaatccattccggccagatgatgatggcatcttcgtcacccgcgtgcagccagaggggcctgcctctaagctcctccagccaggcgataagattattcaagcaaatggctattcttttatcaatatcgaacacggacaggcggtgtctctactgaagactttccagaacacggtcgagttgatcatagtgcgcgaagtctcaagttag

SEQ ID NO: 186768 - DNA, 3909 bp, Artificial Sequence
  Description of Artificial Sequence: Synthetic coding sequence
atgaccaccaagcggagcctgttcgtgcggctggtgccctgccggtgcctccgaggcgaagaagaaaccgttaccacattggactattcccattgttcactcgagcaggtgcccaaagaaatcttcaccttcgagaagacactcgaggagctgtacctggatgccaaccagattgaggaactgccgaaacagcttttcaattgtcagagcctgcataaactgtcgctgccagataatgacctgactaccttgcccgcaagcattgccaacctgattaacctcagggagctcgacgtgagtaagaatgggattcaggaatttcctgagaatatcaagaactgcaaagtgctgacgattgtcgaggcttctgttaatccaatttcaaagctccccgacggtttcagccagcttttgaatttaacccagctctacttgaacgatgctttcctagaatttctgcctgccaatttcggacggctgaccaagctgcagattcttgaattaagggagaatcagctcaaaatgctgcctaaaactatgaatcggctgactcaactggaacgcttggatctgggaagcaacgaattcaccgaggtgcctgaggttctggaacagctaagtggattaaaagagttctggatggatgccaatcgcctgaccttcattcctgggttcattgggtcactgaagcagctgacctacttagacgtgtcaaaaaacaatatcgagatggtcgaggagggtatatccacttgtgagaaccttcaggatttactactcagctccaattccttacagcagttgcccgagactatcggctccctgaagaatatcaccacgctgaagatcgatgaaaaccagctcatgtaccttccggatagcatcggtggactaatatctgtagaggaactggattgctcctttaacgaggtggaggccttgccgagctcaatcgggcaactgaccaatctccgtacctttgctgcagatcataactacctgcagcagctgcctccagaaatcggctcctggaaaaacatcaccgtactctttttacactctaataagctggaaacgctccctgaagagatgggagatatgcagaagctgaaggtaatcaacttatctgataataggctcaagaacctgcccttctcttttacgaagctccaacagctgacagccatgtggctttcagataatcaaagtaagcccctgattcccctgcagaaggaaaccgattccgagactcagaagatggtccttaccaattacatgttcccacagcagccaagaaccgaggatgtgatgttcatttctgacaacgagagttttaatccgagcctttgggaggagcagaggaaacaacgtgctcaagttgcattcgaatgtgacgaggataaggatgaacgggaagcacctccccgagaggggaatttgaaacgctatccaacaccatatccggatgaattgaagaacatggttaagaccgtccagacaatcgtgcatcggctcaaagacgaagagaccaatgaggattcaggacgtgatctaaaaccacatgaggatcagcaggacatcaataaagacgtgggggtgaagaccagcgaaagtactacaacagtgaaatctaaagtggatgagagggaaaagtatatgattggtaattccgtgcagaagatctccgagccagaagcagagatcagccctggaagcctccctgtaactgccaacatgaaggcgtcggagaatctgaaacatatcgttaatcatgatgacgtttttgaagagtctgaggaactctctagtgacgaggaaatgaagatggcggagatgaggcctccactgattgagacaagcattaaccaacccaaggtggtcgccctctctaataacaaaaaggacgatacgaaggaaacagactctttatctgatgaagtcacacacaattctaaccagaataacagcaactgttcttcaccctctaggatgtctgactcagtgtcgctgaatactgacagtagccaggacactagcctttgcagccctgttaaacagacccacatcgacataaattctaagataaggcaggaagatgaaaattttaactctctccttcagaatggcgatattcttaattcttccactgaagagaagtttaaagcccacgataagaaggacttcaacctcccggagtacgacctgaacgtggaggaacggctggtcctcatagagaaatccgtggactctacagccaccgctgacgacacccataaactggaccatatcaacatgaaccttaacaaactgataactaatgacacctttcagcccgaaataatggaaaggagcaaaacgcaggacatcgtgctcggcaccagtttcctgtcgatcaatagcaaagaggaaaccgaacatttggagaatgggaacaagtacccgaatctggagtccgttaacaaggtcaatggccattcggaggagacatctcagtcccctaacagaacggaaccccacgattccgactgctccgtggacctggggatatcgaagagcaccgaggatctgtctcctcaaaaatcaggacccgtcggaagcgtggtgaagtctcattccatcactaatatggaaattggaggcttgaagatctacgatattctgagcgataacgggccacagcaacccagcactactgtaaagatcacttctgctgttgacggaaagaacatagtgagatcaaaaagcgccaccctgttgtatgatcagccattgcaggtcttcaccggtagttccagttcttcggacctgattagcgggactaaggccatatttaagttcgacagcaaccacaaccctgaggagcctaacattataagagggcctacttccggaccccagtctgctccacaaatctatggtccgcctcagtataatatccagtatagctcctccgcagctgtaaaagacacactatggcattctaagcagaatccacaaatcgatcacgccagcttcccaccccaacttctgcctcgaagtgaatcaacagagaaccagtcctatgccaaacattccgccaatatgaatttttcaaaccataacaacgtgcgcgccaatacagcataccacctgcaccagaggttaggcccagccaggcatggggagatgtgggcaatctcacctaacgacagattaatccctgccgtcacaagaagcacaatacagcgacaatcttctgtctccagcacagcgtcagtgaaccttggggatcctggatcgacgcgcagagcccaaattcccgagggtgattacttgtcttatagagagttccattctgccgggcgcacaccccccatgatgccagggtcacagcggccactcagcgctcgcacctatagcattgatggacccaacgctagtcgcccacagagcgctcgaccttccatcaacgagatacctgaaaggaccatgagtgtgagtgactttaactactctcgtacaagcccatccaagaggccaaacgccagagtaggctccgagcatagcttgctcgacccccccggcaagagtaaggtcccccgggattggcgggaacaggtactccgtcatatcgaggccaaaaagctcgaaaagattagggtgcgtgttgagaaagacccagaattgggattctcgatctccgggggagtgggtggacggggtaaccccttccgcccggacgacgatggaatcttcgtgacgcgcgtgcagcctgagggccctgccagtaagctgctccagcctggtgataagattatccaggccaatggatacagtttcattaatatcgaacatggccaggccgtaagtcttcttaaaacttttcaaaacactgtcgagttgataatcgtccgcgaagtgtcaagctag

SEQ ID NO: 186769 - DNA, 4023 bp, Artificial Sequence
  Description of Artificial Sequence: Synthetic coding sequence
atgaccaccaagcggagcctgttcgtgcggctggtgccctgccggtgtttacggggcgaggaagaaacagttacaaccctcgattatagtcactgctcactggagcaagtacctaaggagatattcacgtttgagaagaccttggaagaactgtaccttgatgccaatcagatcgaggagctgcccaagcagctgttcaattgccaatcactgcacaaactgtccctacctgacaatgatctgaccacattgcctgcctcaatcgccaacctgatcaaccttcgcgaactggatgtgagcaaaaatggtatacaagaattccccgagaacatcaagaattgcaaagtccttactatcgtcgaggcaagcgtcaaccccataagtaaattacccgacggattttctcagctgttaaatctaacccaattatatctgaacgatgcctttctcgagttcctcccagctaatttcggccggttgaccaagcttcagattctggagctgagggagaaccagttgaagatgctgcccaagactatgaatcgactcacccagttagagagattggatctgggcagcaacgagttcactgaagttcctgaagtgctcgaacaactgagcgggctgaaagagttttggatggacgctaacagactgacctttattcccggcttcattgggtccttaaagcagctgacctatcttgatgtatccaagaataatatagagatggtggaggagggaattagtacctgcgagaatctgcaggaccttttgttgagctccaatagcctgcagcagctaccagaaaccattggaagcctgaaaaatataacgactctgaagatagatgaaaaccaattgatgtatctgcccgacagcattggtgggttaatcagcgtggaggagctggactgcagttttaacgaagtggaggcactcccatcatcgattgggcagcttaccaatctacgcacgtttgccgcagaccacaattatctgcagcagctgccccccgaaatcggctcttggaagaatattaccgttttatttctgcattccaataagctggagactctccccgaagagatgggcgacatgcagaaattaaaggtaatcaacctgtcagacaatcggctcaaaaatttgcccttttcgttcactaagttacagcagctgacggcgatgtggctgtcagacaatcagagtaaacccctcatccccttacagaaggagactgacagtgaaacccagaaaatggtgctaacaaactatatgttcccgcagcaacctcgaactgaggacgttatgttcatctcagacaacgagtcttttaacccttccctgtgggaggagcaaagaaagcagcgcgcacaggtggcgtttgagtgtgacgaggacaaggacgagagggaggcccccccacgcgaaggcaatctcaagagatacccaacgccctatcctgatgaacttaaaaacatggtgaagactgtgcagactatcgtgcatcgcctgaaggacgaagagaccaacgaagactccgggcgggaccttaaaccccacgaggatcaacaagatattaacaaagacgtgggtgtgaagaccagtgaatccactaccaccgtgaaatctaaggtggacgaacgcgagaaatatatgatcggaaactctgttcaaaagatatcagagcccgaagctgagatctcccccggctcactccccgtcacagccaatatgaaggcttcagaaaatcttaaacatatagtcaatcatgatgacgtatttgaggaatccgaggagctgtccagcgacgaggaaatgaagatggccgagatgagaccacccttgatcgagaccagcatcaatcaaccaaaggtggtggccctctccaataataagaaagacgacacaaaggaaacagactcactgagtgacgaggtgacccacaatagcaaccagaataactcaaattgctctagcccaagtagaatgtctgactctgtatctctgaacaccgattctagccaggatacctctctttgtagccccgtcaagcaaacacacatagatattaactcaaagatccgccaggaggacgagaacttcaattctttactgcagaacggagatattttgaactcctcaaccgaggagaaattcaaggcacacgataaaaaagactttaacctacctgagtacgacctcaatgtggaggagaggttggtgctcatagagaaatctgtggattccaccgctaccgctgacgacacccataaactcgatcacattaacatgaacctaaacaaactcataaccaacgatactttccagcccgagatcatggagcggagcaaaacccaagatatcgtcctgggcacgtctttcctctccattaactccaaagaggaaactgagcatcttgaaaacgggaataaatatccgaatctggagagcgtcaacaaagtgaacgggcatagtgaggagacctcacagagccccaatcgcacagagccacacgactctgactgctccgtggatttgggcatctcgaaaagtaccgaagacctgagtccacagaagagtggccctgttggctccgtcgttaaatcccactctatcacgaacatggagatcgggggcttgaaaatctacgacatactttccgataatggcccacaacagccgtctaccacagtgaagatcacctctgcagttgacgggaaaaacatcgtgaggtccaagagtgccaccctgttgtatgaccaacccctgcaggtgtttactggctcaagttcatcctcggacctgatctctggcacaaaagctatttttaagtttgattcaaaccataatcctgaagagcccaacattataagggggcccactagtggcccacagtccgctccccagatctatggccctcctcagtataacatccaatactcttcctccgctgcagtgaaagacaccctctggcacagtaaacagaacccacaaatcgaccacgcctcttttccacctcagttgctgcccaggagcgagtcaaccgaaaaccaatcctacgccaaacattcggccaacatgaatttcagcaaccataataatgtccgcgcaaacacagcttaccatttgcaccagagactcggacctgcaagacacggggagatgtgggccataagcccaaacgacaggctcatcccagctgtcactaggtctaccattcaaaggcaatcctccgtatcatccacggcttccgttaacttaggtgaccccgggtctaccagacgggctcagattcccgagggagactacctgtcttatcgggagttccattctgcagggcggacacccccgatgatgccaggatcgcagaggccattgagtgctcgaacttacagtattgatggcccaaacgcatccagaccccaatccgcccgcccctctatcaacgagattcccgagaggaccatgtccgtctccgacttcaattactctcgtacaagcccctccaagcgcccgaacgccagggtgggctccgagcactctctactggaccctcccggtaagagtaaggttcccagggattggcgcgagcaggtgctgagacacatagaggctaagaagttggaaaagatgccactctctaacggacagatgggacagccgttaaggccccaggctaactactcgcagatacaccatccaccccaagcaagtgtcgctagacatccgtcccgtgagcaattaatcgattatctgatgctgaaagtggcccaccagccgccatacacccagccccattgttcacccagacaaggccatgaattggccaagcaagaggggatttttgttacccgcgtgcagcctgagggccccgcaagcaaactcctgcaacccggcgataagataatacaagctaacggctactcttttattaatatcgaacatggccaggctgtgagcctgttgaaaactttccagaacactgtcgagctgataatcgtaagagaagtgtccagttag

SEQ ID NO: 186770 - DNA, 4041 bp, Artificial Sequence
  Description of Artificial Sequence: Synthetic coding sequence
atgaccaccaagcggagcctgttcgtgcggctggtgccctgccggtgcctgcgtggggaagaggaaacagtaactactttggattatagtcattgttccctggaacaggttccgaaggagatctttaccttcgagaaaacactagaggaactctatctagatgccaaccagatcgaagagctgcctaagcagctgttcaactgtcagtccctgcacaagttaagccttccggataacgaccttactacgctgcccgcaagtatagcaaacctgattaacctgagggagctggacgtgagtaagaatggtattcaggagttcccagaaaacataaagaattgtaaggtgctgacaatcgttgaggccagtgtgaatcccatttctaagttgcctgatgggtttagtcaactgctcaatctcacacagctctaccttaatgacgcattcttggagttcctacctgcaaattttggtaggttgacgaagctgcagattctggaacttcgcgaaaaccagctgaagatgctgcccaaaaccatgaatagattaacccaactggagagactggatctgggttctaatgagttcacagaggtgcccgaggttctggaacaactgtccggcctgaaggagttctggatggacgcaaatcgcctcacctttattcctggctttatcggatcactgaagcaactcacctatctcgacgtgtcaaaaaataatattgaaatggtcgaggagggcatctctacatgcgaaaatctgcaagatctgttgctgagtagtaattctctgcagcagctaccggaaacgatcggaagcctgaagaacattacgactctgaagattgatgaaaaccagctgatgtacctcccggatagcattggcggactgatttccgtagaagagctggactgcagcttcaatgaggtagaggcactgccgagttctataggtcagcttaccaacttacggacattcgccgccgatcataactatcttcagcagctaccccctgaaatcggcagctggaaaaatatcacagtgttatttcttcattctaataaactagagacactgccagaggagatgggagacatgcagaagttgaaggtgattaaccttagcgacaacagacttaagaatctgcccttttcgtttactaaactgcagcagctgaccgccatgtggctgtccgataaccaaagtaaaccactgattccgctccaaaaagaaactgactcagaaacacagaagatggtgttgacgaattatatgttcccccagcagcctcgcaccgaggacgtgatgttcatctctgacaatgagagctttaaccctagtctatgggaagagcagagaaagcagcgtgcccaagtcgccttcgaatgcgacgaggataaggatgagagggaagcccccccaagggaaggtaatctgaagcgctaccctacaccctatccggacgagctgaaaaatatggtgaaaactgttcagactatcgtgcataggctgaaggatgaagagacaaacgaggattcagggcgcgacctaaaacctcatgaggatcagcaggacatcaataaggacgtgggcgtgaaaacttcagagtccacaacgacagtcaagagtaaggtggacgaaagagagaaatatatgattgggaattcagtgcaaaagatctctgagcccgaggcagaaatatcacctggaagtttgccagtgaccgcaaatatgaaggccagcgagaacctcaaacacatcgttaatcacgatgacgtgtttgaggagtctgaggaactgtcgtctgatgaggaaatgaaaatggcagaaatgcgccctccactgattgagactagcataaaccaacccaaggttgtggctctgagtaacaacaaaaaggacgataccaaagaaacggattcattgagtgatgaggtgacgcacaacagcaaccagaacaacagcaactgcagcagccctagtagaatgtctgattctgtctctctgaatacggactcctctcaggatacctcactttgctcccccgtcaaacagacccacatcgacatcaacagtaagatccggcaggaggatgaaaactttaactcgctgcttcagaatggcgatattctcaatagttctacagaggagaaattcaaagcccatgacaagaaggattttaacttacccgagtacgatctgaacgtcgaggagagactcgtattgattgagaagtctgtcgatagcacagccactgctgacgatacgcacaagcttgaccatatcaacatgaacttaaacaaactcataaccaacgataccttccagcccgaaattatggagaggtccaaaactcaagatattgtgctagggacatcgtttctgtctattaactcaaaagaagagacagaacatttagagaacggcaacaagtaccccaatctggagtcagtgaacaaggtaaacggccacagcgaagaaacttctcaatcgcctaatcggacagagccgcacgacagcgactgctccgtcgacctgggcatttcaaaaagcacagaagacctaagcccacaaaagtcgggccctgttggcagtgtcgtgaaaagccatagcatcacaaatatggagatcggtggcctgaaaatctacgatatcttgtcggacaatggtcctcagcagccctccacgaccgtgaaaatcacctcagcggtcgacgggaaaaacatcgttcggagcaagagtgcaaccttactgtacgaccagccattgcaagtatttactggctccagcagcagcagcgacctgatctccggtacaaaagccattttcaagttcgacagtaaccataacccagaggagccaaatattatacgcgggcccacttccggcccgcagtccgctcctcagatctacggcccccctcagtataatattcagtacagcagctccgccgccgtgaaagacaccctttggcatagcaagcagaacccccagatcgaccatgcttccttcccaccacagctgcttccacggagtgagtcgacagagaatcagtcttatgccaagcactctgctaatatgaatttctcaaaccataacaacgtgcgggcaaataccgcctaccacctccatcagcgcctgggcccagcgcgacacggtgagatgtgggccatttcccctaacgaccgccttattcccgccgtgacaagatccacaattcagcggcagagcagtgtctcaagtaccgcttccgttaacttgggtgaccctggatcaactcgccgagcccagattcctgaaggcgattatctttcctatagggagttccactctgccggaaggacgcccccaatgatgcctggctcacagagacccctctctgctagaacctatagcatagacggacccaacgcctcgaggcctcagtccgctaggccctccatcaatgagatccccgagcggacgatgagtgtgagtgacttcaactacagtcgcacgtcgccgtcaaaaagacctaacgctcgggtggggagcgaacatagcctcctggaccctccgggtaagagtaaagtgcccagagactggcgcgagcaggttctccgtcacatagaggccaaaaaactggaaaagatgccactgtctaacggccagatgggtcagccgctacgcccacaggccaactacagtcaaatacaccatccccctcaggcttctgtggcccggcacccctccagagagcaactgatagactatttaatgttgaaagtggcccaccagccaccttatactcaacctcactgtagccctaggcagggacatgagctggcaaagcaggaaatccgcgtgcgggttgagaaggaccctgagctgggcttttctataagcggaggtgtcggcgggcggggcaacccattcagacccgacgacgatgcaaatggatatagtttcatcaacatcgagcatggtcaagccgtgagcctcctcaaaacattccaaaacacagtggagctgattattgtgagagaagtatcttcttag

SEQ ID NO: 186771 - DNA, 4083 bp, Artificial Sequence
  Description of Artificial Sequence: Synthetic coding sequence
atgaccaccaagcggagcctgttcgtgcggctggtgccctgccggtgccttaggggcgaagaagaaacagtgacaactctggactattctcattgctccttagaacaggtgcctaaagagatttttacttttgagaaaaccctggaggagctgtatctagatgctaaccagattgaagaacttcccaaacaattgtttaactgtcagtccctgcataagctaagcctccctgacaacgaccttacgaccctgccggcttccattgccaacctcatcaacctgagagaattggatgtttccaaaaacgggatccaggaatttcccgaaaatataaaaaattgtaaggtgctaacaatcgtagaagcaagcgttaatccaatctcaaagctgcccgatgggttttctcagctgctcaacctgacccagctgtacctgaacgacgctttccttgaatttttacccgcgaattttggaaggctgactaagctccagatattggagcttagagagaatcagttaaagatgttacctaagactatgaatagactgactcagctcgagagattagacctgggctccaatgaatttacagaagttccagaggtgctggaacagctgtccggcctgaaggagttctggatggacgccaacaggctaacttttatacccggcttcattggctccctcaagcagctgacatacttagacgtgtctaagaataacatcgagatggtggaggagggtatctctacttgtgaaaatctgcaagacctcctcctcagctctaatagcctgcagcagctccctgagacaattggatccctcaagaacatcacaacacttaaaatcgacgaaaaccagctgatgtacctgcccgattccatcggtggcctcatctcagttgaggagctggattgctctttcaatgaagtcgaggccctcccgtcatcaatcggacagctcacaaacctcaggaccttcgctgcggaccacaattacctgcagcagctccctcccgagattggcagctggaagaacataactgtgctgttcttacattcaaataaactggagacattgcctgaagaaatgggcgacatgcagaaactcaaggtcattaatctgagcgataatagactcaaaaatctcccattttctttcacaaaactgcagcaactgacggccatgtggctcagcgacaaccagagcaagcccctcatccctctgcagaaagaaaccgactccgagacacaaaaaatggtgttgaccaattacatgtttcctcagcagccaaggactgaggacgtcatgttcatcagcgataatgaatcgtttaatccttctctctgggaggaacagaggaagcagagggctcaggtagcatttgagtgcgatgaagataaggatgaaagggaagcacctccacgggagggtaaccttaagcggtatcccacaccctatccggacgagctgaagaacatggtcaagactgtgcagaccatagtccatcgcctgaaagatgaggagaccaatgaggattccggccgtgatctgaaaccccatgaagatcagcaagacattaataaggacgtcggcgtgaaaacttctgagtcaaccaccactgttaagagtaaagttgacgagagggagaagtacatgataggtaacagcgttcagaagatttcggagccggaggcggagatcagtcccggtagtctccccgtgactgctaacatgaaagccagtgagaatctgaagcacatcgtgaatcacgatgatgtcttcgaagagagcgaggagttgtcgtccgacgaggaaatgaagatggcagagatgcgaccccccctaattgaaaccagtataaatcagcctaaggtagtggccctgtctaacaataagaaagacgacactaaagagactgattccctcagtgatgaggttacacacaattctaaccaaaataatagcaattgttcctcgcctagcagaatgagcgacagcgtttctcttaacaccgatagttctcaggatactagcctttgctcaccggttaagcaaacccacatcgatattaatagcaaaattcggcaagaggacgaaaattttaattctttgctgcaaaatggcgatattttgaatagctctacagaagagaaattcaaggcacacgataaaaaggatttcaacctcccggagtatgatctaaacgtagaagaacgattagtcctgattgagaaaagtgtggatagtacagccactgctgacgatacccataaactcgaccatattaacatgaacctgaataagctgatcacgaacgatacattccagccagagataatggagcggtcaaagactcaggacatcgttctgggtactagcttcctcagcatcaacagcaaagaggaaacggaacacctggaaaacggtaacaaataccctaacctggagtcagtgaacaaggtgaacggacatagtgaggagactagccagtcgcccaaccgaacagaaccccacgactctgactgctccgtggacctgggaatcagcaaatcgacagaggatctctccccccaaaagtcaggtccagtaggctccgtggtgaaaagccactctattaccaatatggaaattggtggtctgaagatttatgatatactgtctgacaacggcccccagcagccttctactaccgtcaaaatcaccagcgccgtggatggaaagaatattgtgcgcagcaaaagcgcaacccttctatacgatcagccgctccaggtgttcacaggctccagttcctccagtgatctgattagcgggaccaaggctatttttaaattcgactcaaaccacaatccagaagagccaaatataatcagagggcctacctcagggcctcagtcagcccctcaaatatacgggccacctcagtataacatccagtatagcagcagtgccgcagtaaaggatactctctggcacagtaagcagaacccccaaatcgatcacgcctccttccctccccaacttttaccccgaagcgaaagtaccgaaaatcaatcttacgccaaacacagcgccaacatgaacttctcaaaccataacaatgtccgtgccaatactgcctaccatctacatcagaggctgggaccggcaagacacggggagatgtgggctattagtcccaatgacaggctgatccccgccgtaacacgctccactattcaaaggcaatcttctgtgagctcaacagcctccgttaacctcggtgatcctggtagtacccgcagggcacagatccccgaaggagactacctcagctatcgggagtttcattccgccgggcgcacaccacccatgatgcctggtagccagagaccactgagcgctaggacctattcaattgatgggccaaatgccagtagaccccagtccgcacgcccaagcataaacgagattcctgagcggaccatgagtgtctcagactttaattactcccggactagcccctcgaaacgccctaacgctagggtgggtagcgagcatagcctgctggaccccccagggaagtccaaggtgccaagggactggcgtgaacaagtactgagacacatcgaagcgaagaagctggaaaagatgcccctgtccaacggacagatggggcaacccttaaggccccaagctagcgtcgccagacacccatctagggagcagctgatcgactatctgatgctcaaggtagcccaccagcccccctatactcagcctcattgctctccacggcagggccatgagttggctaagcaggagatccgtgtgcgcgtggagaaggaccccgagctggggttttccatcagtggaggcgtcggtggcaggggaaaccctttccgtcctgacgacgacggcatttttgtcactcgcgtgcaacccgagggacccgctagcaagcttctgcagcctggcgataagatcatccaggccaatggctatagcttcataaacattgagcatgggcaggctgtgagtcttctaaaaacttttcaaaatacggttgagctaattatcgtgagagaagtcagctcttag

SEQ ID NO: 186772 - DNA, 4116 bp, Artificial Sequence
  Description of Artificial Sequence: Synthetic coding sequence
atgaccaccaagcggagcctgttcgtgcggctggtgccctgccggtgtctcagaggagaggaagaaacagtaaccaccctggattatagccactgttccttggaacaagtgccaaaagagatcttcaccttcgagaaaactctcgaagaactgtacttggatgcaaatcaaatagaagagctcccgaaacagctatttaattgtcagtcactacacaaactatccctccctgacaacgacctgacaacacttcccgcctctattgccaacctcatcaacctacgagagctggacgtatcaaaaaacggaatccaggagtttccggagaatattaaaaactgtaaagtgctaacaatcgtagaagcctccgtgaaccccatctccaaactcccagatggtttctctcagttgcttaatctgacccagctgtatcttaacgatgcatttttagagttcttgcccgcaaattttggtagactcaccaaactccagatcctcgaattgagggaaaatcagctgaaaatgcttcctaaaaccatgaatagactgacccagctcgagcgactcgatcttgggagcaacgagttcactgaagtgccagaggtgctcgaacaactcagcggactgaaagaattctggatggatgccaatcgtctcactttcatccctggcttcatcggaagtctgaaacaactaacatacctggacgtttcaaaaaacaacatcgaaatggtcgaggaaggcatttcaacgtgtgagaatctccaggacctgctgctgtcctcaaatagcctgcagcagctgccagagaccatcggatcactaaagaacatcactacgcttaaaattgacgagaatcagctcatgtatctccctgactctatcggtggacttatctctgtcgaggagttggattgtagttttaacgaagtagaagcgctcccaagctcgattgggcagctcactaacctgcgcacatttgccgccgatcacaattatctgcagcaactcccccctgagatcggctcttggaaaaacatcaccgtcctgtttcttcactccaataagcttgaaaccctgccagaagaaatgggcgatatgcagaagctgaaggtcattaacctgagcgacaaccgacttaagaatttacctttttcctttaccaaactgcaacagttgaccgcaatgtggctgtccgacaaccagagcaagccgctgatcccactccaaaaggagactgattccgaaacccagaagatggtgctgacaaactatatgtttccacagcagcccagaaccgaggatgtgatgttcatctccgataacgaatcctttaatccaagcctgtgggaggagcaacgtaaacagcgtgcccaggttgcttttgaatgtgacgaagataaggatgagcgcgaagctccaccccgggaggggaacttaaagcgatacccaaccccttaccccgacgagttgaagaatatggttaagacagtgcagacgatcgtccataggcttaaggatgaggagactaatgaggacagtggacgagacttgaaacctcatgaagatcagcaggatataaacaaggacgtgggtgtcaaaactagtgagagcaccactacagttaagtctaaagtggatgaaagggagaaatatatgatcgggaactctgtacaaaagatctctgaacccgaggcggagatttctcctggaagcctaccggtcacagctaatatgaaggccagcgaaaatctaaaacatatagtgaaccatgatgacgtattcgaggaatctgaagagctgagcagtgacgaggagatgaaaatggccgagatgcggccaccactgatcgaaacctcaattaatcagccaaaagtcgtcgccttgtctaataacaagaaggatgacacgaaagaaaccgacagtctcagtgatgaagtgactcacaactcaaatcagaataattccaactgttcaagcccctcccgcatgagtgactctgtttcactgaatacagattcaagtcaagatacctctctctgtagtcctgttaagcagactcacattgacatcaattcaaagatacgccaggaggacgaaaatttcaattctctgctgcagaacggcgatattctgaactccagcactgaggagaagtttaaggctcatgacaaaaaggacttcaaccttcccgagtacgacctgaacgttgaggagcggctggtcctgatcgagaagtccgttgactcaaccgcaaccgctgatgatactcacaaactggatcacatcaacatgaatctgaacaagcttattactaatgacactttccagccggagatcatggagcgcagcaaaactcaggatatcgttctcggcacatccttcttgtccataaactctaaagaggaaacagaacatttggagaatggcaacaaatacccaaacctggagtcagttaacaaggtcaacggccacagcgaggaaacatctcagagcccgaaccgcaccgaacctcatgactctgactgttcagtcgaccttggaatctctaaaagcaccgaggatctgtccccgcagaagtcgggacccgtaggcagtgtagtcaagtcgcactctattaccaatatggagattggcggccttaagatctatgatatactgtctgacaatggcccccagcagccctcgacgacggtgaagattactagcgctgtggatggtaagaatatcgtccgctccaagagtgcgactctactttacgaccagccattacaagtctttaccgggtcaagtagtagtagcgacctgatatctgggacgaaggcaatcttcaagttcgatagcaatcacaaccccgaggagcctaacattattaggggaccaacctctgggcctcagagcgcaccacagatctacgggccccctcagtacaacattcagtactctagttccgccgccgtgaaagatacgctgtggcacagcaagcaaaatccccagatagaccacgctagctttcccccgcaactgctgcctagaagtgagagcaccgagaatcagtcttatgccaagcacagcgctaacatgaatttttctaaccataacaatgttcgcgctaataccgcctaccatctacatcagcgactgggaccagcccgacatggtgagatgtgggccatcagccctaacgatagactgattccggccgtgacaagatcaaccattcagcgacagtcatcagtctcatccaccgcttcagtcaatctcggggatccggggagcaccaggcgtgcccagattccagagggagactacttaagctaccgggagttccacagtgcaggacgaacgccaccaatgatgcctggatctcaacgacctcttagcgctaggacgtactccatcgacgggcctaatgcatccaggcctcagtctgctcgtccaagcattaatgagataccagagagaacgatgtcagtgagcgactttaactactcacggacatctccatccaagcggcccaacgcacgtgtcggtagtgagcacagtttgttggatccaccaggaaagagtaaagtcccacgtgactggcgtgagcaggtcttgaggcacattgaagctaaaaagttagagaaaatgccactatccaatgggcagatgggccagccactccgcccccaggccaattattcccagattcaccatccgccccaagcctctgtggcacggcatccgagccgtgaacaactgattgactatctgatgctgaaagtggctcatcagccaccatatacacagccacattgttcacctaggcaggggcacgaactagcgaaacaagaaattagggtgcgcgtcgagaaggaccccgagctggggttttcaatcagtggaggtgtcggggggcggggaaacccatttcggccagacgatgatggaattttcgtcactagagttcagcccgaagggcccgcgagcaaactcctacagcccggggacaagattattcaagctaacggatacagctttattaatattgaacacgggcaggcggtatcccttttgaagaccttccaaaacacagtggagctcatcattgttcgcgaggtgagtagttag

SEQ ID NO: 186773 - DNA, 3909 bp, Artificial Sequence
  Description of Artificial Sequence: Synthetic coding sequence
atgaccaccaagcggagcctgttcgtgcggctggtgccctgccggtgcctgcggggtgaggaggagaccgtaaccacactggactatagtcattgctccctcgaacaagtgcctaaggaaatttttacctttgagaaaaccttagaggagttatacctagacgcaaaccaaattgaagagcttccaaagcaactcttcaactgccagtccctccacaaactgagcctgccagataatgacctgacaaccttgcctgcttccattgccaaccttattaacctccgcgagctggatgtgtccaagaacggcatccaggagttccccgaaaatataaaaaactgtaaggtcctgactatcgtagaggcatccgtcaatcctatctccaagctccccgacggcttctcccagctcttgaacctcacccagctgtacctaaacgacgcatttttggagttcctgccggccaacttcggaaggcttactaagctgcagatcctagagctgcgtgaaaatcagcttaaaatgctgcccaagaccatgaaccgcctcactcagctggagcggctggacctaggatcaaacgaattcaccgaggtgccggaagttctggaacagctcagtggcctgaaagagttttggatggacgcaaatcggctgacgtttattcctggctttatcggatcccttaaacagttgacatacctcgatgtctctaagaataacatcgaaatggttgaggagggcatatccacatgcgagaacctgcaggatcttctgttatcgtccaactccctgcagcagctacccgagaccatcggatccctgaagaacatcactactctgaagatcgacgagaatcagctgatgtatttgccagacagtattggaggtctcatcagcgtcgaagagctagattgttcctttaacgaagttgaagccctgccctcaagcattggccagctcacaaatctgcggaccttcgcagcagaccataattatctgcaacagctccctcctgagatcggtagttggaagaatataacggtgctcttcctgcactctaacaaactggaaaccctgcctgaggagatgggggacatgcagaagctcaaagtgattaacctaagtgacaatcggctcaagaatctgcctttctctttcaccaaactgcagcagttgacagcaatgtggttatcagataaccagtccaagccactaattcccctgcaaaaggagacagactccgaaactcagaagatggttctaactaactatatgttcccccaacagccaaggaccgaggacgtcatgtttatctccgacaacgaaagtttcaacccctctctgtgggaggagcagcggaagcaaagagcgcaggttgcattcgaatgtgacgaagacaaggatgagagagaggcgcctccgagagaggggaacctcaaacgctacccaaccccctatccagatgaactcaaaaacatggtgaaaacggtccagaccatagtgcaccgtctaaaggatgaagaaacaaatgaagacagcggccgggacttaaagccacacgaggatcagcaggatattaataaagatgtgggtgtgaagacgtctgagtccacaaccaccgtgaagtcaaaggttgacgaacgagaaaaatacatgatagggaatagtgttcagaagatcagtgaacctgaggcggagatttctccggggtccttgcctgtaaccgccaacatgaaagcgagcgaaaatttgaagcacatcgtaaatcacgacgacgtgttcgaagaatctgaggagctcagtagtgatgaagagatgaaaatggctgagatgcgccctccgctgattgaaacaagcattaatcagcctaaggttgtggccctatcgaataataagaaggatgatacaaaagaaacagattcactctccgacgaggtaactcacaattccaatcagaacaattccaactgttcaagcccttcacggatgagtgattctgttagccttaacacagattcatcgcaggatacctctctttgtagtcccgttaagcagacccacatcgacattaatagtaagattcgtcaagaggacgagaatttcaatagcttgctgcagaacggtgatatcttaaatagcagtacggaggagaaattcaaggctcacgataaaaaggattttaacctgcccgaatatgatttgaatgtcgaggaaaggctggtgctgatcgaaaagtctgtggatagcacagcaacagccgatgacactcacaagttggaccacataaacatgaacttgaataaactgataacgaacgatactttccagccagaaataatggagaggagcaagacacaggacatagttcttggtaccagtttcctgtccatcaattccaaggaggagaccgagcacctggaaaacggaaataagtatccaaacctggagagcgtaaacaaggtgaacggtcacagcgaggaaaccagccagtcacctaataggaccgaaccgcatgatagcgactgctcagttgacctggggatatcaaaatctacagaggatcttagccctcagaaatcaggaccggtgggatcagtcgtgaaaagccattctatcacaaatatggaaatcggggggctgaaaatttacgacatactctctgataatgggccacagcagccttccaccacggtcaagattacaagtgcagtagacggaaagaacatagtccgcagcaagtctgccactttgctgtacgatcagccactgcaagtgttcacgggaagctcatcatcttctgatctaatctctggtaccaaggctatcttcaaattcgactccaaccacaatccagaagagccgaacatcatccgcggacccacatccggacctcagtcagcccctcagatctacgggcctccacagtacaatatccagtattcctcctcggctgccgtaaaggacaccctgtggcactctaaacagaatccgcaaattgatcatgcatcctttcctccccagctcctcccccgatcagagtcaactgaaaaccagtcctatgcgaagcactcggccaacatgaatttctcaaatcacaataatgtccgagccaatacagcctaccacctccaccaacggttggggcccgcgcgtcatggtgagatgtgggccatttctcccaatgatagactgattcccgctgtcacacgatccacaatacagcgacagagctcggtcagcagtactgcatctgtaaatcttggggatcccggctcaacccgacgagcccagatccccgagggtgattatctgagctaccgggagttccactcagccggcaggaccccacctatgatgcctggctcccagcgacccctcagtgctcggacatacagtatcgacggccctaacgcaagtagaccacaatccgcgagaccctcaattaacgagatccccgaaagaactatgagcgtctccgatttcaactactccagaaccagtccttccaagcgacccaacgctcgcgtgggctctgagcattccctgctggacccaccgggcaagtctaaagtgcctcgggactggagagagcaggtactccgtcacatagaggcaaagaagctcgagaaaattagggtgagagtggagaaagatcctgagttggggtttagcattagtgggggtgtgggcggacgaggcaatccgtttaggccagatgacgacggcatcttcgtgacacgcgtccaacctgaagggcccgcgagtaaattgcttcagccgggtgataaaataatacaggcgaacgggtactcttttatcaacatagaacacggccaggccgtgtctctgctgaagacgttccagaacacggtggaactgatcatcgtgcgggaggttagttcttag

SEQ ID NO: 186774 - DNA, 4260 bp, Artificial Sequence
  Description of Artificial Sequence: Synthetic coding sequence
atgaccaccaagcggagcctgttcgtgcggctggtgccctgccggtgcctgcggggcgaagaggaaacggtgaccacactggactactctcactgttctttggagcaggttcccaaagagatatttaccttcgagaaaacattggaagagctgtacctcgatgccaaccaaatagaagagttgcccaaacagctgtttaattgccagtctttgcacaaactatccttgccagataatgacctgaccacattgcctgcctcaattgccaatctcatcaacctccgagagcttgacgtgtccaagaatggaatccaagagtttcccgagaacattaaaaattgtaaagtacttacaattgtggaagcctcggtaaatccaatcagcaagctcccagatggctttagccagctgttgaatctgactcagttgtatctgaatgacgccttcctggagttcttgcctgctaattttggcaggcttacaaagctgcagatcctggaactgcgggaaaatcagctcaaaatgctgcccaaaacaatgaacagacttacccagcttgagcgcctggatctggggagcaacgagttcacagaagttccagaagtcttggagcagctctccggcctcaaggagttctggatggatgcgaacaggttgacgtttattccgggtttcataggttcactaaaacagctgacctatctggatgtaagcaagaacaacattgagatggtcgaagaggggattagtacctgcgaaaacctccaagacctgttgctgtcatccaacagccttcagcagctgcccgaaacaatcggaagcttgaaaaacattacaactttgaagattgacgagaaccaactaatgtacctccctgattcaatcggtggtttgatttccgtagaggagctggactgctcgtttaatgaggtggaagcccttcctagctcaatcggacagcttaccaatcttagaaccttcgccgcagatcataactacttacaacagctacctcctgaaatcggtagttggaagaacatcacggttctctttctgcacagtaacaaattggagactcttccggaggagatgggtgacatgcaaaagcttaaagtcatcaacttgagcgacaataggctcaagaatctgccatttagtttcacaaagctccaacagctgactgctatgtggctgagcgacaaccagagcaaacctctgattcccttgcagaaggagacagacagtgagacacaaaaaatggttctgactaattacatgtttccccagcagccccggacagaagacgtgatgttcataagtgataatgagtctttcaacccttctctgtgggaggaacagagaaagcaacgcgcgcaggtcgcctttgagtgcgatgaggataaagatgaacgcgaagctccccctagagagggtaatcttaagcgttaccctacaccgtaccctgacgagctcaaaaatatggtgaaaacggtgcagaccatcgtgcataggctcaaagatgaggaaaccaatgaggattcgggacgcgatctgaaacctcatgaagatcagcaggacataaacaaagatgtgggagttaagacatctgagtctactactacagtaaagtctaaggttgatgagcgggaaaagtacatgatcggtaactcagttcaaaagatcagcgaaccggaggcggaaatcagccccgggtcccttcccgtgacagctaatatgaaggccagcgagaatctcaagcatatcgttaatcacgatgacgtgtttgaggagagtgaagaactgagtagtgatgaggagatgaaaatggcggagatgaggccaccactcattgagacaagcattaaccagccaaaggtggtcgcgctgtcaaataacaagaaggacgatactaaggaaaccgattcgctaagcgatgaagtgactcacaatagcaatcagaacaattcaaattgctcatccccatccagaatgtccgactccgtatctctaaacaccgattctagccaggacacaagcctgtgcagcccagtgaaacagactcatattgacatcaattccaagattaggcaagaagatgaaaattttaactcccttctgcagaatggtgacatacttaacagctccaccgaagaaaagtttaaagcccatgacaaaaaggactttaacctgcccgaatacgatttgaacgtagaggagcggttagtacttatcgagaagtcagtagatagtacagccacggcagacgatacacacaagctcgaccacatcaacatgaatctgaacaagttgattacaaatgatacattccagccagaaattatggaacgaagcaaaactcaggacatcgtattggggacaagctttctgagtattaatagcaaagaagagactgagcatctggagaatggaaataagtatccgaatttagagtctgtgaacaaggtgaatgggcactcagaagaaacgagccagtctccgaaccgtacggagccacacgattccgactgctcagtggacttagggatctccaagtccacagaagacttgagcccacagaagagcggacccgttggcagcgttgtgaagagtcactctattactaatatggagattggaggacttaaaatctatgacatcctgtcagacaatggtcctcagcagccttctacaacagtgaaaatcacatctgccgtagacggcaagaacatcgtccgctctaagagtgccacccttttatacgaccagccccttcaggtgttcacgggatcctcatcctccagcgatctcattagtgggacaaaggcgatcttcaaatttgatagcaaccataaccccgaggagcctaatataatccgaggcccaactagcggcccccagtccgctccgcagatctatggtcccccccagtataacattcagtacagttcttcagcggccgtgaaggataccttatggcactccaaacagaacccccagatagatcacgcctccttccctcctcagctgctgcctcgcagcgaatctactgagaaccagagttacgcaaagcacagcgcgaatatgaacttcagcaaccataacaacgtaagggctaacaccgcataccacctacaccagagactgggccccgcaaggcacggtgagatgtgggctattagtcccaatgatcggctgatacctgccgtgaccagatccactatccagcggcagagtagtgtatcctccacagcatcagtgaacctgggcgacccgggcagtacccggagagcccagattcctgagggcgactacttaagttacagggaatttcatagcgctggccgtacaccacctatgatgcctggatcacagagaccactgtcagcacgaacttatagcatcgacggtccaaacgcctcccgcccacaatcggcaagacccagcatcaacgagatccccgagagaactatgtcagtgtccgacttcaactatagccggacgtccccctctaaacgacctaacgcaagagtggggagcgagcactcactgcttgatccccctggcaagtcaaaagtgccacgggactggcgggagcaggtcttgaggcacatagaggcgaaaaagctcgagaaatctatgctgtcccgcagttttaatagcaactttaccactgtttccagctttcactgcggctcttctagggacctgcacggaagtcagggcagcctggccctcagtgtggccgatcgccgagggagcggcggccacatctttcggatgcctttgagtaatggacagatgggccagcctttacgcccccaggctaactattcccagattcatcatccacctcaggccagcgtggcgcgccatcctagtcgggaacagttgatcgattacctcatgctcaaggtagctcaccaacctccgtatacacagccccactgctcaccgcgacagggccacgagctcgccaagcaagaaattagggtgagagtagaaaaggacccggaactgggctttagcatctcaggaggagttggggggagaggaaatccatttcgcccagacgacgacggtattttcgtcacccgtgtccagccagaaggcccggcttccaagctgctacaacctggcgacaaaattatccaggcaaatggttattccttcattaatattgaacacggacaggccgtgagtttactgaagacctttcaaaacactgtcgagcttatcatcgtgcgcgaggtaagcagttag

SEQ ID NO: 186775 - DNA, 1158 bp, Artificial Sequence
  Description of Artificial Sequence: Synthetic coding sequence
atgaaggaggaggagggcttccccgaggacgaggccaccgagagcgaaaccctgagtctggttaaggaactcgacgccttccccaaagtaccagagtcctatgtagaaaccagtgcctcggggggaaccgtgtctcttatcgcctttacaaccatggccctcctgaccatcatggagttctccgtctatcaagacacctggatgaaatacgagtatgaggtggacaaggatttcagctccaagttgcgcatcaatatcgacatcaccgttgcaatgaagtgccagtacgtgggcgcggacgtcctggatttagctgagacaatggtggctagcgctgacgggttggtctacgagcccacggtttttgacttgagcccccagcaaaaggaatggcagaggatgttacagctgatccagtcccgactgcaggaagagcattccctccaggacgtcattttcaaaagcgccttcaaatctaccagcaccgccctgcctccgagagaagacgacagctcacagtcaccaaacgcatgccgcattcacggtcacctgtacgtgaacaaggtggcagggaactttcatatcacggtgggaaaggcaatcccccatccaagggggcacgctcacctagctgccctggtgaaccatgaaagctataacttctcccaccggattgatcacttgtcctttggggagctcgtgcctgctatcatcaatcccctggatggcaccgaaaaaattgcaatcgatcataatcagatgttccaatatttcattacggtcgtgcccacgaaattgcatacctacaaaatatctgcggatacgcatcaattttccgtcaccgagcgggagaggattattaatcacgccgccgggtcccacggcgtgagcggtatttttatgaagtatgatctcagctcactgatggtcaccgtgactgaggagcatatgcccttttggcagttttttgttaggttgtgcggcatcgtgggaggtatcttttctaccaccggaatgctgcatggcatcggaaaattcattgtcgaaatcatctgctgtcgctttcggctcggctcatacaaacctgtgaacagcgttcccttcgaggatggccataccgacaaccatctgccgctacttgagaataacacccactag

SEQ ID NO: 186776 - DNA, 1134 bp, Artificial Sequence
  Description of Artificial Sequence: Synthetic coding sequence
atgcggcggctgaaccggaagaagaccctgagcctggtgaaggagctggacgcgtttccaaaggttccagagtcttacgtcgagacatccgccagcggaggcactgtgtccctgattgcatttaccacaatggcattgctcactataatggagttttctgtgtatcaagacacttggatgaagtatgagtacgaagtggacaaggacttttcgtcgaagctgcgcatcaacattgatattactgtggcaatgaaatgccagtatgtcggggccgatgtgctggatctcgcggaaactatggtggcgagtgctgacggactcgtgtatgaaccaaccgtgttcgacctgtctccccagcagaaggaatggcagagaatgcttcagctgatccagtctagactgcaggaggagcacagtctgcaggacgtgatctttaagtctgcttttaaatccacctcgacggcattgccaccgcgggaggacgacagcagtcagagcccaaacgcttgcagaattcatggacatctgtacgtgaacaaagtggcaggcaattttcacataaccgtaggaaaggctatcccccacccacggggacatgcccatttggccgccctcgtcaaccatgagagttataactttagccacagaattgaccaccttagctttggagagttggtgcctgccattatcaaccccctcgatggaaccgagaagatcgccatagatcacaaccaaatgtttcagtactttattaccgtggtgcctacgaagctgcacacctacaagattagcgccgacacacaccagttctctgtgaccgagagggagagaatcattaatcacgccgctggctcgcatggtgtgagcggaatctttatgaaatacgatctgagctccctgatggtgaccgtgaccgaggagcatatgcccttctggcagttctttgttagactatgcggaatagtaggtggcattttctctactaccggtatgctccacggaattggaaagtttattgtcgaaatcatctgctgtcggttccggctgggaagttacaaacctgttaattcagtgcccttcgaggacgggcacaccgacaatcacctgcctttgctcgaaaataatactcattag

SEQ ID NO: 186777 - DNA, 663 bp, Artificial Sequence
  Description of Artificial Sequence: Synthetic coding sequence
atgcggcggctgaaccggaagaagaccctgagcctggtgaaggagctggacgcattccctaaggtgcctgagagctacgtggagacatctgcaagcggcggaactgtttcactgattgcattcactacaatggccctgttaaccataatggaattctccgtatatcaagacacctggatgaaatatgagtacgaggtggacaaggacttcagtagcaagcttcggatcaacatcgacataactgttgccatgaagtgccagtacgtgggcgccgatgtcttagatttagccgagactatggttgcctcagccgacgggttggtgtatgagccgaccgtgttcgacctgtcccctcagcagaaggaatggcaacgcatgctgcaactcatacagtctcgcttgcaggaggaacattctctacaggacgtgatatttaaatcggcctttaaatctaccagtaccgctttgcccccccgcgaagatgatagctcccagagccccaatgcgtgccgcattcacggccacctgtatgttaacaaagtggccggaaactttcatattactgtggggaaagccattcctcatccacgaggtcacgcacacctggcagcattagtgaatcacgagtcctataacttttcacaccggatagatcacctatag

SEQ ID NO: 186778 - DNA, 216 bp, Artificial Sequence
  Description of Artificial Sequence: Synthetic coding sequence
atgcggcggctgaaccggaagaagaccctgagcctggtgaaggagctagacgcctttccaaaagttcctgaatcttatgtggagacatccgctagtggtgggactgtatcccttattgcatttaccaccatggcgctcctgaccataatggagttttcagtgtatcaggacacttggatgaagtatgagtacgaggtggataaagacttttcctag

SEQ ID NO: 186779 - DNA, 528 bp, Artificial Sequence
  Description of Artificial Sequence: Synthetic coding sequence
atgcggcggctgaaccggaagaagaccctgagcctggtgaaggagttggatgccttccctaaggtgccggagtcgtacgtggaaacatccgcatcgggtggcacagttagcctcatcgctttcactacgatggcacttttaactatcatggaatttagtgtataccaggatacatggatgaagtatgagtatgaggtggacaaggacttctcctcaaaactgcggattaacattgacatcaccgtggctatgaagtgtcagtatgtaggcgcagatgtacttgatctggcagaaacaatggtggccagtgccgacggtttagtgtatgaacctaccgtgtttgatctctcaccacaacagaaagaatggcagaggatgttacaattgatccagtcccgccttcaggaggagcactcgctgcaagacgtgatattcaagtcagccttcaagagtacttcgacagctctgcctccaagagaagacgacagctcacaatctcctaacgcctgccgtattcacggacattag

SEQ ID NO: 186780 - DNA, 1158 bp, Artificial Sequence
  Description of Artificial Sequence: Synthetic coding sequence
atgcccgagtacaagggccggaccgtgctggtgcgggacgcccaggaggggtccgtaacacttcaaattcttgacgtgagattagaagaccagggctcctatcgctgcttgattcaagtgggcaatttatccaaagaggatacagtcatcctgcaagtggccgcaccctctgtagggtcactgagccctagtgccgttgccctggctgttatcttacccgtgttggtcctgctgatcatggtctgcctgtgccttatatggaagcagcggagggcgaaggaaaagctgctttacgaacacgtaacagaggtggataacctattatctgatcatgccaaggagaaaggcaagctccacaaggccgtaaaaaagctcagaagtgaattgaaactgaaaagggctgccgccaactccggatggcggcgagcaagattgcactttgtggccgttaccctagatccggacacagcgcatccaaagcttatattatcagaggatcaaaggtgtgtgcgcctgggagacaggagacagccagtacctgataatccccagagatttgacttcgtggtctctatactcggctccgaatattttacaaccggatgtcactattgggaggtgtacgtaggagataaaactaaatggatccttggcgtgtgctctgaatcagtgagccggaaaggtaaggtgacggcttccccagccaatgggcattggcttctgcgccagtcaagagggaacgaatatgaagctcttacatctccccagactagctttcggctgaaggagccccccagatgtgtgggtattttcctggactatgaagccggcgtaataagtttctataatgttacaaacaaatcgcatatctttactttcacccacaacttctccgggcctctaaggcccttctttgaaccttgtttacacgatggcgggaaaaacaccgcacctctcgtgatctgtagcgagttgcacaagtcagaagagtccatcgtgccaagacccgagggcaaaggacatgctaacggggacgtaagcctgaaagtaaattcctctttgctaccgcctaaagctcccgaacttaaggacatcatcctatccctgccccccgaccttggtccagcactgcaggagctgaaagctccgagtttttag

SEQ ID NO: 186781 - DNA, 1428 bp, Artificial Sequence
  Description of Artificial Sequence: Synthetic coding sequence
atggagatggccagcagcgccggcagctggctgagcggctgcctgatccctttggtctttctaagattgagcgtgcacgtgtccggacacgcaggggatgctggcaaattccatgtggcattactcggaggcacagccgaactcttatgcccgctgagtctgtggccgggcacggtcccaaaagaggttcggtggctgcgtagtccattcccgcagaggtcgcaggcagtacacatcttcagggacggcaaagatcaggatgaggacctgatgcctgagtacaagggccggaccgtactggtgagggacgcccaggagggctcagtgaccttacagattttggatgtgcggcttgaggatcaagggagctacaggtgtcttattcaggtggggaatctgagcaaagaggacaccgtcattttacaagtggcagccccaagcgtgggatctctctccccctccgccgtcgcgctggcagtgatacttccagtgcttgtcctgttgataatggtgtgcctctgcctgatctggaaacagcggcgagcaaaagaaaagctgctttatgagcatgtcactgaggtggacaacctgctcagtgaccacgccaaggagaagggcaaactgcataaggcagttaagaagctgaggtctgaattgaagcttaaacgagctgcggccaactccggctggcggagggctcggcttcattttgtcgccgtgacgctggacccggacaccgcacacccgaagttaattcttagcgaggaccagcggtgcgtcaggctgggagacagaagacagccggtgccggacaatcctcagcggtttgactttgtggtctctatcctgggtagcgagtactttaccaccggatgtcattattgggaagtttacgtgggagataagacaaaatggattctcggcgtgtgttcggaaagcgtgagccggaagggaaaggtaacagcctctcctgctaacgggcattggctgttgcggcagagccgcggaaatgagtacgaagctcttactagcccccagactagcttccgcctgaaagagccccccagatgcgtggggattttcctggactacgaggctggcgtcatctcgttctacaacgtgactaataagtcacatatcttcacctttacacacaatttttctggaccactgcgtccattctttgaaccatgtcttcatgacggaggaaaaaacactgctcctctggtcatttgtagcgagcttcataaaagcgaagagtctatcgtcccaagacccgagggcaagggacacgccaacggggacgtgtccttaaaagtgaattcgagcttactgcccccgaaagcccctgagctaaaggacatcatcctgagtcttcccccagatttgggcccagcgctgcaggaactgaaggccccctccttctag

SEQ ID NO: 186782 - DNA, 1428 bp, Artificial Sequence
  Description of Artificial Sequence: Synthetic coding sequence
atggagatggccagcagcgccggcagctggctgagcggctgcctgatccccctagtgttcctgagactgagtgtacatgtgtcgggccatgccggcgatgctgggaaatttcacgtagccctgcttggagggacagccgagctcctgtgccccctgtccctatggccaggtacagtgcccaaggaagtcaggtggcttagatcaccgttcccacagcggtctcaggccgtccacatctttagagatgggaaggatcaagatgaggaccttatgcctgagtataaggggcgtaccgtgttagtaagagacgctcaggaaggtagcgtgaccctacaaattcttgatgtgcggctggaagaccaggggtcttatcggtgtcttattcaggtcggcaatctgtctaaggaagatactgtgatccttcaggtggcagcccccagcgtgggatctctcagtccttccgcggtggcacttgctgtgattcttcccgtgctggtgctcctaataatggtgtgtctgtgcctcatatggaagcagcgacgcgccaaggaaaagctcctgtatgagcacgtgacagaagtggataacttgctgtccgatcatgcaaaggagaaagggaagctgcacaaagctgtcaagaaactgaggtccgaactcaaactgaaacgtgccgctgccaattcaggctggagaagagcccgactccactttgttgcagttacgctggatcccgacacagctcatcccaaattgatcctctccgaggaccaacgctgcgtgcgcctaggagatcgccgtcagccggtgccagataacccgcaacggttcgatttcgtggtgtcgattctaggcagcgagtattttacaacaggctgccactactgggaagtgtatgtaggagataaaactaaatggatcctgggggtatgttcagaaagtgtaagccgaaagggaaaggtaaccgcgtctccagcaaacggacattggcttttaagacagtctaggggcaatgagtacgaggctctaacttccccccagacttcctttcgactaaaggaacctccccggtgcgtgggaatctttttggactacgaagccggagtgatcagcttttataacgtgaccaataagtctcatatattcacctttacacataacttcagcggaccactcagaccatttttcgagccctgcttgcacgacgggggcaagaacaccgccccattagtgatctgtagcgaactccacaaatcagaagaatctatcgtgccccgccccgagggaaaaggacacgcaaatggcgacgtgtccctgaaagtgaactcctctctgttgccaccgaaagcccctgaacttaaggatataattttgagccttcctccagacctgggcccagctttacaagaactcaaggctccctccttttag

SEQ ID NO: 186783 - DNA, 2595 bp, Artificial Sequence
  Description of Artificial Sequence: Synthetic coding sequence
atgaccaccgagaagagcctggtgaccgaggccgagaacagccagcaccagcagaaagaggaaggcgaggaagcgatcaatagcggccaacaggagccacagcaggaagagagctgccaaacagccgcggaaggggacaattggtgtgagcagaaattaaaggcctcgaacggcgacactccaacccacgaagatctcaccaaaaacaaggaaagaacgagcgaaagtaggggattgtcgagactatttagctcattccttaagaggccgaagagccaggtgagcgaggaggagggcaaagaagttgagtcagacaaagaaaagggggagggcgggcaaaaagaaatcgagtttggtacctctctggacgaggaaatcatcttaaaggctcctattgccgctccagaacccgagttgaaaacagacccctcactcgatctccattcccttagctcggctgaaacccaaccagctcaggaggagctccgggaggatcccgacttcgagattaaggaaggagaagggctggaggaatgttctaaaatagaggtgaaagaggagagccctcagagcaaagccgagacagaactgaaggccagccagaagccaatccgtaaacacagaaatatgcactgtaaggtgagtctgctggacgataccgtctacgagtgtgtggtcgagaagcacgccaagggccaggatctgctgaagagagtctgtgaacacttgaatctcttggaagaagactactttggtttagctatatgggataacgccacaagcaagacatggctcgactctgctaaggagatcaaaaagcaggtgaggggcgtgccatggaactttacctttaacgtgaagttttatccacccgaccccgcacagctcaccgaggacattacccggtactatctatgtttacaattgaggcaagatatcgtggcaggaaggctcccatgctcctttgccactcttgccctactgggttcctacactatccaaagcgaattaggtgattacgaccccgagctgcatggcgtcgactacgtgagcgattttaaactggcccctaatcagacgaaggaactggaagaaaaggtgatggagcttcataaaagttatagatcaatgacgcccgcgcaggccgacctagaatttcttgagaacgctaaaaagctctcgatgtatggagttgatctgcacaaagctaaggacctggagggcgtggatatcattctgggagtgtgttcaagtggtcttcttgtctataaggataaacttcggattaacagattcccttggcccaaggttctgaagatttcttataaacgatccagcttctttatcaagatcagacctggtgaacaggagcagtatgagtctaccattggttttaagttgccatcctacagggccgcaaagaagctctggaaagtgtgtgtcgagcatcataccttcttccgactgacaagtacagatacgatacctaaatcaaagttcttggccctcggttctaagttccgatactccgggcggacacaagcccagaccaggcaagcttctgccttgattgaccgtcccgcgccccactttgagcggactgccagtaagagagcatcgagatccctggatggcgctgctgcagtggacagtgctgatcgttcccccaggccgaccagcgctccagcaatcacacaggggcaagtcgctgaagggggcgtgctggacgctagcgctaagaaaactgttgtccccaaggcgcagaaggaaaccgtcaaagccgaggtgaaaaaagaggatgaacccccagagcaggccgagcccgagcccacagaagcctggaaggttgagaaaacgcacattgaggtcactgtacctacgagcaatggggaccagactcagaaactagcagagaagactgaggacctgattcggatgcgtaaaaagaaaagggaacgactggatggggaaaacatctatatccgccacagtaacctcatgctcgaggacttagataagagtcaggaagaaattaagaagcaccacgcttccatctcggaactgaagaaaaatttcatggagtccgtgccagaaccgcgccctagtgaatgggataagagactcagcactcattctccctttcgcactctcaatatcaatggccagatccccaccggtgaaggccctccactcgtgaaaactcagaccgtgacaatcagcgacaacgctaatgccgttaaatctgagattccaacaaaggacgtaccgatagtgcacacggagaccaaaacaatcacctacgaggcagcacagaccgacgacaactcaggggacctcgatccaggcgtcctgttgacagctcagacaatcacatcggaaaccccgtcgagcactactactacccagataactaagactgtgaagggaggcatcagcgagacccgaattgaaaagaggattgttattacaggcgacgcagacattgatcatgatcaggtgctggtgcaagctattaaggaggccaaagagcagcaccccgatatgagtgtgaccaaggttgtggtgcaccaggaaaccgagattgcagacgagtag

SEQ ID NO: 186784 - DNA, 2328 bp, Artificial Sequence
  Description of Artificial Sequence: Synthetic coding sequence
atgaccaccgagaagagcctggtgaccgaggccgagaacagccagcatcagcaaaaagaggagggcgaggaggctataaactctggtcagcaggagccacaacaagaagaatcctgccagaccgctgccgagggtgacaactggtgtgaacagaaactcaaggccagcaacggcgatacaccgacccacgaggacctgactaaaaacaaggaaaggactagtgagagtaggggcctgagtcgactgttttcctcctttctcaagaggcccaaatcacaggtttcagaagaggaaggaaaagaggtggaaagtgataaagaaaaaggcgagggaggacagaaggagattgaattcggcacatctttggacgaagagattatactgaaggctcctattgcggctcccgagccggaactcaaaaccgacccttcgctggatctgcatagtttgtcttcagctgagacccagcctgcccaggaagaacttcgcgaagatcctgacttcgagattaaagaaggagaagggttagaggagtgctcgaagattgaggttaaggaagaatcaccccaatcgaaggctgaaacagaactaaaggcctctcagaagcctatccgaaaacataggaacatgcattgtaaagttagtctgctcgacgatactgtttacgaatgcgtcgtagagacatggttagactctgccaaagagattaagaaacaggtgcggggagtaccatggaactttacctttaacgtgaagttttacccccccgatcctgcccagcttactgaagatataacccgatattatttgtgcctgcaacttagacaggatatcgtcgccggacgactcccttgcagctttgctacgctcgctctcctcggatcatatacgattcagagcgaacttggagactatgatccagaactgcacggtgtggattatgtctcagacttcaaactggcccccaaccagaccaaagaattagaagagaaagtgatggaactgcataagtcctacagatcaatgactccagcccaagccgatctcgagttcctggagaacgcaaagaaactctccatgtacggtgtagaccttcacaaggccaaggacctagagggagtcgatattatccttggtgtgtgctcctccgggctgcttgtttacaaggacaaactgaggataaacagatttccatggcccaaagtcctgaagatttcatataaaaggagtagcttctttatcaaaatcagaccaggtgaacaggagcagtatgaaagtaccattggttttaagctgccctcctatcgtgccgccaagaaattatggaaggtgtgtgtggaacatcataccttcttccggctgacaagcacggacactatcccaaagtctaagtttctcgcattggggagtaagtttagatactctggacggacccaggcccagacccggcaggcctctgctctgatcgaccggcctgcgccccatttcgaacgaacagcttccaagcgggcgagccgaagcttagatggggccgctgcggtagactctgcggatagaagtccccgacctaccagcgctcctgccattactcaggggcaggtcgcagaaggaggcgtcttggacgcaagtgccaaaaagacagtcgttccgaaggctcagaaggagacagtcaaggccgaggtgaagaaggaggatgagccacctgaacaggcagagcccgagcccacagaggcatggaaagatttagataagtcccaggaagagatcaagaaacatcatgcctccatctcggagctgaaaaagaacttcatggaatctgtgccagaaccccgcccatcagagtgggacaagaggctgtccacgcactcacctttcaggactctgaacatcaacgggcagatcccaacgggcgagggccccccactagtgaaaactcagaccgtaaccatcagcgataacgcaaatgccgtgaaatcagagataccaacaaaggacgtgccaatagtccataccgagaccaaaaccattacttacgaggctgcacagacagacgacaactcgggcgaccttgaccctggcgttttactaacagcacaaactatcacctctgaaacaccttcttccactactaccactcagataactaagaccgtgaaaggggggattagcgaaacgcgcattgagaaacgtatcgtaatcactggtgacgccgatatcgatcatgatcaggttcttgtgcaggcaataaaggaggctaaagagcagcatcccgacatgtccgttaccaaggttgtagttcaccaagagacagagattgccgacgaatag

SEQ ID NO: 186785 - DNA, 1926 bp, Artificial Sequence
  Description of Artificial Sequence: Synthetic coding sequence
atgcactgcaaggtgagcctgctggacgacaccgtgtacgagtgcgttgtcgaaaaacatgccaagggtcaggacctgctgaagcgagtttgcgagcatctgaacttgctcgaagaggattattttggactggcaatttgggacaacgccacaagcaaaacttggctcgactccgcaaaggaaatcaagaagcaggtgagaggtgtgccctggaactttacattcaacgtgaagttctatcctccggaccctgcccaacttaccgaggacattactagatactacctgtgtttgcagttacggcaggatattgttgccggccgactgccatgctctttcgctactcttgccctgttaggaagctacactatccaaagtgaactgggggactacgaccccgagctgcatggagtggattatgttagtgattttaagctcgctccaaatcagacaaaagagctggaggagaaagtcatggaactgcataagagctatcgttccatgactcccgcccaggctgatctggaatttctcgaaaacgccaagaagctttcaatgtatggtgtcgacctccacaaagctaaagacctagagggcgttgatatcattctgggagtctgttccagtggactgctagtctacaaggataagctcagaatcaatcgatttccctggcctaaagtgctcaaaatctcctacaagagaagcagcttctttatcaagatcaggccgggcgagcaagagcagtatgagtccaccattggattcaagcttccatcgtaccgcgctgccaagaagctgtggaaggtgtgtgtggagcaccacactttcttccgtctaaccagcactgacaccatccctaaatccaaattcctcgccttgggctccaagtttcgatacagcggacgcacccaggctcagacacggcaggcttctgctttaattgacagacctgcaccccacttcgagcgtactgcctcaaaaagagccagccgaagtctggatggagcggcagctgtggacagcgctgaccggtctcctcgacccacgtcagcgccggcaataacccagggacaagtcgccgaaggaggagttctggacgcttcagctaagaagactgtggtgcccaaagcccagaaggagactgtcaaggccgaagtaaagaaggaagatgaacctccagagcaagctgaacccgaaccaacggaagcatggaaggttgagaaaactcatatcgaggtgacggtgcccaccagtaatggcgaccagacacaaaaaaaacgggagcgcttggatggggagaatatctacataagacacagcaacctgatgctggaagacttggacaaaagccaggaggagatcaaaaagcaccacgctagtatttccgagttaaaaaagaatttcatggaatctgtacctgagccccgcccatctgaatgggacaagaggctttccacacatagtccattcaggacgctgaatatcaacggtcagattccaacaggcgaggggccccccctcgtgaaaacacagaccgtgacgatttctgataacgccaacgctgtgaagagcgaaattccgacaaaagatgtccctatcgtccacaccgaaaccaaaacaattacctacgaggctgcacagaccgatgacaacagtggcgatctggaccccggtgtgctactgactgcccagaccatcacatctgagactcctagttctactaccaccacacagatcaccaaaacggtgaaaggggggatctctgagacccgaattgagaagcggatcgtgatcaccggggatgccgacattgaccatgatcaggtcctcgtgcaggccatcaaagaggcaaaagagcagcatccggacatgagcgttacgaaggtggtggtgcaccaagaaacggagatcgccgacgagtag

SEQ ID NO: 186786 - DNA, 2496 bp, Artificial Sequence
  Description of Artificial Sequence: Synthetic coding sequence
atgaccaccgagaagagcctggtgaccgaggccgagaacagccagcatcagcagaaggaagagggagaggaggccattaactccggtcagcaggagccccaacaagaggaaagttgccaaactgctgccgaaggtgataactggtgtgagcaaaaactaaaggcatccaacggcgacaccccaacacatgaggacctgacaaagaacaaagaacgcacctccgagagcagggggctgtcccgactgtttagttcattcctgaagcgacctaagtcacaggtgagtgaggaggaggggaaagaggttgagagcgataaagaaaagggtgaggggggtcagaaggaaattgagttcggaacgagtctcgatgaagagatcattctgaaagcccccatagccgcccctgagcctgaactgaaaacagacccatccttagacctgcatagcctatcaagcgccgagacgcagcctgctcaggaggaactccgcgaggatccggactttgagattaaggaaggtgagggtctagaggagtgctcgaagatagaagtcaaggaagagagcccccaaagcaaggctgagactgagctcaaggccagtcagaagcccattagaaagcaccgtaacatgcactgtaaggtttctctgctcgacgacaccgtgtatgaatgcgtggtggagaagcacgctaaggggcaagacctgcttaagcgagtgtgcgagcatctgaatctcttggaggaggattactttggactggccatctgggacaacgccactagtaaaacttggctcgacagcgccaaagagatcaagaagcaggtcagaggtgtcccttggaattttacctttaacgtgaaattctacccccccgacccagctcagttgacagaggacatcactcgatactacctctgcctccaattaaggcaggatattgtggccgggcggctgccatgctcttttgctacactcgctctgctcggatcctataccatccaatctgaactcggcgactacgatcctgagctgcatggggtcgactatgtcagcgacttcaaactggcacccaaccagaccaaggaactggaagagaaggtaatggagctgcacaaaagctaccggtctatgacgcctgctcaggccgatttagaatttctcgagaatgctaagaagctctccatgtatggggtcgacctgcataaagctaaggaccttgaaggagtggatatcatactgggggtctgcagctccggcctgctcgtttataaggacaaactgcggatcaacagattcccctggcctaaggtcctgaagattagctacaaaagaagcagtttttttattaaaatcagaccaggagagcaggaacagtacgaaagcaccattggctttaagttgccatcataccgggcggctaagaaactgtggaaagtttgtgtggaacaccataccttttttagactgactagcacagatactattcccaagagtaagtttctggcgctgggatcaaaatttaggtattccggcaggacacaggcccaaacccgacaggccagcgcgctcatcgacaggcccgcaccacacttcgaacgcaccgctagcaagcgcgcatctcgatctctcgatggggccgccgccgtggattctgcggatcgttctccccgtccaacatcggcgccagcaataacacagggacaggtcgctgagggaggggtgctggacgcaagcgctaagaaaacggtcgtccccaaggctcaaaaagagaccgtcaaagccgaggtgaagaaggaggacgaacctccagaacaagccgagcccgaacctactgaggcctggaagaagaagcgcgagcgcctcgacggagagaacatttacattagacattccaatctgatgctggaggatttggataagagccaggaagaaatcaagaaacaccatgcgtccattagtgaactgaagaagaattttatggagtcagttcccgaacctcggcccagtgagtgggataagagactatctactcactccccattccgcacgctcaacataaacgggcagattcctacaggagagggtcctccattggtgaaaacccagaccgtgaccatcagcgataacgccaatgccgtcaaatccgagatcccaactaaagatgtacctatcgttcacactgaaacaaagacaatcacctatgaggctgcccagactgatgataatagcggtgatctggatcctggcgtactcctcactgcccagaccattacctctgaaacgccgtcatccaccactactacccaaataaccaagactgtgaaaggcggcatctcggagacacggatcgagaagagaattgtcataactggcgatgccgatattgaccacgaccaggtgctggtgcaagccatcaaagaggcaaaggaacaacaccctgatatgtccgtgacaaaagtggtcgttcatcaggagactgaaatagcagatgagtag

SEQ ID NO: 186787 - DNA, 2484 bp, Artificial Sequence
  Description of Artificial Sequence: Synthetic coding sequence
cgggcccgggccgcccggagccagaacgccgtgggccccgtgcccgctgcaccttccccagagaaatctttggtgaccgaggctgagaactcacagcaccagcagaaggaggagggagaggaggccataaactctgggcagcaggaacctcagcaagaggagtcttgtcagactgctgcagagggggacaattggtgtgagcagaaactgaaggcttcaaacggtgacacccccacccacgaggacctcactaagaacaaggagcgtacctctgaaagcaggggcctgtcgcgcctgttttcaagcttccttaaaagacccaaaagccaagtgtcagaggaggagggaaaggaagtggaaagcgataaagaaaaaggagaaggcggtcagaaagaaatagaatttggcacgagtctggatgaggagataatcttaaaagcccctatcgccgcccccgaacctgagctgaaaaccgacccatcccttgatctccacagcctctcatccgcagagacccagccagcccaggaagagctcagggaggaccccgattttgagattaaggaaggcgagggacttgaggaatgtagcaagattgaagtaaaggaagaaagtcctcagagcaaggctgaaactgagctcaaagcttcgcagaagcccattcgaaagcacagaaatatgcactgtaaagtgagtcttttagacgacacagtgtacgaatgcgtagtcgaaaaacacgctaagggccaggatttattaaaacgtgtgtgcgagcatctgaacttactggaagaggattactttggactggcaatttgggataatgctacatccaagacctggctggatagcgctaaggagatcaagaagcaagtgcggggcgtgccgtggaacttcacgtttaatgttaagttctaccctccagatcctgcccaattaaccgaagacatcacacgctattacttgtgtctgcagctgcgtcaagatatagtcgctggccggctgccttgttctttcgccaccctggcgctattgggaagctatacaatccagtctgaactgggagattacgatcctgagctccatggagttgactatgtatctgactttaaactggcccccaaccagaccaaggagctggaagagaaggttatggagttacacaaatcctatcgctcaatgacacccgctcaggccgacttggagttcctggagaacgcgaaaaagctcagtatgtacggggttgatcttcataaggctaaagacctagaaggcgtagatatcattcttggggtctgctctagtggcctcctagtttataaggataagctgcgaattaataggttcccatggccaaaagtacttaagatctcttacaagcggtctagcttttttatcaagattagacctggggaacaagaacagtacgagtcgaccatcggatttaagttaccttcttacagagctgctaagaagctgtggaaggtgtgcgtggagcaccatacgtttttcagactcaccagcaccgatacaatccctaaatctaagtttttggccctggggagtaaatttcgctatagcggacgcacccaggctcagactcggcaagcttccgccttgattgatcgcccagctccacatttcgaaagaacggccagtaagcgggcgtccagatctctcgatggggcagccgccgtggactccgccgatcgcagtcctcggcccacatccgcccccgccataacacaaggccaagtggccgagggcggcgtcctggacgcatcagccaaaaagacagtcgtgcctaaagcgcaaaaagagacggtgaaggctgaagtaaagaaggaggacgagccccctgagcaggccgagcctgaaccaactgaagcttggaaggacctcgataagtctcaagaagaaatcaaaaagcaccatgccagcattagcgaactcaagaagaattttatggaaagtgtacctgagccgcgcccttctgagtgggataagagactatctacacatagcccttttcgcacccttaacattaacggacagatccccaccggggagggaccacctctggtaaagactcagaccgtcactatctccgacaatgccaatgccgttaaatccgaaatcccaaccaaggatgtgcccatagtccacaccgaaactaagaccataacctacgaagccgcccaaactgatgataattccggggacctcgaccccggggtgctcctgaccgctcagactatcacatccgaaacaccttcctccactactaccacacagatcacaaagaccgttaagggtggcatttcagagacacggatcgaaaaaagaatcgtgattacgggagatgccgatattgatcatgaccaggtgcttgtccaagctattaaagaagctaaagaacaacatccagatatgtctgtgacaaaggtcgtggtgcaccaggagaccgagattgcggatgagtag

SEQ ID NO: 186788 - DNA, 2163 bp, Artificial Sequence
  Description of Artificial Sequence: Synthetic coding sequence
atgaccaccgagaagagcctggtgaccgaggccgagaacagccagcaccaacaaaaagaggagggcgaagaagccataaactctggacagcaagagcctcagcaggaggaatcttgccaaacggccgccgagggagataactggtgtgagcaaaaactgaaagcctctaacggagatacccctacacatgaggacctgactaaaaataaggagagaacatctgaatctaggggcttatctcgcctgttctcgagctttcttaagagacccaagagccaagtgagcgaggaggaggggaaagaagtcgaaagtgataaggagaaaggggaagggggccaaaaagaaattgagtttggcacgtccctagacgaggaaatcattttgaaggccccaatcgctgcgcctgagcctgagctgaaaacagatcctagtctggacttgcactctctgagctctgcagaaacccagcccgcgcaggaggagctccgagaggacccggactttgaaataaaggaaggagaaggcctggaagagtgttccaagattgaggttaaagaagagagtcctcagtctaaggccgaaacggaactaaaggcctcccagaaacctattcggaaacaccgcaacatgcattgtaaggtgagcttattggacgacactgtgtatgagtgtgttgtagaaaagcatgcaaaggggcaggacctgctgaagagggtatgtgagcacctgaatttactggaagaagactattttggattggccatatgggacaacgccacttctaaaacttggttagacagtgcaaaggagatcaaaaaacaggtgcggggcgtgccttggaactttacctttaacgtcaagttctaccccccagatcctgcccagcttaccgaagatataacaagatattacctgtgcctgcagctgcgccaggatatcgtggcagggagacttccttgttccttcgcaaccttggcgctgttggggtcatatactatccaatctgaactgggagactacgaccccgagctgcacggagttgactatgtttccgactttaaactcgccccgaatcagaccaaagaactagaggagaaagtcatggagctgcacaagagctaccgctccatgacaccagcacaagctgatttggagtttttagagaacgcgaagaagcttagtatgtacggcgtagatcttcacaaggctaaggacctggagggggtggatattattctgggcgtctgttcctcaggactgctcgtgtacaaagataaacttagaattaataggtttccatggcccaaggtgctgaagatttcctataaacggagtagcttctttattaagattcgaccgggggaacaggagcagtacgaaagcacgatcgggttcaagcttccgagctatcgtgctgccaaaaagctgtggaaggtttgtgttgagcaccatacattttttagactgaccagcacagacaccataccaaagtcaaaatttctggccctgggctccaagttcaggtacagcggacggacccaagcacagacccgacaagccagtgctctcattgataggcctgcaccccacttcgagagaaccgcctctaaaagagcctcaagaagcctggacggagccgcggctgtggatagtgccgacagatcgcctcgccctacctctgccccagccataactcaaggccaggtagctgagggaggcgttcttgacgctagtgcgaagaaaactgtggtgccaaaagcacagaaagagacggtcaaagcagaggtcaagaaggaggatgagccccccgaacaggccgagcccgagcctaccgaggcttggaaagtcgagaagacgcacatcgaggtgacggtacctacaagcaacggcgatcagacccagaagaagagagaacgcctagacggggaaaacatttacattcgtcattccaatttaatgttggaggacttggataaatcccaggaggagattaagaagcaccatgcctctattagtgaacttaaaaagaacttcatggagagcgtgcccgaaccgcgtcctagtgagtgggacaagcgcttatccactcacagtccctttcgcaccctcaatattaacggacagatccctacaggcgagggcgtatctactcttagcacctag

SEQ ID NO: 186789 - DNA, 2595 bp, Artificial Sequence
  Description of Artificial Sequence: Synthetic coding sequence
atgaccaccgagaagagcctggtgaccgaggccgagaacagccagcaccagcaaaaagaggaaggggaggaggctattaattctggacagcaggaaccccagcaggaggaatcgtgtcagaccgcagcagaaggggacaattggtgtgaacaaaagctgaaggcatctaatggcgatacaccaactcacgaggatctcaccaagaataaagagcggacttccgaatctcgtggcctatcccgcttgttctccagttttctgaagcgtcctaagagtcaggttagcgaggaagagggtaaggaggtggagagcgacaaggagaagggcgaggggggacagaaggagatagaattcggcacatctttggatgaggagatcatccttaaggcgcccattgccgcacccgagccggagctgaaaaccgatccatcactcgatctacattctctatcctctgcggaaacccagcctgcccaggaagagctgagggaagacccagacttcgagattaaggagggagaaggtctggaggagtgctcaaagattgaagtgaaagaggagtctccccagagtaaagccgaaaccgagctgaaggcgagccagaagcctatcagaaagcacagaaacatgcattgcaaggtctcactcctggatgacacggtgtacgaatgcgtggtagagaaacacgccaaaggccaggacttgctgaagagagtgtgtgaacaccttaatctgcttgaagaggattacttcggtctggccatctgggacaatgcgacttccaaaacatggctggattccgcgaaagagataaaaaaacaggtacgcggcgtgccatggaacttcacttttaacgtcaaattctacccccctgatcctgcacagctgactgaagacataactcgctattacctgtgtctccaattgaggcaggatattgtagccggccgcttgccatgctcttttgcgaccctggcccttctaggttcctatactatacagagcgaactgggcgattacgaccccgagctgcatggagtcgattatgtctccgattttaaactggcccctaatcagacaaaggagttagaagagaaagtgatggaattgcataaaagctatcgtagcatgactcctgcacaggccgatctggagttcctcgaaaatgcaaaaaaactttccatgtatggggtggacttgcataaggccaaggatctagagggggttgacattatcttgggggtgtgcagctccggtctgctagtctacaaagataagttgcggatcaaccgcttcccctggccaaaggttctcaaaatttcctataagcgctcatcttttttcattaagattagaccaggggaacaggaacagtacgaatccaccataggtttcaaactgccaagttatagagccgctaagaaattgtggaaagtgtgcgtagagcatcatactttctttagattgacctccaccgatacgatccccaagagcaagtttctcgccttggggtccaagttccgctactccggccgcacacaggctcaaacgagacaggccagcgcccttatcgatcgaccggccccccattttgagaggaccgccagtaagcgagcctcccgctcattggacggcgccgccgcggttgattctgcagatagaagcccccggcctacctctgctcccgctatcacccagggtcaagtcgccgagggtggtgtactggacgccagcgccaagaaaaccgtcgtaccgaaagctcagaaggagacggtcaaagcagaggtgaaaaaggaggacgaaccccccgaacaagccgagccagaaccaacggaagcctggaaggttgaaaagacccatatagaggtgactgtcccgacatctaacggagaccagacccaaaagctcgccgagaagactgaggaccttataaggatgcgaaaaaagaagcgagagaggctcgacggagagaatatctatatccggcacagcaatctgatgctagaggacttggacaagagccaggaggagattaagaagcatcacgcctccatttctgaactgaaaaaaaacttcatggaatccgttccggagccaaggcccagtgaatgggataaacggctaagtacacactcgcctttcagaactctcaacatcaatggtcagatacccactggcgagggacctccgctagtcaagacccagacagtgacaataagtgacaatgccaatgctgttaagtcggagattcccacaaaggatgtgcctatcgtccatactgaaacgaagaccattacctatgaagccgcccagaccgacgacaatagcggcgacctcgaccctggggtactgctgacagcccaaacaattacttccgagaccccttcctcaaccactactacccagataaccaagactgtaaaaggaggaatctcggaaaccagaatcgaaaagcgcatcgtgattactggtgacgccgacatcgaccatgaccaagtgctggtccaggccattaaagaagccaaagaacagcacccagacatgtcagtaaccaaggttgtggttcaccaagaaactgagatagcagacgagtag

SEQ ID NO: 186790 - DNA, 1767 bp, Artificial Sequence
  Description of Artificial Sequence: Synthetic coding sequence
atgcactgcaaggtgagcctgctggacgacaccgtgtacgagtgcgtcgtagaaaaacacgccaaaggtcaggatctgctgaaacgcgtctgtgaacatctgaatctgctggaggaggactactttgggctggctatctgggataacgcaacaagcaaaacgtggctcgacagtgccaaagaaatcaagaaacaggtccgcggagttccttggaatttcacatttaatgtgaagttttacccccccgaccctgcacagctgaccgaggacataactcggtactacctgtgcctccaattacgccaggatatagtggctggaagactcccctgtagttttgccactctcgcccttctaggaagctataccattcaatctgaactgggggactacgaccccgaactgcatggggtggactatgtttcagattttaagctcgcaccaaatcagactaaggaattggaggagaaagtcatggaactgcacaagagctatcgttccatgactccggctcaggccgatctagaatttctcgagaatgctaagaagttatcaatgtatggggtggacctgcataaagccaaggatctagaaggagttgatattatcctgggcgtatgcagttccggactgctcgtgtacaaggataaacttcggatcaatcggttcccatggcctaaggtgcttaaaattagttacaaaaggagttccttcttcattaagattcgaccgggagagcaggaacaatatgaaagtaccatagggtttaagctccctagctacagggctgccaaaaagctttggaaagtgtgtgttgagcaccacaccttctttcgcctcacgagcacagacaccattcctaagtctaaatttctggctctaggcagcaagtttcgttactcggggagaacccaggcacaaacacgccaggctagcgctcttatagaccgacctgctccccacttcgagcgcaccgcgagcaagcgggcatcaagatccctcgacggagccgccgcggtcgattccgcagatagaagtccccggcctacaagcgcaccggctattacccaagggcaggttgcagaggggggcgtgttggacgcatctgctaagaaaacagtggtgcctaaagcacaaaaggagacggttaaagccgaggtgaaaaaggaagacgagccacccgaacaagctgagcctgaaccaacagaagcttggaagaagaaaagggagcgactcgacggtgagaatatatatatcaggcatagtaatcttatgctggaggacctggacaagtcgcaggaagagatcaagaaacaccatgccagcatctccgagctgaagaaaaacttcatggagtctgtcccagagccaaggccgtctgaatgggacaagcgcctcagcactcactctcctttccggacactcaatataaatggccagatcccgaccggggaaggacctccactggtgaagacccagacggtgaccatcagcgataatgctaatgcagtgaagagcgagatccccactaaggatgtccctatcgtccatacagagacaaagacaattacgtacgaggcggcccagactgtgaaaggcggcatcagtgagacccgcatcgaaaagcggatagtaattaccggcgacgcggacatcgatcacgatcaggtattggttcaggcaatcaaggaggcaaaggaacaacatccagatatgagcgtgactaaggtggtggttcaccaggaaacagaaattgctgatgagtag

SEQ ID NO: 186791 - DNA, 2115 bp, Artificial Sequence
  Description of Artificial Sequence: Synthetic coding sequence
atgaccaccgagaagagcctggtgaccgaggccgagaacagccagcatcagcagaaggaggagggagaggaagcaataaattccggccaacaggagccccagcaggaggagagctgtcagactgctgccgaaggagataactggtgtgagcagaagctgaaggcgtcaaatggtgacacaccgacacacgaagacttgaccaagaacaaagagagaactagcgagtcccggggcctttcacgcctgttttccagttttctaaaacgtccaaaaagtcaggtgagcgaagaagagggaaaggaggtcgagtcagataaagaaaagggggagggaggccaaaaggaaatcgaattcgggaccagtttggacgaggagatcatactcaaagcccccatcgccgccccagaaccagaattaaagacagacccaagcctggatctgcatagtctgtcgtcggctgagacacagacttggctggattcagctaaggaaatcaaaaagcaggttcgtggagttccctggaacttcactttcaatgtgaaattttacccacctgacccagcgcagctgaccgaggacatcacacggtactacctctgtttgcagctgagacaggatatcgtggctggcagactgccctgttctttcgccacactggccttattgggctcttatacaatacagagcgagttgggcgattatgaccctgaactccatggcgtcgattatgtctctgacttcaaactcgccccgaaccagacaaaagagcttgaggagaaagtcatggaactgcataaatcgtaccgcagcatgacccccgctcaggccgacttagagttcctggagaacgctaagaaactgagcatgtacggggtggacctccacaaagccaaagacttggaaggtgtggacattatattaggagtgtgcagctctgggttactggtgtataaggacaagctcagaattaatcggttcccttggccaaaagtcttaaaaatcagttataagcggagttccttcttcatcaaaattagacctggcgagcaggagcagtatgaaagtacaatcgggtttaaattgccatcctaccgcgcagcaaagaagttatggaaggtgtgtgtagaacatcatacttttttcaggctgacaagtaccgatacaatacctaagtccaaattcctggcactggggtcaaaattccgttactccgggagaacacaggcacaaacaaggcaggcctcggcactgattgacagaccggctccacatttcgagagaaccgccagtaaacgagcctcaaggtctctggatggtgccgccgcagtggatagcgccgatcgatcccccagacctacctccgctccggccattactcagggccaggtggccgaggggggcgtgcttgacgcgagtgcaaagaagacagtggtgcccaaggcccagaaagaaacggtgaaggccgaggtgaaaaaggaggatgaacccccagagcaggccgaacctgagcccacagaggcctggaaagatctggataaatcccaagaggaaataaagaagcatcacgctagcatttccgagttgaagaaaaatttcatggaatcagtcccagaacctaggccttctgagtgggataagagactgtcaacacactcaccctttcgtaccttgaatataaacgggcagattcccacaggagagggtccaccgctcgtgaagacacagactgttacgatttcggacaatgcaaacgcagtgaagtccgaaatcccaacgaaagatgtcccaatcgtgcacaccgaaactaaaactatcacttatgaggccgctcagacagacgataactccggcgacctggaccctggagtcctccttaccgcccagacaataacgtctgagaccccatcaagcaccactacaacgcaaattacaaaaaccgttaaaggtggtatctcagagaccaggatcgagaagcggatcgttattaccggcgacgctgacatcgaccacgatcaggttctggtgcaggccattaaggaggcaaaggaacagcatcctgacatgagtgtcaccaaggtcgttgtgcaccaggaaactgagatcgctgacgagtag

SEQ ID NO: 186792 - DNA, 2304 bp, Artificial Sequence
  Description of Artificial Sequence: Synthetic coding sequence
atgaccaccgagaagagcctggtgaccgaggccgagaacagccagcatcagcagaaagaagagggggaagaggccattaattcaggtcaacaagagcctcagcaggaggagtcctgccagactgccgccgagggagacaattggtgcgaacagaaactgaaagcttccaatggagacaccccaacccatgaagacctcactaagaacaaagagcggacctccgaaagtagaggtctgagccgtctgttctcctcctttctgaaaagaccaaagtcgcaggtgagcgaagaagaggggaaggaggttgaatctgataaggaaaaaggagaagggggtcagaaagagattgaatttgggactagcttggatgaagagatcatcctgaaagcccccatcgcagcgcccgagcccgagctcaagaccgatccctcgctggacctgcatagtcttagcagtgcagaaactcagcctgcccaagaagaactccgcgaggatcccgactttgaaattaaggaaggagagggtcttgaagaatgctctaaaattgaagtcaaggaagagagcccacagtcaaaggctgagactgaactcaaagcctcacagaagccaatcaggaagcataggaacatgcactgcaaagtctctctgctggacgatactgtctatgaatgtgtggtggagaaacatgcaaaaggtcaggatctcctcaagagggtctgcgagcacctgaatctgcttgaagaggactacttcggcctggcgatctgggacaatgcaactagtaagacctggctggacagtgctaaggagataaagaaacaggtgcgaggggttccctggaatttcactttcaacgtcaaattctacccaccggaccctgcacaattaacggaggacattacacggtactatctttgcctgcaattaaggcaggatatagtggccgggagattaccctgtagttttgccaccctcgccttgctcggcagttatacaatccagtctgaactgggggattacgaccccgaactccatggcgtggactatgtgagtgattttaaattagcccctaatcagaccaaggaactggaagagaaggtgatggagctacacaaaagttatcgtagtatgacccccgcgcaggcagacctggagtttctggagaatgctaaaaagctatccatgtatggagtagatctgcacaaagccaaagatcttgagggagttgacatcattttgggagtgtgcagctcaggcctgctcgtgtacaaagacaagctcagaatcaaccgatttccttggcccaaggtgctcaaaatcagttacaaacggtcttcttttttcatcaaaatccgcccaggggaacaagaacaatatgagtctactattggattcaaactcccaagctatagagctgcaaaaaagttgtggaaagtgtgtgtggaacatcacacgtttttccggctcacctccacggatacgatccccaagtctaagttccttgcactaggttcaaaattcagatactcaggccgcactcaagcccagacgaggcaggcttccgcactgatcgatcggcctgcaccccactttgaaaggaccgccagtaaacgagcctctcggtcactcgacggcgcagccgctgtggacagcgccgaccgttcgccacggcccactagtgcacccgccatcacccagggccaggtggctgaaggaggcgtactcgacgcatcagctaagaaaacagtcgtccctaaagcccagaaagagactgttaaagcggaggttaagaaggaagatgagcccccggaacaagcagagccagagcccactgaggcatggaaagacttggacaagagccaggaggaaattaagaagcatcatgccagtatcagtgagctgaagaaaaactttatggaaagcgttcctgaaccccgcccgtccgagtgggacaaacgattatcaacacattctccgtttcggaccctcaatataaatggacagatacctacgggcgaagggactgacgataacagtggcgatctggacccaggggttttgcttacggcccagaccatcacctcagaaacaccctctagcacaaccacaactcagattacaaagacagtaaagggcggtatctccgagactaggatagaaaaaagaatcgtcataaccggtgacgcggacattgatcatgaccaggtactggtacaggcaatcaaggaggcaaaagagcagcaccccgacatgtccgtgacgaaggtcgtggtgcaccaggaaactgaaattgctgatgagtag

SEQ ID NO: 186793 - DNA, 2145 bp, Artificial Sequence
  Description of Artificial Sequence: Synthetic coding sequence
atgaccaccgagaagagcctggtgaccgaggccgagaacagccagcaccagcaaaaagaagagggcgaggaagctattaattccggacaacaggaaccacagcaggaagaatcatgccagaccgcagccgagggagacaattggtgcgagcaaaagctcaaagcaagtaacggagacactcccactcacgaagacctcaccaagaacaaggagaggacatctgagtcacggggattgtcccgcctgtttagctcatttctaaagcgtcctaaatcccaagtatccgaagaagaagggaaagaagtggaatcagacaaggaaaaaggtgagggagggcagaaagaaatcgaattcggaacatccttggatgaggagatcatcctgaaagctccaatcgctgctccagagcccgaactgaaaactgacccctccctggatctccattctctgagttctgctgagacccaacctgctcaagaggaactcagagaggatcccgatttcgaaattaaagagggggagggcctagaggaatgctctaaaattgaggtaaaggaggaatcacctcaatctaaagccgagacggagctcaaagcttcacagaaacccatcagaaagcaccgcaatatgcattgcaaggtgtctttgcttgatgacacagtctacgaatgtgtggttgaaaaacatgccaagggccaggacttgctgaaacgggtgtgcgaacacttaaatctcctcgaagaggactattttggactcgcaatttgggacaatgcaaccagcaaaacatggcttgacagtgccaaagagatcaagaagcaggtgagaggtgtgccatggaacttcacctttaacgttaaattttatccccctgaccccgcacaacttaccgaagatatcaccagatattatctctgcctgcagcttcgccaggatattgtggcaggccgactcccatgctcgttcgccacgctggcacttctggggtcatacacgattcagagcgaactgggagactacgaccccgagctccatggggtggattatgtgtcagacttcaaactggcccccaaccagactaaagaactcgaagaaaaggtgatggaactgcacaagagctaccgaagcatgaccccagcgcaagccgatctcgagtttctggagaacgccaagaagctgagtatgtacggggtggatctacataaggcgaaagaccttgaaggtgtcgacataatcctaggggtgtgctctagtggtttgctggtttacaaggacaagctccgcataaatcggtttccctggcccaaggtgctgaaaatttcttataagcggagcagtttcttcattaagatcagacctggagagcaggagcaatatgaatccacaatcggattcaaactgccgagctatcgagctgcaaagaagctgtggaaggtctgcgtagagcaccatactttttttcgccttacctccactgatacaatcccgaaatccaaattcctggcgctcgggagcaaattccggtacagcggcaggacccaggcccaaactcggcaagcttctgcactcatcgacaggcctgccccccacttcgaaaggaccgcttcaaagagagcaagtcgcagcctcgacggagcagctgccgtggattcagctgatcggtctccccgccctacatcggcccctgcaattacacagggacaggtggccgagggcggtgtgttggacgcctccgctaaaaaaacggtcgtacccaaggcacagaaagagactgtaaaagcggaggtgaagaaggaggatgagccgcctgaacaggctgaaccagagccaaccgaagcctggaaagtcgagaagactcatatcgaagtgacagtgcccacttctaacggtgaccaaacccagaaaaagcgggagaggctcgatggtgagaacatctatatcaggcactcaaaccttatgctcgaagacttagacaaaagccaggaggagatcaagaaacatcatgcctctatctccgaactgaagaagaattttatggaatccgtccccgagcctaggccttctgagtgggacaagaggctgtccactcacagtccttttagaaccctcaacataaatggacagatcccgaccggtgaaggttag

SEQ ID NO: 186794 - DNA, 2061 bp, Artificial Sequence
  Description of Artificial Sequence: Synthetic coding sequence
atgggctgcttctgcgccgtgcccgaggagttctactgcgaggtgttgcttctagacgagagtaaacttacattgaccactcagcagcaggggattaagaagagcactaagggttccgtggtgctcgatcatgtcttccaccacgttaacttggttgagatcgactatttcggactgcggtactgtgataggtctcaccaaacctactggctagatccggctaagaccctcgccgagcataaagaactgattaacacaggccccccctacactctctatttcggaattaagttctacgctgaagatccctgtaaactgaaggaagagattacacgctatcaattcttcttacaggtcaaacaggacgtgctgcaggggagactgccgtgtcccgttaacacagctgcccagcttggagcttatgccatacagagcgagctcggcgactatgacccctacaaacatacagcaggatatgtgtccgaatacaggtttgtgccggaccaaaaggaagagctggaagaggcaattgagaggatccataaaactctaatgggacagatcccatcagaagcagagctgaactatttgagaacagcaaaatccctggagatgtacggtgtggatttacaccctgtgtacggggaaaacaagagcgagtacttcctcgggttgactccagtcggagtagtggtttataaaaataaaaagcaggtgggaaaatatttttggcctcgcatcactaaggtccatttcaaggaaacacagttcgagctaagagtgctgggaaaggattgcaacgaaacttcattcttctttgaggcaagaagtaaaacagcatgcaaacatctgtggaaatgctctgttgagcaccatactttctttcgaatgccagaaaacgagagtaactctcttagccgtaagctctctaagttcggttccatacggtacaagcaccgttattcaggcaggacagccctgcagatgtcaagagacctgtccatacagctgccccgccccgatcagaacgtcacaaggagccgaagtaaaacctaccctaagcgcattgcccagacacagcccgccgagtcgaacagcatctctcgcatcaccgcaaacatggaaaatggagagaatgagggcacaattaaaatcattgcaccttcgccagtgaagtcatttaagaaggcgaagaatgagaattctccagacacacagcggagtaaaagtcacgctccctgggaggagaacggaccacagtccggactgtacaactcaccttctgatcgtactaagtctcccaagtttccttacacacggagacgtaatcctagctgtggctcggataacgactccgtccaaccggttagacgacggaaagcacacaattcgggagaagacagcgacttaaagcaaaggaggagatcccgctcacggtgtaatacatcaagcggtagtgaatccgaaaactctaaccgagaataccgcaaaaagcgtaacaggataaggcaggagaatgacatggtggatagcgctccccagtgggaggctgtgcttagaaggcagaaggaaaagaaccaggccgatcctaacaaccggcgcagcaggcaccgctctcgcagccgttcacctgatattcaagcaaaagaagagctgtggaagcacatacagaaggagcttgttgatccttccggattatccgaggagcagcttaaggagattccttataccaaaattgagacgcagggcgatccaataagaatcaggcattcccattctccccgaagttatcgacaatatagaagatctcagtgctcggacggagaaagatcagttcttagtgaggtgaattcaaaaacggacctagtgcctcccctacccgtgacacgtagttccgacgcccaaggcagtggagacgctaccgtccaccagaggagaaacgggagtaaagattcactgatggaggagaaaccacagacatctaccaataatttggctgggaagcacacggccaagaccattaaaaccatccaggcgagtcggctaaaaactgagacctag

SEQ ID NO: 186795 - DNA, 1836 bp, Artificial Sequence
  Description of Artificial Sequence: Synthetic coding sequence
atggacttcaagaagagcaagctgaccctggtggtggtggaggacgatgaccagggccgtgagcaggaacacactttcgtgttccgactggattccgctcgtacttgtaaacacttgtggaaatgcgccgttgaacaccatgcgttctttagactgcgcactccaggaaatagtaaaagtaatagatccgatttcattcgcctgggctctcggtttcgtttcagcggcaggacagagtaccaggcaacacacggttcccgtttgaggcggacgagtacgttcgagcgcaagccctccaaaagatatcccagtcgccgccactccacctttaaggcatcaaatcccgtcattgctgctcagctctgctcgaagaccaaccctgaagtacacaattaccagccacaatatcaccctaacatccacccttcgcagcccaggtggcaccctcatagtcctaatgtcagctacccgctgccgagtccggtgttgtcatccagcgatagactccccttcggcatcgaggagaacgggggaacgccctttctgacggcagcatctggccgacaccatcatcagcatcagcaccagcaccagcaccagcaccatagcaactacagtcttagcctcacactagaaaacaaagaaggtccccttcgatcccccaactctagttcaaagtctctgaccaaattgagtcctgggacaccagccctgttcagcgaagctgccgctcacctaaaaaagctggagctggaaacagtcaaggccgcgggcccctggccccctctccatattaacatcaacaaagcggaagaaaaaaaggtgtctgagaaaaccctgcagactccattgctcccaagccctgtggcggaccatgtgaaatgcaacatcctcaaagctcagctggaaaatgccagtcgggtgaacatccaagggggtaaagaagagagtccctttgtgaacataaacaaaaaatcttccctgcaggatgcctccgttcggtcacccattcctattcgagtggagactgctcaaccagccgtcgaaaagcctgagataaaacccccacgagttcggaaactgacccggcagtactccttcgacgaggacgatctgccgcctgacctggcggaggcagtgggagtcactacctcaactacaactaatacgactacggcagcgacacaggtctctgttccactaccgtctccaaaagtgcagaacgtatcatctccgcataaatccgaggggaaaggactcctcagccctggggccaagtcccccagcgaccgtggaggtgcttttacactggaacccggtgacctcctgatggacttcactgaggcaactccactcgccgaacctgcgtcaaacccacactgtgctcactctaggtgtagtcctcctctttctctccctatgaaagaggagaccacgggcgtctgtatgtacccgccaattaaaactcgcctcattaagaccttcccggtagatactatgaatcctttccctgatacatttactaccggccctcagttcaccgcggattttcgggactcaaagctgcagtgctgtcctgggcccactagccctttaataccagccgctacccttcgcccactcactgagacagtacacagcgccgaccacctccatcaccccgaaacttgcttctccggcagccagtgccgcgataccccggccggtacaggagagcgcgaggatgacgagaaaactgtcgacgaccgtacagtgaagttctccccctgtcacctggaagacggcatggtgccctccgtgcgactcctaagtagcggttttgtatgcagcttgtag

SEQ ID NO: 186796 - DNA, 1323 bp, Artificial Sequence
  Description of Artificial Sequence: Synthetic coding sequence
atgaagttcctgctgatcaaggacgcccccggcaagaagaagcggaagaatctcatgctttccttcaaacggaaacacgccaagggacaggacctgtttgaccagatagtataccacctcgatctcgtggaaactgattatttcggcctgcagtttctggactcggctcaggtagcccactggctggaccacgctaaacctattaaaaaacagatgaagatcgggccagcctatgcgctgcatttcagagtgaagtactattccagcgaacctaacaaccttcgtgaagagtttaccaggtatttgtttgtgctacagctgagacatgatatcctgagcggcaaacttaagtgcccttacgaaaccgccgtggagttggctgcactttgcctgcaggcggaacttggcgaatgcgaacttcccgagcatacgccggagctagtgtccgaattccgctttatcccaaaccagacagaagccatggaatttgatatttttcaacgttggaaggaatgtcgcggaaaatcccccgcccaggctgagctgagctacctgaacaaagccaaatggctggaaatgtacggagtagacatgcatgtcgtccgagggcgggatggctgtgagtactcactcgggctaacgcctacaggcatcctgatcttcgagggagctaacaagatagggctattcttctggcccaagatcacaaagatggactttaaaaagtctaaactgaccttggttgtagtggaggacgatgatcagggacgcgagcaggaacataccttcgtgttccgtctggactctgcgagaacttgcaaacacctgtggaagtgtgccgtggaacaccacgcattcttcaggcttcgcacgcccggcaattctaaatctaataggagcgattttatcaggctcggaagtaggtttcgattttcagggaggaccgaatatcaggcaacccatggttcccgccttcgacggacatccacattcgaacgtaaaccatctaaaagatacccttcacgtagacatagcaccttcaaggcaagcaaccctgtgatagcagcccagctatgctccaagaccaaccccgaagtgcataactaccagccacaatatcatcctaatattcatccgtcacagccacgctggcacccccactcccccaacgttagacctagttttcaggacgacagaagtcactggaaagccagtgcctctggcgatgatagtcattttgattacgtgcatgaccagaaccagaagaatttgggtggaatgcagtcaatgatgtatagagacaagctgatgaccgcactatag

SEQ ID NO: 186797 - DNA, 1557 bp, Artificial Sequence
  Description of Artificial Sequence: Synthetic coding sequence
atgctgcggttcctgcggcggaccttcggccggcggagcatgcagcgttatgctagaggcgccgccgggcggggcgccgcaggcctaggcgatgaaagggatggcgggcccaggggcggacctgcagccgccgcctccagcagcgcccttcctgccgcccctggcggcagcgtgttccctgccggaggcggaccgcttctgaccggaggagcggccgtccacatttccgctgccggggccgcaaaagccaccctgtactgccgggttttcctgttggatggtactgaagtatcagtggacctgcccaagcatgctaaaggtcaggacctatttgaccagatcgtctaccacctagacttagtcgagactgactattttggcctgcaattcttggactcagcccaggtcgcacattggttggatcatgctaaaccaatcaagaagcaaatgaaaatcggaccggcgtatgcgctacattttagagtaaagtactattcttccgagcccaataatctgcgggaggagttcacccgttacctgtttgtgctgcagttgcgccacgacatcctgtcagggaaactgaaatgcccctatgaaacggccgtagagctggcagctttatgcctgcaggcagagcttggcgaatgcgaactcccagagcataccccggaactggtgtccgagttccggtttattccaaaccagaccgaagcgatggagtttgacatcttccagaggtggaaagagtgcagaggcaagtcccccgcccaggctgagctgtcctatcttaataaggctaaatggctagaaatgtacggagttgatatgcacgtggtgaggggccgtgacggctgtgagtactcgttaggcctcacccccaccggaatcctcatcttcgagggggcaaataaaatcggactttttttctggcccaagatcaccaagatggattttaagaaatccaagttgaccttagtggtcgtcgaggacgacgatcagggcagggaacaggagcacacgttcgttttccgcctggattccgcaagaacttgcaaacacctgtggaaatgcgccgtcgaacaccatgctttcttcagactgaggacacctggaaactcaaagtcaaaccgatccgacttcatcaggctcggttcaaggttccggttttcaggtcgcacagagtaccaggcgactcatggctcccggctgcgccggacctctacctttgaacgtaagccatcaaagaggtacccttcaaggcggcatagcactttcaaggcttcaaaccccgtgatcgctgcacagctgtgttctaagacgaacccggaagttcataattaccagcctcaatatcatccaaatattcatccttcccagccccgctggcatccccacagtccaaatgtccgcccctcctttcaggacgaccgtagccattggaaggcctcagctagcggggacgactctcacttcgactatgtccacgaccaaaatcaaaagaaccttggcggaatgcagtcaatgatgtatagagataaactgatgacagctctttag

SEQ ID NO: 186798 - DNA, 2703 bp, Artificial Sequence
  Description of Artificial Sequence: Synthetic coding sequence
atgctgcggttcctgcggcggaccttcggccggcggagcatgcagcggtatgctaggggagccgccgggcggggtgctgctggcttaggcgatgaaagggacggtggcccccgggggggccctgctgcagctgcctctagtagcgccttgcctgctgcaccaggaggctcggtcttccctgccggtggaggccctctgctcactgggggagcggccgtccacatttcggctgcgggggccgccaaagctacactgtattgtagagtcttcctcctagatgggactgaagtgagcgtagacctgcccaaacacgctaagggacaggatctattcgaccagattgtttatcacctggatctcgtggagacagactatttcggactgcagttcctggactccgcgcaggttgcccattggttggatcacgcaaaacctataaagaagcagatgaaaattggcccagcctatgcgttgcacttcagagtgaagtactacagctccgaacccaataacctgagggaggagttcacaaggtacctttttgttctgcagcttagacatgacattctgtccggcaagctgaaatgcccttacgaaaccgccgttgaactggccgcactgtgtttgcaggcagaactgggagagtgcgagctgcctgagcacacacccgaattagtgtctgaatttcgttttattcctaatcagaccgaagccatggagttcgacatatttcagagatggaaggaatgccggggcaaaagtccggcccaagccgagttgtcctatctgaataaggctaagtggctcgaaatgtacggcgttgatatgcacgtggttcgaggccgcgacggctgtgagtatagtctggggctgacacctaccggcattttgatctttgagggggcaaataagattgggctgttcttttggccaaagataacaaaaatggattttaagaagtccaagctcacactggtggtcgtggaggacgatgatcagggccgagagcaagaacataccttcgtgttccggcttgattccgctcggacatgtaaacatctctggaaatgtgccgtagagcaccatgcctttttccgtctgcgtactccaggaaacagtaaatctaacaggtctgattttatccgccttgggagcaggtttcgattttccggacgcacagaataccaggcaacccacgggagcagattgaggcgaacctccaccttcgagaggaagccctccaaacgctatccctcccgccgccactcaacctttaaagcaagtaatcccgtgattgccgctcagctctgctctaagactaatcccgaggtgcacaattatcagccacaataccatccaaacattcacccttctcagccacggtggcatccacactcgcccaacgtgagttatcctctgccaagtcctgttctgagcagcagcgacaggctgccctttggaatcgaggagaacggcggaaccccctttcttacagctgcatctgggcgccaccaccaccaacaccagcaccagcatcagcatcagcaccactcaaactacagtcttagcctgacccttgagaataaggaggggcccctccgaagtccaaactctagttcaaagagcctcaccaagctctccccagggacccccgcacttttttccgaggccgcagcccatctaaaaaagctcgaactggaaacagtaaaggccgctggtccctggccacccctgcatatcaacatcaacaaagcggaagaaaagaaagtgtcagagaaaacactgcagactccactgctgccgtcccccgtcgctgaccatgtgaagtgcaacattctcaaagcacagctggaaaatgcctctcgagtaaatattcaaggcggcaaagaggaatccccatttgtaaacattaacaagaagtctagcctgcaagacgcaagtgtgcggagtcccatacccattcgcgtggaaactgcgcaacccgccgtggagaaaccagaaatcaaacccccccgagtgaggaaactgactcggcagtattcctttgacgaggatgacttgcctcctgatctggctgaggccgtgggagtgacgaccagcaccacgaccaatactactaccgctgcaacccaggtgtctgtgcccctgccttccccaaaggtgcagaacgtgtcctccccccacaagtcggagggaaagggcctcctgtctccaggggccaagtctccgtcagatcgcgggggtgcatttactctggagcccggtgatctcctgatggatttcaccgaagctacacctttagctgagcccgcttccaacccccactgcgcgcactcccgatgcagccctcccctgagcctgccgatgaaggaagagacaacaggagtgtgcatgtatcccccgatcaagacgcgtttaataaagacctttccagtagacacaatgaatccattcccggacacttttacgaccggtccacagtttacggcagacttcagggattcaaaacttcaatgctgtcccgggcccacttctccgcttattccagcagccacgctgaggcctctgaccgaaaccgtctccactgtgcagaccatctacactacccgcaaacccgtctctctcgctgcttccgcagagacactgaggcaggagctcgaacgggagaaaatgatgaagaggctgcttatgacagagctttag

SEQ ID NO: 186799 - DNA, 2202 bp, Artificial Sequence
  Description of Artificial Sequence: Synthetic coding sequence
atgctgagcttcttccggcggaccctgggccggcggagcatgcggaagcatgccgaaaaagaacggttgcgggaagcacagagagccgccacacatattcctgcagccggcgacagcaagtccattatcacttgccgggtgtccctactcgatggtaccgacgtttcagtggatttacctaagaaagctaagggacaggagctctttgaccaaattatgtatcacctcgacctgatagagagtgattacttcggcttacggttcatggactccgcccaagtagcccactggctggacggcactaagagcatcaagaaacaggttaagatcgggtcaccttactgccttcatctcagagtgaaattctactcctccgaacccaataatctccgggaagagctgaccagatatctcttcgtcttacagctcaagcaagatatcctctctgggaaacttgactgcccctttgacaccgccgtccagttggccgcatacaacctgcaggcagaactgggcgattacgatctggcggagcactcgcccgaactggtctccgaatttagattcgtaccgatacagaccgaagagatggagctcgcaatctttgagaagtggaaggaatatagaggccaaactcccgcccaggcggaaactaattacctgaataaggcaaaatggttagaaatgtacggggtggatatgcacgtggtcaaagctcgcgatgggaatgattacagcctaggtcttacacctacaggagtgctcgtgtttgaaggagatacaaaaatcggactcttcttctggcctaagatcaccaggcttgactttaaaaagaacaagttaactttggttgtcgtggaagacgacgaccagggtaaggagcaggagcacacatttgtgttcaggctagatcatcccaaggcttgtaagcacctgtggaaatgcgcagtggaacatcatgcattttttcgattacgcgggccagtacagaagagctctcataggtcaggctttatcagactgggtagccgtttccgctacagcggaaagacggaataccagaccacaaagactaacaaggcccgacgttccacaagctttgaacgtagaccttccaagcgctacagccgcagaaccctgcagatgaaagcgtgtgcgacaaaacctgaagagttatccgtacacaataacgtgtctactcagagtaatggatcacagcaggcgtggggaatgcggtctgcgctgcccgtgagcccctcgatttcatctgcccctgtacctgttgagatcgagaacctgccacagtcacctggaactgaccaacatgatcgcaaatgtatccctctgaacattgatttgttgaacagtcccgatctcttggaagcgactatcggggacgtgataggagcttccgataccatggagacgtctcaagcactgaacgacgtgaatgtggctacacgcttgccaggcttgggagagccggaggtagagtacgaaacattgaaggatacaagtgaaaagttaaaacagttagaaatggaaaactcaccattgctctccccacgaagtaacattgacgtgaacatcaactcacaggaagaagtcgtaaaactgaccgaaaaatgccttaataacgtcatcgagtcacccggcctaaatgtcatgagagtgccacccgacttcaaatccaacatcttgaaagctcaggtggaggctgtgcataaagtgaccaaggaggatagtcttctctcgcacaagaacgccaacgtccaagatgccgctacaaacagtgccgtcctcaatgagaacaacgtgcctttacccaaggagtcacttgagactctgatgttgatcactccagctgattctggaagtgttttgaaagaggccaccgacgaattggatgcattgcttgcctcattgacggaaaatctgattgatcacactgtcgcaccacaggtgtcttccacctcgatgattacccccaggtggatagtgccccagagcggagctatgagtaacggcctggccggctgcgagatgctcttgactgggaaagagggccacggaaataaggacggcattagcctgattagtccacccgcacccttcttggtcgacgccgtgacctcttctgggcccatacttgccgaggaagcagtgctgaaacagaagtgcctgctcaccacagaactctag

SEQ ID NO: 186800 - DNA, 1518 bp, Artificial Sequence
  Description of Artificial Sequence: Synthetic coding sequence
atgctgagcttcttccggcggaccctgggccggcggagcatgcggaagcatgccgaaaaagaaaggctacgagaagctcagcgagccgcaactcacattccggccgcaggagactcgaagagcattatcacctgtagagtaagtttacttgatggcacggatgtgagcgtggacctgcccaaaaaggcaaaaggccaagagttattcgaccagatcatgtaccacttagacctgatagaatccgattattttggactgcgctttatggactccgcacaagttgctcactggctagatggcacgaaatctatcaagaagcaggtgaaaatagggagtccttactgtctccaccttcgagtcaagttttactcttctgaaccgaataatcttagagaggaactgaccagatatctcttcgtgcttcagttgaagcaggatatcctgtctggtaaactggactgcccctttgacaccgccgtacagctcgcagcgtacaacctacaggccgaactgggtgactacgacctggcggaacactcacccgaactcgtgtcagagttccggtttgtgccgattcagacagaagagatggagttagccatcttcgaaaaatggaaggagtaccgcggtcagactcctgcacaggcagaaacgaattatttgaataaagctaaatggctcgaaatgtacggcgttgacatgcatgtggtaaaggcaagagatggcaatgactacagcctgggccttacccccaccggggtgttggtgtttgaaggggatacaaaaatcgggctatttttctggcctaaaatcacgagactcgattttaaaaagaataaactaacactggtagtagtcgaagacgatgaccagggaaaagagcaggaacacacctttgttttcagactggaccatcccaaagcctgcaagcacctgtggaaatgtgctgtggagcatcacgctttcttccgccttcggggaccagtgcagaaaagcagtcaccgctcgggctttattagattgggctcacggttccggtactcaggcaaaactgaataccagaccaccaaaaccaacaaagctagacgaagcaccagctttgaacggagaccgtccaagagatattccagacgaaccttgcagatgaaagcctgcgccaccaagcctgaagagttgtccgtgcacaacaatgtgagtacccagtcgaatgggagccaacaggcatggggaatgagaagtgccttgcccgtgtcaccctccatcagtagtgctcctgttcccgtcgagatcgaaaatctgccccaatcacccggaacagaccaacacgacaggaagtggctgtcagctgccagtgactgctgccagagagggggcaatcagtggaacactcgggctttaccaccgccgcagaccgcccacagaaactataccgacttcgtgcatgagcataatgtgaagaatgcggggatccgccatgacgtccacttccctggacacaccgcaatgaccgagatatag

SEQ ID NO: 186801 - DNA, 1518 bp, Artificial Sequence
  Description of Artificial Sequence: Synthetic coding sequence
atgctgagcttcttccggcggaccctgggccggcggagcatgcggaaacatgcggaaaaggaaagactgagggaagctcaacgcgcggccacccatattcccgcagccggagactcaaaatccataatcacatgtcgggttagcctgttagatgggacagacgtgtccgtcgacctaccaaagaaagcaaaagggcaagagctgttcgatcagattatgtaccacctggatctgatagaaagtgactattttggcctgcgattcatggattctgcacaagtcgcgcactggctcgatggaactaaatctatcaagaaacaggtgaagatcggttccccctactgtcttcacctgagagttaaattttacagttcagagccgaataacctgagggaggagctcacaagatatctcttcgtgctccagctgaagcaggacatcctgtctgggaagctggattgccctttcgataccgcagtgcagttggctgcatacaatctgcaggccgagctaggcgattacgatttggctgagcattctccagagctcgtgtcagaatttagattcgttcccatccagaccgaggagatggaacttgctattttcgagaaatggaaagaatacagggggcaaactcctgcccaggccgagaccaattatctcaacaaagccaagtggctcgagatgtacggtgtggatatgcacgttgtcaaggctagggatggtaatgattactccctgggtctgactcccacgggggtcttagtcttcgaaggagatactaaaatcgggctgtttttctggcctaagattacacgcctcgactttaaaaagaacaaactgactctcgttgttgtcgaggacgatgaccaggggaaagagcaggagcatacatttgtctttaggctggaccatcccaaagcgtgcaagcacctgtggaaatgtgctgtagaacaccacgcttttttcaggctaagaggacccgttcagaaatcttcgcaccggagcgggtttatacgcctgggcagccgattcaggtactctggcaaaaccgagtatcaaaccacaaagacaaataaagcgcggcggagcacgagctttgagagaagaccaagtaagaggtattctagacgcactctccagatgaaagcctgtgccaccaaacccgaggagctgtcagtgcacaacaatgtctccactcagtcgaacggttctcaacaggcatggggcatgcgttctgccctgcccgtcagcccctcgattagctccgcgcccgtccctgtcgagatcgaaaacttgccacagagtccagggaccgatcagcacgatcgtaaatggctgagcgcagcgtccgattgctgccaacgtggtggcaaccagtggaatacacgcgccctccctccacctcaaacagcccatcggaactacactgactttgttcacgagcacaatgtgaaaaatgcgggtatccggcacgacgtgcacttcccgggccacacagccatgactgagatttag

SEQ ID NO: 186802 - DNA, 2064 bp, Artificial Sequence
  Description of Artificial Sequence: Synthetic coding sequence
atgctgagcttcttccggcggaccctgggccggcggagcatgcggaagcatgccgagaaagaaaggttgagagaggcacaaagggcagcaacacatattccagccgcaggtgactccaagtccatcattacctgccgcgtttcattgttagacggaacagacgtgtccgttgatcttcccaaaaaagccaagggacaagaattgttcgatcaaataatgtaccatttggatctgattgagtcagactatttcggcctgaggttcatggattcagcccaggtggctcactggctggatggcacgaagtctattaagaagcaggttaaaatcggaagcccctactgtttgcatctacgggtgaaattttactctagcgaacctaacaacctgagagaggaactgaccagatatctgtttgtgctccagctgaagcaagatatattatcgggcaagcttgactgcccttttgacaccgccgtgcagttggccgcgtataacttgcaggccgagctgggcgactacgatctggcagaacattcaccagagctggtgagcgaatttcggtttgtccctattcagaccgaggaaatggaactggccatcttcgaaaagtggaaggaatatagaggccaaactccggctcaggcagaaaccaactacctaaacaaagccaagtggcttgagatgtacggggtggatatgcacgtcgtcaaggcacgtgacgggaatgattattccttaggattgactcctacgggggtcctggttttcgaaggggataccaaaataggtctgttcttctggccaaagatcacaagacttgacttcaagaagaacaaactcactttggtcgttgtggaagatgacgaccagggcaaagagcaggagcacaccttcgtgttccggttagatcatccaaaggcttgtaaacacctgtggaagtgtgctgtcgaacaccacgcattcttccgtctcagaggacctgttcagaagagcagccataggtcgggcttcatccgcctgggctccagatttcggtactccggcaagacagagtaccaaacgacgaagacaaataaggcacgacgatccacatcttttgagcggcgcccaagtaaaaggtacagccgtcggaccctccaaatgaaagcctgcgccactaagcccgaagaattaagcgtacacaacaatgtgagcactcagagtaatggtagccagcaagcatggggaatgcggagtgccctacccgtcagtccatctatttctagcgccccagtccccgtagaaatcgagaacctgccccagtcgccgggcaccgatcagcacgatcgtaagtgtattccgctgaacattgaccttttgaactcccccgatctgctcgaggccacaattggagacgtcatcggtgcctctgacacaatggaaacttctcaggcactgaatgacgtgaacgtcgctacacgcctaccggggctgggcgagcccgaggtggagtatgaaaccctaaaagatacaagcgagaagcttaagcagctggagatggaaaattcaccgcttctgtcgccccggagcaacattgacgtgaatattaatagccaagaagaagtagtgaagctcacggaaaaatgccttaataatgtgattgagagccccgggctgaacgtgatgcgtgtcccaccggacttcaagtccaatattctgaaggcacaggtcgaagctgtgcataaagtaaccaaggaagactccctgctctcacacaagaacgcgaacgtgcaggatgcagctactaacagcgccgtgttgaacgaaaataacgtacccctgcccaaagagtcactggaaacacttatgctgattacacccgcagattccggttctgtgctaaaggaagctaccgacgaactggacgccctcctggctagcttaaccgaaaacctgatcgatcatacggtggctccccaggtttctagtacttctatgattacccctagatggattgtgcccctgtggtctcactttggtcgccggagctgtcctgaggccgaagtgttcactgaccactag

SEQ ID NO: 186803 - DNA, 2199 bp, Artificial Sequence
  Description of Artificial Sequence: Synthetic coding sequence
atgctgagcttcttccggcggaccctgggccggcggagcatgcggaagcatgcagagaaggaaagactacgagaggcgcagagggccgcaactcacatacctgcagctggggactccaaaagtatcattacttgcagggtgtctctgctcgacggaacagacgtctcagtagacctgccgaagaaggctaaaggccaggagctctttgatcagatcatgtaccatctcgaccttatcgagagtgactacttcggactcaggtttatggattctgcccaggttgcacactggctcgatgggacaaagtctatcaagaagcaagtgaagatagggagcccgtactgcttgcacctgcgagttaagttttacagttcagagcctaacaatctgcgggaggagctcacacgatacttgtttgtgctccagctgaaacaggacatactgtccggtaaactcgattgtccttttgacactgcagtacagctcgccgcatacaacctgcaggccgagctgggagactatgatttggctgaacatagtccagaactggtgtcagaattccgcttcgtgcccatacaaaccgaagagatggagttggccatttttgaaaaatggaaagagtaccggggtcagacacctgcccaggccgagacaaactacctcaacaaggcaaagtggttggaaatgtacggtgtcgacatgcacgtggtgaaggcccgagatggaaatgactattctcttggcctcactcccaccggagtcctggtatttgaaggagatacgaagatcggcctgttcttctggcctaagatcacccgactcgactttaagaaaaataaactcaccttggtggtcgtcgaggatgacgatcagggtaaggagcaggaacacacctttgtgttcaggctggatcatcctaaggcttgtaaacacctgtggaaatgtgccgtagagcaccatgccttcttccggctccgaggcccagtccagaaatccagtcatcgctcagggttcattcgattaggcagccggtttcgctactcaggcaaaactgaatatcagactaccaagacaaacaaagctcgacggagtaccagtttcgagcgtcgtccgagcaagagatattcacgtcggaccctgcaaatgaaagcgtgcgctacaaagccagaggaactctcagtgcataacaacgtaagcacccagtcaaacggttcccagcaagcctgggggatgcggagcgctctaccggtgagcccgtcaatctctagtgctccagtgcccgtcgagattgagaacctgcctcagagtcctggtacagatcagcacgacagaaagtgtatccccctgaatatcgacctgctgaactcaccggacctcctggaagcaaccattggagatgtgatcggcgcttcagacacaatggaaactagccaggctcttaacgatgttaatgtggccactcgtttgcctgggctgggcgaaccggaagtagaatacgaaaccctcaaggacacctcagaaaaactgaaacaactggagatggaaaactcccccctgcttagcccccgtagtaatatcgatgttaatattaattcccaagaagaggttgtgaagctgacagagaagtgtctgaacaacgtgatcgagagtcccggcttgaatgtgatgcgagttcctcctgacttcaagtctaatatcctgaaagcgcaggtagaggccgtccataaggtcacaaaggaggactcactgttgtcacacaagaatgctaatgttcaggatgccgccactaacagcgccgtcctgaatgagaacaacgtccctctccctaaagaatcactggaaaccctgatgctaatcacccctgcagactcgggcagcgtacttaaagaagccacagacgaactggatgccctccttgcttcactgactgagaacctgattgaccataccgtcgcaccacaggtgagtagtacttccatgattacccctcggtggatcgtaccttctggagctatgagtaacggcctcgccggctgtgaaatgctcctgacaggcaaagagggacatggtaacaaggacggaatcagcctgatcagcccccccgcaccttttctcgtggacgccgttacctctagtggccccatcttagccgaggaggccgtccttaagcagaagtgcctcctgacaacagagctgtag

SEQ ID NO: 186804 - DNA, 2340 bp, Artificial Sequence
  Description of Artificial Sequence: Synthetic coding sequence
atggaggagaaggactacagcgaggccgacggcctgagcgagcggactactccaagcaaagcccagaagagtcctcagaaaatcgccaaaaagtataagagcgctatctgcagggtcacactgttggatgcttccgaatatgagtgcgaagtggaaaagcacggccgtggtcaggttctctttgaccttgtatgcgagcatctgaatctcctcgaaaaggattattttggattaactttctgtgacgccgattctcaaaagaactggctggaccccagtaaggagatcaaaaagcagattcgatcaagcccttggaattttgcatttaccgtgaagttctacccacctgatcccgctcagcttaccgaggatatcactcgctattacctgtgtcttcagctgcgggccgacataattaccggacgactgccgtgtagcttcgtgactcatgcgttgctggggagctacgcagtgcaagcggaactcggtgattatgatgccgaggagcacgtgggcaactatgtctctgagttgagatttgcgccaaatcagacccgggaattggaggagaggattatggagctgcacaagacatatagggggatgactcccggagaggctgaaatccacttccttgagaacgctaagaaactgagtatgtatggcgttgacctacatcatgctaaagacagtgagggcatcgacatcatgttaggcgtctgcgctaatggcttgctgatttacagggatcgcctccgcatcaataggtttgcctggccaaagatcctgaagatttcttacaaacgctccaacttctatatcaagatccgccccggcgaatacgagcagtttgagtctactataggctttaagctgcctaaccataggtccgctaagagactttggaaggtatgtatcgaacaccacaccttttttcgcctagttagcccagagccacccccgaagggctttctggtgatgggttcaaaatttaggtatagcggcaggactcaggcgcaaaccaggcaagcttctgctttgattgaccgccccgcacctttctttgaaagatcaagttccaaacgctacactatgtctagatctcttgatggtgctgaattctcccgccctgcttccgtgtctgagaatcacgacgccgggcctgatggcgataagagagatgaagatggagaatcagggggccagcgctcagaagctgaggagggcgaggtacggacaccgaccaaaattaaagaactgaaatttctggacaaacctgaggatgtgttgttgaaacaccaggcgtcgatcaacgaactgaagaggacactgaaggaaccgaatagtaagctaatccacagggaccgcgactgggaaagggaacgccggctgccttcatcacctgcctctccttcccccaaagggactcccgagaaagcaaacgagagagctggactgagagaaggttccgaggagaaggtgaagccaccacggcctagagcacccgaaagtgacacgggtgacgaagatcaagaccaggagcgggacaccgtgtttctgaaggacaaccacctggctattgagagaaagtgcagctcaattacggtgtcatcaacttcatcactagaggccgaggtggatttcactgttatcggggactaccacggaagcgcctttgaagacttcagccggtcactccccgaactcgatcgtgataagagcgacagcgatactgagggacttctgttttctcgagacctgaataagggtgctccatcgcaggacgatgaatcaggtggcattgaggacagtccagaccggggagcctgctccacgcctgacatgccacaatttgagccagtgaaaaccgagactatgactgtgtcctctctcgcaatacggaaaaagatagaacctgaagccgtgctgcaaaccagggtttcagcgatggacaacacccaagagaactctctgaagtcaggaaagggagccgccgccatgatcccgggccctcaaactgtcgcaacggagattcggagcctgagtccgatcatcgggaaagacgtgttgactagcacctatggcgccactgctgaaacacttagtacatccaccactacccacgtgactaagactgtcaagggtggtttctccgagacacgcatagaaaaacgtatcataatcaccggcgatgaggatgtggaccaggatcaagccctggccctggctataaaagaggccaagctgcagcatcctgatatgcttgtgacgaaagctgtggtgtacagagaaactgacccatcccctgaagagagagataaaaagccgcaggaaagctag

SEQ ID NO: 186805 - DNA, 2646 bp, Artificial Sequence
  Description of Artificial Sequence: Synthetic coding sequence
atgaccaccgagaccggccccgacagcgaggtgaagaaggcccaggaggaggcccctcagcagccagaggcagcagccgctgtgactactcctgtgaccccagcgggccacggccacccagaagcaaattctaatgagaagcaccctagccagcaggatacccggcccgcagagcagtccttggacatggaggagaaggactatagcgaggctgacgggctcagtgagcgcacaactcccagcaaagcccagaaaagtcctcagaagatagcaaaaaagtacaaatccgcaatctgccgtgttacactactagacgcaagcgagtatgagtgtgaggtggagaaacatggacgcggacaggtcttgtttgacctggtgtgtgaacacctaaatttactggaaaaggactatttcgggttgactttctgtgacgccgattcccagaaaaactggttagacccttctaaggaaattaagaaacaaattcggagctctccctggaatttcgcttttacagtgaagttctatccacctgaccccgcccagttaactgaggacatcaccagatattacctttgccttcagctcagagccgacattatcacaggcaggttgccatgttcctttgtgacccacgctctgctggggtcttacgccgtccaagcggagctgggcgattacgacgcagaggagcacgtgggcaattacgtctctgaactgagatttgctcctaaccaaacgagagagctcgaggaaaggatcatggaactgcacaagacttatagaggaatgacacctggggaagctgaaattcacttcttggaaaatgccaagaaactgtctatgtatggagtggatcttcatcacgccaaggatagcgaggggattgacattatgctgggagtgtgtgccaacggacttctcatctatcgcgacaggcttagaattaaccgctttgcctggccgaaaatattgaagatctcttacaagcgctctaacttctatatcaagattcgcccaggcgagtatgagcagtttgagagcaccataggcttcaaactgcccaaccataggtctgcaaagcggttgtggaaagtgtgtatcgaacatcataccttctttaggttagtgtcgccagagcctccacctaagggcttcttggtaatggggagcaagtttcggtattcaggccgcacccaagcccagactcgtcaagccagtgctctgatcgacaggccagcccctttcttcgagcggagcagcagcaagagatacacaatgtcaaggagcttggatggagctgagttcagccggccagcttctgtctccgagaaccacgatgccggtcccgacggcgataagcgcgacgaggatggggagtctggaggccaaaggtccgaggcagaagagggtgaggtgcggactccgacgaaaataaaagaactgaagcctgagcaggagacaactccacgccacaaacaagaatttctggacaagcccgaagacgtcctcttaaaacatcaagcctcaatcaatgaattgaaacggacactcaaagagccaaattccaaactgattcatcgggatagagactgggaacgggagcgacggttgccgtcctcccccgcttcacctagccccaaggggacccccgaaaaggccaatgagcgggctgggttacgggagggctccgaagaaaaggttaagcccccaaggccgcgagcgccagagtctgacacaggagacgaagaccaagaccaggagagggataccgtgttcttgaaggataatcatcttgctatcgagcggaaatgcagttccattaccgtgagcagcacctcctctctggaagcagaggtggacttcaccgtgatcggagattaccacggcagtgccttcgaggacttctctcgcagcctcccggagttggaccgcgataaatcggatagcgatacggaggggcttctattttctagagatttgaataagggggctccctctcaggatgacgaaagcggaggtatcgaggacagtcccgacagaggggcatgttcaacaccagatatgccccagttcgagcctgttaagacagaaacgatgacagtctccagtcttgccattcgaaagaagatagagcctgaagccgtgttacagaccagggtcagcgctatggacaatactcaacaggtcgacggctctgcgtccgtgggtcgagagttcatcgccacaactccctccatcaccaccgagacgatctctacaaccatggagaactccctgaagagtggaaagggggcagcggccatgatccccggaccccagaccgtggctacggagatcaggagcctttcacccattatcggtaaggacgtattaacctctacctatggggccactgccgaaaccctgtccacatctactactacccacgtgaccaagaccgtgaagggtggattctccgagacccggatcgagaagcgcattatcattacaggagatgaagatgtggaccaggaccaggctctggcattagccataaaggaggcaaagctgcaacacccagacatgcttgtgaccaaggccgtcgtgtacagggaaacggatccctcccccgaggagagagataagaaaccacaagagtcatag

SEQ ID NO: 186806 - DNA, 2877 bp, Artificial Sequence
  Description of Artificial Sequence: Synthetic coding sequence
atgagccggagcctggacggcgccgagttcagccggcccgccagcgtgtcagaaaatcacgacgctggcccagacggggacaaacgtgacgaagatggggagagcgggggccaaagatcagaagcggaggagggcgaagtaagaacacctaccaagatcaaggagttgaaacctgagcaagagacgactcccagacacaaacaggagttcttggataaaccagaggacgtgctcctgaaacaccaagccagcattaatgagctgaaaagaacgttgaaagaaccgaacagtaagctcatccaccgtgatagagattgggagcgcgaacgaaggcttcccagctcccctgcctcacctagcccaaagggcacaccagagaaagcaaatgagtcccaacgaacgcaggatatttcccagcgcgacctggttcccgagcctggggctgcagccggtttggaggttttcactcagaaatctttggccgcttccccagagggatccgagcactgggtgtttatcgagcgggaatatactaggccggaggagctcggccttctcaaagtgactaccatgcagcaggaggaacgccaagctggcctcgccgggattctggcaaacgggaggctatcaaaggtcgatgtgctagtggataagttcaaggttgaggtggcaaccgaggaaatggtggggaatagaagagcgaatactcaacagcaaggaaagatgatcgcctctccagaagattttgaatcagtgggagaggaaggtccttggataagagaatcaccaggaggagcagctttagcaagtgggagaaccttggccgaaaagctgctcgaaggttcagagctgagggccgacacccgggaggctaccatccggaaccggtgcatgagcgacgggcaaccagaggggcagaccgaattacggaaaggtttggaagagcctcacacgtgtggacggccgacggcccccggtacaaggcctgcagaagtggacgtcctgtccccggcctccgacaagggtggactgcaatcttttctgcttgaccctgcccatgctgaagctcgcgcggaactcagtaatgaaactgatactagctttgccgagcgaagcttctatcttaactacgaggagaaggattccgaagaccaggttctccctccacccttggaagagcgcaaaggtcgcttggacgcccccccagggggtgagcctcgtccaacccttaactctttagacctgcgggtgtctgcagccgcatcttcccggtcgaaggatgaggcccatatgacgagccccaaagaaggggccgggacccctaagaaccacggtggccctggcgacttgaaggggtccccggccggtcagacattcgctgagggatgggaggacgcgcagtggggagtagaaggagagtttccccacctgactgcctctgctgcaagggaggagggcactcctgttagtggcgacttactcggcaaggccgaggagagccccacagaggagttaaagaagcatcctccccaccggggccaaggcgtgcacccagatccccaggcctgcgcactgccccgggcaattcccctcaacgttcgcaagccagtcaaaccagaccggggaaactttccaccaaaggaacggggagtggttcccacacaaaaggggggagcagagttaaaggaccgcgaggcctcagccttcctgcacatggaagtgattatccctctcccggcttcacccggacatagtgaggacttggctgccttggaggaggccagtccttccccaaccagtcatggctctggggagccaagcgagctgcgagagccattcctgaggcatgtacatctcagcaaagcttcaccagagcctaaggaccaggtcgggttcgtagtatcacccgcaaccggaggggaaagacggcctcctccaattacttctaggaagccaagggttgtccccgaggaagcggaaggacgaattcccctgggctttggtttccctagcggaaaacgccgcgaaatgactagcttccaggcaggggatcaagaaggaagcttagaggacatctccaaaacatctgtggccaacaagatccgtatatttgaaacccatggcgctgagaccagaaggatgtcggaaggcgaggcccgaagcctgcccaacgatgtttcatccgaggcgccagtaggtcaggctgaacagcagcgtagtacgttgagcgatctgggcttcgcccagctacaaccgcctggagatttcgcctctcccaaggcaacgcactctaccgttatccccctcgcgactcgacactttagggaggacaccagtgccagctatcaggaagcccacaccgaactcgagcccgtttctccaaacagcggatgtgaaactacactggctgaggctactggcaccggaaacaaatcaggggacgctgtgagggaggaaaagcggagcaccaacctggcagccaatacgcctggaaaaggagggagactgcgcttcgcctcccccagtgggccacaaagagcagggcttcgggaaggctccgaggaaaaggtgaagcccccccgcccacgagcaccagagagtgacacaggggacgaggaccaagatcaggaacgggatactgtttttctcaaagacaatcacttggccattgagcgtaagtgtagctctatcaccgtgtccagcacttcgtctctagaggccgaagtggacttcacggtgataggcgattaccatggatcagcttttgaggattttagtaggtccctgcccgaacttgaccgcgacaaatcagattctgatactgaaggattgttatttagtcgcgacctgaacaaaggtgcaccaagtcaggactag

SEQ ID NO: 186807 - DNA, 2643 bp, Artificial Sequence
  Description of Artificial Sequence: Synthetic coding sequence
atgaccaccgagaccggccccgacagcgaggtgaagaaggcccaggaggaggcccctcagcagccagaggctgcggccgctgtcacaacacctgttactccggccggccatgggcatccggaagccaattcaaacgagaaacatcccagtcagcaagacacccggcccgccgagcagtcactggacatggaagaaaaggattactcagaagcagatggcctgtctgaaaggacaaccccaagcaaggcccagaagtccccccaaaagatcgccaagaagtacaaatccgcgatttgccgggtcacattgctcgatgcgtccgaatacgagtgcgaggtcgagaagcacgggagaggccaggttctgttcgacctggtttgcgagcatctgaacctccttgagaaggattacttcggactcacgttctgcgacgccgatagccagaaaaattggttagaccctagcaaagaaatcaaaaagcagataaggtcatcaccatggaacttcgcctttactgtcaagttttaccctccggatcctgctcaacttacggaggatattacccgatattacttgtgccttcagctcagagcagacattattaccggtcgcctaccttgctcattcgtgactcacgcgcttcttggcagctatgccgtgcaggctgagctaggagattatgatgcagaagagcacgtcggtaattatgtgtccgagctgagatttgcccctaaccagactcgggagcttgaagagcgcatcatggagttgcacaagacctatagaggaatgacccctggtgaggccgaaatccattttctggaaaatgcaaagaagttaagtatgtatggggttgatttgcatcacgctaaagatagcgagggtatagacataatgctgggtgtgtgcgctaatgggcttctgatctaccgggaccgattgagaatcaacaggtttgcttggccaaagattcttaagatatcctataagagatccaatttttacatcaagattcggcccggagagtacgaacagtttgagagtacaattggttttaagctgcccaaccatagatccgctaagagactctggaaggtgtgcattgagcaccacacctttttcagactggtttctccagaacctccgcccaaaggtttcttggtgatgggaagcaaattccgctattccggcagaacacaggcacagactcgtcaagcttctgccctgatagatcgacctgcgcctttttttgaacggtccagctcaaagcggtataccatgtcaaggagcttggatggagcggaattcagtcggcccgcttcagtttctgagaatcacgacgctggacccgatggcgataagcgagatgaagacggagagagcggtggccaacggtccgaggccgaggaaggtgaggtgcgcactcccacgaaaatcaaggagttgaagcctgagcaggaaacaacccctcgacacaagcaagaattcctggacaagcccgaagacgtgttgctgaagcatcaagccagcattaatgagctgaagcgcaccctgaaagagccaaactccaagttaattcatagagatagagactgggaacgtgagcggcgtcttccctcctctcccgcctccccttcgcccaagggtactcctgaaaaagctaatgagcgcgctggcctgagggaaggttccgaggagaaggtgaagcctcctcgcccaagagcccccgagtctgacacaggtgacgaagaccaagatcaagaacgggacaccgtattcctgaaggacaatcatctcgccatcgagcgtaagtgctcatccatcaccgtttccagtacaagcagcctggaggccgaagtggacttcaccgtgatcggggactatcacgggtccgcatttgaagatttttctaggtcgctgcccgaactggaccgcgacaaatctgacagcgacacggaagggttgctcttttccagagacttaaacaaaggcgccccctctcaggacgatgagtccggcggaatcgaggactccccggaccggggagcctgctcgacccccgacatgccacagtttgaacccgtcaaaactgaaacaatgacggtctcatcactggctatcagaaagaaaattgaacctgaggccgtgttacagacccgggtttcagccatggacaatactcaggtagacggctcagcaagtgtgggaagagaattcatcgcaaccaccccctcaattacgacagagacaatatccacaacgatggagaactcactgaagtccggcaagggggccgctgccatgattcccgggccgcagactgttgccaccgaaatcaggagtctgagtcccatcataggaaaggacgtgctgacttcgacatatggggcaacggctgagaccctgtctacttctaccacgacccatgtcacgaagacagtcaaaggcggcttttctgaaactaggatcgagaagaggatcatcataactggcgatgaggacgtcgaccaggatcaggctctggcactagcaatcaaagaggccaaactgcagcatcctgacatgctagtcacaaaggcagtggtgtaccgggagacagacccctctcctgaagagcgtgacaagaagccacaggagtcctag

SEQ ID NO: 186808 - DNA, 600 bp, Artificial Sequence
  Description of Artificial Sequence: Synthetic coding sequence
atggaggagaaggactacagcgaggccgacggcctgagcgagcggacaaccccttcaaaagcacagaaatctcctcagaaaatagctaagaaatataagagcgccatctgtagggtgacactcctggacgcgtcagagtacgagtgtgaggtagaaaagcatgggagagggcaggtgctgtttgaccttgtgtgcgagcatttgaatctcctggagaaagattattttggccttactttctgcgacgcagattctcagaaaaattggctggatccgtccaaggaaatcaagaagcaaatccggagctccccctggaacttcgcattcaccgtcaagttttatcctcctgaccctgctcagttaaccgaggatatcaccagatactatctgtgcctgcagttacgagctgatatcatcacagggcggctgccatgttcttttgtgactcatgccttactggggagctacgccgtgcaggccgagctgggggactatgatgcggaagagcacgttggtaactatgtgagcgagctccggtttgcgcctaatcagacacgcgagcttgaggaaagaatcatggaactacacaagacctattag

SEQ ID NO: 186809 - DNA, 2106 bp, Artificial Sequence
  Description of Artificial Sequence: Synthetic coding sequence
atggtgttcctgggccggatcaacgaggtggagcccgccaagggcttagcagaatcactggctcctactgagcggagcgtgaagagtcttgatatggaagaaaaggattatagtgaagctgatggcctgagtgaacggaccactccaagcaaggcgcaaaaaagtccccagaagatcgccaagaagtataagtccgctatttgtagagtgacactgttagatgcatctgagtatgaatgtgaggtggagaagcatggccgtggtcaagtccttttcgatctcgtgtgcgaacacctcaatctgctggagaaggactattttggactgacattctgcgatgccgattcacagaagaactggttggatccttcaaaggagatcaagaagcagataagaagctctccttggaatttcgcatttactgtgaaattctatccaccagacccggcacaactcacggaggacatcaccaggtactacctgtgcctccagcttcgcgcagacattatcaccggtcgactcccttgttctttcgttacccatgccctcctagggtcctacgctgtgcaggcggagcttggagactatgacgccgaagaacacgtgggtaactacgtgtcagagttgcgttttgcacctaaccagacacgtgagctcgaagagcgaataatggagctacacaagacttacaggggaatgacaccaggagaagcagaaattcatttcttagaaaatgctaaaaagttgtctatgtatggggttgatctgcatcatgctaaagattcggaaggcatcgatattatgctaggcgtgtgcgccaacggtctactcatttatcgggacagactgcgtattaatcgcttcgcatggcctaagatccttaagattagttataagagaagtaacttctatataaagattaggcctggcgagtacgagcaattcgagtcaaccatcggcttcaaactgccgaatcaccggagcgccaagaggctgtggaaagtgtgcattgagcatcacacgttcttcaggctggtgtctccagaacccccacctaagggttttcttgtgatggggtctaaattccgatattcaggtaggactcaggctcagacacgacaggccagcgccctgattgatcgacctgctcctttcttcgagagaagtagctccaagcggtataccatgagtaggagtctggacggagccgagttttcccgccctgcgtccgtatccgagaaccatgacgctggcccagacggggataaacgtgacgaggacggcgagtctggagggcaaagatctgaagctgaggaaggagaggtgaggactccaactaaaatcaaagaactcaaattcctagacaaacctgaggacgttctgttgaaacatcaagcctccatcaatgaattaaaacgcacacttaaggagccaaactccaaactgatacaccgagaccgggattgggagagagagcgtcggttaccctcttcccctgcgagcccaagcccgaaggggacccccgaaaaagccaacgagcccgtgaaaaccgagaccatgactgttagttccctggctattcgaaagaagatagagcctgaggccgtgcttcagactcgggtttccgcgatggacaatacccagcaagtggacggatctgcatcagtcggcagagaattcatagccaccaccccgtccatcacaacggagactataagcacaacaatggagaattccctgaaaagcgggaagggcgccgcagccatgatccctggaccacaaaccgtggccacagagatccggagtcttagtcccataattggaaaggatgtgcttacatccacctacggtgcaaccgcggagacactgagtacaagcacgacgacccatgtgactaagactgtcaaggggggtttctccgaaactcggatcgagaaaagaatcatcattactggagacgaggacgtcgatcaagaccaagcattggccctagcaataaaggaagctaaactgcaacaccccgacatgttagtgaccaaagccgttgtgtatagggaaacagatcctagccccgaagaacgggataagaaaccacaagaatcatag

SEQ ID NO: 186810 - DNA, 2319 bp, Artificial Sequence
  Description of Artificial Sequence: Synthetic coding sequence
atggaggagaaggactacagcgaggccgacggcctgagcgagcggaccactcctagcaaggcccagaagagcccacagaagatcgccaagaaatacaaatccgcgatatgtcgtgtcaccctactggacgcctctgaatacgagtgtgaggtggagaattggcttgatccatccaaggaaattaagaaacagatcaggtcctccccctggaattttgccttcacagtgaaattctatcctccagatccagcccagcttacagaagacattactcgctactacctttgcctgcagctccgggccgatattattacaggccgactcccctgctcgttcgtgactcatgctttacttggttcctacgccgttcaggccgaattaggcgattatgacgctgaagaacatgtggggaattatgtgagcgagttaagattcgccccaaatcaaacacgggagctcgaagaaaggataatggaacttcacaagacctaccgggggatgacaccaggtgaggcggaaatccattttttggaaaatgccaagaagctgagcatgtacggcgtcgatctgcatcatgccaaggattctgaaggcatcgatatcatgctgggcgtgtgcgccaacggtttgctcatctaccgcgataggctgcgtatcaaccgctttgcttggcccaagattttaaagattagttacaaacggtcaaacttctatattaagatacgtcctggagagtacgagcagttcgaaagcacgatcggcttcaaactccccaaccataggtccgcgaaacggctgtggaaggtttgcatcgagcaccacacattctttaggcttgtctcccctgaacccccacccaagggctttttagtgatgggatcaaagttcaggtactcgggccgaactcaagcccagacacggcaggcctcagcgctcattgatcgcccggcaccattcttcgaacggtcaagcagcaaacgttatacaatgagtcggagtctggacggcgcggagttttccaggcctgccagcgtgtccgaaaaccatgacgccggccctgacggggataaacgcgacgaggacggagaaagtggtgggcaaaggtctgaagccgaagaaggggaggtaaggacgccaacgaagattaaggagttgaaatttctggacaaaccagaggacgtgctcctgaaacatcaagccagtattaatgagctgaagcgtactctgaaagaacctaactctaaattgattcatcgtgaccgcgactgggagcgcgagcggaggcttccttcttcgcccgcatctcccagccctaaggggactccagagaaggcaaatgagcgcgccggcctgagggaaggcagcgaggaaaaggtcaaacctcctaggccccgtgctcccgaaagcgataccggtgatgaggatcaggaccaagagagagacaccgtgtttctaaaagacaaccatctggccattgagagaaaatgcagctccataacagtcagtagcacgagctcattggaagctgaggtggattttaccgtgattggagattaccacggtagcgcatttgaggatttctctagaagccttcccgaattagacagggacaaaagcgattccgacaccgaaggcctgctcttctccagggacctgaataagggcgcccctagtcaggatgacgaatccggcggaatagaggattctcccgacagaggggcctgcagcacaccagatatgccccagttcgagcctgtgaagacagaaactatgaccgtgtcctcgctggcaatcagaaagaaaatcgaacccgaagccgtacttcagactagagttagcgcaatggacaacacccagcaagtcgacgggtctgcaagcgtgggccgggagtttatcgccaccacaccatctataaccaccgaaacaattagcaccacgatggagaatagtctgaagagcggcaaaggggccgctgcgatgattcccggaccccagacagtggccacagaaatccgaagcctgagtccgataataggcaaagacgtcctgaccagcacttatggtgccactgcagagactctctcgacgagtaccacaactcatgttaccaagactgtgaagggcggcttcagcgaaacccgcattgagaaacggatcataatcactggagacgaggatgtggaccaggaccaggctctcgccttagcaatcaaggaagccaagttgcaacatcctgacatgttggtgacaaaagccgttgtgtatcgggagacagatccctcacctgaggagcgagacaaaaagccacaagaatcttag

SEQ ID NO: 186811 - DNA, 2319 bp, Artificial Sequence
  Description of Artificial Sequence: Synthetic coding sequence
atggaggagaaggactacagcgaggccgacggcctgagcgagcggaccacaccttccaaggcccaaaagtcccctcagaagatcgctaagaagtacaagtccgcgatttgtcgtgtaactcttctggatgccagcgagtatgaatgtgaagtcgaaaactggctggatccttcaaaggaaatcaaaaaacagatcaggtcaagtccatggaactttgcattcactgttaagttttatcctcccgaccctgctcagctgactgaggatattacacggtactatctttgtctgcagttgagggcagatattattaccggtagactgccctgctcgttcgtaacccacgctctgctcggaagctacgcggttcaggctgagttaggcgactacgatgcagaggaacatgtgggcaactacgtatccgagctgcgattcgccccgaaccagacacgcgaattggaagagcgcattatggagctgcataagacgtaccggggcatgaccccaggggaagccgaaattcattttttggaaaatgccaaaaagctgtccatgtacggcgtcgacctgcatcatgccaaagactccgagggtatagacattatgctcggagtgtgtgccaacggactgttgatctatcgggaccgcttgagaattaatcgatttgcttggccaaagatcctgaaaattagctataagcgttctaatttttacatcaaaataagaccaggtgagtacgagcagtttgaatcgactatcggcttcaaactgcccaatcacagatccgctaagaggctgtggaaggtgtgtatcgagcaccacacattctttaggctggtctctcccgaacctccacccaaaggctttctcgttatgggatccaagtttcggtactctggtcgcactcaggctcagaccagacaagccagcgcgctcatcgacaggcctgcacctttcttcgagaggagctcctctaagaggtatactatgtcccggagtcttgatggggccgaatttagccgcccagcctccgtgagcgagaatcacgacgccggccccgatggcgataagcgcgatgaggacggagagtctggtgggcaacgaagcgaggcagaagagggagaagtgcggacccccacaaagattaaagagctaaagttcttggacaaacccgaagatgtcctactcaaacaccaggccagcataaacgagctgaagcggacactgaaggagcccaattccaagctgattcacagagaccgtgattgggagagagaacggaggctgccttccagccctgccagcccttcaccaaaggggacgcccgagaaagcgaacgagcgggcaggcctgagagagggcagcgaagagaaagttaaaccacctaggccccgggcgcccgaaagcgataccggtgacgaagaccaggatcaggaaagagacaccgtgttcctgaaagataaccaccttgccatagagagaaaatgtagcagtatcaccgtctccagcacttcaagcttggaagcagaagtagactttactgttatcggagactatcatggatccgcctttgaagactttagtagatccctacctgagcttgatcgggacaagtctgacagcgacacagaggggttgctgttttctagggacctaaataaaggtgctccatcccaagatgacgaatctgggggaattgaagactcccccgacagaggggcttgttccacgccagatatgccccagttcgagccggtgaagactgagaccatgactgtctcttctctggcaatcagaaagaagatcgaacctgaggcagtgctgcaaacacgcgtttcggccatggacaatactcagcaagtggatggctccgcctctgtggggcgggagttcatcgcgacaacaccatcaatcacgaccgagactatttcaaccacaatggaaaactccctgaaatccggcaaaggagcggccgccatgatcccaggcccgcagacagtcgccaccgagatccggtctctttcacctattatcgggaaagacgtgttaacctcaacttacggtgccactgctgaaactctcagcacaagcactacaacccatgtgactaaaacagtaaaaggcggcttcagtgaaacaaggatcgaaaaacgaattatcattaccggagacgaagacgtagaccaggatcaggccctggccttagccatcaaggaggctaaattgcagcaccccgacatgttggtaaccaaagcggtcgtgtatagagaaacagacccatcccctgaggagcgtgataaaaaaccccaagaatcgtag

SEQ ID NO: 186812 - DNA, 600 bp, Artificial Sequence
  Description of Artificial Sequence: Synthetic coding sequence
atggaggagaaggactacagcgaggccgacggcctgagcgagcggactaccccctcaaaggcccagaaatccccacagaaaatcgcaaagaaatataagagtgccatatgccgtgttacccttctcgacgcgagcgagtacgaatgtgaggtagagaaacatgggcggggacaagttctgtttgatctcgtgtgtgagcacctaaatcttcttgaaaaggattatttcggcctaactttttgcgatgcagattcccagaagaattggttagatccctccaaggagatcaagaagcagattcgctcatctccctggaactttgctttcacggttaagttttatcctccggatcccgctcaactgacagaagatattaccagatactacctgtgtctgcagctccgggccgatattattactggtcgtctgccttgcagctttgtgacacatgcgctcctgggaagctacgctgttcaagctgagcttggggactatgacgcagaagagcacgtggggaattacgtatccgagctcagattcgcccctaaccagactcgggagttggaggaaagaattatggaactgcataagacgtattag

SEQ ID NO: 186813 - DNA, 2385 bp, Artificial Sequence
  Description of Artificial Sequence: Synthetic coding sequence
atgaccaccgagaccggccccgacagcgaggtgaagaaggcccaggaagaagcaccgcagcagcccgaggctgcagcggcggtgacaacccccgtgacccccgcaggacatggccatcccgaagctaactctaatgagaaacatcccagccagcaggacaccagacctgcggaacaatccctagacatggaggagaaagactacagcgaagcagatgggctgagcgaaagaacaactccaagcaaagcccagaagagccctcagaaaattgcaaaaaagtataaatctgcaatctgtcgggtgactcttttggacgcatctgaatacgagtgcgaggtcgagaagcatggacggggccaggtccttttcgatctggtttgcgagcacttgaatctgctcgagaaagactatttcgggcttacattctgcgacgctgattctcagaagaactggctggatccatccaaagaaattaaaaagcaaattcggagttccccatggaacttcgccttcactgtcaagttttatcccccggaccccgcacaactgacggaggatattactcgctattacctctgcctgcagctcagggccgacatcatcacagggaggcttccctgctccttcgtgacgcacgccctgttgggctcatacgcggtacaggccgaactgggggattacgatgccgaagaacacgtaggtaactacgtgagcgagctgagattcgcacctaaccaaactagggagctcgaggagcgcattatggaactacataaaacgtaccgaggaatgactcccggtgaagctgagatccattttctggagaacgccaagaagctttccatgtacggcgtggaccttcaccacgcgaaggactccgagggtatcgacattatgcttggtgtttgcgccaacggtctgctaatctacagggacaggctgagaataaacagatttgcctggccaaaaattctcaaaatttcctacaagaggtcaaacttctacattaagatcaggcctggcgagtacgaacagtttgagagtacgatcggcttcaaactcccaaatcataggtccgccaagcgtctttggaaggtgtgcatcgagcaccataccttttttcgcctggtctcacccgagcctccccctaaaggcttccttgttatggggtctaaatttcggtattccggaaggactcaggcgcagactagacaggcatctgcccttatcgatcggccggcccctttttttgaacgcagcagcagcaagcggtacacaatgagccggagcttggatggcgcagagttctccaggcccgcctccgtctccgagaatcacgacgccgggcccgatggggacaagagggatgaggatggagagagcggcggccagcggagcgaggccgaagaaggcgaagtgcgcactcccaccaagattaaggagctgaaaccagagcaggaaaccacccccagacacaaacaggagttcctcgataaaccggaggatgtactcctaaagcatcaggcgagcataaacgagcttaaacgcaccctgaaggagcccaattccaagcttatccaccgggacagagactgggagcgggagcggcgtctgcccagcagcccagcctctcccagccccaaaggcacaccagaaaaggccaacgagcgcgctggcctgcgagagggaagcgaggaaaaggtgaagcccccaagaccccgggcccctgagtccgacacgggcgatgaagaccaggaccaagagcgcgatacggtctttcttaaagataatcatctcgccatcgagcgaaagtgcagctccattacagttagctcaacttcctccttggaagccgaagtggattttaccgtgataggcgattaccatggctcagccttcgaggatttctctaggtctttacccgaacttgatagagataaatctgacagcgacaccgaaggactgctgttttcacgagatcttaataaaggagctccgagccaagacgatgagagtgggggaattgaagattcacccgaccggggcgcctgctcaactcccgatatgccccagttcgagccggtgaagaccgaaaccatgacagtctcttccctggcaatcaggaaaaagattgagcccgaagcagttctgcaaaccagagtgagtgccatggacaacacccaggagaatagcctcaaaagtgggaaaggtgccgcagccatgattcccggccctcaaactgttgcaactgagattcggagtctcagcccttctgctgaccatagagagcgctgtccacaccagcacttgaggagacactgtggtaatcccctgaacctgcatcaccacccttgtcatcaaaactgtgaaaggcgggtcttttag

SEQ ID NO: 186814 - DNA, 507 bp, Artificial Sequence
  Description of Artificial Sequence: Synthetic coding sequence
atgaccaccgagaccggccccgacagcgaggtgaagaaggcccaggaagaggcaccccaacagcccgaggcagccgccgcagtaactaccccagtgacacctgcaggccacgggcacccagaggccaattccaacgagaaacacccctctcagcaggatacaagacctgctgagcagtcactggacatggaggaaaaagactactccgaggcagacgggctatcagagcggacaacacccagcaaggcccaaaaatccccacaaaagatcgcgaagaagtataagtcagccatatgcagagtaacgctcctggacgcctctgaatacgaatgtgaagtagagaaacacggcagaggccaggtgttatttgatctggtttgtgagcacttgaatctcctggaaaaagattatttcggcttgaccttctgcgacgcagattctcagaaaaattggctggatccttctaaagaaatcaaaaaacaaatcaggtccagcccctggaactag

SEQ ID NO: 186815 - DNA, 180 bp, Artificial Sequence
  Description of Artificial Sequence: Synthetic coding sequence
atgaccaccgagaccggccccgacagcgaggtgaagaaggcccaggaagaagcccctcagcagcccgaggcagccgccgccgtcactacccccgtgacacccgccggccacggccacccagaggccaattctaacgaaaagcatccgtcccaacaagatacgaggccggccgagcagtag

SEQ ID NO: 186816 - DNA, 774 bp, Artificial Sequence
  Description of Artificial Sequence: Synthetic coding sequence
atggaggagaaggactacagcgaggccgacggcctgagcgagcggaccaccccctctaaagcacagaaatccccgcagaaaattgctaaaaagtataaatccgctatttgccgcgtcacacttcttgatgcctccgagtacgaatgcgaggtggaaaaacatgggagaggacaggtcttgtttgacttagtgtgcgaacacctgaatctgttggagaaggattacttcggcctgactttctgcgacgccgatagtcaaaagaattggcttgacccatccaaggaaattaaaaagcagattaggtcctcgccatggaactttgctttcacggtaaagttttatccccccgatcccgcacagctgaccgaagatatcacaagatattacctttgcctgcaactccgagctgatatcattacgggtcgactgccatgttcatttgttacccacgcgttactgggctcatatgcagtccaggcagagttgggcgactacgacgctgaagagcatgtgggaaattacgtatccgagttgcgctttgcgcccaatcagacccgcgaacttgaggagcggattatggaactccataagacctacagaggaatgacaccaggtgaggcagagatccacttcctcgaaaacgccaagaagttgtctatgtacggagtcgatctgcaccacgcgaaggattcggaagggattgatattatgcttggggtgtgcgccaatgggttgctcatctatcgcgaccgactcaggataaataggttctag

SEQ ID NO: 186817 - DNA, 114 bp, Artificial Sequence
  Description of Artificial Sequence: Synthetic coding sequence
atggaggagaaggactacagcgaggccgacggcctgagcgagcggaccacacctagtaaagcacagaagtcaccccaaaaaatcgctaaaaagtacaaaagcgcaatctgttag

SEQ ID NO: 186818 - DNA, 360 bp, Artificial Sequence
  Description of Artificial Sequence: Synthetic coding sequence
tgaagcgtgggccgggagttcatcgccaccacccccagcatcaccactgaaacgatctcaacaactatgatcatcggtaaggacgtactgacgagcacatatggcgcaacagcggagacgctctctacctctaccactacacatgtgactaagaccgtcaaggggggctttagcgagacacgaatcgaaaaacgaataatcataaccggggacgaggatgtagatcaagaccaggcattagcacttgcaattaaggaggccaaattacaacatcctgacatgctggtgactaaggccgttgtttatcgcgaaactgatcccagtccagaagaacgcgataaaaagccacaggagtcttag

SEQ ID NO: 186819 - DNA, 2340 bp, Artificial Sequence
  Description of Artificial Sequence: Synthetic coding sequence
atggaggagaaggactacagcgaggccgacggcctgagcgagcggaccacacccagcaaagcccaaaagtctccacagaagattgctaagaagtacaagtctgcgatctgcagggtgactctgctggacgcatctgagtatgaatgcgaggtggaaaagcatgggcgagggcaagtgctttttgacctggtctgcgaacacctgaacctgctggaaaaggactattttgggctcaccttttgtgacgccgatagccagaagaactggctagacccctccaaggagatcaaaaaacagattaggtcctcaccctggaacttcgcatttacagtgaagttttacccccctgatcctgcccaactcacagaagacattactcgttactacctgtgcctacagttacgggcagatatcatcacaggacgattgccatgctctttcgttacacacgcactcctgggctcttatgcggtgcaagcagagcttggagattatgatgccgaggagcacgtcggtaattacgtgagcgagctgcgctttgcccccaatcaaacgcgagagcttgaagagcggatcatggaactgcacaagacctatagaggcatgaccccaggtgaagccgaaattcactttttggaaaatgcgaaaaagctttccatgtacggcgttgacctgcaccacgcaaaggattctgaagggatcgatatcatgcttggagtgtgcgcgaacggactgctgatttatagagacagactgagaatcaatcgattcgcctggcctaagattctcaaaatcagctacaaaagatccaatttttacatcaaaattcgaccgggggaatacgaacagttcgagagcaccatcggatttaagctgcccaaccaccggtccgccaagcgtctgtggaaggtgtgcatcgaacaccacacattttttcgattggtttcccccgagcctccgcccaaggggtttctggtgatggggtcaaagttccgatattcaggaagaactcaggcccagaccagacaggctagtgccctaatagaccgtcccgcacccttttttgagagatcgtcctctaaacgctacaccatgtcccgatccctggacggtgctgagttttcaaggccggcctcagtaagtgaaaaccatgatgccggaccagacggagacaagagagatgaggacggcgagagtggcggccagagatccgaggcagaagagggtgaggtacgtacccccactaagattaaggaactcaaatttctggacaaacccgaggacgtgctgctgaagcatcaggcctcaataaacgaattgaagcggactctgaaagaacctaactccaagctcatccaccgggatcgggactgggagagagaacgacgcttgccttccagtccagcaagtccatcaccaaagggcactcccgagaaagcaaacgaacgcgcaggacttagagaggggagtgaggagaaggtcaagccacctcgccctcgcgcgcctgagtctgatactggagacgaagaccaagaccaagagcgtgatacagtattcctcaaagataatcaccttgcaatcgagaggaagtgttcctctattacagtgagtagtacgtctagtcttgaagctgaggttgactttaccgtgattggcgactaccatggaagtgcctttgaagacttcagtagatcactgcctgagctggacagagacaaaagcgacagcgatacagaaggcctcctcttctctcgagaccttaataagggggcccccagtcaagacgatgaatcaggaggtattgaggacagtcccgaccggggagcctgttctacgcctgatatgccgcagttcgaacccgtgaagacagaaaccatgaccgtgtcatcacttgcgattaggaagaaaattgagcccgaggctgtgttgcagacaagggtaagcgccatggataatacacaggagaattctttaaagtcggggaaaggagctgccgcaatgatccccggaccgcagacagtagcgacagagatacggtcgctgtcacctataattggcaaggatgtgctgacatcaacctacggagcaactgctgagacgcttagtacttccaccactacccatgtgacgaagaccgtcaagggaggcttctcagaaacacgtatagaaaagcgcatcattatcaccggcgatgaagatgtcgatcaggaccaggcactggcactggctatcaaagaagccaagttacagcatcccgacatgttggtgaccaaagccgttgtgtatagggagaccgacccctcccccgaagagagagacaagaagccacaggagtcttag

SEQ ID NO: 186820 - DNA, 345 bp, Artificial Sequence
  Description of Artificial Sequence: Synthetic coding sequence
atgaccaccgagaccggccccgacagcgaggtgaagaaggcccaggaagaagctccccagcagccagaagccgccgccgcggtaaccacccccgtgactccggcaggacacggccacccggaggctaattctaatgagaaacacccttcacagcaggacacccgcccggctgagcagtccctggatatggaagagaaagattattccgaggcggatgggctgtccgagaggacaaccccctcaaaagctcagaaaagtccacagaaaattgcgaaaaagtacaagagcgcaatctgtagagtcacacttctggatgcctctgagtacgaatgcgaggtcgaatag

SEQ ID NO: 186821 - DNA, 567 bp, Artificial Sequence
  Description of Artificial Sequence: Synthetic coding sequence
atgaccaccgagaccggccccgacagcgaggtgaagaaggcccaggaggaagctccacagcaaccagaagcagcggctgccgttaccactcctgtgactccagctggtcacgggcacccagaggccaatagtaatgaaaaacaccccagccaacaggacacaaggcctgccgagcagagcctcgacatggaggagaaagactacagcgaagccgacggcctcagcgagcggaccactccatctaaggcccaaaagtccccccaaaagatagcgaagaagtacaagtcagccatctgtagagtgaccttgctcgacgccagtgagtacgaatgtgaggtcgagaagcacggacgtggccaggtgttgtttgacctcgtttgtgagcatcttaacctattggaaaaggactactttggcctcaccttttgtgacgctgactcccagaagaactggctagatcccagcaaggaaatcaaaaagcaaattaggtcaagcccttggaactttgcatttacagtcaaattctatcctcctgatcccgctcagctgaccgaggacattacatag

SEQ ID NO: 186822 - DNA, 705 bp, Artificial Sequence
  Description of Artificial Sequence: Synthetic coding sequence
atggagagcacccccgagccccggcccaacgagtgggagaagcggagaattaccccactgtctctgcagacacaagggcggaagggagaccatttgtttaaagacattttgagtgtgaaggaaaagtacctgatgcctactatttggactgtggaggagaaggcacaggagaccgataaaactagggctcctgagagtgaaggcccctgtacgggagcgagggatgcagtgaaatccagtcatgagacacttaatatcgtagaagagaaaaagagagctgaagtgggaaaagatgagcgggtcatcacggaggaaatgaatggcaaggaaatctcacctggtagcgggcctggggagatcaggaaggttgagcccgtaacacaaaaggattccacttctcttagcagcgagtcgagcagctcctcaagcgagtccgaagaggaggatgtgggcgaataccggccgcaccatcgggtgacggagggaactatacgcgaggagcaagaatatgaggaggaggttgaggaagagcctaggccagccgccaaggtggttgagagggaagaagcagtgcccgaggcgtctccggtgacccaagcaggcgcctcggtcattacagtggaaactgtgatacaagaaaacgtcggcgcgcagaaaattccaggcgaaaaatctgtccatgagggagccctgaagcaggactag

SEQ ID NO: 186823 - DNA, 3018 bp, Artificial Sequence
  Description of Artificial Sequence: Synthetic coding sequence
atgaccaccgaggtgggcagcgtgagcgaggtgaagaaggacagctctcagctgggcacagatgctacaaaggagaagcccaaggaggtcgccgagaaccaacaaaaccagagtagcgatcctgaggaggaaaagggcagccaacctcctcccgctgccgagtctcagagctcactgaggagacagaaaagggagaaagaaacatccgagtctcgagggatctccaggttcatccccccttggctcaagaagcagaagtcctatactttggtggttgccaaagatggcggggataaaaaagagcctactcaagctgtggttgaggagcaggtgctggacaaggaagagcctctccctgaggagcaacgtcaagcaaaaggcgatgccgaggagatggcccaaaagaaacaagagattaaagttgaggtcaaggaggaaaagccaagtgtgagcaaagaagaaaagcccagcgtctccaaggttgagatgcagccaacggagttggtcagtaaggaacgagaagagaaggttaaggaaacacaggaggacaagctcgagggtggcgcagctaagcgcgagactaaggaagtgcagactaatgaactgaaagccgaaaaagcttctcagaaagtgacgaagaagactaaaacagtacagtgcaaagtgacattgctggacgggacagagtactcatgcgacctcgagaaacacgccaagggacaggttcttttcgacaaagtttgcgagcacttgaacctcttggagaaggactacttcgggcttcttttccaggaatcccctgagcagaaaaattggcttgatccagctaaagagatcaagcgccagctacgaaacctcccctggttatttacctttaatgtcaagttctaccccccagacccatctcaattgactgaagacatcaccagatacttcctctgcctccagctgagacaggacatagccagcggaagacttccctgttcctttgtcacacacgctctcttgggctcctacacactccaggctgaactcggagattatgaccccgaggagcatggaagcatcgatttgtccgaatttcagttcgccccgacacagaccaaagagctggaagaaaaagtggccgaattgcataagacacatcgaggactgagtcctgctcaggccgatagtcaatttctggagaacgcaaaaagactttcaatgtacggcgttgatctccatcacgcaaaagactctgagggcgtagacattaagctcggggtgtgtgccaatggattactcatctacaaggaccgcctgagaatcaaccgattcgcctggcccaaaatcctgaaaatcagctacaagcggtcaaatttctatataaaggtgaggccagccgagctggagcagtttgaatctactatcggatttaaattgccaaatcaccgcgccgctaaacgactatggaaggtgtgtgtcgaacatcatactttctatagactggtctcaccggagcaacctcctaaagccaagtttttgaccttgggttcaaagttcaggtactccggcagaacccaagcacaaacgaggcaagcttcaacactcatcgatcggcccgcaccacatttcgaacgaacctcgagcaagcgtgtgtcgagatccttggatggcgctcctattggcgtcatggaccaaagcctaatgaaagattttccaggggccgcgggcgaaatatccgcatatggcccagggcttgtgtctatcgcagtagtgcaggatggggatggacggcgggaggtgagatcgcccactaaggcaccccatctccagcttatcgagggaaaaaagaatagtctgagggtggagggtgacaatatttacgtccgtcatagtaatcttatgctcgaggagctggacaaagcgcaggaggacatcctcaagcatcaagccagtatttctgagctgaaaagaaacttcatggagtctactccagaacccaggccaaacgagtgggagaagcgacggatcacacccctgtctcttcaaactcagggatccagccatgagactttaaacattgtggaggaaaagaagagggccgaggtgggtaaagatgagcgagttatcacagaggaaatgaatgggaaggagattagccccggatccggaccgggtgaaattaggaaggtggagccagtgacccaaaaagactccacaagtctttcctcggaatcttcaagcagcagtagcgagtctgaagaggaagatgttggagaatacagacctcatcatagagtcaccgaaggcaccatcagagaggaacaagagtacgaggaagaggtggaagaggaacccagacccgctgctaaggtggtggagcgggaagaggcggtccctgaagcaagcccagtgacccaggcgggagcttccgtgataaccgtcgagactgttatccaggagaatgtcggggcacaaaagatcccaggggaaaaaagcgtacatgaaggagcactcaagcaggatatgggggaggaagcagaggaagagccccagaaggtgaatggagaagtctcacatgtagatatcgatgtgctaccgcagatcatttgctgctccgaaccccccgtggtcaaaacagagatggtaacaattagcgacgctagccaacgcaccgaaatcagtacaaaagaggtgcctatagtccagacagaaacaaagacgataacttatgagtctcctcagatcgacggtggagcgggtggggatagcggcacactgctgaccgcccagaccatcacgtctgagtcagtgagcaccacaaccactacacacatcaccaagaccgttaaaggcggaatcagcgagacccgaatagaaaagcgcattgtgattacaggtgacggcgatattgatcacgaccaagcactggctcaggccatcagggaggctcgagagcagcaccccgacatgtctgtcacacgtgtcgtggtccacaaggagaccgaactggctgaggagggtgaggattag

SEQ ID NO: 186824 - DNA, 3018 bp, Artificial Sequence
  Description of Artificial Sequence: Synthetic coding sequence
atgaccaccgaggtgggcagcgtgagcgaggtgaagaaggacagcagtcagctcggtacagacgcaaccaaagaaaagccaaaagaagtcgccgaaaatcagcagaaccagtcatccgatccagaggaagaaaaaggcagtcagccaccaccggctgctgaatctcagtccagtctacgcaggcaaaagcgtgaaaaggaaacatctgagtcgcgtggaatctcccggtttatacctccctggcttaagaagcaaaaatcatacactcttgtggttgctaaggatggtggggataagaaggagccaactcaggcagtggtggaggaacaggtcctggacaaagaggagcccttgcctgaggaacagagacaggctaagggcgatgctgaagaaatggcacaaaaaaagcaggagatcaaggtggaagtaaaagaagaaaagccgagcgttagcaaagaagagaagcccagtgtcagcaaggttgagatgcaacccaccgagcttgtttctaaagaaagagaagagaaggtgaaggaaacgcaggaggacaaattagaggggggtgccgcgaagagggagaccaaagaggtgcagactaatgaactgaaagctgagaaggcctcccaaaaggtgactaagaaaacgaagacagttcaatgcaaggtgacgttgctcgatggcactgaatattcttgtgacctggagaagcatgctaaggggcaggttctgtttgacaaggtgtgtgaacatttgaacctgttagaaaaggattatttcggtctactttttcaagagtcccccgagcagaagaattggctcgatccagccaaagagattaaacgccagctgaggaacctgccctggctttttaccttcaatgtgaagttctacccacctgatccctctcaattgacggaggatataactagatatttcctgtgcctccagctgcgacaggatatcgctagcgggcgcctaccttgctcctttgttacccacgccctgttggggagttatacactgcaggcagaattaggggactatgatcctgaggagcatggttctatcgatctcagtgagtttcagttcgcgcctacacagactaaggaactggaggagaaggtcgccgagctccacaaaacccaccgaggcctctcgcctgcacaggctgatagtcagttcttggagaacgctaaaagactgtccatgtacggagtggatctccaccacgctaaagactctgagggcgtagatattaagctcggcgtgtgtgccaatggactgttgatttataaggacagactccggattaatcggttcgcgtggccaaagatcctgaaaattagctacaagagatcgaacttctatatcaaggtaagacccgccgaactggagcagttcgaaagcaccatcggctttaaacttcctaatcaccgcgctgcaaagcggctgtggaaggtgtgtgtcgaacatcacacattctaccgcctcgtctcgcccgagcaaccacccaaagcaaaattcctaaccttaggctccaaattcagatactccggccgcacccaggctcagacccggcaagcgagcaccctaatcgatcgtcccgccccccacttcgagagaaccagttctaagcgggtgtcaaggagcctggatggagcgcccataggagtgatggaccagagcttaatgaaagactttccgggcgcggccggcgagatctccgcgtatggaccaggtcttgtctccatcgcagtagtccaggatggggatggtcgcagggaggtaagatccccaaccaaagcaccacatcttcagctaatcgagggcaaaaagaacagcctgcgagtcgagggagataatatctacgtgcggcattcaaacctgatgctggaggaactggacaaggcccaggaagacatccttaaacatcaagcaagcatatcagagttgaagcgcaattttatggagtccactcccgaaccacgcccgaacgagtgggagaaacgtagaattacccccctcagcctccagacccagggtagttcgcacgaaacccttaatatcgtggaagagaagaaacgagccgaagtgggcaaggacgagcgggtgatcactgaagagatgaatggtaaggaaatcagccctgggtccggacctggagaaatacgcaaggtggaacctgtgacccagaaggactccacgagtttaagctctgaaagttcttcatcgtcctctgaaagtgaagaggaagacgtgggcgagtacaggcctcatcaccgggtcaccgaaggaaccatcagagaggagcaggagtatgaggaagaggtggaggaggagcctagaccggccgctaaggtggtcgagagggaggaggcagttcctgaggcttcccccgtgacccaggccggagcgtctgtcataaccgtggaaaccgtaatccaagagaatgtaggtgcccagaaaatcccgggcgagaagtccgtccatgaaggcgccttgaagcaggatatgggcgaagaagccgaagaggagcctcagaaagttaatggtgaggtgtctcacgtagatattgacgttttaccccaaataatttgctgttctgaacctcccgtcgtgaagactgaaatggttacgatctccgatgcatcacagaggaccgagatctccacaaaggaggtacctatcgtccagaccgagacaaagaccattacctacgagagcccccagattgacggaggggctggaggtgactccggaacattgctcacggcacagacaattacatcagagtccgtaagtaccactactactacacatattacaaagacggtgaaaggtgggataagtgaaactcggatcgagaagcgcattgtaataactggcgacggcgacattgaccacgatcaagccctggctcaggccattcgagaggcccgcgagcagcatcctgacatgtctgtaacccgcgtggtggtccataaggagactgaactggcggaagagggggaagactag

SEQ ID NO: 186825 - DNA, 2022 bp, Artificial Sequence
  Description of Artificial Sequence: Synthetic coding sequence
atgaccaccgaggtgggcagcgtgagcgaggtgaagaaggacagctcccagcttggcacagacgcaactaaggagaagccgaaagaggtggccgaaaatcagcagaaccagagcagcgatccagaggaggagaagggcagccagccccccccagccgccgagtcacagtcatctttaagacgacagaagcgggagaaggaaacgagcgagagcaggggcatctcccggtttattcctccttggctgaaaaaacagaagagctacaccctggtggtggcgaaagacggtggagacaaaaaagagccaactcaggccgtggtggaggagcaagtgctagacaaggaagaacccctcccagaagagcagagacaggctaaaggtgatgctgaagagatggctcagaaaaagcaagaaataaaagtggaagtcaaggaagaaaagccgtccgttagtaaggaggagaagccaagcgtatcaaaagtggagatgcagcccaccgagctggtgtcaaaggagagagaagagaaagtgaaagagacccaggaggacaagctagagggcggtgctgcaaagcgtgagacaaaagaggtgcaaacgaatgagttgaaagctgagaaagcaagccaaaaggtgacaaagaagacaaagaccgttcagtgcaaggttacgttgttggacggaaccgagtactcctgcgatctcgagaagcacgccaagggacaggtgctgttcgacaaggtttgtgaacacttgaatcttttagaaaaagactactttggactcctcttccaggagtcacctgagcagaaaaattggctggaccccgctaaggagataaagcgccaattgcggaacctgccatggttgtttaccttcaacgtgaaattttatccacccgacccttctcagctgaccgaggacattacccgctactttctctgcctccaactccgccaggacattgcttcaggacggttgccttgtagctttgttacacacgccttgctcggatcatacaccttgcaggcggaattgggagattatgaccccgaagagcatggctcaatcgatctctctgagttccagtttgccccaactcagacaaaggaactggaggaaaaagtggcagaactgcataagacacacaggggtctctccccggcacaggctgatagtcagttcttagaaaatgccaagaggttgtccatgtacggagtggacctgcaccatgccaaagattccgaaggagtcgatatcaaactgggagtgtgtgccaatggtttactgatttacaaggacaggctccggatcaaccgctttgcgtggccgaagattctgaagatttcttacaagaggagcaatttctacatcaaagtacgtcccgctgagctagagcagttcgaatctactataggctttaagcttccaaaccaccgagccgccaaacgcctgtggaaggtatgtgtggagcaccataccttctatcgcctggtgtctcctgagcagccccccaaggcaaagttcctgaccctgggctccaaattccgctacagcggacggacccaggcacagaccagacaggctagcactcttattgatcgaccggccccccacttcgagagaacgagtagcaaacgggtgagccggtcactggacggagcacccattggggtgatggaccagtctcttatgaaagactttcccggcgcagccggggagatttccgcatatggtcccggcctcgtcagcatcgcagttgtgcaagacggggacggtcggagagaagtgcggagcccgactaaggcacctcatctccaactaattgaggggaaaacagttaagggaggaatatcagaaactcgaatcgaaaagcgaattgttatcacaggggacggggacattgatcacgatcaggctctcgctcaagccatacgtgaggccagggagcagcacccagacatgtctgtcaccagagtggtagtccataaggaaaccgagctggcggaagagggagaggattag

SEQ ID NO: 186826 - DNA, 1902 bp, Artificial Sequence
  Description of Artificial Sequence: Synthetic coding sequence
atgaccaccgaggtgggcagcgtgagcgaggtgaagaaggacagctcccagctaggcacagatgcaacgaaggaaaagccaaaagaggtggcagagaatcagcaaaatcaaagctccgatcctgaggaggaaaaagggagtcagccgcccccagccgccgaaagccagtcctcgctgcgacgccagaagagagagaaggaaacatccgagtcccgaggtatctcccggttcatccccccctggctgaagaagcagaagagttacaccctcgtcgtggcgaaagacggtggggacaaaaaggaaccgacacaggccgttgtggaggaacaggtgctcgataaggaagagcctctgcctgaggaacagaggcaggcaaagggcgacgcagaagaaatggcacagaaaaaacaggaaatcaaagtcgaggtaaaggaagaaaagccatccgttagcaaagaggagaaaccgtcggtgagcaaagtggaaatgcagccaactgaacttgtaagcaaagaaagggaggagaaggtcaaagagacacaagaggacaaactcgaaggcggagccgcgaaacgcgagaccaaagaagttcaaactaatgagttgaaagccgagaaggcttcccagaaggtgacaaaaaagaccaagaccgtgcaatgcaaagtgacccttttggacgggaccgaatattcttgtgaccttgagaaacatgctaagggacaggtgctcttcgacaaggtctgtgaacacctgaacttgctcgaaaaggactactttgggctactgttccaggagtcccccgaacagaagaactggctggacccagccaaggagataaaacgacaactgcgcaatctgccctggctctttacttttaatgtcaagttttaccctcccgatccatcccaactgacagaggatattactcggtacttcctatgcctgcagctgcgtcaggacatcgcctctggccgacttccatgtagctttgttacacacgccttgctgggctcatacacgctccaggcagagcttggcgattacgatccagaagagcatgggtctatcgacctcagcgagttccaatttgcgccaacccagacaaaggagcttgaagagaaggtcgccgaacttcataagacacacaggggcttgtctccggcgcaagcagattctcagttcctggagaacgccaaaaggcttagtatgtatggggtggatctccaccatgcaaaagactctgagggggtcgatataaagcttggggtgtgcgccaatggcctgctcatttacaaggaccgtctgaggatcaatcgcttcgcttggcctaagatcctgaagatatcctataagcggtctaacttttatatcaaagtgagaccagcagaactcgagcagtttgaatctactatcgggttcaaactgcccaaccacagggctgcaaagagactttggaaggtttgtgtcgagcaccacacattttaccggcttgtgagccctgagcaaccaccaaaagcaaagttcctcaccctgggctcaaagtttcggtactccggtagaacacaggcacagacacgtcaggccagtacgctcatcgacaggcctgcacctcactttgaacggacgtcaagcaaaagggtgtcacgctcgctggatggagcgccaattggagtcatggaccagagcttaatgaaggacttccccggtgcagccggcgagatcagtgcctacggacctgggctcgtctccatcgcagtggtgcaggacggggatggaagaagggaggtgagatcccctactaaagccccacacctgcagctgatcgaaggtaaatcaagccacgagaccctcaacattgtagaagaaaagtctggccaaagattgggcaagactaaggaatag

SEQ ID NO: 186827 - DNA, 2244 bp, Artificial Sequence
  Description of Artificial Sequence: Synthetic coding sequence
atgaccaccgaggtgggcagcgtgagcgaggtgaagaaggacagcagccaacttggcacagacgccaccaaggagaaacctaaagaagtggccgagaatcagcagaatcagtctagtgaccccgaagaggagaaaggtagtcagcctccccccgcggccgaatctcagagcagcctaaggcggcagaaacgcgagaaggaaactagcgaatctaggggcatcagtagatttattccaccatggcttaaaaagcagaagagctacacactggtggtggcaaaggacggaggcgacaagaaggaacccactcaggccgtggtcgaagagcaggtgctcgacaaagaggaacccctgccggaggaacaacgtcaagcaaaaggtgacgcagaagagatggcacaaaagaaacaggaaatcaaagtcgaggtcaaggaggagaaaccctcagttagcaaggaggaaaaaccatccgtctcaaaggtagaaatgcaacccaccgaactggtgtcgaaggagcgggaggagaaagtgaaggagacccaggaggataaactcgaggggggagcagctaagcgggagacaaaggaagttcagactaacgagctcaaagcagaaaaggcatctcagaaagtgaccaagaagactaaaaccgtgcagtgcaaagttactctgttggatggaactgagtattcttgcgacttggagaagcacgccaaagggcaggtactcttcgataaggtatgtgagcacctgaatttgttggaaaaagattattttggactacttttccaggagtccccagaacagaagaactggctagaccccgcgaaggagataaagcgccagttgagaaacctaccctggttgtttacctttaatgtgaagttctatcctccagacccctcgcagttgaccgaggacattactagatatttcttgtgccttcagctcagacaagacatcgcgagcggaaggttaccttgtagcttcgtaactcacgcactacttggatcctatacgctccaggctgagcttggcgactatgacccagaggaacacggttcaattgatctgagcgagtttcagtttgcaccaacacagacaaaagaactggaagagaaggtggcagagttgcacaagacgcaccgcggcctgagtcccgctcaggccgactctcagttcctggaaaatgctaaaaggctgtctatgtatggggtggacctgcaccatgcaaaggattctgaaggcgtggatatcaagttaggagtctgcgcgaatggacttctcatctacaaggatcgtctcaggatcaatagattcgcctggcccaaaatactgaagatttcatataagcgcagcaacttctatattaaagtgaggcccgcagagctggagcagtttgagagtactatcgggtttaagctccctaaccatagagctgccaaacgactttggaaggtgtgcgtcgagcatcatactttttatagactcgtctcgcccgagcagccaccgaaagcaaaattcctgacgctgggttcaaagttcaggtactcaggtcgcacccaagcccaaacaagacaagccagcaccctcatcgacaggcccgcgcctcatttcgagcgcacttcctctaagagagtgagtaggtccctggacggggcccccataggcgttatggaccaaagcctaatgaaagatttccccggggctgccggagaaatctcagcttacggacccggattggtgagcatcgcagtggtgcaggatggtgatggaagacgcgaagtgcggtctccaaccaaagccccccacctgcagctgatcgaaggaaaaccccctgttgtgaagacagagatggtgacaatcagtgatgcctcccaaagaactgaaatctccaccaaagaggtacccattgtgcaaactgagacaaagacgataacatatgaaagcccccaaatcgatggtggcgcggggggggactctggtaccttgctgacagctcagacaattacaagtgaatccgtgagtacaactactaccacccatataacaaagactgtgaaaggaggcatttccgaaacaaggatcgaaaagagaatcgtgatcacaggcgacggggacatcgaccatgatcaggctctggcccaagcaatccgggaagcaagagagcagcatccggacatgagtgtgaccagggttgtggtacacaaagaaacggagttagccgaagaaggcgaagattag

SEQ ID NO: 186828 - DNA, 1143 bp, Artificial Sequence
  Description of Artificial Sequence: Synthetic coding sequence
tgactgggcagcaagttccggtacagcggccggacccaggcccagaccagacaggcgtctacactgatagacagacctgccccacactttgaacggacgagtagtaaacgcgtgagcagaagcttagatggcgcgccaatcggcgtgatggaccagtcactaatgaaggattttcctggcgctgccggggagatctccgcttatggcccgggactggtgtcaattgccgtggtacaggatggtgacggccgcagggaggtgcgatcacccacgaaagcaccgcacctgcagctaatcgagggcaagaaaaactctcttcgagtcgaaggcgacaacatctatgtacgccattccaatctcatgctggaggaactggacaaggcccaggaggacatcttgaaacaccaggcatcgatttcagagctcaagcgcaatttcatggaatctacacctgaacctcggccaaacgaatgggagaaaagaaggattacaccgttgagcctgcagactcagggacgcaagggagaccatctgtttaaagacatactgtctgtgaaagagaagtacctgatgcccacaatttggactgtggaggagaaggctcaggagacggataagacacgggctccagagagcgaagggccgtgcacaggggcaagagacgcagtcaagtcctctcacgagacgctgaacatagtggaagaaaaaaaacgggccgaggtgggaaaagatgaaagggttataacagaggagatgaacggaaaggaaatttctcccgggtccggacctggcgagataagaaaggtggaacccgttacccagaaagactccacttcgctgagttccgagagctcttcttcttcctctgaaagcgaagaggaagacgtaggggaataccgaccgcatcacagagtgacagagggtaccatcagggaagagcaggagtacgaggaggaagtcgaagaagaaccccgccccgccgccaaagtagttgagcgggaggaggccgtacctgaagcaagcccagtgacccaggcaggcgcaagcgtgataaccgtggagaccgttatccaggaaaatgtaggtgctcagaaaattcctggggaaaaaagtgtgcatgaaggagcccttaaacaggactag

SEQ ID NO: 186829 - DNA, 1152 bp, Artificial Sequence
  Description of Artificial Sequence: Synthetic coding sequence
atggaggaggaggagacccagctggaggaggagctggacaaggcccaggaagacatcctgaaacaccaggctagtatcagtgaactcaagcgcaactttatggagtctactcccgaaccccgacccaacgaatgggaaaaacgcagaatcacaccacttagcctgcagacacagggatcgtcgcatgaaacactgaacattgtggaagagaaaaaacgtgccgaggtgggaaaggatgagagagttatcacggaggaaatgaatggcaaagagatatccccgggttcaggacccggagagatcaggaaagtggaaccggttacgcaaaaggactctacgtcgctaagcagcgagagctcatcgtccagctcggaaagcgaggaggaggacgtgggcgaatatagaccgcatcatagggtgaccgaggggacgatccgggaggagcaggaatacgaggaggaggtggaagaggagccgagaccggccgccaaggtggtggaaagagaggaggcggttcctgaagcttctcccgtgacgcaggccggggccagtgtgattacagtcgagacggtaattcaggagaatgtgggggcccagaagatcccgggcgaaaagtccgtccatgaaggtgccctgaagcaggacatgggcgaagaggccgaggaggaacctcaaaaagtcaacggtgaagtttctcatgttgacattgatgtgttgccccaaatcatctgttgtagcgaaccgcccgtggtgaaaaccgagatggtaactatttcagacgcatcccagcgcactgagatatctaccaaagaagtccccatcgtccagacagaaacaaagactattacttacgagagcccacagattgatgggggagctggaggagattccggtaccctcctgacggcacagacaatcactagcgagagtgtgagcacaaccacgaccacccacattaccaaaactgtgaaaggggggatcagcgagacacgcatcgagaagcgaatcgtaatcacgggagacggcgacatagaccatgatcaggcgctggcgcaggcaatacgcgaggccagagagcagcacccagacatgtctgtgacccgggtagtcgtacacaaggagaccgaattagctgaggagggcgaggactag

SEQ ID NO: 186830 - DNA, 2022 bp, Artificial Sequence
  Description of Artificial Sequence: Synthetic coding sequence
atgaccaccgaggtgggcagcgtgagcgaggtgaagaaggacagctcacagctcgggacggatgcaaccaaagagaaacctaaagaagtggcggaaaaccaacaaaaccagtcaagtgacccggaggaagagaagggatcacagcctccacccgcagctgaaagtcaaagctctctgaggcggcaaaaacgagagaaggaaacaagcgaatccagaggcatctcgcgctttattccaccttggttgaagaaacagaagtcttacactctggtagtggctaaagacggtggcgataaaaaagaacccacacaagcagtggttgaagaacaggtgctcgataaggaggaacccctgcctgaagagcaacgccaagcgaagggagatgccgaggagatggcgcagaagaaacaggagatcaaggtggaagtgaaggaggaaaagccctcagtgagtaaggaagaaaaaccctctgtatccaaagttgaaatgcaaccgactgaacttgtgagcaaagaaagagaggagaaagtcaaggaaacccaggaggataaactggaggggggggcagccaagagggaaaccaaagaagtgcaaacaaatgaactcaaagctgagaaggccagtcagaaagttacgaagaaaactaagacagttcagtgcaaggtgacactgctggacggaaccgaatactcatgcgacctcgagaagcacgccaaaggccaggtgctgtttgataaggtttgtgagcatctcaacctgctagagaaggattacttcggactgttatttcaggaatcacccgagcagaaaaattggctcgatccagcaaaagaaatcaaacgccagctcaggaatcttccatggttgtttacattcaatgtaaaattttatccgcccgacccgtcacagctgacagaagacattactaggtattttttatgcctgcagttgaggcaggacatcgccagcggaagactcccttgctcatttgtgactcacgcgctcctggggagctacacattacaggctgagctcggcgattatgaccctgaggagcatggtagcatcgatctttctgagttccaattcgcccccacgcagactaaagagctagaggagaaggtggctgaactccataaaactcatagaggtctgtcaccagctcaagctgattcccagtttctggagaatgccaagaggctgagtatgtacggcgttgatctacaccacgcaaaggatagcgaaggggtggacattaaactgggggtgtgtgctaacgggctcctcatttacaaagaccgattacgcattaatcgctttgcatggccaaagattctgaaaattagctacaaaagaagcaacttctatattaaggtgaggcctgcggagcttgaacaatttgaaagtacaataggttttaagttgccaaatcatagagctgccaagaggctatggaaagtttgtgtagaacatcacaccttttaccgtcttgtctcacccgagcagccacccaaggctaaatttcttactcttggctccaagtttaggtatagcggccgcacacaggcacaaaccagacaagcttctaccctcatagatcggcccgctccgcactttgagagaaccagctcgaaaagagtgtcaagatcactggatggggccccgatcggcgttatggaccagtcattaatgaaagatttccccggggccgccggagagatcagcgcctacggaccgggcctggtgtccatcgcagttgtgcaggatggcgacggacgacgcgaggtcagatctcctacaaaggccccgcatctacaattgatcgagggaaaaacagtgaagggaggaatctctgaaacacgaattgagaaaaggattgtgataactggcgacggtgatattgaccacgaccaagccctggcccaggccattcgggaagctagagaacagcatccagatatgtccgttaccagagtcgtagtgcacaaggagacagagctggccgaagaaggggaagattag

SEQ ID NO: 186831 - DNA, 462 bp, Artificial Sequence
  Description of Artificial Sequence: Synthetic coding sequence
atgaccaccgaggtgggcagcgtgagcgaggtgaagaaggacagctctcagctggggaccgacgcaaccaaggagaaacccaaagaggtggcagagaaccagcagaaccagtcaagtgaccccgaagaagagaaaggatctcagcctccgccggctgcagaatcacagagtagcctgcgtagacaaaaaagagaaaaagaaactagtgagagcaggggaatctcacgatttatccccccctggctcaagaagcagaagagttatacgcttgtcgtcgcaaaagatgggggtgataaaaaggaacctactcaggctgtggtagaggagcaggttctagacaaagaggagcctctccccgaagaacagaggcaggcaaaaggggatgccgaggagatggcccaaaagaaacaggaaatcaaagtggaggtgaaagaggagaagccatctgtttcaaaggaatag

SEQ ID NO: 186832 - DNA, 2244 bp, Artificial Sequence
  Description of Artificial Sequence: Synthetic coding sequence
atgaccaccgaggtgggcagcgtgagcgaggtgaagaaggacagctcacaactcggaaccgatgccacaaaagagaaacctaaggaggtagcagaaaaccaacagaatcagagctcagatcccgaagaagagaaggggtctcagccaccgcctgccgcggagtctcagtctagcctgaggagacagaaaagagagaaggagacaagcgagtcgcgcggaatctctcgcttcattccgccctggcttaagaagcagaagtcatatacacttgtggtggcaaaggatggtggcgacaaaaaggaaccaacccaggctgtggtagaggaacaggttctggacaaggaagaaccgctgccagaagaacagagacaggctaagggggacgctgaagaaatggctcagaagaagcaggagattaaagtggaggtgaaagaggaaaagccatccgtgtctaaagaggagaagcctagtgtgagcaaagtggaaatgcaacctactgagctcgtgtcgaaagaacgtgaggagaaagtgaaagaaacacaggaggataagctggaaggcggcgccgctaagagggaaaccaaagaggtgcaaaccaatgagctcaaggctgaaaaggcatcccaaaaggttacgaaaaagactaagaccgtgcagtgtaaggtgaccctgctggacggcactgaatactcctgcgatttagagaaacacgctaaagggcaggtcctgtttgataaggtctgcgagcacctgaacttgcttgagaaagactacttcggactcctcttccaggaatctcctgaacaaaagaactggcttgaccccgctaaagagataaaacgtcagcttcgaaacttgccctggttgtttacctttaacgtgaaattctaccctccggatccgagccagttaactgaggacatcaccaggtacttcctttgtttacagctccggcaagatattgccagtgggcgcctaccttgcagttttgtgacgcacgcactgttaggttcctacacccttcaagccgaactgggcgattacgaccccgaggaacatgggtccatcgatctaagcgagttccagtttgcgcctacacagactaaggagttagaggagaaggtggcggaactacacaagactcaccgcggcctgagccccgcacaagccgactctcagtttctcgaaaatgccaagaggttgtccatgtatggcgtcgatctgcaccacgctaaggattctgaaggtgtcgacattaaactgggcgtgtgtgccaatggcctcctgatttacaaggaccggttaagaattaatagattcgcttggccaaaaatcctcaagattagttataagaggtctaacttctatatcaaggtgaggcccgccgagttggagcagttcgaatcaactatcggctttaagctccctaatcaccgcgctgcgaagagattgtggaaagtgtgtgttgagcaccacaccttctatcggctggtcagtcctgaacaacctcctaaagccaaattcctaaccctgggttccaaattcaggtatagtggccggacccaagcccagacgcggcaggccagcaccttgatcgatcgtccagctccccattttgaaagaacatcctccaagcgggtcagtagatccctggacggcgcgcctattggagtgatggatcaatcactgatgaaggactttcccggggcagccggggagattagtgcctacgggcctggcctcgtctctatcgccgtagtccaggatggggacggtagaagagaagtgagaagtccaaccaaagcgccacacttgcagctgattgaagggaaaccgccagtggtgaagactgaaatggtgacaatcagcgatgcatctcagcggactgagatatcgaccaaagaagtcccaatcgtgcaaacagaaaccaaaaccataacatacgagagcccccaaattgatggcggtgcaggcggcgattccgggacactcctcacagcgcaaacaatcacgtccgagtctgtatccacgactaccaccacacatattactaagacggttaaagggggcattagcgagactcgaatcgaaaaacgcatcgttatcacgggcgacggagacatcgatcacgaccaagcactcgcacaggccattcgggaggcgcgggagcagcacccagacatgtcagtgactagggtcgtggtccacaaggaaacagaactcgcagaagagggggaggactag

SEQ ID NO: 186833 - DNA, 540 bp, Artificial Sequence
  Description of Artificial Sequence: Synthetic coding sequence
atgaccaccgaggtgggcagcgtgagcgaggtgaagaaggacagcagccaactagggaccgatgccacaaaggaaaagccgaaggaagttgccgaaaatcagcagaaccaatcctcggacccagaggaagaaaagggaagccagcctccgccggccgccgagtcccagtcttctcttcgcagacagaagcgcgagaaggaaacctccgaaagccgcgggatcagtaggtttattccgccatggctgaagaaacaaaagtcttacaccctcgtggtcgctaaagacggcggagataagaaagagccgacccaggcagtggtggaggagcaagtccttgataaagaggaaccattgccagaggagcagagacaagctaaaggggatgccgaggagatggcgcaaaaaaagcaggagataaaagtagaagtgaaagaagaaaaacccagcgtgagcaaagaggaaaaaccttcggtgtccaaagtggagatgcagccgacggagctggtgtcaaaggagcgcgaagaaaaagtgaaggaatag

SEQ ID NO: 186834 - DNA, 2559 bp, Artificial Sequence
  Description of Artificial Sequence: Synthetic coding sequence
atgaccaccgaggtgggcagcgtgagcgaggtgaagaaggacagcagtcagcttggaactgatgctaccaaggagaagccgaaagaggtggctgagaaccaacagaaccagagcagcgaccccgaagaggagaagggatcacagccgccacctgctgccgaatcccagagctcgctccgacgacagaaaagggaaaaggaaacctccgagagccgtggtattagtcggttcatccctccctggctgaaaaagcagaagtcttatacattggtggtcgccaaagacggaggcgacaagaaggaacctactcaggccgtggttgaggagcaggtgctcgacaaggaggaacccctccccgaggaacaacgccaggcaaaaggggacgcggaagaaatggcccagaaaaaacaggagatcaaggtcgaagtgaaggaggaaaagccgagcgttagtaaagaagaaaaaccttccgtatcgaaggtggaaatgcagccaacagaactggtgtcaaaagagcgtgaggagaaagtgaaagagacacaggaggataagttggagggtggcgccgccaagagggaaacaaaagaagtgcagaccaacgagctcaaggccgagaaggcctcacagaaggtgacaaagaaaaccaaaacagttcagtgtaaagtcacactattggacggcactgaatacagttgtgatctcgaaaaacacgccaaaggccaggtgctgttcgacaaagtctgcgagcacctaaacctgctggagaaagactactttggcttgctgttccaggagtcccccgaacaaaaaaattggcttgaccccgctaaggagattaaaagacagttgcgcaatctgccatggctcttcacatttaatgtgaaattctatccccctgatccctcacaattaactgaggatataacacggtatttcttgtgcctccagctgcgacaggacatcgccagcggtaggctgccatgttcctttgtgacccacgctcttctaggctcatacacgctgcaggccgagcttggagattatgatcccgaagagcatggatcgatcgatctcagcgagttccaatttgcaccaacacaaacgaaggagctcgaagagaaagttgcggagctgcacaagacccacagaggcttgtctcctgcccaggcagacagccaatttttagaaaacgcaaaacggctgtctatgtatggtgtagacctgcaccatgccaaggactcagaaggtgtggacattaagttaggtgtgtgtgctaatggcttactgatttacaaagatcgactgaggatcaaccgctttgcctggcctaaaattctaaagatctcctataagagatcaaacttctatattaaggtgagacccgccgagttggagcagttcgaatccaccattggttttaagcttcctaatcacagagctgctaagagactctggaaagtgtgtgtggagcatcacacgttttatcgactggtgtctcctgaacagccgcctaaggcaaagtttcttactctggggagtaaattccggtatagcggccgcactcaagctcagacccgtcaggcaagcacccttatcgaccgtcccgcaccccactttgagagaaccagtagcaagcgcgttagtcgaagcctagatggagctcctataggggttatggaccagtctctcatgaaggactttcctggcgcggcgggtgagattagcgcttacggcccgggtttagtatccatagctgtggttcaggacggcgatggacgacgagaagtaagatcccctaccaaagccccccaccttcagttaatagaggggaaatcctctcacgagaccctgaacatcgtcgaggagaagaaaagagccgaagtggggaaggacgaacgcgtgataactgaagagatgaatggaaaggaaatttctcctggatctggcccgggtgagatcaggaaggttgaaccggttactcaaaaggattctacaagtttatcttcagagtcatcttccagctctagtgaatccgaagaggaagacgtaggagagtataggccgcaccacagagttacagagggaaccatacgcgaggagcaggagtatgaagaagaagtggaggaggaaccaaggcctgccgccaagcctcctgttgtgaaaacagagatggtgacaatctcggacgcaagtcagagaactgagatcagcaccaaggaggtccccatcgttcagacagagaccaaaacaatcacttacgaatcgccccagatagatgggggggccggaggcgactccggcactctcctcacagctcaaactatcaccagtgagagtgtgagcacgacaaccaccacccatattaccaagactgtgaagggaggaatttccgagacgcgaattgagaaaaggatcgtgataaccggtgatggcgatatcgatcacgatcaagcactggcccaggcgatcagagaggcgagagagcaacatccggacatgtctgtgactagagtcgtcgttcataaggagacagagctggccgaggagggggaagattag

SEQ ID NO: 186835 - DNA, 357 bp, Artificial Sequence
  Description of Artificial Sequence: Synthetic coding sequence
atgaccaccgaggtgggcagcgtgagcgaggtgaagaaggacagctctcagttaggcacagatgccactaaggaaaagcccaaagaagtggcggagaatcagcaaaaccagtcatccgatcccgaggaggagaaaggcagccagccacctcctgcggcagaatcgcaatcatcactcaggagacagaaaagagagaaggaaaccagtgaatcccgtggtatctcacgcttcatcccaccatggctgaaaaagcaaaaatcatatacccttgtggtggcgaaagatggaggagataagaaagagccgacccaggcggtcgtcgaagagcaggttctggacaaggaggagccgctatag

SEQ ID NO: 186836 - DNA, 606 bp, Artificial Sequence
  Description of Artificial Sequence: Synthetic coding sequence
atggaggaggaggagacccagctggaggagaagaacagcctgcgggtggaaggggacaacatttatgtccgtcactctaatctaatgctggaagaactggacaaggcccaagaggatatcctcaaacatcaggccagcatcagtgaacttaagcgcaacttcatggaaagcactccggagcctcgccccaacgagtgggagaagagacgcatcactcccctcagcttacagacacaaggcacacgcgcacctgaaagcgaggggccttgcaccggcgccagagatgcggttaagccacctgttgttaaaacagaaatggtgacaatatccgacgcctcccagcgaaccgagatctccacaaaagaggttccaattgttcagactgagacaaagacgattacatacgaatccccacaaacggtaaagggtggtattagtgaaacacgaatcgaaaagcggattgttatcactggggacggagacatagaccacgaccaggcattggctcaagccatacgcgaagcacgggagcagcaccctgacatgagtgtaacaagagtagtggtgcacaaagagaccgaattagccgaagagggggaagactag

SEQ ID NO: 186837 - DNA, 384 bp, Artificial Sequence
  Description of Artificial Sequence: Synthetic coding sequence
atgaccaccgaggtgggcagcgtgagcgaggtgaagaaggacagcagccagctgggcaccgacgccaccaaagaaaagccaaaggaggtggccgagaatcagcagaatcagtccagcgaccctgaggaggagaagggcagccagcccccaccggcagctgaatctcagagcagtcttcgccgacagaaaagagaaaaggagacttctgagtctcgtggcatcagtagattcattcctccttggctgaagaaacagaagagttacactctggtagtcgctaaggacggcggtgacaaaaaggaaccaacacaagcagtggtagaagagcaagtgctagacaaggaagagccactgcccgaggagcagagacaagctaaaggatag

SEQ ID NO: 186838 - DNA, 489 bp, Artificial Sequence
  Description of Artificial Sequence: Synthetic coding sequence
atgaccaccgaggtgggcagcgtgagcgaggtgaagaaggacagcagccagcttggcacagatgctaccaaggagaaaccaaaggaggtcgcggagaatcagcagaaccagagttctgatcccgaagaggaaaagggttcacagccccccccagcagccgagtctcagtccagtttacggcgtcagaaaagggaaaaggaaacaagcgaaagcagaggaatcagtagattcatccccccttggctcaaaaaacaaaaaagttatacacttgtggtggccaaagatgggggcgataagaaagagcctacccaggccgtggtagaagaacaggtgctcgataaagaagaaccattacccgaggagcagagacaggccaaaggtgacgccgaggaaatggcacagaaaaaacaggaaattaaagtagaggtgaaagaggaaaagcctagcgtgtcaaaggaggagaaaccttcagttagcaaagtggaatag

SEQ ID NO: 186839 - DNA, 3264 bp, Artificial Sequence
  Description of Artificial Sequence: Synthetic coding sequence
atgaccaccgagagcggcagcgacagcgagagcaagcccgaccaggaggctgagccccaagaagcggcaggagcacaggggcgggccggggctccggtgccagaaccacctaaggaggaacaacagcaggccctcgagcagtttgccgctgctgcagcacactccactccggtgaggcgggaggtgacagacaaagagcaggagttcgccgcgagggcggcaaaacagctggagtatcagcagctcgaggacgacaagttgtctcagaagagctcttcctctaagctcagccggtctccgctgaaaatcgtgaaaaagcccaagtcaatgcagtgtaaggtgatccttcttgacggttctgagtatacttgtgacgtggagaaacgcagcaggggacaagtgctgttcgataaggtctgtgagcatctgaacctcttggaaaaggattatttcggcctgacctatcgagacgccgagaatcagaagaattggctggatcccgctaaagagattaagaagcaggttaggtccggggcctggcacttttccttcaacgttaagttttatccacctgatccggcccagctgtcagaagatataaccagatattacctgtgtctgcagctcagagatgacatcgtttcgggaagactgccgtgttccttcgtgaccctcgcattgctagggagctacaccgttcagtcagagctgggcgattacgatcccgacgagtgcggatctgactatatctctgaatttcgtttcgccccgaaccacaccaaggaactcgaagacaaggtgattgagctccacaaatctcatcgtggcatgacaccggccgaggcagagatgcactttctggaaaacgccaagaagctctctatgtacggcgtcgatctccaccatgccaaagactccgagggtgttgagatcatgttaggcgtctgtgcttctggacttctgatctatcgcgacagattacgaattaatcgatttgcctggccaaaggtcctgaagatcagttataaaaggaataatttttatattaagataagacccggcgagttcgaacagtttgaatcaacgattggctttaagctccctaatcacagagccgctaagcggctgtggaaggtgtgcgtggagcatcacaccttttttcgcctcctgctcccagaagctcctcccaagaagttcctgacacttggatctaagtttcgctactccggcaggactcaagctcagacaaggagggcatccgcactaatcgacagaccagctccatattttgagcggtcctcttcgaagcggtatacaatgtcccgctcccttgatggcgaagttggtaccggccagtatgccactactaaaggcatctcccaaacaaacctgatcacaaccgtgactccggagaaaaaggctgaggaggagcgcgatgaggaagaagacaaaagacgaaagggtgaggaggtcaccccgatctctgcgatccggcatgaaggtaagtccccaggcctcggaacagatagctgtccactgagcccaccctctacacactgcgcacctacctctccaacagagctgaggcgcaggtgcaaggagaatgattgcaagttgcccggctacgagccgtctcgggccgaacacctgcctggagagccagcattggattcggatgggccagggcggccatatttaggggaccaggacgtggcattttcatatagacaacagactggaaaaggcacgacattgttctccttcagcctacagttgccagagtcttttccgtctctgctggacgacgatgggtatctttcttttccaaacctcagcgagacgaatctgctgcctcaatccctacagcactacttacctatccgaagccctagcctcgtcccctgcttcctgttcatatttttctttctgttgtcagcctcattcagcgtgccctacgcccttactctgagcttccccctggcactgtgcctctgttacctggaacctaaggccgccagtctcagtgcttccctcgataacgatccatccgactctagcgaggaggagacagattctgagcggaccgacaccgccgctgacggtgaaaccacggccactgagtcagaccaggaagaagatgctgagctaaaggctcaagagttagaaaagactcaagatgacttgatgaagcaccagacaaatatcagtgagttgaagaggaccttcctggagacctccacggatactgccgttaccaacgagtgggagaagcgcctcagtacaagcccggtgaggctcgccgctaggcaagaagacgccccaatgatcgagcctttggttcctgaagagaccaaacagagctcaggggaaaaattgatggacggttctgaaatattctctttgctcgagtccgcacgcaagccaaccgagtttatcggaggagtcacaagcactagtcagagctgggtccaaaagatggaaaccaagaccgagtcctctggaatagaaacagaacctacagtgcaccacctgccgctcagcacagaaaaggtagtgcaagagacagttctggtggaggagaggagggtggtgcacgcttccggagacgcctcatatagcgctggggacagcggtgatgccgccgctcagcctgcttttacaggcattaaggggaaagagggcagcgcccttacggagggtgcgaaggaggagggaggggaagaagtggccaaagctgtgcttgaacaggaggagacagctgccgccagtcgcgagcggcaggaggagcagagcgccgcaattcacatctctgagacactggagcagaagcctcatttcgagtcaagtactgtcaagactgagacgatttcttttggttcggtgtcccctggaggcgtgaagctggagatttcaacaaaggaagtgcccgttgttcataccgaaaccaagaccatcacgtatgagagctcacaggtggatccgggcaccgacctggagccaggagtcctgatgagcgctcagacaatcacatcggagaccacctctacgacaactactactcacattaccaagacagtgaagggaggtatctccgaaactcggatagaaaaacgaatcgtgatcacaggggatgccgacattgatcacgaccaggccctcgctcaggcgatcaaagaggctaaggagcagcatcccgacatgtcagtcactaaggtggtggttcacaaggagaccgagatcactcccgaagacggggaggactag

SEQ ID NO: 186840 - DNA, 3264 bp, Artificial Sequence
  Description of Artificial Sequence: Synthetic coding sequence
atgaccaccgagagcggcagcgacagcgagagcaagcccgaccaggaagctgagcctcaagaggcagccggcgcgcagggccgcgctggcgctcctgtccccgaaccccctaaagaagagcagcaacaggcactcgagcagtttgcggcagctgcagcccattccacgcctgtgcgtcgcgaggtgaccgacaaggagcaggaattcgcggcaagggccgcaaagcagctcgagtatcaacagttagaagacgataaactgtcccagaaaagctccagctctaaactctcccggtcacccttgaagattgttaagaagccgaagtctatgcaatgtaaggtgattcttctcgatggtagcgaatacacctgcgacgtggagaagcggagccggggccaggtcctgttcgacaaagtgtgcgaacatttaaatctcctcgagaaggactactttggcttgacgtatagagatgccgagaaccagaagaactggctggatccagccaaggaaattaaaaagcaagtcagatcaggagcatggcatttcagctttaatgtgaaattctatccacccgaccccgcacaactgtccgaagatatcacacggtattacctctgtttacagctgcgcgacgacattgtcagcggtagactcccctgctcttttgtaacattagccctcctaggtagttataccgttcagtctgagctcggtgattatgatcctgacgaatgtggatcagattatatctccgagtttagatttgctccaaaccacaccaaggagctggaagacaaggtgattgagctccacaagagccaccggggtatgactcccgccgaagctgaaatgcacttcctggagaacgctaaaaaattatctatgtacggcgtggacctccaccatgctaaggacagtgaaggagttgaaattatgctcggggtctgtgctagtgggctccttatctatagagatagacttagaataaaccgtttcgcttggcccaaagtgcttaagataagctataagcggaacaacttttacattaagattcggcccggcgagttcgaacagttcgagtctaccattggtttcaaactgcccaatcatcgagctgccaagaggctgtggaaggtctgtgtcgagcaccacaccttcttcaggcttctactgccggaggcccccccaaagaagtttctgaccctgggaagcaaattccgttactcagggcgcacccaggcccagacccggagagctagcgcacttattgatcggcctgctccatatttcgaacgctcgtcatctaagagatataccatgagtagaagtctcgacggagaggtggggactgggcagtacgcgaccacgaagggcataagtcagaccaacttgatcactacagtcactccggagaagaaggccgaagaggagagagacgaagaggaggataaacggagaaaaggcgaggaagtaaccccaattagtgctatcaggcatgagggaaaaagccctggcctcgggactgattcatgccctctttctcctccttctacacactgcgcgcccacaagtccaacagagctccgcagaagatgtaaagagaacgactgcaaactgcccggctatgagccctcacgtgcagagcaccttcccggagagcctgccttggatagcgacggccccggcaggccctatctgggggaccaggatgttgctttcagttaccgccagcagacaggtaaaggtaccacactcttctcttttagcttgcagctgccagagagttttccatctctcctcgacgacgacggataccttagtttccctaatttgtccgagacgaacctgctgccacaatccctccagcattacctgccaattagatccccttctttggtgccctgctttctgtttatcttcttttttctcctgagcgcatcttttagtgtcccttacgccttgactctgtcattcccgctggctctgtgcctttgctacctcgaaccaaaagcagcctccctgtcagccagtctcgacaacgatccttctgattcctctgaggaagagacagacagcgagagaacggacactgctgccgacggcgagacaacagctaccgaaagtgatcaagaggaggacgccgagctcaaagcacaggagctggagaagacccaggacgatctgatgaagcatcaaacaaacatctcagaacttaagaggacctttctggagacaagtaccgacactgctgtcacaaacgagtgggaaaaacggctttccactagccctgtcaggttggctgcccgacaggaggacgctcctatgattgagccgctggttcctgaagaaaccaaacagtccagtggtgaaaaactcatggatggctcagagatcttcagcctgcttgaatccgcgcggaagccaacggagtttatcggtggcgtgacaagtaccagtcagtcatgggtacaaaagatggagacaaagactgagtcttccgggatcgagaccgagcccacagtgcaccatttgcctctcagcacggagaaggtcgtgcaggagacagtgctggtggaggagaggagagtggtccatgcctctggtgacgcaagctatagcgcaggcgatagtggcgacgccgccgctcaacccgccttcaccggtatcaaaggaaaggaggggagtgccctgacagagggggccaaggaggagggaggagaagaggtggctaaggccgttttggagcaagaggaaactgctgccgcttctagggaacgacaggaggaacagagcgccgccatccacatatcagagacactggagcagaagccgcacttcgaaagctcgaccgtcaaaactgaaaccataagtttcggctccgtgagccctggaggtgtgaagttggagatctcaactaaggaggtacctgttgtgcacacagagacgaaaactatcacttacgagagctcacaggtagatcccggaactgatcttgagccaggagtcctcatgtctgctcaaactatcacatctgaaactacttcaacaacgaccacaacacatatcaccaaaactgtaaagggtggtatttctgaaacgaggatcgagaaaaggattgtgatcaccggggacgctgacatcgatcacgatcaggccttagcccaggccattaaagaagctaaggaacagcatcccgatatgtccgtaacaaaagtggtcgttcacaaggaaacagaaataaccccagaggacggagaggactag

SEQ ID NO: 186841 - DNA, 2598 bp, Artificial Sequence
  Description of Artificial Sequence: Synthetic coding sequence
atgaccaccgagagcggcagcgacagcgagagcaagcccgaccaggaggcggagccccaagaagccgctggcgcccaaggacgcgccggggccccagtgcctgaaccacccaaggaagagcagcaacaggctttggaacaattcgcggcggccgccgcacactcaaccccggtacgaagagaagtgactgataaggagcaggaattcgccgctcgtgctgcaaagcagctggagtaccaacagctggaagacgataagctgtctcagaagtcaagctcttcaaagcttagtaggtcgccgttaaaaatcgtgaagaagcctaaatccatgcaatgtaaggtgattctgttggatggctcagagtacacctgcgatgtggagaagcgatcccggggccaggtgctattcgacaaagtttgtgaacatctcaatttgctggagaaggactatttcggactcacttatagagacgccgagaaccagaagaactggctcgatcccgctaaagagataaagaaacaggttagatccggtgcctggcatttcagtttcaatgtgaaattctatcccccagaccccgctcagctgagtgaggacataacaaggtattacctgtgtctgcaactgcgcgatgatattgtaagtggaagattgccctgttcattcgtgacactcgctctgctggggtcttacacagtgcaatctgaactcggagactacgacccagatgagtgcggtagtgactatattagtgaattcagatttgccccaaatcacaccaaggagttagaggacaaggtgatcgagttgcataaaagtcatagaggcatgactcccgccgaagctgagatgcactttctcgaaaacgccaagaaactgagcatgtacggagtggatttgcaccatgccaaggacagtgaaggcgtggaaatcatgctgggagtttgcgcttccggcctccttatctaccgcgacagactgaggatcaatcgctttgcctggccaaaagttttgaaaatcagctacaagaggaataacttttacataaaaatccggcccggtgaatttgagcagtttgaatccaccatcggatttaagctgccaaatcatagagctgcaaagcgtctgtggaaagtgtgcgttgagcaccacacgttttttcggctgctactccctgaagcaccaccaaaaaagttcctgaccctgggctccaaattccggtactccggtagaacccaggctcagacccgtagagcttcagcacttatagaccggcctgccccctatttcgagagaagcagcagtaagaggtatactatgagcagatcccttgacggcgcctccgtcaatgagaaccacgaaatctatatgaaggacagtatgagcgcagccgaagtggggactggacagtacgcaacaaccaagggaattagccagactaacttgattaccaccgtcacacctgagaagaaggcagaagaggagcgagacgaagaagaagacaagcgcaggaagggtgaagaagtgacccctatatcagccatccgccatgagggcaaaaccgacagcgaaaggactgacaccgccgccgacggtgaaaccaccgcaacggaggagctcgaaaagacacaggatgatctgatgaagcaccagactaatatttcagaactgaaacgcacttttttggagacctcaactgacactgctgttacaaatgagtgggaaaagcggctatctacatctcctgtcagactggcggctagacaggaagacgcacccatgatagagccattagtaccagaagaaaaaatggagaccaaaacagaatccagcggaatcgagactgagcccactgtgcatcacctacccctgtctacagaaaaggtcgttcaagagaccgtcctcgtggaggagcgtagggtcgtacacgcgtcaggagatgccagctactcagccggagattccggcgatgctgccgcacaaccggcatttaccggcattaaaggcaaagagggcagcgcactgaccgagggtgccaaagaggaggggggtgaggaagtcgctaaggcagttcttgaacaggaagaaacagccgccgcctccagggaacgccaggaggagcagagtgccgccattcacatcagcgaaacactcgagcagaaacctcattttgagtcctccaccgtcaagacagaaacgatctcctttggttctgtgagccctggtggagtaaagctggaaatctctactaaggaggtgcctgttgtgcacaccgagacaaaaactataacctacgagtcctctcaggtggaccctgggactgatctggagcccggcgtcctcatgtccgcccagacaattaccagtgagactacaagtacaacaaccaccacccacatcactaaaactgtgaaaggtggcatctccgaaacccgcattgagaaacgtattgttattacaggcgatgcggacattgaccatgaccaggccctggcccaagccatcaaggaagctaaagagcaacatcccgacatgtccgtgacaaaggtggtggtccacaaagaaactgaaattacccctgaggacggagaggactag

SEQ ID NO: 186842 - DNA, 1155 bp, Artificial Sequence
  Description of Artificial Sequence: Synthetic coding sequence
atgaagcaccagaccaacatcagcgagctgaagcggaccttcctggagacatctaccgatacagccgtgaccaacgagtgggaaaaaagactaagcacgtccccagttcgtcttgccgcccgccaggaggacgctccaatgattgaaccactggtgccagaagaaacgaaggaagaaaccgaaatctctgagaaagtgatttttttgcagcagggcagcgcgccctttttggaaagccagacaaaacagagctcaggcgagaaattgatggacgggagcgaaatcttttccctgctcgaatctgcccgtaagcctacagagttcatcggaggggtgacaagtactagccagtcttgggtacagaaaatggagacgaagaccgagtcctcaggcatcgagactgagcccacggtacaccacttaccactaagcaccgagaaggtcgtccaggagactgtgctcgttgaggagagacgagttgtgcacgcctccggtgatgcaagctacagcgccggtgattccggagatgccgccgctcagcccgccttcactggcatcaaggggaaagaaggatctgctctgactgagggcgcgaaggaagaggggggtgaagaagtagcaaaagccgtgctcgagcaggaagagactgctgcggcttctagagagcgccaggaggaacagagcgctgccattcacatctccgaaaccctggagcagaagcctcactttgagtcctcaactgtcaaaactgagaccatctcttttggaagtgtgtcaccggggggagtgaaattagaaataagtacaaaggaggtgcccgtggtccacacagagaccaagacgatcacctacgagtcatcacaggtggatcctggcaccgatctggaaccaggggtgctgatgagcgcccagactataacttcagagaccactagcacaacgacaactacacatattacaaaaaccgtgaagggtggaatcagtgaaacaagaatcgagaagaggatagtgatcactggagatgcagacattgaccatgaccaggcactggcccaggcaattaaggaggcaaaggagcagcaccctgatatgtcggtcaccaaagttgtagtgcacaaggaaacggagatcacaccggaagacggagaggattag

SEQ ID NO: 186843 - DNA, 2271 bp, Artificial Sequence
  Description of Artificial Sequence: Synthetic coding sequence
atgcagtgcaaggtgatcctgctggacggcagcgagtacacctgcgacgtagagaaaaggagcaggggccaggtgctgttcgataaagtttgtgagcatttgaatctcttggaaaaagactattttgggctgacctatcgcgacgccgagaaccagaagaattggttggaccccgcgaaggagattaagaagcaagtccggagcggagcctggcacttcagctttaacgtgaagttctatccacccgaccctgcacaactttctgaagacattacacgatactacttgtgtctccagctgcgcgatgatattgtgtcaggacgtttgccatgctcatttgtcactctagcgctccttggatcatacaccgtacagtctgaattgggcgactatgatcccgatgagtgcgggtctgattatatttctgagttcaggttcgctccaaatcataccaaagaacttgaagataaggtcatcgagcttcacaagtcacacagggggatgacacccgctgaggcggaaatgcacttcctcgagaatgcaaaaaaattgtctatgtacggcgtagatctgcaccacgctaaagactccgaaggagtggagattatgctcggagtatgtgcgagcggactgttgatatatagggacaggttgagaattaatagatttgcctggcctaaagtcttgaagattagctacaagagaaacaatttttacatcaaaatcagacccggcgagtttgaacagttcgaaagcaccatcggatttaagctgccaaatcaccgcgcggcaaagaggctctggaaagtttgcgttgagcaccacacattctttcggctgttgctccctgaagcccctcccaaaaagtttctgaccctggggagcaagttcagatattctgggcgtacccaggctcagactagaagagcttcagcactgatagaccgaccagcaccttatttcgaaagaagtagctcaaaaagatatacaatgtcaagaagcctggatggggcgagtgtcaacgaaaatcacgaaatttacatgaaagattctatgagcgccgccgaagtggggaccggacagtatgccaccaccaaaggaatttctcagactaaccttataacaacagtgacaccagaaaagaaggccgaggaggagcgcgacgaggaggaggacaaaagacggaaaggagaggaggtcacacccatatcagccatacgacacgagggcaagaccgactcagaacggaccgacaccgccgccgatggtgagacgactgccacggaggagttggaaaaaacgcaggatgatcttatgaaacatcagactaacattagcgagcttaaacggaccttcctggaaacctcgaccgacacagcagtcaccaacgaatgggagaaaaggctgtccacgtcccccgtgcgcctggctgcacgtcaagaagacgcacccatgatcgagcctctcgtacctgaggaaaagatggagacgaaaactgagtccagtggtatcgaaaccgagcccacagtccatcaccttccactcagcaccgagaaagtcgtgcaggagactgttcttgtggaggaacggagagtagttcacgcttcaggggacgcctcttattcagccggagattccggtgacgcggccgcacagcccgccttcacggggatcaaagggaaggagggttcagccctgaccgaaggcgcgaaggaggagggtggcgaggaagtggctaaagccgtactggaacaggaagagaccgctgctgcatctagggagaggcaggaagagcagtccgccgccatccatatttccgagactctcgaacagaagcctcacttcgagagcagcaccgtgaagacagaaacaatctctttcggatcagtatctcccgggggggttaaattggaaattagcaccaaggaggtgcccgtcgtgcacactgagactaagacaattacctacgagtcgtcccaagttgacccaggcacagacctggaacctggtgtccttatgagcgctcagaccatcaccagtgagactacctctaccactactacgactcacatcaccaagaccgtgaagggcggtatctctgagacccggatcgagaagcgcattgttattacaggagacgcggatatcgatcatgatcaggctttagctcaggctattaaggaagctaaggagcaacatcccgatatgtccgttaccaaagtggtggtgcacaaggaaactgagattacacccgaggatggagaggattag

SEQ ID NO: 186844 - DNA, 1179 bp, Artificial Sequence
  Description of Artificial Sequence: Synthetic coding sequence
atgaagcaccagaccaacatcagcgagctgaagcggaccttcctggaaaccagcactgatacggccgttaccaacgagtgggaaaagagactcagcacatcacctgtccgcttagccgcccggcaggaggatgctccaatgattgaacccctggtacctgaggaaccctctgtcattaaaaagatgcaggaaggcgacagtgccgattccgtagttacttctcggcaaataattttccaaaaaactgtaccctctacattggagacgaaacagagcagcggcgaaaaactgatggatggaagcgaaatcttctccctcttggagtccgcccgtaaacccaccgagtttatcggaggcgtgacaagtacctctcaatcctgggtgcagaagatggagactaagaccgagtcatctggaattgaaaccgaacccactgtgcaccatctgcctctgtcgaccgaaaaagttgttcaagagaccgtcctggtagaagaacggcgcgtggtgcacgcctctggggatgcctcgtactctgccggagactcaggtgatgctgccgcccaaccggcctttactggaattaaaggcaaagagggatccgccctgacagaaggcgccaaggaagaggggggagaggaggtcgcgaaggcagtgctcgaacaggaagaaaccgcagccgccagccgggagcggcaggaggagcagagtgccgccattcatatctcagaaaccttagagcagaagcctcacttcgaatcgtccaccgtaaagaccgaaaccattagctttgggagtgtctcccctggaggcgtgaagctggagatctccactaaggaagtccccgtggttcacaccgaaacaaaaacaatcacatacgagagctctcaagtcgatcccggcactgacctcgagcccggggtgttgatgagtgcacagaccataacatcggaaaccacatcgacaacaaccacaacacacatcacaaaaacagtgaaaggtggaatttccgaaactagaatcgagaagagaatagtgataaccggcgacgccgacatcgaccatgaccaggcgctggctcaggctattaaagaggccaaagagcaacatcctgacatgtccgttaccaaggtggttgtgcataaagagacagaaatcacgccggaggacggggaagattag

SEQ ID NO: 186845 - DNA, 936 bp, Artificial Sequence
  Description of Artificial Sequence: Synthetic coding sequence
cggtggcagctgggcggcgccgccaccgccgccgccggcggcgcccgggtatggcggcccttgcccgcttcaaggtcgtccttcccgccaccctcccctcgattggacccaggggaattcgagggaaagagtccttgcggaggaacgtgcgagcagccatatttaagtctcccacttaggtacttcttcagccccaggaaagtcgtcccagccggatgtgagcaagcccccgggggcgccccgaaagagggattcggcgatagcgactccgagtctaagcccgaccaagaggcggaaccccaggaggccgccggcgctcagggcagagctggggctcctgtgcccgaaccccctaaagaggagcaacagcaggcactggagcagttcgcagcagctgccgcacacagcacgcccgtccggagggaggtgaccgacaaagaacaggagtttgcggcgagggcagcaaaacaacttgagtaccagcaactcgaggatgataagttaagccaaaaaagttcttccagcaaactgagtcgatccccgctcaagattgtgaagaagcccaagtcaatgcagtgtaaagtaattctcctggatggctctgaatatacctgtgacgtggaaaaaaggtcccggggtcaagtgctcttcgacaaggtgtgcgagcatcttaatcttctcgaaaaggactactttggactcacctatagggacgctgagaaccagaagaactggctggacccagctaaagagattaaaaagcaggtccgatccggggcttggcatttctcgtttaacgtcaaattttaccctcctgacccggcccagttgtctgaggatataactcggtactacctctgcctacagctcagagatgacatagttagcggaaggctgccttgcagttttgtcactctcgctctactcggctcatag

SEQ ID NO: 186846 - DNA, 2652 bp, Artificial Sequence
  Description of Artificial Sequence: Synthetic coding sequence
atgaccaccgagagcggcagcgacagcgagagcaagcccgaccaggaggcggagccccaggaagcagctggtgcccaaggacgggccggtgctccagtccctgaacctcccaaggaagagcagcagcaagctttggaacagttcgcggccgctgctgctcattcgactcccgtgaggagagaggtcacagacaaagaacaggaatttgccgctagggccgcaaaacaacttgagtaccaacagttggaggatgacaagctgtcccagaagagctcatccagcaaactttcaaggagccctctgaaaatcgtgaagaagccaaagtctatgcagtgtaaagtaatattgctcgatggatccgagtatacctgcgacgtagagaagaggagccggggtcaggtcctattcgataaggtgtgcgaacacttgaatctgctcgaaaaggactattttggcctaacctaccgcgatgccgagaatcaaaagaactggctggacccggcaaaggaaatcaagaaacaggttcgttctggcgcatggcacttcagtttcaacgttaaattctatccccccgaccctgctcagctgtctgaggatataacgcgctactacctctgccttcagctgcgcgacgatatcgtaagcgggaggttgccttgctcattcgtgacccttgcgctgttggggagctataccgtgcagtcagagctgggggattacgatccagacgagtgcggtagcgattatatctccgaattccgttttgctcccaaccacaccaaggaacttgaggacaaggtgattgaactgcataagtcacacaggggaatgacacctgcagaggccgagatgcacttcctggagaacgctaagaagctcagtatgtacggggtcgatttgcatcacgccaaagactcggaaggagtggagatcatgctgggggtttgtgcttcagggctgctgatctatcgggatcggctcagaatcaaccgcttcgcctggcctaaggtgcttaagatctcatataagagaaataatttttacattaagattaggcccggtgagttcgagcagttcgagtccactatcggtttcaagctccccaatcacagagccgccaagaggctctggaaggtgtgcgtggagcaccatacattcttccgcctgcttctaccagaggccccccccaagaagttcctgacactcgggtcgaaattccggtactccgggcgcacgcaggcccagacgcgcagagcctccgctctgattgaccggccggcgccatactttgagcgctcctctagtaagcggtatacgatgtctcgttcacttgacggcgccagcgtcaacgagaatcacgagatatacatgaaggacagtatgtcagcagctgaggtggggaccggccagtacgctacaaccaagggcatctcacagacgaatctcatcactactgtcacccctgagaagaaagctgaagaagagagagacgaggaagaggataaacgacgaaagggtgaagaagtgacccccatcagcgccattagacatgaaggcaagactgacagcgaacgcacggacacagcagccgatggtgaaaccactgctactgaaagtgatcaagaggaagatgctgaactcaaagctcaggagctggagaaaacacaagatgatctcatgaaacatcagactaacatcagcgagctgaaaagaaccttcctcgagacatctacggataccgcagtcaccaatgagtgggaaaaacgactgtcaacttcccccgtacgcctcgccgctcggcaggaggatgcccctatgattgagccgctcgtgcctgaagagaccaagcagtcttctggcgaaaaattgatggacggttctgaaatcttcagccttctcgagagcgcccgtaagccaaccgaattcatagggggtgttaccagcacatcacaatcttgggtacaaaaaatggagaccaaaactgagtctagcgggatcgagaccgaacctactgtgcaccatttaccgctgagcaccgagaaagtcgttcaagaaacagttctggttgaagagaggagagtggtgcacgcatccggcgatgcctcctatagcgccggtgacagcggtgatgccgcggctcagcccgcattcactgggattaagggaaaagagggctccgccctgacagagggggctaaggaagagggcggggaggaagtagctaaagccgtgcttgagcaggaagagacagccgcggcatcccgggagcgccaagaggaacaatctgctgctattcacatttccgaaactcttgagcaaaaacctcacttcgagtcctcaaccgtcaagacagagaccatatctttcggatcagtgagcccgggaggcgtgaaactggaaatttccacaaaggaagtgccagtggtacacaccgaaacaaaaacaattacctatgaaagctctcaggtcgaccctggcacggatctagaaccaggcgtgctgatgagcgcacaaactatcacctccgaaactacaagtaccacgacaaccacgcatatcacaaagactgttaaaggaggtatctcagagaccaggatcgagaagaggattgtgatcacaggagacgctgatattgatcatgatcaggaatag

SEQ ID NO: 186847 - DNA, 2271 bp, Artificial Sequence
  Description of Artificial Sequence: Synthetic coding sequence
atgcagtgcaaggtgatcctgctggacggcagcgagtacacctgcgacgtggagaagagatccaggggtcaggtgctgtttgacaaagtgtgcgagcatctcaatctgcttgagaaggactattttggtctgacctatcgagatgcggagaaccaaaaaaactggctggacccagccaaagagatcaagaaacaggttcgtagcggcgcctggcatttttccttcaacgtgaaattctaccccccagatcccgcacagctaagcgaggacatcactcggtactatctgtgtttacagctgcgggacgatatagtttccggcaggctgccctgctccttcgtgaccctggcactgctgggctcctacactgtgcagagtgagttgggggactacgatcctgatgaatgtgggtccgactatatttctgagttcagatttgcgccaaatcacaccaaggaactcgaggataaagtgattgagctccacaaaagtcacaggggtatgacaccggccgaggcagaaatgcacttcttggaaaatgccaagaagctcagcatgtacggggtggaccttcatcacgcaaaagatagtgagggagtggaaattatgctcggggtttgcgcatcgggcctcttgatctatcgcgatcggttaaggatcaataggttcgcctggccaaaggtactgaagatcagctacaaacggaacaacttttatatcaagataagacccggagagtttgagcagttcgagagtacaataggcttcaagcttcccaaccatagagccgctaagagactgtggaaagtctgcgtggagcaccacacttttttccgcctgctgctccccgaagcacctccaaaaaaattcctgactcttggatccaaatttagatactccgggagaacccaggctcagacccgccgagctagcgccttgatcgaccgtccggcaccctatttcgagcggagcagtagtaaaaggtacactatgagtagatcgttagacggggcatcagtcaatgaaaatcatgaaatttacatgaaagattcaatgtccgccgctgaggtgggaacaggacagtacgccacgacgaagggcatctcccagaccaacctcatcacaaccgtgacccctgagaaaaaagccgaagaggagagagacgaggaggaggacaaacgtcgaaagggggaggaagtcacccctatctcagccatccggcatgagggcaaaacggattccgagcgaaccgatactgctgccgacggcgagaccacagccaccgaagagttagagaaaactcaagatgacctgatgaaacatcaaacaaatatctcagagcttaaaagaacctttctggaaacatctacagacacagcagtcacgaacgagtgggagaaaagactctcaacctctcctgttcggctcgctgccaggcaggaagatgcacctatgatagagccactggtccccgaggagaaaatggaaaccaagacagaatcttccggtatcgaaacagaaccaacagtacatcatcttcccttgtccacagagaaggtggtgcaggagacagttctggttgaggaaagacgggtagttcatgcatccggagacgcgtcttactccgccggcgattcaggggacgccgcggcacagccagcatttaccggcatcaagggcaaagagggctcagctttgacagagggagccaaggaggagggcggcgaggaagtggcgaaagcggtgctggagcaggaagagactgccgcagcatccagggagcgccaagaagagcaatctgcggccattcatatctctgagacattagaacagaagccccactttgaatcctcaaccgtgaaaactgagaccatcagcttcgggagtgtgtccccgggcggcgtgaaactggagatctcaaccaaagaagtgccagtggtgcacaccgaaaccaagacgatcacttacgagtctagtcaggtcgatccaggcacagatcttgagccaggtgttctgatgagtgcccagaccataacatcagagaccacgtcgactacaaccaccacccacatcaccaagacggtgaaagggggtatcagcgaaacacgtattgagaagcggattgtcatcactggggatgccgacattgaccacgatcaagctttggcccaagcaatcaaagaggccaaagaacagcaccccgatatgagcgtcacaaaagttgtcgtgcacaaggaaacagaaataacgcctgaggatggagaggattag

SEQ ID NO: 186848 - DNA, 2166 bp, Artificial Sequence
  Description of Artificial Sequence: Synthetic coding sequence
atgggccagggcgagcccagccagcggagcaccggcctggccggcctctatgccgctcctgctgcctcgccggttttcatcaaaggaagtgggatggacgccctgggaatcaaatcctgcgatttccaggctgcccgcaacaacgaggagcaccatactaaagctctgtcctctcggaggctgtttgtgcgcaggggccagccatttaccatcatcctttactttcgcgccccagttcgcgcattcctgcctgctctaaaaaaggtggcactgacagctcaaacaggcgagcagcctagtaaaataaatcgtacacaagcgactttcccaatttcatccctgggcgatagaaaatggtggtcagcagtggtcgaggaacgagatgcgcaatcttggactatctctgtgactacccctgccgatgccgtgattgggcattattccctgttgctgcaggtctccgggcggaagcaattgctgttggggcaatttaccttgctgtttaatccatggaaccgcgaggacgcagtgttcctcaagaacgaggcccagcgtatggagtacctcctgaaccagaatggccttatatatcttggcaccgccgactgcatccaggctgaatcttgggatttcggtcagttcgaaggagatgtgatcgatctttctctgagactgctgagtaaagacaaacaggtggagaagtggagccagcctgtgcacgtggctcgagtactcggggctctgctccactttctgaaggaacaacgggtacttcccacccctcagactcaagcaactcaggagggtgcacttctgaacaagaggagggggtccgtgcccatcctgcgccaatggctcacaggaagggggagaccagtctacgacgggcaagcttgggtcctggcggcggtggcttgcaccgtcctaagatgcctgggcattccagcgcgggtcgtaacaacatttgcttctgcccaaggtaccggcgggaggctcttaattgacgaatattataatgaggagggcctgcagaacggagaaggccaacgaggaaggatatggatctttcagacaagtacagagtgctggatgacgcgccccgctctgcctcagggctatgatggttggcagatactgcatccctctgcccctaatggaggcggggtgctcgggtcctgcgatctggtacctgttcgtgccgtcaaagaagggactcttgggctcactcctgcagtttccgatcttttcgctgccattaatgcctcttgcgtagtgtggaaatgttgcgaagacgggactctggaactgacggactccaatacaaaatacgttggtaacaatatcagtacgaagggggtgggctctgatagatgcgaggatataactcagaattacaagtatcccgagggctcccttcaagaaaaagaggtactggagagggtggaaaaggagaagatggagagggaaaaggacaatggaatccggccgcctagtctggagaccgcatctccattatacttgttattaaaggcgccaagcagtctccccttgcgcggggatgctcagatttcagtgaccctggtcaaccacagcgaacaggagaaagcagtgcaacttgccatcggagtccaggcagtacattacaatggagtgctggccgccaagctgtggcgcaaaaaacttcaccttacactctcagccaatctagaaaagatcattacaattggcctgttcttctccaattttgagagaaacccgcccgaaaatacattcctgaggctcacagccatggcaacccactctgaaagtaatttaagctgcttcgctcaagaggatatcgccatatgcagaccccacctcgcaatcaagatgcccgaaaaagccgaacagtaccagcccctgaccgccagtgttagcctccagaattccttggacgcacctatggaggactgcgtgatctccatcttaggtagaggtcttatccatcgagaacggtcctaccggtttcgcagtgtatggcccgaaaacaccatgtgcgcaaaattccagttcaccccaacacacgtcgggctgcaacgcctgaccgtagaggtggactgcaacatgtttcaaaacctgactaactataaaagtgtcacagtcgttgctcctgaactgagcgcatag

SEQ ID NO: 186849 - DNA, 1860 bp, Artificial Sequence
  Description of Artificial Sequence: Synthetic coding sequence
atgggccaggccctgggcatcaagagctgcgacttccaggccgcccgaaataatgaagagcaccacacaaaagccctatcatcaaggcgcctatttgtgcgacgcgggcaaccatttacaatcatcttgtacttcagggcgccggtgagggctttcttaccagctttaaagaaagtagctctcacagctcaaacaggagaacaaccttcaaagatcaatcgaacacaggccacctttccaatttcttccctcggcgatagaaagtggtggtccgccgtcgtggaagagagagatgcccagtcctggaccatctctgtgactacacctgctgatgcggttatcggacactatagtctgctgctccaggtgtctggccgcaagcagctcttgcttggacagttcactctgttatttaacccctggaatagagaggatgctgtattcttaaaaaacgaggctcaaaggatggaatacttgttgaatcaaaacggtctgatttaccttggaacagcagactgcatacaagctgaatcttgggatttcgggcaatttgagggggacgtgatagacctgtctctccgtctactgtcaaaagacaagcaagtggaaaaatggagtcagccagttcacgttgcccgggtgctcggagctctgcttcacttcctcaaggaacaacgcgtgctgccgacaccacagacccaagccactcaggagggagctttgctaaacaagaggcgggggagcgtccccatcctacgtcaatggttaactgggcgaggacgccctgtttatgatggtcaggcttgggtcctggcagctgtggcatgcaccgtgctccgctgcctgggaatcccggccagggtggtgactactttcgcatcagcccagggtacagggggccgcctactgatcgacgagtattacaacgaagagggcttgcaaaacggggaaggtcagaggggaagaatatggaaatgctgtgaagacggtacactggagctgaccgatagtaacacgaaatacgtaggcaataatatctccactaagggtgtggggagtgatcgctgcgaggacatcacacagaactacaagtacccagagggctcattgcaggaaaaagaggtcctcgaacgcgtggagaaggaaaaaatggaacgagaaaaggataatggaatccgtcctccctcactcgagacagcatcccctttgtacctcctccttaaggccccatcctctctacctctgcgaggggatgctcagatatctgtcacgctggtcaatcattccgagcaagagaaggcagtgcagctggctatcggtgtgcaggccgtacactataacggcgtgctggcagcaaagctgtggcgaaaaaagctgcacctaactctttccgccaatctcgaaaagattatcacaatcggactgttcttctctaacttcgagaggaatccgccagaaaatactttccttcgtttgaccgcgatggctacccatagtgagagtaacctgagctgcttcgctcaggaagacatcgcaatctgtcgccctcatctcgccatcaagatgcccgaaaaagccgagcagtaccagcctttgacagcctccgtgtccctgcaaaattcactggacgcgcccatggaagactgcgtgattagcatcttgggtcggggcctgatccatcgcgaaagatcttatagattccgctctgtatggcctgagaacacgatgtgcgccaaatttcagttcacccctacccacgtagggctccagagactcacggtcgaggtcgattgtaacatgtttcagaacctcacaaattacaaatccgtcaccgtggtcgcacccgagctgtcggcctag

SEQ ID NO: 186850 - DNA, 2076 bp, Artificial Sequence
  Description of Artificial Sequence: Synthetic coding sequence
atgggccaggccctgggcatcaagagctgcgacttccaggccgccagaaacaacgaggaacatcacaccaaggccctgagcagtcgccgattgttcgtgcgacggggacagcctttcaccataattctctacttcagagcgcccgtaagagcgttccttcccgccctgaagaaggttgcactcacagcccagactggcgagcagccttccaaaatcaaccgtacacaggccaccttccccatatcatctctgggcgataggaaatggtggtcagccgtggtggaggaaagggatgcccaaagttggaccatctctgtgacaacgcccgccgatgccgtgattggccactactccttgctgctgcaggtgtcagggaggaaacagctgctgctgggccagttcacacttcttttcaacccctggaatcgtgaagatgccgtgtttctgaaaaatgaggctcaacggatggaatacttactgaaccagaatggtcttatctaccttggaaccgccgactgcattcaggctgagtcctgggattttggccagttcgagggtgatgtgattgacttgtcactgcgtcttctttcaaaggacaagcaagtcgagaaatggagtcagcctgtgcatgtggcccgagtccttggggccctgctacacttcctgaaagaacaaagggttctcccaactcctcaaacccaggcaacccaggaaggtgcactcctgaacaaaagacgcggttctgtacctattctgaggcagtggctgacagggcggggccgccccgtctacgatggacaggcatgggtgctggcggctgtggcgtgcaccgtcctgaggtgcctggggatcccggcccgggtggtgaccaccttcgccagcgcccagggaacgggagggcggctattgatcgacgaatattataacgaagagggtttgcagaacggcgaagggcaacgagggcgcatctggattttccaaaccagcacagaatgctggatgacgcgaccggcactaccgcaggggtacgatggctggcagattctgcacccgtctgcccccaacggcggaggagttctgggatcctgcgatttggtcccggtgcgcgctgtcaaggaagggacgctcgggctcacacccgcggtgagtgaccttttcgctgctataaatgcctcctgtgtcgtgtggaagtgctgcgaagatggaacacttgaattgaccgattccaacactaagtacgtcggaaataatatctcgaccaagggagtggggagtgacaggtgcgaggacatcactcagaactacaaatatcctgaaggctctctacaggagaaggaagtcctcgaaagggtagaaaaggagaaaatggagagggagaaggataacggtattagaccaccctctctcgaaaccgctagccccttgtacttgctgctgaaagcaccttcctcgttacctttaagaggtgacgctcagataagcgtgaccctggtgaatcattctgagcaagagaaggccgtccagcttgccattggagtccaggcagtccactataatggcgtgctcgcggcaaaattgtggaggaaaaagctccatctgactctgagcgctaatttggaaaagataatcaccatcggcctattctttagcaacttcgagcgtaatccccctgagaacacctttttacggcttaccgccatggctacccacagcgaatccaacctcagctgctttgcccaggaagacattgccatctgcagaccacaccttgccatcaagatgccagaaaaggcagagcagtatcaacccctgactgcgtctgtcagcctgcaaaatagcctcgatgcacccatggaggattgcgtgatctccatcctcggtcgaggacttattcaccgggagcggtcttatagattcagaagcgtttggcccgaaaacaccatgtgcgcaaagtttcagttcacccctacacacgttgggctccagcggttgacagtggaagtggattgtaatatgttccagaacttgactaactataaatctgtcaccgtggtggcacctgagctgtccgcgtag

SEQ ID NO: 186851 - DNA, 1842 bp, Artificial Sequence
  Description of Artificial Sequence: Synthetic coding sequence
atgggccaggccctgggcatcaagagctgcgacttccaggccgccagaaacaacgaggaacaccatacaaaggcgttatcgtctagacgcctttttgtccggcgaggacagccatttactattattctgtactttagagcccctgttagggcctttctgcctgcccttaaaaaagtggctctgactgctcagactgaagacgccgtcttcctgaaaaacgaggctcaaagaatggagtacctactgaaccagaatggtcttatctatctcggcaccgccgactgtatccaggccgagagttgggatttcgggcagttcgaaggcgatgtgatcgatctaagtctgcgtctgctgtccaaggacaaacaggttgagaaatggagccagcctgtccatgttgcacgtgtcctgggagctttactccattttcttaaggagcaaagggtgctacccaccccgcaaacacaggcaacccaggaaggcgccctgcttaacaaacgccgcgggagtgtccccatccttaggcagtggttaacaggtcgcggtagacccgtgtatgatgggcaggcctgggtgttggcagcggtggcatgcacagtgctccgatgtctgggtatccccgcccgtgtcgtaactacttttgcgtccgctcagggaacaggaggaagactactcatcgatgagtactataacgaggagggactgcagaacggggaaggccaaagggggcgaatatggatcttccaaacatccacagaatgctggatgacacggcccgcactgccgcagggttatgatgggtggcagatccttcacccctccgcacctaatggtggtggagttttgggtagttgcgacctggttcccgttcgggcagtcaaagaggggacactgggcttgactccagctgtgtcagacttattcgcggcgatcaacgccagctgtgtggtctggaaatgttgtgaggacggtaccctggaactgacagatagcaatacgaaatatgtggggaacaatataagtaccaagggagtgggaagtgaccggtgcgaggacatcacccaaaattacaaatatccagaaggcagcctccaggagaaagaagtgctcgaacgtgtggaaaaggagaaaatggagcgagagaaagacaatggaatcaggccacctagccttgagacagcctcacccctttacctgctcctaaaagctccttcttcgctgcccttgaggggagatgctcaaatttccgtgacactggtaaatcattctgagcaggaaaaagctgtgcagcttgctatcggagtccaggccgtgcactataacggggtcttggccgctaagttatggagaaaaaaactccacctcacactctccgcaaatcttgagaaaatcattactatcggtcttttcttctcaaactttgaaagaaatccgcccgaaaacacttttctgcgtcttacagcgatggcaactcactccgagtctaatctgtcctgttttgcgcaggaggatattgcgatttgcagaccccatctagcaattaagatgcccgaaaaagctgaacagtaccaacccttgactgcttccgtcagcctgcaaaactctctcgatgccccgatggaagactgtgtcatcagcattctcgggcgcggcctaatccacagggagaggagttacagattccggtctgtgtggcccgagaataccatgtgcgcgaaatttcaatttacccccacgcatgtgggattgcagcgcctgactgttgaagtcgactgtaatatgtttcagaacttaacaaattacaaatcggttacagtggtggcacccgaactgtcagcatag

SEQ ID NO: 186852 - DNA, 1218 bp, Artificial Sequence
  Description of Artificial Sequence: Synthetic coding sequence
atggagcggctgcagaagcagcccctgaccagccccggcagcgtgagcccatccagagattctagtgtgcctggatccccctcttcaatcgtggctaaaatggacaatcaggtcctcggttataaggatctggcggccattcccaaggataaagctatcctagatatcgagagacccgacctgatgatatatgaaccccatttcacttatagcctcctggagcatgtggagctacctcggtcacgggaaagaagcttgagcccaaaaagcacgtcccccccacccagccccgaagtttgggccgatagtcgaagtcccggcatcatcagccaagcttccgccccacgaaccacgggcactccacggacttccctgcctcacttccaccatcccgaaacatccaggcctgactccaacatctacaagaaaccaccaatctacaagcagagagagtccgtcggaggatctccccagactaagcacctaatcgaagatctgattatcgagtcttccaagtttcccgcagcacagccgcctgaccccaaccagcctgccaaaatcgagaccgactattggccttgcccccccagcctggccgttgtcgagaccgaatggcgcaagaggaaagcatctcgcaggggggcggaggaggaggaagaagaggaagatgacgatagtggtgaagagatgaaggcactgcgggaacgccagagggaagaactgtctaaggtcaccagcaatttgggcaaaatgattctaaaggaagagatggaaaaatccctgcccattcgaaggaaaacccggagcctccccgatcgcacccctttccatacatctttacatcagggtaccagcaagagcagtagtctgcctgcctacggtagaaccactctgagccggctgcagagcaccgagtttagccctagcggctcggaaaccggatcgcccggcctccagaacggggaagggcaaagaggaaggatggacagaggcaactccctcccttgtgtgttggaacaaaaaatttatccatacgaaatgctagttgttacgaacaaagggagaaccaagctgccccccggggttgataggatgagactcgagaggcacctttccgctgaagacttcagccgggttttcgctatgtcaccagaagaattcgggaaattggctttatggaagaggaatgagctgaaaaagaaggcctccctcttttag

SEQ ID NO: 186853 - DNA, 1218 bp, Artificial Sequence
  Description of Artificial Sequence: Synthetic coding sequence
atggagcggctgcagaagcagcccctgaccagccccggcagcgtgtcccccagcagagattctagcgtccccgggtctcccagctccattgttgcaaagatggataatcaggttctgggctataaagacctagcagccatccccaaggataaagccatcctggatattgagcgcccagatcttatgatatatgagccacactttacttacagtctcctggagcacgtcgagctcccccgaagcagggaacgcagcttatcgcctaaaagcaccagcccacccccttcacctgaggtttgggccgactccagaagcccaggcataatttcccaggcatcagcccctagaacaaccgggacgccgcggaccagcctaccacattttcaccatcccgaaacctcccgacctgatagtaacatctacaaaaaacccccaatatataagcagagggagagcgtgggcgggagcccccagaccaagcacctgattgaggaccttatcattgagtcttctaagtttcctgcagctcaacctcccgaccctaatcagcccgccaagatcgaaaccgactattggccctgtcctccctctttggctgtggtggaaactgaatggcgcaagcggaaggcctcccgccgtggcgcggaggaagaagaggaagaggaggatgatgattctggggaggagatgaaggcgctgagagagcggcagcgtgaagaactctctaaggtgacatccaacctggggaagatgatcttaaaggaagaaatggagaaaagccttcctattcgtcgcaaaacacgaagccttccagacagaacaccattccacacctcccttcaccagggaacctcaaagtctagcagcctgcctgcctatggccgaaccacgttaagcagactccaaagcacagagttctctccaagcgggtccgagactggaagccctggtctgcaaaatggcgaaggccagaggggaagaatggacagaggtaattccctgccttgcgtcttggaacagaagatttacccatacgagatgctggtcgtcactaataaagggcggactaagttacccccaggggttgaccggatgcgtctggaacgccacctgtcagctgaggacttctcccgagtgtttgcaatgtcccccgaggagttcggcaagctggccctgtggaaacgtaacgagctcaaaaagaaagcctcactgttctag

SEQ ID NO: 186854 - DNA, 1626 bp, Artificial Sequence
  Description of Artificial Sequence: Synthetic coding sequence
atgatctacgagccccacttcacctacagcctgctggagcacgtggagttaccacgctcccgcgagcggtccttatctcctaaaagcacgtccccaccacctagtccagaggtttgggctgattctcgttctcctggaattatcagccaggcgtccgcgccgcgtaccactggcacgcctcgcacctctctgcctcactttcaccatccagagacgagtcgtcccgactcgaatatctacaagaaacctcccatatataagcaacgagagagcgtgggtggctccccccaaacaaagcatctcattgaggacctaataatagaatctagtaaatttcctgccgcccagccaccagatcctaaccagccagctaaaatcgagacagactactggccttgtccaccttcactcgccgttgtcgaaacagaatggaggaagcgcaaggctagtagacggggggctgaagaagaggaggaggaagaagacgatgactcaggcgaagaaatgaaggctcttcgtgagcgacaacgagaagagctttccaaagtgaccagtaatctgggcaagatgatcctcaaggaggaaatggaaaagtcactgcccatccgaaggaagacacgctcccttccagatcgcacacctttccacaccagcctacatcaaggaacatccaagagtagctccctgcccgcctatggccggacaacactgtcacgcttgcagtccactgaattcagccctagcggctcagagaccgggagccccggcttacagaacggggaagggcaacgcgggcgtatggacagaggaaatagcctcccttgtgtgctcgaacaaaaaatctacccctatgaaatgttggttgtgactaataagggccggacaaaactgccacctggagtggacaggatgaggctggagcgacacctgtctgctgaggatttttcgagagtgtttgcaatgtccccagaggaattcggaaaattggcactgtggaagaggaacgaattgaaaaaaaaggccagcctatttggggccctggttgtaagaccagttggatgtctggaacagctggaaggcaggtgcagaggagggaaaagacccggccgaaaaagctcccggctgttgtgtaggcccccgtccccacctattctcacccccgactcatttccagcacttcagccccctgcccctctgacattagtcggaactggtcctagctctgcgagcggccgagaggtgaccccaccgctgcagctggccttgacttcagccagaaaacctagggcatctaagcctttcgcccccgccctgagattgccccagaaacccggcctgcgtgtggagatgccgccgacccatgaccctggcccaccacccgccagccggcccagaaacggcaacagttctaccaaaccaggaactggtcagaagctgggtctcccgccgccccttgacggcgtgaaaaggccaggtctggcccatttcggggtttcttggctccccgctctaacatacacacacgcgccccctcacactctgtgtagcttaaagaacgtgatctattggggcccaccaagctgcttcccacatctccctttaccataccttaccccacccgcttag

SEQ ID NO: 186855 - DNA, 1152 bp, Artificial Sequence
  Description of Artificial Sequence: Synthetic coding sequence
atggagcggctgcagaagcagcccctgaccagccccggcagcgtgtcaccttcaagggattcctccgttccaggctcgcctagcagcatcgtggccaaaatggataaccaggtgctcgggtacaaagatcttgccgctatcccaaaagataaagctatactggacatcgagagaccagacttgatgatctacgagcctcactttacatatagtttattggagcatgtcgagctcccacgcagtagggaacggagcctgtcgccaaagtccacatctcccccaccctcaccagaagtgtgggccgatagcagaagccctggtattatctcccaggcaagtgcacccaggaccactgggaccccgcgtacatccttgccccacttccaccatcctgagacatctagacccgatagcaacatctataaaaagccgcccatttacaagcaacgggagtctgtgggaggttcaccacagaccaaacacctgatcgaggatctaattatagagagttccaagttcccagctgcacagccgccagatcccaatcagcccgccaaaatcgaaaccgattactggccctgtcccccaagtcttgctgtggttgagacagagtggcgtaaacggaaagcatctcgcagaggagctgaggaggaggaagaagaggaggatgatgattctggcgaagagatgaaggccctgcgggagaggcagagagaagagctgtcaaaagtgacatcgaatttgggaaagatgatccttaaggaggagatggaaaaaagccttccgatacgccgcaaaactcggtcacttcccgatcgcaccccgttccatacgagtctacatcaggggacctccaagtcctcttccctgcctgcctatggcaggactaccctcagcagattacagtccacagagttctctccgtctgggtccgagactggtagccctggactccagatttatccttatgaaatgctagtagttactaacaaaggtcggaccaagcttccaccaggtgtggaccggatgcggctcgagcgtcatctcagcgcagaagacttctctcgcgtttttgctatgagtcctgaagaattcggtaaactggccctatggaagcgcaatgagttaaagaagaaggcttctctgttctag

SEQ ID NO: 186856 - DNA, 1152 bp, Artificial Sequence
  Description of Artificial Sequence: Synthetic coding sequence
atggagcggctgcagaagcagcccctgaccagccccggcagcgtgagcccatccagagacagcagtgtgccaggcagtccctcatccattgtggccaaaatggataatcaggttctggggtataaggacctcgcagctatccccaaagacaaagcgatcctggacattgagaggcctgacctgatgatttatgagccacattttacttattctctgttggagcacgtggagcttcccagaagtagggaacggagcctgagccccaagtccacttctccaccaccaagtcccgaagtgtgggctgattctaggagtccaggaatcataagccaagcatccgctccccggacaaccggaacgccccgcacgtcactacctcacttccatcatccagagactagtcggccagactctaacatttacaagaagcctccgatatataaacagcgcgagagcgtcggtggttctccccagacaaaacatctcatcgaggatctaattatcgaaagctccaaatttcccgccgctcagccacccgatccgaaccaaccagccaaaattgaaaccgactactggccgtgcccaccatcgttggcagtggttgaaaccgagtggcggaagaggaaggcgtctcggcgcggggccgaggaagaggaggaggaagaagacgatgattccggggaggagatgaaggccctgcgggaacgacagcgagaagagttgtcaaaagtaaccagcaacctaggtaagatgattctgaaagaagaaatggaaaaatccctccctatccgtagaaaaactagaagcctccccgatcgtactccattccacacttccctgcatcagggcacctccaagagttcttccctgcccgcctatggccgaaccaccctttcacgtttgcaaagcacagagttttcacctagcgggagtgaaacagggtctcctgggctgcagatttacccctatgagatgctggtcgtgaccaacaaaggccgcacaaaattaccacccggcgttgacagaatgaggcttgagagacacttgtctgcagaagatttctcacgagtgttcgccatgtcacctgaggaatttgggaaattggccttgtggaagaggaacgagctgaagaaaaaggcttctttgttctag

SEQ ID NO: 186857 - DNA, 1218 bp, Artificial Sequence
  Description of Artificial Sequence: Synthetic coding sequence
atggagcggctgcagaagcagcccctgaccagccccggcagcgtgagccctagccgggacagctctgttcctggcagccctagtagtattgtggctaagatggacaatcaggtgctgggctacaaagacctggccgccataccaaaagataaggcgatactcgacattgaaagacccgatctcatgatttacgagccacacttcacatattctctgctggagcacgtggagctcccacggtccagagagcggagtctgagccctaagagtacatctccacccccatctcctgaggtatgggctgattctcggtcgccaggcatcatctctcaggcaagtgcaccccggacaacgggtacgccacggaccagcctaccccatttccaccatccagagaccagccgacccgattccaacatctataagaagcctcccatatacaaacaacgcgagtctgttggtggtagcccccaaactaaacacctgattgaagacctgatcattgaaagcagtaaattcccggctgcacagccaccagatcccaaccagccggccaagatagagacggactattggccatgccctccaagcctcgcagtggtggagacagaatggcgaaagcgcaaagccagtagaagaggggccgaggaggaggaagaagaagaagacgatgacagcggtgaggagatgaaggctctgagggaacggcagagggaggagttatcaaaagtcactagcaacctcggcaagatgatcctgaaggaggaaatggaaaaaagcttgcccatacgtcggaaaacgcgttccctcccagatcggacgccatttcacacttcactgcaccaggggactagtaagtctagcagtcttcctgcttacgggaggaccactttatctagactgcagagcacagagttctcccctagcgggtccgagaccggttcacctggattgcagaacggagaagggcaacggggtagaatggatcggggcaattcccttccttgtgtgcttgaacaaaagatctacccgtacgagatgctcgtcgtaaccaacaaaggccggacaaagcttcctcccggagtagaccggatgagactggagaggcatctctccgcggaagatttcagtcgcgtgtttgccatgtcacctgaggaatttggcaagctggctttatggaagcgaaacgaactgaagaagaaggccagcctgttctag

SEQ ID NO: 186858 - DNA, 1077 bp, Artificial Sequence
  Description of Artificial Sequence: Synthetic coding sequence
atggagcggctgcagaaggccaagatggacaaccaggtgctgggctataaggatttggctgcgattccaaaagacaaagcaatactggacatcgaacggcccgatctgatgatctatgagccacacttcacatactccttactcgaacacgtggaactgcctaggtcaagagagaggagcctgtccccaaagtctacttcacccccaccatctcctgaagtgtgggccgatagcagaagccctggcatcatttctcaggcctcagcgccccgaacaacagggacaccaagaacatcccttccacattttcatcatcccgagacatcccgaccagactccaatatctacaaaaagccacctatttataagcagagggaatcagtcgggggctctccccagaccaagcatctcattgaggatctgatcatcgagagttcaaagttcccggccgcacaaccccccgacccaaaccaacctgctaagatcgagacagattattggccgtgtccccctagcctagccgtggttgagaccgagtggcggaaaagaaaggctagtcgcaggggcgccgaggaagaggaggaagaagaggacgacgactcaggagaggagatgaaagctttacgggaaaggcaacgcgaagagctgtccaaagtcacctctaatctgggaaagatgatactgaaggaggagatggagaagagcctacctatcagaaggaaaaccaggtccttaccagaccgaacccctttccatactagtcttcatcaggggacaagtaaaagctcctcactgccagcttatgggaggaccaccctctcacggctgcaaagtacagagttctctcctagcgggtctgagacggggtcgcctggtctgcagatatacccctacgaaatgcttgtcgtgaccaacaaaggccgtacgaaactgccacctggcgtcgacagaatgaggctggaacgtcacctgtctgcagaggacttttcccgggtgttcgccatgtctcctgaagaattcggtaaactggcactttggaagagaaacgaactgaaaaaaaaggcgtccctgttctag

SEQ ID NO: 186859 - DNA, 1152 bp, Artificial Sequence
  Description of Artificial Sequence: Synthetic coding sequence
atggagcggctgcagaagcagcccctgaccagccccggcagcgtgagtccatcgagggattcctctgttccaggaagcccaagcagtatcgtggcgaagatggacaaccaggtgctcggttacaaagacctggcagctattcccaaggacaaggccatcctcgatatcgagcggcccgacctgatgatttatgagccacacttcacctacagcctgttagaacacgtagaactcccacggtcgcgcgagcgatcgttgagccctaaatctacatcccccccgcccagtccagaggtgtgggccgattctcgctcacctggtatcattagtcaggcaagcgccccacgcacaacaggcacacctcgcacttcgcttcctcatttccatcaccctgaaactagtagaccggatagcaacatttataaaaagccacctatctataagcagcgagagagcgtgggtgggtcccctcagactaagcatttgatagaggatctgatcattgagtccagtaagttcccagctgcccagcctcccgatcccaatcagccagccaagattgagaccgactattggccttgcccccctagtctcgcggttgtggagacagaatggcggaaacggaaagcttccagaagaggcgcggaggaggaggaggaggaagaagacgacgatagtggtgaggagatgaaggctttgagggaacgccagcgtgaggagctgtccaaggtcacctccaacctgggaaaaatgatccttaaagaagagatggagaagagccttcccatccggaggaaaacacgaagcctgcctgatcgaacgcccttccatacatcattacatcagggaaccagtaagagcagctcacttcctgcatatggacggacgaccttgagcagactacagtccactgaattttctcccagtgggagcgagacgggatctcctggtctgcagatctacccatacgaaatgctggtggttactaacaagggtcgtacgaaactgcctcctggcgtggacaggatgaggctggaacggcacctctccgccgaagacttcagtcgggtatttgccatgtcacccgaagaatttgggaagctggccctctggaaaagaaatgaattaaaaaagaaggcttcactgttctag

SEQ ID NO: 186860 - DNA, 1218 bp, Artificial Sequence
  Description of Artificial Sequence: Synthetic coding sequence
atggagcggctgcagaagcagcccctgaccagccccggcagcgtgagcccttctcgtgattcgtcagtccctgggagcccttcctcaattgtcgccaaaatggacaatcaggttcttgggtacaaggatctcgctgccatcccaaaggataaggcaatactggatatcgagagaccagatctcatgatttacgagccccatttcacatactcgcttttggaacacgtcgaactgccaagaagcagagaaagaagcctcagtcctaaatcaaccagtccccccccaagccctgaggtttgggcggacagccgaagcccaggaatcatttcccaggctagcgccccaaggaccacgggaactccaagaacatcattaccacactttcatcatcctgaaacaagcagacctgacagcaacatttataagaagccgcccatatataagcagagggagagcgtcggagggtccccgcagacgaagcatttgatcgaagatctaatcatcgagagctccaagttccctgccgcccagccgccagatccaaatcaaccagctaagatcgagacagactactggccgtgtccacccagcttggctgtggtggagacggaatggcggaagcgtaaggcctccaggcgtggagctgaagaggaggaggaggaggaggacgacgattccggggaggagatgaaagctcttagggaacgccaaagagaagagctgagtaaggtaacgtctaatttgggaaagatgatactcaaagaggagatggagaagtctttgcccatacgtcggaagacacgaagtctccccgatagaacgccattccacactagtctgcatcaggggacatcaaagtcatcgtcactgcctgcttatggtcggacaactttgtccaggctccaatcaacagaattcagtccctctggctccgaaaccggcagccctggcctgcagaatggggagggccagcgggggcgaatggatcggggaaactccctgccctgtgtactcgagcagaagatttatccctatgagatgcttgtagtgacaaacaagggacggacaaagctccctcctggcgtggaccggatgcgactggaaagacatctgtctgccgaggatttcagcagggtgttcgccatgagccccgaggagttcggaaaactggccctgtggaaaaggaatgaattgaagaagaaggcttctttattctag

SEQ ID NO: 186861 - DNA, 1098 bp, Artificial Sequence
  Description of Artificial Sequence: Synthetic coding sequence
atggagcggctgcagaaggccaagatggacaaccaggtgctgggctacaaggacctggccgcaatccccaaggacaaggcaattctggacatagagcggcctgacctgatgatatacgagcctcacttcacctattcactgctagaacacgtggaactgccaaggtctcgcgaagtttgggctgactcccggtcccccgggataattagtcaggcgtccgccccacgcacgaccggcactcccaggaccagtctgccgcactttcatcaccccgaaacttcacgtcccgatagcaacatttacaaaaaaccacctatctacaagcagcgggagtcagtgggaggatccccccaaaccaagcacctcattgaggatctcatcatcgagtcatccaagtttcctgcggcgcagccccccgaccctaatcaacctgctaaaatcgaaacagattattggccttgtccaccctcgctagccgtggtcgaaaccgagtggcgaaaaagaaaagcctcccggcgcggggcagaggaggaagaggaggaagaagatgatgacagcggggaggaaatgaaggcgctccgggagaggcaaagggaagaattgtccaaggtgacgtccaacctcgggaagatgatactgaaggaagagatggagaaatccctcccaatccgaaggaagactagatccctccccgatcgaactccgtttcataccagcctccaccagggtacatccaagtcttcatccctgcctgcgtatggcagaactacactgtccagactccagagcacagaatttagtccatccggctctgaaacaggcagccctggcttacagaatggggaaggacaaagggggcgcatggaccgtggaaattcactcccttgtgttctggaacagaagatctacccttacgagatgctggtggtcaccaataaaggtagaaccaagctgccaccgggagtcgatagaatgcgtctggaaagacacctctctgccgaggatttctcccgcgtgtttgccatgtcaccggaagagtttggaaaactcgcgctctggaaacgcaatgagttaaagaagaaagcaagcttattctag

SEQ ID NO: 186862 - DNA, 570 bp, Artificial Sequence
  Description of Artificial Sequence: Synthetic coding sequence
atggacgccgtggacgccaccatggagaagctgcgggcccagtgcctgtccagaggggcctctgggattcagggtctggcaagatttttccgtcagctggatcgagatggctcccggagcttggatgccgacgagttcaggcagggccttgccaagcttggtctggtgctggatcaggccgaggctgaaggggtctgcaggaaatgggatcgtaatggaagcggcacgctcgaccttgaagagttcctacgagccctgcggccacccatgagtcaggccagagaggccgtgattgccgctgccttcgccaagctggaccgatcgggcgatggggtggttacagtggatgacctgcgtggagtatattccggccgagctcatcccaaggtgcgtagtggagaatggaccgaggatgaggtgcttcggagattccttgacaatttcgattctagcgagaaggatggccaagtcactttggctgagtttcaggactactattctggagtaagtgctagcatgaatacagatgaggagtttgttgcaatgatgacctccgcatggcaactatag

SEQ ID NO: 186863 - DNA, 2565 bp, Artificial Sequence
  Description of Artificial Sequence: Synthetic coding sequence
atggccctggagcaggccctgcaggccgcccggcagggcgagctggatgttctacggagcctgcatgcagctggcctgctcggcccgtctctccgggaccctctcgacgccttaccggtgcaccatgctgcccgggcaggtaaactgcattgcctccgattccttgtggaagaggctgccctcccggccgccgctagggctcgaaatggcgccacaccagctcatgacgcctctgccaccgggcatctcgcgtgcttacaatggttgctaagtcagggcggctgtcgcgtgcaggataaggacaactctggcgccacagtcttgcacttggccgcccggtttggccatccggaagtcgtcaactggttgctgcatcacggcggcggtgaccccacggcggcgaccgacatgggggctctacctatccactacgctgctgccaaaggcgactttcccagcctcagacttttggtagaacactacccggagggcgtgaatgctcaaaccaaaaacggcgccacccctctgtatctcgcctgccaggagggacatctcgaagtgacccagtacttagtccaggagtgtggggctgatcctcatgctagggcccatgacggtatgactccactgcacgcggcagcccagatgggccattcgccagtgatcgtctggctcgtaagctgtacagatgtgtctttgagcgagcaggataaggacggagccacggcgatgcactttgctgcttcacggggtcatactaaagttctttcctggcttttgctccacggcggcgagatatcagctgacctgtggggtggaactccattgcacgatgccgccgaaaacggggaacttgagtgctgccagatattagtggtgaacggtgcggaactggatgttcgggatagagacgggtatactgccgcagacctgtccgattttaatggccacagccattgtacccgctacttacggacagtagagaatttatctgtggagcacagggttctctctcgagacccctccgctgagttggaggccaagcagccagactccggaatgtctagtcccaacacgaccgtttcagtgcagcctctgaacttcgacctgtcttctccgacctctaccctgtctaattatgactcttgcagttcgtctcatagcagtattaagggccaacacccaccatgtggtctctctagtgccagggctgccgacatccagagctacatggacatgttgaacccagagctgggtctccctcggggcaccatcggaaaacctacccctccacccccacctccgagttttcctcctcccccccctcccccaggaacccagctacctcccccacctccgggttatccagccccaaaaccacctgtggggccgcaagcggctgacatatacatgcagacgaaaaataaattgaggcacgtcgaaaccgaggcccttaagaaggagctctcaagctgtgacgggcacgatggactaagaaggcaggactcatcacgcaagccccgagcattctccaaacagccaagcactggtgactattataggcagctgggtcgctgtcccggcgagactttggcagcacggccgggcatggcgcacagcgaagaagtgagagcacgtcagccagctagagccggatgcccgcggctggggccagctgccagggggtcactcgagggtcctagcgcccccccacaggccgctctcctgccaggtaatcacgtccctaacggctgcgcagcggacccaaaagcctcgcgggagctgcctcccccaccacctccgccgccaccccccttacccgaggccgcaagttccccgcctccggcgccaccactccccttggaaagcgcaggacccggttgtggccaacgccggagcagctcgtcaacaggttctactaaaagttttaacatgatgtctcctacaggcgataatagcgagctgttggccgaaataaaagccggtaaaagcctgaaacccacaccacaatccaaaggactaacaaccgtcttttctggcattggccagcccgcctttcagcctgatagtcccttgccttcagtgtcccccgccctgtctcctgtccgcagccctaccccacccgccgctggttttcagcctttacttaacggcagtctggttccagtccctccaacaacacctgcccctggagttcagctggacgttgaagctctcatacccacccacgacgagcagggccggcccatccccgaatggaagcgtcaggtgatggtccgaaagatgcagcttaaaatgcaggaagaggaagagcagagaagaaaggaagaggaagaagaggccagactcgcctccatgcctgcatggagacgggacctgctccggaagaagctcgaagaggagcgagagcaaaagcgcaaagaggaggagagacagaaacaagaggagttacgaagagagaaggaacagtccgaaaaactgcgaacccttgggtatgacgagagcaagctggcgccctggcaacgacaggtgattctgaagaaaggagacatcgccaagtactag

SEQ ID NO: 186864 - DNA, 867 bp, Artificial Sequence
  Description of Artificial Sequence: Synthetic coding sequence
atggcccacagcgaggaggccgccctgctgcccggcaaccacgtgccaaacggatgtgccgccgatcctaaggccagcagggagcttccaccaccaccccctcctccccccccccctcttcctgaggccgcttcaagccccccccctgctcctcctctgccgttggaatctgcaggaccaggctgcggccagaggcgtagctcttccagcacgggatctacgaaaagttttaatatgatgagtccaaccggggacaacagtgaattattagcggagataaaggctggcaaatcactcaagcctacaccccaaagcaagggactgaccacagtcttttccggaatcggtcagcccgccttccagcctgattctccgttaccgtccgtgtcacccgcactgtcacccgtgcggtctccaaccccacctgccgcaggattccaacccctgttgaacggttcacttgtgccggtgccacccacgactcctgccccaggggtgcagttagacgtcgaggccctgattccaacccatgatgaacagggccgcccaataccggagtggaaacggcaggtgatggtccggaaaatgcagttgaagatgcaggaggaagaggagcagcgcaggaaggaggaagaagaagaagctcggttggcgagcatgccagcctggcggcgcgatctactccggaagaagcttgaagaagagagagaacagaagcgcaaggaagaggagcggcagaagcaagaagaactgagacgagaaaaggaacagagtgagaaactgaggacgttgggttatgatgaatcgaaactcgcaccttggcaaagacaggtcattctgaaaaaaggcgacatcgccaagtattag

SEQ ID NO: 186865 - DNA, 645 bp, Artificial Sequence
  Description of Artificial Sequence: Synthetic coding sequence
gacggcatgacccccctgcacgccgccgcccagatgggccacagccccgtaattgtgtggctcgataaagacggtgctaccgccatgcactttgccgcctccagaggccacacaaaggttctgtcttggctccttctgcatggtggtgaaatctccgcagacctctggggcggaacacccttgcacgacgcagctgagaatggcgagctggagtgctgccaaattcttgttgttaatggagcagagcttgatgtcagggaccgcgacggctacaccgcagcagatctttcagactttaacgggcactctcactgcacacgctacctgcgaacagtcgaaaaccttagtgtcgagcatcgggttctgagtcgagatcctagcgcagagctggaggccaagcaaccggattcagggatgtcatcccccaacactacagtgtccgtccagcccttgaacttcgatctttcgagtccaacatccacgctgtccaactatgacagttgttctagctctcatagctccattaaaggtcagcaccctccctgtggattgagtagcgcacgtgccgcagacatccagtcttatatggacatgctgaaccccgagcttggcttgccacggggaactatcgggaagccaacctag

SEQ ID NO: 186866 - DNA, 567 bp, Artificial Sequence
  Description of Artificial Sequence: Synthetic coding sequence
tgagagatcaaggccggcaagagcctgaagcccaccccccagagcaaaggcctgactacagttttctcaggcatcggtcagccagctttccagcccgactcgccactgccaagtgtgtcacctgccttgagtccagtcaggagccccacgcctccagccgccgggttccagcccctgctaaacggatccttggtgcctgttcccccgactacaccggccccaggggtgcaactggacgtggaggctctgatccccacccacgatgagcaaggccggccaattcctgagtggaagcggcaggttatggtgagaaagatgcaactaaagatgcaggaggaagaagaacagcgtcgcaaggaagaggaggaagaagcaaggcttgccagcatgccggcttggcgccgcgacttgctgaggaagaaattggaggaagagagggagcagaagcggaaggaagaagagagacagaagcaagaggaattgcggcgggagaaagaacagtccgaaaagcttagaactctgggttacgacgagtctaagcttgctccctggcagcggcagatatag

SEQ ID NO: 186867 - DNA, 1335 bp, Artificial Sequence
  Description of Artificial Sequence: Synthetic coding sequence
atggcccgggtgggccccggccgggccggcgtgagctgccagggccggggcaggggaagagggggaagcggacagagacgcccacccacttgggaaatatccgatagcgatgccgaagattcggctggatcagaggccgccgctcgcgcccgtgacccagctggcgagcgaagggccgcggccgaggcactgcggttactccgtcctgaacaggtgttgaagcgactggctgtatgtgtggacacagccatcctggaagatgcgggcgccgacgtcctgatggaggctctggaagccctcggatgcgaatgccgcattgagcctcagcgccccgcccggagcctgcggtggactcgtgcttcccctgacccatgccctcgatcattgccccctgaggtgtgggcggcaggggagcaggaacttcttctcttgctggagcctgaggagttcctgcaaggggtggcgaccctgacccagatctcagggcccactcactgggtcccctggatttctcctgaaacaaccgcaagaccacatcttgccgtgatcggtctggacgcgtacctgtggtaccgatctctttcttgccctcaacaagggtggctaggacgcggctttcggggaggaggactgtggcagaggccatcgtctggacgcgccggacccatgggcagcggggaagaatggtcgccactgctccgctcacgacagcatgtctctaggggaacccaacagccggagtctcctaaagtagccggagcagaagtcgccgtgagttggcccgaggtggaggaggtgcgggcctgtctctcatgggcgctagtgctccttcagctatgggcaaacctggatgtgcttttagtagctagctggcaggagctcagtcgccacgtatgcgcagttaccaaagctctggctcagtatccgctcaagtgcgtgatgccaagacttaagggcggcaggattacatcccgccaatatcgagaatcccaggcctttagcttctgcacagccggaagatgggctgctggggagcctgtagcacgtgatggagcggggcttcaggccgcttggagaagacaaatcagacaattttcgcgggtaagccctgctgtggctgacgccgtggttactgcctttcctagtccccggctcctgcagcaggcactggaagcctgttccactgagcgagaacgaatgggtttacttgctgacttgcccgtgccaccatccgaaggcggtcgtccgcgtagggtgggcccagatctcagtagaagaatttgtctatttctcacaacggcaaatcctgaccttctcctggatctggggagttag

SEQ ID NO: 186868 - DNA, 1161 bp, Artificial Sequence
  Description of Artificial Sequence: Synthetic coding sequence
atggcccgggtgggccccggccgggccggcgtgagctgccagggccgggggagaggacggggcggctctggtcagagacgtccccctacgtgggaaatatcggactcagacgctgaggactctgcgggctctgaagctgcagcacgcgcccgcgatcccgccggcgagcgtagggccgccgccgaggctctccgcctactccgaccagaacaggtcctgaagagactggccgtgtgcgtagatacggccatcctggaagatgccggtgctgatgttctaatggaggctctagaggccttagggtgcgaatgtcgcatcgagccccagcgccctgccaggagcctcaggtggacacgagcaagccctgacccctgccctaggtctctcccaccggaggtgtgggcagccggcgaacaggaattgctattgctcctggaaccagaagaattcctgcaaggagtagcaacccttacccagatttccggccccacccactgggtgccgtggatttcaccagaaactacagcccgaccccacctggcagtgattgggcttgacgcatacttatggtcgaggcagcacgtgtcccgaggaactcagcagccggaaagccccaaagtggccggcgcagaggtagcggtgagttggcctgaggtggaggaggtgagggcctgtttgagttgggcactcgtcttgttgcagctgtgggcaaatttagatgtactgttagtagctagttggcaagaactctcccgtcacgtgtgcgccgtgaccaaggcacttgcccaatacccattgaagtgcgtaatgcccagacttaaaggcggccggattacctccagacagtatagggagtctcaggccttttctttttgcacagctgggagatgggccgctggagaacccgtggcccgggacggggcaggcctgcaggctgcatggaggcgacagattcggcagtttagccgcgtgagccccgccgtagccgacgcggttgtgacagcattcccttcacctcgactgttacaacaggccctcgaagcctgtagcactgaacgggagcgtatggggctccttgctgtcgggccggatctaagcaggcggatttgcctttttctgaccactgccaaccctgatctgctgctagatttggggtcatag

SEQ ID NO: 186869 - DNA, 2523 bp, Artificial Sequence
  Description of Artificial Sequence: Synthetic coding sequence
atgatgagcatccaggagaagagcaaggagaacagcagcaaggtgacaaagaagagcgacgacaaaaatagcgagactgagatccaggactcacagaaaaatctcgcgaagaagtcgggccccaaagagaccatcaagtcccaggctaaatcctcgagcgaatcgaaaattaaccagcccgagcttgaaacgcggatgtccaccaggtccagcaaggctgctagcaatgataaggctacgaagtccataaacaaaaacaccgtaacagtccggggctacagtcaagagtctactaagaaaaagctctcccaaaagaaattggtgcatgagaacccgaaagctaacgaacaactcaatcgccgatcacagagactccaacaactgactgaagtctcccgccggtcactcaggtcgagagagattcagggccaggtgcaggcagttaagcagtcattacctccgaccaaaaaggagcagtgtagttcaacccagagcaagtcgaacaagacaagtcaaaagcatgtgaagcgaaaggtgctcgaagtcaagtcagactcaaaggaggacgagaaccttgtgatcaacgaggttattaacagtccaaagggcaaaaagcgcaaggttgaacatcaaacagcctgtgcatgcagtagccaatgtacccagggatcggaaaagtgccctcagaagaccaccagaagggacgagactaagccagtgccagtgacaagcgaagtgaaaaggtcaaaaatggctacaagtgtggtacccaagaaaaacgaaatgaaaaagagtgtccacacacaggtaaatacaaataccaccttacccaagtcgccccagcccagcgttccagaacagtcagacaatgaacttgaacaggcggggaaatcaaagcggggatctatcttgcagctgtgcgaggaaatcgcaggagagattgagagtgataacgttgaggtgaagaaagagtccagccagatggaatccgtcaaagaagagaaacctaccgagatcaagttagaggagacatcagtggagagacagatccttcatcagaaggaaaccaaccaggatgtgcagtgtaatcgattttttccaagccggaagaccaagcccgtgaaatgcatcctgaatggaatcaacagctctgcgaaaaaaaactctaactggacaaagatcaagctaagtaagtttaattctgttcagcacaataaactggacagtcaggtctccccgaagttaggtctgctgaggacttctttttccccacccgccctggagatgcatcatcctgttacgcagtctacttttctgggcactaaattgcacgataggaacatcacatgtcagcaggaaaaaatgaaggaaattaacagtgaggaagtcaagattaacgatattacggtggagatcaataaaacaacagagcgtgctccagagaactgtcatctggccaatgaaattaaaccgtctgacccaccattggataatcagatgaaacacagttttgactcggcgtctaacaaaaacttctcccaatgcctggaatccaagttagaaaacagccctgtcgagaacgtcacagctgccagtaccctcctctcccaagcgaaaattgatactggggagaacaaattccccggaagtgccccacaacagcactcaattctcagcaaccagacatctaagagtagtgacaaccgggagaccccacgtaaccatagcctgcctaagtgcaacagtcacttagagatcacaatacctaaggatctgaaattgaaggaggctgagaaaaccgacgaaaaacagctaataatcgatgccggtcaaaagcgatttggagccgtatcctgcaatgtatgcggtatgctttacaccgccagtaatccagaagacgaaactcagcacctcctctttcataatcagtttatttcagcagttaaatatgtaggatggaagaaggagcgtatactggctgaatatccagacggtcggatcatcatggtgctccctgaggaccccaaatacgctcttaaaaaagtcgacgagatccgtgaaatggtagacaacgacttgggtttccaacaggcacccctgatgtgttatagccgtaccaaaactttactattcatcagcaacgataagaaagttgtgggttgcctgatcgcagaacacattcagtggggctatcgtgtcatagaggaaaagcttcccgtcattcgcagcgaggaggaaaaggttcggttcgagcggcagaaggcatggtgttgttcgacacttccagaacctgctatatgcggaatctcccgcatctgggtctttagcatgatgcggagaaagaagattgcaagccggatgattgaatgcctacgctccaattttatatatggatcgtacttgtccaaagaagaaatagccttctccgacccgacccccgatggaaaactcttcgcaactcagtactgcggcaccggccagtttctggtgtataatttcattaatgggcagaattcaacttag

SEQ ID NO: 186870 - DNA, 2106 bp, Artificial Sequence
  Description of Artificial Sequence: Synthetic coding sequence
atgatgagcatccaggagaagagcaaggagaacagcagcaaggtgaccaagaaaagtgatgataaaaactctgagactgaaatccaagattctcagaagaacctggccaaaaagtctggccctaaggaaacaattaaaagccaagccaaaagttctagcgagagtaagatcaatcaaccagagctggaaaccagaatgagcactcgaagttcaaaagctgcaagtaacgataaggcaacaaagagtatcaataagaacacggtgaccgtcaggggctactctcaggaatccactaagaaaaagcttagtcagaagaaactcgtccatgagaaccctaaggctaatgaacagcttaaccggaggtctcaaaggttacaacagttgacagaggtgtcgaggagatctctgagatcacgcgagattcaggggcaggtgcaggccgttaagcagagcctgccaccgacaaagaaggagcagtgttcttccacccagagtaaatccaacaagacatcacagaaacatgttaaacgcaaagtgctggaggtcaaatcagactctaaggaggatgaaaatctggtcattaatgaagtcattaacagccccaagggtaaaaaaagaaaggtcgagcaccagacagcttgcgcctgttcatctcagtgtactcaaggtagcgagaaatgcccacagaaaaccacccgcagagacgaaactaagcccgtcccagttacttcggaggtgaagcgctccaaaatggccaccagcgttgtgcctaaaaagaatgaaatgaaaaagagcgtccacacccaggtcaacacaaacacaaccctaccgaaatctcctcagcctagtgtgcccgagcagagcgacaacgagctcgagcaggcagggaagtccaaaagggggtcgatactccagctgtgcgaagaaatcgctggggaaatcgagtcagataatgtggaagtcaagaaggagtcttcgcagatggaaagcgtcaaagaggagaagccgaccgaaataaagctggaggagacctccgtggaacgccagatactgcaccagaaagaaacaaatcaagatgtacagtgcaatcgtttctttccatcacggaagacgaaaccagtgaagtgtatcctgaacgggatcaattctagtgctaaaaaaaactctaactggaccaagatcaaactgagcaaattcaacagcgtgcagcacaataagttagatagccaggtgtctcctaaacttggacttctgagaacctccttttccccacctgccctagagatgcatcatcctgtcactcagtcaaccttcttggggaccaagctgcacgatcgaaacatcacatgtcagcaggaaaagatgaaagagattaattccgaggaggttaaaattaatgacatcaccgttgagatcaataaaacgacggaacgcgctcctgaaaattgccacctggctaatgagatcaaacccagcgacccaccattagacaaccagatgaagcatagcttcgattcagccagcaataagaattttagtcagtgtcttgaatctaaactcgagaacagtcccgtcgagaatgtaaccgctgctagtaccttgcttagtcaggctaagattgacaccggggagaataagtttcccggcagtgctccgcagcagcattctatcttgagcaaccagacctccaaatcctctgataaccgtgagactccacgcaaccatagtctcccgaaatgtaattcccacctggagatcactatcccgaaagacttaaaactgaaggaggccgaaaaaaccgatgagaaacagcttattatcgatgcgggccaaaagcggttcggagctgtgagttgcaacgtgtgcggcatgctttataccgcttcaaatcctgaagacgagacacagcacctgttgtttcacaaccagtttatctctgcggtaaaatacgtcgtcctgctgattaaccaccacgaatgcggctcagaagaagagtttattacgtccctcttcctgtccatgtttaactttcgctatacacaaaggtcattctcgtttccaataaggttcctagagggattggaagaaagaaagaactccgggtag

SEQ ID NO: 186871 - DNA, 1806 bp, Artificial Sequence
  Description of Artificial Sequence: Synthetic coding sequence
atggccgccctgaccccccggaagcggaagcaggacagcctgaagtgcgactctctactgcactttaccgagaatctttttccatcaccaaataaaaaacactgcttttaccagaattccgacaagaatgaggagaatttgcactgttcccagcaagaacacttcgtactttccgcattgaagacgacagagataaatcgactaccgtctgctaatcagggctcacccttcaagagcgctttaagcactgtatccttctacaaccagaacaaatggtacctgaaccctctagagagaaaactgatcaaagagtcacgctcgacatgtctgaaaactaacgatgaggataagtccttcccaatagtaacagagaagatgcagggcaagccagtgtgttccaagaagaataacaagaaaccgcagaaatcccttactgctaaatatcagccgaagtataggcacatcaagccagtcagccgaaattctcgcaactctaagcagaaccgagtgatttataaaccaatcgttgagaaggaaaacaactgccatagcgcagaaaataatagtaatgcaccacgagtcctgtcgcaaaaaataaagccacaagtgactcttcaggggggggccgcttttttcgtcagaaagaaaagctccctcagaaagtccagtctggagaatgagccgtccctgggcaggacgcagaagagtaagtcggaggtgattgaggactcagacgttgaaacagtctctgagaagaagacttttgctacccgccaagtgcctaaatgcctggtgttagaggagaaactgaaaatcgggctgttgagcgcatccagtaaaaataaggagaagctgatcaaggacagctccgatgaccgagtgtcgagcaaagagcacaaagtcgataaaaatgaggcattcagtagtgaagactctcttggcgaaaataaaaccatttctcctaaatcaaccgtttacccaatcttctctgcctctagcgtgaatagtaaacgttccctgggcgaggagcagttctcagtggggagcgtgaacttcatgaagcagacaaatattcagaagaataccaatacccgggatacctccaagaagaccaaagatcagctcatcatagacgctggtcaaaaacacttcggggccactgtttgtaagtcctgcggaatgatatacaccgcatcaaatcccgaggatgaaatgcagcatgttcaacaccaccatcgtttcctagaaggaatcaaatacgtagggtggaaaaaggagcgtgtggtggccgagttctgggacgggaagatcgtgctggttctaccccacgacccgagcttcgctattaagaaggtggaggatgtccaggagttggtggacaatgaactggggttccagcaagtggttccgaagtgccccaataagataaaaacctttctgttcatctctgatgaaaaacgcgtggtggggtgcctgatcgcagagcctattaaacaagctttccgcgtgctaagcgagcccatagggccagaaagtcccagcagcactgaatgcccccgagcatggcagtgtagcgacgtgccagagccagccgtgtgcggcatttcccgaatatgggtttttaggctgaaacggcggaaacgtattgccagacggctggtggatactctgcggaactgttttatgtttggttgttttctgtctacagacgaaatcgcattctcagaccccacacctgacggtaagctgtttgctacaaagtactgtaatacccccaattttttagtgtacaatttcaacagttag

SEQ ID NO: 186872 - DNA, 720 bp, Artificial Sequence
  Description of Artificial Sequence: Synthetic coding sequence
atgaagcagaccaacatccagaagaacaccaacacccgggacacctccaagaaaacaaaagaccagctgatcatcgacgccggacaaaagcacttcggggccaccgtgtgtaagtcctgcggtatgatctacaccgcctctaaccccgaggatgagatgcaacacgttcagcatcaccatcgttttttagaggggataaagtacgtggggtggaaaaaggagcgcgtagtcgcggagttctgggatggtaaaatcgtgctggtcctgccccacgaccccagtttcgcaataaagaaagttgaggacgttcaggaacttgttgacaatgagttaggcttccagcaggttgtgcctaaatgtcccaataaaattaagactttcctttttatttccgatgaaaaaagagtggtgggctgcctcattgctgagcctatcaaacaagcgttcagagtcctaagtgaaccgatcggtccggagtccccttcttccaccgaatgcccgcgcgcctggcagtgctctgatgtgcctgagccagctgtgtgcggcatttcccgcatctgggtgtttcggttaaagcggagaaagagaatcgctcgccggctggtggacacattgcgtaactgcttcatgttcggttgctttctgtccaccgatgaaatcgccttttctgaccccacacccgacgactgtcgccgactcaatagataccaggagacctag

SEQ ID NO: 186873 - DNA, 849 bp, Artificial Sequence
  Description of Artificial Sequence: Synthetic coding sequence
atggccctgaagcagatcagcagcaacaagtgcttcggcggcctgcagaaggtttttgagcacgactcagttgagttgaactgtaagatgaaattcgctgtgtatctaccccccaaagccgagacgggcaagtgcccggccctgtattggctgagcgggctgacatgtactgagcagaacttcatatctaagtcaggttaccaccaatctgcttcagaacacggcttagttgtgatcgcccctgataccagcccccgcggatgtaacattaagggtgaggatgagagctgggattttggaacgggagctggattctacgttgatgccaccgaggatccttggaaaaccaattatagaatgtactcttacgtgacagaggaactgccccagttgatcaatgctaacttcccagtggatcctcagcggatgtctatcttcgggcatagcatgggtgggcacggcgccctcatctgcgccctgaaaaatcccggcaagtataagagtgtgtcggcattcgcgccgatatgtaatcccgttctgtgtccatggggcaaaaaggcattcagcgggtatctgggaaccgaccagagcaagtggaaggcctacgatgctactcacttagtaaagagctacccagggagccagctggacattctgatcgaccagggaaaggacgaccagttcctgctcgatgggcaactacttcctgacaacttcattgctgcatgtacagagaagaagatccccgtggtgtttcgccttcaagaaggctatgaccacagctactacttcatcgcaaccttcattacagatcacatcagacatcacgcaaaatacctgaatgcgtag

SEQ ID NO: 186874 - DNA, 642 bp, Artificial Sequence
  Description of Artificial Sequence: Synthetic coding sequence
atggccatcacccagttccggctgttcaagttctgcacctgcctggcaaccgtgttctcattcctgaagaggctgatttgccggtcaggaagagggaggaaactgtcaggtgatcagattactctccccacaacagtcgactactctagtgtccctaaacaaaccgacgtagaagaatggacctcttgggacgaggatgcaccaacgtctgtcaaaattgaaggtggtaacggtaacgtggccacacagcagaattctctggagcagctggagccagactattttaaggatatgaccccaactatccgaaaaactcagaagattgtcataaagaaacgggaaccattgaactttgggatcccagacggctctacagggttcagctcccgcttagctgctacacaggatctgccattcatccatcagtccagcgagttaggggacttggacacatggcaagagaacaccaacgcctgggaggaagaggaagacgccgcatggcaggcggaagaggtgctgcggcagcagaagttggccgaccgcgagaagagagccgctgagcagcaacgcaaaaaaatggagaaagaagcccagcgcctcatgaaaaaggaacaaaacaagatcggcgtcaaattgtcctag

SEQ ID NO: 186875 - DNA, 642 bp, Artificial Sequence
  Description of Artificial Sequence: Synthetic coding sequence
atggccatcacccagttccggctgttcaagttctgcacctgcctggctaccgtcttctcgttcttaaagaggttgatttgtcggagtggccggggaaggaaactctccggagatcaaataactctcccaaccacagtggactattcttcggtgccgaagcagaccgacgtggaggaatggacttcatgggacgaagacgctcccacatcggtgaaaatcgaaggagggaatggtaatgtggctacacaacagaactccctggagcagctggaacctgactattttaaggacatgacccctaccattcgaaagacacagaagattgtcatcaaaaagcgagaacccctcaacttcgggatcccagatggcagtaccggcttctccagtcggttagccgccacccaagatttgccctttatccaccagtcttccgagcttggcgatttagacacttggcaagaaaataccaatgcatgggaggaggaggaggacgccgcttggcaagccgaagaggtgctgcgccagcagaagctggccgatcgtgagaaacgggccgctgaacagcaacgaaagaagatggaaaaggaggcacagagactgatgaagaaagagcagaataagatcggggtgaagttgtcttag

SEQ ID NO: 186876 - DNA, 594 bp, Artificial Sequence
  Description of Artificial Sequence: Synthetic coding sequence
atggccatcacccagttccggctgttcaagttctgcacctgcctggctactgtcttctcatttctaaagagacttatatgtcggtccgggagaggacggaagctcagcggggatcagattactcttcccaccactgtagattattcttccgtgccgaagcagacagatgtggaggagtggacatcctgggatgaggacgcgccaaccagcgttaaaatagaaggtggcaatggtaatgtggctactcagcagaatagtttagagcagctggagcccgattactttaaggatatgacgcctaccatacgcaaaacgcagaaaattgtcatcaaaaagagagagcctctgaatttcgggattccggatggctcgacaggcttctccagtcgtctagctgccacacaggacctgccattcattcatcaatcatctgagttaggagacctggatacgtggcaggagaatacaaacgcctgggaggaagaggaggacgctgcgtggcaggccgaggaggtgttgagacagcaaaagctggctgatcgcgaaaaacgcgcagctgagcagcagagaaagaagatggagaaggaggcttag

SEQ ID NO: 186877 - DNA, 777 bp, Artificial Sequence
  Description of Artificial Sequence: Synthetic coding sequence
atggccatcacccagttccggctgttcaagttctgcacctgcctggccactgtcttctcattcctgaagcgtctgatctgtcgctccgggcggggtcggaaacttagcggggaccagattactctgccaacaactgtggattattcatcagttcctaaacagacagatgtggaggagtggactagctgggacgaagatgcacctactagcgtaaagattgagggaggtaacggaaacgttgccacgcaacagaatagtctggagcagctggagcctgactactttaaagacatgacacccaccatccggaaaacccagaagattgtgatcaagaagagagagcctttgaatttcgggattcctgatggaagcaccggcttcagtagccggctggcagcaactcaggatttgccattcatccaccaatcttctgagctgggagacttggacacatggcaggagaacacaaatgcctgggaggaggaagaagacgccgcctggcaggctgaggaggtgctacgaagtagaacgaacgtatgcctattgtgttccctgctgtttcaccaccctactccaactagcacaccttacatcaatcagtccgtcaagatagagagagtgtcccttggccagtggtcgtacggaaaatctaaggagcagcagaagctcgccgaccgagagaagcgcgctgccgagcagcagaggaagaagatggagaaggaagctcagagactcatgaaaaaggagcagaataagatcggtgttaaactgagttag

SEQ ID NO: 186878 - DNA, 237 bp, Artificial Sequence
  Description of Artificial Sequence: Synthetic coding sequence
atggccatcacccagttccggctgttcaagttctgcacctgcctggctaccgtcttcagctttttgaagaggttgatctgccggagtggtcgggggcgtaaattgtctggagaccaaatcactttacccaccacagtagattattcttctgtacccaaacagacagacgtcgaagagtggacttcctgggacgaagatgcccctacctccgtaaaaatcgagggtggcaacggctag

SEQ ID NO: 186879 - DNA, 1272 bp, Artificial Sequence
  Description of Artificial Sequence: Synthetic coding sequence
atgagcagccaggtggtgggcatcgagcccctgtacatcaaggccgaaccagctagccctgactctccaaaaggctctagtgagactgaaaccgaacctcctgtggcactggcccccggtcctgcccccactaggtgcttgccagggcataaagaggaggaagacggcgagggcgccggccctggcgaacaggggggtggcaagttggtgctttccagcctgcctaagcgattgtgtctggtgtgtggggacgtggcctccggatatcactacggcgttgccagctgtgaggcctgtaaggccttcttcaagcggacaatccagggcagtatcgaatatagttgcccagctagcaatgagtgtgagatcaccaagcggcgtcgtaaagcttgccaggcgtgtcgatttaccaaatgtttgcgggtgggaatgctcaaagagggggttcgcctggaccgggtcaggggcggaaggcaaaagtacaagcgaagaccggaggttgatcccctccccttccctggaccctttcctgccggaccacttgccgtagcaggcggtccccggaagactgctgcccccgtcaacgcgcttgtatctcacctcctggttgtggaacccgaaaagctgtacgccatgcctgatccagcggggcccgacggacatttacccgccgtggcaacactctgtgacctgtttgacagggagatcgtggtaactataagctgggcaaaaagcatcccggggtttagtagcctctccctttcggaccagatgagcgtgctgcagtccgtgtggatggaagttcttgttctgggcgtggctcagcgaagcctaccacttcaagacgagctggccttcgccgaggacttggtcctggacgaggagggcgctcgggccgcaggactgggtgagctgggagcggccctactgcagttagtcaggcggctccaggctctccgcctcgaacgcgaagagtacgtattgctgaaggccctggccttagctaatagtgacagcgtgcatattgaagatgcagaggctgttgagcaactgcgggaagcattacacgaagctctactggagtatgaagccggacgcgctgggccgggaggtggcgccgaaaggcgaagggccggcaggctgctactgacactgcctctgctccgacagaccgctggcaaagtcctggcgcacttctacggggtgaagttagagggcaaggtccccatgcacaagctgttcctcgaaatgctcgaggcgatgatggactag

SEQ ID NO: 186880 - DNA, 1272 bp, Artificial Sequence
  Description of Artificial Sequence: Synthetic coding sequence
atgagcagccaggtggtgggcatcgagcccctgtacatcaaggccgagcccgcttcacccgactcacctaaagggagtagtgaaaccgaaacagaaccaccggtcgccttagcacctgggcccgcccctacacgctgccttcctggccataaggaggaagaggacggagagggagctggccccggagagcagggcgggggtaagctggtgctctcaagtctaccgaaacgcctgtgtctggtgtgcggggacgtggcatccgggtaccattatggggttgccagctgcgaggcgtgtaaggccttcttcaaacggactatccagggtagtattgagtacagttgccccgcatctaatgaatgcgaaattacgaagcgcaggcggaaggcctgtcaggcgtgtcgttttactaaatgcctccgagttgggatgcttaaggagggcgtgcgcttggacagggttcgcggcgggcggcaaaagtataaacgccgacctgaggtggatccactgcccttccctggcccatttccagcagggccgcttgctgtggcaggcggcccccggaagacagccgcaccggtgaacgccctcgtttcccatttacttgttgtcgagcccgagaaattgtacgctatgccagacccggcgggccctgacggacacttaccggcagtagctacgctttgcgatctgtttgatagggaaattgtggtgactatcagctgggccaagtcaattcctggcttctcatcgctctccctttccgaccagatgtctgtcttgcaaagcgtttggatggaagtgctagtactcggggtcgctcaaaggtcactgcccctgcaggatgaattagctttcgctgaagatctcgtgctggacgaggagggtgcccgagcggcaggattgggggaattaggcgctgccctgctgcagcttgtacgtcggctgcaggcacttcgcctggagcgcgaagaatatgtgctcctgaaagcattagccctcgccaactctgattctgtgcacattgaagacgcagaggcagtggagcagttgagggaggctctgcatgaagcattgctagagtacgaggcaggccgtgctgggccggggggaggggctgaaagacgaagggccggccggcttctgctgactctcccactgctgaggcagactgcagggaaagtcctggcccacttttacggggtcaagttggagggaaaagtcccaatgcacaaactcttcttggaaatgctcgaggcaatgatggattag

SEQ ID NO: 186881 - DNA, 1269 bp, Artificial Sequence
  Description of Artificial Sequence: Synthetic coding sequence
atgagcagccaggtggtgggcatcgagcccctgtacatcaaggccgaaccggcttcaccagattctcccaagggatcctcagagacagagacagagcccccggtcgccctggcccctgggcccgcccctacacgttgtctgccaggtcacaaagaggaggaggatggtgagggagctgggcctggagagcagggtgggggcaaactggtattatcatcccttccgaagcggctgtgcctcgtgtgcggggatgtggcttcgggataccattacggggtagcctcttgtgaggcttgcaaagccttcttcaagagaaccatccagggctctatagagtacagctgtcctgccagcaacgaatgcgaaatcactaagcgcagacggaaggcctgtcaggcttgcaggtttactaagtgcctgcgtgttggtatgcttaaagaaggagttagactggatagggtgcgagggggcagacaaaagtacaaacggcggccggaggtggatccactcccatttcctgggcccttcccagcaggcccgctggccgttgccggaggccctagaaagacggccccggtgaacgcccttgtctcccaccttttggttgttgaaccagaaaagctatatgcaatgcccgacccagccggacctgacggacacttacccgccgtggctacgttgtgtgacttgttcgacagggaaattgtggtgactattagttgggccaagagtatccccgggttctcatccttgtccctctcagaccagatgtcagtgctgcagtcagtttggatggaggtcctggtgttgggggtggcccagcgatctctgccattgcaggacgaactcgcctttgctgaggatctggtgctggacgaggagggcgccagggccgctgggttgggagagctcggggctgctctactgcaattagttcggcgcctgcaggcacttagactcgagagggaagaatatgtgctcttaaaggcactcgcattagcaaactctgattccgtgcacatcgaagatgctgaagctgtcgaacagctgcgggaggcccttcatgaggccctcctggagtatgaagccgggagggcaggacccggagggggcgctgaaagacgccgggcaggtaggttgctgctaacgctgcctctgctgagacaaacagctggtaaagtgctggcccatttctacggggtcaagctcgaaggcaaagttcccatgcataagctgttccttgaaatgctggaggctatgatggactag

SEQ ID NO: 186882 - DNA, 330 bp, Artificial Sequence
  Description of Artificial Sequence: Synthetic coding sequence
atgagcagccaggtggtgggcatcgagcccctgtacatcaaggccgagccagcgtctcctgattccccgaaaggcagttctgaaacagagacggagcccccagtggcgctcgcacccggacctgccccgaccagatgtctgcctggtcataaagaagaggaggatggggagggagccggccctggggagcagggcggcggtaagctcgtcttaagctccctgcctaagcgtctctgtctcgtgtgtggggacgtggcctctgggtaccactacggtgtcgcgtcctgcgaagcctgtaaggctttcttcaagaggacaattcagggctag

SEQ ID NO: 186883 - DNA, 1503 bp, Artificial Sequence
  Description of Artificial Sequence: Synthetic coding sequence
atgagcagcgacgaccggcacctgggcagcagctgcggcagcttcatcaaaaccgaacccagttcacctagctcaggcatcgatgccctgagtcaccactctccatcaggtagctccgacgcatcagggggatttggtctagccctgggaactcacgccaacggtctggattccccacccatgttcgccggcgctggactcggtgggacgccatgccggaagagctacgaggattgcgccagcgggattatggaggactccgccattaagtgcgagtatatgctgaacgctattccaaaacgcctctgtttggtgtgcggtgacatagctagtggctaccactacggcgtggcgtcgtgtgaggcctgcaaggctttcttcaagcggacaatccagggcaatatcgaatattcatgcccagcgaccaacgagtgtgagatcaccaagaggcggcggaaatcctgccaagcctgtcgcttcatgaagtgcctgaaggtggggatgctcaaagagggcgtaaggctggaccgggtcaggggtggaaggcagaagtacaaacgacgactagactctgaatctagcccatacctcagtcttcagatctcacctcctgcaaaaaaaccactcacgaagattgtcagctacctcctggtggcagagccagataaactttacgccatgccaccgcccggaatgcctgagggagatattaaggcattgacaaccttatgcgacctagccgaccgggaactggtggttatcatcgggtgggcgaagcatattccgggtttctcctcactcagcttgggggaccaaatgtctctccttcaaagcgcatggatggagattctgatcctcggaatcgtctataggtctctgccctatgacgacaaattggtgtacgcagaggactacattatggatgaagagcactcccggttggcgggactgcttgagctgtatcgcgccatcctgcagctggtgagaagatacaagaagctcaaggttgagaaggaagagttcgttacgctgaaggccctcgctctcgccaatagtgattccatgtatatcgaagatctcgaggcagtgcagaagctccaggatttgctgcacgaggctttacaggattacgaactaagtcagcgccatgaagagccttggagaaccggaaagcttctcttgaccctcccgctcttgagacagaccgcagcaaaagccgtgcagcatttttactcagtcaagctccaggggaaggtgccaatgcacaaactctttcttgagatgctagaagccaaagcctgggcacgcgccgactctttgcaggaatggcgccccttggaacaagtgccttcaccccttcacagagccactaaaaggcaacacgtgcactttcttaccccattgcccccacccccctcagtggcttgggtgggaacagctcaggcaggctaccacctggaagtgtttcttccacaacgcgccggctggcccagagctgcatag

SEQ ID NO: 186884 - DNA, 1527 bp, Artificial Sequence
  Description of Artificial Sequence: Synthetic coding sequence
atgagcagcgacgaccggcacctgggcagcagctgcggcagcttcattaagaccgaaccatcatcaccgagcagcggcatcgacgctttatctcatcatagtccctcaggctcctcagatgcttcaggggggttcggtctcgcattgggcactcatgcaaacggcctcgattcccctcccatgtttgcaggagcaggccttggggggacgccttgtcgtaaaagttacgaggactgtgccagcggcattatggaagacagtgcaataaagtgtgaatacatgttgaacgccatccctaaaaggctctgtttggtgtgcggtgacatcgcgtccggctatcactacggcgttgcttcgtgcgaagcttgtaaagctttctttaaacggacaatacaaggcaatattgagtactcctgccccgccacgaacgaatgcgaaattaccaagcgcaggagaaagtcatgtcaggcctgtcgatttatgaagtgcctaaaggtggggatgctgaaggagggagtgcgtctggatcgtgttaggggcggcagacagaagtataagcgtagattggactctgagagtagtccatacctgtcacttcagattagtccccccgccaagaaacccctgacgaagattgtctcatatctcctagtcgcagaacccgataagctatacgcaatgcctcctccaggaatgcctgaaggcgacattaaggccttgactactctgtgtgatctcgccgatcgggagctggtggtgatcatcggatgggcgaaacacattccgggattcagctcgttgagccttggggaccaaatgagcctcctgcagagcgcttggatggagatcctcatacttggcatagtatatagatctctcccgtatgacgacaaacttgtgtatgctgaagattacattatggatgaagaacacagcagactggctggcctcctggagctctatcgcgcgattttacaactggtcagaagatacaaaaaactgaaagttgaaaaagaagagtttgtgacacttaaagctctcgcacttgcgaacagcgatagtatgtatatcgaagatttagaggcagtgcagaaactacaggacctgctgcacgaggctctgcaagattatgaactctcccagaggcatgaagagccctggagaacaggcaaactgctccttactctccctctgctccgacagacagcagccaaggcagtccagcatttttactcggtgaagctccaggggaaagtgcccatgcacaaacttttcctggaaatgttggaggctaaggttggtcaggaacaactgcgtggctctcctaaggacgagaggatgtccagccatgatggcaagtgtcccttccaatcagccgcgttcacctcgagagaccagtccaatagccctgggatccctaaccctaggccaagtagccccacacccctcaatgaacgagggcggcaaatctctccctctaccagaacaccaggcgggcagggaaagcacctgtggttaacaatgtag

SEQ ID NO: 186885 - DNA, 1503 bp, Artificial Sequence
  Description of Artificial Sequence: Synthetic coding sequence
atgagcagcgacgaccggcacctgggcagcagctgcggcagcttcatcaaaactgagccctcttccccatcgtctgggatcgacgccttatcccatcacagtccctccgggagtagcgatgcttcagggggtttcggtctcgctctgggcacccatgccaacggcctcgacagtcccccaatgtttgctggagctggtttgggcggcaccccctgccggaaatcctacgaagattgtgcctccggtataatggaggactccgccataaagtgtgagtacatgctcaatgcgatccccaagagactgtgcttagtgtgcggcgatatagccagtggctatcattatggggtcgccagctgcgaggcctgcaaggcctttttcaagcgaacaatacaggggaacatcgagtattcatgccccgccactaatgagtgcgaaattacaaaacgccgcaggaaatcatgtcaggcctgcagatttatgaaatgtctaaaagtaggtatgctgaaggagggcgtgcgcctcgatcgcgtgcgcggaggaagacagaaatataaaaggcggctggattcagagtcttccccttacctgtcgctgcaaataagccctcccgccaagaaacccctgaccaagatagtttcctacttgctggtagctgaacccgacaagctgtacgccatgcctccaccaggcatgcctgaaggtgacatcaaggctctgaccaccctttgcgacctggcagacagagagctcgtggtaattatcgggtgggctaaacacatcccagggttttcgagcttgtctctgggcgatcaaatgagcttgctacagtccgcttggatggagattctcatcctgggaattgtgtacaggtcccttccttacgacgacaagttggtctacgctgaagactatattatggacgaggaacactctaggctggcgggactgctcgagctgtaccgagccattctacagctagtgaggagatacaagaaactgaaggtggaaaaggaagagttcgtgacccttaaagccctggcattagccaattccgactcgatgtatatagaggacctggaagcagtgcagaagctgcaggacctcctgcacgaagccctccaggactacgagctctcgcaacgacacgaggagccgtggagaactggcaaactgctgttgacattacctctgttaaggcagaccgcagcgaaagccgtacaacatttctactctgtcaagttgcagggtaaggtgccaatgcacaagttgttcttagagatgctggaggctaaagcctgggccagggccgatagcctgcaggagtggcgacccctggagcaggtgccttcacctctgcatcgggcaacgaagcggcagcatgtacatttcctcacacctttgccaccccctcctagcgtggcatgggtcggaaccgctcaggctggctaccacctggaggtattcctgcctcaacgcgctggctggccgagagccgcctag

SEQ ID NO: 186886 - DNA, 1527 bp, Artificial Sequence
  Description of Artificial Sequence: Synthetic coding sequence
atgagcagcgacgaccggcacctgggcagcagctgcggcagcttcatcaagacagaaccaagcagcccctcctccgggatcgatgcgctgagccaccactccccctcaggctcctcagatgcctctggcggctttggcctggcattgggtactcacgccaacgggcttgactctccgccaatgttcgctggggccggactggggggaaccccgtgcagaaaatcttacgaagactgcgcatcgggcatcatggaggacagcgccatcaagtgtgagtatatgttgaacgctattccgaaacggttgtgtctggtatgtggagacatcgcatcaggatatcactatggcgtggctagttgtgaagcctgtaaagcctttttcaagagaaccatccaaggaaacattgaatactcctgtcctgccacaaatgagtgtgaaatcactaagcggcggcgcaagtcctgccaagcttgccgatttatgaagtgtttgaaggtcgggatgctaaaggaaggagtccggctcgaccgggttcgcggaggtcgccagaaatataagagacgattagactccgaatcctctccctatctaagtctgcagatcagtccaccggccaaaaaacccctgaccaagatagtgtcctatcttctggtggctgagccggacaagttgtatgctatgccccctcctggcatgccagaaggagatataaaggccctgactacattatgtgacttagctgaccgggagctggtggtaatcataggctgggctaaacacatcccggggttcagttccctgtcactgggagatcagatgtcattgctccagtccgcgtggatggagatattgatccttggcattgtctaccgctccctgccctatgacgataaactagtgtacgcagaggattacattatggacgaagagcacagccgcctcgccggtttattggagttgtacagagcaattttgcaactggttcggcgatataagaagctcaaagtggaaaaagaagagttcgtcaccctgaaagcgctcgccctggctaatagcgattccatgtacatcgaagatttggaagctgtgcagaagctccaggatcttctgcacgaggcgcttcaggactatgagttgtctcagcggcacgaggaaccctggaggaccggaaaactgctgttgacactgcctctgctgcggcagaccgccgctaaggcagtacagcacttctatagtgtgaaattacagggcaaagttccaatgcacaagctgtttctggaaatgcttgaagcaaaggtaggacaggaacagctgcgcgggtcacctaaggacgagagaatgagcagtcacgatggcaaatgccctttccaatctgccgccttcacttctagagaccaatccaactctcccggtatccctaaccccaggcctagctcacccaccccacttaacgagcgaggtcggcagatcagccctagcactcggactcctgggggccaggggaagcatctctggctcaccatgtag

SEQ ID NO: 186887 - DNA, 1527 bp, Artificial Sequence
  Description of Artificial Sequence: Synthetic coding sequence
atgctgctgaaccggatgagcagcgacgaccggcacctgggcagctcttgcggttcattcatcaagaccgaaccaagttctccatcctcgggaatcgacgccttatcacaccattcaccaagcggctctagcgacgcgtcaggaggatttgggctggctctgggaacacatgccaacgggcttgattcccccccaatgtttgcaggcgccggtcttggcggaacaccctgtcgcaagtcctatgaggattgcgccagcggcattatggaggattcggctattaagtgtgaatacatgctaaatgcaatccccaaacggctgtgcttggtgtgtggcgacattgccagcggttaccactacggcgtagcttcatgtgaggcctgtaaggctttcttcaagcggactatccaggggaacatcgaatacagctgtcctgccactaatgaatgcgaaatcaccaagagacggcggaagagctgtcaggcttgtcgctttatgaagtgtctcaaggtaggaatgttgaaagaaggtgtacgtttggatcgggtccgggggggtcgtcagaagtacaagaggagactggattccgagtcatccccctacctgtctctccagatttcccccccagccaaaaaaccactgacaaaaatcgtctcatacctgctggtggccgaacctgacaagctgtacgccatgccacccccaggcatgccagagggcgatatcaaggcacttaccactctgtgcgacctagccgatagggaattagtcgttattattggttgggccaagcatatcccaggcttttcctctctgagtctaggagatcaaatgagcctcttacagtcggcttggatggagattttaatccttgggattgtgtataggagcctgccctacgacgacaagctggtctatgcagaagattacattatggacgaggagcattctagactcgccggactgttggaactgtatagagctattctgcagttggtgaggagatataaaaagttaaaagtcgagaaagaggaattcgtgacccttaaggccctagccttggcaaatagtgattcgatgtacattgaggacctcgaggccgtgcaaaaattacaagatctccttcacgaagccctgcaggattacgagctctctcagagacatgaagagccatggagaaccggtaagctgctactcacgttaccactgcttcgccagacagccgctaaagccgtgcagcacttttacagcgtgaagctccaggggaaagtgcctatgcacaagcttttcctggagatgttggaggccaaagtggggcaagagcagctgagagggagcccgaaggacgaacggatgtcctcccatgacggcaagtgtccctttcaaagcgcggctttcactagcagagaccagtccaattcaccaggaatcccgaaccccaggcccagttccccaacaccgctcaacgagcgcggccgtcaaatctcaccgagtactcgaacacccggcgggcagggcaaacactag

SEQ ID NO: 186888 - DNA, 1302 bp, Artificial Sequence
  Description of Artificial Sequence: Synthetic coding sequence
atgagcagcgacgaccggcacctgggcagcagctgcggcagcttcatcaagacggagccctcatctcctagcagcggaatagatgccctctcacatcactcgccctctggctcaagtgacgcctccggtggcttcgggctcgcactgggcacccatgccaatggtctggattccccccccatgttcgcgggtgcagggctcggcggcactccatgtcgcaagtcctatgaagattgtgcatctggaattatggaggatagtgcaatcaaatgcgagtatatgctcaatgctatcccaaagagactttgcctggtatgcggggatattgcctctggctaccactacggcgttgccagttgtgaagcttgcaaggccttcttcaaaaggacgatccagggaaatattgaatactcttgccccgccacgaacgagtgtgaaatcacaaagcgccgccgtaaatcctgtcaggcatgccggtttatgaaatgtctaaaggtaggtatgctgaaagaaggcgtaaggttggaccgcgtaaggggcggccgccagaagtataaacggaggctcgattctgagagctctccatacctgagcctccagatcagccccccagcaaagaagcctttgaccaagatcgtgagttatctgctggttgccgagcccgacaagctgtacgcaatgcctccccctgggatgccagagggggacatcaaagccctcacaacgttatgtgacctggccgatagagaactagtggtaataattgggtgggcaaaacacattccagggttcagttcattgtcattgggcgaccagatgtccttactgcagtcagcgtggatggaaattctgattctcggcattgtctacagaagcttgccctacgatgacaagcttgtctatgcagaggactacataatggacgaggagcatagtcgactcgcgggactgctcgaattgtacagagctattctgcagctcgttagacgatataaaaaactgaaggtagagaaagaagagttcgtcacattaaaagctctcgcactggcaaatagtgactcaatgtatatagaagatctcgaggccgtgcagaaactccaggacttattgcacgaggcactccaagattacgagctcagccaacgccatgaggagccctggaggacaggaaaacttctccttacactgccactgctgcgacaaactgccgcgaaggccgtgcagcacttctactcagttaagcttcaagggaaagtgccaatgcataaactatttctcgaaatgttggaagccaaagtgtag

SEQ ID NO: 186889 - DNA, 1311 bp, Artificial Sequence
  Description of Artificial Sequence: Synthetic coding sequence
atgagcaacaaggaccggcacatcgacagcagctgcagcagcttcataaagacggagcctagtagtcctgcttctctcacggactctgtcaaccatcactctcccggaggctcctccgacgcgtccggtagttactcttccaccatgaacggtcatcaaaatgggctcgattcccccccactttacccgagcgcccccatattgggaggctccggacccgtcagaaagctgtatgatgactgttccagtactatcgtcgaggacccacaaacaaagtgtgagtacatgctgaacagcatgccaaagcgcctctgccttgtgtgtggagacattgcctccggatatcactatggagtggcgtcttgtgaagcctgtaaagcgtttttcaagaggaccatccagggcaatatagaatatagctgtcctgccactaatgagtgtgaaattaccaaaagaagaagaaagtcatgccaggcctgtaggttcatgaagtgcctaaaagtgggtatgctcaaggagggagtgagactggatagagttaggggtgggaggcagaaatacaaaaggagaattgatgcagaaaacagcccttatctcaatccccagctggtacaaccagcaaagaagccctacaacaagatcgtgtctcacctccttgtcgctgaacccgaaaaaatctatgcaatgccagatccgacggttcccgactcagacatcaaagctctgacaactctgtgtgacttggccgacagggagctggttgtgattatcggatgggcaaagcacattcctggtttctccaccctgtcgttagctgaccagatgagcctcctccagtccgcatggatggaaatactgatcctgggggttgtctatcgcagtctcagtttcgaggacgaactcgtgtacgcggacgactacattatggacgaggaccaaagtaagctagcgggtctgctggatctgaataatgcaattttacaactcgttaaaaaatacaagagcatgaaattagaaaaggaggaattcgtcaccttgaaagcaattgccttagccaatagcgattccatgcacatcgaggatgtggaggccgttcagaaactgcaggatgtactccatgaagccctccaggactatgaagccggacagcacatggaggaccctaggagggccgggaaaatgttgatgaccctgcctctccttaggcagacatctacaaaggcagtgcagcacttctacaacatcaaattggagggcaaggtccctatgcataagctcttccttgaaatgttggaagcaaaggtgtgctag

SEQ ID NO: 186890 - DNA, 1308 bp, Artificial Sequence
  Description of Artificial Sequence: Synthetic coding sequence
atgagcaacaaggaccggcacatcgacagcagctgcagcagcttcatcaaaacagaaccaagctctccagcttctctgactgacagcgtcaaccatcactcccctggaggatccagtgatgcgagcggttcgtattcctctaccatgaatgggcatcagaatggtctggatagcccccccctataccccagtgcacctattctcgggggctccggacccgtacgcaaactgtacgatgactgtagttcgaccatcgtggaggatccgcagacaaagtgcgagtacatgctgaactccatgcccaagagattatgcctggtttgcggtgacattgcctcgggctatcattacggtgtcgcatcctgcgaggcctgcaaggccttcttcaagcggactatccaagggaacattgaatacagctgccccgccacaaacgagtgcgagataacaaaacgcagacggaaaagctgccaggcctgtcggtttatgaaatgtttgaaggtcggcatgctgaaggagggcgttcggctagatcgggtgcgtggcggacgccagaaatataagcggcgaattgatgcagaaaactccccatatctcaaccctcagctcgtgcagccagctaaaaaaccatacaataaaatagtctcgcatcttctggttgcagaacccgagaagatttatgcaatgccggatcctacagtacccgactccgatatcaaggcactgactaccctctgcgacctggctgatcgcgagctcgttgtgataatcggctgggctaaacatattccgggcttctccaccctctctctcgccgatcagatgagcctactgcagagcgcgtggatggagattctgatcttaggcgtcgtctataggagcctgagcttcgaagatgagctagtatatgccgatgactatattatggacgaggatcagtccaaactggcaggtctcctggacttgaataacgctatattgcagctggttaagaaatacaaatcgatgaagctggagaaagaagaattcgtcacccttaaggcaatcgcactggccaattcagactctatgcatatagaggacgttgaagctgtacagaaacttcaggatgttctgcatgaggcacttcaagactacgaggcagggcagcacatggaggacccacgacgagcgggtaagatgctgatgacgcttcctttactgaggcagacatcgacgaaggctgtacaacacttttacaacataaaactggagggcaaggtgcctatgcacaaactttttctggagatgctggaggccaaggtgtag

SEQ ID NO: 186891 - DNA, 1308 bp, Artificial Sequence
  Description of Artificial Sequence: Synthetic coding sequence
atgagcaacaaggaccggcacatcgacagcagctgcagcagcttcataaagacagagccctcctccccagcttctctgaccgatagcgtcaaccaccactcacctggggggtcctcagacgcctccggatcttattcttcaaccatgaatgggcatcagaacggcctggattctccaccactgtaccctagcgcaccaattctgggagggagtggaccagttagaaagctttacgacgattgcagttccaccattgtggaggatccccagactaaatgcgaatatatgttgaactccatgcctaagcgtctttgccttgtgtgcggcgatattgccagcggctatcattatggtgtagctagctgtgaagcatgcaaggctttcttcaaacgcacaatacagggaaatattgagtattcctgtcctgccacaaacgaatgtgagatcacaaagaggagaaggaagtcttgtcaggcttgccgcttcatgaaatgtctcaaagtggggatgttgaaggagggagttaggctggaccgggtgcgaggagggcggcaaaagtacaagcgtcggatcgacgcagagaactcaccctacctgaatccacagctggtgcagcccgcgaagaagccttacaataaaatcgtatcccatctcctggtggcagagccagaaaagatttacgcaatgcctgacccaactgtgcctgactccgatattaaggcgctcaccactctttgcgatctggctgatcgcgaactagtcgttattatcgggtgggccaagcatattcctggcttcagcacgctcagcctggccgaccagatgtccttgctccagagcgcctggatggagattttaattctaggtgtggtttaccgatccctctctttcgaggacgagcttgtgtatgcggatgactatattatggatgaggaccaaagtaaattggcaggcctgttagatctcaacaacgccattctgcagttggttaagaagtacaagagtatgaagctcgagaaggaagagttcgtgaccctcaaagctatcgccctggcgaattcagattctatgcacattgaagatgtcgaggccgtgcaaaagctccaggacgtgctgcatgaggcactgcaagactatgaagcgggacagcatatggaagaccccagacgtgcgggtaagatgctcatgacattgccactcctgcggcaaacatccactaaagccgtccagcacttttataacattaaattggaaggcaaggttcccatgcataagctcttccttgagatgctcgaagcaaaggtgtag

SEQ ID NO: 186892 - DNA, 1308 bp, Artificial Sequence
  Description of Artificial Sequence: Synthetic coding sequence
atgagcaacaaggaccggcacatcgacagcagctgcagcagcttcataaagactgagccatcttctccagcatctctgaccgattccgtgaatcatcatagtccagggggtagtagtgatgccagcggctcttatagtagtacaatgaacgggcatcagaatgggctggattccccaccactttatccttccgccccaatcctgggtggctcaggtccggtccgaaagctttacgacgattgctcctccacgatcgtggaagatcctcagaccaaatgcgaatacatgctcaattccatgcccaaaaggctctgcctcgtttgcggtgatatcgctagtggataccactacggcgtggcctcctgcgaggcttgtaaggcattctttaaacggaccatccaaggcaatattgaatactcatgcccagctacaaatgagtgcgagataaccaaaagacgacggaaaagttgccaggcttgtcggttcatgaagtgtctcaaagtgggaatgctaaaggagggtgttcgtctcgaccgggtccggggtgggcgccaaaagtacaaaaggcgaatagatgccgagaacagcccttatctgaatccgcagctggttcagccggctaaaaaaccgtataacaaaattgtgtcacatctgctcgtcgctgagcccgagaaaatctatgcgatgcctgacccaactgtgccagattccgacataaaggctttgacgacactatgtgatcttgcggatcgcgaactggtagttatcatcggatgggccaagcacatccctggattctctacactgagcctggcggaccagatgagcctgctgcagtccgcatggatggagatcctgatcctgggcgtagtctaccggtctctgtcttttgaagacgagctggtctatgccgatgattacatcatggacgaggaccagagcaaactggcaggcctgttagatctaaataacgccattctgcagctcgtcaagaagtataagtcaatgaaactggaaaaggaggagtttgtgacactgaaagccatcgctctggccaactcagatagcatgcatatcgaagatgtggaggccgttcagaaactgcaggatgtcctgcacgaggccttacaggattacgaggctggtcagcatatggaggacccgcggagagccggaaagatgctcatgaccctcccattgctcagacaaacctctacaaaagcggtgcagcacttctacaacattaagctcgagggcaaggtgcccatgcataagctgtttctagagatgctggaagccaaagtctag

SEQ ID NO: 186893 - DNA, 1308 bp, Artificial Sequence
  Description of Artificial Sequence: Synthetic coding sequence
atgagcaacaaggaccggcacatcgacagcagctgcagcagcttcattaaaaccgagcccagcagtccagccagcctgacggattccgtgaatcaccactccccgggaggaagttctgacgccagtgggagttactcatctaccatgaatggtcaccagaatggacttgacagcccccccctgtatccttccgcccctatcctgggcggctcagggcccgtgcgaaaactgtatgatgattgttctagtacgatagttgaggatccccagaccaagtgcgaatatatgctcaacagcatgcctaagaggctgtgtctagtttgtggcgatattgcaagcgggtaccactatggagtggcctcctgcgaggcctgcaaagcttttttcaaacggacgatacagggtaacatcgagtactcctgcccagcgactaatgaatgcgagattactaaacgccggagaaaaagctgtcaagcctgccgctttatgaagtgtctgaaagtcggcatgctgaaggagggcgtccgcctggaccgtgtccgcggggggcgacagaagtacaaaaggaggattgatgccgaaaattctccttacttgaacccccaactcgtccagcccgctaaaaaaccctacaacaaaatcgtctcccatctactggtcgcggagcctgagaaaatttatgcaatgcccgacccaacagtgcctgactctgacataaaggctctgaccaccctgtgcgatctagccgatagggagctagttgtgattatcggttgggcgaagcatatcccaggcttctccactctgtcactggcggatcaaatgagtttgctgcagtcagcctggatggagattcttatcctgggtgtcgtttacagatcgctgtcatttgaagatgaattagtgtacgcagatgactatataatggacgaggaccaatccaagttggctggtctgctggacctcaacaatgccattctgcaactggtcaaaaagtacaaaagcatgaagctcgagaaggaagaattcgtcacgctcaaggctatcgctctggccaatagcgatagtatgcacatcgaagatgtggaagctgtgcagaaactgcaggatgtcctgcacgaggccctgcaggactacgaggcaggccagcatatggaggacccaagacgggcggggaaaatgctgatgactctgccactcctgagacagacttccacaaaggctgttcaacacttctataacatcaagctggaagggaaagtccccatgcacaagcttttcctcgagatgctcgaggctaaggtttag

SEQ ID NO: 186894 - DNA, 1308 bp, Artificial Sequence
  Description of Artificial Sequence: Synthetic coding sequence
atgagcaacaaggaccggcacatcgacagcagctgcagcagcttcattaaaaccgagccatcttcaccagcatccctaaccgatagtgtcaaccatcattcacccgggggatctagcgacgccagtggtagctatagctcaactatgaacgggcatcaaaacggcttagatagcccccctctctacccatctgctcccatactcggcggcagcgggccagtcagaaaactgtacgacgattgcagctccacaatcgtagaggacccccagactaagtgtgaatatatgctgaactcaatgccgaaaaggctttgtctggtgtgcggtgatatcgctagtgggtaccactatggagtagccagctgcgaggcatgcaaggccttcttcaaacgcaccatccagggtaacatagagtattcctgccctgccaccaatgaatgtgagattactaagaggcggaggaaaagctgtcaagcatgtagatttatgaagtgtctgaaagttggcatgttgaaggagggagtccggcttgatcgagttcggggcgggcggcagaaatacaagcgcagaatcgacgccgaaaactccccctatcttaatccacagctggttcaaccagctaagaaaccatacaataagatcgtgtcccacctccttgtcgctgaaccagaaaagatctacgccatgccagacccaacagtgcctgactccgatattaaggccctgacgacactgtgcgacctcgctgaccgagagcttgttgtaattatcgggtgggcaaaacacattcccgggttctccaccctctcactggccgaccagatgtcactgctgcagagcgcttggatggagatattgatcctgggtgtcgtgtatagatccctgtccttcgaagatgagctggtgtacgccgatgattacattatggacgaagaccagtctaagctcgccggactgctcgacctgaataatgctattctccagctcgtcaaaaaatacaagtccatgaaactagagaaggaggaatttgtcaccttgaaagctatagccctggccaactcagatagcatgcacatcgaggacgtggaagccgtgcaaaagctgcaggacgtgctgcatgaggctttgcaggactacgaggctggccagcatatggaggatcctagacgggctggaaagatgctgatgaccctgcctctattaagacaaacaagtactaaggcagtacagcatttctacaatataaagctcgaaggcaaggtaccgatgcataagctgtttttagaaatgctggaggccaaggtctag

SEQ ID NO: 186895 - DNA, 1308 bp, Artificial Sequence
  Description of Artificial Sequence: Synthetic coding sequence
atgagcaacaaggaccggcacatcgacagcagctgcagcagcttcatcaagacggagcctagctcacctgccagcctcactgacagtgtgaaccatcattctcctggtggaagctcggatgcctccggatcatattcttcaacaatgaatggccaccaaaatggcctcgactccccgccgctctatccttcagcacctatattggggggcagcggacccgtccggaaactgtacgacgactgcagcagcacaattgtagaggatccccagacaaagtgcgagtacatgctgaactcaatgccaaagaggctgtgtttagtatgtggcgatattgcaagcggctaccattacggagttgcctcatgtgaagcttgcaaggctttttttaagcggaccatccagggcaacatagaatactcttgtcccgccactaatgagtgcgagattactaagcgccggagaaaatcttgccaggcctgcagatttatgaaatgtctgaaagtgggcatgttaaaggagggcgtgcgcctcgaccgagtccggggaggccgccagaagtataaaagacgcatcgatgccgagaactccccatatctgaacccacagctggtgcagcccgctaaaaaaccgtacaataagattgtttcccatcttctggtcgccgagccagagaaaatttacgcaatgcccgatcccaccgtgcctgacagcgatatcaaggcactgacaactttgtgtgatctcgcagaccgggaactcgtggtgataatcggttgggcaaaacatatccctgggttttcaactctttccttggctgatcaaatgagtctgctacagtcggcgtggatggaaattctcatcttaggagtggtctacagatcactgtccttcgaagacgaactggtgtacgcggacgactatattatggatgaggatcagagcaaattggctgggttgttagacctgaacaacgctatcctgcaactggtgaaaaaatataaaagcatgaaattggagaaggaggaatttgtgacactgaaagctattgccctcgccaattcggatagcatgcacattgaggatgttgaggcagttcagaagttacaggatgtgttgcatgaagcgcttcaagactacgaggctggtcaacacatggaggaccctcggcgagctggcaaaatgctcatgactctgcctctcctgcggcagactagcacaaaggccgtgcagcatttctataacatcaaactagaagggaaagtacccatgcacaagttgtttctggagatgctggaggcgaaggtctag

SEQ ID NO: 186896 - DNA, 1329 bp, Artificial Sequence
  Description of Artificial Sequence: Synthetic coding sequence
atgagcaacaaggaccggcacatcgacagcagctgcagcagcttcattaagacagagcccagctccccagccagtttgacggattctgtaaaccaccattcacccggcggttcctcagatgcgtccggaagttactcttctacaatgaatggccaccaaaatggattagactccccacccttgtatccgagtgcgcccatcttgggcgggtccggcccagtcaggaagctgtacgacgattgcagctccaccatcgttgaggatccccagacaaaatgtgaatacatgctgaactcgatgcccaaacgcctatgcctggtgtgcggggatatcgcctctgggtaccactacggagtcgccagctgcgaggcgtgtaaggcctttttcaagcgaaccattcagggcaatattgagtacagctgccctgccacgaatgagtgtgagattacgaaacgccgccgcaagtcttgccaagcgtgccgtttcatgaagtgtttaaaagtgggcatgttgaaagagggggtgaggctcgaccgggtgcggggaggaagacagaagtacaagcggcgcattgacgcagaaaattcaccctacctcaaccctcagttggtccagcccgctaagaaaccacttctatggtctgatcccgccgataataagattgttagtcatctgcttgtggctgagccggagaagatttatgcaatgcccgacccaaccgtgccggactctgatatcaaggccctgaccactctctgcgatctcgctgatcgcgaactggttgtgatcatcgggtgggcgaagcatatccccggattcagcactctgtctttagcagatcaaatgtcgctactacagagcgcttggatggagatactaatcctgggtgtggtgtacaggagcctctcttttgaggatgaactcgtttacgctgatgactacatcatggatgaagatcaatccaaactggcaggcttgcttgacttgaacaatgcaatcctccagttagtgaaaaaatataaaagtatgaaactcgagaaagaggagtttgtgactcttaaggccatcgcccttgccaattccgatagtatgcacatagaagacgttgaagccgtccagaagttacaggacgttctccacgaggcactgcaggattatgaggctgggcagcacatggaggacccgcgccgcgccggcaaaatgctcatgactctgcccctgctacggcagacttctactaaggctgtgcagcacttctacaatataaaactggaaggaaaggttccaatgcacaagctgttcctcgagatgctggaggcaaaagtctag

SEQ ID NO: 186897 - DNA, 1377 bp, Artificial Sequence
  Description of Artificial Sequence: Synthetic coding sequence
atggacagcgtggagctgtgcctgcccgagagcttcagcctgcactacgaggaagaattgctttgtcgcatgtctaacaaggacagacacatcgattcatcctgcagctccttcatcaagactgagcctagcagtccagcttcacttactgattctgtcaatcaccactctcccggtggctcaagcgacgcctcaggctcatactcaagtaccatgaatggacaccagaacgggctcgattcccctcctctataccctagcgctcccatacttgggggttctggcccagttcggaagttgtatgacgactgttctagcacaatcgtcgaagatccacaaaccaaatgcgaatatatgctgaacagcatgccaaaacgcctgtgtctcgtgtgcggtgacatcgcttcaggataccactatggcgttgcctcgtgtgaggcgtgcaaagccttttttaagcggacgatccaaggcaatatagagtattcatgccctgcgaccaacgagtgcgagatcacgaagcgaagacgaaagagttgccaggcatgccgattcatgaagtgcctgaaagttgggatgttgaaggaaggagtgcgcctagatcgcgttaggggaggtagacagaagtacaaacgcagaatcgacgcggaaaatagtccatatctcaatccccagcttgtgcagcctgccaaaaagccttacaacaagattgtttcccacttgctcgttgctgagcctgagaagatttacgccatgcctgaccctactgttccagactccgatatcaaagcactcacaaccctgtgtgacctcgctgaccgcgagttggtcgtaataatcgggtgggccaagcacatccccggctttagcactctctccctcgcggatcagatgtcattactgcagtcagcttggatggaaattctcattcttggagtggtctaccgcagcttgtcttttgaagacgaactggtgtatgcagatgactatatcatggacgaagatcaaagcaaattggctggcctcttggacctgaataacgctattcttcagctcgtgaagaaatacaagagcatgaaactggaaaaggaagaattcgttacacttaaggccatagcactggccaactccgatagtatgcacattgaagatgttgaggcagtacagaagcttcaggatgtcttgcacgaggctctgcaggactacgaagctggccagcacatggaagatccaaggagggcgggtaagatgttgatgacactccccctgctgcggcagacctccaccaaagcagtccagcacttctataatattaagctagagggaaaagtgccgatgcataagctgttcctggaaatgctcgaagccaaggtgtag

SEQ ID NO: 186898 - DNA, 171 bp, Artificial Sequence
  Description of Artificial Sequence: Synthetic coding sequence
atgagcaacaaggaccggcacatcgacagcagctgcagcagcttcataaaaacggagccgtcttcaccagcatccctgaccgactcagtcaaccaccatagccctggggggagttcagatgctagtgggtcctacagctccacaatgaatggacaccagaacgggctgtag

SEQ ID NO: 186899 - DNA, 279 bp, Artificial Sequence
  Description of Artificial Sequence: Synthetic coding sequence
atgagcaacaaggaccggcacatcgacagcagctgcagcagcttcatcaagaccgaaccctcctctccggccagcctaactgactctgttaaccaccactccccaggcggctcatcagatgcgagtgggagctatagcagcaccatgaacgggcaccagaatggtcttgattcacctccattgtacccctctgccccgattctgggagggtccggtccagtccgtaagctctatgacgattgttcttccacaatagtggaggaccctcaaaccaaatag

SEQ ID NO: 186900 - DNA, 1065 bp, Artificial Sequence
  Description of Artificial Sequence: Synthetic coding sequence
atgagcaacaaggaccggcacatcgacagcagctgcagcagcttcatcaagacagagccctctagtcccgcgtcccttacggatagcgttaatcaccattccccaggaggaagtagcgacgcctccggaagctatagctccaccatgaatgggcatcagaatggactagattcacccccactgtatccctccgcgccaatcctcggaggtagcggtccagtcagaaagctttacgatgactgttccagcacgattgtcgaggacccgcagaccaaatgcgagtacatgttgaactctatgccgaagcggctttgcctggtctgtggcgatattgcaagcgggtaccattacggagttgcatcttgcgaagcttgcaaggcattttttaagaggactattcaaggcaatatcgaatatagctgccctgccactaacgaatgtgagataaccaagcgccgccggaaaagttgtcaggcctgtcgctttatgaaatgtcttaaagtgggtatgcttaaggaaggcgtgcgtctggacagagtccgtggaggtcgccagaaatacaagaggagaatcgatgcggaaaattccccttacctgaatccacagctcgtacagcccgccaagaaaccctataacaagatcgtatctcacctgctagttgctgagcccgaaaagatttacgccatgcctgaccctacagtgcctgattctgacattaaagcgctgactacactgtgtgaccttgctgaccgcgagctcgtagtaataattgggtgggctaaacacatccccggtttttcaaccctatcccttgcggaccagatgagcctgctgcagtctgcttggatggaaattttaattctgggggttgtatacagatctctgagcttcgaggatgaactggtctatgctgacgattacatcatggacgaagaccagtccaagctcgccgggctgttggacctaaacaatgccatcctccaactcgtgaaaaaatacaagtctatgaagctggaaaaagaagaatttgtcactttaaaggcaatcgcattagctaatagctag

SEQ ID NO: 186901 - DNA, 153 bp, Artificial Sequence
  Description of Artificial Sequence: Synthetic coding sequence
atgagcaacaaggaccggcacatcgacagcagctgcagcagcttcattaagacagagccgtcatctccagcctccttgacagatagcgtcaatcatcactctccagggggatcgtctgacgccagtggttcctattccagtaccatgaactag

SEQ ID NO: 186902 - DNA, 1308 bp, Artificial Sequence
  Description of Artificial Sequence: Synthetic coding sequence
atgagcaacaaggaccggcacatcgacagcagctgcagcagcttcataaagaccgagccgagcagccctgcatcgctcactgatagtgtgaatcaccattcacccggggggtcttcagatgcttctggaagttatagctccaccatgaacggccatcagaacggattggactctccccccttataccctagcgctcccattctaggcggcagcggccctgttaggaagctttacgatgattgcagttccaccatcgtggaagacccccagaccaaatgtgagtatatgttgaacagtatgcccaaacgcctgtgcctggtatgtggcgacattgccagcgggtatcactacggggtggcctcatgcgaagcctgcaaggcattctttaaaagaacaatacagggcaacatagaatattcctgccccgccaccaacgagtgtgaaatcaccaagaggagacgaaaaagctgtcaggcttgtcgatttatgaagtgtctgaaggtcggcatgctgaaagaaggagtacgcttagaccgagtgagaggaggaagacagaagtacaagcgccggatagatgccgagaactctccttatctgaatccgcagctggtgcagccagccaaaaaaccatacaataaaattgtttctcatctgttagtggcagaaccagaaaagatctatgccatgccagacccgacagtgcctgactctgacataaaagcactcactaccctgtgtgatcttgccgatcgtgagctggtagtcatcatcgggtgggcaaagcacatccccggcttttcaaccttgagtctcgccgatcagatgagcctgttgcaatctgcttggatggaaattctaatcctcggcgtggtttatcgctccctcagctttgaggatgagttggtttacgctgatgattatataatggatgaagatcaatcaaagcttgccgggttactagatttaaataacgctattctgcagctggtcaagaaatataaatctatgaagcttgaaaaggaggaatttgtgacactcaaagccatagccctggccaacagtgattcgatgcacatcgaggacgttgaagctgtacagaaactccaggatgtgctccacgaggctttgcaggattacgaagctggccagcacatggaggatcccaggagggcggggaagatgcttatgacccttcctctactgagacagacaagcacgaaagcagtccaacacttctacaacataaagctcgaggggaaagtaccaatgcataagctttttttagagatgctggaagcaaaggtttag

SEQ ID NO: 186903 - DNA, 1308 bp, Artificial Sequence
  Description of Artificial Sequence: Synthetic coding sequence
atgagcaacaaggaccggcacatcgacagcagctgcagcagcttcatcaaaaccgaaccttcctcccctgctagtctcacggacagtgtgaatcaccactcaccaggtggctcaagtgatgctagcggctcttactcctcgactatgaatggacaccagaatgggctcgattcccccccactctatccctcagcccctatcctcggagggtcgggcccggttagaaaactctacgacgactgtagttcaaccattgtcgaagaccctcaaacaaaatgcgaatatatgctgaattccatgccaaagagactctgcctcgtctgtggggacatcgctagcgggtaccattacggagtcgcgtcttgcgaagcttgtaaggctttttttaaacggaccatacagggaaacatcgagtactcttgccccgctactaacgagtgtgaaatcaccaagcggagaaggaagagctgccaggcctgtaggtttatgaagtgcctaaaggtgggaatgttgaaggagggggtgcgactggaccgggtgcggggtgggaggcagaagtacaaacggaggattgacgctgagaattcaccttaccttaatccccaattggtacaaccggctaaaaagccatacaacaaaattgtatcccacctcctagtcgcggaacccgaaaaaatctatgccatgcccgatcctaccgtccctgatagcgatattaaagccctcaccaccctgtgcgaccttgctgacagggagctggtcgttattatcggatgggccaagcatatccccggtttctcaactctgagccttgccgaccaaatgagcttactgcagtccgcctggatggaaatactgatcctcggcgtcgtgtataggagtctaagcttcgaagacgaactggtttacgctgacgattacattatggatgaggatcagagcaagctggcaggcctattggaccttaataacgctatcctgcagctggtgaaaaaatacaagtcaatgaagcttgagaaagaggagtttgtgaccctaaaggcaatcgccttggctaactctgattctatgcacatcgaggatgtggaagcagttcaaaagctccaggacgtgctgcatgaagctctccaagactatgaagccggtcaacatatggaggatccccgccgggccggaaagatgttaatgaccctcccacttttaaggcagaccagtaccaaggctgtgcaacacttttataatatcaagctagagggcaaagtccctatgcataagctgttccttgagatgttggaagctaaggtttag

SEQ ID NO: 186904 - DNA, 1308 bp, Artificial Sequence
  Description of Artificial Sequence: Synthetic coding sequence
atgagcaacaaggaccggcacatcgacagcagctgcagcagcttcattaaaacagagcccagctctcctgcctccttgactgattctgtcaatcaccactcgccaggaggatcatcagacgcctccggcagttattctagcacaatgaacgggcaccagaatggactggatagtccaccgctgtatccctcagccccgatacttggggggagtggacctgtcaggaaattgtatgatgactgtagttccactatcgtggaagaccctcagaccaagtgcgagtacatgctgaatagcatgcccaagagattatgcctggtatgtggggacatagcgagtgggtatcactacggcgtggccagttgcgaagcctgcaaggcattctttaaacgaacaattcagggcaacatagagtactcctgccctgccacaaacgagtgcgaaattacgaagcggcggaggaagagttgccaggcttgtcgctttatgaagtgcttgaaggttgggatgctgaaagagggcgtacggctggatcgcgtcaggggtgggcgacagaagtacaaaaggaggattgacgcggagaacagcccttatctgaatccgcagctggtgcagcccgcaaagaagccttataataaaatcgtgtcccacttgctggtcgccgaacccgaaaagatctacgccatgcctgatcccactgttcctgatagtgacattaaggccctgacaacattatgtgatctggcagacagagagctcgtggtgatcatcggctgggctaagcacattccaggctttagtacgctgagcctcgcagatcaaatgtctctgctccagtctgcatggatggagatcttgattttgggagtggtgtacagatctttgtcttttgaagatgagctggtgtacgccgacgactacattatggatgaggatcagtccaagttggccgggctgctagacctgaacaacgccattttacagctggtgaagaagtacaagtctatgaagttagaaaaggaggagtttgtgacactcaaagccattgccctcgctaacagcgatagcatgcatatcgaagacgtagaagccgttcagaagctacaggatgtcttacatgaggctctccaggactacgaagccgggcagcacatggaagatccaaggcgcgctggaaaaatgctgatgactctccccctgctccgtcaaactagcaccaaagccgtccagcatttctacaatataaagctggaggggaaagtccccatgcacaagctgtttctggaaatgcttgaagccaaggtatag

SEQ ID NO: 186905 - DNA, 1413 bp, Artificial Sequence
  Description of Artificial Sequence: Synthetic coding sequence
atgtggcgggagtgcgactggggcctgggcgccgtgaagagcgaccttgcctgtgtcccctcagctaagcgcctgctgtgcagaatgtcaaacaaggacagacacatcgatagcagttgcagcagcttcataaagaccgagccctccagccccgcaagtctgacagacagtgtcaaccatcatagtcccggagggtcatcagatgccagcgggtcttattctagtactatgaacgggcaccagaatggcctggactcacccccactttatccctcagcacctatcctgggcggctctggtccagtcaggaagctttacgatgactgttcttctactatcgtggaagaccctcagacaaagtgtgagtatatgctcaactccatgcccaagaggctctgcctagtctgtggcgacatcgcttctggttatcactacggtgtggcttcatgcgaagcttgcaaggccttcttcaagaggaccatccagggcaacatcgagtatagctgccctgctaccaacgagtgcgagataaccaaaaggcgtcggaaaagctgtcaggcctgccgctttatgaaatgtctgaaggttgggatgctaaaagagggcgtacggcttgatcgggttcgcggagggcggcagaagtataagaggcggatcgatgcagagaactctccctacctaaatccccaacttgtgcagcctgctaagaaaccattgctctggtctgatccagccgataataaaatcgtgtcccacctgcttgtcgctgaaccagagaagatttatgccatgcctgatcccaccgtgcccgatagcgatattaaggctctgaccaccctctgtgatctggcggacagagagcttgtcgttatcataggttgggcaaagcacatacccggcttttcgactctttcccttgctgatcaaatgtcattgctgcagtctgcctggatggagattttgatcctcggagtcgtttacagatcattgagcttcgaagatgaacttgtctatgcagacgactacattatggacgaagaccaaagcaagctggccgggttgctggacctgaacaatgctatcttacaactcgtgaaaaaatacaagagcatgaaactggagaaagaggaattcgtgactctgaaggcaatagcactcgctaattccgatagcatgcacatagaggatgttgaggccgtccagaaactgcaggatgttctgcacgaagcactgcaggattatgaggccggacaacacatggaagatcccaggcgggccgggaagatgctcatgacactgcctctcttacgccaaacctccacgaaggcggttcagcatttctataacattaagctggaggggaaagttccgatgcacaagctgtttttggaaatgttggaagccaaagtttag

SEQ ID NO: 186906 - DNA, 1359 bp, Artificial Sequence
  Description of Artificial Sequence: Synthetic coding sequence
atgctgtgcggccggccccggagcagcagcgacaaccggaacttcctaagagagcgggcaggactatcctccgccgccgtgcagacacgtattgggaatagcgccgcatcccgaagaagccctgcggcacgtccacccgtgccggctcctccagcattgcccaggggcagaccgggcaccgagggaagcacatccctcagcgcgcccgctgtgctggtggtggccgttgcggtggtggttgtcgtcgtcagcgcagtcgcgtgggctatggctaattatatacatgttcctccaggctcccccgaggtgcccaaactgaacgtcacagtccaggatcaggaagagcatcgatgccgggaaggcgccctatccctgctgcagcacttacggccgcactgggacccacaggaagtaaccctccaactctttaccgatggcatcactaacaaattgattggatgctatgtaggcaacaccatggaggacgtggtgcttgtccgtatctacgggaacaagactgaattgctggtggatagggatgaagaagttaagagctttcgcgtcctccaagctcatggctgcgcaccacagctgtattgcacatttaacaatggactgtgctatgaatttatccagggcgaagcgttggatcccaagcacgtgtgcaaccccgctatcttcaggctgatcgcccggcagctggccaagatccatgcgatccacgcgcataacgggtggattcccaagtcaaacctctggctgaaaatgggaaagtacttcagcctgatccctacagggttcgccgacgaggacatcaataagcgattcctgagtgacatcccctcatcccagatcctgcaggaagagatgacttggatgaaagaaatcctgtccaacttgggcagtccagttgtcctctgtcataatgacctcttgtgcaagaatataatctataatgagaagcagggagatgtccagttcatcgattacgagtactctggctacaattacctggcctatgacattggaaaccattttaatgagtttgctggcgtgagcgacgtggactatagcttgtaccccgatcgcgagctgcagtcacagtggctgcgagcctacctggaagcctacaaggagttcaaaggctttggaacagaagtcacagagaaagaagtcgaaatacttttcatccaggttaaccagttcgctctggcgagccacttcttctggggactctgggccttgatccaggcgaagtattcaaccatcgaatttgactttctgggttatgccatagttcgatttaaccagtactttaagatgaagcctgaggtgaccgcactgaaggttcctgagtag

SEQ ID NO: 186907 - DNA, 777 bp, Artificial Sequence
  Description of Artificial Sequence: Synthetic coding sequence
atgctgtgcggccggccccggagcagcagcgacaaccggaacttcttgagggaacgagcaggtctgtcatccgccgccgtgcagacacgaatcggtaactcagccgcctcccggcgtagccctgcggcccgccccccagtgccggccccccccgcgctgccgagaggccggcctggaacagaaggatccaccagtctttcggcgccagccgttttggtcgtggctgtggccgtcgtcgtggtagttgtgtcagccgtcgcctgggctatggccaactatatccatgtgccccccgggtcgcctgaagttccgaagctcaatgtcaccgtccaggaccaggaggagcaccggtgccgcgagggagctttgtcactattgcagcacctgaggccgcactgggatccacaggaggtcaccctccagctgttcaccgacggaattaccaataaactgataggttgttatgtggggaacactatggaggatgtggtgctggtccgtatctacggaaataaaacagaattgctggtcgacagggacgaggaggtcaaatcgttccgagtgcttcaagcacatggctgtgcacctcagctctattgcacatttaacaatggattatgctatgagtttatacagggggaggcattggaccctaaacacgtgtgcaaccctgcaatattctcactgagttccctgacactgtgtaagggcaagactaccaggtgctttggcctcacagggtgcagaggtagtcgtctgcttttgagcttcttctag

SEQ ID NO: 186908 - DNA, 1305 bp, Artificial Sequence
  Description of Artificial Sequence: Synthetic coding sequence
atgctgtgcggccggccccggagcagcagcgacaaccggaacttcctgcgggagagggccggtctctccagcgctgctgttcaaactagaataggtaacagcgccgcatcacgccggagtccagccgctcgcccaccggttcccgcccctccagccttgccgagggggagaccgggaaccgaagggtccaccagtttgtccgcacctgcagtgctggtcgtagctgtcgctgtggtcgttgtggttgttagtgccgtggcctgggccatggcgaattatattcacgtgccccctggaagcccggaggtgccaaagttgaacgttaccgtgcaagaccaagaggaacataggtgtcgtgagggggccctgtcactcctgcagcacctgcggccacattgggacccccaggaggtcaccctccaactgttcacagatggaataacaaataagctgatcggctgttacgtcgggaataccatggaagacgtcgtcctagtgagaatctatggaaataagaccgagctgttagttgatcgggatgaagaagtcaagtcatttcgagtgctgcaggcccacggctgcgctcctcaactttattgcacctttaataacgggctgtgttatgagttcatccaaggtgaggccttggatcctaaacacgtgtgtaaccccgctatcttcaggctcatcgctaggcagctggcgaagatccatgccatacatgcccataatggctggatccctaaatctaacttgtggctcaagatgggcaaatactttagcctgatccctaccgggtttgcagatgaggacataaataagagattcttaagcgacattcctagttcccagatcctgcaagaagagatgacctggatgaaagagattctcagcaacttagggagtccggtggtgctgtgccataacgacttattgtgcaagaatattatctataacgaaaagcagggcgatgtgcagtttattgattacgaatactctggctataattacctggcctacgatatcggaaaccactttaacgagttcgcgggcgtgagcgatgtcgactattcgctgtatcccgaccgcgagctccagagccagtggctcagagcctacctcgaagcttacaaggagttcaaaggctttggaactgaggttactgagaaagaggtggagatcctattcatccaggttaaccagttcgcgctcggagagaatctgaattttatcatcggtaataagtactgtcagctgttcagcttaaaatggctcctgatctcatttggggactgcggcctctag

SEQ ID NO: 186909 - DNA, 627 bp, Artificial Sequence
  Description of Artificial Sequence: Synthetic coding sequence
atggccaagatccacaccatccacgccaacggcagcctgcccaagcctatcctgtggcataaaatgcataactattttactctggtgaaaaatgaaataaatccctcactgagtgcagacgttccgaaggtggaggtccttgaacgcgagctggcctggctaaaggagcacttaagccagttggagtcacctgtcgtcttttgccataatgacctcctgtgtaaaaacatcatatatgactcaatcaagggtcatgttcgtttcatagattatgaatacgccgggtacaattatcaggccttcgacattggaaatcacttcaacgaatttgccggcgttaatgaagtggattattgtctatacccagcacgggagactcagcttcaatggctccattactacttgcaggcccagaaagggatggccgttacgccgcgcgaagtgcaacgtctgtacgtgcaggtgaataagtttgccctggcatcccacttcttttgggctttgtgggccctgattcaaaaccagtattctaccatagacttcgattttctgagatacgcggtgatccgcttcaaccagtatttcaaagttaagcctcaggccagcgcattagagatgccaaaatag

SEQ ID NO: 186910 - DNA, 954 bp, Artificial Sequence
  Description of Artificial Sequence: Synthetic coding sequence
atggaggagaaggccgccgccagcgccagctgccgggagccccccgggcctccccgggctgctgccgttgcgtactttggcatctcagtggacccagatgatatattgcctggagcactgcgactgatccaggaattgcgacctcactggaaaccagagcaggtgagaactaagcgcttcactgatggaattaccaataagcttgtggcctgctacgtcgaagaagacatgcaggattgtgttttggtgagggtgtacggtgaacggaccgagctactagtagatcgcgagaatgaggtcaggaacttccagctgctaagggctcattcatgcgctcccaaactgtactgtaccttccagaatgggctgtgttatgaatacatgcagggagtggcactggaacctgagcacattcgcgaaccgagactgttctcacttagtgctgatgtccccaaggttgaagtgctggagcgggagctggcatggctgaaggaacatttatcccaactggagagcccagtggtcttctgtcacaatgatctgctctgcaagaacataatctatgacagtattaagggccatgttagattcatagattacgaatacgccggctacaattaccaggcatttgatatcggtaatcactttaacgagttcgcaggtgtcaatgaggttgactattgtctgtacccagctcgcgagacacagttacagtggcttcattactacctccaggctcagaagggcatggccgttactccacgtgaagtccagcggctctacgttcaggtgaacaagttcgccctggcaagtcacttcttctgggctctgtgggctctcatccagaatcagtactccaccatcgatttcgattttctgcgctacgcagtgatccgctttaaccagtactttaaggtgaaacctcaggcctcagcactcgagatgcccaaatag

SEQ ID NO: 186911 - DNA, 1185 bp, Artificial Sequence
  Description of Artificial Sequence: Synthetic coding sequence
atggccgtgccccccagcgccccccagccccgggccagcttccacctcagacgccacactccttgccctcaatgttcttggggaatggaagaaaaagctgccgctagtgccagctgcagggaacctcctggtcctcccagggcagctgcggttgcatatttcggtatttccgttgatcccgacgacattctgccaggcgccttacgtctaatccaagagttacgcccccattggaaacctgagcaggtccgtaccaaaagatttaccgatggcatcacaaacaaactggtggcctgctacgttgaagaggatatgcaagactgtgtgttagtcagggtttatggtgagagaaccgagctgttggtagaccgagaaaacgaggtgcgtaattttcagctcctgagggcccatagttgtgctcccaaattatactgtacatttcagaatggcctctgctacgaatatatgcagggcgttgcactggaacccgaacatattcgggagcccagactgtttcggctgatagctctggagatggctaaaatccacacaatacacgccaatggcagtcttcctaaaccaatactatggcacaaaatgcataattacttcactctagtgaagaacgagattaacccttccctgtctgcggacgttccgaaagtcgaagtgctcgagcgagaactggcctggctcaaggagcacctgtcacagctggaaagtcctgtcgtgttttgccataacgatctgttgtgcaagaatatcatctatgacagcataaagggccacgtgcggttcatcgattacgaatatgccggatacaactatcaggcattcgacattggtaaccattttaacgaatttgcaggagttaacgaggtagattactgcctgtacccggcacgtgaaacacagctgcagtggctccactactatttacaggcccagaaggggatggcagtcaccccaagggaagtgcaacgactgtatgtgcaggtcaataagtttgcattggggccgtcctgcgtttcttcgaccatgaccgcttccttacagtgttgtcgggtggggaacagacacggggagattgccaggctcaccttgtcagggttgttcccaggggtgtccttactgctgggaagcctcggcccgcaccccgagccagttctgcaccataggctgtag

SEQ ID NO: 186912 - DNA, 1161 bp, Artificial Sequence
  Description of Artificial Sequence: Synthetic coding sequence
atggccgtgccccccagcgccccccagccccgggccagcttccacttgcgccgacacacaccctgtccgcagtgtagttggggtatggaggaaaaggctgcagctagcgcctcctgtcgcgagccgccgggaccccccagggcagcggccgtcgcttattttggtatctctgtggacccagacgatattttgcccggtgctttacggctcatccaggaattaagaccccattggaaaccagagcaagttaggaccaagcgtttcacagatgggatcactaataaactggttgcctgctacgttgaggaagacatgcaggattgcgtgctagtgagggtttatggagaaaggactgaactgcttgtcgacagggagaatgaagtccgcaatttccaattgctgagggcgcattcctgcgcacccaaactttactgcacattccagaacgggttatgttacgaatacatgcagggtgtggctctggaacctgaacatatcagggagccaagactgttcaggctaattgcactcgagatggcgaaaatccatactatacacgctaatggcagtctgcctaagccgatcctctggcacaaaatgcacaactactttacactcgttaagaacgagataaatcctagcctatccgcagatgtcccgaaggtggaagttctcgagagagagttagcatggttgaaggagcacctgagtcagctcgaatcccccgttgtcttctgccataatgacctgttgtgcaaaaacatcatatatgactctattaagggccatgtacgatttatcgattacgaatacgctggatataactatcaggcttttgatattggaaatcattttaacgaattcgccggagtaaacgaagtagactactgtctgtaccccgcaagggaaactcagttacagtggctgcactactatctgcaggcccagaagggtatggccgtgacccctcgtgaggtacagagactctatgtacaggttaacaagtttgcactcgctagccactttttctgggcgctgtgggccctaatccaaaaccaatattctactatcgactttgattttttgagatacgcagtgattaggtttaaccagtactttaaggtgaagccccaggccagtgcacttgaaatgcctaaatag

SEQ ID NO: 186913 - DNA, 759 bp, Artificial Sequence
  Description of Artificial Sequence: Synthetic coding sequence
cggcggctgggcggcggcaccgccgagggcaagaccggccggggcctcggcggtccgagctgggataccggacctagggctatgggctctctgagccggccatcgttcagcgaccggctcatcgcgctggaaatggctaagattcatacaattcacgcgaatggtagcctgcctaagcctatcttatggcataaaatgcacaactatttcacgctcgtgaagaacgagattaatccatctctatcagctgatgttccgaaggtggaggtgttagaaagagaactggcttggctgaaggagcatttaagccaactcgagagccccgtcgtcttctgccacaatgacctcctctgtaagaacatcatatacgacagcattaaaggacatgtgaggtttattgactacgaatatgcgggatataactaccaagccttcgacattggaaaccacttcaacgagttcgctggagtgaatgaagtggactactgcctgtaccctgcaagggaaactcagctgcaatggctgcattattatctgcaagcacagaaaggtatggccgtgacaccccgtgaggtacagaggctttatgtccaggtgaataaatttgccctcgccagtcacttcttttgggctctgtgggccctcatacagaatcagtactctactatagattttgatttcttacgctatgcagtgatccgattcaatcagtatttcaaggtaaagcctcaggcctctgctttagagatgcccaaatag

SEQ ID NO: 186914 - DNA, 765 bp, Artificial Sequence
  Description of Artificial Sequence: Synthetic coding sequence
atggccgaggccgtgctgcgggtggcccggcggcagctgagccagcggggtggatcgggggcgcccatcttgctgcgccagatgtttgaaccggtcagctgtacctttacatatttgctgggggatagggaatcaagagaggctgtgctgattgaccccgtcctggagactgccccccgagatgcacagctgattaaggagctggggctcaggctgctgtatgccgtgaatactcattgccatgctgatcacattactggctctggtttgctgcgtagtttgctcccaggctgtcaaagcgttatctcacgcctctctggcgcccaggctgatctgcacattgaagacggtgactcaataagatttgggaggttcgctctcgaaactcgtgcatctcccgggcacactccaggctgcgtaaccttcgtgctgaatgatcatagtatggcttttacaggagatgccctgcttatccggggctgcggacgcacagatttccaacagggctgcgccaagactctgtaccacagtgtacacgagaaaatcttcactctgcctggtgattgcctgatttatcccgcccatgattaccatggctttaccgtgtccacagtggaggaggagcgcaccttaaacccgcggctgacgctttcctgtgaagagttcgttaagataatgggcaatctgaatctccctaagcctcaacagatcgattttgccgttccagcaaacatgaggtgtggagtgcagaccccaacggcttag

SEQ ID NO: 186915 - DNA, 1020 bp, Artificial Sequence
  Description of Artificial Sequence: Synthetic coding sequence
atggccgacagcgtgaagaccttcctgcaggacctggcccggggcataaaggatagtatatgggggatttgcaccatatcaaagctggacgcaagaatccagcagaaacgcgaggaacaacggagaagacgcgcctcttcagtcctggcacagcggcgggcccaatcaatcgaacggaaacaggaatccgaaccacggatcgtttctcggattttccaatgctgtgcctggaatggtggcgtcttttggttttcacttctcctgttctatcgcgtgtttattccagtgttgcaaagtgtcactgcccgaatcatcggcgatccgtcgctccacggggacgtgtggagttggctggagtttttcctgactagcattttctccgccctatgggtgttacctctgttcgtgttatcaaaggtggtgaacgccatctggtttcaggacattgctgaccttgccttcgaagtcagcggcaggaagccgcacccctttccgagcgtgtccaaaatcatcgctgatatgctgttcaatctgctgctgcaggccttgttcctgatccagggaatgttcgtgtccctgttccctatccatctggtcggccagttggtctccctgctccacatgtcgctgctttactccttgtattgcttcgaataccgctggttcaacaagggtatcgagatgcaccagcggctgagtaatattgagaggaattggccttattactttggctttgggttgccactggcttttctcaccgccatgcagtcttcatatattattagcggctgtctgttttccattctgttccctctgttcataatttctgccaatgaggcaaagccgggcaaggcttacctgttccaactccgcctattttcattagttgtgttcctgtctaaccggctgtttcacaagacagtttacctccagagtgcactatcaagctccacctcagcagagaaattccccagcccgcatccctccccggcaaaactgaaagctaccgctgggcactag

SEQ ID NO: 186916 - DNA, 786 bp, Artificial Sequence
  Description of Artificial Sequence: Synthetic coding sequence
atggccgacagcgtgaagaccttcctgcaggacctggcccggggcatcaaagattctatctgggggatctgtaccatttcaaaacttgatgcacgcattcagcaaaaaagagaggaacagcggcggagaagggcatcatctgttctggctcagcgcagagcccagagtatagaaaggaaacaggaaagcgagcctagaattgtgtcacggattttccagtgctgcgcttggaatggcggagtcttttggtttagcctattgcttttctacagagtgtttatacctgtgttacagtcagtgacggcccgaataatcggtgacccttctcttcatggggacgtgtggagctggctagagttttttttaacatcaattttcagcgccctctgggtgctccctctcttcgttctgtcaaaagtagtgaatgccatttggtttcaggacatagctgacctggcgttcgaggtgagcggacgaaagccacatccattcccatccgtgtccaagatcatcgccgatatgctgtttaacttactgctacaggccctatttctgatccaggggatgtttgtgagcctgtttcccattcatttagtgggccaactcgtgagcctcctccacatgtcactcctctacagcctgtactgtttcgagtatagatggttcaacaaggtggcggcattctcattgtctagctttctgtattcactcagcgcgccgatgaaacagaggcccgccaagcatatcagttcaagttgcgccagctcaccttggtggagttcttag

SEQ ID NO: 186917 - DNA, 903 bp, Artificial Sequence
  Description of Artificial Sequence: Synthetic coding sequence
atgatcctggagggcggcggcgtgatgaacctgaaccccggcaacaacttgctgcaccagccgcccgcctggactgacagttatagcacctgcaatgtgtcatccggcttcttcggaggacagtggcacgagatccatccccagtactggactaaataccaggtgtgggaatggctgcagcacctgctcgataccaaccagctggacgcaaactgtattccgttccaggagtttgacatcaacggcgaacatctttgttcaatgtcactgcaggaattcaccagagcagccgggactgcaggacagctgctgtacagcaatctgcaacacttgaagtggaatggacaatgttcttctgacctattccagtctacccacaatgtgattgtaaagactgagcaaactgagccatccataatgaatacttggaaggacgagaactacctgtacgacactaactatggcagcactgtcgatttactcgatagcaagaccttttgccgggcgcagatcagcatgacaaccacatcccatcttccagtcgctgagagccctgatatgaaaaaagagcaagatccaccagccaagtgtcatacgaagaagcacaaccctcgagggacccacctgtgggaatttatccgagacatcctgctaaaccccgacaaaaaccctgggcttatcaagtgggaggaccggtctgagggtgtgtttcgcttcctgaaatctgaggcagtggcacagctttggggaaagaaaaagaacaactcctcgatgacgtacgagaaactctcaagggccatgcggtactattataagcgagaaatcctcgagagggtggacggaaggaggctggtctacaaatttgggaagaacgccagagggtggagagaaaatgaaaactag

SEQ ID NO: 186918 - DNA, 903 bp, Artificial Sequence
  Description of Artificial Sequence: Synthetic coding sequence
atgatcctggagggcggcggcgtgatgaacctgaaccccggcaacaatctcctgcaccagcccccggcatggacagactcttactctacttgtaatgtttcatctgggttcttcggtggccaatggcatgaaatccacccacagtattggacaaaataccaggtatgggagtggctccagcatctcttggacactaatcagctggacgccaattgcattcccttccaggagttcgacatcaacggtgagcacctgtgctcaatgtctctgcaagaatttacacgcgcagcaggtacagctgggcagctcttgtattcgaacctgcaacacctaaagtggaatggccagtgcagctcagatttattccagtccacacacaatgtgatcgttaagacggaacagacagagccctcaattatgaacacatggaaggacgaaaactatctttacgatacaaactacggctccaccgtggatctcttagattccaaaacgttctgccgcgcccaaatatcaatgactacaacatctcacctgccagttgccgaaagtccagatatgaaaaaggagcaggacccaccagctaaatgccacaccaaaaagcacaaccctcgcggtacacacctctgggagtttataagagatatcctactaaacccagacaaaaatcccgggctgatcaaatgggaagatcgttcagagggcgtcttcagattccttaaatccgaggctgttgcccagctgtggggcaaaaagaaaaacaacagctccatgacatacgaaaagctgtctagagccatgcggtattattacaaacgggagattttggagcgcgtggacggtcgtagattagtgtataagttcggcaagaatgcaagagggtggcgggagaacgaaaactag

SEQ ID NO: 186919 - DNA, 969 bp, Artificial Sequence
  Description of Artificial Sequence: Synthetic coding sequence
atgggcctgcccgagcggcggggcctggtgctgctgctgagcctggctgaaattttgttcaaaataatgatattagaagggggaggggtgatgaatctcaatcccggtaacaatctgttgcatcaaccgcccgcttggaccgactcttacagcacttgtaatgtgtcttccggattctttggggggcagtggcacgagatccaccctcagtattggaccaagtaccaggtgtgggagtggctgcagcatctgctggacacaaatcagctcgatgcaaactgcatcccatttcaagagttcgacattaacggtgagcacctttgctcgatgagcctccaagaattcactagagctgcagggactgctggccagctgctgtacagcaatctccagcacttgaagtggaacggccagtgttcatccgacctttttcagtccacccataacgttattgtaaagaccgaacagactgagcctagtatcatgaacacctggaaagatgagaattatctttatgacacgaattatggcagtactgtggacctacttgattctaaaaccttctgcagagcacaaatttccatgacaactacctcccacttacccgtcgccgaatctccagacatgaagaaagaacaagatccacctgctaagtgtcacacgaaaaagcataaccctcggggtacccacttgtgggagttcatcagggacattcttcttaaccccgacaagaatcctggcctgatcaaatgggaagatagatctgagggcgtgttccggttcctgaaaagtgaggctgtggcacagttatggggaaagaagaagaacaactcatcgatgacctacgagaaattgagccgggcaatgaggtactattataagagagagatcttagagcgcgtggacggcaggcgtctggtgtacaaatttggcaagaatgcgcgcggctggagagagaatgaaaattag

SEQ ID NO: 186920 - DNA, 903 bp, Artificial Sequence
  Description of Artificial Sequence: Synthetic coding sequence
atgatcctggagggcggcggcgtgatgaacctgaaccccggcaacaacctcctccatcagccccccgcctggactgactcctactcaacgtgcaacgttagtagtggattctttggcggccaatggcacgaaatccacccgcagtactggaccaagtaccaagtgtgggaatggcttcagcacctgttagacacgaatcagctggatgcaaactgcatcccttttcaggaattcgacataaatggcgagcatctgtgtagcatgagcttacaggagttcacccgcgcggcaggcaccgccggccagttgctgtatagcaatcttcagcacctcaaatggaatgggcaatgtagcagtgatctgttccaatctacgcataacgtgattgtcaagaccgagcagactgaacccagcattatgaacacatggaaggacgaaaactatttgtacgacactaattatggtagcacagtggatctgctcgactccaaaactttttgccgggctcagatttcaatgaccacgaccagccatctgccggttgctgagagtcccgatatgaaaaaggaacaggatcctcctgccaagtgtcacacgaaaaagcacaatcctagagggactcacctgtgggaattcattcgcgacatcttgttgaaccccgacaaaaaccctggcctaataaaatgggaagatcggagcgaaggcgtatttaggtttctgaaatcagaagccgtggcccaattgtggggaaaaaagaagaacaattcctccatgacttacgaaaaactttctcgcgctatgcggtactactataagcgcgaaattcttgaacgagtggatggccgccggcttgtatataagttcgggaaaaatgcaagaggatggagagagaacgaaaactag

SEQ ID NO: 186921 - DNA, 834 bp, Artificial Sequence
  Description of Artificial Sequence: Synthetic coding sequence
atgatcctggagggcggcggcgtgatgaacctgaaccccggcaacaatttgttacaccagccacctgcctggactgatagctacagcacctgcaatgttagctccggctttttcggaggacagtggcatgaaattcacccgcagtactggacgaagtaccaggtgtgggagtggctgcagcatctcctagataccaaccagctagatgctaattgtattcccttccaggagttcgacataaatggggaacacttgtgctccatgagtctgcaggagttcaccagagctgcgggtacagccggccagctgttgtattctaatctgcagcaccttaaatggaacggacagtgtagctcagatctgtttcagagcacgcataatgtgatagtgaagaccgagcagaccgagccttctataatgaatacatggaaagatgaaaactacctgtatgataccaactacggtagcaccgtggccgagtctccagacatgaaaaaggaacaggaccccccggcaaaatgtcataccaaaaagcacaaccctcgcgggacccacctgtgggaatttataagggacattctattgaatccggataagaatcctggactgattaagtgggaagaccggtcggagggcgtgtttaggttcctgaagtcagaggctgtggctcagctttgggggaagaaaaagaacaattcaagcatgacgtacgaaaagctctctcgcgcaatgagatactactataaaagagagatactagagcgggtggatgggcggcgcctggtatacaaattcggcaaaaacgccaggggctggcgcgagaacgagaactag

SEQ ID NO: 186922 - DNA, 555 bp, Artificial Sequence
  Description of Artificial Sequence: Synthetic coding sequence
atggacctgtggaactgggacgaggccagcccccaggaggtgccccctggtaataagctcgccggccttgagggagcgaaattagggttttgctttcccgacttagctctccagggcgacactccgacagccacggccgaaacctgctggaaaggcaccagtagtagcctggcatctttcccccagctcgactggggatccgcacttcttcacccggaagtgccatggggtgccgaaccagacagtcaggctctgccatggtccggagactggaccgatatggcatgcacagcgtgggacagctggtctggcgcatcccaaacacttgggccagccccactgggacccgggccaatcccggccgctggctcagaaggcgcggccgggcaaaattgctcccctcccgccccaggcctgtaccatctcctcgaaccaggggcggcctgcggctggcatcacctattcgaggccgtcccagagctttcctctcaccgcttgctgaggacagagccagcggtcggtccgtgccagttcgggagtatgcctcagaactag

SEQ ID NO: 186923 - DNA, 468 bp, Artificial Sequence
  Description of Artificial Sequence: Synthetic coding sequence
atggacctgtggaactgggacgaggccagcccccaggaggtgcccccaggaaataaactggctggactggagggagcgaagttggggttttgtttccctgatctagctctgcagggagatacaccgactgccactgcagagacatgttggaagggcccgattcaactgtggcagtttttgttggagctgcttcacgatggggcaaggtccagctgcatcagatggaccggcaattcgagagagttccagttgtgcgatcccaaagaggtcgctcgcctgtggggcgagaggaagcggaaacctggcatgaactacgaaaagctgagtagagggctcagatactactaccggcgcgatattgtccggaaaagtggggggagaaagtacacttacagatttggcggaagagtgccatctctggcctaccctgactgtgcaggcgggggccgcggggcagaaacgcaatag

SEQ ID NO: 186924 - DNA, 1029 bp, Artificial Sequence
  Description of Artificial Sequence: Synthetic coding sequence
atggacctgtggaactgggacgaggccagcccccaggaggtgcccccagggaacaagctcgcaggattagaaggggctaaacttgggttctgctttcccgatctggcattgcaaggtgacacaccaaccgccaccgccgagacatgttggaagggtacttcaagcagccttgctagcttcccacaacttgactggggaagtgccttgttacaccctgaggtcccctggggtgcggagcctgattcccaagctctgccgtggagtggtgattggactgacatggcttgcacagcgtgggatagctggagtggtgcctcccagaccctcgggcccgcacctctgggccccggacccatccccgctgcgggctcggagggtgctgcaggccaaaattgcgttcccgtggccggtgaagccacatcctggtcgagagcacaagcagccggaagcaacaccagctgggactgctctgttggccctgacggtgacacttattggggttctggcctcggcggcgagcctcggaccgattgtacaatctcttggggcgggcccgccggccccgattgcacaactagttggaacccaggactgcacgcaggtggcaccacaagcctgaagaggtaccaaagcagcgctcttacagtgtgttctgagccctcccctcagtcagatcgagccagtttggcccgctgtccgaagacaaaccaccgtggccctatacagctgtggcagtttctcttggagttactgcatgacggagctcgttccagctgtataaggtggaccgggaattcccgcgaattccagctatgcgacccaaaggaagtggcaaggctgtggggggagaggaagcggaaacccggcatgaattacgagaagttgagcaggggtctccggtattactaccgcagggacatcgtcagaaaatcgggggggagaaagtatacatatcgctttggcggccgagtcccttctttggcatatcccgactgcgccggcggcggacgtggcgcagagacccaatag

SEQ ID NO: 186925 - DNA, 1029 bp, Artificial Sequence
  Description of Artificial Sequence: Synthetic coding sequence
atggacctgtggaactgggacgaggccagcccccaggaggtgcccccaggtaataagttagcagggctcgagggagcgaaacttgggttttgcttcccggacctagcactgcaaggggatacgccaacagcaactgcagaaacctgctggaagggcacctcatcctctctcgctagtttcccccaactagattgggggtccgccctcttacatcccgaggtcccatggggggcagaacctgactctcaggccctgccctggtcaggagattggacagatatggcatgcacagcttgggacagttggtctggggccagtcagacactcggtcccgccccgctcggccccgggcccatccccgccgcgggaagcgagggggcagctggtcagaactgtgtgcccgtcgccggcgaagctaccagctggtccagagcccaggctgcaggcagcaacaccagttgggattgtagcgttggcccagacggcgacacctactggggctctgggttgggtggcgagcctagaaccgactgtactattagttggggcgggcctgcgggccccgactgtacgacctcctggaaccctggccttcacgccggtggaacaaccagtcttaaaaggtaccaaagcagtgctctgacggtctgcagcgagccctctcctcagtccgaccgggccagccttgctcggtgcccaaaaacaaaccaccggggcccaattcagctgtggcaattcttactagaacttcttcacgatggagctaggtcctcatgcatccggtggactggaaacagccgcgagttccagctctgcgatcccaaggaagtcgcaaggctgtggggggagagaaaacggaagcccggaatgaactacgagaaactatcgcgcgggcttcgctattactaccgacgggacatagttaggaagtccggggggcgaaaatacacgtatcgtttcggaggacgggtgccttccctcgcatatcctgactgtgcgggcggaggtcggggcgcggagactcaatag

SEQ ID NO: 186926 - DNA, 432 bp, Artificial Sequence
  Description of Artificial Sequence: Synthetic coding sequence
atgaaggccggctgcagcatcgtggagaagcccgagggcggcggcggctaccagttcccagactgggcttacaaaactgaaagtagccccgggagtcggcagatacagctctggcatttcattctggagctgctgcaaaaggaggagttcagacatgtgattgcgtggcagcagggcgaatacggcgaatttgtaataaaggaccccgacgaagtggcccggctgtggggccggcgaaagtgcaagccacagatgaattacgacaaactgtctcgggccctgcgatattattacaacaaaaggatccttcacaaaactaagggaaagcgcttcacatacaagtttaattttaataagctggtgatgcccaattacccctttataaacataagatcatcaggaaagatccagaccctgctagtggggaattag

SEQ ID NO: 186927 - DNA, 1539 bp, Artificial Sequence
  Description of Artificial Sequence: Synthetic coding sequence
atgaaggccggctgcagcatcgtggagaagcccgagggcggcggcggataccagtttccagattgggcctacaagacagagagtagccccggttctaggcagattcaactatggcattttatcttagaattgttgcagaaggaggagttcagacacgtgatcgcatggcagcaaggagagtacggggagtttgtgattaaggacccagatgaggtagcccgtctgtgggggcgccggaagtgtaagcctcagatgaattacgataagctcagtagggccctgagatattattacaataagcggattctgcacaagaccaagggcaaaagatttacctataagtttaactttaataagctggtaatgcctaattatcccttcatcaatatcaggtcctccggcgtagtgccccagagcgcgccacccgtgccgactgccagctcccgctttcattttcccccccttgatacacactcgcccacaaacgatgtgcagcctggcaggttctccgcatcaagtcttactgcaagcggccaagagagctcgaacggcacagacaggaaaacagaattgagtgagcttgaggacggaagtgctgcagattggcgcagaggagtggacccggtgtcctcccggaacgccatcggaggagggggcattggacaccaaaagaggaaaccggatattatgctccccctcttcgccagacccgggatgtaccccgatccacacagcccttttgccgtgtcccccataccagggaggggaggcgtgttaaatgtccccatctctcccgccctcagcttgacacctacaatcttttcctactctccctcccctggactgtcaccgttcacgtctagcagctgctttagcttcaatccggaggagatgaaacactacttgcattcccaggcatgttcggtttttaattaccacctatcaccaaggaccttccccagatatccaggcttgatggtgccacccttacagtgccagatgcatcccgaggagtccacacagttttcgattaaattacagccgccacctgtcgggaggaaaaatagggagagagtcgaatcttcagaggaaagtgcgccagtgacaacccccacaatggcctcgatccctcccaggatcaaagtggaaccggcctcagaaaaagacccggaaagtctcagacagtccgccagggagaaggaagagcatacacaagaagaaggcaccgtgccaagtcgaaccatagaggaggagaagggaaccatattcgcccgccctgctgcccccccaatctggccatccgtccctatttccaccccaagcggcgagcctcttgaggtcaccgaggatagtgaagacagacccggcaaagaaccttccgcccccgagaagaaagaggatgctctgatgcctcctaaactgcgcctgaagaggcggtggaatgatgaccctgaagccagggaactatctaagtcggggaaattcttatggaacgggtctggccctcaaggtctggccaccgcagctgctgacgcctag

SEQ ID NO: 186928 - DNA, 1533 bp, Artificial Sequence
  Description of Artificial Sequence: Synthetic coding sequence
atggacggcttctacgaccagcaggtgcccttcatggtgcccggcaagagcagaagcgaagaatgtagaggacggcctgtcatcgatagaaagcggaaattccttgacacagacctcgctcatgatagcgaggaactgttccaggacctctctcagctgcaggaggcatggcttgctgaagcacaggtgcctgatgatgaacaatttgtgcccgatttccagtcagataacctggtccttcacgctcctccacctactaagattaaacgggaacttcacagtccgagctccgagctgagctcgtgtagccacgagcaggcacttggcgcaaactacggtgaaaaatgtctgtataactactgcgcctatgatcgcaaacctccttctgggttcaagcccttgactccccctacaacaccactctctccgacccaccagaatccactgtttcctcctccccaggctaccctccctacttccgggcatgcccctgccgccgggccagtgcaaggcgttggccctgctccggctccacactctcttcccgagccagggcctcaacaacagacgttcgccgtccctcgccctccgcaccaacctttacagatgcctaaaatgatgccagaaaaccaatacccctccgagcagagattccaaaggcagctgtcagagccatgtcaccccttccccccgcagccaggagtcccaggggataataggccaagttaccaccgccaaatgagcgagcctatcgtcccggccgccccccccccaccccaggggttcaaacaggaataccatgaccccctgtatgagcatggtgtgccaggaatgcctggcccacctgcccacgggttccagtctccaatgggtattaagcaggagccaagagactactgcgtggacagcgaggtccctaactgccagtcctcatatatgagaggaggttacttctcatccagtcacgaagggttctcctatgaaaaagatcccaggttatacttcgacgacacgtgtgtggtgcctgagagactagagggaaaagtgaaacaggaaccgaccatgtacagggaggggcctccttatcagcgacgtggatctctgcaactgtggcagtttctagtcacgctactcgacgaccctgccaacgcacactttattgcctggactggcagaggcatggaatttaagttgattgaacccgaggaagttgcccgccggtggggaattcagaagaaccggccggcaatgaactacgacaaactgtctcgctccctgaggtactactacgagaaaggcataatgcagaaggtcgccggtgagcggtacgtgtacaaatttgtgtgcgacccagatgccctgttctctatggcttttcctgacaaccaaagaccttttctaaaggccgaaagcgagtgtcatctgagtgaagaggacacgctgcccctcactcatttcgaggatagccccgcttatctcctggacatggacagatgttcttccctcccctatgctgagggcttcgcctactag

SEQ ID NO: 186929 - DNA, 399 bp, Artificial Sequence
  Description of Artificial Sequence: Synthetic coding sequence
atggacggcttctacgaccagcaggtgcccttcatggtgcccggcaaatcccgaagcgaggagtgccggggacggcctgtgattgaccgcaaacgtaagtttttggatactgacctggctcacgactctgaagaacttttccaggatctctctcagcttcaggaagcgtggttggccgaggcccaggtaccggacgatgagcagttcgtgcctgatttccagtccgataacttggtgttgcacgcacccccaccaacaaaaatcaagagggagctgcactcgccttcttctgagttgagcagttgttcgcatgaacaggcattgggcgccaactatggtgagaaatgcctttataattactgcgcttacgataggaagcccccgtccgggtttaagtag

SEQ ID NO: 186930 - DNA, 423 bp, Artificial Sequence
  Description of Artificial Sequence: Synthetic coding sequence
atggacggcttctacgaccagcaggtgcccttcatggtgcccggcaaatcccggtccgaggaatgcaggggacggcctgttatagacagaaaacgcaagttccttgatacagaccttgcacacgactctgaggaactgtttcaggatctgtctcaactgcaagaagcatggctggccgaagctcaagtccccgatgatgagcaatttgtccctgactttcagtccgacaatctggttctgcatgcacccccccccacaaaaattaagagagagcttcactcacctagctccgagctttctagctgctcccacgaacaggccctcggagccaattacggcgagaagtgcctgtacaactattgtgcttacgacaggaaaccaccaagcggattcaaacccctcactccaccgaccaccccatag

SEQ ID NO: 186931 - DNA, 1533 bp, Artificial Sequence
  Description of Artificial Sequence: Synthetic coding sequence
atggacggcttctacgaccagcaggtgcccttcatggtgcccggcaaatcccggtccgaagagtgtcgtggtagacccgtgatagataggaagagaaaattcctggataccgatctcgcccacgattctgaggagctgtttcaagatttgtcccagctgcaagaggcctggctggctgaggcacaagtgcccgacgacgagcagtttgtgccagacttccagtccgacaatctagtgctgcacgcccccccacctaccaagattaaacgcgaactgcattcaccaagcagcgagctgtccagctgtagccacgaacaggccctgggagctaattatggcgaaaagtgcttatataattattgcgcatatgaccggaagccaccttctggatttaaaccgcttactcctccgacgactccactctcacccacccatcagaacccccttttcccaccaccacaagcaaccctgccgacatccggccatgcccccgctgctgggccggtgcagggtgtggggcccgcgcctgctcctcactccctcccggaacctggcccacaacaacagacattcgcagtgcctagaccgcctcatcagccactccagatgcccaaaatgatgcctgagaaccagtaccctagtgaacaacgttttcagaggcagcttagtgagccttgccaccctttcccccctcagcctggggtgcctggcgataatcgaccttcttaccaccggcaaatgtcagaaccaatagtgcccgctgccccacctcccccgcagggctttaagcaggaataccacgatccgctctacgagcatggggtaccaggaatgcctggaccaccagcgcacggtttccaatctccaatggggatcaaacaggagcctcgggactactgcgtggatagcgaagttccaaactgccagagtagctacatgcgaggcggctactttagcagtagtcatgaagggttttcctatgagaaggatcccaggctatacttcgacgatacttgcgtggtaccagagaggttagagggaaaagtgaagcaagagcctaccatgtatcgggaaggccctccttatcagcgccgcggatcactgcagttatggcagtttctggtcactctcctggacgatccagcaaacgctcatttcatagcctggaccgggaggggaatggagtttaagttgatcgaacccgaggaagtggctaggcgctgggggatccagaaaaatcggccggcaatgaattacgataaattatctcgcagcctgaggtattactacgagaaaggtattatgcagaaggtggctggggaaaggtatgtgtataagtttgtgtgcgaccccgacgccctgttctcgatggccttcccagataatcagcgccctttcctaaaagccgaaagcgaatgccacctttccgaggaggacacactgcctttgacccacttcgaggacagtcccgcttacttactggatatggaccggtgttcaagcctcccatatgctgaggggtttgcatactag

SEQ ID NO: 186932 - DNA, 453 bp, Artificial Sequence
  Description of Artificial Sequence: Synthetic coding sequence
atggacggcttctacgaccagcaggtgcccttcatggtgcccggcaagagcaggtcggaggaatgcaggggccgtccagtgattgatagaaagcgaaaatttctcgacactgatctggcacacgatagtgaagaattgttccaggacctgagtcaacttcaggaagcctggttagcagaggctcaggttcccgacgacgagcagtttgtccccgactttcagtccgacaatttggtcctgcacgctccccctccaacgaagattaaaagagaactgcacagcccgagctcggagctatcaagctgctcccatgagcaggcgctaggcgcaaactatggggaaaagtgcttatataattactgcgcttatgataggaagccccctagcgggtttaagccattaacccccccaacaaccccgttaagccccacccaccagaaccccctcttttag

SEQ ID NO: 186933 - DNA, 1659 bp, Artificial Sequence
  Description of Artificial Sequence: Synthetic coding sequence
atgagcgagcggcggtgcccccccgagcaccgggagggcgtgaacgatacaggaggcagcctctttccccagaagctgctgaacgccgaaacatcccagtccggaatcagagatgcggagagtactatggacggtttttacgatcagcaagttccattcatggtccctgggaagtcccgctctgaagagtgccgaggacggccagttattgacaggaagcgtaaatttctcgacactgatctggcacacgatagcgaggagcttttccaggatctgtcccagttgcaggaagcttggctggctgaggctcaggtgcccgacgatgaacaatttgttcccgatttccagtccgataacctggtcctgcacgcgcctcccccaaccaagatcaaacgcgaactgcactcccccagctctgaattatcttcttgctctcacgagcaagcattgggcgcaaactacggagagaaatgtttatacaactactgtgcctatgatcggaaaccgccatccgggttcaagccactcacaccccctaccacccccctctctccaacacaccagaacccactctttccaccgccacaagccacgctgccaacctcaggccatgccccagctgcagggcccgtccagggtgtcggcccggccccagccccccactctctaccagaacccggccctcaacagcaaacgtttgctgtgccaaggcccccccatcagcccttacaaatgccaaaaatgatgccagagaatcaatacccgtccgaacagaggttccagcgacaacttagtgagccatgccaccctttcccacctcagccgggggttcccggagataacagaccttcctatcaccgtcaaatgtctgagcccatagtgcccgctgcacctccgccaccccagggcttcaaacaggaataccacgatcctttgtacgagcatggagtccccggaatgccaggacctccagcacatggatttcaaagccccatgggcatcaagcaggaaccaagagactattgtgtggacagtgaggttccaaactgtcagtcatcatatatgcggggtgggtacttctccagttctcacgaaggattctcctacgaaaaagaccccagattgtactttgacgacacgtgcgtggtgccagaaagactggaaggcaaggtcaaacaggagccaaccatgtatcgggagggccctccttatcagaggaggggctctttacaactttggcaatttctggtgacgctgctggacgatcctgccaatgcacacttcatagcctggacaggaagagggatggaattcaagctgatcgaacccgaagaggtcgcccggaggtgggggatacagaaaaaccgtcctgcaatgaactatgataagctgtctaggtcactgaggtactactatgaaaagggtatcatgcaaaaggtggcaggtgaacgctacgtctacaaattcgtgtgcgacccagatgctcttttctccatggcttttcccgataaccagcggccttttcttaaggctgagagtgaatgccatctctccgaagaggataccctgcctcttacccattttgaagattccccagcttacctgttggatatggatagatgctcttcactgccctacgcggagggttttgcttactag

SEQ ID NO: 186934 - DNA, 1359 bp, Artificial Sequence
  Description of Artificial Sequence: Synthetic coding sequence
atgagcgagacccccgcccagtgcagcatcaagcaggagcggatctcgtataccccccccgagtccccggtcccctcatacgcgtcttcgacacctttgcacgtccccgtacctagagcccttcggatggaagaggatagtatccgcctcccggctcacttgcgcttgcagccaatttactggtccagggatgacgtcgcccagtggctgaagtgggctgagaatgagttctctctccggccgattgactctaacacttttgagatgaatggtaaagccctgctgctgctcaccaaggaggacttccgatacaggtccccccactcaggcgacgtgctgtatgagctcctccagcacattctgaagcagagaaaaccccggatcctgttttctccttttttccacccaggcaactcaatccatacgcagcctgaggtgatcctacatcagaatcatgaggaagataattgcgttcagcgcactccgcggccctccgtcgataacgtacaccacaacccacctacaattgaattattacataggagcagaagccccattaccacaaatcaccgaccctctcctgatcctgaacaaagacccttgcggagcccactcgacaacatgatccgcaggttgtctcctgccgaacgcgcccaggggccacgcccccaccaggagaataatcaccaggagtcttaccctttgagcgtgtctccgatggagaacaaccactgccctgccagctccgaaagtcacccgaagcctagtagcccaaggcaggagagcacacgtgtcattcagctgatgccttccccaatcatgcacccactcatcctgaatccaagacactctgtggatttcaagcagagccgcctgagcgaagatggcctgcatcgagaaggaaagccaatcaatctgtcccaccgggaggacctcgcctacatgaaccacataatggtgtccgtttcaccacctgaggagcacgctatgccgattggcaggatcgccgactgtagactactctgggactatgtatatcagcttctgtctgatagccgctatgaaaacttcatcagatgggaggacaaggagagcaagattttcagaatcgtggacccaaacggcttggctagactgtgggggaatcataaaaaccgcactaatatgacctacgaaaagatgagtagagcactgagacactattataagttgaacatcatcagaaaagaacctgggcaacggctgctgttcagattcatgaaaactcccgacgagattatgtcagggcgaactgataggcttgaacatctggaaagtcaggagctagacgaacaaatctaccaagaagacgaatgctag

SEQ ID NO: 186935 - DNA, 954 bp, Artificial Sequence
  Description of Artificial Sequence: Synthetic coding sequence
atgcaggagggcgagctggccatcagccccatcagccccgtggccgccatgcctcccctcgggacacacgtacaggcgagatgcgaggcccagataaatctgctgggagagggtggaatctgcaaactgcccggacgcttgcgcatacagcctgcactgtggtctagggaggatgtgctccactggttgcgatgggcagaacaggaatacagcttaccctgtactgctgagcacgggttcgagatgaatggcagagcgttatgtatcctcaccaaggatgattttcgccatcgggccccgtcaagcggagacgtgctttacgaactgctgcagtacatcaagacccagcgccgggctctggtttgcgggcccttcttcggtgggatcttcaggctgaaaacccccactcagcattcaccagtaccacctgaggaggtgacaggaccttcccagatggatactagacggggtcacctattgcagccgcccgatccgggtctgacatcaaacttcggacacctggatgaccccgggctggcgcgttggacacccgggaaggaagaaagcctcaacctctgtcactgtgccgagcttggttgtaggacccagggggtttgttctttcccagcaatgcctcaggcaccgattgatgggcgcatcgcagactgtcggttgctgtgggactatgtgtaccagctgcttctggacacaagatatgaaccctacataaagtgggaggataaggatgccaagatctttagggtggtggatcccaacggcctagcaaggctgtggggtaaccacaagaaccgggtgaacatgacatacgagaagatgtctcgtgctctgcgacattactataagctgaatattatcaagaaagagcccggacagaaactgctgttccgcaacggactccagttgattttcatctttatctggagcttccaatag

SEQ ID NO: 186936 - DNA, 1026 bp, Artificial Sequence
  Description of Artificial Sequence: Synthetic coding sequence
atgcaggagggcgagctggccatcagccccatcagccccgtggccgctatgccccccctcggcacacacgtccaggcccggtgtgaggcgcagataaatttacttggagaaggcgggatctgcaaacttcccggacgactgagaattcagcctgccctttggagcagggaggatgtgttacattggttgcgttgggccgaacaggaatacagtctgccctgcactgccgagcacggcttcgagatgaatggccgtgccctgtgcatattgactaaagatgactttagacaccgcgcaccttctagtggcgacgtgctgtatgagctccttcagtatatcaagacacagaggcgggctttagtgtgcggaccattttttggaggaatcttcagacttaaaacgcctactcagcacagtccagtacccccagaagaagtaactggcccctcacagatggacacgcggcgaggccatctgcttcagcccccagacccgggcctgacatccaacttcggccatttggatgatcctgggctagctaggtggacccccggcaaagaagagtcgctaaatctctgccactgtgcagagcttggatgtcgtacccagggggtgtgcagtttccccgccatgccccaggcaccaattgacggaaggatcgccgattgtcggctgttgtgggattacgtttatcagctgctgctggacacacggtacgagccatatattaaatgggaagacaaggacgcaaaaattttcagggtagtcgacccaaacgggctggccaggctgtgggggaaccacaaaaatcgggtaaatatgacctatgagaaaatgtctagggctctccgccactactacaaattgaatattattaaaaaggaaccagggcagaagctgctgtttagatttctgaagactccagggaaaatggtgcaggacaagcactcccacttggagcctctggaatcacaggagcaggaccgcatcgaatttaaagataaacggcccgagatttcaccctag

SEQ ID NO: 186937 - DNA, 795 bp, Artificial Sequence
  Description of Artificial Sequence: Synthetic coding sequence
atgcaggagggcgagctggccatcagccccatcagccccgtggccgcaatgccccctctcgggactcacgtgcaggcgagatgtgaagcccagattaatctgctgggggaggggggaatttgcaagttacccggtcgactccgcattcaaccggcgttatggtcgcgagaagatgtgctgcattggctgcggtgggcggagcaagaatactccctcccgtgtacagctgaacatggatttgagatgaatggtagagcgctctgcatcctgacgaaagacgattttcgtcatagagccccaagctcaggggacgtcctctatgagctgctgcagtacatcaagacccaacggagggcgctcgtttgcgggccctttttcggaggcatattcaggctgaaaacccccactcagcatagtccggtaccccccgaggattgtagactattgtgggattatgtctatcagctactgctcgatacccggtatgagccatacatcaaatgggaagacaaagacgcaaagatcttcagagtagttgatcctaacggactggcccgtctctggggaaatcacaagaacagggtgaatatgacctatgaaaagatgtccagggctctcaggcactactacaaattaaatatcatcaagaaggaaccgggacagaagctgctgttccgcttcctcaaaactcccggcaagatggtccaggacaaacactcccatttggagccccttgaatctcaggaacaagataggattgaattcaaggataagagacccgaaattagcccttag

SEQ ID NO: 186938 - DNA, 861 bp, Artificial Sequence
  Description of Artificial Sequence: Synthetic coding sequence
atgcaggagggcgagctggccatcagccccatcagccccgtggccgctatgccccctctcgggactcacgttcaggctcgctgcgaggcccaaattaaccttttgggtgagggagggatctgcaagcttccaggtcgcctgagagacgtgctctatgaacttctgcagtatataaaaacacagcgccgggctctagtatgtggaccattctttggcggtatatttaggctaaagactcctacacagcacagtcctgtaccccccgaggaagtaactgggcccagccagatggacacgagacgtggacaccttctgcaaccaccggaccccggactgacttctaactttgggcacctagacgatccagggctcgctagatggactccgggcaaggaagagtccctgaatctgtgtcactgcgccgagctgggctgtcgaacccagggcgtctgctcattccccgcaatgcctcaagcccctatagacgggcgaattgcagattgtagacttttgtgggactatgtataccagctgcttttggacactcgctatgagccctacatcaagtgggaggacaaggacgcaaaaatttttcgcgtagtcgacccaaacggtcttgccaggttatggggcaaccataaaaatagggttaatatgacctacgagaagatgagcagggctctgcgccattattataagctgaacattattaaaaaagagcccggccagaaactccttttcagattcctaaagacacccggtaaaatggtgcaggacaaacatagccacttggagcccctggagtctcaggagcaggacagaattgaatttaaagacaaacgcccagaaatttcgccttag

SEQ ID NO: 186939 - DNA, 573 bp, Artificial Sequence
  Description of Artificial Sequence: Synthetic coding sequence
atggacacccggcggggccacctgctgcagccccccgaccccggcctgacctctaatttcggtcatttggacgatccaggactggctcggtggacgccgggaaaggaggagagcctgaatctgtgccactgtgcagagctcgggtgcaggacacagggcgtgtgttccttccctgcgatgcctcaggcccctatcgatggtcgaatcgccgactgtcgcttgttgtgggattacgtctatcagttgttgttagacactcggtacgagccttacatcaaatgggaggataaagacgctaagatattcagggttgtcgatccaaatggtctggccaggctgtggggcaatcacaagaatcgcgtgaatatgacctacgaaaagatgtccagagcactgagacattattacaaactcaacataattaagaaggagccaggtcaaaagctgttgttccggtttctcaagactcccggcaaaatggtgcaagacaaacactcacacctcgagcctctggaatctcaggagcaggatcgcattgaattcaaggataagcgccctgaaatatccccctag

SEQ ID NO: 186940 - DNA, 1242 bp, Artificial Sequence
  Description of Artificial Sequence: Synthetic coding sequence
atggccagctgcgccgagcccagcgagcccagcgcccccctgcccgccggcgtgccacccctcgaggacttcgaggttctggacggcgtggaagatgccgagggtgaggaggaggaggaggaagaggaggaggaggaagatgatctcagcgagctgccccctctcgaggacatgggccagcctcccgcggaagaagccgagcagccgggggccctagcgagggagttcctcgccgcgatggagcccgagcccgcccccgctccagcccccgaagaatggcttgatatacttggaaacggtctgctgcgcaagaaaactctggttcccgggccaccaggctctagccgacctgtcaagggacaagtcgttacagtgcacttacagacttcactggaaaacggcacgcgcgttcaggaagaacccgagctggtgtttacactgggggactgcgatgttatacaggccctcgacctgtcagtaccccttatggatgtgggcgaaacggcgatggtcactgccgactctaagtactgctatggtccacagggaagccgcagcccatatattccaccccacgctgcactgtgtctggaagtcacactgaaaaccgctgttgacggaccggaccttgagatgctgacaggacaggaacgtgtggcccttgccaaccggaaacgcgagtgtggtaacgcacactaccagagagcggatttcgtgctggcggccaacagttatgatttagcgataaaagccatcacatcgagcgccaaggtggacatgacctttgaggaagaggcccaactcctgcagctgaaagttaagtgcttgaacaaccttgccgcttcccaactcaagctggatcactaccgggccgccctgcgatcatgcagtctggttctggagcatcaacccgacaacataaaggcacttttcagaaagggtaaggtactggcgcagcaaggagagtactctgaagccattcctatcctgcgagccgccttgaagctggagccgtctaacaagacaattcacgccgaactgtcaaagctcgtgaaaaagcacgctgcccagcggagtacggaaacagccctttatcgcaagatgctgggtaatccttcacgcctcccagccaagtgtccgggtaagggcgcctggtccataccctggaaatggctgttcggggccaccgctgtggccctaggcggcgtggcactctccgtcgtgattgcagctagaaattag

SEQ ID NO: 186941 - DNA, 1422 bp, Artificial Sequence
  Description of Artificial Sequence: Synthetic coding sequence
atgaactacgacaagctgagccgggccctgcggtactactacaacaaaaggatcctgcacaagacaaagggcaagcggttcacgtataagttcaatttcaacaaactggtgctggtcaattatcctttcatcgacgtgggactggctggcggagccgttccccagagcgccccgccagtccctagcggaggcagccacttcagattcccaccctcaacaccttctgaggtcctgtctccaacagaggaccctcggtcccctcctgcctgcagcagttcatcctcaagcctgttttccgccgtggtcgcacgtagattgggacgggggtcagtctcagactgcagtgacgggacatcagagctggaggaacctctcggtgaggatcctagggctcggcctcccggaccccccgacttaggggccttccgcggtcctcctctcgccaggttacctcatgaccctggagtcttcagagtgtaccctcgcccacggggaggaccagagccattgtcccccttccccgtcagccccttagcaggtccaggcagcttacttccacctcaactgtcccctgcactgcctatgacgcccacccaccttgcatatacaccatcaccaaccctaagccccatgtatcctagtggaggtggggggccatctggatctggcggggggtcccacttttcctttagccccgaggatatgaagcgctacttgcaggcccacactcagtctgtgtacaactatcacctgtcgcccagagcgttcctgcattacccagggctcgtggttccacagcctcagaggcccgacaagtgccctcttccgccaatggcccccgagacgccgccggtgccaagttccgcatctagctcaagcagctcatcttcctcaccattcaaattcaagttacaacccccccctctggggcggcgccagcgggcagctggagagaaggcagtggccggtgccgataaatccggcggaagcgccgggggcctagccgagggcgccggggccttggccccaccaccgcccccccctcagatcaaagttgagccaatctctgagggtgagtctgaggaggtggaagtcaccgacatctctgatgaagacgaggaggacggagaggtgtttaaaacaccgagagcccctccggctcctccgaaacccgaaccaggcgaggctccaggagcatcccagtgcatgcctttgaagctgcgctttaagcgccggtggagcgaggactgtaggcttgaaggaggagggggcccagctggcggctttgaggatgaaggcgaggacaaaaaagttcggggggaaggacctggagaagcagggggccctctgacacccaggagagtttctagcgatctgcaacatgctaccgcacagttatcattagagcatcgcgatagctag

SEQ ID NO: 186942 - DNA, 2478 bp, Artificial Sequence
  Description of Artificial Sequence: Synthetic coding sequence
atggccgccgacgagggcagcgccgagaagcaggccggcgaggcccacatggctgctgacggggagaccaacgggagttgcgagaattctgatgcaagttctcatgcaaatgccgccaagcacacccaggattccgctcgcgtaaacccccaggatggcacaaataccctgacaaggatagctgagaatggagtatcagaacgggactccgaggcggccaagcagaatcatgtcaccgcagacgatttcgtccagacgagcgtcattggttctaacggatacatattaaacaaacctgccttacaggcacagcccctgcgcacaacttcgaccttggcttcctccctgccaggacatgccgcaaaaacactccctggcggtgccggaaagggccgaactccttcagcctttccacagactccagccgcacctcctgccactttgggagaaggctccgcagataccgaagacagaaagttgcccgcacccggggccgacgtaaaggtccacagagcaaggaagacgatgcccaaatctgtcgtgggactgcacgccgcatcaaaagatccaagagaggtccgagaggcacgagatcacaaagagccaaaggaggaaatcaacaagaatatttctgattttgggaggcagcagctactaccgcccttccccagccttcaccaaagcctgccccagaaccagtgctatatggccacaaccaaaagtcagactgcgtgtctgcccttcgtattggcagctgccgtgtctaggaaaaagaagcgccgtatgggtacatattctctggtccccaaaaagaagacaaaggtcctgaaacaaaggaccgtcattgagatgttcaagagtattactcacagtactgtgggaagcaagggcgaaaaggatctgggtgcttcttctttgcacgttaatggagagagcctggagatggatagcgacgaggatgattcagaagaactcgaagaggatgatggtcatggcgcggagcaggctgccgctttccccacagaagacagtaggacaagcaaagagtccatgtctgaggctgatagagcccagaagatggacggggagagcgaggaggaacaagagtctgtggataccggagaggaggaggaggggggagacgagagtgacttatcttctgaaagctctatcaaaaaaaaatttctgaaacgaaaaggaaaaacggacagtccttggattaagcccgcccggaagcggcggagacgttcacgtaagaagccctccggagccctgggctctgaatcatataagtcgtccgccggttcagccgagcagacagcaccaggggacagcacaggctatatggaggtgagcttggactcactggacttacgtgtaaaagggattttaagttctcaagcagagggcttggccaatggaccagatgtcctagagacagatggtctgcaggaggtgcccttatgttcttgccggatggagacacccaaatcccgggagatcactacacttgctaataatcagtgtatggcgacagagtcagtcgaccacgagctgggaaggtgcactaactccgtggttaagtacgaacttatgcggccgtctaataaggcaccacttcttgtgctgtgcgaggaccaccggggaaggatggtgaaacaccaatgttgccccggctgcggctatttctgcacagccgggaactttatggaatgtcagcctgaatcaagcatcagccacagattccacaaagactgtgcatcacgggtgaacaacgcctcttactgcccccactgcggtgaagaaagcagcaaggccaaagaggtgaccatagctaaagcagacacaaccagcactgtcacaccggtgcctggacaggagaagggctcagctctcgaaggccgggcagatactaccaccggcagcgctgctggaccccctctgagcgaggatgacaagctgcaaggtgccgcctctcacgttcccgagggcttcgatcctacagggccagctggtctgggccgacctactcctggattgagtcagggaccaggaaaggagacacttgaaagtgccctcatcgcgttggactcagaaaaaccgaaaaaactgagatttcacccaaagcagctgtatttttccgctagacagggagagctgcagaaagtgttattgatgctggttgacggcatcgatcctaacttcaaaatggaacatcaaaataagcgttcacccttgcacgctgccgccgaggccgggcatgtcgacatctgccacatgctcgttcaagccggggcgaatatagatacttgcagcgaggaccagcgcaccccactgatggaggccgcagagaataatcacctcgaggcagtcaaatacctcataaaggcaggagctcttgtggatcccaagatccagaagacatccaaagtatacactgaatctcaggagactcagcgatcacagaccatcttgtag

SEQ ID NO: 186943 - DNA, 3462 bp, Artificial Sequence
  Description of Artificial Sequence: Synthetic coding sequence
atggccgccgacgagggcagcgccgagaagcaggccggcgaggcccatatggctgcagatggagagaccaacggctcatgcgaaaactcagacgcctcttctcacgccaacgctgcaaagcacacccaggactcggcccgggtcaatcctcaggatggtacgaacacccttacgcggattgctgagaacggggttagcgaacgcgatagcgaggcagcaaaacagaatcatgtgactgccgacgatttcgttcagacatctgttatcggcagtaatggctatattctcaacaagcctgccttgcaggcgcagcctttacgtaccacatccaccctcgcctcctcgctccccggtcacgccgccaaaaccctcccgggcggagccggcaaaggaagaactccctctgctttccctcagactccagctgcccctccagctacactaggtgaggggagcgccgatacggaggacagaaagttacccgcccccggtgcggatgtgaaagtccacagggcccgcaaaaccatgcctaaaagcgtggttggactgcacgccgcctcaaaggaccctcgcgaggtgcgcgaggccagagaccataaagagccgaaggaagagataaacaaaaacataagcgattttggacgccagcagttgttgcctccattcccttccctgcaccagagccttccacagaatcagtgctatatggccactaccaaaagccaaaccgcttgcttgccctttgtccttgccgccgccgtgagccgcaaaaagaagagacgcatgggtacctattctctggtgcccaagaaaaagaccaaagtgttaaagcagcgcactgtgatagagatgttcaaatcaatcacccacagcactgttggatcgaaaggggaaaaggacctgggtgcctcctccttgcacgtgaacggggagtctctggagatggactccgacgaggatgacagcgaagagctagaagaggacgatggacacggggccgaacaggctgctgcctttcctaccgaagattcccgcacaagtaaggaaagtatgtccgaggccgatagggcacaaaagatggacggcgaatctgaagaggaacaggaaagcgtagatactggggaggaggaagagggaggcgacgagagcgatctgagctctgagtcctcaatcaagaaaaaatttttgaagagaaaggggaaaaccgactctccgtggatcaaaccagcgaggaagcggcgtaggcgcagccggaaaaaaccgtcgggagccctgggatccgagagctacaaaagcagtgcagggtctgctgagcaaaccgctcccggcgacagcacggggtatatggaagtttctctggactcactggatctccgagtgaagggtattctgagtagccaggcggaaggactcgccaacggccctgatgtgctggagactgatggtcttcaggaggttccgctttgtagttgtcgaatggagacacctaaaagcagagaaatcacaacgctcgctaataatcagtgtatggctacggaatcagtcgaccatgagttgggccgttgtactaactctgtcgtgaaatacgagctgatgcggccatccaataaagctcctctgctagtgctatgtgaagatcataggggccgaatggtgaagcaccagtgctgtcccggctgcggatatttctgtacagccgggaattttatggaatgtcagcctgagagctccatctcacacagatttcataaagactgtgcctctagggtaaacaacgccagctactgccctcactgtggcgaagaaagctcaaaagctaaggaggtcaccatcgctaaagccgacacaacttccaccgtgactcctgtcccaggccaggagaagggatccgctctcgaaggccgagctgatacgactactggctcagcagccggacctccactatccgaggacgacaagctgcaaggcgccgcttcccacgttccagaggggttcgaccctacggggcctgcgggactggggcggcctactcccgggctaagtcagggccctggtaaagagaccctagagagcgcgctgatcgcactggattccgagaagcctaagaaactgagattccaccccaagcagctctacttctccgccaggcagggtgaattgcagaaagtgctgctcatgttagtcgacggaatcgaccctaattttaagatggagcaccagaacaaacggtctcccttgcatgcagccgctgaggctggccacgttgatatatgccacatgctcgtccaggcgggtgctaacatcgacacctgtagcgaggaccagagaacccctctgatggaggcagcagagaataatcaccttgaggcggtgaaatatctgatcaaagctggagcgctggttgatcccaaggacgctgagggctcaacgtgtctccatttggcggccaaaaaaggacattatgaagtggtgcagtatcttctttccaacggccaaatggatgttaattgtcaagacgacggcggttggacccccatgatttgggctacagagtacaagcatgtagatctcgtgaagcttttgctctcaaaggggtccgacatcaatattcgtgataatgaagagaatatctgcctgcattgggccgctttttccgggtgtgtcgacattgctgagatattactcgccgccaagtgcgacttgcacgccgtgaacattcatggtgattctcctttgcacatcgccgcacgggaaaaccgctacgattgtgtggtgcttttcctctcccgggacagcgacgtgacgctgaaaaataaggagggtgagacccctcttcagtgtgcctctctgaactctcaggtttggtccgcgctacagatgtccaaggccctccaagattccgctccggatagaccaagcccggttgaacggattgtttcacgggatatcgcacgaggctacgagagaattcccatcccttgcgttaacgccgttgactccgagccgtgcccttccaactacaagtacgtcagccagaattgtgtcacatcccccatgaacattgaccggaacatcacgcatctccagtactgcgtgtgtatagacgactgcagttcaagcaactgtatgtgtgggcagctgtccatgcggtgttggtacgacaaagatggccgactactcccggaattcaatatggccgaaccccccctgatctttgagtgtaaccacgcttgttcatgttggagaaattgtcggaatagagtcgtgcagaatgggttgcgggctcgcctccagctctacaggacaagggatatgggttggggtgtcaggtccctacaggacatcccaccaggaaccttcgtgtgcgagtacgtgggagagttgatcagcgactcagaggccgacgtcagagaggaagacagctacctctttgacctggacaacaaagtgattagcgcatag

SEQ ID NO: 186944 - DNA, 3897 bp, Artificial Sequence
  Description of Artificial Sequence: Synthetic coding sequence
atggccgccgccgacgccgaggccgtgcccgcccggggcgagccccagcaggattgctgcgttaagaccgaactgcttggggaagaaactcctatggccgcagacgaagggtccgctgagaaacaggccggcgaggctcacatggccgcagacggtgagacaaacggatcttgcgagaatagtgacgcctcctctcacgccaatgcagccaagcacacgcaggacagcgctcgggtgaatccacaggatggaacgaatactttgaccagaatcgcagagaacggcgttagtgagagagacagtgaggcagccaaacagaaccatgtaactgcagacgactttgtccagaccagtgtcattggatccaacggctacatcctgaataaaccagctctccaggcccagcccctacggacaacttccaccttggcaagtagtttaccagggcacgccgcgaagactcttcctggtggcgccggtaaagggcggactcccagcgcattccctcagacccccgcagcgcccccggcaacgttaggcgagggttctgctgataccgaagatagaaagttgccggcgcccggcgctgacgtcaaggtgcatcgtgccagaaagactatgcctaaaagcgtggtgggtctgcacgccgcaagcaaggatcctcgagaagttcgggaagcccgggatcacaaagaaccaaaagaagaaattaataagaacatttccgatttcgggcgccagcagttgctgcctcccttcccttcactacaccaatccctaccacagaaccaatgttacatggctaccaccaagagtcagacagcctgcttaccatttgtcctcgctgccgccgtcagccgcaagaaaaagcggcgcatgggcacctactccttagttccaaagaaaaagacaaaggtgttgaagcagcgaaccgtcatcgagatgttcaaaagcatcacacacagtacagttggtagcaagggtgagaaggaccttggggcaagctcactccacgtgaatggagagtcattagagatggattccgacgaggatgatagcgaagaattagaggaggatgatggccacggagccgaacaggctgctgcattcccaacggaagattctcggactagcaaagaaagcatgagcgaggccgaccgtgcccagaagatggatggggagagtgaggaagagcaggagagtgtcgacaccggcgaggaggaagaaggcggtgacgaatcagatctctcaagcgagtcatctatcaagaaaaagtttcttaaacgaaaggggaagaccgactctccatggatcaagccagcaaggaagcgccgtcgcagatcaaggaagaagccatcgggagctctcggatctgaatcttacaaatcctcggctggctctgctgagcagaccgctcctggcgatagcaccggctacatggaggtgtcgcttgattccttggacttgcgagtaaaaggcatcctctcctcgcaagccgagggactcgctaatgggccagacgtactcgaaacagacggccttcaggaagtgcctttgtgttcctgccgaatggaaactcccaaatcaagagagataaccaccctggctaataaccaatgcatggctaccgagtcagttgatcatgagttaggacggtgtacgaattcagttgtgaaatacgaactgatgcggccctcaaacaaagcccccctgctcgtcctgtgtgaggatcaccgcggccgaatggttaagcatcagtgttgccctgggtgtgggtatttttgtactgccggaaacttcatggagtgtcaacctgagagctcgattagccaccgctttcacaaggactgtgcctccagagtgaacaatgcaagctactgtccacattgtggtgaggagagtagtaaagcaaaagaggtgaccatcgctaaggcggacacgacgtcaacggtgactcctgtgcccggccaggaaaaagggagtgcactagagggacgcgcggacaccaccactgggagcgccgcgggccctccattgtctgaggatgacaaattacagggggctgcctcccacgtcccggaaggttttgatcctactggaccggccgggctcgggcgacctaccccagggctgagccagggcccagggaaggaaaccttggagagtgcccttatcgcactggactccgagaaacctaagaagctaagatttcaccctaaacagctgtatttcagcgcacgccaaggagagctgcaaaaggttctcctcatgctcgtagatggcatcgatccaaactttaaaatggaacatcaaaataaaaggtcccccctccacgcggcagctgaagctggtcacgtcgatatttgtcatatgctggtgcaggccggcgcaaacatagatacctgttcagaggaccagcgcacaccattgatggaagctgcagagaacaaccacttggaggccgttaagtatctcatcaaggctggggccctggtggatccaaaagatgctgaggggtccacatgcctgcacttggcagccaaaaaaggacactacgaggtggtgcagtacttgctctctaacggacaaatggatgtcaattgtcaggatgacggcggttggactcctatgatctgggctacagaatacaagcacgtggacttagtgaagctcctcctctcaaaaggaagcgacatcaatatcagagacaatgaagaaaacatatgcctgcactgggccgccttttcaggatgtgtggacattgcagagattcttctcgcagcgaagtgtgacctgcacgctgtcaacattcatggcgacagtcccttgcacatagcagctcgggagaaccggtacgattgcgttgttctcttcctctcaagagatagcgatgtaaccctgaagaataaagaaggcgagacgcccctccaatgcgcttcattgaattcacaggtgtggtccgccctccaaatgtccaaggccttgcaggattcagcaccggaccgcccatcgcccgtcgaaaggatcgtttcccgcgacatcgccagagggtacgaaagaatacccatcccatgtgttaatgctgtggattcagaaccttgcccttcgaactataagtatgtgagccagaattgcgtcacctcccccatgaacattgataggaacattacacatctccagtattgtgtatgtatcgacgattgttcatcatctaattgcatgtgtggccagctcagtatgaggtgttggtacgataaggatgggaggttgctgcccgagtttaatatggccgagccacccttgatcttcgagtgcaaccacgcttgtagctgctggaggaactgccgcaaccgcgtcgttcagaacggcttaagagcccggctgcagttatataggacccgcgatatgggctggggcgtgaggtcactgcaagacattcctccggggactttcgtgtgcgagtacgtgggcgagctgatttccgattccgaagcagacgtgcgtgaggaagatagctacctttttgacctagacaacaaggacggagaggtatattgtatcgatgccaggttttatggcaatgtaagcaggtttatcaatcaccactgcgagccgaatcttgtgcctgtcagagtcttcatggcacaccaggatctgcgattccccaggatcgccttcttctccacacgtctcatcgaagccggggagcagcttggttttgattacggcgaacggttctgggacatcaaaggaaaactgtttagctgccgatgcggttctccaaaatgtaggcactcctcagccgcattggcccagcgccaggcctcggctgcacaggaggcccaggaagacggtctgccagatacttcctcagccgccgccgcggaccctctgtag

SEQ ID NO: 186945 - DNA, 2427 bp, Artificial Sequence
  Description of Artificial Sequence: Synthetic coding sequence
atggccgccgccgacgccgaggccgtgcccgcccggggcgagccccaacaggattgctgcgtcaagactgaacttctgggtgaagagactcccatggctgctgatgaagggtccgccgaaaagcaggcaggcgaggctcatatggccgcagatggcgagaccaatggttcctgtgaaaactctgacgccagctctcacgccaatgctgccaaacatactcaggacagtgctagggtgaaccctcaggatggcactaacaccctaacacgtatcgctgaaaatggcgtgtccgagagggactcagaagcagcgaagcagaaccacgttacagcagatgactttgtgcagacttccgtaattggtagcaatgggtacatcctgaacaagcccgcactgcaggcgcagccactgcgcaccaccagtacactcgctagttctctgcctggtcacgcagcaaaaactctgccagggggtgctgggaagggtcgcaccccttcagcgttcccccagacccctgctgcaccaccagccacactgggcgaaggaagcgccgatacggaggatcgcaaactcccggcaccaggggccgatgtaaaggtgcatcgggccaggaagaccatgcctaaaagcgtggtgggcctccacgccgccagcaaagacccacgtgaagtccgggaagcacgggatcacaaagaaccaaaggaggaaatcaacaaaaatatctccgatttcggtcgccagcagcttctgcccccattcccctcactccaccagagtttaccacagaaccaatgctatatggcgacgacaaagtcgcaaactgcctgccttcctttcgtgctggcagcggccgtgtcgcgcaagaaaaagcgccggatggggacatattctttggtacccaaaaagaagacgaaggtgctaaagcagaggactgtaattgagatgttcaaatccataacccactctactgtgggctctaagggtgagaaagacttaggggcttcttccctgcatgtgaacggcgagtcactggagatggatagcgacgaagacgactccgaggaactcgaagaggacgatgggcacggagctgagcaggccgctgcctttcccacggaggacagcaggacgagtaaagaatcaatgtcggaagccgatcgtgctcaaaaaatggatggcgagagcgaggaggagcaggaatcagtcgatactggcgaggaggaagaaggtggagacgaatccgatctgtccagcgagagctccattaaaaagaagttccttaaacgaaaaggcaagactgatagcccttggataaagccagctcgaaagcgcaggaggcgaagccggaagaaaccttctggcgcactgggcagtgagtcctacaagagcagcgcgggcagcgcagaacagaccgcaccgggggatagcaccggctacatggaggtgagccttgatagtctggacctccgagttaagggtatcctaagttcacaagccgagggtctggccaacggaccagatgtactggaaactgatgggttacaggaggtcccgttatgtagttgtagaatggaaactccaaagagtcgggaaattactaccttggctaataatcaatgtatggcaaccgaaagcgtggaccacgaactaggccgatgtaccaactctgtagtcaaatacgaactgatgagaccctctaataaggcccctctccttgttctctgcgaggatcatcgcggcaggatggtgaagcatcagtgctgtcccggctgcgggtacttctgcactgctggaaattttatggaatgccagccagagtcctctatttctcaccgcttccataaggattgcgccagtagagttaataacgcctcttactgcccgcactgtggggaggagagttcgaaagctaaagaggtcactatcgccaaagctgacacgacttcaacggtgacgccagtgcctggtcaagaaaagggttcggcccttgagggtcgcgcagataccaccacggggagcgccgcgggaccccctctcagtgaggatgataaattacaaggagcagcttcgcatgttcctgaagggtttgaccctactggcccggccggactgggaaggcccacccctggattgagccagggcccaggcaaagaaactctggagtctgccctgatcgcactcgatagcgaaaaaccaaagaagctgagattccatccaaagcagctgtacttcagcgctcgacaaggcgaactgcagaaagttctgcttatgcttgtagatggtatcgatccaaatttcaagatggagcatcagaataagaggagcccactgcacgccgccgccgaagctgggcacgtggacatctgccatatgctcgtgcagttctgccgactggggagtccgcgttctcgtggatgcttatggtag

SEQ ID NO: 186946 - DNA, 3702 bp, Artificial Sequence
  Description of Artificial Sequence: Synthetic coding sequence
atgcggggcctgccccggggccggggcctgatgcgggcccggggccggggaagggccgccccaccagggagtcgaggacggggaagggggggcccacaccggggtcgcggtcggccaagatctctgctttccttgcccagggctcaagcatcatggacgccgcagctatccaccggccttactagtccccctgtaccttgcttgccctcccagggcgaagccccggcggagatgggggccctactgttggaaaaggagactcgtggggccaccgaacgggtccatggatcattaggcgacactccccgatcagaggagacgctccccaaggcaacccctgacagcctggaacctgcaggtcccagtagccccgcctcagtgacggtgacagtgggagatgaaggcgccgacaccccagtgggcgccactccattaatcggcgacgagtcagaaaacttggaaggagacggggatttaagaggggggcggatcctgctcggacacgccacgaagtcctttcccagctccccctctaagggcggcagttgtccaagcagagccaaaatgtccatgactggcgcaggcaaatcaccaccctctgtgcagagccttgctatgaggttattaagcatgcctggtgcacagggtgcggctgccgcggggtctgagcctcctccagccacaaccagccccgaaggccagccaaaagtgcatagagcacggaaaacaatgtctaagccagggaatgggcagccacccgtgcctgagaagagaccccccgagatacagcatttcaggatgtccgatgatgtgcattccttgggaaaagtaactagtgacctggctaaaaggcgcaaactgaacagcggaggcgggctgtcagaagaacttggctccgctagacggtctggagaggtcacactcacaaagggggatcccggttcactcgaggagtgggaaacggtggtcggcgacgatttctctctgtactacgacagctactcagtcgacgagcgggtggacagcgattctaaatctgaggtagaagcactgaccgaacagctcagcgaggaagaggaggaggaagaagaagaagaggaagaagaggaggaggaggaagaggaggaagaggaagaagaagacgaagaaagcggtaatcagtcggataggtccggatccagtgggcgacgtaaagctaaaaaaaagtggcggaaagactctccctgggtgaagccctcacggaaaagacggaagagagagcccccacgagcaaaagagccgaggggggtatctaatgatacttcatcactggagacagaaagaggcttcgaggaattaccactgtgttcttgtcgaatggaagcacccaaaatcgacaggatctcggaacgggccgggcataagtgtatggccactgaaagcgtagacggcgagctcagtggctgtaatgccgccatcctgaagcgcgagacaatgagaccaagctcccgagttgcgctgatggtcttgtgcgagacccaccgggcaagaatggtgaagcaccactgctgtccggggtgtgggtacttctgcaccgccgggaccttcctcgagtgccacccagacttccgcgttgcacatcggttccataaggcgtgtgtttcacaattaaatggcatggtgttctgccctcattgcggagaggatgcttcagaggctcaggaggttaccatccccagaggcgatggggtcacaccaccggccgggacagccgcccctgccccccctcccttgagtcaggatgtgcctggaagagctgatactagccagccatccgccagaatgcggggccacggcgagcccagaaggccaccttgcgaccccttagccgacaccattgactccagcgggccttctttgaccctgccaaacggcgggtgtctgagtgcagtgggcttgccgctcgggcctggtagagaggcccttgagaaagcgctagtgattcaagagtctgaacggcggaagaagctgcggtttcaccctaggcagctgtacctatccgtcaaacagggcgagctgcagaaggtgatcctgatgctcctggacaacttagaccccaatttccaatctgatcagcaaagtaagcgaacccctctccatgcagctgcacagaagggcagcgtcgaaatatgccatgtgctactgcaagctggcgctaatatcaatgctgtcgacaaacagcagcgcactccattaatggaagcggttgtgaacaatcatcttgaggtggctcggtacatggtccagagaggcggttgcgtgtatagcaaggaggaagacggcagcacatgcctgcaccacgcggccaaaatcggcaatttggaaatggttagcctgctgctgtccaccgggcaggtcgatgttaatgcccaagattctggggggtggaccccaatcatatgggccgctgaacataagcacatcgaggtaatccgtatgctcctaacacgcggagccgatgttacactgacagacaacgaggaaaatatatgcctgcactgggcctcctttacaggatctgccgccattgccgaagtactccttaacgcgcgctgcgacttgcacgccgtgaactaccatggcgacactccactgcatattgccgcccgcgagtcgtatcacgattgcgtcctactgttcctgtcacgaggtgccaatcctgagttgagaaacaaggagggggacaccgcctgggacctgaccccagaacgttccgacgtgtggtttgcacttcagcttaatagaaagctgcggctcggggtaggaaaccgggccatcagaactgaaaagattatttgtcgggatgtagcgcgtgggtacgaaaatgttccgattccttgtgtcaacggggtggacggggaaccgtgtcccgaagactataaatatatttccgagaactgtgaaacatctaccatgaatattgacaggaatatcacacacctccagcactgcacgtgcgttgatgactgcagtagctcaaattgcctctgcggacagctatcgatccgatgttggtatgataaggatggccggctgctccaggagtttaacaaaattgagccccctctgatattcgagtgtaaccaggcatgctcctgctggcggaactgcaagaaccgggtggtacagtccggaattaaggtgaggttgcagctgtatcggacggcaaaaatgggttggggtgtccgtgctctgcagactatccctcagggcacttttatttgcgagtacgtaggggaactaatctctgacgccgaagcagacgtgcgcgaggacgactcttatctgtttgacctggataataaggacggcgaggtgtattgcatcgacgcacgttattacgggaatattagccggtttatcaaccatctgtgcgatcccaacatcatccccgtgcgggtgttcatgctgcatcaggacctgcggtttccacgaattgccttctttagctcaagggatattaggacaggcgaagagctgggctttgattatggtgatagattctgggatattaaatcgaagtattttacttgccagtgcggcagcgaaaagtgcaagcactctgctgaggccatcgcgctggagcagagtcgtcttgcccgactcgaccctcatccggagctcctgccggaactcggatcattgcctcccgtcaatacatag

SEQ ID NO: 186947 - DNA, 3531 bp, Artificial Sequence
  Description of Artificial Sequence: Synthetic coding sequence
atggccgccgccgccggcgccgccgccgccgccgccgccgagggcgaggcacctgctgagatgggcgctctacttttagagaaagaaaccaggggagcgacggagcgagtgcacggctcactgggagacaccccgcggtcagaggaaacactcccgaaggcaacccccgacagcctggaaccggcaggcccatcttctccagcatctgtcaccgttaccgtgggtgatgaaggagctgacacccctgtaggtgctactcccctgatcggagatgagagtgagaatctagagggagatggggacctcagaggtggccgcatcctcttggggcacgcgacaaagtccttcccatcctcccccagtaaaggggggtcgtgtccttcgagagcaaaaatgagcatgacaggcgcaggtaagagcccaccaagtgttcagagcttagccatgcggctactgtctatgcccggggcacagggcgcggccgccgccggaagtgaaccacctccagctactacatcgcccgaggggcagccaaaagtccatagagccagaaagacaatgagcaagccaggtaacggtcaacctcccgtgcccgaaaagaggcctcctgagattcaacatttcaggatgtcagatgatgtgcacagcttgggcaaagtgacaagcgatctagctaaacggagaaaacttaattccggcggaggactgtccgaggaattgggctccgcacgcaggtccggcgaagtgacgctgactaagggtgatccaggaagtttagaggagtgggaaactgtggtgggtgacgatttcagcctgtattatgactcttatagcgtggatgagagggtggactcggattctaaaagtgaagtggaagctttgaccgagcagctctctgaagaagaggaagaggaggaggaggaagaggaagaggaggaggaggaggaggaggaagaggaagaggaggaggacgaagagtctggaaaccagtctgatcggtctggctcaagcggaagacggaaggccaagaaaaagtggcgtaaagatagcccctgggttaaaccaagccgcaagagaagaaaaagagagccacctcgagcaaaagagccccggggggtgagtaatgatacttcctcccttgagactgagcggggcttcgaggagctcccattatgtagttgcagaatggaggcccctaagattgaccgcataagcgaacgcgccggtcataaatgtatggctactgaaagtgttgacggggagctctctggttgcaacgcggcaatcctaaaaagggagacaatgaggccatctagtcgggtagctctgatggtgttgtgcgaaacacacagagctagaatggttaagcatcactgttgccctggatgtggctacttctgcactgctggcacattcctggaatgtcacccggactttagggttgctcatcgatttcacaaggcctgtgtttctcagttgaatgggatggtgttctgccctcactgcggcgaggacgctagcgaagcacaagaggttactatcccccggggtgatggggtgacccctccagctgggacagcggcgcctgcaccccctccactgtcgcaggatgtgcccggccgggccgacacatcacaacccagtgcgcgtatgcgcggccacggagagccaaggaggccaccctgcgatcccctcgctgatacaattgatagtagcgggccatctcttaccctccctaacggcggttgtctgtctgccgtgggtctcccactgggtcccggaagagaagctctggaaaaagcccttgtgattcaggagtccgagcgcaggaagaagctccgcttccatcctcggcaactgtacctgagcgtgaaacaaggggagctccagaaagttattttgatgctgctagataacctcgaccccaactttcaatcagatcagcagtccaaacgcacaccgctgcacgctgccgcacaaaagggatctgtggaaatttgtcatgtgttactgcaggcgggggcaaacatcaatgccgtcgataagcagcagaggacacccctcatggaagctgtggtgaataatcatctggaagttgctcgctacatggtgcaacgcggaggatgcgtgtatagcaaggaagaggatgggtctacatgtctacatcacgctgcaaagatcggcaacctggaaatggtaagccttctgctatcgaccggccaggttgacgtgaacgcccaggatagcggggggtggactccaattatctgggcggcggaacacaaacacatcgaggtcatcagaatgttattgaccagaggggccgacgtaaccctgactgacaacgaagaaaatatctgtctgcattgggcctctttcactggatctgctgcaatcgcggaagtcctgttgaatgctcgctgcgatctccacgctgtgaactatcatggagatactccgctacacattgctgcccgggagtcataccacgattgtgtgctgctctttctcagtagaggtgccaaccctgagctgaggaacaaggagggcgataccgcctgggacctcacaccggagagatccgacgtctggttcgccttgcaactgaatcgcaaattgcgccttggagttggcaacagagcaatccggactgaaaaaatcatctgcagagatgtggctagggggtatgagaacgttccaattccatgtgtgaacggggtggatggggagccatgcccagaagactacaagtacatctctgaaaactgtgagacgagcaccatgaacatcgaccggaacataactcacttgcaacattgcacatgcgtagacgattgttcctcatccaactgcctgtgcggccaactgagcatcaggtgctggtacgacaaagatggccgactgctgcaggagttcaacaagatagaacccccactgatctttgaatgcaaccaggcatgctcttgttggcgcaattgtaagaaccgggtcgtccagtcgggcatcaaggtgcggctgcagctgtaccggacagccaagatgggatggggagtcagggccctgcaaacaattcctcaaggaaccttcatctgcgaatacgtgggggaacttatcagtgacgcggaggctgatgttcgcgaggacgactcttacctttttgaccttgataacaaggacggtgaagtttactgcatcgatgctagatactacggcaacatctcaaggttcatcaaccacctgtgcgatcctaacataatccccgtgagggtgtttatgctccatcaagacctgaggtttccgcgtatcgcctttttcagctcacgagatatacggactggcgaggagctcggcttcgattatggggatcggttttgggacattaagtcgaaatacttcacatgccaatgcggctccgagaagtgtaagcatagcgcagaggctattgcactggaacagagtcggctagcacggctggacccacaccctgagctgctgcctgagctggggtccttgcctcctgttaatacttag

SEQ ID NO: 186948 - DNA, 3633 bp, Artificial Sequence
  Description of Artificial Sequence: Synthetic coding sequence
atggccgccgccgccggcgccgccgccgccgccgccgccgagggcgaagcaccagccgaaatgggcgcactgctcttggagaaagagactaggggcgcgactgagagagtgcacgggtcactgggtgacactccacggagcgaggaaacgctgcctaaggccacccctgattcactggagcctgccggaccctcgagtccagcctccgtgacagtgacagtaggggacgaaggagcagacactcctgtcggcgcaacgcccctgattggcgatgaatcagagaatctggaaggggacggcgatctacggggagggagaattctgctagggcatgcgacgaagtcttttccgagctcacccagcaaaggcgggtcatgcccctctagggcaaagatgtcgatgacaggggcaggaaaatcccccccgtctgttcaatcgctcgctatgcgtctgctgtccatgcccggcgctcaaggagcagcagccgccggcagcgaacctcctcctgctaccacatcccctgaaggtcagcccaaagtgcaccgggcaaggaagaccatgtccaaacccggcaatggccaaccccctgtgcctgagaaaaggcctccagaaatccagcatttccggatgagtgatgatgtccactcgttaggcaaggtgactagtgacctggccaagcggaggaaactgaactcaggcggtggcctgtcagaggagctcggcagcgcccgccggtccggtgaggttaccttgactaagggcgatccaggatccctggaggaatgggaaactgttgtgggggacgacttttctttgtattacgatagttactctgtggatgagcgcgtcgattccgattctaaaagcgaagttgaagcattgacagaacaactctcagaggaagaggaagaagaggaggaggaagaggaagaagaggaggaggaggaggaggaagaggaggaagaagaggacgaagagtccgggaatcaatctgacagaagcggatcaagcggcagacggaaggccaagaagaagtggaggaaggatagcccatgggtaaaacctagccggaaacggcgtaagcgagagccccctagagctaaggaaccacgcggagtgaatggcgtcggctcctccggtccttctgagtacatggaagtgcccctcggatccctggagcttcctagcgaaggcaccctgtcgccaaatcacgccggtgtttcgaatgatacatcttcccttgagacagaacgggggtttgaggaactccctctgtgctcctgccggatggaagctccaaaaattgacaggatctctgagagggctggacacaaatgtatggcaaccgaatctgtggacggcgagttgagcggttgtaatgccgccatacttaaaagggaaaccatgagaccctcttccagggtggcacttatggtgctgtgtgagacacaccgggctaggatggtcaaacaccactgctgcccaggctgtggatacttctgtactgccggcacattcttggaatgccatcccgatttccgcgtcgcccacagattccataaggcgtgtgtgtcccagctgaatggcatggtgttctgcccccattgtggggaggatgcttcagaggcacaggaggtgacaatcccaagaggggacggagtgacccccccagcaggaactgctgcccctgctcccccccctctatcccaggacgtcccaggaagggcagacacatcgcagcctagtgcacggatgagggggcacggggaaccacggcggccaccatgcgatccattggctgatactattgatagctccggccccagcttaactctgcctaacgggggctgcttgtctgcagtaggactgcccctgggacctgggcgggaggccctggaaaaggccttggtcattcaggaaagtgaaaggcggaagaaactgaggttccacccaagacagctctacctgtctgtaaaacagggggaattgcaaaaggtgatccttatgcttctggataatctagatccaaactttcaatccgaccagcagtccaagaggacaccactgcacgccgccgcacaaaaaggttcggttgagatttgtcacgtgttgctgcaggccggggcaaatatcaatgccgtagataaacaacagaggacccccctgatggaggcagtagttaataatcatctcgaggttgcaaggtatatggtccagcgcggtggctgtgtgtattctaaggaggaagatggctccacctgtctgcaccatgcagccaagattggtaacctcgaaatggtcagtctcctgttatccaccggacaagttgatgtgaacgctcaggattcgggcggttggacacccatcatttgggcagccgaacacaagcatatcgaagtgattagaatgctgctgacgcgaggtgctgacgtgactctcactgacaacgaggaaaacatatgtcttcactgggcttcttttaccggatcggctgcaatagccgaggttctgctgaacgcccgctgtgacctgcacgctgttaattaccatggcgacacccctctgcatattgccgctagagaaagctaccatgattgcgtgctgctgtttctgtcccgcggggcaaatcctgaactgcgcaataaagagggcgatactgcttgggacctcacaccagagcggtccgatgtctggttcgcactgcagctcaatcggaagcttcggcttggcgtcggcaatcgcgctatccgcaccgaaaaaataatttgccgagatgtggcccgcggctacgaaaacgtgccaatcccatgtgtgaatggagtggacggagagccatgccctgaggattataagtacatttctgaaaattgcgagacatccaccatgaacatcgaccgcaacattacccacctccagcactgtacttgtgtggatgactgtagcagtagcaactgcctctgtggccaactttccatccgatgctggtatgacaaagacggccggcttttgcaggaattcaataaaattgagccgcctctgatctttgagtgcaaccaggcttgtagttgctggcgtaattgtaaaaacagggtagttcagtccggaatcaaagtccggctgcaactctaccgaacagccaagatgggctggggggtgcgggcattacagaccatccctcagggcacatttatctgcgagtacgtgggggagcttatctcagatgccgaggccgacgtccgggaagacgacagctatctgttcgatttggataacaaggacggcgaggtatactgtattgacgctcggtactatggaaacatcagcagattcatcaaccacctctgcgatcctaatatcattcccgtaagggtatttatgctccatcaggatctaaggtttccacgaatagccttctttagctcgcgggacatccggactggcgaggaactgggattcgattacggcgatcgcttctgggacattaaaagtaaatacttcacttgccaatgtggcagtgaaaaatgcaagcactctgccgaagctatagctcttgaacagagtcggcttgctaggcttgatccccatccagagctattgcccgagctcggctcgctaccccctgtgaatacctag

SEQ ID NO: 186949 - DNA, 3531 bp, Artificial Sequence
  Description of Artificial Sequence: Synthetic coding sequence
atggccgccgccgccggcgccgccgccgccgccgccgccgagggcgaggccccagcggaaatgggcgccttactgctcgaaaaggagacgcggggtgccaccgagagggtgcatggaagccttggcgacactcctcgttcagaagaaaccctgcctaaagctacgcccgactcgctggaacctgcagggccaagcagtcccgcatcagtgaccgttactgtaggtgatgagggggcggacacaccagttggcgccactcccctcatcggcgatgagtccgaaaacctagaaggggacggcgatcttcgcggtgggagaatattgttaggacacgctacgaagagtttcccaagcagcccgtctaaaggtggctcctgcccaagccgggccaaaatgagtatgaccggagccggcaagagccccccgtcggttcagtcgttggcgatgcggttactctcaatgcctggggctcagggtgcagcggccgccggaagcgagccaccacccgccacaacatctcctgagggccagcccaaagtacaccgtgctcgaaagaccatgagcaagcctggcaatggacagccccccgtgcctgagaaaagaccaccggaaatccagcacttccgcatgagtgacgatgtgcatagcttgggaaaagtgacaagcgatctggccaaaaggcgaaaactgaattccgggggcggtttgagcgaagagctgggttcggcacggcgcagtggtgaggtgacactcaccaaaggggacccaggctctctggaggaatgggagacggtcgtgggagatgatttctctctctactatgattcatactctgtggatgagagggttgattctgacagcaagagcgaggttgaggccctaaccgagcaactctcagaagaagaagaagaagaagaggaggaggaagaagaagaagaagaagaggaggaagaagaggaggaggaggaggatgaagagtcaggtaaccaatccgatcggtcaggctccagcggccgcaggaaagcaaagaaaaaatggcgcaaagattcaccatgggttaagccttccaggaaacggcgcaagagggagcccccccgggccaaagagcccaggggtgtctctaatgacacttcttctctggagactgagaggggatttgaggagctccccctctgctcctgtcgcatggaggccccgaaaatcgatcgaatctcagagagagctgggcataagtgcatggcaaccgagagcgtggacggtgagctctccgggtgtaatgcagcaattttaaagagggaaactatgagacctagttctcgcgtggccctgatggtgctctgtgagactcacagagctcgtatggtgaagcaccattgctgcccaggctgcggttatttttgtactgctggcacatttcttgagtgccaccccgacttccgggtagcgcatagattccacaaggcctgcgtttctcaactcaatggcatggtgttttgtccccactgcggagaggacgcctccgaggcccaggaagtcaccatccccaggggggacggagttactccccccgcaggaacggcagcacccgcaccaccccccctctcacaagacgtccctggacgggccgatacatcccagccttccgcgaggatgcgcggccacggcgaacctcggaggcccccgtgtgatcccctcgccgacacgatagattccagcggccccagtctcacgctccccaatgggggttgtctctccgcagtaggtctccctcttggccccggaagagaagcactggaaaaggccctggtcattcaggaatctgagcgtcggaagaagttgcgttttcaccccaggcagctgtacctgtcagtcaaacaaggcgagctgcagaaggtcattctgatgctcctggacaatctggaccccaattttcagagcgatcagcagtcgaagagaactcccctgcatgcggcagcgcagaaaggcagtgtggaaatttgccatgtgctcctacaggcaggcgctaacatcaacgctgtggacaagcaacagagaactccacttatggaagctgtggtaaataatcacctagaggtggccagatatatggtgcagaggggaggctgcgtctatagcaaggaagaagacggcagcacatgcctccatcacgccgctaagataggcaacctcgagatggtgagtttactattgtccaccggccaggtggacgttaacgcccaggattctggcggatggactcccattatttgggctgccgaacacaaacatatcgaagtgatccgaatgctgctcacgagaggggccgacgtcaccttgaccgacaatgaggagaatatatgccttcactgggcctctttcaccgggagcgcagctatagcagaagtgctcctgaacgcacgatgcgacttgcatgctgttaattatcacggcgacacccccctgcatatagcagctagggaatcttaccatgattgcgtcttactgtttctgagtaggggcgctaatccagaactgaggaacaaggagggtgacactgcatgggacctaacccctgagagaagcgatgtgtggtttgcgcttcaactcaatcggaagttacgactaggggtcggcaatcgagccattcgcacagagaagatcatctgcagggatgtcgctcgaggatatgagaacgtcccgattccttgcgttaacggcgtagacggagaaccatgtcccgaagattataaatatatctccgaaaattgtgaaacttccaccatgaacatcgaccgcaatattacacacctccagcactgcacctgtgtcgatgactgttcatcctccaactgtctgtgcggtcaactctctatccggtgctggtatgataaagatggccggctgctccaggaatttaataagattgagcctcccctaatttttgaatgcaaccaggcttgctcctgctggcgcaattgcaaaaatcgcgtggtgcagagcggcatcaaggtcagacttcaactctatcgaactgccaaaatgggctggggagtccgagccctgcagacgatcccacagggaacatttatctgcgagtacgtcggtgaactaatcagcgacgctgaggcggacgtgagagaggatgacagctatctgtttgaccttgataacaaagatggggaggtttattgtatcgatgctcgttattacgggaacattagccgtttcattaaccatctctgcgatcctaatataattcccgtgcgcgtgttcatgctgcatcaggatctacggtttcctcggattgcattctttagcagccgtgacattcggaccggcgaggagctggggttcgactatggagatcgtttctgggatattaaaagcaagtatttcacatgccagtgtggcagcgagaagtgtaaacatagcgccgaagctattgccctggagcaaagtcgcctggcccggctcgatccgcaccctgagcttcttcccgaacttggcagcctcccccctgtgaacacatag

SEQ ID NO: 186950 - DNA, 3633 bp, Artificial Sequence
  Description of Artificial Sequence: Synthetic coding sequence
atggccgccgccgccggcgccgccgccgccgccgccgccgagggcgaggcccccgccgaaatgggagccttgctgctggagaaggagacccgtggtgctaccgagcgggtgcatggttcattaggtgataccccccgttcagaagagactctgcccaaggcgactccagactcactggaacccgcaggcccatcttcaccggcatccgtgactgtgactgtcggcgacgagggcgctgatacccccgtgggggctactcccttgatcggcgatgaatctgagaaccttgaaggagacggagacttgcgcggtggccggatccttcttggtcatgctacgaaaagttttccttcatccccaagcaaaggaggctcttgccctagccgcgcaaagatgtccatgacaggcgccgggaagtctcctccttctgtccaaagcctggctatgcgtctgctgagcatgcctggcgcccagggtgcagccgccgccgggagtgagcctccccctgcaacgacttccccagaaggccagccaaaggttcatagagcgcgcaagacgatgtccaagcccgggaacggccagccaccggtcccagaaaagcgccctccagagattcagcacttccgtatgagcgatgacgtccacagccttgggaaggtgaccagcgatctggccaagcgaaggaaactaaactctggggggggactctccgaggaactaggaagcgcaaggcggagcggcgaagtgactctgacaaagggtgatccagggtccctcgaggaatgggagactgtggtgggcgatgatttcagcttatattacgactcatacagtgttgacgagcgggtagattctgactccaaaagcgaagtggaggcccttactgagcagctgagcgaagaggaagaggaagaagaagaggaggaagaggaggaggaggaggaggaggaggaagaggaagaggaggaagacgaggagtcaggcaaccagtctgaccggtccgggtcatccggcaggcgaaaggccaagaagaagtggagaaaggactctccttgggttaagccgagcagaaaacgcaggaagcgcgaacccccaagggctaaagagccaaggggcgttaacggagtgggctcatccgggcccagcgaatacatggaggtgccgctcggatctctggagctcccctcagagggcactctaagtcctaaccatgccggcgtgtcaaatgacacaagctcattggaaaccgagcggggtttcgaagaactaccactttgcagctgcagaatggaagcccctaagatcgacaggatatctgagcgcgcagggcacaagtgcatggctacggagtcagttgacggggaattaagcggctgcaacgccgctattttaaaaagggagactatgaggccttcttcccgtgtggccctgatggttctgtgtgagactcatagagctcgaatggtaaagcatcactgctgtcccggatgtggctatttctgtacagcgggcacctttctggaatgtcacccggatttccgggtggcgcataggttccataaggcctgcgtgtctcaattgaatgggatggtgttctgcccacactgtggcgaagatgcatctgaggcacaggaggtgaccatccccagaggagatggggtgacgccacccgcgggaaccgccgcccccgccccgccacccctcagtcaggatgtcccaggaagagccgatacttcccaaccttcggccagaatgcgcggccatggtgaaccacggcggcctccatgtgatcccctcgctgatacaatcgatagctcagggccatctcttacgctgcccaacggaggctgtctatctgccgtgggactgcctttgggccctggcagagaagccttggagaaagcgcttgtgatccaggaatctgagcgacggaaaaagctgcgcttccatccaaggcagctttacctctccgtaaagcagggagaattacagaaagtgatactgatgttgcttgacaatctggaccccaatttccagagcgaccaacagtctaagcgcacgccactgcatgctgcagcccagaaggggtccgtggagatttgccatgttctgctgcaggccggagccaacatcaatgctgttgacaaacaacagagaacccctctcatggaggccgtcgtgaataaccatctggaggttgcccgctacatggtccagagagggggctgcgtgtattccaaagaggaagatggatccacctgcctgcatcacgccgcaaaaattggaaacctcgaaatggtgtccctcttgctgagtactgggcaggtcgatgtaaacgcccaggatagcggaggttggactcctattatctgggccgcggagcataagcatatcgaggtgatcagaatgctgctgactcgcggcgctgacgtcacactgacagacaacgaggagaatatctgtctgcactgggcctcttttacagggagtgcagccatcgcggaagtcctgctaaacgccaggtgtgacctccatgccgtgaattaccatggagacacacccctgcatattgccgcccgcgaaagctatcacgactgtgtgttgttgtttctttctagaggggcaaacccagaactcagaaacaaggaaggtgacactgcctgggatctgacccctgaacgctccgatgtatggtttgccctccagctcaaccgcaagctaagattgggggtgggcaatcgagcaattcgcacagagaagatcatctgcagagatgttgccagagggtatgagaatgtgccaatcccctgtgtgaatggggtagatggggagccttgtcctgaggattataaatacatatccgaaaactgtgagacaagcacaatgaatattgatagaaatataacacacctgcagcattgtacatgtgtggacgattgctccagcagcaactgcttgtgtggccaactgtccattcggtgctggtacgacaaggacggaaggctgttacaggagttcaacaagattgagccccccctgatatttgagtgtaaccaagcctgctcatgttggagaaactgtaaaaatagggtcgtccaatcaggtattaaggtcaggctccagctgtatcggactgctaaaatgggctggggagtgcgagcactccaaactatcccccagggcactttcatctgcgagtatgtgggggagctgatctcggacgcagaagccgatgtccgggaggacgactcctatctgtttgacctggacaacaaggacggcgaagtgtactgtattgatgctagatactatgggaacatctccaggtttattaatcacctctgcgaccctaacatcataccagtgcgcgtgtttatgttgcaccaggaccttaggtttccacgcatcgcgtttttctcctccagagacattagaacaggggaggaactgggttttgactacggggaccggttttgggatattaagtcaaagtattttacttgtcagtgtggttccgagaagtgtaagcatagcgctgaagcgatcgcattagaacagtcgcgactagctcggttggacccccatcccgagcttttgccagaactggggtcactgccaccggttaatacctag

SEQ ID NO: 186951 - DNA, 3804 bp, Artificial Sequence
  Description of Artificial Sequence: Synthetic coding sequence
atgcggggcctgccccggggccggggcctgatgcgggcccggggcagaggcagggctgctccccccggctcacgcgggagaggacgcggggggccgcatagggggagagggaggcccagaagccttctttccctgcctcgagcccaagcctcctggactccccagctgagtaccggccttacgtcaccacccgtcccctgtttaccctcccaaggtgaggcccctgccgaaatgggagctttactgcttgagaaagagaccaggggggccacagagagagtacatggctcattgggagataccccacgcagtgaagagactttgcccaaggccaccccggacagtctcgagccagccggtccaagctcgcccgctagcgtgaccgtcacggtaggagacgagggtgctgatactcctgtcggcgccacaccattaattggggacgagtcagaaaacttggaaggcgatggggatttacggggcgggcgcatcctcctggggcatgcaactaagagttttccgagtagcccgagcaaaggcggatcttgtccaagtcgagctaagatgtctatgactggtgcaggaaaatcaccaccttctgtgcagtccctggctatgcgcctcttgtcaatgcccggagcgcagggagcagcggcagccgggtctgagcccccaccagcaacgacgtcaccggagggccagcccaaagtgcacagggccaggaagactatgagtaagccaggcaatggccaaccccccgtcccggaaaaacgcccacctgaaatccagcacttccggatgtctgacgatgtccattctcttggcaaagtgacaagtgatttggccaaacgcaggaagcttaattctggcggaggactcagcgaagagctagggtctgcccgccgctcaggagaagtcacacttaccaagggagatcccggctccctggaagagtgggagaccgtggtcggcgatgacttttcactgtactacgattcatatagcgtcgatgaaagggtggactccgatagcaaatctgaggtagaggcccttacagagcagctctccgaggaagaagaggaggaagaagaagaagaagaagaagaagaggaagaggaggaggaggaggaggaagaggaagatgaagaaagcggaaaccagtcagaccggtccggctcctcggggcggcgcaaggctaaaaaaaagtggcggaaggatagcccctgggtaaaaccaagcagaaagaggaggaaaagagagcccccacgcgccaaggagccacgtggggtgaacggcgtagggtcttccgggccttccgagtacatggaggtgcccttgggaagtctagagctccccagcgagggcaccttgagcccaaaccacgctggtgttagtaacgatacttcaagccttgagacggaacgagggttcgaagaactacctttatgtagctgccgtatggaggcaccgaaaatcgaccgcataagcgagcgcgcagggcacaaatgcatggccacggaatccgtggacggtgaacttagcggatgcaacgcagcgatactcaagagagaaacaatgaggcctagcagcagggtcgctctcatggtgctctgcgagacccatcgtgcacgcatggtgaagcatcactgctgtcctggatgcgggtacttttgtacggctggtacttttctcgagtgtcacccagattttcgcgtggctcacaggttccacaaggcttgcgtctcccagttgaatggaatggtgttttgcccccactgtggcgaggatgcttcggaggcccaggaggtgacaatcccccgaggtgacggtgtaacccccccggctggcaccgccgcccctgccccacccccactgtctcaggatgtgcctggcagagcagataccagtcagccttctgcccgaatgcgaggacacggggagcctcgccgcccaccttgcgatccgttagccgacacgatcgactctagcggaccttcgctgacactcccaaacgggggttgtttgtccgcggttggattgcccctgggccctggtcgggaagcacttgagaaagcccttgttattcaggaaagcgaacggcgcaaaaagctccgctttcatccccgccagctgtacttatcagttaaacagggcgagctacagaaggttatcctgatgctgttagataatctcgatccaaactttcaatccgaccagcagtctaagaggacacctctgcatgcagccgcacaaaagggctcggtggaaatttgtcacgtgctcctacaggccggagcaaacatcaatgccgtggacaaacagcagcggaccccactgatggaagccgtggtaaataatcatctggaagtagcgagatacatggtgcagagaggcggatgtgtgtactccaaagaggaggatggcagcacctgcttacaccacgccgccaagatcggaaatctggagatggtgagcctcctcctctccaccgggcaggtcgatgtgaacgctcaggactctggcggatggactcccattatctgggcagcggaacacaaacatatcgaggtgatccggatgctcctcactaggggcgccgacgtgaccctgactgacaatgaagagaacatctgcctgcactgggcttcttttacggggagtgccgcgatcgcagaagtactccttaatgcgcggtgcgacctgcatgccgtaaactaccacggcgacacacctttacatatcgctgcccgagagtcttaccatgattgcgttctgctattcttatctcgaggggccaaccccgagctgcgcaataaggaaggggatactgcctgggatctcacgcccgagcgatctgacgtgtggtttgcactacagctgaacagaaaactgcggctgggcgtaggcaatcgcgccatcagaactgagaagattatctgccgtgacgtagcgaggggctacgagaacgtgccgataccttgtgtaaatggggtggacggggaaccatgtccagaggattataaatatatttccgaaaattgcgagacttcaactatgaacattgataggaacatcacacatctccagcactgtacatgcgtggacgattgctcctcttcaaactgcctctgcgggcagctgtcaattcggtgctggtacgacaaagacggccgtctgctgcaggaattcaataagattgaacccccactcatctttgagtgcaaccaggcatgctcttgctggaggaattgcaagaaccgcgtggtgcaatcagggatcaaagtaaggctccagctgtatcggaccgcgaagatggggtggggagtgcgggccctgcaaactatcccccaaggcacctttatttgtgagtacgtcggggagctgatttcagacgccgaggcagatgttagagaagatgattcttatctattcgatctcgataataaggatggggaagtgtattgtatcgacgcgaggtactatggtaatatctccagatttattaaccacctgtgcgatccaaatattataccagtgcgggtcttcatgctgcaccaggatctccgcttccctaggatcgcatttttttccagcagggacattagaaccggtgaagaactgggattcgactacggcgacagattttgggatatcaaatcgaaatactttacatgtcagtgtggcagcgaaaagtgtaagcactctgctgaggccatcgccctggagcaatctcggcttgctcggctcgatccacatccggagctgctgccggaattgggctcgctacccccagtgaacacctag

SEQ ID NO: 186952 - DNA, 3804 bp, Artificial Sequence
  Description of Artificial Sequence: Synthetic coding sequence
atgcggggcctgccccggggccggggcctgatgcgggcccggggccggggacgcgctgctccccctggtagtcgaggccgtggacggggagggccccaccgcgggagaggcaggccacgcagtctgctttcgttaccaagggcccaggcctcctggacaccacagctttccacgggcctcacctcgccccccgtgccttgtcttccgtctcagggagaagcaccagctgaaatgggggcactgctgctggaaaaggagacgaggggagccaccgaacgagtgcatggcagtctgggagatactcccaggtcagaagagaccctgcccaaggcgacgccggatagcctcgagccggccggaccatcgtcgccggctagcgtgaccgttaccgtgggtgatgagggagccgacactcctgtgggggctacacccctgatcggagacgaatctgagaacctggaaggggatggagacctacgcggaggtcgtatccttcttggtcacgccactaagagttttccaagttctccttcaaaaggcggcagttgtccatcccgcgcaaagatgtctatgaccggggcaggaaaaagcccacccagcgtccagtcattggccatgcggcttttatctatgcctggcgcccaaggtgctgccgccgctggttccgaacccccgcctgccaccacaagcccagaggggcagccaaaggtgcacagggcacggaaaacaatgagcaagcccggaaacggacagccccccgttcccgagaagcggcccccagagatccagcactttagaatgtccgacgacgttcactccctgggaaaggtcaccagtgacctcgcaaagcgcagaaagctgaatagtggcgggggtctaagtgaggagctgggttctgcccggcggtctggggaggtaacccttaccaaaggcgatccagggtccctggaagagtgggaaacagtggtgggggacgatttctcgctctattacgattcttacagcgtagatgaacgtgtggactccgactccaaatctgaggtggaagctcttactgagcagctgagcgaggaggaagaggaggaagaggaagaggaggaagaggaggaagaagaagaggaagaggaagaggaagaggaagatgaggagagcggcaaccaatctgaccgcagtgggtcctccggaagacgtaaagctaagaaaaagtggaggaaggatagcccatgggtgaagccatccagaaagagaaggaagcgtgaaccccctagagctaaggagcccaggggagtgaacggcgtgggttcttccggaccctcagagtatatggaagtgcccttgggcagtctagagctgccctctgaagggactctctccccaaaccatgccggtgtttctaacgatacctcgagtctggagaccgaacgtggctttgaggagctgccactatgcagttgtaggatggaagccccaaagatcgacaggatctccgagagggccgggcataaatgcatggcaaccgaatctgttgacggggagttatccggttgtaacgctgcaatcctaaagcgagagaccatgcgaccctcttctcgagtagcactgatggtgctgtgcgagactcaccgcgcgagaatggtgaagcaccactgttgtccaggttgcggttacttttgcactgcaggcacgttcctggagtgccaccccgattttcgtgtcgcccatcgattccataaggcgtgcgtgagtcagctcaatgggatggtattttgcccccactgcggcgaggacgctagtgaagcacaggaagttacgattccgcgaggggatggtgtcaccccccctgctggcaccgcagcccctgcacccccccctctatcacaagatgtgcccggtagggcagacacaagccagccaagcgctcgcatgaggggacacggggagcctagaagaccaccctgcgaccctctcgcagatacgattgactcctccgggccctctctgacactgccgaacggcggttgtctgtccgccgtgggactcccactgggccctggacgcgaggcactggaaaaagctttggttatccaagaatcggaaaggcggaagaagctcaggttccatcctcgccagctgtatctgtctgttaaacagggggagttgcagaaggtcatcctgatgctgctggataacctcgaccctaactttcagagcgaccaacagtctaagcgtacaccacttcatgccgcagcgcagaaaggatcggtcgagatttgccacgtgctcttgcaagctggggctaatatcaacgccgtcgacaaacagcagaggacacccctcatggaggccgtcgtgaacaatcaccttgaggtggccagatacatggtccagaggggaggttgtgtctattctaaggaggaggatggcagcacttgtttgcaccatgcggccaagattgggaacctggagatggtcagtctgcttctgtccactggccaagtggatgtcaacgcgcaagactcaggcggttggacacccatcatttgggctgctgaacataagcatatcgaagttattaggatgctcctaacccggggggccgatgtgactctcaccgacaatgaggagaatatctgtctacactgggcatcctttactggatcagccgccatcgctgaggtactgctcaacgctaggtgcgatttgcatgccgtaaactatcacggggacacacctctgcatatcgcagccagagagagttatcacgattgtgttctgttattcttgagccggggcgcaaacccagaactgcgtaataaagaaggggatactgcttgggatctgacacctgaaagatcagatgtttggttcgcactgcagttaaatcggaagcttcgacttggagtgggaaaccgcgcaatcagaacggaaaagattatctgcagagacgtagctaggggctatgagaacgtgccaataccatgtgtcaatggagttgatggtgagccatgcccagaggattataaatatatctctgaaaactgtgaaacatcaaccatgaacattgatcgaaatatcacccacttgcagcactgcacttgcgttgatgattgcagctcctctaactgtctgtgtgggcaattgtccatccgatgctggtacgacaaggatggaagactgctccaggagtttaataagattgaacccccactgatctttgaatgtaatcaggcatgttcttgctggcgcaactgcaagaacagagtcgtgcagtcggggatcaaggttcggctgcaactgtaccgcacagcgaagatgggatggggggtgcgcgcgctccagactatcccccagggcacattcatctgcgagtacgtgggggagcttatctctgacgcggaggccgatgtgagagaagatgattcctatctatttgacctagataataaagacggcgaagtctattgtatagacgcacgctactacggcaacatctcgcggttcattaatcacctgtgtgacccaaacattatccccgtgcgcgtttttatgctgcaccaagacctgcgctttcctaggattgcgttcttttcgagccgagatataaggacgggggaggagttgggctttgactatggcgatcgcttctgggacatcaagagcaagtatttcacgtgccagtgcgggagcgaaaaatgtaagcacagcgctgaggctatcgctctggaacagtcccgcttggcgcgcctggacccccaccccgagcttctccccgaactgggtagtttacctcccgtgaacacttag

SEQ ID NO: 186953 - DNA, 3702 bp, Artificial Sequence
  Description of Artificial Sequence: Synthetic coding sequence
atgcggggcctgccccggggccggggcctgatgcgggcccggggccggggacgagccgcgccaccaggctcaaggggacggggaaggggtgggcctcacagaggacgaggcagacctaggagcttactgtccctgcccagagcccaggccagctggacaccacaactgtctactggccttacctctccccctgttccgtgcctaccctctcaaggtgaggccccagcggagatgggcgcgttactgctggagaaggaaaccaggggggcaaccgagagggttcatggatcccttggcgacacacccagatctgaggagaccctgccaaaagcgactccagactccctggagccagctggccctagctctcccgcctccgtcactgtgaccgtgggggacgaaggagccgacacccctgtcggggccaccccccttatcggggatgagtccgaaaatctggaaggcgatggagacctgagaggcggccggatcctgctgggccacgctactaaaagctttccatcgagtccatccaagggcgggtcgtgcccaagtagagccaagatgtccatgacaggcgcaggcaaatcacctccatctgtgcagtctctggcaatgaggttgctgtctatgcctggagctcagggggccgccgccgccggctccgagccgcctcctgccaccactagcccggaagggcagccaaaagtgcaccgggctaggaaaacgatgtcaaaaccgggtaacggtcagccccctgtgcctgaaaagcgtcccccagaaatccagcacttccgcatgtctgatgacgtccactctctcggaaaagtgacttctgatctggccaagcggcggaagctgaatagcggtggcggcttatctgaggagcttggatcagctaggagaagtggcgaggtgactctgactaaaggcgatcctggcagtctcgaggaatgggaaacagtcgttggggacgacttctctctatattatgacagctatagcgttgacgagcgtgtagactccgattccaaatcggaagtggaggccctaacagaacaattgtccgaggaggaagaagaagaagaggaggaggaagaggaggaggaagaggaggaagaagaggaggaagaagaagaggacgaggagagcggaaaccagagcgatagaagcggtagtagcgggcgccggaaagctaagaagaaatggcgcaaggactcgccgtgggtcaaaccatcccgcaagcgacgtaagcgagagcctccaagagccaaagaaccgaggggcgtgtctaacgataccagttcgctggaaactgaacgcggtttcgaggagcttccactctgctcatgccggatggaagcccctaagatcgacagaatctctgaacgcgccggccacaaatgcatggctaccgaatccgtggacggcgaactgtccggctgtaacgccgccatactcaagcgggaaacaatgaggcctagctctcgggtggctcttatggtactttgtgagactcatcgagctcgtatggtcaagcatcactgttgtccgggttgtggatacttttgtacagcaggtacctttcttgaatgccacccagatttcagagtggcgcaccggttccacaaggcctgtgtctctcagctgaacggtatggtattttgccctcactgcggagaggacgctagcgaggcgcaggaggtgacgattccaagaggagatggggtgaccccccctgctggcacagccgccccggcccctcctcctctgtcccaggacgtcccggggcgtgctgatacaagtcagccaagcgcccggatgagagggcacggggagccgagaagacctccctgtgaccccctggcagatacaatagacagttccggcccgtctctaaccctgcccaatggcggatgcctctcagccgtaggcttgccactgggacccgggcgcgaggccctagagaaggctctggtcatacaggaaagtgaacgacggaaaaagctccgttttcatccccgccaattataccttagtgtgaaacagggggagctgcagaaagtgattctgatgctcttggacaatctggaccctaacttccagagtgaccagcagtctaaaagaactccactacatgccgcggcccaaaaaggcagcgtggagatctgccacgtgttgctccaggccggtgccaacatcaatgccgtcgataaacagcagcggacgcctcttatggaggccgtcgttaacaaccacctggaagtcgcaaggtacatggtccagcggggagggtgtgtgtatagcaaggaagaggatggcagcacctgtcttcaccacgcggccaagatcggtaacttagaaatggtgagtctcttgctgtccacaggccaggttgatgtgaatgcacaagacagcggcgggtggactccgatcatctgggccgccgaacataagcacatcgaagtgattcggatgctgctgacgaggggcgcagatgttacactgacagataatgaggagaacatttgtctgcattgggcctccttcaccggaagcgccgctatcgccgaagtgctgctcaacgccaggtgtgacctgcatgccgtaaattatcacggtgatacacctcttcacatcgctgcacgcgagtcgtatcacgattgcgtactcctgtttctcagcaggggcgcgaaccctgagctgaggaacaaagagggtgatacagcctgggacctgacgcctgagcggtctgatgtatggttcgcactccagcttaatcggaaactacggcttggggtcgggaatcgggcgatccgaactgaaaagattatttgtcgcgacgtagctagagggtatgaaaacgtgccgattccgtgcgtcaatggcgtggatggggaaccttgtccagaagactataagtatatctctgaaaactgtgagacctccaccatgaacatcgatcggaacatcactcacctacaacactgcacttgcgttgacgactgctctagctctaattgcttgtgcggccagctctccatccgatgctggtatgacaaggatggacggttgctccaagagtttaataagatcgaaccacctctgatttttgagtgcaatcaggcctgctcttgttggcggaactgcaagaatagagtggtgcaaagtggaattaaggtaaggctccaactgtatcggactgctaagatgggttggggggttcgggctctgcagacgattccccagggaacatttatctgcgaatacgttggggagctgatctcagatgcggaagcagatgtgagagaagacgactcatatttattcgatctagataacaaggatggggaggtttattgtatcgatgctcgttattacggtaacatttcccgcttcatcaaccacttatgcgacccaaatattatccccgttcgcgtgttcatgctgcaccaggacctccggtttcccaggatcgctttctttagctcccgggatatcagaactggcgaagaactggggttcgactacggagacaggttctgggatattaaatctaaatacttcacgtgtcaatgcggttccgagaaatgcaaacatagcgctgaagccatagccctggagcagtctcgcctggcccggctggacccccatccagagctcttaccagaactaggctctctgccaccagtgaatacctag

SEQ ID NO: 186954 - DNA, 3804 bp, Artificial Sequence
  Description of Artificial Sequence: Synthetic coding sequence
atgcggggcctgccccggggccggggcctgatgcgggcccggggccgagggcgggcagcacctcccggatctcgaggtcggggccgagggggccctcatagggggcgaggtcgccctagatctttactgagtttgccccgagcccaggcctcttggaccccccagctgtcgacggggctcacaagtcctccagtgccatgcctccctagccagggggaggcacctgccgaaatgggagctctgttacttgagaaggaaaccaggggtgccactgaacgggtgcacggctccctcggtgacactccaagatccgaagagacgcttcccaaagccaacccagactcgctggaaccggcaggacccagctcacctgcctcggtgactgtcaccgtcggagatgagggcgcggataccccagtcggggccacgccccttattggggacgagagcgagaacttggagggcgacggcgatttgagagggggaaggattctactgggacacgccactaaaagtttcccatcaagcccgtctaagggcggatcatgtcctagcagagcaaagatgtctatgaccggagcaggtaagtcacccccctctgtgcagagtttagccatgcgactcctaagcatgccgggtgcccagggagccgcggctgccggatcagagcccccccctgcaacaaccagccccgaggggcaaccgaaagtacacagggctcgtaagactatgtcaaagcctggaaatggtcagcctcccgtgcctgagaagcgcccacccgaaattcagcattttaggatgtccgatgatgttcattctctaggcaaagtgacaagtgacctggccaaacggagaaagctgaactctgggggcggtctctcagaagaacttggcagcgccagaaggagcggggaagttactttgactaaaggcgatccggggagcctggaagagtgggagacagttgtgggtgatgacttttcactttattacgattcctattctgttgacgaacgcgtcgactccgattctaagtctgaagtcgaagccctgacagaacaactctcggaagaggaggaagaggaggaggaggaggaggaggaggaagaggaagaggaggaggaggaagaggaagaagaagacgaggagtccggcaatcaatcagatcgttctggatcctccggtcggcggaaagccaaaaagaagtggaggaaggactccccatgggtcaaaccttctaggaaacgcagaaagcgggagccccctcgcgccaaagagcccagaggcgtcaatggagtcggaagcagtgggccgtccgaatatatggaagttccattagggtcgttagagctgccgtccgagggcacgctaagccctaaccacgccggcgtatctaacgatacatcctccctggaaacagaaaggggctttgaagagcttcctctgtgcagctgccggatggaggcacctaaaattgaccggatcagcgaacgcgcaggacataaatgcatggcaaccgaaagcgtagacggcgaactcagcggatgcaatgccgccattctcaagagagagacaatgcgcccatcctcccgggtcgcgctaatggttctctgcgaaactcatcgggccaggatggtgaagcatcattgctgtcctggatgcggctacttctgtaccgcaggcacgttcctggaatgccacccagacttccgggtcgcacatcggtttcacaaggcctgtgtctctcagttgaatggaatggtattctgtccgcactgtggggaggatgctagtgaagcacaggaggtgactatccctaggggggacggggtaacgcctccggcaggcactgctgcaccggccccccctcccctcagtcaggacgtccccgggagggcagacactagccagcctagtgcacggatgcggggacatggcgagccgcggcgcccgccctgcgaccctttagccgacacgatcgactcttcggggcccagccttacattaccaaatgggggttgcctttccgcggtgggtttgcccctgggacccggccgcgaggcactcgagaaagccttggttattcaggagtctgaacgtcgcaagaagctgagattccatcccagacagctgtacctttccgtgaagcagggcgagttacagaaggtcatcctcatgctgctggacaatctggacccaaatttccagagcgatcagcaatctaagcgaacaccgctccatgccgcagcccagaagggaagtgttgagatctgccacgtgctcctgcaggctggggctaacattaatgccgttgacaagcaacagagaacacctctgatggaggcagtcgtgaacaatcacctggaagtggctcggtacatggtgcaacggggtgggtgcgtgtatagcaaggaagaggatggctctacgtgcctgcaccatgcagccaaaatcggtaaccttgagatggtgagccttctgctgtcaacgggacaggtagacgtgaatgctcaggacagtgggggttggacacccatcatctgggccgctgagcacaagcacattgaggtgatccggatgctgctcacacggggcgcggatgttaccttgacggataatgaagaaaacatatgcctgcattgggcgagcttcactggttccgcggccatcgcagaggtgctgctgaacgcacgctgcgacctccacgcggtgaattatcacggcgataccccgcttcatatcgccgcccgcgagagttatcatgactgcgtccttctatttctgtcaaggggagcaaatcctgagctcaggaacaaagagggcgataccgcatgggatctgacacctgagcgatctgacgtttggttcgctttacagctgaatagaaagctgcgcctaggtgtcggcaatcgagccattcgtactgaaaaaatcatttgtagagatgttgcccgaggttacgaaaacgtgcctatcccatgtgtgaatggcgtggacggagaaccttgcccggaagactataagtacatttccgagaattgtgagacatcaaccatgaatatagatagaaatataacgcaccttcaacactgtacgtgtgtggacgactgcagcagctccaattgtctttgtgggcagctttctatccggtgctggtacgataaagacggaaggttgttgcaggagttcaataaaatcgaacctccgctgatatttgagtgcaatcaggcttgctcgtgttggcggaattgcaagaatcgagtggtgcagtccgggataaaagtccgcctgcaactatatcgcacagccaaaatggggtggggcgtgagagcactccagacaatcccacaaggaacgttcatctgcgagtatgttggcgagctgatcagtgatgctgaagccgatgtgagggaggatgacagttacctgttcgacctggataataaagatggcgaggtgtattgcatcgatgcccgctactacggcaatatctcgcgttttattaaccacctttgtgatcccaacatcattcccgtgcgggttttcatgcttcaccaggacctgaggttcccaagaatagccttttttagcagccgtgacatccgcaccggggaagagttgggatttgactatggggataggttctgggacatcaagagtaagtactttacctgccagtgtggttctgaaaaatgtaagcacagtgcagaggcaatcgccctagaacagtcccggctggcgcgcctggaccctcatcctgagctcctacccgaactcgggtccctgcccccggtcaacacgtag

SEQ ID NO: 186955 - DNA, 897 bp, Artificial Sequence
  Description of Artificial Sequence: Synthetic coding sequence
tgaagcaagcggacccccctgcacgccgccgcccagaagggcagcgtcgaaatttgtcacgtcctgctccaagcaggggcaaatatcaatgctgtggataagcagcagaggactcctcttatggaagcagtagtcaacaatcatcttgaggtcgcccggtacatggtgcagcgcggcggctgcgtgtactccaaagaggaggatgggtcaacatgcctgcaccatgctgccaagatcggaaaccttgagatggtgagcctcttgttgtctacaggccaggtggacgtgaatgcccagggccagctgccaccgccaagcttaccatcccatccgcaggatagtggcgggtggaccccaataatctgggccgctgagcacaagcatatcgaagtcattcgcatgttgttgacaagaggcgccgatgtgacccttacggacaatgaagaaaatatttgtctgcactgggcctcatttaccggctcggccgcaatcgctgaggtgctcctgaacgctcggtgtgatctgcacgccgtgaattaccacggcgatacaccgctgcacatcgcagcacgggagtcctaccatgattgtgtcctgctgtttctcagccggggtgccaatcccgagctaagaaacaaagagggggataccgcctgggacctgacacctgagaggagtgacgtgtggtttgcactgcagctcaacagaaaactgagactgggggtcgggaacagggcaattcgcaccgaaaaaatcatctgccgggatgtggcgcgggggtatgaaaatgtgccaatcccatgcgtgaacggggtggacggagagccttgtcctgaggactacaaatacataagcgaaaattgcgaaacgtccaccatgaacattgaccgcaattag

SEQ ID NO: 186956 - DNA, 3633 bp, Artificial Sequence
  Description of Artificial Sequence: Synthetic coding sequence
atggccgccgccgccggcgccgccgccgccgccgccgccgagggcgaggcccctgctgagatgggcgctctgcttctggagaaggaaacaagaggagctacggagcgggtgcatgggagccttggagacactccccgttcagaggaaactctgccaaaagcaaaccctgatagcctggaacctgctgggccgagctcccctgcgagcgtgaccgtgactgtcggagatgaaggcgctgacacaccagtcggggccactccgctcatcggggatgagtctgaaaacctggaaggggatggcgaccttagaggaggccggattctgctgggacatgccactaaatccttccctagcagccccagtaaaggcggctcatgtccctcccgcgcaaagatgagcatgactggcgcgggtaagtccccccctagcgtccagagcttggctatgaggctcttatccatgcccggggcccagggagcggctgcggccggcagcgaacccccacctgcaactacatctccagagggacagcccaaggtgcatagagctcgcaagaccatgtccaagccaggtaacggacagccccctgtcccggagaagaggccccctgagattcagcacttcaggatgtctgatgatgtacattcgctgggcaaggtgacctccgatttagccaaacgccgaaaattaaactccggaggtggtctgtctgaggaactgggctctgccaggcggtctggagaggttacgctgacaaagggagaccccgggtctctggaggagtgggagactgtggttggagacgacttttcattgtactacgactcttatagcgtcgatgagcgagtagatagtgatagcaagtctgaagtcgaggccctgacagaacagctgtctgaggaagaggaagaagaagaggaggaggaggaagaagaagaagaggaagaggaagaagaagaagaggaggaggacgaggaatcaggaaaccaatcagaccggagtggatccagcggccgtagaaaggctaagaagaaatggaggaaagactccccttgggtgaagccctctcgcaaacgtcggaagagggagccgccccgcgccaaagagccccgcggcgtgaatggggtgggatccagtggcccgtcggagtacatggaggtgcctctgggctctctagagctcccctcagaggggacgttgagccccaatcatgccggcgttagtaatgatactagctccctcgaaaccgaaaggggattcgaggagttgcctttgtgctcttgccggatggaagccccaaaaattgatcggatatccgaacgcgctggacacaagtgcatggctacagaaagtgtggacggagagctgagcggctgcaacgctgccatcctgaagagggagacgatgcgcccttcttcccgggttgcactgatggttctgtgtgagacccatcgtgcccgcatggtaaagcaccattgttgccctggttgcggttatttctgtacagcgggcacttttctggagtgtcatccagacttccgcgtggctcacagattccataaggcatgcgtgtcacagctaaatgggatggtgttctgccctcattgcggagaagacgcaagcgaggctcaggaggtgactattccaagaggcgatggagtgaccccccccgcaggcacagctgctcctgccccccccccactctcacaggacgttccaggccgagccgatacttctcagccttccgcacgtatgagaggccacggcgaaccacgccgtcccccatgtgatcctctggctgacacgatcgacagcagtggccctagccttaccctgccgaacggcggctgtctgtcagcggttggcctgcctttagggccaggcagggaagcgttggagaaggccctggttatccaggagtctgaacgccgcaagaaactccggttccaccctagacaactctacctctccgtaaaacagggcgaacttcaaaaggtaattctcatgttgcttgataacttagatcctaactttcaaagcgaccagcaatcgaaacggacccccctgcacgcagccgcccaaaagggcagcgttgagatttgccatgtactgctccaggcgggtgccaatattaatgctgtagacaagcagcagcggactccactcatggaagctgtagtgaacaaccatttggaggtagccaggtatatggtgcagaggggtggatgcgtctactcaaaagaggaggatggatctacatgcctgcatcacgctgcaaaaatcggcaacctcgaaatggtatcccttttgctatccacaggccaggtcgatgttaacgcccaggattctgggggctggaccccgatcatttgggctgccgaacataaacacattgaggtcatacgaatgctcctgacacgtggggcagacgtcaccctcactgataatgaggagaacatctgcctccattgggcttcctttaccggttctgctgcaatcgcagaggtgctgctgaatgccagatgcgacttgcacgctgtcaattaccacggagacacacccctgcatatagccgcccgcgaatcctaccacgactgcgtcttgttgttcctctctcggggcgctaatcccgaactgaggaacaaagagggcgatacagcgtgggatcttactcctgaacgatccgatgtatggttcgcgctgcaattaaaccggaagctgcgtctgggggttggaaatcgggctattagaactgagaaaattatttgcagggatgtcgctcgtggttacgagaacgtccctattccttgtgtgaacggcgttgatggagaaccgtgccctgaggattacaagtatatctctgaaaactgtgaaacttcgacaatgaatatcgatcgtaatatcacccatctccaacactgtacatgtgttgacgattgttctagttctaactgtttatgcggacagctgtcaattcgctgttggtacgacaaggacggacggttgctgcaggaatttaataaaatagaaccacccctgatctttgaatgtaatcaagcgtgcagttgctggcggaactgtaaaaaccgagtagtgcagagcgggattaaagttaggcttcagctctatcgaacagctaagatgggttggggcgttagggcgttgcagactataccccagggaacctttatctgcgagtacgttggcgaattgatctcagacgcagaggctgacgtgcgcgaggatgattcatacttgttcgacctggataacaaagacggcgaggtgtactgcatagacgcgcgttattacgggaatatcagcaggtttataaaccatctctgtgatcctaatattattccagtgagagtgtttatgttgcatcaggatctgaggtttccccggatcgcctttttcagcagtagagacatccgcactggcgaggagttaggctttgactacggcgataggttttgggacatcaagagcaaatacttcacgtgtcagtgtggcagcgaaaagtgcaagcactcagcagaagccattgccctcgagcaaagccgacttgcgagacttgacccacacccagagttgctgccagagttgggcagcctgccacctgtaaatacttag

SEQ ID NO: 186957 - DNA, 897 bp, Artificial Sequence
  Description of Artificial Sequence: Synthetic coding sequence
tgaagcaagcggacccccctgcacgccgccgcccagaagggcagcgttgaaatttgtcatgtactgctacaggccggcgctaacatcaacgctgttgacaaacaacagcgcacccccttgatggaagctgtggtcaataaccacctggaggttgcaaggtatatggtgcagcggggcgggtgtgtgtattcgaaggaagaagatggcagtacctgtcttcatcatgcggctaagattggaaacttggagatggtgtctttgctgctctccacaggccaggtggatgtgaacgcccagggtcagttacctcctccatccctaccttcgcaccctcaagactcaggtgggtggaccccgatcatctgggcagccgaacacaaacacatagaagtaatcaggatgcttctaacacggggcgcagacgtgacactgaccgataatgaggaaaacatttgtcttcattgggcatctttcaccggtagtgctgcgatcgctgaggtcctgcttaacgcccggtgtgatctgcatgctgtgaactaccacggcgataccccattgcatattgcggccagggaatcataccacgactgcgtgctactgttcttatctcgtggagccaaccctgagctgagaaataaggaaggcgacacagcctgggatctgacccccgaacggtcagatgtatggtttgctctccaattgaatcggaagttgagactaggagtcgggaatcgagcaatccggaccgaaaaaattatctgccgcgacgtggctcgaggctatgaaaatgtccccataccttgtgtcaatggtgtagatggagagccctgccctgaagactataaatatatcagcgagaactgcgagacatctacaatgaatatagaccgcaactag

SEQ ID NO: 186958 - DNA, 3531 bp, Artificial Sequence
  Description of Artificial Sequence: Synthetic coding sequence
atggccgccgccgccggcgccgccgccgccgccgccgccgagggcgaagcaccggcagaaatgggagccctcctgttagaaaaggaaactagaggggccacggaacgagttcacggatcattgggggatacaccaaggtctgaggagactttgccaaaagcaacaccagattcattggaacccgcgggaccctccagtcctgcctcagtgactgtgacagtgggcgatgagggagcagacaccccagtgggtgctactcctctgattggggacgagagtgagaacctcgagggcgacggggacctgagaggaggcagaatcttgctggggcacgcgacaaaaagtttcccctcgtcacctagtaagggaggttcatgtcctagtcgcgcaaagatgagcatgacaggagccggtaaatcaccccccagtgttcagagcctcgctatgagactcttaagtatgcctggcgctcagggtgctgcggccgctggctcagagcccccccccgctactacatcaccagagggccaacctaaggtccaccgcgccaggaaaacaatgtcaaagccgggtaatggtcagcctccagtgcccgaaaaaaggccaccggaaatccagcatttcaggatgagtgacgacgtgcactccctgggcaaagtgacatccgatttggccaagcgacgcaaactgaattctggaggcggattaagcgaagagttaggcagcgctaggagatccggtgaggtgacgcttacaaaaggagatcccggctcactggaagagtgggaaactgtggtaggggacgatttctcgctgtactatgactcctactcagtggatgagagagtagatagtgattctaagtctgaagttgaggcgcttacagagcagctgagcgaagaggaggaagaggaggaggaggaagaggaggaggaggaagaagaagaagaggaggaggaggaagaagaagacgaggagagtggaaatcagtcggacagaagtggaagctctggtagacggaaggcaaagaaaaaatggagaaaggattccccgtgggtcaagccgtctcggaaacggcggaaacgggagccccctcgggccaaagagccccggggagtcagcaacgatacgtcctcactggagacagagcgaggcttcgaggaactccccctgtgcagctgtcgaatggaagcacctaagattgatcggatcagcgaaagagccggacacaagtgtatggctactgaatccgtggacggcgagctgagcggttgcaacgcagccattctcaaaagggagaccatgcgaccatcctctcgggtagcccttatggtgctctgcgagactcatcgcgcccgaatggttaaacaccattgctgccccgggtgcggctatttctgcacagccggaaccttcttagaatgccaccccgacttcagggtggcgcaccggttccacaaggcgtgcgtttcacagctaaatggtatggtgttctgccctcactgcggcgaggatgctagtgaagcccaggaagttactatcccgaggggagacggcgtgacccctccagccggtaccgcggcaccagctccacctccactgtctcaagatgtccccggtcgggcggacacatcccagcccagcgctcgcatgcgcggacatggagagccacggaggccgccatgcgaccccctggcagacacaattgacagcagcggaccttctctcacgctgccgaacggcggttgcctttcggctgtgggcctgccattgggtccgggacgggaagctttagagaaggctctggtgatccaagagagcgagcgccgcaagaagctgagatttcatccccggcaattatacttgtctgttaagcagggggaactgcaaaaggtaatactgatgctcctagacaaccttgaccccaacttccagtctgaccagcaaagtaagcgcaccccactgcatgcagctgcacagaaagggtccgtggaaatttgccatgtcctgttgcaggctggagccaacatcaatgccgtggataaacagcagaggaccccgcttatggaagctgtggttaacaaccatctggaggtcgcccgctatatggttcagcgcgggggctgcgtatattctaaggaagaggacggatcaacatgcttacaccatgcagccaagattggaaacctagaaatggtgtctctgctgctgtctactggccaggtggacgtgaacgcccaggatagcgggggctggacccctatcatctgggccgccgaacataagcatatagaagtcattcggatgttgctgacacgtggagctgatgtcacactaaccgataacgaagagaacatctgcttgcattgggcctcctttactggatctgccgcaatagctgaggtgctcctgaatgctagatgcgatctccacgctgtgaactatcatggcgacacccccttgcatatcgcagcaagagaaagctaccacgactgtgtactgctcttcctgagtcggggagccaaccctgagctgcgcaataaagagggtgacaccgcttgggacttgaccccggagcgttccgacgtgtggtttgcactacagttgaaccgcaagctgagactgggggtgggaaatcgcgcaatcagaaccgaaaaaatcatatgtcgcgacgtggctcgggggtatgaaaacgtgcccatcccctgtgttaatggggtagacggtgagccttgtcccgaagactacaaatacataagcgaaaactgcgagacctctaccatgaacattgataggaacataactcatctgcagcactgtacatgcgtggatgactgtagcagctctaattgtctatgtgggcaactgtccattcggtgttggtacgataaagacgggaggcttcttcaggaattcaataaaatagaaccacctctgatttttgaatgcaaccaggcctgctcatgttggcgaaactgcaaaaaccgcgtggttcagtcgggcatcaaagttagattgcagctctacaggactgcaaaaatgggatggggagtacgagccttacaaacaataccccagggcacgttcatttgcgaatatgtaggggagcttatctcagacgctgaggctgatgtgagagaagatgactcctacctgtttgatctggacaataaagatggcgaggtgtactgtattgacgcaagatactacggaaatattagtaggttcattaaccacctctgcgaccctaacataataccggttagggtgttcatgctgcatcaagatctgcgattccctcgtattgcctttttcagttccagggacatcagaactggcgaggaactcgggttcgattacggggaccggttctgggatattaagtcaaagtacttcacatgccagtgtggatcagagaagtgtaaacattccgccgaggccatagccttggaacaaagcaggttagcgaggctagatccgcaccccgagttgctccccgaactcggttcactcccccccgtcaatacttag

SEQ ID NO: 186959 - DNA, 3804 bp, Artificial Sequence
  Description of Artificial Sequence: Synthetic coding sequence
atgcggggcctgccccggggccggggcctgatgcgggcccggggccggggaagagccgcacctcctggctcccgaggccgaggccggggcggacctcatagaggcagaggccgtccaaggagcctactcagtctacctcgtgcccaggcatcttggacgcctcaattgtccaccggactgacaagccctccagtgccatgcttgccatcccagggagaggctcccgccgagatgggggcgctcctgctggaaaaggaaacaagaggagccactgagcgtgtgcatggctctctgggagacacacctcgatccgaggagactctgccgaaagcaacaccagatagccttgaacctgcgggcccatccagcccagcctccgtcacagtgacagtgggcgacgagggagctgacacacctgtgggggccacccccctgataggggacgaatcagaaaacctggaaggcgatggcgatctccgaggtggccgtatcctgttgggccatgccacaaagtcttttccatccagtccatctaagggcgggtcttgcccttctcgcgcaaagatgagtatgaccggcgcagggaaatcacctccgtccgtccagagcctggccatgaggctattgagcatgccaggcgcccagggggccgccgccgcaggtagcgagcctcctcccgccacgacttctccggaggggcagcccaaagtgcatcgcgcgcgcaagaccatgtctaaaccgggcaatgggcaacctcccgtccccgagaagcgaccgcccgaaattcaacactttagaatgagtgacgatgtacattctcttggaaaggtgacatcagacctggccaaacggcgcaaactgaactcgggtggagggctgtccgaggagctgggctccgccagaagatccggggaggttaccctgaccaagggtgaccccggcagcctggaagaatgggaaacagtcgtgggagatgactttagtctgtactacgactcctacagtgtagacgaacgcgtggactccgactctaagtccgaggtcgaagcactcaccgaacagctctccgaggaagaggaggaagaagaagaagaagaggaggaggaagaagaggaggaagaagaggaggaagaagaggaagatgaggagtctgggaatcagtctgatcgatccggctccagtggaagacgcaaggctaaaaaaaaatggcggaaggatagcccatgggtgaaaccctcaaggaagagaaggaagagggagcccccccgggctaaagagcctcggggcgtcaacggtgtgggctcgtcaggaccgtcggagtacatggaggtgcccttggggtctctggaacttccttccgaagggacgctctcaccaaatcatgcaggggttagcaacgacacatcgtccctcgaaactgaacgtggattcgaagaactgccactttgcagttgccggatggaagcgcccaaaattgaccgaataagtgagagagccgggcataaatgtatggcgaccgagtctgtggatggcgagctgtccggctgcaatgctgcaatccttaagcgggaaaccatgcgtccctcatcacgggtggcgctcatggttttgtgcgaaactcatagggctcggatggtaaaacatcactgttgtcccggatgtggttatttttgtaccgccggcacatttcttgagtgtcacccagacttcagagtcgcccataggtttcacaaggcgtgtgtgtctcagctcaatgggatggtgttttgtccacattgcggcgaggacgcttccgaagcacaagaagtgacgattccccgaggggatggtgtgaccccgcctgccggtaccgcagccccagcccctcccccactgtctcaggacgtgcccggacgagccgatacatctcagccttcagcacggatgcgcgggcatggagagccacgccgccctccctgcgatcctctcgcggatacaatagattcctccgggccctccctgactcttcccaacggcggttgcctatcggctgtgggcctgcccctcggtcccgggagagaagccctggaaaaggccctcgttattcaagaatctgaacgtcgcaaaaagctgcgatttcacccgcgccaactctacctgtcagtgaaacagggtgagctgcagaaggtcattttgatgttgctggataacttagaccctaattttcagtcagaccagcagagtaagcgaactcccctacatgctgcggcgcaaaaaggttcagtcgagatatgccatgtcctgctccaggctggggcaaatatcaacgccgtagacaaacagcaacgcacccctctcatggaagcagttgtgaataaccatcttgaggtcgccagatacatggttcagcgagggggttgcgtgtacagtaaagaggaagacggtagtacctgtttgcatcacgcagctaagatcgggaacctggagatggtgagccttctgctcagcacgggccaagtggacgtgaacgctcaggacagcggcgggtggacgccaatcatatgggccgcagaacacaaacatatcgaggtgatcagaatgcttctcacccgaggcgcggacgtaaccctaaccgataacgaggagaatatctgcctccactgggcttccttcactggctccgcagcaatcgcagaagtactgcttaatgcaaggtgtgacctacacgcagtaaactatcacggcgacactccacttcacatcgcagctcgggaaagctaccatgactgcgtgctgctgttcctgagtcggggtgcaaatcccgaactacgcaataaggaaggagatacagcgtgggatctgactcctgagcgaagcgatgtctggttcgccctccaactgaatagaaagctgcggctcggagtaggcaaccgcgccattaggacagagaagataatctgcagagacgttgcacggggatacgagaatgtccccatcccctgtgtaaacggggtcgatggtgaaccctgcccagaggattataaatacattagcgagaactgcgaaacttctacgatgaatatcgatcgcaatatcacacacctgcaacattgtacctgtgtcgacgactgttcctcttcaaactgtctctgtgggcaattatccatccgctgctggtatgacaaagacggccgactgctgcaggagtttaacaaaatcgagccccccctcatcttcgagtgcaatcaggcctgctcttgctggaggaactgcaagaacagagtggtgcagagtggaatcaaggtacggcttcagctgtatcgtactgccaaaatgggttggggtgtgcgtgctctccagaccatcccgcaaggcactttcatttgtgaatatgtgggcgaattgatctccgacgcagaggctgacgttagagaagacgactcatatctcttcgatctcgacaacaaagatggggaggtctattgtatcgacgctagatactatggcaatattagccgcttcattaaccatctttgtgatcccaacataataccggtgagagtcttcatgctccatcaggatctgaggttcccccgaatcgcctttttttcaagtagagacattagaacaggagaggagttgggtttcgactatggagatcggttttgggacatcaagagcaaatacttcacttgccagtgcgggagcgaaaaatgtaaacattcggcagaggccatcgccttggaacagtccaggctggcccggttagatccccacccagaactgctgccagagttaggctcgctgccaccagtgaatacatag

SEQ ID NO: 186960 - DNA, 3633 bp, Artificial Sequence
  Description of Artificial Sequence: Synthetic coding sequence
atggccgccgccgccggcgccgccgccgccgccgccgccgagggcgaggctccagctgaaatgggagccctgctgctggaaaaggagacccgcggtgccaccgagcgcgtgcatggatccctgggggatactccgagatcagaggaaaccctacccaaagctaacccggacagtctggaacccgccggcccgagtagtcccgcaagtgtgacagtgaccgtgggcgatgagggtgctgataccccagtaggggcaacaccattgattggtgatgagtcagaaaatctggagggggacggggacctccggggtggcaggattttactgggccatgcgacaaagtccttcccctcttcaccgtcaaagggcgggtcatgtccgagccgtgccaagatgagcatgacaggcgctgggaagtcccccccttccgtacagagcctagccatgcggctactttccatgcccggcgctcaaggagcagctgccgctggcagcgaaccccccccagccacaacctcaccagagggccaaccgaaagttcacagggccagaaagacaatgtctaaacccggaaacggccagcccccagtgcctgagaagaggccccctgagattcaacattttaggatgtcagatgacgttcactcgctgggaaaagttacatctgacctggctaagcgaaggaaacttaatagcggaggcggcctcagcgaggagctcggttccgctcgtcgtagcggggaggtgacactcacaaaaggcgaccctggaagccttgaggaatgggaaaccgtcgttggcgacgatttctcgctttattatgactcctattcagtcgacgagcgagtagattccgacagtaagtccgaagtggaggctctcaccgagcagctgtcggaagaggaggaggaggaggaggaggaagaagaggaagaagaggaagaagaggaggaggaagaagaggaggaagatgaagagtcaggcaatcagagcgacagaagtggatcctcaggtcgcaggaaggcgaaaaaaaagtggaggaaggatagcccctgggttaagccatctcggaaaaggcgcaagagagagcctcctagggccaaggagccccgcggcgtgaacggcgttggctcctcaggtccaagcgagtacatggaggtgccactggggagcctggagctcccatccgaggggaccctgagccctaaccacgctggcgtatccaatgataccagtagcctggaaacagagagaggttttgaagagctgccactctgctcatgccggatggaggcccccaaaattgatcggataagcgagcgcgccggacataagtgtatggcaactgagtccgtggacggggaactgtctggctgcaacgcagcaatcctgaagagggagaccatgcgaccttcctcccgagtcgctctaatggtgttatgtgaaacccaccgggcgcgcatggtaaaacatcactgctgtccagggtgcggatacttctgtacagctggaacattcttggagtgtcatcccgacttccgggtggcccatcgatttcacaaagcttgcgtgagtcaactcaacgggatggtcttctgcccacactgtggcgaggacgcttccgaagcacaagaggtgaccataccacgcggagatggagtcacccccccagcaggtaccgccgcgccagcccctccaccactgagccaggatgtgcctgggagggccgacacttctcagccaagcgcacgcatgcggggccacggtgagccacggagaccaccttgcgacccactggcagatactatagattcctccggcccatccctgactttacccaacggagggtgcctgagcgccgtcggccttcctttgggccccggacgggaagctctcgaaaaggctcttgtgatccaggagagcgagcgcagaaaaaagcttcgctttcatcccaggcaattatacctcagcgtcaagcaaggcgaactgcagaaggttatcttgatgctgctcgataatctcgatcccaatttccagtccgaccagcaaagtaaaaggacacctcttcacgctgctgcacagaaaggatcagtcgaaatctgccatgtcctcctgcaggctggagcaaacattaatgcggtggacaagcagcaacgaaccccccttatggaggcagtcgtgaataaccatctcgaagtagcacgctacatggtccagcgtggaggctgtgtgtacagtaaggaagaggatgggagcacctgcctgcaccacgccgcaaaaattggtaatctcgaaatggtctccctcctattgagcacagggcaagtagatgttaacgctcaggactcaggggggtggacacccatcatttgggctgcagaacacaagcacatagaggtgatccgtatgctacttacacgcggggctgacgtgacgctcaccgacaatgaagaaaacatttgtttgcattgggcctcctttactggctcagctgctatagccgaggtgttgctgaatgctagatgtgacttacatgcagtcaactaccacggtgacacacctctgcatatcgcagctagagagagctaccacgactgtgttctcctgttcctgtcacggggcgccaaccccgagctacgaaacaaggagggtgacactgcctgggatctaactcctgaacgctccgatgtgtggtttgctttacagctcaacagaaagctgagactgggagtaggtaaccgtgccatacgtacagagaagattatttgtcgagatgtggcaagaggctatgaaaatgtgcccatcccatgcgtaaatggcgtggacggtgagccatgccctgaagattacaaatatatctctgagaactgtgagacgtctactatgaacattgataggaatataacacatttgcagcactgtacatgcgtcgacgattgctctagctccaactgtctatgtggccagctttcaatccgttgctggtacgataaggatggtcgacttctccaggagtttaacaagattgaacctccactgatattcgaatgtaatcaggcttgctcttgctggcgcaattgcaagaatcgtgtcgttcagtcagggatcaaggtccggcttcagttataccgcacagccaagatgggctggggcgttcgagcccttcagactattcctcaggggacttttatctgtgagtatgtgggcgaactcattagtgacgcagaggcggacgtaagggaggacgacagctacttatttgatctggacaataaggacggggaggtgtattgcattgacgcgcgttactacggtaacatttccagatttattaatcatttgtgtgatcctaatattattccggtgcgggtctttatgctgcatcaggacctgagattcccacgcatcgcctttttctcctctcgtgacataagaaccggggaagaactaggctttgattatggagatcggttctgggacatcaagtctaaatattttacttgccaatgtggttctgagaaatgtaagcattcagcagaggcaatcgccctcgagcagtcgagacttgcgcgactggatcctcacccagaacttcttccggagctaggctcactgccgcctgtgaatacgtag

SEQ ID NO: 186961 - DNA, 897 bp, Artificial Sequence
  Description of Artificial Sequence: Synthetic coding sequence
tgaagcaagcggacccccctgcacgccgccgcccagaagggcagcgtcgagatctgccatgtcctcctccaagcgggtgctaatataaacgctgtggataagcagcaacggactccgttgatggaagctgtggtgaataatcacttagaggttgcacgctatatggtgcagaggggtggctgcgtgtactcgaaggaggaggacggttccacttgtctgcaccatgccgcaaagattggtaacctcgagatggtcagcctgctgctgtccactggccaggtagacgtgaacgctcaggggcagttgcctccgccttccttgccgtcccatccacaggacagcggaggctggacaccaatcatctgggccgcagagcataagcatattgaggtcattcggatgttattaacaaggggagcagatgtaactctgaccgacaacgaagaaaacatctgcctgcattgggccagtttcacgggatctgctgcaattgccgaggtgttgttgaacgctagatgcgacctgcatgccgtgaactatcatggcgacactccactccatatcgctgccagagaatcttatcacgattgtgttttactcttcctatccagaggagccaatcctgagttgcgtaacaaagagggtgacacagcatgggatctgacccctgagaggtccgatgtgtggttcgccctgcagcttaacagaaaactcaggctgggagtcggaaacagagccatcagaacagagaagataatttgtcgcgatgtggcgagaggatatgaaaatgtgcctatcccctgtgtgaacggggtcgacggggaaccatgcccagaggactataagtatattagcgagaattgcgagacatccaccatgaatatcgacaggaattag

SEQ ID NO: 186962 - DNA, 2769 bp, Artificial Sequence
  Description of Artificial Sequence: Synthetic coding sequence
agcgaggtggaggccctgaccgagcagctgagcgaggaggaggaggaggaagaagaagaggaggaggaagaggaggaagaggaagaggaggaagaagaagaggaagacgaagaaagcggaaatcaaagcgatcgctctgggtcctccggaaggagaaaagccaagaaaaaatggaggaaagacagtccctgggtaaagccatctcgaaagagacggaagcgggagcctccgcgggctaaggagcctcgtggcgttaacggcgtcggatcatcagggccctcagagtatatggaggttcctttgggttctttagaattgcctagcgaagggaccctctcacctaaccacgcgggagtgagtaacgacacctcttctcttgagaccgagcgcggtttcgaggagcttccgctgtgttcctgccgtatggaggctccaaaaatcgaccgcatctcagagcgggccggccacaagtgtatggccactgaaagtgtcgatggggagctcagcggctgcaatgccgcgattctcaaaagagagaccatgagaccatcatcacgggtggcactcatggtgctctgtgagactcatcgggcgcggatggtcaagcaccattgttgccctggctgcggatatttttgcaccgcaggaacattcctcgagtgccatccagatttcagggtggcacaccgtttccacaaagcttgtgtgtcccagctcaatggcatggtgttctgcccccactgcggagaggacgcatccgaagctcaggaagtgaccatccctcgaggagacggagtaacgccccccgctggcaccgccgcccctgcaccacctccactgtctcaagacgtgcctgggcgcgcagatacctctcagcccagtgcccgcatgcgtggtcatggggagccccgaagaccaccgtgtgatccattagccgatactattgattcctctgggcctagtcttactctgccaaacggggggtgcctgtccgctgtcggccttcctctggggcccggaagagaagccctggaaaaggcccttgtcatccaggagtccgaacggcgcaagaagcttcggtttcaccctagacagctctatctttcagtgaaacagggtgagctgcagaaagtcatcctgatgctcctcgataatctagacccaaatttccagtctgaccagcaatcgaaacgcacccccctgcatgcagcggctcagaaaggcagcgtggaaatatgtcacgtccttcttcaggccggtgccaacatcaacgccgttgataaacaacaaagaacaccattgatggaagccgtcgttaataatcatttggaggtggcccgatatatggtgcaacgtggcgggtgcgtgtattccaaagaggaggatggaagcacttgtctgcaccacgcggccaagatagggaatcttgaaatggtttctctgctactttccaccggccaagtcgacgtcaatgctcaggattcggggggttggacacctattatttgggctgccgagcacaaacatatagaagttatcaggatgctgctgacccgaggagccgatgtcacacttaccgacaacgaagaaaacatttgtctacactgggctagctttaccggaagtgccgctatcgctgaggttctgctaaacgctagatgcgacctgcacgcagtaaattatcacggcgatacccccctgcacatagctgcccgtgaaagctatcacgactgtgtcctgctgttcttatcaagaggtgccaatcccgagctccgcaacaaagaaggggatactgcatgggacttgacgccggaaaggagtgatgtgtggtttgctctgcagttgaatcgcaagctccggcttggcgttggaaaccgcgcaatccgcacagagaaaattatctgtagagatgtggctagaggctatgaaaacgtccccatcccttgcgttaacggcgttgacggcgaaccctgtcctgaggactacaagtacatctcagaaaactgcgaaactagcactatgaatatcgatcggaacatcacccatcttcagcactgtacatgcgtcgacgactgctccagctcaaattgcctgtgcgggcagctctctattcgctgttggtacgacaaggatggccgccttcttcaggagttcaacaagattgagccacccctgatcttcgagtgtaaccaggcatgcagctgctggaggaactgcaagaatagggtggtgcagtccggcattaaggtccgccttcagctttatagaacggccaagatgggatggggggtgagagctttgcagaccattcctcagggaacgttcatttgtgagtatgtcggtgagctcattagcgatgccgaggccgacgtgagagaggacgactcttacctgtttgatctggacaacaaggatggggaggtttattgtatcgacgcccgatattatggcaacatctctcggtttatcaaccatttgtgcgatccaaacataattccggttagagtctttatgctgcatcaggatctcagatttccgcggatcgcattttttagtagtcgcgatattcggaccggtgaggagctcggctttgactatggagaccgattttgggacatcaagtctaagtactttacttgccagtgcggctctgagaaatgcaaacattccgctgaggccatcgccctggaacagtcacgtcttgcgcgactggacccacaccctgagctcttgccggagctaggctcgctgcctcccgtgaacacgtag

SEQ ID NO: 186963 - DNA, 3702 bp, Artificial Sequence
  Description of Artificial Sequence: Synthetic coding sequence
atgcggggcctgccccggggccggggcctgatgcgggcccggggccgcggtcgcgccgcgccccccggatcacggggcagaggacgggggggcccccatcgtggcagaggacggcctcgaagtctcctgtctttaccccgagcccaagcatcctggactcctcaactatctacaggtctgacgagcccacccgtgccctgtctccctagccagggcgaagcccccgccgaaatgggcgctctcctgcttgaaaaggagaccagaggggccacagagcgggttcacggctccctaggagataccccaaggtctgaggaaacactgcctaaggccaatcccgactcgctggaacccgctggaccaagcagccccgcatccgtgaccgtcacagtgggagacgaaggagccgacacgccagtcggcgccacgcccctgatcggagacgagtccgagaacctcgaaggggacggggatcttcgcggcggaaggatccttttgggacatgctacaaagagcttccccagcagcccttctaagggcggatcttgtccttctcgggccaagatgtcaatgactggtgccgggaaaagcccaccctccgttcaatcactggcgatgcggttgctctccatgccaggcgcacagggagccgccgccgccggctctgagcctccacctgccacaacgtcccccgaaggacagccaaaggtgcacagggccaggaagacaatgtccaaacctggcaacgggcagccccccgtgccggagaaaagaccgcccgaaattcagcacttcagaatgagcgacgatgtgcacagcttggggaaggtcacatccgacctggcaaaaaggcgtaagctgaactctggcggagggctcagcgaggaattgggtagcgctaggcgcagtggcgaggtgacgttgactaaaggagaccccggctcgctggaggagtgggagacagtggtgggtgacgactttagcctgtattatgactcatattctgtggatgagcgagtggactccgacagcaagtccgaagtggaggccctcacagagcagctgtccgaagaggaagaagaggaggaggaggaggaagaggaggaagaggaagaggaagaagaggaagaggaggaggaggacgaagaatcaggcaatcagtccgaccggtcaggaagtagtgggaggcgaaaggctaagaaaaagtggaggaaagactctccctgggtgaagccctccaggaagcgaaggaaacgagaacctccccgagccaaagagcctagaggggtatcaaatgacacgagctccctggaaaccgaaagagggttcgaggagttgccactgtgcagttgtcgcatggaagctccgaagattgaccgtatttctgagcgggccggacataaatgcatggccacggagtccgttgacggtgaattatctgggtgtaatgctgccatcttgaaaagggagactatgcgtccttcgtccagggtcgccctgatggttctgtgcgaaacccaccgggctcggatggtgaagcaccattgctgtcctggatgcggatacttctgcaccgctggtacttttctagagtgccatcctgattttagagtggcacacaggtttcataaggcttgcgtgagtcagctgaatggcatggtgttttgtcctcattgtggtgaagacgctagtgaagcccaggaggtgaccatccccagaggggacggtgtaaccccgcccgccgggacagccgcaccggcccccccgcccctttcccaagacgtgcccggaagagcagatacctcacagcctagcgcgcgcatgagagggcatggggagccccgcaggcctccatgcgatcccctagcggatacaatcgattccagcggcccgtctcttacattgcctaatggaggctgcttgagtgctgtgggattgcccttggggccagggagggaggctctggaaaaggccctggtgatccaagagtctgagcggcggaagaagctgcgctttcatccacgacagctatatctctcggtgaagcagggtgagctgcagaaagttatcttgatgctactggataacctagatcccaacttccaatccgatcagcagtctaagagaacgcccctgcacgctgctgcccagaagggctccgttgaaatctgccacgtgctgctgcaggccggggcaaatattaatgccgtcgataaacagcaaagaactcctcttatggaagccgtcgtcaataatcatctggaggtggccagatacatggtccagcgcggtggttgtgtgtatagcaaggaagaggacggttcaacatgcctacatcatgccgccaagatcgggaacttagagatggtatctctcttactgtccacaggacaagtggacgtgaatgctcaggactccgggggatggacgcctattatatgggcggctgaacataaacatatcgaggtgatcagaatgttgctgacacgcggtgctgatgtgacgctgaccgataacgaagaaaacatttgcctccattgggcttctttcaccgggtccgctgccattgcagaagtactgctgaacgcccgatgtgatctgcacgccgtcaattatcacggtgacactcctcttcatatagcagcccgagagtcttaccacgattgtgtgctgttgtttctgtctcggggggcaaatcccgaactgaggaacaaagagggagatactgcatgggacttaacacctgagaggtccgatgtgtggttcgccctacagctcaaccgcaagctgcgtctcggtgtaggcaatcgagcaattcgtaccgagaaaatcatttgccgcgacgtggcccggggatacgaaaacgtacccataccttgtgtgaatggggtggacggcgaaccatgcccagaagattacaagtacatcagcgaaaattgtgagacttctacgatgaatattgatcggaatatcacccacctgcaacactgtacatgtgtagacgactgctctagcagcaactgtctgtgcggacagcttagcattcggtgttggtacgataaagatggtaggctgctgcaggaattcaacaagatcgagccacccctgatctttgaatgcaatcaggcatgttcatgttggcgcaattgcaaaaaccgcgtcgttcaatcaggcattaaagtccggctgcagctgtatcgtacagcaaagatgggctggggggtgagggctctgcagaccattcctcaagggacatttatttgtgagtatgtgggggaattaatcagcgatgccgaggccgatgttagagaggacgactcatacctgtttgacctggataataaggatggagaggtgtattgtatcgatgcccgttattatggtaacatcagccggttcatcaaccatttatgcgatcctaatatcatccccgtgagagtgttcatgctgcaccaagacttgaggttcccccggatcgcttttttttcatcccgagatatccgaactggtgaagagctgggatttgattatggtgaccgattctgggatataaagtccaaatacttcacctgccaatgtggtagcgagaagtgcaaacattccgctgaagcaatagccctggaacagtctcggctggcgcggttggatccacatccggaactactgccggagttggggtctctgccaccagtgaacacatag

SEQ ID NO: 186964 - DNA, 3702 bp, Artificial Sequence
  Description of Artificial Sequence: Synthetic coding sequence
atgcggggcctgccccggggccggggcctgatgcgggcccggggccgaggccgggcggcccctcctggttctagaggacgcggacggggtggcccccataggggccgcggcagaccccgctctcttttgtctttgcccagggcgcaggcttcctggacacctcagcttagcactgggctcacttcacctccagtcccctgtctgcccagccaaggagaggcacctgctgagatgggtgccctgctactggagaaagagacacgcggtgcaaccgaacgggtgcacgggagccttggtgatacccccaggagtgaggaaactttgcccaaggcaacccccgacagcctggagccagcggggccttcatctcccgccagcgtaacagttacagtgggagacgagggcgccgacacccccgtcggcgccactcctcttatcggggatgagtctgagaacttggagggtgatggggacctccgcggaggaagaatcctactgggacatgctactaaaagtttcccttcttcaccgtctaagggtggcagctgtccttcccgtgctaagatgtcaatgacaggtgctggcaagtcaccgccctccgtgcaatctctcgcgatgcggctgctgtcaatgcccggagcccaaggggcagccgcagctggctccgagccacctcctgccacaaccagccctgagggccagcccaaggtgcaccgggcaaggaaaactatgtctaaacctgggaacgggcagccccctgtgcccgaaaaacgaccaccggaaatccaacacttccggatgtcggatgatgtacactccctgggcaaagtgacttccgacctagcgaagcggcgcaaactgaattccgggggcggcctcagtgaagagctgggctctgcccggaggtctggcgaagtcaccctaacgaagggcgaccccggatccctcgaggaatgggaaacggtcgtgggggacgatttctccctctactatgatagctactctgtagatgagagggtggacagcgactccaagagcgaagtcgaagctctcaccgagcaactgagtgaggaggaagaggaggaagaagaagaagaggaggaagaggaagaggaggaagaggaggaggaggaagaggaagacgaggagtccggtaaccagagcgatagaagcggcagctcagggagacggaaggccaaaaagaagtggagaaaggatagtccctgggtgaagccctctcggaagcgcaggaagcgagaaccgccccgggcgaaggagcctcgcggagtgtccaatgatacttcctctctggagacagagcggggctttgaggagctgccactgtgttcttgtcggatggaggctccaaaaatcgatcgcatctccgagcgagctggccacaagtgtatggcaacagagagcgtggatggagaactaagcggttgcaatgctgccatcctcaaacgggaaactatgcgcccatccagccgggtggcactgatggtgctgtgtgaaacccaccgcgcgcgtatggtcaagcaccactgctgtccagggtgcggatacttttgcaccgcagggaccttcctggaatgtcacccagattttcgagtggcacaccgatttcataaagcctgtgtcagccagctgaacggtatggtgttctgccctcactgtggcgaagacgcttcggaagctcaggaagtgacgatcccgcgcggggatggcgttacaccacccgcggggactgccgcccctgctcctcccccactctcccaagacgtgcctggacgagccgacacatcacaaccgtccgcaagaatgcgaggacatggagagccccgacgacctccttgcgatccactagccgacacaatcgactcctctggccctagtctgacgttgccaaatggcggttgcctctccgctgttgggctgcccctgggacctggacgggaagcactggaaaaggccctggtcattcaagaatccgagaggcggaagaagctacgcttccatcctcggcaactgtatctttccgttaaacagggcgagctgcagaaggttatcttaatgctgctcgacaatttagatcctaacttccagagcgatcagcaatctaagcgcactcccttgcacgccgctgctcagaagggcagcgtggagatttgccacgttctgttgcaggctggcgcaaacatcaacgctgtggacaagcagcagaggacacctctcatggaagcggttgttaataaccatctcgaggtcgctaggtatatggtacaaagaggaggttgcgtctattctaaggaggaggacggatcaacttgtctccaccatgccgctaaaataggtaatctggaaatggtaagcctgttactgtcaacggggcaggtcgatgtaaatgcccaggactcaggaggttggacgccaatcatctgggcagcagagcacaagcacatagaggtgatcaggatgctgctcactaggggtgccgatgtaacattaacagataacgaagagaacatttgcctccactgggcctcttttactggatctgccgcgattgccgaagtgctacttaatgcgcggtgcgaccttcacgctgttaattaccatggggacactccccttcatatcgcggctagagagtcatatcatgactgcgtcctcctgttcctgagccgcggtgcaaaccctgaattacgcaataaagagggggataccgcttgggacctaacacccgaaagatctgacgtctggtttgcacttcaattgaataggaagcttaggttgggcgtcggaaacagggccatacgcacggaaaaaatcatctgtcgggacgttgcaaggggttatgagaatgtgccaatcccttgcgtgaatggtgtggacggtgagccgtgtccagaggattacaagtatattagtgaaaattgtgagaccagcaccatgaacatcgacagaaatattacacacctccagcactgtacttgtgtcgatgattgtagctcgagcaattgcttgtgtggacagcttagcatcagatgttggtacgacaaagacggccgcttgttacaggaatttaacaagatcgagcctcccctcatctttgagtgcaatcaagcctgttcctgttggcgcaactgtaagaatcgagtcgtccagtcaggcattaaagttagattgcaactgtaccggacagcaaaaatgggatggggtgtccgcgctctccaaaccataccgcagggtacattcatttgcgaatacgttggcgagctgatctctgatgcggaagctgatgtgagggaggatgacagttatctttttgacctcgataacaaagacggcgaggtgtattgtatcgatgctcgatattatggaaacatttcccggtttatcaatcatctctgcgaccctaacattatcccggttcgggtctttatgttgcaccaggatctcagattccctaggatcgctttcttttcctcgagggacataaggaccggtgaagagcttgggttcgattacggtgacaggttctgggacatcaagtccaagtactttacatgtcagtgcggcagcgagaagtgcaaacacagcgcagaggccatcgcgctggagcaatctcgcctggctaggctcgacccgcatcctgagctgcttcctgaactgggaagtctacctcctgttaatacatag

SEQ ID NO: 186965 - DNA, 3633 bp, Artificial Sequence
  Description of Artificial Sequence: Synthetic coding sequence
atggccgccgccgccggcgccgccgccgccgccgccgccgagggcgaggccccagccgagatgggcgcattgcttctggagaaggaaacccgaggggctactgaaagagtccacggtagtctgggtgacacaccgaggtcagaggagaccctcccaaaagctactcccgattccttagaaccggcaggacccagttctccagcttctgtcacagttacagttggcgacgagggagctgacactcctgtcggcgcgacccccttaattggagacgaaagtgagaatttggaaggcgatggggacttgcgggggggtaggattctgttaggccatgccacgaagtctttcccatccagcccctccaaggggggttcctgcccatccagggccaaaatgagtatgacaggcgccggcaagtcccctcccagcgtgcagtctttggccatgagactgctctcaatgccaggagcccagggggcggccgctgcgggttcggagcctcctcccgcaaccacatctcctgagggtcagcctaaggtacacagagcaaggaagaccatgagcaaacccgggaatggccagcccccagttccagaaaagcgaccacctgagatccagcattttagaatgagcgacgatgttcattccttgggaaaagtcacatctgacctcgccaagcgcagaaaactgaatagcgggggaggcctctccgaggagttgggaagcgcccgccgctctggtgaggttaccctcacaaaaggcgatccaggaagtctggaggagtgggaaactgtggtgggtgacgatttttcattatactatgactcctattccgttgatgagcgggtggattctgatagcaagagcgaggttgaagccctgaccgaacaactgagcgaggaggaagaagaggaggaagaggaggaggaggaagaagaggaggaggaggaggaagaggaagaggaggaagacgaggaatctgggaaccaatctgacaggtcaggctcatccggacgccggaaagccaagaagaagtggcgaaaagactccccatgggtcaagccaagcagaaagagaagaaaacgggaacccccacgggccaaggaaccacggggcgttaacggagtgggaagctcgggacctagcgaatatatggaggttcccctgggaagcctggagctgccgtcagaagggaccctgtcgccaaaccatgccggggtgtcaaacgacacgtcctctctggagaccgagagaggattcgaagaactcccactatgctcctgtcgaatggaagcacccaaaattgatcggatcagcgaaagggcaggccacaagtgcatggccacggaaagcgtggacggggaattgtccggctgtaacgcagccatattgaagagagagaccatgcgcccctctagccgcgttgcattgatggtattatgtgagacacaccgtgcgaggatggtcaagcaccactgttgcccagggtgtggttatttttgcaccgccggcaccttcctcgaatgtcacccggacttccgagtggcacatcgctttcacaaagcctgtgtgtcccagctcaatggcatggtgttttgtccacattgcggggaggatgcttccgaggcacaggaggtgaccattccacgaggagacggagtgacacctcccgctgggacagctgccccagcccctccacctttgagccaggatgttcctggacgggctgacacgtctcagccttccgcccgcatgcggggccacggtgagccgagacggcccccgtgcgatccactagccgataccattgattcgtctgggccatcattgactttgccaaacggaggatgtctcagcgctgtgggtctccctctggggccaggcagagaggcactggaaaaggccttagtgatccaggagagcgaacgacggaaaaaactgcggtttcacccaaggcagctgtacctgtccgtgaaacagggcgaactgcagaaggttatccttatgctcctcgataacctggaccccaactttcagtctgatcaacagagtaagcgcactccattacatgccgccgctcagaaggggtcagtcgagatttgccatgtactgttgcaggccggcgcaaatatcaatgcggttgacaaacagcagcgaactccgctcatggaggccgtggtgaacaatcatttagaagtggcccggtacatggtgcagaggggcgggtgtgtgtacagtaaggaagaagacggatccacatgcctccatcatgccgccaagataggcaacctcgagatggtttcccttctattatccaccggtcaggtcgacgtgaacgcccaggacagtggcgggtggacgcctatcatttgggctgctgagcataagcatatagaagtgattcgcatgctgttaacccgtggggccgacgtcactttgaccgataacgaggaaaatatttgtttgcactgggcatcttttaccggaagcgccgctattgctgaggtgctgctgaacgcacgttgcgacttacacgccgtaaactaccatggtgacactcccctgcacatcgccgctagagaatcgtatcatgactgtgtgcttttattcttgtcacgaggcgcaaatcccgagctaaggaacaaagaaggagatactgcgtgggatctgacaccagaacgctccgatgtgtggttcgcacttcagcttaatcgcaagttgcgcctcggcgtcggcaaccgggcaatccggacagagaagatcatctgccgggacgtagcacggggatatgagaacgtccccattccttgcgtaaacggagtggatggggagccgtgcccggaggactataaatacatttcagagaattgcgagacctctactatgaacatagaccgcaatatcactcacctccaacattgcacatgcgtcgacgattgctcaagctctaattgcctgtgtggccagctttccataagatgttggtacgataaggacggaagattgttgcaagagttcaataagattgagcctccactcatctttgagtgcaatcaggcatgttcttgctggcgtaactgtaaaaatcgtgtggtgcagtccggaatcaaggtgaggttacaactataccggacggcaaaaatgggttggggcgtgcgagccttgcagaccattccccagggaactttcatctgtgaatatgtgggggagctgatttcggatgctgaggccgacgtccgcgaggatgatagctacttgtttgatcttgacaataaagatggcgaggtgtactgtatcgacgccaggtactatgggaacatttcaagattcattaaccacctgtgcgaccccaatatcattccagttagggtttttatgctacaccaggatctaaggttccctcggattgccttcttttccagccgggatattagaactggcgaggagctggggttcgactatggcgataggttttgggatatcaagtccaagtactttacttgtcagtgcggatccgaaaagtgcaagcactcagctgaagccattgcattagaacaaagtcgtctggctcggctggacccacaccccgaattactgccagagcttggctccctgccacctgttaacacctag

SEQ ID NO: 186966 - DNA, 897 bp, Artificial Sequence
  Description of Artificial Sequence: Synthetic coding sequence
tgaagcaagcggacccccctgcacgccgccgcccagaagggcagcgtcgaaatctgccatgtcttactgcaggccggcgcaaacattaacgccgttgacaaacaacaacgaaccccgctgatggaagccgttgtcaacaatcacttggaagttgcgagatatatggttcagcggggcgggtgtgtatatagcaaggaggaggacggtagcacatgtttacaccacgctgcaaaaattggcaacctcgagatggtgagccttctgctgagcaccggccaggttgatgtcaatgcccaggggcagctgcctccaccttcgctcccctctcacccacaagatagcgggggctggactccaattatctgggccgcggaacataagcacatcgaggtgattaggatgttgttgacacgtggtgctgacgttacccttaccgacaacgaagagaacatatgcttgcactgggccagttttacaggaagcgcagcgattgccgaggtcctcctgaacgcacggtgtgacctgcacgcagtgaattatcatggcgacacccctctgcacatagcggcaagggagagttatcacgactgtgtcctgctcttcctctcccgcggcgctaacccggagctgaggaataaggaaggtgatactgcatgggaccttacccctgagaggagcgatgtgtggtttgccttacagctaaaccgcaagctacgtttaggcgttggaaacagggctattcgcactgaaaaaatcatttgccgggatgtggcaagaggatatgaaaacgttcccatcccctgcgtaaacggggtggacggagagccttgtccagaagattataagtacatctccgagaattgtgagacttcaactatgaacattgaccgaaattag

SEQ ID NO: 186967 - DNA, 3804 bp, Artificial Sequence
  Description of Artificial Sequence: Synthetic coding sequence
atgcggggcctgccccggggccggggcctgatgcgggcccggggccgcggtagagccgcaccccctggatctcgaggtcgaggcagaggcggcccccacagaggcagaggaagaccacgctcactgcttagtttaccacgggctcaggctagttggactccacagctgtccactggcctcaccagtccgcccgtgccttgtctgccctctcagggagaggcacccgccgaaatgggtgcgctactcctggagaaagaaaccagaggtgctaccgagagggtacatggtagcctgggcgatactcctcggtctgaggaaactctcccaaaagccaccccagatagtctggaacctgctggacctagctctccagcatctgttactgtcactgtgggagacgagggcgcagatacgccagttggcgccacccctctgatcggggacgaatccgaaaacctggagggcgatggcgacctacgcgggggaaggattctgctgggacacgcgacaaagtcatttccttcttctcctagtaagggcggcagctgcccttcaagggctaaaatgtcaatgactggggcagggaaatctccaccttctgttcagtctctggccatgcggctgctctctatgcccggagctcaaggagccgcagctgctgggtcagaaccgccacccgcaacgacctctcctgaaggccagccaaaggttcatagggcacggaaaacaatgtccaaacctgggaatggccaaccacctgtgcctgagaaacgcccgcctgagatccagcactttcgaatgagcgatgacgttcattctctaggtaaagtcacgagcgacctggcaaagagaagaaaattgaattctggtggtggcctctctgaggagttgggatctgccagacgcagtggtgaagtgaccctgaccaaaggcgacccgggctccctggaggaatgggagaccgtggtcggtgatgacttttccttgtactacgactcatattccgtcgacgagagagtggactctgactccaagagcgaggtggaggcattgacagaacaactatctgaggaagaagaggaagaagaagaggaggaggaggaagaggaggaagaagaagaggaggaagaagaagaggaagacgaagagtctgggaatcagtccgatcgatccggtagctcaggcagacggaaggccaagaagaaatggaggaaagatagtccctgggttaagccatctcggaaacggaggaagcgggagcccccacgggcaaaagaaccccgaggtgtcaacggggtcggatcatccggaccctccgagtatatggaagtgccattgggatccctcgagctgccctcagaaggtacactttcccccaatcacgcgggcgtctcaaatgataccagctctctggagacagaacgcggttttgaagaactaccactttgctcttgcaggatggaggcacctaagattgaccggatcagcgagcgggctggccataagtgcatggccactgaatctgttgatggagagttatcagggtgtaacgctgcaatcctgaagagggagaccatgcgtccaagctcacgtgttgcgctcatggtactgtgcgagacccaccgggcacgcatggtaaagcatcactgttgtcccggatgcggatatttttgtaccgccggaaccttcttagaatgtcatccggactttcgagtcgcccaccgatttcacaaagcctgtgttagtcagctcaacggcatggtgttttgcccccactgcggcgaagacgcttccgaggctcaggaagtgactattccccgtggcgacggggtgacaccacccgccggtacagcagctcctgcacccccaccactaagccaagatgtccccggacgcgcagacacatcacaaccctctgcgagaatgagagggcacggagagccgaggcgcccgccttgtgaccccttggcagacacaattgactcctctggtccgagcttaacactcccaaatggaggttgcctcagcgccgtcggattgcccctcggcccaggacgcgaagctctagaaaaggcactggtgattcaggagagtgagcggcggaaaaagttgagattccatccgcgtcagctgtatctgagcgttaaacagggggagctgcagaaagtgatcttgatgctcctcgacaatctggaccccaacttccagagtgatcaacagagcaaacgcacccccctgcatgccgccgcccagaaaggaagcgtcgaaatctgccatgtactcctccaagctggcgcaaacatcaatgccgttgataagcagcagcgcaccccactcatggaagccgtcgttaacaatcacctagaggtggcccgttatatggtacagagaggtgggtgtgtctactcaaaggaggaagacggaagtacatgtctgcaccacgctgcaaagattggcaatctggaaatggtgagcctgctcctgtccacaggccaagtcgatgtgaatgcgcaggacagtggcggctggacgcccataatttgggcggcggagcacaaacacattgaggtgatcagaatgctcctgacgaggggagccgacgtcaccttgacggataatgaggagaatatttgcctgcactgggcctcctttaccgggtcagcggccattgctgaagtgctgctcaacgcccggtgtgacttacatgcagtgaattatcatggggatacaccactccacatcgctgctcgggagtcataccatgactgcgtcctgctgttcttgtctcgtggagcgaatcccgagctacggaacaaggaaggtgatactgcctgggatctgactccagagcgttcggacgtatggttcgctctacagttaaaccgaaagctcaggttaggggtggggaacagggctatacgcaccgagaagataatatgccgtgacgttgctcggggttacgaaaacgttccaattccctgcgtgaacggggtggacggggagccttgcccagaggactataaatacatctccgagaactgcgaaacatctactatgaatatcgatcggaacatcacacaccttcagcactgcacttgtgttgacgattgtagctcgagtaattgtttgtgcggccagctctctattagatgctggtacgacaaagacggaagactgctccaggagttcaacaagatcgagccacccctcattttcgagtgcaaccaagcttgtagttgctggagaaattgcaagaaccgcgtggtgcaatcaggcattaaggtaaggctacagctgtacaggacagcgaagatgggatggggggtgcgcgcattgcaaactatccctcaaggaactttcatctgcgagtacgtcggcgagctgataagtgatgccgaggccgacgtgagggaggatgatagttatcttttcgatctggataataaggacggagaggtatattgtatcgatgcccgctattacgggaatatcagcaggtttatcaaccatctgtgcgaccctaatatcattccggtgagagtgtttatgctacaccaggacttgaggttcccaaggatagccttttttagttcaagggacattcggaccggggaggaattaggctttgactatggtgatcggttttgggacatcaaaagtaagtatttcacgtgccagtgcggcagcgagaaatgcaaacattccgcagaagccatcgctcttgaacagagtagattggccaggctcgacccacaccccgagctgttgccagagctgggaagcttacctccagtgaacacttag

SEQ ID NO: 186968 - DNA, 2667 bp, Artificial Sequence
  Description of Artificial Sequence: Synthetic coding sequence
agcgaggtggaggccctgaccgagcagctgagcgaggaggaggaggaggaggaagaggaagaagaggaagaggaggaggaggaagaagaagaagaggaggaggaggatgaggaaagtggaaatcagtcagatcggtcaggatctagcgggcgccggaaggcaaaaaagaaatggagaaaggactccccttgggttaaaccctccagaaagcggagaaagcgagagcccccaagggccaaagagccacgtggggtctctaacgatacaagtagcctcgaaaccgagaggggcttcgaggaactaccgctctgtagttgccgcatggaggcccctaagattgatcggattagcgagcgcgcaggacacaagtgtatggccacagagagtgtagacggtgaactgtctgggtgtaatgcggcgatcttgaagcgtgaaactatgcggcccagtagcagagttgccctcatggtcctgtgtgagacacaccgcgcgcggatggtgaaacatcactgctgtcctggctgtggatatttctgcaccgccgggactttcttggagtgtcatcctgactttagagtcgcccacagatttcacaaagcctgcgtttctcaacttaatgggatggttttttgcccacattgcggcgaagacgctagtgaggcacaggaggtgacaatccctagaggagacggggtgacgccgcctgcaggcactgctgccccagcaccccccccattgagccaggacgtgcctgggcgcgccgatacaagtcaaccttcggctcgcatgcggggccacggtgagccacgccgccctccatgtgacccgctagccgacaccattgacagctctgggcctagcctcacgcttccaaatggcggctgcttatctgccgtaggcctgccactcggtccaggaagagaggccttggaaaaagctctggtgatccaggaatcagagagaagaaaaaaactgcgttttcacccacgccagctctacttaagcgtgaaacagggagagttgcagaaggtgattttgatgttgcttgataatttggatccaaacttccagtccgatcagcagtcaaagcggactcccctccatgccgccgcccagaaagggagtgtcgagatctgtcacgtgctccttcaggctggcgccaacattaacgcagtcgataagcagcagcggacacccctgatggaagccgtggttaataatcatctcgaggtggctcggtatatggtgcaacgaggcggatgcgtttattccaaggaggaagacggatcaacatgtctgcaccacgccgctaaaattggcaacctcgaaatggtgtcccttctcctaagcaccggccaggtggatgtcaacgctcaggacagcggcggctggacccctatcatctgggcagccgagcacaagcatattgaggtcatcagaatgttactgactaggggagccgacgtgaccctcaccgacaatgaggaaaacatatgcctgcactgggcgtcattcacaggatctgctgcaattgccgaggtactgctgaacgcgaggtgcgacctgcatgctgtgaactaccatggcgacactccactgcacattgctgctagagagagttaccatgattgtgtgttgctcttcctttctcgtggagccaacccagagctacgaaacaaagagggcgacacggcttgggatctaactcctgaacggtctgacgtgtggttcgcactccagctgaaccggaagcttcgcttgggggtcggtaatcgcgccatacgaacagagaagatcatttgccgcgatgtggccagagggtatgagaatgtgcctatcccatgcgtgaacggtgtggacggggagccatgcccagaagactataaatatatatcggaaaactgtgagacgtcaactatgaatattgacagaaatattacccacttgcagcactgcacatgtgtggatgactgtagctcctcgaactgtctctgtggacagctgagcattaggtgttggtacgacaaggacggtcgattactgcaggaattcaacaagattgagccaccactgatatttgagtgcaaccaggcatgtagttgctggaggaattgcaaaaaccgggtggtgcaatccggcatcaaggtcaggcttcaactctatagaaccgctaagatgggctggggcgtgcgggcgctgcagacaattccccagggcacttttatttgtgaatacgttggagaactcatctccgatgcagaggcagacgtacgcgaagacgacagctacctgttcgatctcgataacaaagatggcgaagtgtactgtattgatgcccgttactacggaaacatttccaggtttattaatcatctttgcgatccaaacattatcccagtgagggtgttcatgctgcaccaggacctgaggtttccgcgtatcgcatttttcagtagccgagacattcggactggagaggagcttggctttgattatggagaccggttttgggatatcaaaagcaaatactttacatgtcagtgtggaagcgaaaagtgtaagcattcagccgaggcaattgcgctggagcagagccgcctcgcacgcttagacccacaccccgagctactcccggagctcggcagtctacctccggtgaatacctag

SEQ ID NO: 186969 - DNA, 3531 bp, Artificial Sequence
  Description of Artificial Sequence: Synthetic coding sequence
atggccgccgccgccggcgccgccgccgccgccgccgccgagggcgaggcaccggccgaaatgggagcactgcttcttgaaaaggaaacgcgaggagccacggaacgggtccacggatccctgggcgacactccccgctccgaggaaacactgcccaaagccaaccccgatagcctcgagccagcagggcctagctcgccagcaagcgtgactgtcacggttggtgacgagggcgcagacactccagtgggtgctacccctcttatcggagatgaatccgaaaacttggagggagatggcgatctccgcggtgggcggattttactcggccatgctaccaagagcttcccaagttctccaagcaaaggcgggtcctgccccagccgcgctaaaatgtccatgaccggggctggcaagtcaccaccgtctgtgcaatctttggccatgcggcttttgtctatgcccggcgcccagggcgcggctgctgctgggagcgagcctcctcccgctaccacatcccctgaagggcagcccaaagtacaccgcgcaagaaagaccatgtcaaagccgggaaacggtcagccccctgtcccagaaaagcggccacctgagatacagcactttcggatgtctgacgacgtgcattcgctaggcaaagtgactagtgatcttgcgaaaaggaggaaactgaatagcggcggcggactatcagaagaattgggctctgcacgtcgatccggcgaggtcacactcactaaaggcgatcccgggtctctggaagaatgggaaacagtggtcggcgacgacttcagcttgtactatgactcctattcagtcgacgaaagagtggacagtgatagtaaatccgaagtcgaggccctcaccgagcaattgtctgaggaagaagaagaggaagaggaagaagaagaagaagaggaagaagaagaagaggaagaggaggaggaagaagacgaggaaagcggcaatcagagcgaccggtccggctcatccggacgacgcaaagccaagaaaaagtggagaaaggattcaccatgggtgaagccgagccggaaacggcgaaaacgcgagcccccaagagctaaagagccccggggagtatccaatgatactagtagtctggaaaccgaacggggattcgaagagctccctttatgctcctgtagaatggaggctcctaagattgaccgcataagcgaacgtgccggacataaatgcatggccaccgagagcgtcgacggagaactgtcaggatgtaatgcagcaatactaaagcgagaaactatgaggccttcctcaagggtggcccttatggtactctgtgagactcaccgtgcacggatggtgaaacatcactgctgcccaggctgcggatacttttgtactgccgggacattcctggagtgtcaccccgatttccgggtcgcccaccgatttcacaaagcttgcgtgagccagcttaacggaatggttttctgtcctcattgcggggaggacgccagtgaggcacaggaggtgacaatccctcgaggggatggtgttacacctcccgccggcacagccgcaccggcccccccaccattgtctcaggacgtacctggaagggctgacacatctcagcctagtgcccgcatgcgcggccacggagagccacgacggccgccctgtgaccctctcgctgataccattgattcatctggtccctctctgacactgccaaacgggggctgcctgtcagctgtgggtctgccacttgggcctggacgtgaggctttggagaaggcgctggtcattcaagagtccgagcggcggaaaaagctgagattccaccctcgccagctatatctgtcagtcaaacagggggagctgcagaaggttatcttgatgctgcttgataatttggatccaaactttcagagtgatcagcaaagtaagcggactcctctccacgctgctgcacagaagggatctgtcgagatctgccacgtcctgctgcaggccggggccaacatcaatgccgtggataagcagcagcgaactccactgatggaggccgtggttaataaccacttagaagtggctagatacatggtccagcgtggcggctgtgtttatagtaaggaggaagatgggtccacctgcttgcatcatgcagcaaagatcgggaatttggagatggtgtcccttctgttgagtacaggacaggtggatgtgaacgcccaagactccggcggctggactcctatcatatgggccgctgagcataagcacatcgaagtcattcggatgctgctgacgagaggtgcagatgtgaccttgaccgataatgaagagaatatctgcctgcactgggcctcttttaccgggtcagccgctatagcagaggtgctccttaatgccagatgcgaccttcatgcagttaattaccatggtgatacgccgctacacatcgctgcacgggagtcataccacgactgcgtgctgctgtttttgtctcgcggagcgaacccggagctgcgcaacaaggagggcgatactgcctgggatttgacaccagaaaggtctgacgtgtggtttgccctgcagctgaatcggaagctgcgtctcggagtgggaaacagagctatccgcacagagaagattatctgtcgggacgttgctcgcggctacgagaacgtgcccattccatgcgtgaacggcgtcgacggggaaccatgcccggaagactataaatatatctcagaaaattgcgagacttcaaccatgaatattgaccggaacatcacacatctccaacattgtacgtgcgtggatgactgtagcagcagcaattgcttgtgcgggcagctgtcaatcagatgctggtatgacaaagatgggcgcctgcttcaagagtttaacaagatagagcctccactgatctttgaatgtaatcaagcctgctcctgctggaggaactgtaagaacagagtggtgcagagtggaatcaaggtgagattgcagctgtacaggacagccaaaatgggctggggggtacgcgcattacagacaattcctcaaggcaccttcatatgcgaatatgtaggcgaattaatttccgatgcagaagctgatgtacgcgaggatgacagctatctgttcgatttggacaacaaggacggcgaggtgtactgcattgacgcccggtattatggcaacattagtaggtttatcaaccatctgtgtgaccccaacatcatccctgtgcgggtgtttatgcttcaccaggatttacgattcccaagaattgcattcttttctagtcgagatattaggaccggggaggaattaggtttcgattacggagataggttctgggatatcaaaagcaagtacttcacttgtcagtgcgggagcgaaaaatgcaaacactctgccgaagcgattgcccttgaacagtctcgattagcgcgtctggacccacaccctgagctcctgcctgagctgggttcattaccacctgtaaacacctag

SEQ ID NO: 186970 - DNA, 3096 bp, Artificial Sequence
  Description of Artificial Sequence: Synthetic coding sequence
agctgccactgcacccccagctggccccccgtgcccgagaagcggcctccagaaattcagcacttccggatgtccgacgatgtgcacagcctcggtaaagtcacctctgacctagctaagcggcgcaagcttaacagtggaggggggctgagcgaggagctgggatccgctcggcgttccggcgaagtgaccctcactaagggtgacccaggctccctggaggaatgggagaccgtggtcggcgatgacttcagtttatattacgattcctactctgttgacgagcgagtggattctgacagtaaatccgaagttgaagccctcacggaacagctgagtgaggaggaggaggaggaagaagaggaggaggaggaggaagaggaagaggaggaagaggaggaggaggaggaggatgaagagtccggcaaccagagtgatcggtcagggtccagcggtagaaggaaggccaagaaaaaatggcgcaaggactcaccctgggtgaagcccagtcggaagcgccggaagcgcgagccccctagagcaaaggaaccgcgcggcgtgaacggagttggcagctccggtccaagtgaatatatggaggtccctttggggtccctggagctgccctctgaaggcacacttagtcctaatcacgccggcgtgagtaacgacacttcctctttggaaactgaacgtggatttgaggagttaccactgtgtagttgccggatggaagcccccaagattgatcgcatcagtgaacgggcaggacacaagtgtatggctactgagtcggttgatggcgaactctctggctgtaacgctgcaatactgaagcgggagaccatgaggccatcctctcgggtcgcccttatggttctgtgcgagacccacagagctaggatggtcaaacaccactgctgccctggctgcggatacttttgcaccgccgggaccttcttggaatgccacccagattttagagtggcccataggttccataaggcatgcgtcagtcaactaaatggaatggtgttttgtcctcattgtggggaggacgcgtcagaggcacaggaagttactatacctcgcggagacggggtcaccccccctgccggcacggctgcaccagctccccctcctctgagccaggatgttccgggcagagcagacacctcccagccctcagctcggatgagggggcatggggaaccaagacggccaccttgtgatccgctcgccgataccatcgattccagcggcccctctctcacacttccaaatggcgggtgcctgtctgcggtgggcctgcccctgggccccggccgtgaggcactcgagaaggctcttgtgatccaggagtccgaacggcgtaaaaaactgcggttccaccctcggcagttgtatctgtcagtgaagcagggagagctccaaaaggtaatcctgatgttgctggataatctcgaccccaactttcagtctgaccagcagtcgaaaagaacccctctgcatgctgcggcccaaaaaggaagcgtggaaatctgtcatgttctcttacaggctggagcaaatattaacgcagtggacaagcaacagcggacacccctcatggaagcagtcgtaaataaccatctagaggtagcaaggtacatggtgcaaagaggggggtgcgtctactccaaagaggaagatggcagtacctgccttcaccatgccgcaaaaatcgggaacctggaaatggtgtcccttctgttatctactggacaggtggatgtaaacgctcaggattcaggcggatggacgcctattatctgggctgcagaacacaagcatatcgaagttatccggatgcttctgacccggggcgccgatgtgactctgaccgataatgtgagcgagaggctggtggaggaggagaatatttgcctgcactgggcgtcctttaccggttcggctgcgatagccgaggtgctgctaaatgcccgctgtgatctacacgccgtgaactatcatggcgacactcccttacacatcgctgctcgcgagtcctaccatgattgtgtgctgctcttcttatctagaggcgcgaatccagaactgcggaacaaagagggggacacagcttgggatctgactccggagcggagcgacgtttggttcgccctccagctcaacaggaaactccggctgggagtaggaaacagagccattcgcactgaaaagattatctgcagggatgtggccagggggtacgagaatgtgcctatcccctgtgtgaatggagtggatggtgagccgtgccctgaggactacaaatacatctctgagaattgtgaaacgagcacaatgaacattgaccgcaatataacacacttgcagcattgcacgtgcgttgacgattgctcttcatctaactgtctgtgcggacagctaagtatcaggtgttggtacgataaggacggacggttgctgcaggagttcaacaagatagagccccccttgatcttcgagtgcaaccaggcttgtagttgttggagaaactgtaaaaatcgggtggtgcagtctggtatcaaagtcaggctacagctctatcgcaccgccaagatgggatggggtgtgcgggctctgcagaccatccctcagggtacgttcatatgtgagtatgtgggtgagttgatcagcgacgctgaagctgacgtcagagaagacgatagctacctgttcgatttggataacaaggacggcgaagtgtattgcatcgacgccagatactacggcaacatttcccgctttattaaccacctgtgcgacccaaacatcattccggtgagagtatttatgttacatcaggacttaaggtttccccgcattgcattcttctccagtagagacattagaactggcgaggagctcggatttgattatggcgacaggttctgggacatcaaaagcaagtactttacctgtcagtgtgggagcgagaagtgtaagcactctgcagaggccattgcactggaacagtccaggcttgctcgcctcgatccccaccccgaattactccccgaactcggcagcctgcctcccgttaatacttag

SEQ ID NO: 186971 - DNA, 3702 bp, Artificial Sequence
  Description of Artificial Sequence: Synthetic coding sequence
atgcggggcctgccccggggccggggcctgatgcgggcccggggcaggggacgcgcagcacctccaggttcccggggaaggggccgggggggcccccatcgcggacggggtaggcctcggtctctgttgtcgctgccgagggcacaagcctcgtggactccgcagttaagcacaggcctgacatcccccccagtgccttgtctgccctcacagggagaagccccagctgagatgggcgctctgctgctggagaaggaaactagaggcgccacggagagagtgcatggatccctgggtgacacacctcgtagtgaggagaccttgcccaaagcaacccccgattctttagagcctgctggtcccagtagtcccgcctccgtgactgtcacagtgggggatgagggagcggatacccccgtgggcgcaaccccactgatcggcgacgagagcgaaaaccttgaaggcgacggcgacctccgaggaggaaggatactcttgggtcacgcgactaagtccttcccctcctcacctagtaaaggcgggtcatgtccttcccgcgccaaaatgtcgatgacaggcgctggaaaatcaccgccgtctgtgcagagtctggccatgagactgttatccatgccaggagcccaaggcgctgcagcggctggctcggaacctcctccagcaaccacatctccggaaggccagccaaaggtgcacagggccaggaagactatgagcaaacctgggaacggccagcccccagtgcccgagaagaggccccctgagattcagcatttcaggatgagcgacgacgtgcacagtttaggaaaagtcaccagcgacttggccaagcggaggaaattaaactccggaggcggactgagcgaggagctgggatccgcccgcaggtctggggaagttacactgactaaaggggaccctggctccttggaggaatgggaaacagtggtgggggatgattttagcttatattatgattcctacagtgtcgacgaacgcgtagactccgacagtaagtccgaagttgaagccctgacagagcaactttccgaagaagaggaggaagaagaagaggaggaggaagaggaggaggaggaggaagaggaggaagaagaggaagaggacgaagagagtggtaatcagtcagaccgcagcggatcttctggacggcggaaggctaaaaagaagtggcgcaaggatagtccctgggtcaagccatctcggaagcgtcgcaagcgcgagcctccaagagcaaaagaaccacgcggggtgtccaacgacaccagctctttagagacagaacgcggattcgaagagctgcccctgtgtagttgtagaatggaagcgccaaaaattgatagaatttctgagagagccggacataagtgcatggcgacagaaagtgtggatggcgagttgtcgggatgcaatgccgccatcctcaagagagagactatgaggccaagtagtagagtggccctcatggttctgtgcgaaacacaccgtgctcgaatggtaaaacatcactgctgtcccggctgtggctatttctgtaccgccggcacttttctcgaatgccacccagactttcgggttgcgcaccgctttcacaaagcctgcgtgtcccagcttaacggaatggtcttctgtccacattgcggtgaagacgcgtcagaagctcaagaggttacgattccacgaggggatggggtaactcctccagctgggacagccgcccccgcgcctccaccgctttcccaggatgtgcccggtcgcgctgatactagccaaccctcggcgcggatgcgaggccacggagagcctcgaaggccaccctgcgatcccttggccgacacgattgactcaagcggcccgagtttgacactgcctaatggaggatgcctatctgccgttggcttaccactcggcccagggcgcgaggcactcgaaaaagcgctggtgatccaggagagcgaaaggcggaagaaattgcgctttcacccccgccagctctacctgtccgtgaagcagggagagttgcagaaagttatattgatgcttctggataacctagacccaaatttccaatctgaccagcaaagcaaaagaacccccctgcacgcagccgcccaaaagggttctgtagagatttgccatgtgctcctccaggctggcgctaacatcaatgctgtagataaacagcaacgtacccccctgatggaggctgttgttaacaaccaccttgaagtggcaaggtatatggtacaaagaggcggctgcgtgtatagcaaggaagaggatggctctacttgccttcaccacgctgctaagattggaaatttggagatggtgtcacttctgttgtctaccggacaagtagatgtgaatgcacaggatagtggcggatggacgccaatcatttgggcagccgagcacaagcatatcgaggttatccggatgcttctaacccggggagctgacgtaacgctgaccgataacgaggagaacatatgtttacactgggcaagctttactggctcagctgccatagccgaagtcttactgaacgcccgatgtgatctgcatgccgtgaattaccacggagataccccattacacattgccgcaagagaatcctatcacgactgcgtccttctatttctgtcccgaggcgccaacccagagctccggaataaagagggcgacactgcgtgggatctgacacctgagagatccgacgtatggttcgcattgcagcttaaccgtaagctcaggttaggagttgggaaccgggctattcgcacggagaaaattatatgccgcgacgtggcacgtggatacgagaatgtgcccatcccctgcgtgaacggagttgatggggagccctgtcccgaagattacaagtatatttcagagaactgtgagacatctacaatgaacatcgacaggaatattacccatctgcagcattgcacttgtgtagacgattgcagcagcagcaattgtctctgcgggcagttatccatccgttgctggtacgataaagatggaaggctgctgcaagagtttaataagattgaacctcctctcatcttcgaatgtaaccaggcctgcagctgttggaggaactgcaaaaacagggtggtccaatctggcatcaaggtcaggcttcagctataccgcaccgccaagatgggctggggagttcgggctttacagacaatacctcagggcacctttatctgtgagtatgtaggcgagctcatttccgatgcggaggcagacgttagggaggatgactcatatctgtttgacctggacaataaggatggggaggtgtattgtatagacgcaagatattatggaaatattagcagatttatcaaccatctgtgtgatcccaatataattcctgtgcgcgtttttatgcttcaccaagacttgcgttttccaaggatcgcttttttctccagccgagatatccggaccggagaggaactgggcttcgattatggcgatcgtttttgggatattaagtccaagtattttacctgtcagtgtgggtcagagaagtgcaagcattcagcagaagcaatcgcactggaacagtcacgactggcgcgcttagatccccaccccgagttattgcccgaactgggctcactcccccccgtaaatacgtag

SEQ ID NO: 186972 - DNA, 3804 bp, Artificial Sequence
  Description of Artificial Sequence: Synthetic coding sequence
atgcggggcctgccccggggccggggcctgatgcgggcccggggccgcggccgcgcagccccccccggatcccgagggcgcgggcggggaggtccccaccgtggcagaggacggcccagatctctgctctcactgcccagggcacaggcttcctggacccctcagcttagtaccggtcttacgtctccacctgttccgtgtcttcccagtcaaggtgaagctcccgctgagatgggcgcactgctcctagagaaagagacaaggggtgctaccgagcgggtccacggatcgcttggcgacaccccaaggtctgaggaaacgttgcctaaggcgaatccagactcactcgagcctgccggccccagttcacctgcgagcgttacggtaacggtaggggatgagggagccgatacccccgtgggcgctacacccctgattggcgatgagtcagagaatctggaaggcgatggggatctgcgcggcgggaggatattgttaggtcatgcaaccaaaagttttcccagctccccaagcaagggcggatcatgcccgagccgcgccaaaatgtctatgaccggagcaggcaaatcacccccgagcgttcagagcctcgccatgcgcctgctctcaatgcccggcgcccaaggtgccgctgccgccgggtccgaacctcctcctgccacaacatcgcccgaaggtcaaccaaaggtccaccgcgctcgcaaaacaatgtctaagcctggcaatggccagccacctgtcccagagaagaggccaccggagattcagcactttcggatgtctgacgacgtgcattccttgggtaaagtgactagcgaccttgccaagagacggaaactgaactccggtggtgggctgagtgaagagttgggaagcgcccgacggtcaggtgaagttactctcaccaaaggcgatccagggagtctggaggagtgggaaactgttgtgggagacgattttagcctgtactacgattcttactcagtcgacgaaagagttgactctgacagcaaatcagaagttgaagccctcactgaacagctcagtgaagaggaggaggaggaggaggaagaagaggaagaggaggaggaggaagaagaagaagaggaagaagaggaggacgaagaatccgggaaccaaagcgatcgatccggcagctcgggcaggcgaaaggccaagaaaaagtggagaaaggactccccatgggtgaagccttcaagaaagcgcagaaagcgggaaccgccacgcgctaaagaaccaaggggagttaacggtgttggttcctcaggcccttccgagtatatggaggtgcctctggggtccctcgagttaccctcagaaggcactctatcccctaatcacgctggggtgagtaacgatacaagctctctggaaacggaaagaggctttgaagaactgccattgtgcagttgtcggatggaagctcccaagattgacaggatctctgagagggccggccacaaatgcatggcaactgagagtgtcgacggcgaactgtcaggatgcaatgcagccatcctgaagagggagacgatgaggccttcatctcgggtcgctttaatggttctgtgtgaaactcacagagctaggatggtgaagcaccactgctgcccaggttgcggctatttctgtacagctggcaccttcctggaatgtcacccagactttagagtggcacatcggtttcataaagcgtgcgtctctcagctaaacggaatggttttctgtccgcactgtggagaggacgcaagtgaggctcaggaggttaccataccacgcggggatggagtgacaccccctgcaggcacagccgcccctgctcctcctccgttgtcccaggatgtgcccgggcgcgctgataccagccagccttcggcaagaatgcgcgggcacggggaaccccgacgcccaccatgtgacccattggccgatacaatcgattccagcgggccctctctaacgttgcccaatgggggatgcctgtcagcagtgggcctacccctgggcccaggacgcgaagccttagagaaagccctggttatacaggagtccgaaaggcgtaagaagttgagatttcacccaagacagctgtatttgtctgtgaaacagggagagcttcagaaagttattcttatgctgcttgataacctggacccaaactttcagagcgatcagcagagcaagcggaccccgctgcacgcagccgcacaaaaagggtctgtggagatctgccatgtactcttgcaggcaggcgccaatatcaacgcagtggacaaacaacagaggacgccacttatggaggcagtcgtcaacaatcatctggaggtcgctcgttacatggttcagcgcggtggatgtgtatacagtaaagaagaagatggctcaacctgcctgcaccatgctgcaaaaatcgggaacctcgaaatggtatccctcctccttagcaccgggcaggtagatgtgaatgcgcaggatagcggaggttggacaccaatcatctgggcagccgaacataaacatatcgaagtgattcggatgctactgactcgaggggcagacgtaaccctcacagacaacgaggagaatatatgtctacattgggctagcttcaccggaagcgctgcaatagcagaggtgctgctgaacgctcggtgcgaccttcacgctgttaactaccacggcgatacacctctgcacattgcggctcgcgagtcttatcatgattgtgttctcctgtttctgtcccgaggggcgaaccccgagctgcgcaataaggaaggagacacggcttgggaccttacccccgagcgatctgacgtgtggtttgccctgcagctgaataggaagctgagactaggagtgggaaatcgggccattagaacagagaaaattatctgcagagacgtcgcacgaggctatgagaatgtgcctattccatgtgtgaacggcgtggacggcgaaccctgtccagaggactacaaatacatcagtgaaaactgtgagaccagcacgatgaatattgataggaacatcacccacctccaacactgtacttgtgtcgatgactgcagtagcagcaactgtctatgcggtcagctctccattcgttgctggtacgataaagacggccgcctgctacaggaattcaacaaaattgaaccaccccttattttcgaatgtaatcaggcttgtagttgctggcgtaactgcaaaaatcgagttgtccaatctggcattaaggtgcgcctgcaactgtataggaccgcaaaaatgggctggggtgtgcgggcactgcagactatcccccagggaacatttatctgcgagtacgtaggagagctgatctctgacgccgaagctgacgtgcgcgaggatgattcctatctctttgacctggataacaaggacggggaggtttactgcattgatgcccgttattacggcaatatttcacgattcatcaaccacctgtgtgacccaaacataatccccgtccgcgtctttatgttgcaccaggatctcagattcccccgaattgcctttttttcaagccgggacattagaactggtgaggagctggggtttgattacggcgatagattctgggatatcaagagcaagtatttcacttgccagtgcggatctgaaaaatgtaagcactctgcagaagcaatagccctagaacagagtaggctcgcaaggctggacccgcaccctgagcttctgcccgaactgggatctctgcctcctgtaaatacttag

SEQ ID NO: 186973 - DNA, 897 bp, Artificial Sequence
  Description of Artificial Sequence: Synthetic coding sequence
tgaagcaagcggacccccctgcacgccgccgcccagaagggcagcgtggaaatctgtcatgtgctcctgcaggcaggagctaacatcaacgctgttgacaaacaacagcggacccctttaatggaggcagttgtgaacaaccacttggaagtcgcacgatacatggtgcagcgtggaggatgtgtttatagtaaggaagaggacgggtctacttgtctccatcatgccgctaaaattgggaatttggaaatggtatcattgctgttatctacagggcaagtcgacgtcaacgcccaggggcagctaccccctcccagcttgccctctcacccccaggattccggcggctggacccctattatctgggcagcagagcataaacacattgaagtcattaggatgctcctgacccgaggcgccgacgttaccctaaccgacaacgaggagaatatctgtctacattgggcatccttcaccgggtctgctgctattgcagaggtgctgctcaatgccagatgcgatctgcatgctgtaaactatcacggcgacacgcctttacatatcgccgcccgggagtcctaccatgattgcgttctgctgtttctgtcccgcggcgctaacccagaactccgaaacaaagagggcgacaccgcttgggacctcacgccagagcgatcggacgtttggttcgctctccagctcaacaggaagctcaggctcggcgttggcaaccgagccatacgaaccgagaaaattatctgtcgggacgtcgcgcggggctacgagaatgttcccattccatgtgtgaatggcgtggacggcgaaccgtgccctgaggattataagtacatctccgagaactgcgagacaagtaccatgaatatcgaccgaaactag

SEQ ID NO: 186974 - DNA, 897 bp, Artificial Sequence
  Description of Artificial Sequence: Synthetic coding sequence
tgaagcaagcggacccccctgcacgccgccgcccagaagggcagcgtggaaatatgtcacgttctactgcaagccggagctaacataaatgccgtagacaagcagcagcgcacgccccttatggaagcagtcgtgaacaatcatctagaggtcgctagatatatggtgcagagagggggttgtgtatatagcaaagaggaagacggaagcacctgtctgcaccatgctgcgaaaatcggcaaccttgagatggtttccctactcctgtccacggggcaagttgatgtgaacgcgcaaggacagctcccccccccctctctccccagccatccacaggattcaggcggctggactcctatcatttgggccgccgaacataagcatattgaagttattcgcatgttactcacccgtggcgctgacgttacgttgacggataacgaggagaatatctgcctccactgggccagtttcacggggagcgccgcgatcgcggaggtgttactgaatgcgcggtgcgacctccatgcagttaactaccatggagacactccgcttcacattgctgcccgggagagctaccatgactgtgtcctgctgtttctgtcccgaggcgccaatcctgaacttcgaaataaagagggcgacaccgcctgggatctcacccccgagcggtcggatgtgtggttcgctctgcagcttaacaggaaactccgcctcggggttggcaacagagccatcaggaccgagaagatcatctgcagagacgttgctcgcggctatgagaacgtgcctatcccctgcgtcaacggggtggatggggaaccatgcccagaggattataagtatattagcgagaattgcgagacatccacaatgaatatcgatcgcaattag

SEQ ID NO: 186975 - DNA, 3633 bp, Artificial Sequence
  Description of Artificial Sequence: Synthetic coding sequence
atggccgccgccgccggcgccgccgccgccgccgccgccgagggcgaggcccctgctgaaatgggtgccctgctcctcgagaaagagacgcgcggcgctaccgagagggtgcatggtagcctcggggatacaccccgttctgaagagaccctgccaaaagccacacctgactccctcgagcccgcaggcccgagctcacctgcgtccgtgactgttaccgtgggcgatgagggagccgatacgcccgtgggcgcaactcccctaatcggagatgaaagtgagaatctggaaggggatggagatttacggggcgggcgcatcctgctcggacatgctacgaagagcttccccagctccccttccaaaggtggaagttgtccctcgcgtgcaaaaatgagcatgaccggcgcaggcaagagtcctccgtcagtgcagtccctcgcgatgcgcttactctctatgcccggggcgcaaggcgcagctgcagctggctccgaacccccccccgcgaccacctcccccgaggggcaaccaaaggttcatcgcgcgagaaagaccatgagcaaacccggcaacggtcaaccccctgtccctgagaaaagaccccccgaaattcaacatttcagaatgagtgatgacgtgcacagcctagggaaggtgactagcgatttggccaaaaggagaaagttaaatagcgggggcgggctgagcgaagagctgggctccgcaaggcgttctggcgaggtgacattgaccaaaggagatcctgggtcccttgaggagtgggagaccgtggtaggagacgacttttccttatattatgattcatactccgttgatgaacgcgttgacagtgacagcaagtcagaagtggaagcgctcacggaacagttatctgaagaagaggaagaggaagaggaggaggaggaggaggaggaggaggaggaagaggaggaggaggaagaggaggacgaagagtcaggaaatcagtcggatcgttcaggatccagtggccgacggaaggccaagaaaaaatggcgcaaagacagtccctgggtgaagccatcaaggaaaaggcgtaaacgagagccaccaagggctaaggagccccgtggagtgaacggcgtgggatcctcaggaccttccgaatacatggaggtgcccttggggtccctcgaactgccatcagaaggtacactatccccgaatcatgccggagtgtctaacgacacctctagcctagagaccgagcggggttttgaagagctgccactctgtagctgcaggatggaggcacccaaaattgaccgcatttctgagcgagctgggcacaaatgtatggccacagaaagtgttgatggcgaactctccgggtgtaacgctgccatcttaaagcgggagaccatgcgaccttctagtcgggttgccctgatggttctgtgcgagacgcaccgggcccgcatggtgaaacatcactgttgtcctgggtgtggttatttttgtacagccggtacgtttctggagtgccacccagattttagggttgctcaccggtttcacaaggcttgtgtgtcgcaattgaacggaatggtattttgtcctcattgtggagaggatgcctccgaagcccaagaggttactatcccgcgcggcgacggcgttacccctccggctggaactgccgccccagctcccccacccttgtctcaggatgtccctgggcgggccgacacaagccagccctccgcacggatgcgtggacacggagagccgcgccggcccccctgcgaccccctggctgacactatagattcaagcgggccgtcattgacgctccccaacgggggttgcctgagcgcggttggcctgccattggggccagggagggaggcactggagaaggccttagtgatacaggaaagcgaaaggcgcaagaagttgcggttccaccctagacaactgtacttgtctgtgaagcaaggagagctacagaaggtgatcctcatgttgctcgacaatctagacccaaattttcagagtgaccagcagagcaagaggacgcccctgcatgccgcggcccaaaaaggctctgtggagatctgccacgtgcttctccaggcgggagctaacataaacgccgtggacaagcagcagcggaccccgcttatggaggcagtagtgaataatcatctcgaggttgcccggtacatggtgcagcgaggcgggtgtgtatactccaaagaggaggatgggagcacttgtctgcaccacgcagctaagatcggcaacctcgaaatggtgtctttgttgctgtccactggccaagtcgacgtcaatgcccaggattcaggaggttggacaccaatcatatgggccgcggagcacaagcacatcgaggtgatccggatgctgctgacacgcggagcagacgtgactctcactgacaatgaggagaacatctgtctgcattgggcaagtttcaccggatctgccgccatcgccgaagtcctgttaaatgcacggtgcgacttgcacgcggtgaattatcacggcgacacgccccttcatattgcggctagggaatcgtaccacgactgcgttctcctgttcctttcaaggggagccaatcctgagctgcggaacaaggagggcgatacagcctgggaccttacacctgagaggagcgacgtatggttcgcactccaacttaaccgaaaactccgcctcggggtagggaaccgggccatccgcaccgaaaagatcatttgccgtgatgtggcacgtggatatgaaaatgtacctattccgtgcgtgaacggtgtcgatggcgaaccatgcccagaggattataagtacatcagcgagaattgcgagacatctactatgaacatcgaccgtaacatcacccatctgcagcactgtacgtgtgtcgacgattgttcatcttctaactgtctgtgcggccaactctctatcagatgttggtacgataaagatggcagactgctgcaggaatttaataagatcgagccaccactgatattcgagtgcaatcaggcatgtagctgctggcgcaattgcaagaaccgagtggttcagagtggcatcaaggtccgtctccagctctacaggaccgcaaagatgggttggggggtgcgcgctttacagactattccccaggggacatttatatgcgaatatgtcggcgagctcatctccgatgccgaagccgacgtgcgtgaggatgattcctatttatttgatctcgacaacaaagacggcgaggtgtattgcatcgatgcgcgctattacggtaatatcagcagattcattaaccacctgtgcgaccctaatattataccggttagggtgttcatgcttcatcaagacttgcggttccctcgaattgcttttttctcatcccgcgacatcaggaccggcgaggaactgggatttgactatggcgatcgattctgggacatcaaaagtaagtattttacatgccagtgcggaagcgagaagtgcaagcactccgcagaggctatcgccctggagcaatcaaggttagcacgcctcgacccacaccctgaattgctgccagaactgggcagtttgcctccagtgaacacctag

SEQ ID NO: 186976 - DNA, 3531 bp, Artificial Sequence
  Description of Artificial Sequence: Synthetic coding sequence
atggccgccgccgccggcgccgccgccgccgccgccgccgagggcgaagcccccgctgaaatgggggctctgctgctcgagaaggaaacacggggcgctaccgagcgggtccacggctcactcggagacaccccccgaagcgaggagacactgccgaaggccactcctgattctctggagccggctggtccttcctctccggcgagtgtgacggtgacggtgggggacgaaggagctgacacccccgttggagccaccccgcttattggcgacgagtctgaaaacctcgagggagatggagatctcaggggcggcagaattctcttagggcacgctaccaaatcgttcccatcctcccctagcaaggggggctcctgtccctctcgggcaaagatgtccatgacaggcgctggcaagagtcccccaagtgtccagtccctggccatgcggctgctgtctatgcctggcgcgcagggcgcagccgccgccggtagtgaaccccctcccgccaccaccagcccagagggccagcccaaggttcatagggccagaaagaccatgtccaagcccgggaacggccaaccgcctgtgcctgagaaaaggccaccagaaatacagcattttcgtatgtccgatgacgtgcactccctgggaaaagtcacgagtgatttagccaagcgccgtaaacttaattcaggcggtgggttatctgaagaattgggcagtgccaggagatccggagaggtgaccctgaccaaaggcgatcctggcagcctggaggaatgggagacagtcgtgggagacgacttctcactgtactacgacagttactctgtggacgagagggtggatagcgactccaagagcgaggtagaggctctgacagaacagctgtccgaggaagaagaagaggaagaagaggaggaggaagaggaggaggaggaagaagaggaagaagaagaggaagaagacgaagagtcaggaaaccagagcgatcgttcaggcagcagtggcaggcggaaggccaagaaaaagtggcgaaaggacagcccatgggtaaagccatcccggaagcgcaggaagcgtgagccacctcgggctaaagagccaaggggtgtaagcaacgacacgagttctctggaaactgaacgcggctttgaagaactgcctctgtgttcttgtagaatggaagcccccaagatcgaccgcatatctgaacgagccggccacaagtgcatggcaacagaaagcgtcgatggtgaactgagtggctgcaatgcagccatactcaaacgggagacaatgcgcccgtcgtcacgcgtcgccctaatggtcctttgcgaaacccatcgcgcccggatggtgaagcaccactgttgtccagggtgcgggtatttttgtacagcggggacatttctggagtgtcaccccgattttagagtggctcacagatttcataaggcatgtgtctctcaacttaatggaatggtgttctgtccccattgtggagaggacgcttcagaagcgcaggaagttacaataccaaggggagacggcgtgactccacccgcaggcacagccgcaccagcaccgcctcccctgtctcaagatgtgcctggcagggccgataccagtcagccctcagcgaggatgaggggccacggtgagccaaggaggcccccatgcgacccgttggcagataccattgattcttcagggcccagcttgactctgccaaacggaggctgtctctctgccgtcggattacccctcggccccggtagggaggccctagagaaagcactcgttatccaggagtccgaaagaaggaagaagctaaggtttcaccccagacagctgtatttaagtgtgaagcagggggagttacagaaagttattctgatgctgctagacaatctcgaccctaattttcagtcagaccagcagagcaagcgcaccccattacatgcagcggcacagaaaggtagtgtggagatctgtcatgtactgctccaggctggagcaaacatcaacgccgttgataagcagcaaaggactccacttatggaggccgtggtaaataatcatctcgaagtggctagatacatggtgcaacgcggcggctgtgtgtattcgaaagaggaggacggctctacttgcctccatcacgctgcaaagatcggcaatctcgagatggtgtccttgctgttatccaccggacaggtcgatgtcaacgcccaggactccggagggtggacacctataatctgggccgccgagcacaaacacattgaggttatacgaatgttgctcacaaggggtgcagacgtaacattgactgataacgaggagaacatctgcctgcattgggccagttttaccggaagcgccgccatcgccgaggtgctgttgaacgctagatgcgacttgcatgccgtgaactaccatggtgatacgcctttacacattgctgctcgagaatcctaccatgactgcgtgctgttgttcctgtcaaggggagctaatcctgaactccgaaacaaagagggggacaccgcatgggatctgactcctgagcggagcgatgtctggtttgctttgcagctaaaccgaaagctgcgcctgggagtcggaaatagagcgatacgcactgaaaaaattatatgtagggatgtcgcccgaggctacgagaacgtaccaatcccctgtgtcaacggagttgacggcgagccttgcccagaagactacaagtacatctccgaaaactgtgaaacctcgacaatgaatatagatcgcaacattactcatctgcagcactgcacctgtgtggacgattgttccagttccaattgcctctgtgggcaactgtccatccgttgctggtatgacaaagacggcagactgctgcaggagttcaataagatagagccaccgctcatctttgaatgtaaccaggcgtgctcttgttggcgtaactgcaaaaatcgcgtagtgcaatcaggtatcaaagtccgtctgcagctgtaccggactgcaaaaatgggttggggcgtgcgggcccttcagacgattcctcagggtacatttatctgtgaatacgtgggagagctcatttctgatgctgaggctgacgtgcgggaagatgactcttatctcttcgatctggacaataaagacggggaagtctattgtatcgatgccaggtattacggtaacatttcgcggtttattaaccacctctgtgaccctaacataattcccgttcgggtcttcatgctccaccaggatttacggtttcccaggatagcatttttcagtagccgagacataaggaccggtgaggaactgggattcgattatggcgatcggttttgggatatcaagagtaaatacttcacatgccagtgtggcagtgagaagtgcaagcattcagctgaagcaatcgcactggagcaaagcagactggcccgcctggacccccatcccgagctgctccccgagttaggtagtctccctcctgtgaatacatag

SEQ ID NO: 186977 - DNA, 3702 bp, Artificial Sequence
  Description of Artificial Sequence: Synthetic coding sequence
atgcggggcctgccccggggccggggcctgatgcgggcccggggcaggggcagagccgccccgcctggttcgcgggggagagggagaggaggtccccaccgcgggcgaggcaggccacgctcgctcctgagcctgccccgcgcccaggcaagttggacgccccagctgagcaccggactcaccagtcccccggtcccctgcctgccaagccagggtgaggcccccgccgaaatgggagcgctgctgttggagaaagagacgcggggcgctacagagagggttcacggctccctcggcgacactcctaggtcagaagaaaccctccccaaggctaatcccgactctctggaaccggcagggccttcctctccagcaagtgtgactgttactgttggcgatgaaggagcagatactcccgtcggagccaccccacttatcggagatgagtctgagaatctggagggtgatggcgatctgagagggggccggattctgcttggccatgcaaccaagagcttcccaagtagcccgtccaagggcgggtcttgcccgtcacgggccaagatgagtatgaccggagccggcaagagcccccctagcgtacagtcactggctatgagactgctgtccatgccaggcgcgcagggggccgcggccgcaggatctgagcccccacctgctaccacctctccagagggacagccgaaagtccacagggccaggaaaaccatgtctaaaccaggtaatggccaaccaccggttcccgaaaagcgacctccagagattcagcattttcggatgtccgacgacgtccattcccttggaaaggtgacctccgatttggctaaacggagaaagctgaattcaggcggcgggttatctgaagaactcggtagtgctagacgttccggcgaggtgacactaacaaaaggagatcccggaagcctggaagaatgggaaaccgttgtgggtgacgacttctcgctgtattacgactcgtacagtgttgatgagagagtggactcagacagcaagtcggaagttgaagctctcactgaacagctgtccgaagaggaggaggaagaggaagaggaagaggaggaagaagaagaggaggaagaagaagaggaggaggaggaggacgaggaatccgggaatcagtcagaccggtctggtagttcaggcagacgaaaggccaagaagaaatggaggaaagactcaccttgggtgaaaccttctaggaagcggcggaagagggaaccacccagagccaaggagccgcgtggggtgtccaatgatacctcgagcctagagaccgagcgcgggttcgaagaactgcctctttgcagctgcaggatggaggctcccaagatagaccgtatcagcgaacgcgctggccacaagtgtatggccaccgagtcagtcgacggcgaactgtccggatgtaatgccgccattttgaagcgagaaactatgagacccagttcaagagtcgcattaatggtgctgtgcgagactcaccgggcccgaatggtgaagcaccactgctgccctgggtgtggatacttttgtacagcaggcaccttcctggagtgtcaccctgatttccgtgtggcccatcgttttcacaaagcctgcgtcagccagctcaacggtatggtgttttgcccacactgcggcgaggatgcttccgaagctcaggaagtcaccatcccaaggggcgatggagtgacacctcctgcagggaccgccgcaccagctccccccccccttagccaggatgtgccggggagggctgacacaagtcaaccatcagctcgcatgcgcgggcacggcgagccccggcgcccgccgtgtgacccgctcgctgacaccatcgattccagtgggccctctctgaccctccccaacggtggatgccttagcgcagttggtctgcctctgggacccggccgcgaagcactcgaaaaggccctggtgatccaggaaagtgaacggcgcaagaagctccgcttccaccctagacagctttacctgagcgtgaagcagggagaactgcagaaagtaattctgatgctccttgacaaccttgacccgaatttccagtcggaccagcagagcaagcgtacccccttgcacgccgctgcacagaaaggcagcgtcgaaatttgtcatgtactccttcaggccggggcaaacatcaatgcagtagacaaacagcagcgcactccactgatggaagctgttgtgaataaccacttagaagtggctcgctacatggtgcaacgcggcgggtgtgtatatagcaaagaagaggacggtagcacatgtcttcatcatgccgcaaaaataggcaacctcgaaatggtcagtctgctcctctctacaggtcaggtcgacgttaatgcccaggattccggcggctggacacccattatctgggctgctgaacataaacatatcgaggtgattaggatgctcctgacacgcggagccgatgtgactctgaccgataatgaagagaatatttgcctccattgggccagctttacagggtcagccgccattgcagaggtgctgctgaacgcgcggtgcgatctccacgctgttaactaccacggggacacacccctccacattgccgcaagagagtcgtatcatgactgtgttttgttgtttctcagcaggggggcaaaccccgagctgcgaaataaggagggtgacacggcttgggacctaacccccgaacgcagtgacgtgtggtttgcactgcaacttaaccgcaagctccggctgggtgtcggaaatcgcgcaattcggactgaaaagataatttgtcgtgacgtcgcccgcggatacgaaaatgtacctattccttgcgtcaacggtgttgacggggagccttgcccagaagattacaagtacatctctgaaaactgtgaaacttctacaatgaatattgatcgtaatattacccacctgcaacactgtacttgcgtggacgactgttcctccagtaattgcctgtgtggtcagttgtcgatacggtgctggtacgacaaagatggcaggctcctgcaggagttcaataagattgaaccacctctgatcttcgagtgcaaccaggcatgctcttgttggcgtaactgcaaaaaccgggttgtgcagtctggcattaaggttaggttgcagctgtataggaccgctaaaatgggttggggggtgcgcgcacttcagactatacctcagggtacattcatttgcgaatacgtcggtgaactgatctctgacgccgaggcagatgtcagagaggacgactcctatttatttgatcttgacaacaaagacggggaggtctattgcatcgacgcaagatattacggcaacatttcacggttcattaaccacttgtgtgaccccaacattatcccggtgagagtctttatgctgcatcaggatctacgatttcctcggatcgcctttttctccagccgggacatcaggacaggcgaggaactggggttcgactatggagacagattctgggacatcaagagcaagtacttcacatgtcaatgtgggagcgagaaatgcaaacacagtgccgaggccattgctctggaacagtctaggcttgcccggcttgacccccaccccgagctcttacccgaactcgggtctctgccacccgtgaacacctag

SEQ ID NO: 186978 - DNA, 897 bp, Artificial Sequence
  Description of Artificial Sequence: Synthetic coding sequence
tgaagcaagcggacccccctgcacgccgccgcccagaagggcagcgtagagatctgccacgtgttgttgcaagccggcgccaacataaatgcagttgacaagcagcaacgcacaccactgatggaagccgtcgtgaataaccaccttgaagtcgctcggtatatggtccagagagggggctgtgtgtattccaaagaagaagacggaagcacatgtctgcatcatgcagcaaagatcggcaacctggaaatggtctctctcctgctgtcgactggccaggtcgatgtcaatgcgcagggacagctgcctcctccctctttgcccagtcatccccaggactctggcgggtggacccctataatatgggcggcagaacacaaacacatcgaggtcattagaatgctgctgaccagaggagccgacgtcactttaaccgataatgaagaaaacatctgccttcattgggcgagcttcaccggatctgccgctattgctgaagtgctgctcaacgcacggtgcgaccttcacgcagttaattaccatggtgacactcctctgcatatcgcagcccgtgagagttaccacgattgtgtactcctgttcttgagccgcggcgccaaccccgagctgcgtaacaaagaaggtgatacggcttgggacctgacgcccgagagaagcgatgtgtggtttgcccttcagctgaatagaaagttacgcctcggagtcggtaatagagccatccgaactgaaaagattatatgcagagatgttgctcgagggtatgagaatgttccaataccctgtgtgaatggcgtggacggggaaccttgtccagaggattataagtacatctcagagaattgtgagaccagcactatgaacattgatcgaaactag

SEQ ID NO: 186979 - DNA, 3531 bp, Artificial Sequence
  Description of Artificial Sequence: Synthetic coding sequence
atggccgccgccgccggcgccgccgccgccgccgccgccgagggcgaagcgcccgccgagatgggagcattactcctcgaaaaagagacacgtggcgctaccgaaagagtgcatggctcattgggtgacactcctagaagtgaagagacactccccaaagccaaccctgattctctcgagcccgccggaccgtccagtcctgcctccgtcacagtgaccgtgggggacgagggggccgatacacccgtaggagcgacgcccttaataggagatgaatccgagaacctagaaggcgatggagacctaaggggggggcgcatactgctggggcacgccaccaagtcttttcccagttccccatccaaaggcggaagttgtccctctcgtgccaaaatgtccatgactggggccgggaagtctcccccctccgtccagtcactagctatgcgcctgctcagcatgcccggggctcagggcgctgctgcagccgggtctgagccacctcctgccaccacctcgccagagggccaacccaaggtacaccgcgcccggaaaactatgtccaagccaggaaacggtcaaccgcctgtccccgagaagcggcccccagagattcaacacttcaggatgtccgacgatgtacattcactcggaaaggtgacatcagatcttgctaagaggcgaaagctgaattccggtggcggtttaagtgaagaactggggtcggctaggcggagcggagaagtgaccctcaccaagggagaccccggaagtctagaggagtgggaaacggtcgtgggagatgatttctctttgtactatgattcctacagcgtggacgaacgagtggacagcgattccaagagtgaagttgaggctctgaccgagcagcttagcgaagaagaggaggaagaggaagaagaagaagaggaggaggaggaggaggaggaggaggaggaggaggaggaggatgaagaaagtggcaaccaatcagaccggagcggaagttctgggcgacggaaggctaagaaaaagtggcggaaagacagcccttgggtgaagcccagcaggaagcgccgaaagcgggagcccccacgggcaaaagaaccgagaggcgtttctaacgacacctccagcctcgaaacggaaaggggctttgaagagctcccgctctgttcttgccgcatggaagcacccaagatcgacagaatttctgaaagggccggtcacaaatgcatggctactgagagtgttgatggcgaactgtctggctgcaacgcagccatcctgaagcgagaaacaatgcgaccctcctctcgcgtggcactaatggtgctatgcgagactcaccgcgccaggatggtaaagcatcactgttgtccaggctgcggttatttttgtaccgccggaaccttcctcgagtgtcatcctgattttcgcgttgcccatcgatttcacaaggcttgtgtgtcccagcttaacggaatggtcttctgtccgcactgcggagaggatgcatccgaagcacaagaagtcacgatccctaggggcgacggggtcaccccgcccgctggtaccgccgcacctgcgcctccacccttgagccaggacgtacctggccgggcagatactagccaaccatcggcacggatgagagggcacggcgaacccagacgacctccttgcgacccgctggctgacacaattgattctagcggaccctctctgactcttcctaacggtggatgtttgagcgccgtagggctgcctctgggtccaggccgcgaagctctcgagaaggcccttgtgattcaagaatccgagcgtagaaaaaagctgaggtttcacccacgccagttgtatctctccgtgaagcagggggagcttcaaaaggttattctgatgttattggacaaccttgatccaaacttccagagtgaccagcaatcaaagaggactcccttgcatgcagcagcccagaagggctccgtcgagatctgtcatgtcttgctccaggccggagccaacatcaacgccgtcgataaacagcagcgcactcctttgatggaggctgtggtgaacaaccaccttgaagtggcccgttatatggtgcagagaggggggtgtgtgtatagcaaggaagaggacggtagtacatgtctgcatcatgccgctaaaattggtaaccttgagatggtcagtctgctgctgagcactgggcaggtcgacgtgaacgcacaggactcaggaggctggacacccatcatctgggctgctgaacataagcacatcgaggtcataagaatgcttctgacaaggggagccgacgtgaccctgacagataacgaagagaatatttgcttacattgggcatcattcaccggcagcgccgccatcgcagaagtgttactaaatgcaagatgcgacctgcacgccgtcaactaccacggagataccccactgcatattgcagcaagagagtcatatcacgactgcgtcctcctgttcctgtcccgtggggccaaccccgaattgaggaataaggagggggataccgcttgggacctgaccccagagagatccgatgtttggttcgcacttcagttgaacagaaagctgcggcttggggtaggaaaccgtgcgatcaggacagaaaaaattatttgtcgggacgttgcaaggggctatgaaaatgtgcctatcccatgcgtcaacggcgtggatggtgagccctgccccgaagattataaatatataagtgagaactgtgagacttctactatgaacatagatagaaatatcacccacttgcagcattgtacttgcgtcgatgactgtagttcatcgaattgcttatgcggacagctctctatacggtgttggtacgacaaggatggcagactgctgcaggaatttaataagattgaaccgccattaatctttgaatgtaatcaggcttgctcatgctggcgcaattgcaagaaccgggtggtccagagtggtattaaagtacgcctgcagctctacagaactgcgaagatgggctggggggtgagagcactccagaccataccacagggaaccttcatatgcgaatatgttggcgaacttatttccgacgccgaagcagacgtaagggaggatgatagctatcttttcgatctggacaataaagatggagaggtgtactgtatcgatgccagatattatggcaacatctctcgtttcattaaccacctgtgcgaccctaacattattcccgttagggtgttcatgctccaccaggatctccgctttcctcggattgcttttttctccagcagggacatacgtacaggcgaggaactaggattcgactatggtgatcgattttgggacatcaagagtaaatacttcacatgccagtgcggatcggagaaatgcaaacactccgccgaggctattgcactggaacagtcccggctggccaggctcgacccccaccccgagttactccccgagctaggcagcctgcctccggtgaatacctag

SEQ ID NO: 186980 - DNA, 2667 bp, Artificial Sequence
  Description of Artificial Sequence: Synthetic coding sequence
agcgaggtggaggccctgaccgagcagctgagcgaggaggaggaggaggaggaagaagaagaagaggaggaagaggaggaggaagaggaggaagaggaagaagaggacgaagagtcaggcaatcagtccgaccgatctgggtcatctggccggcggaaagcaaaaaagaagtggcggaaggatagtccctgggtaaagccaagcaggaaaagacgcaagcgagagcccccacgagccaaagaaccacgcggagtgagcaatgatacctcttctctagaaaccgaacgggggtttgaagaactgcccctctgctcatgtcgcatggaggccccaaaaatcgacagaattagcgagcgggccggccataaatgcatggccaccgagagtgtggatggagagttgagcgggtgcaatgcagcgattttgaaacgggagacaatgcggccctccagcagggttgcgttaatggtcctgtgtgagacacacagagccagaatggtgaagcaccactgctgtccaggctgtggctacttctgtaccgctgggacttttctcgaatgccatcccgacttccgggtagctcatagatttcataaggcatgcgtctcccagctgaacggcatggtgttttgtccacattgtggggaggacgctagcgaggcacaggaggttacaattccacgcggcgacggcgtgacccctccagccggaacagcagccccagctccaccccctctctcccaggacgttcctggcagggccgacacttcacagccttcagcaaggatgcgcggtcatggcgagcctaggcgaccaccctgcgacccccttgcggataccattgactcttctggcccttcacttacattgccgaatggcgggtgcttatcagccgtgggcttacccttgggtccaggccgggaggccctggagaaggcactcgtgattcaggagtccgaacggcgcaagaaacttcgtttccacccccgccagctctacctgtcagtcaagcaaggcgaactgcagaaagtgatcctgatgctgctagataatttagacccgaactttcaatcagaccagcagtccaagcgtactcctctccacgccgccgcgcagaaagggtccgtggaaatctgccacgtgctgctgcaagcaggggctaacataaacgccgttgacaagcagcagagaacgcctctgatggaggcggtggtgaacaaccatttggaagtggccagatatatggttcagcggggaggctgcgtctatagtaaggaggaggacggatccacttgtctgcatcacgcggctaaaatcgggaacctcgagatggtctccctcctgctgagcactggacaggtcgacgtgaatgctcaggactctggcggttggactcctattatttgggcagccgagcataaacatattgaggtgattcgcatgctgctcaccaggggcgctgacgtgaccctcacagataacgaggagaacatatgcctacactgggccagcttcacgggaagcgccgcaatagctgaagtgttactcaacgcacgctgtgatcttcatgccgtgaattaccacggggacaccccccttcacatcgccgccagggaaagttaccacgattgtgtgctgctgtttttgtcccgcggcgcaaaccctgagctgcgcaataaggaaggggacacagcttgggatctaacccccgagcgcagcgatgtttggtttgcgctccagctgaacagaaagttacgccttggagtcggcaacagagcgatccggactgagaaaatcatctgccgggacgtggcaaggggctatgagaatgtccccattccctgtgtgaatggagtggacggcgaaccctgcccagaggattacaaatatatctcagagaattgcgagaccagcactatgaacattgaccgtaatatcactcacctgcagcattgtacgtgtgttgacgattgcagtagctctaattgtctctgtggccaactttccatccgttgctggtatgataaagacggaaggttgctgcaggagtttaataaaatcgaacctccacttattttcgaatgtaatcaggcctgctcttgctggcgcaattgcaaaaatagagttgtacagagcgggatcaaggttagactacaactttataggactgcaaagatggggtggggggttcgggccctgcagactatcccacagggaaccttcatttgcgagtacgtgggcgaattgatcagtgacgctgaagcagacgtaagagaagatgattcctacctatttgatttagataacaaagacggtgaagtttactgcatagatgcccggtactacgggaatatctctcgttttatcaaccatctctgcgatcctaatatcatcccagtgagagtttttatgctgcaccaggatctgcggttccccagaattgctttctttagttctagggacattcgcaccggtgaggaactcgggttcgattacggagatagattctgggatatcaaatccaaatacttcacatgccaatgtggctccgaaaagtgcaagcatagcgccgaagcgattgccttagaacaatcaaggttggctagactcgaccctcacccggagctactaccagagttgggatccctgccgcccgttaacacctag

SEQ ID NO: 186981 - DNA, 2769 bp, Artificial Sequence
  Description of Artificial Sequence: Synthetic coding sequence
agcgaggtggaggccctgaccgagcagctgagcgaggaggaggaggaagaggaagaggaagaggaagaggaggaggaggaagaggaagaagaggaggaggaggaggacgaagagagcggtaaccagtctgaccgatctgggagttcgggacgcaggaaagccaagaaaaaatggagaaaagacagtccatgggtgaagcccagtcgcaagcgtcggaaacgggaaccccctcgggccaaggagcccagaggcgtcaatggagttgggagttcaggcccttccgaatacatggaggtgcctctcggttccctggagcttccctccgagggaaccctctcacctaatcacgccggtgtgagcaatgacacttcgagtctggaaaccgagaggggcttcgaggaactgccactgtgcagctgtcgcatggaggcacctaagatcgatcggatttccgagcgggcggggcataagtgtatggcaacagaatctgttgacggggagctttccggatgcaacgccgctattctgaagcgcgaaactatgaggccttcttctcgggtagccctgatggtcttgtgcgaaacacatcgggcgagaatggttaaacaccactgttgtccaggatgtggctacttctgtacagcgggtacattccttgagtgccatcctgactttcgggtcgcacacaggtttcataaagcgtgcgtctcgcagcttaatggaatggtgttctgccctcactgcggagaagacgcctcggaggcgcaggaggtaaccattccacgtggtgatggagtaacacctcctgctggtacagcagcccctgcccccccaccactgagtcaggatgttcctggccgggctgacacatctcagccctctgcacgtatgaggggccacggtgagccccggaggccgccttgtgaccctctggcagacaccattgactcttccggaccgtctcttacgctgccgaatggtggttgcttgagcgccgtcggcctcccgctgggtcctggccgggaagcgctggaaaaagcgctcgttatccaagaatccgagcggagaaagaagctgaggttccatccaagacaactgtatctatctgtgaagcaaggagagctacagaaggtgattttaatgttgcttgataacctggatccaaattttcagtctgatcagcagagcaaaaggaccccgctgcacgccgccgcacagaagggctctgtggagatctgccacgtactgctccaggcaggcgcaaatattaacgctgtcgacaagcagcaacgcacgccactgatggaagcggtggtgaacaaccacctcgaggttgctagatacatggtgcaaagaggaggctgcgtgtattcaaaagaggaagacggaagcacatgcttacatcatgcggccaagatcgggaacctggaaatggtttcgctcctcttgagcaccggccaagtagacgttaacgcacaggattcaggcggctggacccctatcatctgggcagctgaacacaagcatatcgaggttatccggatgttgctgaccagaggagctgatgtgactctgaccgacaacgaggagaatatctgtcttcactgggcgagttttacagggtccgctgcgatcgccgaggtgctgttgaatgctagatgtgacctgcatgccgtcaattaccatggtgatacacccttgcacatagcagctcgagagtcttaccacgactgcgttcttctgtttcttagcaggggtgctaatccggagttacgcaacaaggagggcgacacagcgtgggacctaacaccagagcgaagcgatgtctggttcgctttacagctgaaccgcaaactgagactcggcgtgggaaatcgagcaatcaggaccgaaaaaattatctgtcgtgatgtcgcacgaggttatgagaacgtaccaatcccctgcgtgaacggcgtggatggcgaaccatgtcccgaggattacaaatatatctctgaaaattgcgagacttccaccatgaacatcgacagaaacattactcacctgcagcattgcacttgcgtggacgattgtagctcaagtaactgtctgtgcggccagctgtccatcaggtgctggtacgataaggatggcagactgctccaggagtttaacaaaatagagccaccgctgatctttgagtgtaaccaggcctgcagctgctggaggaactgcaagaacagggtggttcagtctggaattaaggtccgcctccagctttaccgcaccgcgaagatgggatggggggtcagagccttacagacaatcccccagggaacatttatttgtgagtatgtaggggagctcatttccgacgccgaggccgatgtgagagaggatgactcctacctattcgacctcgacaacaaggacggcgaagtttactgcatcgacgccagatactacggcaatatatcccgctttatcaaccacctatgcgatcctaacataataccagtccgagtgtttatgctgcatcaagatcttcggtttccccgcatcgcatttttctcgagtcgagacatcagaactggggaggaactcggctttgattacggcgacagattttgggacatcaagagcaagtacttcacctgtcaatgtggtagcgaaaagtgcaaacattcagccgaggctatcgcactagaacagtctagactggcacgcctggacccccaccctgaactgctcccggagctgggcagcctgccgcccgtgaacacttag

SEQ ID NO: 186982 - DNA, 3096 bp, Artificial Sequence
  Description of Artificial Sequence: Synthetic coding sequence
agctgccactgcacccccagccggccccccgtgcccgagaagcggccacccgaaatccagcactttagaatgagcgatgatgtgcattccctgggaaaggtgacctccgatctggccaagagacgaaagctgaattccggaggagggttgtctgaagaactgggcagtgcacggcgctccggggaggtcacgttaacgaagggcgatccaggctctcttgaggagtgggaaacggtcgtcggggacgacttttccctgtactatgactcttactccgtcgatgaaagagtggattctgattccaagagcgaagtggaggccttgactgaacagctctcggaagaagaggaggaggaagaggaagaagaggaagaagaggaagaagaggaagaggaggaagaggaggaagaagatgaggagtccgggaaccagagtgacaggtctggttcctctgggcgtagaaaagcaaagaagaagtggcggaaagacagcccctgggtgaagccctcacgcaagaggcggaagagagagccgcccagagccaaggaacctcgaggcgtgaatggtgtgggtagcagcggcccgagcgaatatatggaggtgcccttagggtcactcgagctgcccagtgaaggtactctgtctccaaatcacgctggagtcagtaatgacacttctagcctggagactgaacgggggttcgaggagctgcctctgtgttcatgcaggatggaggccccaaagatcgatcgcattagcgagcgcgccggacacaagtgcatggcaacagagtctgtggacggcgaattatctgggtgcaacgctgcaatcctgaaacgcgaaaccatgaggccgagctcacgagtggctcttatggttctatgtgagacacacagagctaggatggtcaagcaccactgttgtcctggctgcggctatttctgcaccgccggtacttttttggagtgccaccccgacttccgtgtcgcacatagattccataaggcttgcgtgagccagctaaatggaatggttttttgtcctcattgcggtgaggacgcttctgaagcccaggaggtcaccataccaagaggtgatggggtaacccctccagccggcactgccgcacccgctccgcctcccctgtcgcaggacgtccctggacgagccgataccagtcagcccagcgcacgcatgcggggacatggcgaacctagacgtcctccttgcgaccccctggccgacactatcgactcctcgggaccctccctgactctccctaacggtggctgcctgtcagcagtcggcttgccattgggacccgggcgcgaggccctcgagaaagcgttggtcatccaggaatctgagaggaggaagaagttgcgattccacccccgccagctgtatttgtcagtcaagcagggtgagctgcagaaggttatcttgatgctcttggacaacttggaccctaactttcagtcagaccagcagtccaagcgcactcccctccatgcagcagcccagaagggctccgtagaaatctgccatgtacttctccaagccggtgcgaacatcaatgctgtggacaagcagcagcggactcccctgatggaggccgttgtgaataaccatctggaggttgccaggtacatggtgcagaggggcgggtgcgtgtattctaaagaggaggatgggtccacttgtctgcaccatgctgccaagattggcaatttggagatggtgagcttattgcttagcaccgggcaggtagatgttaacgcccaagactctggaggatggactcctattatttgggcggctgagcataaacatatagaagtaatcagaatgctgctgacccgcggtgctgatgttacactgactgacaacgtttctgagcgcctggtggaagaggagaatatttgcctacactgggcttcattcactggcagcgcagcaatcgctgaggtgttacttaatgcgaggtgtgacctccacgccgtaaactatcatggagatactccacttcacattgccgcccgcgagagttaccatgactgcgtgctgctgttcctttcgcggggggcaaatcccgaactgcggaataaggaaggcgacacagcctgggatctaacccctgagcggtcggatgtctggtttgccctgcagctgaatcggaagctgaggctcggcgtcgggaacagggccatcagaaccgaaaagattatctgtagagacgtggcacggggctatgagaacgttccaatcccctgcgtcaacggcgtcgacggggagccctgtcctgaagattataaatatataagcgaaaattgtgaaacttcaactatgaatattgaccgcaacataacacatcttcaacattgtacttgtgtggacgactgctcttctagcaattgcctgtgtggtcagctctctattagatgttggtacgataaagacgggagactcctccaggagtttaacaaaatcgaaccccccctcatctttgagtgcaaccaagcctgcagctgctggaggaattgcaaaaatcgtgtggtccaatctggcataaaggtccgtctccagctctatcgtactgcaaaaatgggttggggggtgcgggctctccagaccatcccccagggcactttcatttgcgagtacgtcggagaactcattagcgacgccgaggccgatgtgcgcgaagatgattcctacctctttgatttagacaataaggacggagaggtgtattgtatcgatgccaggtattatggaaatatctcccgcttcataaaccatctgtgcgacccgaacattatccccgtgagggtgttcatgctgcaccaagaccttagattccccagaatcgcttttttttcctcccgggacatcaggacgggagaagagctgggattcgattatggcgaccggttctgggacataaagagcaaatattttacatgtcaatgtggttcggagaaatgcaagcatagcgctgaagccattgctttggagcagagtaggctggctaggttagatcctcatcccgagttgctgccagaattaggtagcctcccgcctgtgaatacatag

SEQ ID NO: 186983 - DNA, 3096 bp, Artificial Sequence
  Description of Artificial Sequence: Synthetic coding sequence
agctgccactgcacccccagctggccccccgtgcccgagaagcggccccctgagatccaacacttcaggatgagcgacgacgtgcactctctcggtaaagtgacttcggacttggccaaacgcaggaaactcaatagcggcggcggattgtcagaagagctgggctcagctcgccgatccggcgaggttacattgacgaagggcgacccgggatccctcgaagaatgggaaaccgtagtcggtgatgatttttctctgtattatgactcctattctgtggacgagcgtgtcgatagtgactctaagtccgaggtggaggctctcactgagcagctgtcggaagaagaggaagaagaggaggaggaggaagaggaggaggaagaggaggaagaggaggaagaggaggaggaagacgaggaatcaggcaatcagtcagatcggagcgggtccagcgggaggaggaaagcgaaaaagaagtggaggaaagatagcccttgggtcaaaccctccagaaaaaggcgtaagagagagcctcctagggctaaggaaccccgaggggtgaatggggtgggaagcagcgggcctagcgagtacatggaagtccccctggggtcacttgaactccctagcgaaggaactctcagccccaaccatgccggtgtatcaaatgatactagctccctggaaacggagcgtggatttgaggagcttccactgtgttcctgtcggatggaggctcccaaaatcgaccgtatctctgagcgtgccggacacaaatgtatggcaacggagtcagtggatggtgaactctctggctgtaacgcggctatactgaagcgtgagaccatgaggccctcttccagagtcgctctgatggtgttgtgtgaaacgcaccgggctcgtatggtgaaacaccactgctgccccggctgcggatatttctgcacagccggcaccttcttggagtgccatcccgattttagggtcgctcatcgctttcacaaagcttgcgtgtcacaattgaacggtatggttttttgccctcattgcggagaagatgccagcgaggcccaggaggttactatacctaggggcgatggcgtgactcccccagctggcactgctgccccggcgcccccgcctctgtcccaagacgtgcccgggcgggccgacacctcccagccctctgcacggatgcgaggtcacggggagccccgccgcccaccttgcgaccccttggccgacactatcgatagctcaggaccttccctgaccttacccaatggtggctgtctatccgccgtcgggctgcctctcggacctgggcgtgaggccctggagaaagcactggttattcaagagagtgaacgccgcaaaaagctcaggttccatccccggcaattgtatctgtctgtgaaacaaggggagcttcagaaggttatactgatgttattggacaacttggacccaaacttccaaagcgatcaacaaagtaagaggaccccactacatgctgccgcccaaaaaggctctgtggagatttgtcacgtgcttctccaggctggagccaacattaacgccgtggataagcagcagcggacacccttgatggaagccgtagttaacaatcatctggaggtggcccggtacatggtgcaacgtggagggtgcgtctactctaaggaagaagatggttccacgtgtctgcaccacgccgctaaaatcggtaacttggaaatggtttccctcttgttgtccaccggacaggtggacgtgaacgcccaagatagtggaggatggacaccaatcatctgggcagctgagcacaaacacattgaggtcatacgtatgctgctgacacgcggtgcagacgtgaccctgacggacaatgtgtctgaacgtctcgttgaagaagagaacatctgtctacattgggcctcattcacggggtctgcagcgattgctgaagttctgttgaatgctcgctgtgacctgcacgccgttaactatcacggggacacccccctgcacattgctgcccgtgagtcctatcacgattgcgtgctcctgttcctgagtcggggggcaaaccccgaactacggaacaaggaaggagatacagcgtgggacctgactcccgagagatccgacgtctggttcgcactgcagcttaatagaaaactgaggttaggagtgggcaacagagccatacggaccgaaaaaatcatatgccgggatgtggcaagagggtacgagaacgtgcctattccatgcgtgaacggtgtggatggggaaccctgtccagaggattacaagtatatctctgagaactgcgaaacatccacaatgaacatcgatcgaaatattacacacctgcagcactgtacctgcgtcgatgactgctcctcctctaattgtctgtgtggacagctttccattcgttgttggtatgataaagacgggcggctcctgcaggagttcaataaaatcgagccccctttaatcttcgagtgcaaccaggcgtgttcttgttggcgcaattgtaagaacagggtcgtgcaaagcggtattaaagtgaggctgcagctctatagaacagccaagatgggatggggagtccgcgcactgcaaactatcccccagggcacatttatctgtgaatacgtgggtgaactgatatcggatgcggaagcagatgtgcgagaagatgactcttatctgtttgatctcgacaacaaagatggcgaggtctactgtatcgacgcaagatattacggcaacatatctcggttcatcaaccatttatgtgacccaaacataatccccgttcgggtgtttatgctgcaccaggacctccgattcccccgcatcgcattcttttccagtagagatatacggaccggcgaggagctcggcttcgactacggcgaccgtttttgggacataaagtcaaaatactttacatgtcagtgtggctccgagaagtgtaaacattccgccgaggcaatagctttggaacagagtcgtttagcaagattggacccccacccagaacttcttcccgagttaggaagccttccccctgtcaacacctag

SEQ ID NO: 186984 - DNA, 3096 bp, Artificial Sequence
  Description of Artificial Sequence: Synthetic coding sequence
agctgccactgcacccccagctggccccccgtgcccgagaagcggcccccagagattcagcacttccggatgtccgatgatgtgcattcactcggtaaggtaacctctgatctcgccaaaaggaggaagttaaactctggcgggggactgtccgaagagcttggctctgcccgccggtccggggaggtgaccttaaccaagggagacccagggtcacttgaagagtgggagacagttgtgggcgatgatttctccctgtactatgattcttactcagtcgatgaacgggtggactctgactccaagtcagaagtggaagctctaacagaacagctctccgaggaggaggaggaggaggaggaagaggaggaggaggaagaggaggaggaggaggaagaggaggaggaggaagatgaggaaagcggcaaccagagtgatcggtcaggaagcagcggtcgtcgcaaggcaaagaaaaagtggcgcaaggattcaccctgggtgaagccgagcagaaaacgccgaaagcgcgagccaccacgagcgaaggagcctcggggtgtaaacggtgtgggctccagcggacccagtgagtatatggaagttccactggggagtctggagctgccctctgaggggaccctctcacccaaccatgctggtgtgtccaacgacacatcctctctcgagacggagcgaggcttcgaagaacttcccctgtgtagctgcagaatggaagctccaaaaatcgatcgcattagcgaacgcgctggccacaaatgcatggctaccgagagcgtggacggagagctctctggctgcaacgctgcaattttgaagcgcgagacaatgcgtccttcttctcgggtggctttaatggtgctgtgcgaaacccatcgcgcaaggatggtcaaacaccactgctgtccaggatgtgggtatttctgcaccgctgggacctttttggagtgccatccagattttagggttgcacaccgctttcacaaagcttgtgtctctcagctgaacggaatggtgttttgcccccactgtggagaggacgcttcagaggcccaagaagtcaccataccccgcggggacggggtcacgccgccagctggcactgccgccccagctccgccccccctttcgcaagacgtccctggacgcgccgatacaagtcagccctccgcccggatgagaggccacggcgagcctaggaggccaccttgcgatccactggcagacacaattgactcctctggcccatctctgactctgcctaatggaggatgcctgtccgccgtgggactgcccctgggccctgggcgggaggctcttgagaaagctctggtgatccaagagtcggaaaggaggaagaagctcaggtttcatcccaggcagttgtacttatcagttaaacagggtgaactccagaaggtgatcttgatgctgcttgacaatctggacccgaattttcagtctgaccagcaatccaagcggacaccactgcacgcagcagcccagaagggaagtgtggagatatgccatgtcttgctccaagccggtgccaacatcaacgcagtggacaagcaacagagaacacccctcatggaggctgttgtaaacaaccaccttgaggttgctcgctacatggtgcaacgcggtgggtgcgtgtattctaaagaagaagatggcagcacctgtcttcatcacgcagcaaaaatcggaaacctcgaaatggtgtctctgttgctcagcaccggtcaggttgacgttaacgctcaggacagcggagggtggacacccatcatttgggcagcagagcataagcacatcgaggtgatcagaatgctcctcacccggggagcagacgtgacactgacagacaatgtgtctgagagattagttgaggaagagaacatctgccttcactgggcttctttcacaggaagcgcagccatcgccgaggtcctcctgaacgcccggtgcgacctacacgccgttaattaccacggagacactccattgcacattgcagcgcgggaatcatatcacgattgcgtgctgctgttcctgtccaggggcgctaatcccgagctgagaaataaagagggcgacaccgcctgggacctcacccctgagcgcagcgacgtgtggtttgccctccagctgaatcgcaagttgagactgggggtcgggaaccgtgctattaggacggagaagatcatctgtcgtgatgttgcccggggctatgaaaatgttccaatcccctgcgtgaatggcgttgacggtgagccatgccccgaggactataagtatatcagtgagaattgcgagacaagcaccatgaatattgaccgcaacatcacccacctacagcactgtacgtgtgtggatgattgttcaagcagtaactgcctgtgcggacaactgtctatccgctgttggtacgataaagatggtcggctgcttcaagaatttaataagatcgaaccacccctcatctttgagtgtaaccaggcgtgtagctgctggaggaattgcaaaaatagggttgtccagtctggcattaaggttcggctccagctatacaggaccgccaaaatgggatggggggtgcgagcgttacaaacaattcctcagggcactttcatctgcgagtatgtgggggagctgatttctgatgctgaggctgatgtgcgcgaagacgattcatacctcttcgacctggacaataaggacggggaggtgtactgcatcgacgctcggtactatggaaacatctccagattcattaatcatctctgtgaccccaacattatccctgttagagtctttatgctgcaccaggacctgagatttccacgcattgcgtttttttcttcaagggatatcaggactggcgaggagcttgggttcgactatggtgatagattttgggacattaaaagcaagtacttcacctgccagtgcggttcggagaaatgcaagcattccgccgaagccatagccctggagcagagtcgcttagctcgtttggacccccaccccgagctgctgcctgaattgggctctttgcccccggttaacacgtag

SEQ ID NO: 186985 - DNA, 3096 bp, Artificial Sequence
  Description of Artificial Sequence: Synthetic coding sequence
agctgccactgcacccccagccggccccccgtgcccgagaagcggcctcccgagattcagcattttaggatgagcgacgacgtccattcattgggtaaagtaacctcggacctcgcaaagcgacggaaacttaattctgggggcggactgtccgaagaactgggctctgcgagaaggtccggggaggtgaccctgaccaagggagaccccggtagcctggaggaatgggagacagttgtgggcgacgatttctcgttgtattatgactcatacagcgtcgacgaacgcgtggattccgactccaagagcgaagttgaggctctgacagagcagctcagcgaggaggaagaagaggaggaagaagaggaagaagaagaggaggaagaagaggaggaggaggaggaggaagaggatgaagaatccggcaatcagtccgaccgatctggatcatcagggcggcgaaaagcaaaaaaaaaatggcgtaaggactcgccgtgggtgaaaccctctagaaagagacgaaaaagagaaccaccccgcgccaaggagcccaggggagtgaatggcgttggttcatccggtccttcggagtacatggaagtcccactggggtctctggaactaccctcagagggaacactgagcccgaaccacgcaggagtctctaatgacacctccagccttgagaccgaaaggggctttgaagagctgcctttatgctcatgccggatggaggcccctaagatcgaccggatatccgaacgtgccggtcacaaatgtatggcaactgagtctgttgacggggagctctcaggatgcaatgccgccatcctaaagagagaaaccatgcggccttcctcaagagtcgccttgatggtcttgtgcgagactcatcgagccaggatggtgaagcaccattgttgccccgggtgtggttacttttgcactgctgggaccttcctggaatgtcaccctgactttcgcgtcgcccacagatttcataaggcgtgtgttagccaactcaacggaatggtgttctgcccccactgcggtgaagatgccagcgaggcccaagaagtcaccataccacgtggtgatggggtcacaccccctgctggcactgccgccccggctccacctcccctctcccaagatgtgcccggcagggccgacacctcacagcccagtgctcgaatgcgggggcatggggaacctagacggcccccctgtgaccctctggcagacaccattgattcaagtgggcctagcctgaccctaccaaacgggggctgtctgtccgcagtcggcttacccctggggccgggccgcgaggccctggaaaaggcactcgtcattcaggagtccgaacgtcgcaagaagctcagattccaccccaggcagctgtatttgagcgtgaagcagggagagctgcagaaagtgatcctcatgctgctggacaacctggatcctaactttcaaagtgaccagcagtcaaagagaacgcctctccacgctgccgcgcagaaaggatccgttgagatctgccacgtgctgctccaggccggagcaaatataaatgccgttgataaacagcagcgtacacctttgatggaggccgtggttaataatcacctggaggtcgctagatatatggtccagagaggcggctgcgtgtactctaaagaggaagacggtagcacgtgccttcaccacgccgccaagataggtaatctggagatggtgtctcttctgctttctaccggccaagtcgatgtgaacgcacaggatagcggagggtggactcctatcatctgggcagcagagcataagcatattgaggtcatccggatgctccttacccggggtgcggacgttacacttacagacaacgtgagcgaaaggcttgtggaagaagaaaatatttgtcttcactgggccagcttcacaggcagcgcagccatagccgaggtcctgctcaacgctcgatgcgatctgcacgctgtaaactaccatggcgacactcctttacatattgctgcccgcgaatcttaccacgattgcgtgttgctgttcctgtcaaggggagcaaatcctgaacttaggaacaaagagggtgacactgcgtgggacttaactcctgagagaagcgacgtgtggttcgcactccagttaaataggaagctacgtctgggagtgggtaatcgagccataagaaccgaaaaaattatatgccgggacgtagcccgcgggtacgaaaatgtgcccatcccttgcgtgaatggagttgatggcgagccctgtcctgaggactacaagtacattagtgaaaattgtgaaacatcaacgatgaatatcgacaggaacatcacacaccttcagcactgcacttgcgtggatgactgcagctctagtaactgcctgtgtgggcagctgtcgattaggtgctggtatgacaaagacggccgtctgttgcaggaattcaataaaatcgagccccccctcatatttgaatgcaaccaagcgtgctcatgttggcgcaattgcaagaacagggtggtgcagtctggaattaaggtaaggttacagctctatagaaccgctaaaatggggtggggagtgagagctctgcagacgattccgcagggcaccttcatatgcgagtacgtgggggaactcatttctgacgccgaggccgacgtgcgcgaggatgattcctacttgtttgaccttgataataaggatggggaggtgtactgtatagacgctcggtactatggcaatatcagtagattcatcaatcacctctgtgaccccaatattattccggtgagagtgttcatgctgcatcaggacctcagattcccaagaatcgcattttttagctctcgggacatccgaaccggcgaggaactggggtttgattacggcgaccgattctgggatattaagtcaaagtattttacgtgtcagtgtggctccgagaagtgcaagcactctgctgaggctattgccctggaacagagtcgcctggctcgacttgacccacaccccgaattactcccagaactgggcagtctgcctcctgtaaacacatag

SEQ ID NO: 186986 - DNA, 3096 bp, Artificial Sequence
  Description of Artificial Sequence: Synthetic coding sequence
agctgccactgcacccccagctggccccccgtgcccgagaagcggccacctgagatccaacacttcaggatgagtgacgatgttcactcccttgggaaagtgaccagtgatctggcaaaaagacgcaagctcaattcaggaggcgggctctccgaagagcttggtagtgcgcggaggtccggtgaagtgaccctgacgaaaggcgacccaggttcactggaagagtgggaaacagtcgtgggggacgattttagtctatattatgactcctacagcgtcgatgaacgagtcgactcagactctaaatcagaggttgaagctctgaccgagcaactgtccgaagaagaggaggaagaagaggaagaagaggaggaggaagaggaagaggaggaagaagaggaggaagaagaggacgaggagtcgggcaatcagtctgataggagcggttcttctggacgtagaaaggctaaaaagaagtggcgaaaggatagtccttgggtcaagcctagtagaaaaaggcgcaaaagagagcctcccagagctaaagagcctcgcggtgttaatggtgttggctcctccggaccttctgagtacatggaagtgcccctgggatctttggagctgccctcagaggggactctgagtccaaatcatgctggcgtgtctaatgatactagttccttggaaaccgagaggggattcgaggaactgcccctgtgcagctgcagaatggaggcccctaagatagaccggatttccgaaagggctggccacaagtgcatggccaccgaaagcgtggacggagaactctccggctgtaatgccgcaattctgaagcgcgaaacaatgaggcccagcagtagagtcgcattaatggtgctatgcgagacccaccgggccagaatggtgaaacaccattgttgtcctgggtgtggctatttctgcaccgccggcacttttctggaatgccacccagacttccgggtagcccatcggtttcataaagcctgcgtctcacagctcaatggaatggtcttttgccctcactgcggagaggacgctagcgaagctcaggaggtcactatccctagaggtgacggggtgacccctccagccggcactgcagcgccagcaccccctccgctcagccaggatgttccgggccgtgcagacactagccagccatccgcgagaatgagaggacacggtgaacccagaaggcctccatgtgatcctctcgcagacactatcgattctagcggtccaagcctcacactccctaacggcggttgcctaagtgccgtggggctccctctcggacccggccgcgaggccctagagaaagcgcttgtcatccaggaaagcgagcgccgtaaaaagttacggttccacccaagacagctgtacctcagcgtgaaacagggagaactccagaaagtgattttaatgctgctagacaacttagatccaaactttcaatccgatcagcagtctaagcgcacgccgctgcatgctgcagctcagaagggctccgttgagatctgccatgtgcttctacaggccggagcaaacatcaatgctgtggacaagcaacaaagaacacccttgatggaagctgtggttaataaccacctggaagtcgccaggtacatggtgcagcgcggcgggtgcgtatatagcaaggaggaggatgggtccacttgtctgcaccacgccgccaaaattggcaatctcgaaatggttagcctcttactgtccaccggacaggtagacgtaaacgcccaggatagcggcggttggactcccatcatctgggccgctgagcataaacacatagaggtcatacgcatgctgctcactcgaggtgctgatgtgactctaacagacaacgtgtccgagcgattagttgaagaggagaatatatgcctgcattgggcttctttcaccgggtccgctgcgatcgctgaagtgctgctcaacgcccgatgtgatctacatgccgtgaactaccatggcgacacgccgcttcatatcgctgcccgcgagtcttatcacgactgcgtcctgttgttcctctctcggggggctaaccctgagctcaggaacaaagaaggggataccgcatgggaccttactcctgaacgtagtgacgtctggttcgcgttgcagctgaaccgaaagctgcgcctgggcgttgggaacagagccatccgaacagaaaaaataatatgtcgggatgtcgcacgggggtacgaaaatgtccccataccttgtgtcaatggggtagatggcgaaccttgccccgaagattataagtacatcagtgagaattgtgaaactagcaccatgaacatcgaccgcaatattactcatctgcagcattgcacctgtgttgatgattgctcttcctccaattgtctgtgtggccagctgagtattcggtgttggtacgacaaagacggccgcctgctgcaggagtttaacaagatcgagccccccttaatctttgagtgcaaccaagcctgcagctgctggaggaactgcaaaaaccgggttgtgcaatccggcattaaggtccgccttcagctgtatcggacagccaagatgggctggggtgtgagagccctgcagaccataccccagggcactttcatctgtgagtacgtgggagagttgatctccgatgctgaggccgacgtccgcgaggatgactcatacctcttcgatctcgataataaagacggagaggtgtattgtattgacgcacgctattacgggaacatatctagattcattaatcatctgtgcgatcccaatattattcccgtgcgcgtgtttatgcttcaccaggatctgaggttccctcggatcgccttcttttccagccgcgatattcggaccggggaagagctgggattcgattatggcgaccgtttctgggatataaagagcaagtacttcacgtgtcagtgcggcagtgaaaaatgtaaacattcagcggaggcgattgcccttgagcaatctagactcgcacgcttggatcctcaccccgagctccttcccgagcttggttctctgccacctgtgaatacatag

SEQ ID NO: 186987 - DNA, 2178 bp, Artificial Sequence
  Description of Artificial Sequence: Synthetic coding sequence
atggccgacgaggacctgatcttccggctggagggcgtggacggcggccagagtcccagggctggccatgacggcgatagcgacggcgactctgacgacgaagagggctattttatctgccctataactgacgatccaagctcaaaccaaaatgtcaactccaaggtgaacaaatactactcaaatctcactaaatcagaaagatatagcagctccggttcccctgctaatagcttccacttcaaagaagcatggaagcacgctatccagaaggctaagcacatgcctgacccctgggctgaatttcacttggaggacatcgccacagaacgggcaactcgccaccggtacaatgccgtgacaggggaatggctggatgacgaggttcttattaagatggcaagtcagccctttggcagaggagctatgagagagtgttttaggaccaagaaactgtccaattttcttcatgcccagcagtggaagggggcatcaaattacgtcgcgaaacggtacatcgaaccagtggaccgtgacgtctattttgaggacgtgagattacagatggaagctaagctttggggagaagagtacaataggcataaacctccaaaacaggtagatatcatgcagatgtgcattattgaattgaaggataggcctggcaagcctctctttcacctcgagcactacatagagggaaaatatatcaagtacaatagtaacagcggctttgtgcgtgacgataacatacgcctcaccccacaggctttttcccatttcacctttgaaagaagtggacatcaactgatcgttgtcgatatccagggggttggagacctttatactgatccccagattcacacagaaactggtaccgacttcggagacggcaacctgggggtccggggcatggctctcttcttctacagtcatgcatgcaatagaatttgcgaatctatgggactggccccattcgacctttctccaagagaacgagacgcagtgaatcagaacaccaaactactgcagagtgctaaaacaattctgagggggaccgaagagaagtgcggctccccacaagtgagaacactttccggttccaggccaccattgctcaggccattatctgaaaattcgggagacgagaatatgtctgacgtgacctttgactcactcccctccagtcctagttctgcaacccctcatagtcagaaactagatcacctgcactggccagtattttctgaccttgataacatggccagtcgtgatcatgatcacctggacaaccatcgggagtcagagaattccggcgactcaggttatccaagcgaaaagagaggcgaactggatgaccccgagccgcgggaacatggacactcctactcaaacagaaaatatgagtccgatgaggacagcctggggagcagcggccgggtgtgtgttgagaagtggaacctcctgaacagcagccgcctccacctgccacgcgcatctgccgtggcgctggaggtgcagaggcttaacgccctggaccttgaaaaaaagatagggaagtctattcttggtaaggttcacctcgcgatggtgagataccatgagggaggaaggttctgtgaaaaaggcgaggaatgggaccaagaatccgccgtattccaccttgagcatgcagcaaacctcggcgaactggaggctattgtcggacttggccttatgtatagtcaactgccccaccacattctcgcagacgtttcgttgaaggagaccgaagaaaataagaccaagggatttgactacctcctgaaagccgcagaggccggcgatcgccagagcatgattctggttgctagagcctttgactctggccagaatctctcaccagataggtgtcaagactggttggaggccttgcattggtacaatacagccctggagatgaccgactgtgacgaaggaggagagtacgatgggatgcaggacgagccgcggtacatgatgctcgctagagaggcggaaatgcttttcactgggggctatgggttggaaaaggacccccaaagatccggagatctgtacacgcaggcggccgaggccgctatggaagctatgaagggaagactggccaatcagtattaccagaaggcggaggaggcatgggcccagatggaggagtag

SEQ ID NO: 186988 - DNA, 1389 bp, Artificial Sequence
  Description of Artificial Sequence: Synthetic coding sequence
atgggcaaggagaagacccacatcaacatcgtggtgatcggccacgtggactctggcaaatcaacaacaaccgggcatctgatttacaaatgcggtggcatcgataagagaacaatcgagaagtttgagaaggaagctgctgaaatgggcaagggctcgttcaaatacgcttgggtcctggacaaactcaaagccgagcgcgagaggggtatcacaatcgatatcagcctatggaagttcgagacgagcaaatactacgtgactattatcgatgcccccggacacagggatttcattaagaacatgattacaggcacatcccaggcagactgcgccgtcctgattgtggctgctggtgtaggggaatttgaggccgggatttcgaagaatgggcagacaagagagcacgctctcctggcctatacgctcggagttaagcaacttatcgtgggagtgaacaaaatggactcaacagaaccaccttactcgcaaaaaagatacgaggaaatcgtgaaggaggttagtacatacatcaagaagatcggctacaatccagacacggttgccttcgtccctatctctgggtggaacggggataacatgctcgagcccagcgctaacatgccttggttcaagggctggaaagtcacacggaaggatggaaacgcatctggtacaacattgctggaagcgctcgattgcatcctcccccccacacgcccaaccgacaagcccttaagattgccacttcaggacgtctacaaaatcggaggaattgggacagtgcctgttgggcgagtggagactggcgttcttaagccaggtatggttgtcaccttcgcaccagtaaacgtgaccacggaggtaaaaagcgttgagatgcatcatgaagcgctctctgaagccctaccaggcgataatgtcggattcaatgtgaaaaacgtatctgttaaagatgtaagacggggaaacgtggctggtgacagcaaaaatgaccctcctatggaagccgcaggattcacggctcaggtcatcatactgaatcatccaggccaaatttctgcaggctacgcgccagtgctcgattgccacacagcacatatcgcgtgcaagttcgctgaattgaaggagaaaatcgaccggaggtcgggaaaaaaactagaggatggcccgaagttcctaaaatccggcgatgccgccatagtggacatggttcctgggaagccaatgtgtgttgagagtttctccgattacccgccactggggcgattcgcggtgcgcgatatgagacagaccgttgctgtgggggtcattaaagccgtcgacaagaaagctgccggggcaggcaaagtcacaaagagtgcccagaaagcccagaaagcaaagtag

SEQ ID NO: 186989 - DNA, 1389 bp, Artificial Sequence
  Description of Artificial Sequence: Synthetic coding sequence
atgggcaaggagaagacccacatcaacatcgtggtgatcggccacgtcgattccgggaaatcaacaaccacagggcacctcatttataaatgcggcggaatagataagaggacaatcgagaagttcgagaaggaggcggctgagatgggtaaggggagctttaagtacgcctgggttttagataagctgaaggccgaacgggaacgcggcatcaccattgatatcagtctgtggaagttcgaaaccagtaagtattacgtcacaatcatcgacgctcctggccaccgggactttatcaagaatatgattacgggaacatcccaggccgattgcgcagtccttatcgtggccgccggtgttggtgagttcgaggccggcatctccaaaaacggacaaaccagagaacatgccttactggcctatacacttggggtgaagcagctgatcgtcggcgtgaacaagatggatagtaccgagcctccgtattctcagaaaaggtacgaagagatagtgaaagaagtatccacctacataaaaaagattggatataaccctgatacggtagcatttgtccctatttccgggtggaacggagacaacatgctggagccctctgctaatatgccttggttcaagggatggaaggtgacccgcaaagacggaaacgcatctgggactacccttctggaagccctagactgtatactgcctccgactaggcccacagataagcctctccggctgcctctccaggatgtttacaagatcggggggatcggcaccgttccagtggggagagtcgaaacaggcgtactaaaacctggaatggttgtcacattcgcaccagttaatgtgacgacggaagtgaagagtgtggagatgcaccacgaagccctttccgaggcactcccaggagataacgtgggatttaacgtgaagaatgtgtccgtgaaagatgtccggcgcggaaacgtcgccggagactccaaaaacgatccacctatggaggctgccggcttcactgcccaagtgatcattctcaatcatccaggccaaattagtgccgggtacgctcctgtgttagattgtcataccgcccacattgcctgcaaattcgctgagctcaaagagaaaattgatcggcgatctggaaaaaaactcgaggatggccctaaatttttgaagagcggggacgcagcaatcgtcgatatggtgccaggaaagcctatgtgcgtggagtctttcagtgattaccctcccttgggcagatttgctgtgagagacatgagacaaactgtagctgtcggagttataaaggcagtagacaaaaaggctgccggcgctggcaaagtcaccaaatcagcccagaaggctcaaaaggccaaatag

SEQ ID NO: 186990 - DNA, 1389 bp, Artificial Sequence
  Description of Artificial Sequence: Synthetic coding sequence
atgggcaaggagaagacccacatcaacatcgtggtgatcggccacgttgacagtgggaagagtactaccaccgggcacctgatttataaatgcggcggtatagacaagagaacaatcgaaaagtttgagaaggaggcagctgaaatgggcaaaggatctttcaagtatgcctgggtgctggataagttgaaggccgaacgcgaaaggggcatcacgatcgacatatccctgtggaagttcgaaacaagcaaatactatgtgaccatcatcgatgccccagggcaccgggattttatcaaaaatatgataacaggaacctcccaggccgattgcgcagttctgattgtcgccgcaggggtgggtgaattcgaggctggtataagcaagaatggacaaacccgggaacatgcactgctggcctacacactcggcgtgaaacagctgatagttggggtgaacaaaatggattctaccgagccaccctactcacagaagcggtacgaggagatcgtaaaggaagtaagtacatacatcaaaaaaataggctataacccggatacggtcgcgtttgtgcctatatccggatggaatggtgacaacatgctcgagccttccgctaatatgccttggttcaaaggttggaaggtcacccggaaagatggaaatgcttctggaacgacgttgttggaggccctggactgcatcctgcctccgactcggcctaccgataaacccctacgactgcccctccaggacgtctataaaatcggcggtatcggaaccgtgccggtcggccgcgttgagacaggcgtcttaaagccagggatggtggtgacctttgctcccgtgaacgtgacaacggaggtgaagtcagtggagatgcaccatgaggccctgagtgaggcgctccctggtgataacgtgggctttaatgttaagaatgtttctgtcaaggatgtccgccgtggcaacgtggccggagactccaaaaacgacccccccatggaagcagccggttttaccgcccaagtgatcatactaaatcaccccggtcaaattagcgcaggctacgctcctgttctggattgtcacacagcacacatagcttgtaagttcgcagagttaaaggagaaaattgaccgacgatcaggcaaaaagttagaggacggtccgaaattcctgaagagcggcgatgctgctattgttgatatggttcctgggaaaccaatgtgtgtagaaagctttagcgattaccctcccctgggtagattcgcggtcagagacatgcgtcagacggtggctgtgggggtgataaaagcagtggataagaaagccgcgggcgccggaaaggttaccaagtcagctcagaaagcccagaaggctaagtag

SEQ ID NO: 186991 - DNA, 438 bp, Artificial Sequence
  Description of Artificial Sequence: Synthetic coding sequence
atgggcaaggagaagacccacatcaacatcgtggtgatcggccacgtggatagcggtaaaagcacgacaacggggcatttgatctacaaatgtgggggtatcgataaacgcaccattgaaaagtttgagaaggaggcagccgagatggggaagggcagctttaaatacgcatgggtgctggataaactaaaggctgagagggagcgggggattaccattgatattagcttgtggaaattcgaaacatcaaagtactacgttaccattatcgatgcccccggccatagggacttcataaaaaacatgattaccggcacctcccaagcggactgtgctgtgttgatagtggccgcgggcgtgggagaattcgaggctgggatcagtaagaatggacaaacacgggagcatgccttgctggcatataccctgggcgtttag

SEQ ID NO: 186992 - DNA, 1281 bp, Artificial Sequence
  Description of Artificial Sequence: Synthetic coding sequence
atgggcaaggagaagacccacatcaacatcgtggtgatcggccacgttgattcaggaaagagcacgacaactgggcacctgatctacaagtgtggcggcattgataagcggacgattgagaaatttgagaaagaggccgcggagatgggaaaaggctctttcaagtacgcctgggttcttgataagcttaaagctgaaagagaacgaggcataaccattgacataagcttatggaaatttgagacatccaaatattacgttactatcatcgacgccccaggtcatagagatttcatcaaaaacatgattacaggcacatctcaggcagactgtgccgtcctcattgttgcagccggggtcggcgaatttgaggccgggatctcaaaaaacggacagacgagggaacacgctcttttggcatacacgttgggcgtgaaacagttaatcgtgggtgtgaacaaaatggacagcactgagcccccctattcccagaaacgatacgaagaaattgtgaaggaagtgtctacttatattaaaaaaattggatacaatcctgatacagtggctttcgtgcccatatctggttggaatggcgataatatgctggagccgagcgcaaacatgccttggttcaaaggctggaaggtcaccaggaaagatggtaacgcctctggcaccacactactggaggcgttagactgtatcctgccccctactcggcctactgataagccgctccgtctgcccctgcaggatgtgtataaaatcgggggcatcggtacagtgcccgtcccatcaggcgactggtgctctcctggcatggtagtgacattcgctcctgtgaatgttactaccgaagtgaaatcggtcgagatgcaccacgaagccctcagtgaggctctgccaggcgataacgttggttttaacgtcaaaaacgtgtccgtgaaagacgtgcggagaggcaatgtggctggggattcaaagaacgatccccccatggaggctgccggcttcaccgcgcaagtcattatactaaatcacccggggcaaatcagcgctggatacgctcccgtcctcgattgccacacagctcatatagcatgtaaatttgccgaactaaaggagaagatcgatcggagaagcgggaagaaactggaagacgggcccaaatttctgaaatcgggcgacgccgccatcgtggacatggtgccaggaaagccgatgtgcgtggagtcgttctccgactaccccccactaggtaagtcactctgttgctcatag

SEQ ID NO: 186993 - DNA, 1326 bp, Artificial Sequence
  Description of Artificial Sequence: Synthetic coding sequence
atgggcaaggagaagacccacatcaacatcgtggtgatcggccacgtggacagcgggaagtccaccaccacgggccacctgatttacaaatgcggcggtatcgacaaaaggactatcgagaagttcgagaaggaagctgccgagatgggtaaaggatccttcaaatatgcttgggtcttggacaagctcaaggctgagcgcgaaagaggaatcacaattgatattagcctctggaagttcgaaacaagcaaatattatgtgaccatcatagacgcccccggtcatcgagatttcatcaagaacatgataacagggacatctcaggcagattgtgccgtactgattgttgctgctggtgtgggagaatttgaagctgggatttccaagaacggccagacaagagagcacgctctgctggcatatagccaaaagagatacgaggagatagtaaaagaggtgtctacatatatcaagaagatcgggtataaccctgataccgtcgcattcgtcccaatctcaggctggaatggcgataacatgcttgaacccagtgccaatatgccgtggtttaagggttggaaagtgactcgcaaagatggaaacgctagtgggactacactgttggaagcccttgactgcattttgccgccaacccggcctacagataaacctctgaggctgcccctacaggatgtgtacaaaatcggagggataggtacagtgcccgtaggtcgcgtggaaacaggcgtgttaaagccaggtatggtggtcacattcgcccctgtcaacgtgaccactgaagtgaaatccgtggagatgcaccatgaagcgttgtcagaagctctccctggagacaacgtgggcttcaacgtcaagaacgtgagcgttaaagacgtgcgtcgcggaaacgtggcaggagactccaagaatgatccccctatggaggctgcaggttttactgcacaggtaatcattctgaaccacccgggccagatctccgcagggtatgctcccgtcctcgactgccacacggcccacatcgcttgtaaattcgcagagctgaaggaaaaaattgaccgccgatcgggaaagaaactggaggacggacccaaatttcttaagagcggggatgccgccatcgtggatatggtaccaggcaaacccatgtgcgtggaatcgttcagcgactatccacctcttgggcgtttcgccgtgcgggacatgaggcagaccgtggctgtgggcgtgatcaaggccgtggataagaaggcagctggcgcagggaaggtgaccaagtcagcacagaaagcccagaaagctaagtag

SEQ ID NO: 186994 - DNA, 324 bp, Artificial Sequence
  Description of Artificial Sequence: Synthetic coding sequence
atgggcaaggagaagacccacatcaacatcgtggtgatcggccacgttgactccggcaaatctacaaccaccggacacctcatctacaagtgtggtggaattgacaagcgaacgatagaaaagtttgagaaagaagcggccgaaatgggcaaaggaagttttaaatacgcttgggtactggataaactcaaagccgagcgtgagcggggcatcacaattgatatctcactgtggaaatttgagacatctaagtactacgttacaatcattgacgcacctggacatagggatttcatcaagaacatgattaccggaacgtcgtag

SEQ ID NO: 186995 - DNA, 336 bp, Artificial Sequence
  Description of Artificial Sequence: Synthetic coding sequence
atgggcaaggagaagacccacatcaacatcgtggtgatcggccacgtggacagcggaaagtccactaccaccggtcatctcatttacaagtgtggggggattgacaaacgtactatcgagaaattcgaaaaagaagccgctgaaatggggaagggcagcttcaagtatgcatgggtactggacaagctgaaagctgagcgggaaagaggtatcaccatcgacattagcctctggaagtttgagacaaccaagcagtggacgcgcaggttgctggagctggcaagatctccctctcttccaaggaagttacggagattaaatgagtattacccctag

SEQ ID NO: 186996 - DNA, 1626 bp, Artificial Sequence
  Description of Artificial Sequence: Synthetic coding sequence
atggtgatcaacctgtgcctgccccagttccggccccggatccactgtaacaagatcagcgccgacgggtatgaggtggagaacttgatatcagaagatctgactaagcgatcgcacggtttcagaacagagtatttcataaagcctccggtgtatgtcacagtgagctttcctttcaacgtcgaaatatgcagaattaacatcgacttaaccgccggggggggacagaacgtaaccggcctggaaatgtatacaagcgcgtctagctcacgggtatcttggaatacaccccagtgtcgcaccttagggccagccgagccaagcgtgcctgacaaagaggcattcacccttgtggggaaagttctcctgaaaaatcagtcccaggtggtgttctcgcacagaggattcaaagctagaccgccatttggggcaatggaagccactttacctagcccagctgtcgttgcacaggaattgtggaacaaaggagctttaagcctctcacacgtggcccatctcagaatttgcatcacacacgttaccggaggtggcattccctgcatcaagcgcctcgaagtgtggggacaaccagcaaaaacttgcagtcaggaggtcatcgactccattttattagtgacatctgaaaatctgccccaggatgtcgcacttcaagcacccgccctgcctatggaatcagactgtgatcctggcgaccaaccggagtctcagcaggccccctccagtctgcaaaaactcgccgagatcatacaggatgttcctgaggagtttctcgatcctataacgctcgagattatgccttgcccaatgctgcttccttccggaaaggttatcgaccagagcactcttgagaagtgcaacaggtctgaggctacttgggggcgcgtcccaagcgatcccttcactggagtcgcctttacaccccatagccagcctctgcctcatccctctctgaaagccagaattgaccacttcttgctccagcactctatacctggctgtcatctgttggggcgggctcagaccgccttggccgtcattccgtcaagcatagtactgcccagtcagaaaaggaaaattgaacaggctgagcatgtgcctgacagtaatttcggtgttaatgcttcatgcttttcagcaactagtcctctggtgcttcctaccacctctgagcatacagccaaaaagatgaaagccacaaacgaaccctccctgacacatatggactgttcgaccggcccactgagccatgaacaaaagctctcccagtctctggaaatcgcactggcctccacacttggaagcatgcccagcttcacagctaggctcacccggggccagctgcaacatctcggcactcgtggatccaatacttcctggcgacctgggaccggtagcgaacagcctgggagcattctgggaccggaatgcgcttcctgtaagagggtcttctccccttactttaagaaggaacctgtgtatcaacttccctgcggtcacctcctttgtcgcccatgccttggggagaaacagagaagtcttccgatgacgtgtacggcatgtcagcgacctgttgcatcccaggacgtactccgcgttcacttctag

SEQ ID NO: 186997 - DNA, 1392 bp, Artificial Sequence
  Description of Artificial Sequence: Synthetic coding sequence
atgggcaaggagaagacccacatcaacatcgtggtgatcggccacgtggattcgggcaagtccacgacaactggccacctgatctacaagtgtggcgggatcgacaaaagaacgatcgaaaagtttgagaaggaagccgctgaaatgggcaagggctcgttcaagtatgcgtgggtccttgacaaattgaaggccgagcgcgagcgcggaattaccatcgatatttctctgtggaaatttgaaacaaccaagtactacattactatcatcgatgcacccggccaccgggacttcatcaagaatatgatcacggggaccagtcaggccgactgtgcagtcctgattgtcgcagctggtgtgggcgagtttgaggctggtatctccaagaacgggcaaacccgcgagcacgctctcttggcctatacacttggagtgaagcaactgattgtaggcgtaaataagatggactctaccgaaccggcatattccgaaaaacggtacgatgaaattgtgaaagaggtgagcgcatacatcaaaaaaatcggctacaacccggcaacagtcccctttgtgccaatttcaggatggcacggtgacaatatgctggaaccatctccgaacatgccttggttcaaaggctggaaggtggaaaggaaagaaggcaacgccagcggcgtcagcttgctagaggccctggatacgatcttgccaccgacgcggcccaccgataaaccccttaggctccccttgcaggatgtgtacaaaatcggtggtatcgggactgtcccagtgggccgcgttgaaacaggtatcctgcgcccagggatggtcgtcacttttgctcctgtcaatatcacgacagaggtgaaatcagttgagatgcatcacgaagcccttagcgaagccctgcctggcgataacgttgggttcaacgtgaagaatgtttcagtgaaagatatccggagggggaatgtctgtggggattcaaagtcggatcccccacaagaggcggcccagtttacttcgcaagttattatcctgaatcatcctggtcaaatttcagccggctattctcctgtgatagattgtcacaccgcccacatcgcctgtaaattcgcagagcttaaagaaaaaatcgatcgcaggagcgggaagaaactagaggacaacccgaaatctctgaaatccggagatgcggctatcgtggagatggtaccgggaaagcccatgtgtgtcgagtccttttctcagtatccacctctggggagattcgctgtaagggatatgcgccaaaccgtcgccgtgggcgtgataaagaacgtcgagaagaagtcgggcggcgctggaaaagttacaaagagtgctcagaaagcccagaaagctggtaaatag

SEQ ID NO: 186998 - DNA, 678 bp, Artificial Sequence
  Description of Artificial Sequence: Synthetic coding sequence
atgggcttcggcgacctgaagagccccgccggcctgcaggtgctgaatgattaccttgctgacaagagctacattgagggatacgtccccagtcaggcagatgtcgccgtgttcgaggccgtgtcttcccccccaccagcagatctctgtcatgcgctccggtggtacaaccatataaagtcctacgagaaggagaaggcttctctgcctggcgtgaaaaaggctctgggcaaatatggcccagccgatgtggaagacacaaccggatcaggcgccaccgactctaaagatgatgatgatatagatctcttcggctctgacgacgaggaggagtcagaagaggccaagcggcttagggaagagaggctagctcaatacgaaagtaagaaggccaagaagcccgcccttgttgccaagtcttctattcttctggatgtgaaaccttgggatgacgaaactgacatggctaaacttgaagagtgtgtaaggagtattcaggccgatggactggtttgggggtcctccaagctcgtcccagtcgggtatggcattaaaaagctgcaaatacagtgcgtcgttgaggatgataaggtagggactgatatgcttgaggaacagatcactgcttttgaggattacgtgcagtccatggacgtggccgcattcaataaaatatag

SEQ ID NO: 186999 - DNA, 678 bp, Artificial Sequence
  Description of Artificial Sequence: Synthetic coding sequence
atgggcttcggcgacctgaagagccccgccggcctgcaggtgctgaatgattaccttgccgacaagagctacattgagggatacgtgccctctcaggccgacgtcgcagtcttcgaagcagtatcaagccctccccctgctgacctttgtcacgctctccgctggtacaaccatattaagagctacgagaaggagaaagcatcactcccgggtgtgaagaaagccttggggaaatacggccctgccgacgtcgaggacactaccggatcaggggcgacagatagcaaggatgacgacgatattgacctcttcggatccgacgatgaagaggaatccgaagaggccaagaggttacgggaggagagactggctcaatacgagagcaagaaagcaaagaagccggctttggtggcaaagagcagcatccttctcgacgtcaagccgtgggacgacgagacagatatggcgaagctcgaagagtgcgtgagatccatccaggccgacgggctcgtttgggggagttccaagctcgtcccagtgggatacggcatcaaaaagttacaaattcagtgtgtggtagaggatgacaaggtcggaacagatatgctggaggagcagatcactgcttttgaagattatgtccagagcatggacgtggccgcctttaacaaaatctag

SEQ ID NO: 187000 - DNA, 678 bp, Artificial Sequence
  Description of Artificial Sequence: Synthetic coding sequence
atgggcttcggcgacctgaagagccccgccggcctgcaggtgctgaatgactatttggcagacaaaagttacatagaagggtacgtgccctctcaggcagatgtagctgtgtttgaggccgtatccagtccaccacctgcggatttatgtcacgccctgcggtggtacaaccatatcaaaagctacgagaaagagaaggcgtccctgccaggcgttaaaaaagcactcggtaagtacggacctgccgacgtggaagacactactgggtctggtgcaacagacagcaaagatgatgacgacatagatcttttcggctccgacgatgaggaagaatccgaagaagccaaacggttacgtgaggaaagactggctcaatatgagtctaaaaaagctaaaaaaccagcactcgtcgccaaaagctccatacttcttgatgttaagccttgggacgatgagacggatatggccaagctggaagaatgtgtgagatcaattcaggcggatggactggtttggggtagcagcaaactggtgcccgtcggttatggcatcaaaaaacttcagatccaatgtgtggtcgaggacgacaaggttggcaccgacatgctggaggaacagataacagctttcgaggattatgtgcagagtatggacgtagccgccttcaacaaaatctag

SEQ ID NO: 187001 - DNA, 372 bp, Artificial Sequence
  Description of Artificial Sequence: Synthetic coding sequence
atgggcttcggcgacctgaagagccccgccggcctgcaggtgctgaatgactacctagccgacaagtcgtatattgagggctatgttccatcacaagccgacgtagctgttttcgaggccgtcagcagccctccaccagcagatctctgtcatgccctgaggtggtacaatcacattaagagctacgaaaaagagaaggcatctcttcctggagtcaaaaaggctctgggaaagtatggtcctgctgatgtggaggatacaaccgggtcaggtgctacggacagcaaggacgacgacgatatcgacttattcggctccgacgatgaagaggagtccgaagaggccaagaggctgcgggaagagcgcctgtag

SEQ ID NO: 187002 - DNA, 846 bp, Artificial Sequence
  Description of Artificial Sequence: Synthetic coding sequence
atggccaccaacttcctggcccacgagaagatctggttcgacaagtttaaatacgacgatgccgaacggcgtttctacgagcagatgaatggtcctgtggctggtgcaagtagacaagagaatggggcctcagtcatcctacgagatatagccagagcgagagaaaacattcagaaatctctcgctggcagcagtgggccaggcgcatcatccggcaccagtggagaccatggagagctcgtggtgagaatcgcttcactggaagttgaaaaccaaagtctgaggggcgtcgtgcaggaactgcagcaggctatcagcaagctcgaggctaggctgaatgtgctggaaaaatccagcccgggacatagagccactgccccacaaacacagcatgtgagccccatgcgccaggtcgagcctcctgccaagaagcctgcgactcccgccgaagacgacgaagatgatgacatcgacctctttggatcagacaacgaggaggaagataaagaggccgcccaattaagggaagagaggttgcgccagtatgcagaaaagaaagcgaaaaaaccagctcttgtcgcaaagtcttcaattctgttggacgtcaaaccctgggacgatgagactgatatggcccagctggaagcatgtgtgaggtcaattcagctggacggactagtgtggggcgctagtaaactagtcccagtggggtacggcatcaggaaacttcaaatccaatgcgtggtcgaagatgacaaagtggggactgatctgctcgaagaggagatcaccaaatttgaggagcatgtgcagtcggtggacattgccgctttcaataaaatttag

SEQ ID NO: 187003 - DNA, 1896 bp, Artificial Sequence
  Description of Artificial Sequence: Synthetic coding sequence
atgcggagcggcaaggccagctgcaccctggagaccgtgtgggaggacaagcacaagtacgaagaagccgaacggcgcttttacgaacacgaggcaactcaagccgccgcttctgctcagcaattgcctgccgaaggacccgccatgaacgggcccggacaggatgaccctgaggacgcagatgaggctgaggctcccgacgggggaagcaggagggatcctcgaaaatcccaggactccagaaaaccgttgcagaagaaacgtaagcggagcccgaaatcgggtctgggtccagcagaccttgctcttctaggcctgtctgctgagagagtctggctcgacaagtctttgttcgatcaagcagagtcttcttacagacagaaactggctgacgtcgcagcacaggcggcatggcctccagccctggctccttgggggctgtgtactcacggaaatcaggtcgcctgccaccatgtgacgtggggtatctgggtcaataagagcagttttgatcaggccgagagagcgttcgtagagtggtcacaagctttgctgctcgctcctgatggctctcggcggcagggtacacccaacactgggcagcaggttgccgtacccgacctcgcccaccagccttcaccaccagtgaacggacagcctcctcttggctctcttcaggctctcgtcagggaagtgtggctcgaaaagcccagatacgacgctgcagaaagaggcttctacgaggccttattcgatggccatcctccagggaaggtaaggctccaggaacgcgctgggctggccgaaggcgctagacgcggaaggcgcgataggaggggtagaaacattctaggaaataaacgtgccgggcttaggagggcagatggcgaggccccctctgcacttccttattgttactttcttcagaaagacgccgaggccccgtggctgagtaagccggcctacgattctgcagaatgtcggcaccacgctgctgaagccttgcgggtagcttggtgtctggaagctgcctctctcagtcaccgcccgggtcccaggtccggcttgtcagtctcctcgctgagacccaaccgcaagatggccactaatttccttgcccacgaaaaaatctggtttgataaattcaagtacgatgatgccgagcgtagattctatgagcaaatgaacgggccagtggcgggcgccagtcggcaggagaatggagcctccgtcattctgcgggacatcgcccgcgctcgcgagaacattcaaaaatcgctggcaggatcctcaggccccggagcctcgtctggaacctccggtgatcacggggaattggtggtgaggatcgcttcgcttgaggtcgaaaaccagagtctgcggggcgtggttcaggaactgcaacaggccatatcaaagcttgaagcaagacttaatgtattagagaaatcttcaccaggtcatcgtgccacagccccccagacccaacacgtatcaccgatgcgccaagtggagccaccagctaaaaaacccgctacacccgccgaggacgacgaggacgatgatattgacttgttcggaagtgacaacgaggaagaggacaaggaagcagcacagcttcgcgaggaacggttgcggcagtatgcagagaagaaggcaaagaaacctgcactcgtggcgaagtcctccattctccttgatgtgaagccctgggatgacgaaactgatatggcccaacttgaggcttgcgtaaggtctattcagctggacgggctggtttggggcgcctctaagctggtgcccgtgggctacgggatccgcaagctccagatccaatgcgtgggtggacgccagggaggggatcgccttgccgggggaggagaccatcaggtgtag

SEQ ID NO: 187004 - DNA, 1728 bp, Artificial Sequence
  Description of Artificial Sequence: Synthetic coding sequence
atgaacggccccggccaggacgaccccgaggacgccgacgaggccgaagcccccgacgggggttcccgcagagatccacgtaaaagccaggacagtcggaaacccctgcagaagaagcgaaaacggtctccaaagagtggcctcggtcctgctgatctggctctcttgggcctctctgcggaacgggtgtggctagacaagtctctcttcgatcaggctgaatcaagctaccggcagaagttggccgatgtggcagctcaggctgcgtggccccctgccttagcaccctggggcctgtgcacccacggaaaccaagtggcttgccaccacgtcacctggggcatctgggtcaataaatcttctttcgaccaagctgagcgcgccttcgttgagtggagtcaggctttgttgctcgcgccagacggatccaggaggcagggaacgcccaataccggtcagcaggtggccgtccctgacttagctcatcagccctcaccgccagtgaacggtcagccccctctcggatctttgcaggctctggtaagggaggtgtggctagagaagccccgctacgatgcagcggagaggggcttttacgaagctctcttcgacggtcacccgccaggaaaggtccgtctgcaggagagagccgggttggcggagggcgctcgccgtgggagacgagatcgccggggaagaaatatactcgggaacaagcgagccggtctgcgtagagccgatggcgaagccccttccgctctgccctattgctattttctgcagaaggacgccgaggcaccctggctgtctaagcctgcctatgattcggccgagtgccgacaccatgcagccgaagcattacgcgtggcttggtgcttggaggctgcctccctgtcacataggccaggcccacggtctggcctttcggtctcctcactccgacccaacagaaaaatggcaaccaatttcctggctcatgagaaaatctggttcgacaaatttaaatatgacgacgcggagagacggttttacgaacaaatgaatggtccagtggcaggtgcgtcacgacaatcaagtgggccgggggcttcttccggcacctctggagatcacggtgaactagttgtcagaattgcttctcttgaagtggagaatcagtccctgaggggggtggtgcaggagcttcaacaggcaatctccaagttagaagcgcgtctgaacgtgctggaaaaatctagcccagggcacagagccactgccccccaaacccagcatgtctcccctatgaggcaggtggagccacctgcgaagaaacccgctactcctgctgaggatgatgaggatgatgacatcgacctatttggctcagataatgaggaagaagataaagaggccgcccagttaagggaggagcggctgcggcaatatgccgaaaagaaagcaaaaaaacctgctttggtcgctaagtcctccatcctcttggatgtaaaaccatgggacgatgaaaccgatatggctcagctggaggcatgcgttaggtctatacagctggatggactggtgtggggcgccagcaagcttgtccctgtaggctacggcattcgcaagcttcagattcagtgtgttgtggaggacgacaaagttggcactgatctgctggaggaggagattacaaagttcgaggaacatgtacagtctgttgatatcgcggccttcaacaaaatctag

SEQ ID NO: 187005 - DNA, 846 bp, Artificial Sequence
  Description of Artificial Sequence: Synthetic coding sequence
atggccaccaacttcctggcccacgagaagatctggttcgacaagtttaaatacgacgacgcagaacggaggttttatgaacaaatgaacggacccgtggcaggcgctagtaggcaggagaatggggccagtgtcattctgagagacattgcacgcgcccgcgagaacatacagaaatctttggccggttcgtccggcccaggggcttctagtggcacatctggggaccatggggaactcgtggtccgaatcgcttcactggaagtagagaaccagtcactgagaggggtggttcaggagttgcaacaagctattagtaagctcgaggcccgtttgaatgtgttggagaagagttcacccggacatagggccacagcccctcaaacacagcatgtgagtcccatgaggcaggtggaaccaccggccaaaaaaccggcaacacctgctgaggatgacgaggatgacgacatcgacctgtttggctcggataacgaggaggaagacaaagaagccgcccagttgagggaggaacggttgagacagtatgccgaaaagaaggcaaagaagcctgccctggtggctaagagctcgatccttcttgacgttaagccatgggacgatgagactgacatggcccagttggaggcttgcgttaggtccattcagctcgatggcttggtttggggtgccagcaaactggtgccagtcggctatggaatcaggaagctccagatccagtgtgtagtggaagatgacaaagtgggaacagatttactagaagaggagatcactaagtttgaggagcatgtgcagtctgtagatatcgcagcttttaataagatttag

SEQ ID NO: 187006 - DNA, 846 bp, Artificial Sequence
  Description of Artificial Sequence: Synthetic coding sequence
atggccaccaacttcctggcccacgagaagatctggttcgacaagttcaaatacgacgacgctgaacggcgattttatgagcagatgaacgggcccgttgcaggcgcaagccgccaggaaaatggagctagcgtgattctcagagatattgcacgggccagggagaacatccaaaaatctctggcgggcagctcagggcctggagcaagctctggtacctctggggatcacggcgagctggtggtcaggatagcctcgctagaggtagagaatcagagcctgcgtggtgtcgttcaagagctgcagcaggcaatttccaaactggaagcacgcttaaatgttctggagaagagctcgcctggacaccgggctaccgcaccccagacgcagcatgtgtcgcctatgagacaagtcgagccacctgccaaaaagccggccaccccagcggaggacgacgaggacgatgatattgacctctttggtagtgacaacgaagaagaggacaaggaagctgctcaacttcgggaggagcgcctaaggcaatatgctgagaaaaaggcaaaaaagcctgcactggtcgcaaagagttccattctgctcgatgtcaaaccatgggatgacgaaacagacatggctcagctcgaggcttgcgtgcgttcgatccaattagatggactggtctggggtgccagtaaactggtgccagtgggctacggtataaggaagctgcagattcagtgcgtggtcgaagatgacaaggtgggaactgatctgctcgaagaggagattaccaagttcgaggagcatgtgcagtccgtggatattgcggcatttaacaagatctag

SEQ ID NO: 187007 - DNA, 1944 bp, Artificial Sequence
  Description of Artificial Sequence: Synthetic coding sequence
atgcggagcggcaaggccagctgcaccctggagaccgtgtgggaggacaagcacaagtatgaggaggccgagcggcgcttctacgagcacgaagccacccaggctgctgcttccgctcagcagctccctgctgagggacctgcaatgaatgggcctgggcaggacgaccccgaagacgccgacgaggcagaggctcccgatggggggtctcgccgcgatccaagaaagtcacaggactccagaaaaccactgcagaagaaaaggaaacgatcccccaaatccggattaggacctgcggacctcgctctgctcggtctttctgcggagagagtttggttagacaaatctcttttcgaccaagccgaatcttcgtatcggcagaagctggctgacgtggccgctcaagcggcgtggcccccggcactcgcaccgtgggggctgtgcacccacggtaatcaggtggcctgtcaccacgtaacttgggggatttgggtgaacaaaagttccttcgatcaggccgaacgtgcatttgtagaatggagccaggcccttttgctggcccctgacggttccaggagacaaggaacacctaacacgggccaacaagtagccgtcccggatcttgcccaccagccatctccacctgtaaacggtcaaccccccctaggcagcctccaggccctggttcgtgaggtatggttagagaagccacgatacgacgcagccgaaagagggttttatgaggcactgttcgacggccacccccctggcaaggtgcgcctgcaagagcgggctggactggccgaaggtgcgcgccggggcagaagagaccgtaggggccgcaacattctgggaaataaacgggcgggcttgaggcgagccgacggcgaagcccctagcgctttaccttactgctacttcctgcaaaaagacgccgaggctccatggttgtctaaacccgcctacgacagcgctgagtgccgccaccatgcggccgaggccttaagggtagcctggtgcttagaggccgcatcactctctcaccgacccggacctcggagcggcctttccgtgtcttcgttacgacccaatcgaaagatggccactaactttcttgctcacgagaagatctggtttgataagttcaagtatgacgacgctgagagacgattttacgaacagatgaatgggccggtcgcaggagcttctcggcaggaaaatggcgctagtgtaattctgagagatatcgccagagcccgagaaaatatccaaaagagcctagccgggagctcaggcccgggagcctccagcggaacaagtggcgatcacggggagctggtggtaaggatcgcatccctcgaggtggagaatcaatcattgcggggcgtggtacaagagctccagcaggcaatctcgaagcttgaggccagactcaatgtactggagaagtcatctcccggtcaccgagccaccgccccgcagacacagcatgtgtcacccatgaggcaagtcgagccccccgcaaagaaacccgcaacacccgccgaggatgatgaagatgacgacatcgatttatttgggtcggataacgaagaggaggataaagaagccgcccaattgagagaagaacggctgagacagtatgccgagaagaaagcaaagaagcctgcgctagtagccaagagctctatcctgctagatgttaagccttgggacgacgagaccgacatggcacagctggaagcatgcgtgcggagtatccagctggatggattagtttggggagctagcaaactggtgccagtaggatatggtattaggaagctgcagatccagtgcgtcgtggaagatgataaggtggggactgacctgctggaggaagaaataacaaaatttgaagagcacgtgcagtctgttgatatagcagccttcaacaaaatctag

SEQ ID NO: 187008 - DNA, 1944 bp, Artificial Sequence
  Description of Artificial Sequence: Synthetic coding sequence
atgcggagcggcaaggccagctgcaccctggagaccgtgtgggaggacaagcataagtacgaagaagccgagagacgtttctacgagcacgaggcaacacaggccgccgcaagcgcccagcagttgcctgctgaaggaccagctatgaacggaccaggtcaggacgatcccgaggatgcagacgaagcagaggcaccggacggaggaagcagacgtgaccctagaaagtcccaagatagtaggaagcctctccaaaagaagcggaagagatccccgaagtcaggattgggccccgcagatttggcgctgcttggtctaagtgccgaaagggtatggctggacaagagcctctttgatcaagctgagtcaagctacagacaaaagctcgccgatgtggctgcacaggccgcctggcccccagcccttgcgccttggggtctgtgcactcacggcaaccaagtggcctgtcatcatgttacatggggcatctgggttaacaagagctccttcgaccaggccgagcgcgcatttgttgagtggtcacaagcccttctactggcacctgatggtagccggcggcaaggcacgcctaatactggtcaacaagtggcagttcccgatctcgcccatcagccttctccccctgtgaacgggcagcccccactcggatcgctgcaggccctcgtgagggaggtgtggctggagaaaccccgctacgatgcagccgaaagagggttctatgaggctttatttgatggacaccctcctgggaaggtgagactccaagaaagggctggactggccgagggagcacggaggggacgcagggatagacggggtaggaatatcctggggaataagcgggcaggcctccgaagagcagatggcgaggccccctcagccttgccttattgttactttctccagaaggacgctgaggccccctggctgtctaagccagcatacgactcagctgagtgcagacaccatgctgctgaggctctccgggttgcctggtgcctggaggccgcatcactgtcccacaggcccggccccagatcaggcctttcagtcagttctttaagacccaacaggaagatggcgacaaactttcttgcacacgaaaagatctggttcgacaagttcaaatatgatgatgccgagagacgattttacgagcagatgaatggccctgttgctggcgctagccgccaggagaacggagcctccgtgatactgagagacattgcccgggcccgcgaaaatatccagaaaagtctggccggctcctcaggacccggggccagctctggcaccagtggagatcatggagaactagtcgtcaggatcgcctctttggaagttgagaatcagtctctcagaggagttgtccaggagcttcagcaggccatatcgaaattagaagcccggctgaatgtattggagaagtctagtccaggccaccgtgctacggccccacagactcagcatgtgagccctatgcgccaggtggaaccccccgcaaaaaagcctgccactcctgccgaggacgacgaagacgacgacatcgaccttttcgggtcagataatgaagaagaggataaagaggccgcccagctgcgggaggagaggctcaggcagtacgcggaaaagaaggccaaaaagccagccctggtagcaaagtctagcatcctgctcgacgtcaaaccatgggatgacgagacggacatggcccagcttgaggcttgcgtacgcagtattcaattagatggcctggtttggggtgcatcaaaattagtacctgtgggatacggcatacggaaattgcagattcagtgcgtggtggaagatgataaggttggcactgacttactggaggaagagatcaccaagtttgaggagcatgtgcagtccgttgatatcgcagcttttaataaaatctag

SEQ ID NO: 187009 - DNA, 774 bp, Artificial Sequence
  Description of Artificial Sequence: Synthetic coding sequence
atggccaccaacttcctggcccacgagaagatctggttcgacaagttcaagtatgacgatgcggagcggcggttttatgagcagatgaatggcccagtggctggggcctctagacagagctcagggcctggcgccagcagcggtactagtggggaccatggggagctcgttgtgcgtatagcctccttagaagtcgagaaccaatctttacggggagtagtacaggaactgcaacaggccatcagtaaactggaggcccgcctgaatgtactggaaaaaagcagcccgggccaccgtgccaccgcaccgcagactcagcatgtatccccaatgcgacaagtggaacccccagccaaaaaaccagcaacaccggccgaggacgacgaagacgatgacatcgatctgttcggttctgataatgaggaggaagataaagaggccgcacagctgcgcgaagagcggctgagacagtacgctgagaagaaggccaagaaacccgcgctggtggccaagtcatcaatcctcctggacgtgaagccttgggacgacgagactgacatggctcaacttgaagcctgcgttcgctcaatccagttagatggcctggtgtggggcgccagcaaattggtccccgtcggatacgggatcaggaagctgcagatccaatgtgttgttgaggacgataaagttggcaccgatctcctggaggaagagattacgaagtttgaggaacacgtgcaatctgtggacatcgccgcattcaacaagatctag

SEQ ID NO: 187010 - DNA, 546 bp, Artificial Sequence
  Description of Artificial Sequence: Synthetic coding sequence
atgcggagcggcaaggccagctgcaccctggagaccgtgtgggaggataaacataaatacgaagaggctgagaggagattttacgagcacgaggcaacccaggcggcagcaagcgcacaacagctgccagcagagggaccagccatgaatggtccaggtcaggatgaccccgaagacgctgatgaagccgaggccccggacggaggctcccgtcgcgaccctcgcaagtcacaggactcaagaaaaccccttcaaaaaaaacgaaaacgctcaccaaagagcggcctagggccagccgatttagccctccttggccttagcgcggagcgggtatggctggacaagtcccttttcgatcaagccgaatcaagctataggcaaaagctcgccgatgtggccgctcaggctgcatggccccccgccctggccccatggggcctgtgcactcacggcaaccaggtggcctgccaccacgttacatggggcatctgggtaaataagtcatcattcgatcaggctgagcgggcttttgttgagtggagctag

SEQ ID NO: 187011 - DNA, 192 bp, Artificial Sequence
  Description of Artificial Sequence: Synthetic coding sequence
atgcggagcggcaaggccagctgcaccctggagaccgtgtgggaggacaaacataagtatgaagaagccgaacgaaggttctacgaacatgaggcgacccaggctgctgcctctgctcaacagctgcctgccgaagggcccgcgatgaatggtcccggtcaggatgatcccgaagacgcagacgaggcatag

SEQ ID NO: 187012 - DNA, 120 bp, Artificial Sequence
  Description of Artificial Sequence: Synthetic coding sequence
atggccaccaacttcctggcccacgagaagatctggttcgacaagtttaagtatgatgatgctgaacggagattctacgagcagatgaacggtcctgtggctggtgcgtcaagacagtag

SEQ ID NO: 187013 - DNA, 246 bp, Artificial Sequence
  Description of Artificial Sequence: Synthetic coding sequence
atgcggagcggcaaggccagctgcaccctggagaccgtgtgggaggataagcataaatacgaagaggcagaacggcggttttatgaacacgaagccacccaagcggctgccagtgcacaacaacttccagcggaggggcccgccatgaacggtccgggacaggatgaccccgaggatgccgatgaagcagaagcacccgacggaggctcaagacgcgatccccgcaagagccaggattccaggtag

SEQ ID NO: 187014 - DNA, 114 bp, Artificial Sequence
  Description of Artificial Sequence: Synthetic coding sequence
atgcggagcggcaaggccagctgcaccctggagaccgtgtgggaggataaacataagtatgaggaggcagagaggcgtttttacgaacacgaagccactcaggccgcagcttag

SEQ ID NO: 187015 - DNA, 162 bp, Artificial Sequence
  Description of Artificial Sequence: Synthetic coding sequence
atgcggagcggcaaggccagctgcaccctggagaccgtgtgggaggacaagcataaatatgaagaggccgagcgccgattttacgagcacgaggccacgcaggcagccgcctccgctcagcagctgccagctgagggaccagctatgaacggaccagggtag

SEQ ID NO: 187016 - DNA, 192 bp, Artificial Sequence
  Description of Artificial Sequence: Synthetic coding sequence
atggccaccaacttcctggcccacgagaagatctggttcgacaagtttaaatacgacgacgcagagaggagattttacgagcaaatgaacgggcccgtcgccggggccagtagacaggagaatggtgcgtccgtcatactcagagatatcgcaagagcccgcgaaaatattcagaagagtcttgccggctag

SEQ ID NO: 187017 - DNA, 903 bp, Artificial Sequence
  Description of Artificial Sequence: Synthetic coding sequence
atgcggagcggcaaggccagctgcaccctggagaccgtgtgggaggataaacacaagtatgaggaggccgaaagacgtttctacgaacacgaggcaacacaggcagctgcctctgcccagcagctccccgctgaaggtcctgccatgaatggcccaggtcaggatgatcccgaggacgccgacgaagccgaggccccagatggcggaagtcggcgtgacccccgcaaaagtcaagacagcagaaaaccgcttcagaagaaaagaaaacgctcccccaaaagcggtctgggcccggctgacctagcactcctgggactgagcgccgagcgggtttggctggataagagcctcttcgaccaagccgaatccagctaccgtcagaaacttgcagacgtcgcagctcaggcggcatggcccccagctcttgctccatggggactgtgtacccacggcaatcaggtcgcttgccatcatgtaacatgggggatctgggtcaacaagagtagttttgaccaagcggagcgggcattcgtggagtggtctcaagccctgcttttagccccagatggctccaggaggcaaggtactcctaatacgggacagcaagtggccgtccccgatctggcccatcagccttctccacctgtgaatgggcaaccgcccttgggctccctacaggccttagtccgagaagtgtggctggagaagccccggtatgatgccgctgaacgcggcttctatgaagcgctcttcgacgggcacccccctgggaaagtcaggctgcaagaacgtgctggcctcgcagaaggcgcccggcgcggcaggcgtgaccgccgggggagaaacatcctgggaaacaaacgggctgggcttagacgcgctgatggcgaggctcccagctag

SEQ ID NO: 187018 - DNA, 66 bp, Artificial Sequence
  Description of Artificial Sequence: Synthetic coding sequence
atgcggagcggcaaggccagctgcaccctggagaccgtgtgggaggacaagcacaaatatgagtag

SEQ ID NO: 187019 - DNA, 474 bp, Artificial Sequence
  Description of Artificial Sequence: Synthetic coding sequence
atgcggagcggcaaggccagctgcaccctggagaccgtgtgggaggacaaacacaagtacgaggaagcggagcggcgcttctacgagcacgaggccactcaagcggctgcgtctgctcagcagctcccagccgaagggccagcaatgaatgggcccggccaggatgatcctgaggacgcggatgaggcggaagcccccgacggaggtagccggagggatccgcgcaagagtcaagacagccgaaagccattgcagaaaaaacggaagcggtcccctaagtcggggctcggaccagccgacttagccctgctgggattatccgctgagcgagtgtggctcgacaaatctctgttcgaccaggctgagtcgtcctacaggcagaaactggcggacgtggccgcccaagcggcttggccacccgcactggctccctgggggctctgcacccacggcaaccaggtggcctgtcattag

SEQ ID NO: 187020 - DNA, 774 bp, Artificial Sequence
  Description of Artificial Sequence: Synthetic coding sequence
atggccaccaacttcctggcccacgagaagatctggttcgacaagttcaagtacgacgacgccgagaggcgcttttatgagcagatgaacggtccagtcgctggcgcctcgcgtcagagtagcggccctggagccagcagtgggacatctggcgaccatggagagttagttgtgagaatcgccagcctggaagtggaaaaccaaagtcttcgaggcgtcgtacaggagttacagcaagcgatttccaaattagaagcgcgactgaacgtgttagaaaaatcctcccccgggcatcgcgcgacagcaccccagacccagcacgtgagccctatgagacaggtagagccaccggccaaaaaacccgcaactccagcagaggatgacgaagacgatgacattgacctgttcgggagcgacaatgaagaggaagacaaagaagctgcacagctaagggaggaacgcctccgtcaatacgctgagaagaaggccaagaaacccgctctggtggcgaaatcttcaatcctgctggatgtcaagccatgggacgatgaaaccgacatggcccagctcgaggcctgtgtacgtagcattcaattagatggtctcgtgtggggcgcttctaagctagtgcccgttgggtacggaatccgaaagctgcagatacagtgcgtcgttgaagatgataaggtcgggacagatctgcttgaagaggagattacaaagtttgaagagcatgtgcagtctgttgacattgctgccttcaacaagatctag

SEQ ID NO: 187021 - DNA, 846 bp, Artificial Sequence
  Description of Artificial Sequence: Synthetic coding sequence
atggccaccaacttcctggcccacgagaagatctggttcgacaagttcaaatatgatgacgcagaacgacgtttctacgaacagatgaacggaccggtggcaggagcctcacgtcaggagaatggggctagcgtgatcctccgagatatagcgagggcccgggaaaatatccagaaaagcctcgcaggctccagcggacctggtgccagttcaggaacttccggagatcacggtgagctagtggtacggatagccagtctcgaagtggagaaccaatctctgcggggcgtcgtccaggagttacagcaggcaatatctaagcttgaggccagactcaacgtcctcgagaagtcgtctccaggacaccgggcgaccgcaccacagacccagcacgttagccctatgcggcaagtggagccccctgcaaagaagccagctacccccgctgaggatgatgaggacgatgatatagatctgtttgggagcgacaatgaggaggaggacaaagaagccgcccagctgcgggaagagaggttaaggcagtatgcggaaaagaaggctaagaaacccgcactggtagctaaatctagcatattgctggacgtaaagccatgggacgacgaaacagacatggctcagttagaggcttgtgtccgctcaatccaactggacggactggtatggggcgccagcaagctggtgcccgtcggatatggcattagaaaactgcagatacagtgcgtggtggaagatgacaaagtcgggactgatctcctagaagaagagattaccaaattcgaggagcatgttcagtctgtggacatcgccgctttcaataaaatatag

SEQ ID NO: 187022 - DNA, 441 bp, Artificial Sequence
  Description of Artificial Sequence: Synthetic coding sequence
atgcggagcggcaaggccagctgcaccctggagaccgtgtgggaggataagcataaatacgaggaagccgagcggcggttctacgaacatgaagctacccaggctgctgctagtgcccagcagctgcccgctgagggtcccgccatgaacggacctggccaggacgatccagaggacgcggacgaggcagaagctcctgatggtggctcgaggagagacccacgaaagtctcaagatagccgaaagcccctgcagaagaagcgcaagcggtctccgaaatcaggacttggaccagctgacctggcattattggggttaagtgccgagagagtgtggctcgataaatctttgttcgaccaggccgaatcgtcatatagacaaaagctggcagatgtggccgcccaggctgcctggccgcctgctttagctccctgggggtag

SEQ ID NO: 187023 - DNA, 615 bp, Artificial Sequence
  Description of Artificial Sequence: Synthetic coding sequence
atggccaccaacttcctggcccacgagaagatctggttcgacaagttcaaatacgatgacgccgagcggagattctacgaacagatgaacgggccggtagctggtgcctcacgacaggaaaacggggcctccgtgattctgcgggacatcgcacgtgctcgtgagaacatccagaagagcttagccgggagctccggaccgggggcgtcatcaggtactagtggcgatcacggtgagctggtcgttcgaatcgcttccctcgaggtcgaaaaccagtctttacgaggcgtcgtccaggaacttcagcaagccatttcaaagttggaggcacgtcttaacgtgctagagaagtccagccctggacatcgggcaacagctccacaaactcagcacgtgtccccaatgcggcaagtcgaacccccagccaagaagccagccactccagcagaagacgacgaggatgatgacattgacctctttggatctgacaacgaagaagaggataaggaagcagcacagctgcgggaggaacgcctcagacagtacgctgaaaagaaggcgaaaaaacccgcactggtggccaaatcctctatcctgctagatgtcaagccctag

SEQ ID NO: 187024 - DNA, 390 bp, Artificial Sequence
  Description of Artificial Sequence: Synthetic coding sequence
atgcggagcggcaaggccagctgcaccctggagaccgtgtgggaggacaagcataaatacgaagaggcagagcggcggttctacgaacatgaagccacccaagccgccgccagcgcccagcagctgcccgcagaggggcccgcgatgaacgggcctgggcaggatgacccagaagacgcagatgaggcagaggcccccgacggaggaagtaggcgggatcccagaaaaagccaagactcacgaaaacccttgcagaagaagcgcaaacggagccccaagagtggactgggacccgctgacctggccctgctcggcttgtccgccgagcgtgtctggctcgacaagagcttatttgatcaggcagaaagtagctaccggcagaagctctag

SEQ ID NO: 187025 - DNA, 501 bp, Artificial Sequence
  Description of Artificial Sequence: Synthetic coding sequence
atggccaccaacttcctggcccacgagaagatctggttcgacaagttcaaatacgatgacgccgaaaggaggttctacgagcaaatgaatggtcccgtggccggtgcctctcggcaagagaacggcgcatctgttattcttcgggacattgcacgggcacgggaaaacatccagaaatctttggcaggctctagcggtcctggcgcctcctctgggacctccggtgatcacggcgaacttgtggtgagaatagcttccctggaggtggagaatcagagtctgaggggagttgtccaggaactgcagcaagcgatatctaagctcgaggcccgtctgaacgttttggagaagtcatctcctggccacagggccactgcgcctcagacacagcatgtctcgccaatgagacaagttgaacctcccgccaagaaacccgcgaccccagcagaagatgacgaggacgacgatatcgatctgttcggtagcgacaatgaagagtag

SEQ ID NO: 187026 - DNA, 255 bp, Artificial Sequence
  Description of Artificial Sequence: Synthetic coding sequence
atgcggagcggcaaggccagctgcaccctggagaccgtgtgggaggataagcacaaatacgaggaagcagagcggaggttttatgaacatgaagcaacgcaggctgccgcatcagctcagcagctgcctgctgagggaccagcaatgaatggaccaggtcaagacgaccccgaggacgctgatgaagcagaagctcctgacggaggttctcgccgtgacccaaggaaatcccaggattcaaggaagcccctttag

SEQ ID NO: 187027 - DNA, 600 bp, Artificial Sequence
  Description of Artificial Sequence: Synthetic coding sequence
atggccaccaacttcctggcccacgagaagatctggttcgacaagtttaagtacgatgacgccgaacgccgattttatgagcagatgaacggccctgtagccggagcgtctcgccaggaaaacggcgccagcgtgatactgagggacattgccagagcccgcgaaaacattcagaagagtctggccggcagcagtggtccaggcgcctcctccgggacatctggcgaccacggggagctagtcgtcaggattgctagcctggaggtggaaaatcagtctttacgcggagttgtccaggagctgcaacaggcaatctcaaaattggaagcacgtttgaatgtgttggagaaatcatccccagggcacagggcaacagccccacagacccaacatgtatcccccatgagacaggttgagccccccgccaagaaaccagccaccccagccgaggatgatgaagatgacgacatcgatttattcggctcggacaatgaggaagaagacaaggaggctgcacagctgagggaggagcgcctcaggcagtatgctgaaaagaaggcaaagaagcccgcacttgtcgccaagtcctcaatcctgtag

SEQ ID NO: 187028 - DNA, 774 bp, Artificial Sequence
  Description of Artificial Sequence: Synthetic coding sequence
atgcggagcggcaaggccagctgcaccctggagaccgtgtgggaggacaagcacaaatatgaagaagctgagaggaggttctacgagcatgaagcaactcaggctgccgcttcggcccagcagctgcccgctgaggggcccgcaatgaatggtcccggccaggacgaccccgaggacgctgacgaagccgaggctccggacggaggatcccgaagggacccacggaagagccaggacagtcggaagcccctccaaaaaaaaagaaaaaggtctccaaagagcgggttggggcccgccgatttggccctgctggggctctccgctgagcgagtttggctcgataaatccctctttgaccaagccgagagttcctacagacagaagctcgccgatgtggcggcccaggcagcatggcccccagcacttgccccctggggcttgtgtacgcatggcaaccaggttgcctgccaccatgtgacctggggcatctgggtaaataagagtagtttcgatcaggccgagagggcgtttgtggagtggtctcaagccctgctgctggcacctgatgggtctagaaggcaaggcacaccaaatacaggccagcaagtggcagtcccagatctggctcaccaaccttccccccccgtcaacgggcagcctcctctgggatccctgcaggctcttgttcgagaagtttggctggaaaagcccaggtacgatgctgccgagagaggtttctacgaggcgctctttgacggacatcccccaggatag

SEQ ID NO: 187029 - DNA, 540 bp, Artificial Sequence
  Description of Artificial Sequence: Synthetic coding sequence
atgcggagcggcaaggccagctgcaccctggagaccgtgtgggaggacaaacacaagtatgaagaggctgagcggagattctatgagcatgaggccactcaggcggccgcgtccgctcagcagttgcccgcggagggcccggccatgaacggtcctgggcaggatgacccagaagacgcagacgaagccgaagcacccgacggcggaagccgccgtgaccccagaaagtctcaggactcacgtaaacccctgcagaagaaaaggaagcggtcccccaagagtggcctgggccccgcagatttggcactgctagggctttcagctgaaagagtgtggctcgataagtcactcttcgatcaggcagaatctagctaccgccagaagttggccgacgtggctgcccaagctgcctggcccccagccctggccccgtggggactttgcacccatggcaaccaggtagcctgtcaccatgtgacgtggggcatttgggtcaataagtctagcttcgatcaggcagagcgtgctttcgtagaatag

SEQ ID NO: 187030 - DNA, 108 bp, Artificial Sequence
  Description of Artificial Sequence: Synthetic coding sequence
atggccaccaacttcctggcccacgagaagatctggttcgacaagtttaagtatgatgatgccgagcggcgtttctacgaacagatgaatggacctgtcgctggctag

SEQ ID NO: 187031 - DNA, 150 bp, Artificial Sequence
  Description of Artificial Sequence: Synthetic coding sequence
atgcggagcggcaaggccagctgcaccctggagaccgtgtgggaggacaagcacaaatatgaagaagctgaacgacggttctacgagcatgaagccacacaggcagctgcaagcgcccaacagttacccgctgaaggacctgccatgtag

SEQ ID NO: 187032 - DNA, 120 bp, Artificial Sequence
  Description of Artificial Sequence: Synthetic coding sequence
atggccaccaacttcctggcccacgagaagatctggttcgacaagttcaaatacgatgacgcagaacggagattttatgagcaaatgaatggcccagtcgccggggctagcagacaatag

SEQ ID NO: 187033 - DNA, 573 bp, Artificial Sequence
  Description of Artificial Sequence: Synthetic coding sequence
atgcggagcggcaaggccagctgcaccctggagaccgtgtgggaggataaacacaagtatgaggaggcggagcgtaggttctatgaacacgaagctacccaggctgccgcctccgctcagcaactgcccgccgagggccccgctatgaatggacctggccaggatgatccagaggacgccgacgaggccgaggccccagatggcggtagtcgtagggatccgcgcaagtctcaagatagcagaaagcctttgcagaaaaaacggaaaagatccccaaaaagcggcctgggtccagccgatctcgccctgctgggcttgtcagccgagagggtttggctggataaaagtttgttcgaccaggctgagagctcgtaccgccagaagctcgccgacgtggctgcccaagcagcctggcctccagcccttgctccgtggggactgtgcacccacggcaatcaggtggcttgccaccatgtgacctggggcatctgggtgaacaaaagttcctttgaccaggccgagagggcttttgttgagtggagccaagcgcttctgttggctcccgatggatag

SEQ ID NO: 187034 - DNA, 2094 bp, Artificial Sequence
  Description of Artificial Sequence: Synthetic coding sequence
atggaggcccccctgggcagcatcctgagcccctgccccggccgggccgccaccggccgcgcgggcaccggacgggtagggacaggactgagacctccagccgtgttacagctctgccctcttctggctttctaccggtgtgtgaggaagatgagatccggcaaagcctcttgtaccctcgaaaccgtctgggaagacaagcacaaatatgaggaagcggagcggagattttatgagcatgaggctacccaggcagcggccagcgcccagcagctgcccgctgaggggccagcgatgaacggaccgggtcaagacgatcccgaggacgccgatgaggcagaggcccctgatggaggatcccgacgggacccacgtaaatcacaggattcccggaaacctttgcaaaagaagagaaagaggagccccaagagcgggcttgggccagcggatctggccctgcttggtctctcagcagaacgtgtgtggctggataaatctctgtttgatcaggccgaaagtagttacagacagaagctcgccgatgtggcagcccaggcagcgtggccaccagccctggccccctggggactctgtacacacggtaaccaggtagcttgccatcacgtcacatgggggatttgggttaacaaatccagcttcgatcaggcggaaagagccttcgtggagtggtcacaggctctgctgctggccccagatggatcccgtagacaaggaacacccaataccgggcagcaagtggccgtacccgacctggctcatcagccttcaccccccgttaacggtcagccaccactcggctctttgcaggcactggtcagagaggtatggctagagaaaccccggtatgatgccgctgaaagggggttctacgaggccctcttcgatggtcacccaccaggtaaggtccgcctgcaggaaagggccggtctggctgaaggcgcgcggagaggacgacgggaccgccggggccgcaatatactggggaacaagcgcgccggactccggagagccgatggagaggcgccttctgcgctgccgtactgttacttcttacaaaaggacgcggaggccccatggctgagcaaacctgcctacgactccgctgaatgcaggcaccacgccgctgaggctctgagagtagcatggtgtctggaggccgctagccttagtcacaggcctggcccaagatcgggtttgagcgtctccagcctccggcccaatcgcaagatggcgacaaactttcttgctcacgaaaaaatctggttcgataagttcaaatacgatgatgccgaaagacgattctacgagcagatgaacgggcccgttgccggcgcttctcggcaggaaaacggagctagtgtgatcctcagagatattgcacgggcaagggagaatatccagaagtccctcgcaggctcttcgggacccggagcatcttctgggaccagcggagaccacggcgagctagttgtaaggatagcctccctcgaggtggaaaaccaatccctccgcggagttgtccaggaattgcagcaagcgatctctaaattggaagctagacttaatgtgctggaaaaatctagccccgggcaccgagcaacagctcctcagacgcagcatgttagccccatgagacaggtagagcctccagcgaagaagcctgccaccccagcggaggacgacgaggacgacgatatagatttgttcggatccgataatgaggaggaggataaagaagctgctcagctccgggaggagcggctcagacaatatgccgaaaaaaaggcgaaaaaaccagcccttgtcgccaagagtagtatcctgctcgacgtcaagccctgggacgatgaaaccgatatggcacagctagaagcttgtgtcaggtccattcagctggatggcctggtgtggggtgcctctaagctggttcctgttggctacggaattcgcaagctacagatccagtgcgtggtggaagatgataaggtgggcaccgatctgctggaagaggagattacaaagttcgaagagcatgtgcagagtgttgatattgctgcttttaataaaatttag

SEQ ID NO: 187035 - DNA, 615 bp, Artificial Sequence
  Description of Artificial Sequence: Synthetic coding sequence
atggccaccaacttcctggcccacgagaagatctggttcgacaagttcaagtatgatgatgccgaaagaaggttttatgagcagatgaatgggccggtcgcgggggccagccgccaggagaacggggccagtgtgatactccgtgacatcgccagggcccgagaaaacatacagaagtcactcgcggggagtagcggccccggcgcctcctcaggaacctcaggggatcatggagagctcgttgtgcggatcgccagtctggaggttgaaaaccagagccttcggggcgtggttcaggaattgcagcaggctatttctaagctggaagctcgtctcaatgtactagagaagtcatctcctgggcatcgagccactgcccctcagacgcagcatgtcagcccgatgaggcaggtagaacccccggcaaaaaaacctgccacccccgctgaggacgacgaggacgacgacatcgacctgtttgggtccgacaacgaagaggaggacaaagaagctgcgcagctgagagaggaacgtctgcgccaatacgctgaaaaaaaggctaaaaagcctgcgttggttgctaagtcctccattctgttggacgtaaagccatag

SEQ ID NO: 187036 - DNA, 507 bp, Artificial Sequence
  Description of Artificial Sequence: Synthetic coding sequence
atggccaccaacttcctggcccacgagaagatctggttcgacaagtttaagtacgacgatgccgagagaagattctacgagcaaatgaacggaccagtggccggcgcatcacgccaagaaaatggggcaagcgtgatactccgagacattgctagagcacgggaaaatatccagaagtctcttgcagggtcttctggcccaggagcgtcctccggcacaagcggggaccatggcgaactggtggtgcgcatcgcaagccttgaggtggagaatcaatccttgcggggggttgtgcaggagttgcaacaggccatatccaagctcgaagcacggcttaacgtgctggagaaatcctctccaggtcatagagccaccgcacctcaaacccagcacgtcagccccatgcgacaggtcgagcctccagcaaagaagccggccacccccgcagaggacgatgaggacgatgatatcgatttatttggctccgataacgaggaagaagattag

SEQ ID NO: 187037 - DNA, 786 bp, Artificial Sequence
  Description of Artificial Sequence: Synthetic coding sequence
atggccaccaacttcctggcccacgagaagatctggttcgacaagtttaagtacgatgacgccgagaggagattttatgaacagatgaatggtccggtggctggggctagtaggcaagagaacggcgcctcggtgatcctccgtgatatcgcacgggccagggagaatatacagaagagtctggccgggagctcaggtccgggcgccagcagcggaacaagtggagatcacggagagcttgtggtacgtatagcttcgttagaggtagagaaccagagtctcaggggcgtggtgcaggagttacaacaggctatatcaaagctggaagctaggctgaacgttttggaaaaatcgtctccaggtcacagggctaccgcaccacaaacccagcacgtgtctcctatgagacaggtggagcccccagctaaaaaacccgcaacaccagccgaagacgatgaggacgacgatatagatctattcggctccgacaacgaggaggaagataaggaagccgctcagctgcgtgaggaacggctccgtcaatatgccgagaagaaagccaagaagcccgccttggtagccaagtcaagcattctgctcgacgtgaaaccgtgggacgatgagaccgacatggcacaactggaggcatgtgttaggtcaattcagttggatgggctggtatggggagcctcaaagctggtaccagtgggatacggaatacggaagttgcagatacagtgtgttgtcgaagacgataaggttggaactgatctgctggaagagtag

SEQ ID NO: 187038 - DNA, 96 bp, Artificial Sequence
  Description of Artificial Sequence: Synthetic coding sequence
atgcggagcggcaaggccagctgcaccctggagaccgtgtgggaggacaagcacaaatacgaggaggctgagcgtaggttctacgagcacgagtag

SEQ ID NO: 187039 - DNA, 207 bp, Artificial Sequence
  Description of Artificial Sequence: Synthetic coding sequence
atgcggagcggcaaggccagctgcaccctggagaccgtgtgggaggacaagcataagtacgaagaagcggagaggaggttctatgagcatgaggcaacccaggccgcagcctctgctcagcagttacctgcagaaggtcctgcaatgaacgggcctgggcaggacgacccggaagatgccgacgaggcggaggctcctgacgggtag

SEQ ID NO: 187040 - DNA, 789 bp, Artificial Sequence
  Description of Artificial Sequence: Synthetic coding sequence
atggccaccaacttcctggcccacgagaagatctggttcgacaagtttaaatatgacgatgccgaacggagattctacgagcagatgaatggacccgtggcgggggcctcaaggcaagaaaatggggcctctgtcatcctgagagatatagcaagagcccgggagaatattcagaagtcccttgctgggtcatctggtcccggtgcatcaagtggcacaagcggggaccacgtggtgcaagaattacagcaggctatctcaaaactcgaggcgaggctgaacgtactcgagaaatcatccccgggtcaccgggctactgcacctcagactcagcacgtgtctcccatgaggcaggtggaacctcccgccaaaaaaccagcaacccccgcggaggatgatgaagacgatgatattgacttattcggcagcgataatgaagaggaggataaagaggccgcacaactgagggaggagcgcctccgacagtacgctgagaaaaaggctaagaagcccgcgctggttgcaaaaagctccattctgttagatgttaaaccttgggatgatgaaacagatatggcccagctggaggcttgtgtgcgctccatccagctcgatgggctggtgtggggagccagtaagcttgtccccgtcggatacggaatccgaaagctccagattcaatgtgttgtcgaggatgacaaagttggaactgacctgttagaagaggagattacaaagtttgaagaacatgttcaaagtgtggacatagcggcgtttaataaaatctag

SEQ ID NO: 187041 - DNA, 525 bp, Artificial Sequence
  Description of Artificial Sequence: Synthetic coding sequence
atggccgccgccgccgagctgagcctgctggagaagagcctgggcctttcaaaaggaaacaagtatagcgctcagggagaaagacagatccctgtgctgcagactaacaacgggccttccttgacaggcctgaccaccatcgccgcgcatctcgtcaagcaagctaataaagagtatttgctgggtagcacagctgaagagaaagcaatcgtgcagcaatggctcgagtaccgcgtgacccaggtagatggtcatagctccaagaatgacatacacactttgttgaaggatttgaattcctatcttgaagataaggtttacttgaccggctacaatttcactctggctgatatccttctttattatgggctgcatcgttttatcgtcgatcttacagtgcaggagaaagagaagtatctgaatgtcagccggtggttctgccatattcaacattaccccgggatccggcagcacctctcttcagttgtttttattaagaataggctgtacaccaacagccactag

SEQ ID NO: 187042 - DNA, 420 bp, Artificial Sequence
  Description of Artificial Sequence: Synthetic coding sequence
atggccgccgccgccgagctgagcctgctggagaagagcctgggcctgagcaaaggtaataaatattctgcccagggggaaaggcagatccctgtgctgcaaaccaacaacggaccctctttgaccggcttaactaccatcgccgcacacttagtgaaacaagctaacaaggaatacttactggggtcgactgccgaggaaaaggctatcgttcagcagtggctcgaataccgcgtgacgcaggtggacggtcattcctcaaagaacgacatccatacgctgctgaaggatctgaatagctacttggaagacaaggtttacttgacgggttataactttactttggccgatattctgctgtattacggacttcacaggtttattataagaaagcttcggcataccgaggtgggaaactag

SEQ ID NO: 187043 - DNA, 1314 bp, Artificial Sequence
  Description of Artificial Sequence: Synthetic coding sequence
atggccgccggcaccctgtacacctaccccgagaactggcgggcctttaaagcactgattgccgcccaatatagtggcgctcaagttcgggttttatcagcacccccacattttcactttggacagacaaaccgcacccctgagttcctccggaaattccccgctgggaaggttcctgcctttgagggagacgatggattctgtgttttcgaatccaacgccattgcttattacgtgagtaacgaggagctgcgggggtcaacgcctgaggcagccgcgcaggtcgtgcagtgggtgtctttcgctgactccgatatcgtgccacctgcaagcacttgggtgtttccaacactcggaatcatgcatcacaacaagcaggcgaccgagaacgcgaaagaggaggtaagacggatcctcggattgttggatgcataccttaagactaggaccttcctagtcggggaaagggtaactctggccgatatcactgtggtgtgcaccttattgtggctttataaacaggtgttggagcccagcttccgacaggcatttcctaacactaatcgatggtttttgacatgcatcaaccaacctcagtttagagcggtgctgggtgaggtcaagctttgtgagaaaatggcccagtttgacgctaaaaaattcgctgaaacacagccaaagaaagataccccccgaaaggagaaggggtcccgagaagaaaagcagaagcctcaggcagaaaggaaggaagaaaaaaaagctgccgcccccgcgcccgaggaggagatggatgagtgcgagcaggctctcgcggccgagcccaaggccaaggacccatttgctcatctgccgaagagcacctttgtcctcgatgagtttaaacggaaatacagtaacgaggatacactgagcgtggccctcccctacttttgggagcatttcgacaaagacggatggtctctgtggtactcagaataccggtttcctgaggaattgacacagacttttatgtcttgcaacctcataaccggtatgtttcagaggcttgacaagttgcgaaagaatgcgttcgcctctgtgatcttatttgggacaaataactcctcaagcatttctggtgtgtgggtgttccgaggccaggaacttgcgtttcctctctcacccgattggcaggtggactatgaatcatatacatggcgcaagctggatcctggatctgaggaaactcagacactagtgcgcgaatatttctcttgggagggggcatttcaacacgtgggtaaagcgttcaatcaaggaaagatcttcaaatag

SEQ ID NO: 187044 - DNA, 1464 bp, Artificial Sequence
  Description of Artificial Sequence: Synthetic coding sequence
atggccgagcggtgggtggcccccgccgtgctgcggcgggcccggttcgcctctacttttttcctgtcaccccaaatttacgctcataaggatggggacctacgaagtgcctttttcatactgtcgttcaaacggggcgaatttatccccttcttgaactggaccttgtacacatatccagaaaactggcgcgccttcaaagctctgattgccgctcagtactctggagcgcaggtccgggttctgagtgcacctccccattttcactttgggcagaccaaccggacgcctgaatttctcagaaagtttcccgccggcaaagtccccgcgttcgaaggagacgatggattttgcgtcttcgaaagtaacgccatcgcttactatgtcagcaatgaagaattgaggggctctacgccagaggcggccgcgcaggtcgttcagtgggtttctttcgcagacagcgatatcgttcctcccgcgtctacatgggtctttccaactctcggcatcatgcaccacaacaaacaggcaaccgaaaacgccaaagaagaggtacgtcgcatactagggttgctcgacgcctacttgaaaacccgcacgtttctggttggagagagggtgaccctggcagatatcacagtggtgtgtactctgctgtggctatacaaacaggtgctggaaccttcttttcggcaggcctttcccaacaccaatagatggttcctcacatgtatcaaccaaccgcagttcagagcagtgttaggcgaagtcaagctgtgcgaaaagatggcccagttcgatgctaaaaagttcgccgagacacaaccgaagaaagatacacctaggaaggaaaaaggctccagggaggagaagcagaagccccaggccgagcggaaagaggaaaagaaggccgcagctccagcgcctgaggaagagatggatgagtgtgaacaggcccttgccgctgagcctaaggcgaaagaccctttcgcccatctgcctaaaagtacatttgtgctggatgagttcaaacgaaaatattctaatgaggacacgctgagcgtggccctaccatacttttgggagcactttgacaaggacggctggtcactttggtattccgaatataggttccctgaggaattaacccagacctttatgtcgtgcaatctgattacaggaatgttccagcgtttagataagctccgcaagaacgctttcgccagcgtcatcctgtttggtactaacaattccagtagcatttccggagtgtgggttttcagaggacaggagttggcatttcccctgtctccagactggcaagttgattatgagtcctatacttggcgaaagctggatccaggcagcgaggaaacacaaacattggtgagagagtacttctcatgggaaggtgcatttcagcacgtgggcaaagccttcaatcaaggcaagatctttaaatag

SEQ ID NO: 187045 - DNA, 621 bp, Artificial Sequence
  Description of Artificial Sequence: Synthetic coding sequence
atgcaccacaacaagcaggccaccgagaacgccaaggaggaggtgagaaggatattgggcttactggacgcctacctgaagactcgcactttcctggtcggggagagagtgaccctagcagcggagcccaaggccaaggatccattcgcgcacctcccaaaaagtacatttgtattagacgagttcaaacgaaagtactccaacgaagatacactcagcgtcgccttaccatacttctgggagcatttcgacaaggatggctggtccctatggtactccgagtatagattcccggaggaactgactcagacattcatgtcatgtaatttgatcactggtatgttccagcggcttgataaactgcggaagaacgccttcgcctcggtcattctcttcggaacgaataactcctcgagtatcagtggtgtgtgggtgttcaggggccaggagttagcctttccactgtcaccggattggcaggttgactacgaatcatacacctggaggaagctggaccccggatccgaggagacccagacactagtacgagagtattttagctgggagggggcttttcagcacgtgggcaaggcttttaaccaggggaaaatctttaaatag

SEQ ID NO: 187046 - DNA, 2577 bp, Artificial Sequence
  Description of Artificial Sequence: Synthetic coding sequence
atggtgaacttcaccgtggaccagatccgggccatcatggacaagaaagccaatatacgcaatatgtccgtaatcgctcatgtcgatcacgggaaatccacactgacagacagtctggtttgtaaagctggtataatagccagcgcaagagctggagagactcgattcacagatacgcgtaaagacgagcaggagcggtgtattacaattaagagcacggccatcagtctgttctatgaactatctgagaacgacttgaactttattaagcagagcaaagacggagccgggtttctgatcaatctcatcgactcccctggccacgttgatttctctagtgaagtgacagccgcactgagagtcactgacggtgcactagtcgtggtggattgcgtttcaggcgtttgtgtccagacagaaactgtgctaaggcaagccattgccgaaagaataaagcccgtattgatgatgaacaagatggatagagcgctccttgaactgcaactggagccggaggagctgtatcagacattccaaaggattgtcgaaaatgtgaatgtgattatcagcacgtacggcgaaggcgaatccggtcctatgggcaatattatgatcgatcctgttttggggaccgttggtttcggcagcgggctccacggttgggccttcacactgaaacaatttgcagaaatgtacgtggcaaaatttgctgcgaaaggggagggccagttaggcccggcagaaagggccaagaaggtcgaggatatgatgaagaaactgtggggagatcgttacttcgatccagccaacggcaagttttctaaatccgctacgagcccggaaggtaaaaagctgccgcgcactttctgccagctgatcctggatcccatctttaaagtgttcgatgccatcatgaactttaagaaggaggagacagctaaactgattgagaagctggacattaagctggacagtgaggacaaggacaaagaaggaaagccactgcttaaggccgtgatgcgcaggtggctgcctgctggggacgcccttctccaaatgattactatccacctgccttccccagtcactgctcagaaataccggtgcgaacttctgtatgagggtccgcccgacgacgaggcagccatgggaattaagtcatgcgaccctaaagggcctctgatgatgtacatctctaaaatggtccctacaagcgacaaggggcgcttctatgctttcgggcgcgttttctccgggctcgttagcaccgggctaaaggtccgtattatgggcccaaattatacacctgggaagaaagaggacctatacttaaagccgattcagcgtaccattttaatgatggggcggtatgtagagcctattgaagacgtcccgtgtgggaacatagtgggcttagtcggcgtggaccagtttctagtgaaaaccgggacaattacaacgttcgaacacgcccataacatgagagtgatgaaattctctgtgtctcccgtggttcgcgttgcggtcgaggccaagaaccccgcagacctccccaagctcgttgagggcctgaagcgattggcaaagtcagatcctatggtccagtgcatcatcgaggaatcgggagagcatatcattgctggtgccggggagttgcatctcgaaatctgtttaaaagatctcgaggaagatcacgcttgcattcctatcaagaagtcagacccagtggtgtcttacagggagacggttagcgaagaatccaacgtgctatgtttgagcaagagtcctaacaaacataacagactgtatatgaaggcccgccccttcccggatggcctggcggaggatattgataaaggagaagtgtcagcgcgtcaagaactgaagcagagagcgcgctacctggcagagaaatacgaatgggacgtggccgaggctcgcaagatatggtgctttggacccgatgggacgggccctaatatcctcaccgacattacaaagggcgtccaatacctcaatgaaattaaggacagcgttgttgccggcttccagtgggccactaaggaaggcgcactctgcgaggagaacatgcgaggggtgcgctttgatgtccacgacgtcacgctgcacgctgatgctattcacagaggtggtggccagattattccaacagcccgaaggtgtctttatgcctccgtgttgactgcgcagccaaggttgatggaaccaatatatctggtcgagattcaatgtcctgagcaggttgtgggcggtatctatggagtcctgaacagaaaacgggggcacgtatttgaggagagccaggtggctggaacaccgatgtttgtcgtcaaggcctatctgcccgtgaacgagtctttcggcttcacggccgacctgcggtccaatactggggggcaggcctttccccaatgcgtattcgatcattggcagatcttacccggggatccatttgataactcttcccgcccaagccaggtggttgctgagaccaggaaacgcaagggccttaaggaggggattccggcgctggataattttctggataagctgtag

SEQ ID NO: 187047 - DNA, 1752 bp, Artificial Sequence
  Description of Artificial Sequence: Synthetic coding sequence
atggtgaacttcaccgtggaccagatccgggccatcatggacaagaaggcaaatatcaggaatatgtctgtaatcgctcacgtggaccacggtaagtccacgctcaccgattccttagtgtgtaaggccggcattatagcaagcgccagggccggcgagacacgttttactgatactcggaaggatgaacaggagcgctgtattactataaagagcactgctatttcactgttctacgagctcagtgagaacgacttgaatttcatcaaacagagcaaagatggagccgggtttttgataaatctgatagattctccaggccatgtcgacttctcctcagaggtgactgctgcccttagggttacagatggggcactggtcgtcgtagattgtgtcagcggcgtgtgtgtgcagaccgagacagtcctgaggcaggccatcgccgaaaggatcaagccagtgctgatgatgaacaagatggatcgagcactgctggaactgcagctggaaccggaggaattgtaccagaccttccagcggatagtggaaaacgtcaacgttatcatctctacttacggtgaaggagagagcgggccgatggggaatatcatgatcgatcccgtactggggacagtcggctttggctcaggactccacggatgggccttcactttgaaacagttcgcagaaatgtacgtagctaagttcgccgcgaagggggaaggacagctcggtcccgctgaacgagcgaagaaagtggaggacatgatgaagaaattgtggggggaccgctactttgacccagcgaatggtaaattcagcaaaagtgctacttcgcctgagggaaaaaaattgcctcgcaccttctgtcagctgattcttgaccctatcttcaaagtgtttgatgcaatcatgaacttcaagaaagaggaaacagctaaattgatcgagaaattggacattaagcttgactcagaagataaggacaaggaaggcaagccattgctgaaagccgtgatgcgccgttggttgcccgccggtgacgccctgctgcagatgattacgattcacctgccaagtcccgttaccgctcagaagtaccgatgcgagctgttgtacgaaggtcctccagacgatgaggccgctatgggcattaaaagttgtgacccgaaaggtcccctgatgatgtacatatctaaaatggttcccacgtcagacaaaggcagattctacgccttcggacgcgtgttttccggtctggtatccacaggattaaaagtcaggataatgggccccaactacactcctggcaaaaaggaggatctgtatttaaaaccgatccagcgaactattctgatgatggggagatacgtcgaacccatcgaagacgtgccctgtggaaacattgtcggccttgtcggggttgaccagttcctagtgaaaacaggcacaatcacaactttcgagcatgctcacaacatgagggttatgaagttctctgtgtccccggttgttcgtgtcgcagtggaggcaaaaaatcccgcagatctgcctaaactcgtagaaggcttgaaacgcctcgccaagtcagatcctatggtccaatgcatcatcgaggaatctggtgaacacataatcgccggtgccggcgagctgcatctcgagatttgcctgaaggatttagaagaggaccatgcgtgtatccctataaagaaagagaccgtctcaaaaaaaaaaaagaagaaaaagtag

SEQ ID NO: 187048 - DNA, 351 bp, Artificial Sequence
  Description of Artificial Sequence: Synthetic coding sequence
atgcccaagaacaaggagtacgcccaggtgatcaagatgctgggcaacggcaggctcgaagccatgtgctttgatggcgtcaaaaggttatgtcatatacgcgggaagttgcgcaagaaggtgtggatcaacacttctgatatcatccttgttggtttgcgggattatcaggacaataaagccgacgtaattcttaagtacaatgccgacgaggctcggtctctaaaggcttacggcgagctgccagaacacgccaagatcaacgaaaccgacacctttgggcctggggacgacgatgaaatccagttcgatgatattggggatgacgatgaggatatcgatgatatctag

SEQ ID NO: 187049 - DNA, 435 bp, Artificial Sequence
  Description of Artificial Sequence: Synthetic coding sequence
atgcccaagaacaagggcaagggcggcaagaaccggcggcggggcaagaacgagaatgaatctgagaagcgggagctcgtatttaaagaggatggacaggagtatgcccaagtaatcaagatgctcggcaacggacgccttgaagctatgtgttttgatggcgttaagaggttatgtcacatacggggcaaattgcgcaagaaggtgtggatcaatacctctgatatcattctcgtgggtcttcgagactaccaagataacaaagcagatgtcatcttaaagtataatgcggacgaggcgcggagcctgaaagcttacggtgaactccctgagcatgccaaaatcaacgaaactgatacgtttggacctggcgacgatgatgagattcagtttgacgatatcggagatgatgacgaggatatcgacgatatttag

SEQ ID NO: 187050 - DNA, 435 bp, Artificial Sequence
  Description of Artificial Sequence: Synthetic coding sequence
atgcccaagaacaagggcaagggcggcaagaaccggcggcggggcaagaacgagaacgagagtgagaagcgagagctagtctttaaagaggacgggcaggagtacgcacaggttattaaaatgttgggtaacggtagactggaggctctttgctttgacggtgttaaacggctttgtcacatccggggtaagttacgcaagaaggtgtggatcaatacttccgatatcattctggttgggctgcgcgattaccaagataataaggcagacgtcattctaaagtacaacgctgacgaggctcgcagtctgaaagcgtatggtgagctccctgaacacgccaaaataaatgaaactgatacgtttggccctggggacgatgatgagattcaatttgacgatatcggcgacgacgatgaggacatcgatgacatctag

SEQ ID NO: 187051 - DNA, 384 bp, Artificial Sequence
  Description of Artificial Sequence: Synthetic coding sequence
atgcccaagaacaagggcaagggcggcaagaaccggcggcggggcaaaaacgaaaacgaatccgaaaagcgcgaattagtgtttaaggaagacggccaggagtatgcacaagtcatcaagatgctcggaaatggtaggctagaagctctctgttttgacggcgttaaacgtctttgccatatccgcgggaagttgagaaagaaagataataaagcggacgtcatactcaagtacaacgcagatgaagccaggtcgctgaaagcttatggggagttgcccgaacacgcaaaaataaacgaaactgacactttcgggcccggagatgatgatgagattcaatttgatgatattggcgacgatgacgaggatatcgacgacatatag

SEQ ID NO: 187052 - DNA, 1419 bp, Artificial Sequence
  Description of Artificial Sequence: Synthetic coding sequence
atggccggcggcgaggccggcgtgaccctgggccagccccacctgtctcggcaggatttgacaactctggacgttacgaaactaacaccattaagtcatgaggtcattagccgacaggcgacaattaacatagggactatcggccacgtggctcacggtaaaagcactgtggtcaaggccatctctggtgtccataccgtgcgattcaaaaatgagctcgagcgaaacattaccatcaaactgggctacgcaaatgccaagatctataagctggacgacccatcgtgcccgaggcccgagtgctatcggtcctgcggaagctccacccctgacgaattccctactgatatacccgggaccaagggaaattttaaactggtgaggcatgtgtcattcgtcgattgtcccggtcatgatattctgatggccacaatgctcaacggggccgcagttatggatgccgccctattgctgatcgctggcaacgaatcttgcccacaacctcagaccagcgagcatttggcagccatcgagattatgaaactgaagcatattctcatcctccagaataaaatcgacctggtcaaggaatcacaggccaaggagcaatatgaacaaatcttagcctttgtccagggcacagtagccgagggtgctcccatcatccccattagtgctcagctgaagtacaacattgaagtggtctgcgaatacattgtgaaaaaaataccagtgcccccgcgtgatttcactagtgaacctagactgattgtcattaggagttttgatgtgaataagcctggatgtgaagtggatgatttgaagggaggggtagctggagggagcattctgaagggtgtgttgaaagtgggccaagagatcgaggtgcggcctggaatcgtctcgaaggactctgagggcaagctcatgtgtaaaccgattttctcaaagatagtcagcctctttgccgagcacaatgacctgcagtacgctgcgcctggtggcctgattggcgtgggaacaaaaatcgaccccacactctgcagggctgaccgaatggtcgggcaggttctgggtgccgttggggcacttcctgagatcttcaccgaactggagattagctactttcttcttcggcggttgctgggagtccggactgagggcgacaaaaaagctgccaaggtgcaaaaactcagcaaaaacgaggtactgatggtgaacataggttctctctctaccggagggcgcgtcagcgcggtcaaggccgatctgggcaagatcgtgttgactaatcccgtttgcacagaagtgggggagaagatagccctcagtaggagagtggagaagcactggcgacttattgggtggggtcagatccggcggggcgtgactatcaagccaactgtcgatgacgactag

SEQ ID NO: 187053 - DNA, 552 bp, Artificial Sequence
  Description of Artificial Sequence: Synthetic coding sequence
tgagccggcggcgaggccggcgtgaccctgggccagccccacctgtctaggcaagacctgaccaccctagacgtgacaaagctgacccctttatcccacgaggtgatctcccgtcaggctacaatcaatattggaacaataggtcatgtggcgcacggaaaatcaaccgttgtgaaagccatcagcggtgttcacacagtccgctttaagaacgaactggagagaaacattactatcaaactgggatacgcgaacgcaaaaatttacaagctggatgatcctagttgtccacggcccgaatgttacagaagttgtggtagttcaacacctgacgagttcccaactgacatcccaggcacaaagggcaatttcaaactagtgagacacgtcagtttcgtggactgtccagggcatgatatactgatggccacaatgctcaacggtgctgctgtaatggatgcagcgcttttactaatcggaaaatatctcacaattggacttgacaagtcgatgtggaacaaatcaaagatgaagtaccttaaaggtaactag

SEQ ID NO: 187054 - DNA, 1116 bp, Artificial Sequence
  Description of Artificial Sequence: Synthetic coding sequence
atgttccaggaggtgaaggccgacaaggtgaccatgctgtggaacaagaaggccactgctgtgcttgtcatagcaagcactgacgtcgataagaccggcgcgtcatattatggcgagcagacgctgcattacattgctactaatggcgagtccgcagtcgtgcagctgccgaaaaatgggccaatttacgatgtagtgtggaactccagctcaaccgaattctgtgctgtgtacggcttcatgcccgcgaaagcgactatcttcaacttgaagtgtgaccccgtgttcgactttggaacgggaccacgcaacgcggcttactatagtccacacggtcacatattagtgctcgctggattcggcaatctcaggggccagatggaagtgtgggatgtgaaaaactacaagctgatcagtaagcctgtggcgtccgacagcacttatttcgcttggtgcccggatggcgaacacattcttactgccacgtgcgccccccgcttgagggtgaacaacggttacaagatctggcactatacaggcagcatactgcataagtatgatgtgccctcaaacgcggagctatggcaggtttcatggcagccattccttgacggaattttcccagctaagaccataacctaccaggctgtgccttctgaggtcccgaacgaggaacccaaggtcgcgaccgcctacagaccaccggctttacgtaataaaccaattacaaactctaagctgcatgaggaagagccccctcagaacatgaagccccagtctgggaacgataagcccctgtcaaagactgccctgaaaaatcagaggaagcacgaagccaaaaaagcagccaagcaggaggctcgctctgataagagcccggatctcgcccccacacccgcacctcagtctaccccccgtaataccgtgagtcagagtatttccggcgatcccgagatcgacaaaaagatcaagaatctgaagaaaaagctgaaggccatagagcaacttaaagaacaagctgcaacagggaagcagttggagaaaaaccagttggagaaaatccagaaggagactgccctgctgcaagagctggaggatttggagttgggtatctag

SEQ ID NO: 187055 - DNA, 1758 bp, Artificial Sequence
  Description of Artificial Sequence: Synthetic coding sequence
atggcccccagcacccccctgctgaccgtgcggggcagcgagggcctgtatatggtgaatggtcctcctcattttactgagagtaccgtcttccctcgcgagtctgggaaaaattgtaaagtatgcatcttctctaaggacggcaccttgttcgcttgggggaatggagagaaggtgaatatcatctcagtgacaaataaggggctattgcactcgttcgaccttctcaaggctgtgtgcctagaattttcaccgaagaataccgtcctggccacttggcagccgtacaccacatctaaagacgggaccgccggaatccctaacctccagttatacgatgtgaaaaccgggacctgcctaaaatcctttatccagaagaaaatgcagaactggtgccctagctggtctgaagatgagacactctgtgctagaaacgtcaataacgaagtccacttctttgaaaataacaactttaatacgatcgcaaacaagttgcacctgcagaagataaatgatttcgtgcttagccctggcccccagccttataaggtggccgtctatgtacccggctcaaagggagccccttctttcgttcggttgtatcagtacccaaatttcgcaggcccccacgcggcgctagccaataaaagtttctttaaggctgataaggtgaccatgctgtggaacaagaaggctaccgcagtgctggtgattgcttccacggacgtggataaaacgggggcctcctactatggagaacaaacacttcattacatcgccacgaacggtgagagtgctgttgtccaactgccaaagaatggcccaatctacgacgtggtgtggaatagcagctctaccgaattctgcgctgtatatggctttatgccagctaaggcaacaatatttaacctgaagtgtgacccagtgttcgatttcgggacaggacccagaaacgctgcctactactccccccacggtcatattctagtcctcgccggttttggcaacctgaggggccagatggaggtttgggatgtgaaaaattacaaattgatatccaaaccagtggcatccgacagtacatacttcgcttggtgtcccgacggcgagcacatcctgactgctacttgcgcgcctcgcctacgagtgaacaacggttataagatctggcattatacaggatcaattcttcataagtacgacgtgcccagcaatgccgaactgtggcaggtgagctggcagccttttttagatgggattttcccagcaaagaccattacctatcaagcagtgccgagcgaggtacccaatgaggagcccaaagtcgctactgcatacagacctcccgctctgcgaaacaaaccgataaccaacagcaagctccacgaggaagaaccaccgcaaaatatgaaacctcagagtggcaatgacaaaccactctccaaaacggctctcaaaaatcaaaggaaacatgaggccaagaaggcagccaaacaggaagcaaggtcagacaagagtccagacttagctccaacgccagccccccagagtacgccccggaatactgtgagtcagagtatctcaggtgaccctgaaatcgataaaaagatcaaaaatttgaagaagaagctgaaagcaattgagcagctgaaggagcaagcagcaaccggcaaacagcttgagaaaaaccaattggaaaagatccagaaggaaacggctctgctgcaagagctagaggaccttgaactgggcatttag

SEQ ID NO: 187056 - DNA, 1893 bp, Artificial Sequence
  Description of Artificial Sequence: Synthetic coding sequence
atgcagggcggcaacagcggcgtgcggaagcgggaggaggagggcgatggcgccggcgcagtcgcagccccccctgcaattgatttccctgccgagggcccggacccggagtacgatgagagcgacgtgccagctgagatacaggtgctcaaggaaccactgcagcagcccaccttccccttcgcggtggcaaaccagctactgcttgtttctcttttggagcacctgtctcatgtgcacgagcccaatcccttaaggtctaggcaggttttcaaattactctgtcagacattcatcaagatgggcctgctgagctctttcacttgctctgacgaattttcctccctcaggctccaccacaacagagctatcacccacctaatgaggtctgctaaggaacgagtgcggcaggatccctgtgaggacatctctaggattcagaaaatccgctctcgagaagtcgcccttgaagcacagactagccggtatttgaatgaattcgaggaactggccatcctaggtaaaggcggatatggccgcgtgtataaagtccgtaataaactggatggacaatattatgctattaaaaaaatcttaatcaaaggagccaccaaaacggtctgtatgaaggtcctgagagaggtcaaggtgttagctgggctacagcaccccaatattgtgggataccacaccgcatggatcgagcacgtgcacgtcattcagcctcgcgcggatcgagctgccatagagctcccttcactcgaggtactttccgatcaggaggaggacagagagcagtgtggagtgaaaaacgatgagagctcctctagtagcattattttcgcggaacctaccccggaaaaagaaaaacggtttggagaatcggacacggaaaatcaaaataacaaaagcgtgaagtacactacgaacctcgttatccgtgagagtggcgagttggaatccacattggagttacaggaaaacgggttggcggggctttcagcttctagcatcgtggagcagcagctgccgctgaggaggaactctcacctcgaggaatctttcactagtaccgaggagtccagtgaagagaacgttaatttcctgggccagaccgaagcacagtatcatttaatgctgcacatccagatgcagttgtgtgaactgagcctgtgggactggatagtcgaacgcaataagaggggaagggagtatgttgacgagtccgcttgtccttacgtgatggcaaacgtggctaccaaaatctttcaggagctggtcgaaggcgtgttttatatacacaacatgggaatcgtgcatagggatctgaagccacgcaacatttttctccacgggcccgatcagcaggtgaaaattggagatttcggactggcctgtaccgatattctccaaaagaatacagattggaccaatagaaacggcaagagaacccccacacatacctcaagagtcggcacctgcttgtacgccagtcctgagcagctcgaaggaagcgaatatgacgccaagagcgatatgtacagcctcggcgttgtgctcctggagctgtttcagccgttcgggacagagatggagagggctgaagtcctgaccggactcagaactggacaacttccggaaagtcttcggaagcgatgccctgtgcaggctaaatatatacagcatctgacgcgaaggaactcgtcacagaggcctagcgccatccagctgctccagagcgagctgtttcagaattctggaaacgtgaacttgacactgcagatgaagattatcgaacaggaaaaagagatcgccgaactgaagaagcaactaaatctgctctcccaggacaagggcgtgagagacgacggcaaagatggaggtgttggctag

SEQ ID NO: 187057 - DNA, 1734 bp, Artificial Sequence
  Description of Artificial Sequence: Synthetic coding sequence
atgaaccagacccacttcgtgcaggaccggtgcctgagcgacccctgtgaagatatatccagaatccaaaaaattcgctctcgagaggtggcgttggaagcccaaacttcgcgctacctgaatgagttcgaggagttagcaattctcggcaagggcggatatggcagggtatataaagttaggaacaagctggacggccagtactatgccattaaaaagatcctcattaaaggggcgaccaagaccgtctgcatgaaggtgttacgagaggtgaaggtgctggctggcctgcagcatcctaacatcgtgggctatcatactgcatggattgagcacgttcatgtgatccagccacgggccgacagagcagccatcgagctcccgtctctagaagttctgagcgatcaggaggaggaccgagagcagtgcggggtgaaaaacgacgaaagtagctcatcatcaataattttcgccgagccgacacccgaaaaagagaaaagatttggcgaatctgatactgaaaatcagaataataagtccgtgaagtacactaccaacctcgttataagagaaagcggcgagctggaaagcacactggaattgcaggaaaatggactggcgggcctgtctgcttcttcaattgttgaacagcaacttccacttaggaggaacagccacctggaggaatcttttacttcaaccgaagagtctagcgaggagaatgtgaactttctgggtcagacagaggcccagtatcacctgatgctgcacatacaaatgcagctgtgtgagttaagcctgtgggattggatcgtagagaggaacaagagaggtagggagtacgttgacgagtctgcctgcccctatgtgatggccaatgttgcgacaaagatcttccaggagctggtcgaaggagtgttctacatccataatatgggaattgtgcatcgggatctgaaaccacgtaatattttcctgcacggacctgatcagcaagtaaagatcggggacttcgggttggcctgtactgatatcctgcagaaaaacacagactggaccaaccgtaatgggaaacggacacccacacacaccagtagggtgggcacctgcttgtacgccagccccgaacagcttgaaggatcggagtacgatgccaagtctgatatgtatagccttggtgtggtgttgctcgaactcttccagccgttcggaacagaaatggagcgagctgaagtcttgactggtcttcggaccggacagctacctgagagcctcagaaagaggtgcccagtccaggccaagtatatccagcatttgacccgtcgaaactcttctcagcgtcccagcgctatacagttactgcagagcgagctttttcagaattccggaaacgtgaatctgaccctgcagatgaagattattgagcaggagaaagagatcgccgaactcaaaaaacaattgaatctgctgtctcaggataaaggatttagcgtcattccaaagccccacccttgtaaggccctctactctgccccgcagatgatatcaaggcagttgaggtcccttagttgcctctgtcctgcactttttcccggaacgtcatcatttatcgttgcactttcatctcctgcaaacttgtatattccccagcggcaacgctccgacgagctggtgttcgaaagtcagaaggggagcgctatggaactggctgtgataacagtggatggggtttag

SEQ ID NO: 187058 - DNA, 3351 bp, Artificial Sequence
  Description of Artificial Sequence: Synthetic coding sequence
atggagcgggccatcagccccggcctgctggtgcgggccctgctgctgttgttgcttctgctcggattagcggcaagaaccgtggcggccgggagggccaggggactgccagcccctaccgctgaggccgcatttggactgggggccgcagctgccccaacgagcgctacgcgcgtgcctgctgctggagctgttgcagcggctgaagttacagtggaggatgcggaggcgttacctgcggctgccggggaacaagagccacggggccccgagccagatgatgagactgagttgcgcccacgcgggaggtctctcgtgatcatttctaccctcgatggtagaatcgctgctctggaccctgagaaccacggaaagaaacagtgggacctggatgtaggatcgggctcgctggtatcttcaagcctctccaagcctgaagtgttcgggaataaaatgatcatccccagtctcgatggggccctgtttcagtgggaccaggatagggagagcatggagactgttcccttcaccgtagaaagtctccttgaatcctcctacaaatttggtgacgatgtggtacttgttggcggcaagagccttacaacctacggcctctcagcatattccggtaaggtgcggtatatctgcagcgccctcggctgccggcagtgggatagcgacgaaatggagcaggaagaagacatcctcctacttcaaaggacccagaaaacggtgcgggccgtaggcccaagaagcggtaacgagaagtggaatttctctgtgggccattttgaacttagatacatacccgacatggaaacgagagcaggatttatagagtcaactttcaagcctaacgagaataccgaggagtccaaaattatatctgatgtcgaggaacaagaggcagcaattatggacatcgtgattaaagtctctgtcgccgactggaaggtgatggcattttctaagaaaggcggacatctcgagtgggaataccagttctgtaccccaattgcgtctgcttggctactcaaggacgggaaggtgatcccgattagtttgttcgacgatacgagttacacatccaatgatgatgttttggaagacgaagaagatatcgtcgaagccgcccgcggagctaccgagaattccgtctacctagggatgtatagggggcaattgtatctgcaaagcagcgtccgcatctcagagaaattcccctcaagcccaaaagccttggaaagtgtgacaaacgagaacgctatcattcccctgcccaccataaaatggaagccactgatacactctccgagcagaaccccagttctcgtcggatccgatgagtttgacaagtgtctctccaacgataagttctctcatgaagagtattccaatggtgccctgtccattctgcagtacccttacgacaatgggtactaccttccttactacaaaagagaaagaaataagcgaagcacgcagatcactgtcagattcttggataatccccattataataagaatattcgcaaaaaggaccctgtattgctgctgcactggtggaaggaaatcgttgctaccatactgttctgcataatcgcaaccacatttatcgtgaggcgactgtttcacccgcatcctcatagacagaggaaggagtccgagacccagtgtcagaccgaaaataaatacgattcggtctccggcgaggcgaatgattcttcgtggaatgatatcaagaacagcggttacatatcgcgctatctcaccgacttcgaacctatccagtgcctgggtagagggggattcggagtggtgttcgaggccaaaaacaaggttgacgactgcaactatgctattaagagaatccgacttcccaatcgggagttggccagagagaaagtaatgagagaggtgaaagctttggcaaaactcgaacatcccggcatagtccgctactttaacgcgtggctggaagcacccccagagaagtggcaagagaaaatggacgagatctggttaaaggacgaatctactgactggcctctgagcagcccatccccaatggacgccccttcggttaaaatcaggcggatggatcctttcgctactaaggagcacattgagattattgcccccagcccacagaggtcgagaagtttctcagtcggcatctcgtgtgaccaaacaagctcatccgagagccagttcagtccgttggagtttagcggaatggatcacgaggatatttcggagtcggtagacgccgcctataatctgcaggacagttgcctcaccgattgtgacgtggaggacggcaccatggatggaaacgacgaaggccacagctttgagctgtgtcccagcgaagcctctccttacgtacggtcgcgggagcgaacaagctcgtccatagtgtttgaggattctgggtgcgacaacgctagctccaaggaagagcccaaaacaaatcggcttcacataggcaaccactgtgcaaacaaactgacagcgtttaagccgactagctctaagtctagttccgaggcgacgctgtccataagtccgcctcgacctaccacgctgtccctagaccttacaaagaatactaccgaaaagctgcagcctagttcccccaaggtgtacctgtatatccagatgcagttatgtaggaaggagaacctgaaggactggatgaacggtcggtgtaccatcgaagaaagggagaggtccgtgtgcctgcatatctttcttcagattgccgaagcagtggagttccttcatagcaagggactgatgcacagagacctgaagccaagcaatattttcttcacgatggatgatgtggtgaaggtaggtgacttcggcctagtgactgcaatggatcaggatgaggaagagcaaactgtgttaaccccaatgcccgcttacgctagacacaccgggcaagtcggaacaaagctgtacatgtcacccgagcaaatccatggtaattcctactcccataaggtggacatttttagcctgggtttgatacttttcgaactgctgtatccttttagcacgcaaatggaacgggttagaacactgactgacgtgagaaacctgaagttccccccactgtttacccaaaaatacccctgcgagtatgtgatggtccaggacatgctatctccaagccctatggagagacccgaagcgataaatattatagagaatgcagtgtttgaagatttggactttcctggtaagacagtgctcagacagcgtagccgtagtttaagcagctctgggaccaagcactctagacagtccaataactctcacagcccccttccgtctaattag

SEQ ID NO: 187059 - DNA, 2898 bp, Artificial Sequence
  Description of Artificial Sequence: Synthetic coding sequence
atgatcatccccagcctggacggcgccctgttccagtgggaccaggatagggaaagcatggagactgtaccgtttactgtggagtcactacttgagagttcctacaaattcggagacgacgtggttttggtgggtggcaaatcactgacaacatatggactcagcgcgtattccgggaaggtgcggtatatttgtagcgctctaggctgccgacagtgggacagcgatgaaatggaacaagaagaagatatactgctgcttcagcggacacaaaaaaccgtgcgagctgtgggaccccgatctggcaatgagaaatggaacttctccgtagggcactttgagctccgctatattccagatatggaaacacgcgcaggattcatagagtccacattcaagccaaacgaaaacaccgaagaatccaagatcatctctgacgttgaagagcaagaggccgccatcatggatatcgtgattaaggtaagtgtggctgactggaaagtgatggctttttcaaagaagggcggacacttggaatgggaataccagttttgtacccctattgcctccgcatggctcctgaaggatggcaaagttatccccattagcctgttcgacgacacttcttatacatccaacgatgatgtgctggaggatgaggaggacatcgtggaagcagcccgcggagccacagaaaattccgtatacctgggaatgtacagggggcagctttacctgcaaagcagtgtcagaatctccgagaaatttccctcctcccccaaggcattagagtccgtgactaatgagaacgccattattcctctgccaactatcaagtggaagccgctaatccactctccttcaagaactcccgtcctggtcggctctgatgagttcgataagtgtctatccaatgacaaattcagccatgaggagtattcaaacggcgcattgagcatcttgcagtatccatatgataacggttactatctgccttattacaagagagaacgcaataaacggagcacccaaattacagttaggttcctggataatcctcattataataagaacatcaggaaaaaagacccagtgctgctgctgcactggtggaaagagattgtggccacgatcctgttttgcattattgctacgaccttcatagtgcgccgcctgtttcacccccacccccataggcaaaggaaagagtcggagacacagtgtcagacagaaaataagtacgattcagtgtccggggaggctaacgatagcagctggaacgatatcaaaaatagcggctatatcagtcggtatctgacggactttgaaccgattcagtgcctaggaaggggtggcttcggcgtggtattcgaggccaaaaataaggtggacgactgtaactacgctatcaagagaataagactacccaaccgcgaactcgctcgggagaaggtcatgagggaagtgaaagcactggccaagctggaacatccaggcattgttcgctacttcaacgcctggctggaagcccctcctgagaaatggcaggagaaaatggacgaaatctggctgaaggatgagtccactgattggccactcagcagccccagcccaatggacgcgccttctgtaaaaattcgtcggatggaccctttcgccaccaaggaacacattgagatcatcgccccctctccccagaggtcccgttccttttcggtggggataagttgtgaccagacgagcagctctgagtctcagttttcccctctggaattttccggaatggatcatgaggacatctctgaatccgtagacgctgcttacaatctccaggactcgtgtctgactgactgcgatgtagaagacgggaccatggacggaaacgacgaggggcacagcttcgaattgtgtccttccgaggcatccccgtacgtacgctcccgggagcggactagcagttcgattgtgttcgaggactcaggatgtgataatgcctcatccaaggaggagcccaagactaaccgtctgcatattggaaaccattgtgcgaacaaattgacggcctttaaacccactagttcaaaaagcagttcggaagcaaccttgtcaatttcccctcctagacctaccacactgtctctggatctgactaaaaacacgacggaaaagctgcaaccttcttctcccaaagtttacctatacatccagatgcaactgtgccggaaagaaaacctgaaagactggatgaacgggcgctgcactattgaagagcgcgaacgttccgtctgtctacacattttcttgcaaattgcagaggccgttgagttcctacactctaaggggcttatgcacagggatcttaaaccttctaatatctttttcacaatggacgatgtggtgaaggtgggagactttgggctcgtcaccgctatggatcaagacgaggaggaacaaaccgtcctcactccgatgcccgcatatgccaggcacacaggccaggtgggtactaagctgtacatgtccccggagcagattcacgggaatagctattcccacaaggtagacattttctcattgggcctgatcctttttgaactgttatatcccttctctacacaaatggagcgtgtgagaaccctgactgacgtccgaaacctgaagtttccacctttatttactcagaaatatccttgcgaatacgtcatggtccaggacatgcttagcccctcccccatggaaaggcccgaggccattaatataattgaaaatgcagtttttgaggatcttgatttccctggaaaaacagtcctcagacagcggtctcgctctctgtccagctctgggacaaagcactcgaggcaatccaataattctcattctccccttccctcaaactag

SEQ ID NO: 187060 - DNA, 1569 bp, Artificial Sequence
  Description of Artificial Sequence: Synthetic coding sequence
atggccgccgtggccgtggccgtgcgggaggacagcggcagcggcatgaaagccgagctgcctccggggccaggcgccgtgggaagagagatgactaaggaagagaagctgcaactccgcaaagagaagaagcagcagaaaaagaaaagaaaagaggagaagggtgctgaaccagagactggctctgctgtgtccgctgcccagtgccagggtcccacaagagaactccccgagtccggtatccagctcggtacaccccgagagaaagtacctgcagggcgttccaaagctgagctgcgcgcggagcgcagggccaagcaggaggctgagagggctttgaagcaggcgcggaaaggggaacagggaggtccccctcccaaggctagcccctcaactgctggggaaaccccttccggtgtcaagcggctgccagagtatcctcaagtcgacgatctgctcctgagacgcttggtgaaaaagcccgaacgacaacaggttcctacccgcaaagattacggatccaaagtgtcactcttctctcatctcccccagtactcgcggcagaattctctgactcagttcatgagtattccctcctccgtgatccatcctgccatggtacgccttggtctacagtacagccagggcctcgtctctggatctaacgctcggtgtatcgctctgctgagggcgctgcagcaggtcattcaagattacacaacaccacccaatgaagaattgtcacgggatctcgtaaataagttgaagccttatatgtcattcctcacgcagtgtcgcccactatccgcttcaatgcacaatgctataaagttcctgaacaaagagatcacctctgtgggaagctctaaacgtgaggaagaggcaaagtccgaattgagagctgccatcgatcgctacgtgcaggagaagattgtcctcgctgcccaggcaatctccagatttgcctaccaaaagatctcaaatggggacgttattttggtgtatggctgttcttccttagtgtccaggattctgcaggaagcatggaccgaagggcgtaggtttcgcgtcgttgttgtcgattccagaccgtggctggaggggaggcacaccctaagatccctggttcacgccggcgtgccagcatcttacctgctaatcccagctgctagctacgtactgcctgaggtgtcaaaagttctcctcggcgcccacgccctccttgctaacggaagcgtaatgtcccgcgttggaactgctcaactagcccttgttgcccgagcgcataacgtgcctgtcctggtatgttgtgaaacttacaagttctgtgagcgggtgcagactgacgccttcgtgtccaatgagctggatgaccctgatgacctgcagtgtaaacgcggggagcatgtggcgctggcaaattggcagaaccacgcaagccttagattgttaaacttagtctacgatgtgactcccccggagttggtggatctggtgattacagagctgggaatgataccctgttcaagcgtgccagtcgttctgcgggtcaagagttccgaccagtag

SEQ ID NO: 187061 - DNA, 1632 bp, Artificial Sequence
  Description of Artificial Sequence: Synthetic coding sequence
atgcccacccagcagcccgccgcccccagcacccgggcccccaagccatctcgaagcctctcaggctctttgtgtgccctgttctccgatgccgactccggttccgggatgaaggcggaactgcctcctggcccaggagccgtgggtcgggaaatgaccaaggaggaaaagctgcagctgcgaaaggagaaaaaacaacagaagaaaaagagaaaggaggaaaaaggggctgaacccgaaacgggcagtgctgtatctgccgcccagtgccagggccccaccagggaacttccagagagtgggatccaactgggcacgcctcgagagaaggtgcccgcagggagatccaaggctgaactcagagctgaacgcagggcaaaacaggaggcagagagggccttaaaacaggccaggaaaggcgagcagggcggtccaccgcccaaggcttcaccatctaccgccggggaaactccaagcggcgtaaaaaggctccctgagtacccgcaggttgatgatttactcttacgccggttggtcaagaagccagaacgccagcaggtgcccactcggaaagactatggctctaaggtctcactttttagtcacttacctcaatactccagacagaactctctgacgcaatttatgagtattccatcgtctgtcattcatcctgcaatggtgaggctgggactgcagtacagtcagggcctggtcagcggctctaacgcgaggtgcattgcactacttcgggctttgcagcaggtgatccaagactacaccacgccacccaatgaggagttgtctcgcgacctggtgaacaagctgaaaccttacatgagctttctaactcagtgccgaccactgtccgcatccatgcacaacgctatcaagtttctgaacaaggagatcaccagtgtcggcagctctaaaagagaggaggaagccaagtcagaactacgtgctgccatcgacaggtacgtccaggaaaaaatcgtcctggccgcccaggctattagccggtttgcttaccagaaaatctccaatggcgacgtcattctcgtgtacggttgctcctcactggtgtctcgcattctgcaggaggcctggacggagggcaggcgtttcagggtggtagttgtggactccaggccgtggctggaaggtaggcacacccttcgctccctcgtgcacgcaggggttcccgctagctatctccttatccccgctgctagctatgtactgccagaggtcagtaaggtgctactgggtgctcacgcgctcctggcaaacggatctgtgatgagcagggtggggacagcacagttggccttggtggccagagcgcacaatgtaccggtgctcgtgtgctgcgagacctataagttttgtgaacgagtccagaccgacgccttcgtgtccaacgagctggacgatcctgacgatctgcagtgtaagaggggagagcatgtagcccttgctaattggcaaaaccatgcttcattaagactgctgaatcttgtgtatgatgttacaccacctgagctggtggatctcgtgatcacagaattggggatgatcccttgtagttccgtgccagttgtcctgcgcgtaaaatccagtgaccagtag

SEQ ID NO: 187062 - DNA, 918 bp, Artificial Sequence
  Description of Artificial Sequence: Synthetic coding sequence
atggacgacaaggagctgatcgagtacttcaagagccagatgaaggaggacccagacatggcgtcggctgttgccgccattcgtactcttttggagtttttgaaacgggacaaaggcgaaacgatccaggggctgcgggccaatctcacgtccgctatcgagaccctttgcggcgttgatagttcagtggctgtgtccagtgggggcgagttgttcctgagattcattagtttagccagtctcgagtactccgattacagtaagtgtaagaaaattatgattgagaggggggaactctttctgagaaggatttcattgagccggaacaagatcgcagatctgtgtcatacattcattaaggacggtgccacgatcttgacacatgcctactcgagagttgttttgcgcgtactggaagccgcagtcgcagcaaaaaaacgattctctgtgtatgttaccgaatcccagccggacctgagcggaaagaaaatggccaaggccctatgccacctgaacgtgcccgtgacggtcgttttagatgctgctgtagggtatatcatggagaaagctgatctggtgattgtcggagccgagggcgttgtggagaatggcgggatcattaacaagattggcacaaatcagatggccgtgtgcgctaaggcccaaaacaagcccttttatgtggttgcagagtctttcaagttcgtacgacttttcccgctgaatcagcaggatgtgccggacaagttcaagtataaagctgacacactgaaggtggcccagaccgggcaggatttgaaagaggaacacccatgggtggattacaccgccccatccttgattactcttttgttcaccgacctgggcgtgctgacccccagtgccgtatctgacgaactgatcaagctatatctttag

SEQ ID NO: 187063 - DNA, 1056 bp, Artificial Sequence
  Description of Artificial Sequence: Synthetic coding sequence
atgcccggcagcgccgccaagggcagcgagctgagcgagcggatcgaatcatttgtggagaccttgaaacggggagggggacctagatcctctgaggagatggcccgggagaccctcggattgctgcggcagatcattaccgatcataggtggtccaacgccggagagctgatggagcttatcagaagggagggacgacggatgacagctgcacaacccagcgagacaactgtgggaaacatggtgaggcgggtcctcaaaattatacgcgaggaatatggacgtctgcatggaaggtccgatgaaagcgatcagcaagagagtttacacaagttgttaacaagtggcggccttaatgaagacttctcctttcattatgcccaactgcagagcaacattattgaggccattaatgagctgctggtagaactcgaagggaccatggaaaatattgctgcgcaggcccttgagcacatacactcaaacgaggtcatcatgaccattggtttttctagaacagtggaagccttccttaaggaggccgcccgcaagcgcaagttccacgtgatcgtggctgaatgcgctccattctgccaaggccacgaaatggcagttaatttatccaaggctgggatagaaacgactgtgatgacagatgcagccattttcgcagtcatgagcagggttaacaaggtcatcatcggtaccaaaacaattcttgctaatggagcactcagggcggtgaccggcacacatacattggcactggccgctaagcatcatagtaccccactgatcgtgtgtgctcccatgtttaagctgtcaccgcagtttcctaatgaggaggattccttccacaaattcgtggcccctgaggaagttctcccttttacagaaggggatattttggaaaaggtgtctgttcactgccccgtgtttgattacgtgcccccagaattaataaccctattcatctcaaatattggagggaatgcgcccagttacatatacaggcttatgtctgagctgtaccatcccgacgaccatgtcctgtag

SEQ ID NO: 187064 - DNA, 1359 bp, Artificial Sequence
  Description of Artificial Sequence: Synthetic coding sequence
atggagttccaggccgtggtgatggccgtgggcggcggcagccggatgacagacctaacctcctcaattccaaaacctctcttacctgttggtaacaagcccctgatctggtaccctttgaacctcctcgagagggttgggttcgaagaagtgatcgtggtgaccactagagacgtgcagaaagccctatgtgctgagtttaagatgaagatgaaacccgacatcgtctgcatacccgatgatgccgacatgggaactgctgactccctgaggtacatctatcccaaactcaagacagatgtgttagtattatcttgtgacctgatcaccgatgtcgctctgcatgaggtcgttgatctctttcgcgcctacgacgcctcccttgctatgctgatgcgaaaaggccaggattctatagaaccagtgccaggtcaaaagggtaagaagaaggcagttgagcagagggacttcataggcgtcgactctaccggaaagcgactgctgtttatggcgaacgaagcggatctggacgaagagttggtgattaaagggtctattttacaaaagcacccccgcatccgattccataccggtctggtagatgcccacctttactgcctgaaaaagtacatcgttgactttctcatggaaaatggctccataacaagcatccgttcagagctgatcccttacctggtgcggaagcagttcagtagtgcttcgtcacaacagggacaggaagagaaggaagaagacctgaagaagaaggaactgaaaagcctcgatatttactcttttatcaaggaggcaaataccttaaacctagccccgtatgacgcctgttggaacgcttgtcgcggggatcgctgggaagatttatctcgctcacaggtgcgctgttatgttcatataatgaaggagggactgtgcagcagggtcagtacgctgggactgtacatggaggcgaataggcaggtgcctaaactgcttagcgccctatgccctgaagagccccctgttcacagcagcgctcagatagtttccaaacacctcgttggggtcgattccctgatcggcccggaaactcagattggtgaaaagtcctccatcaaaagatctgttatcggttcctcatgtcttatcaaagaccgggtgacaattactaattgcttgctgatgaacagtgtgacagtggaggagggttctaatattcaagggtctgtgatatgtaataatgctgtcatagagaagggagcggacatcaaggactgtcttattgggtccgggcagcggatagaggccaaggctaaacgcgtcaacgaggtgatcgtaggtaatgatcagctaatggagatctag

SEQ ID NO: 187065 - DNA, 594 bp, Artificial Sequence
  Description of Artificial Sequence: Synthetic coding sequence
atggagttccaggccgtggtgatggccgtgggcggcggcagccggatgactgacctaacatcttcaatcccaaagccactcctcccagtgggtaacaaaccgctgatatggtaccccctgaatcttctggagagggtgggttttgaagaagtaattgttgtcacaactcgggacgtccaaaaggctctctgcgcagagtttaaaatgaagatgaaacctgacattgtttgcatccctgatgacgcggatatgggaacagcggactccctccgttacatataccccaagctaaaaacagatgtgctcgtgttatcttgcgatctgattactgatgtggccttacatgaggtagtcgatctgtttcgcgcttatgatgcttcccttgccatgctcatgcgcaagggccaggacagcatcgagcccgtgcctggacagaaaggcaaaaagaaagccgacggagatagcctgtgttgccaagctggcgtacaatggcaccacctgggttctctccagtctccgccacccggcttcaagcattttacatgtctctcattgccttcctcttgggactacatgcacatgcccccacactag

SEQ ID NO: 187066 - DNA, 1239 bp, Artificial Sequence
  Description of Artificial Sequence: Synthetic coding sequence
atggagttccaggccgtggtgatggccgtgggcggcggcagccggatgacggatcttactagctctattcctaaacccctgctacctgttggcaataagcccctaatttggtacccactaaacttgctcgagagggtaggttttgaggaagttatagtggtcacaactcgagacgtgcagaaggctctctgcgccgaatttaagatgaaaatgaaacccgacattgtctgtatccctgatgacgccgacatggggactgcagattctctgcgatacatataccccaagctgaagactgacgtgctggtcttgagttgcgacctgatcactgacgttgccctccacgaggtcgtggacttatttcgggcctatgatgctagcttggccatgctgatgagaaaggggcaggattcaattgaaccagtgcctggtcagaaaggcaagaaaaaggccgtggagcagagagacttcattggcgtcgattctaccggtaaaagactattgtttatggcaaacgaggcggacctggatgaagagctagtcatcaaaggatctattctccagaaacacccgagaataaggtttcacaccgggctggtggatgcacacctttattgcctgaagaaatatattgtggactttctgatggagaacggaagtatcacctccatacgcagcgagctgatcccttatcttgtcaggaaacagttctcaagtgccagtagccagcaggggcaggaggagaaagaggaggacttaaagaagaaagagctcaaatccctcgacatctacagtttcatcaaagaggctaataccctgaatcttgccccatacgatgcctgctggaatgcatgccggggagatcgctgggaagatctgagtagatcacaggtccgctgttatgtccatattatgaaggaggggctgtgcagccgggtcagcactttgggattgtatatggaagctaatcgccaggttcccaaacttctgtctgcgctttgcccagaagaacctcctgtacattcttccgcccagattgttagcaaacacctcgtgggagtggacagcctgatcggcccggagacacagattggcgagaagagctccattaaacgcagcgtgattggaagctcatgcctgatcaaagatcgagtcaccatcaccaattgtctattaatgaactccgtgaccgtggaagagggatacgtaagcccatgtacccacctgagacaaagatag

SEQ ID NO: 187067 - DNA, 669 bp, Artificial Sequence
  Description of Artificial Sequence: Synthetic coding sequence
tgagtgatcaagggcagcatcctgcagaagcacccccggatccggttccacaccggccttgtggacgcacacctctactgcttgaaaaagtacatcgtcgattttttaatggagaacggatccatcacctctatcaggagcgaattgattccttatcttgtgcggaagcagtttagctccgcaagttcacaacagggccaagaggaaaaggaagaggacttaaagaaaaaagagcttaagagcctggatatatactccttcataaaagaagctaataccctgaacctcgccccttacgatgcatgctggaatgcgtgtaggggggaccggtgggaggacttaagtcgaagccaagtacgatgctacgttcatatcatgaaggaagggctgtgtagtagggtgagcaccttggggttatacatggaggccaaccgacaggtgcccaaactgcttagcgcactctgccccgaggagcctcctgtccacagttccgctcagatcgtgtcaaagcacctggttggcgtggatagtctcattggccccgagacgcagatcggcgagaagagttcaattaagcggagcgtgatcggtagctcctgtttgatcaaggatcgtgtgactattacaaactgtcttttaatgaatagcgtgacagtcgaggagggttag

SEQ ID NO: 187068 - DNA, 1572 bp, Artificial Sequence
  Description of Artificial Sequence: Synthetic coding sequence
atggccgccgtggccgtggccgtgcgggaggacagcggcagcggcatgaaagctgaacttcctcctgggcccggagcggtgggaagggaaatgactaaagaggaaaagctgcagcttaggaaagagaagaaacagcagaagaaaaagcgcaaagaagagaagggggccgagcccgagacaggcagcgctgtgtcggctgcccagtgtcaggtgggccctactcgcgaactccccgaaagtggcatccaattggggactccacgcgaaaaggtgcccgctggtcgatcgaaagccgaattgagagcggaaaggagggcgaagcaggaggccgagagagcactgaaacaggcccggaaaggcgagcaaggaggccctcctcctaaagcctccccttctaccgcaggagagaccccgagcggagtgaagcgcctccccgaatatcctcaggtggacgacttactcttaagacgacttgtgaagaaacctgagaggcaacaggtccctacgcgtaaagactatggcagcaaagtttctctgttctcacatctgcctcagtacagccggcagaacagcctcactcagtttatgtccattccgtcatctgtgatccaccccgcgatggtgcggttagggctacagtatagccaggggctggtctctggctccaatgcaagatgcattgccctgcttcgggccctccagcaagtaatccaagattacaccacgcccccaaacgaagaactttcccgggatttggtaaataaactgaagccttacatgagttttctgacccagtgtcgtccgctgtctgccagtatgcataacgccataaaatttttgaataaagaaatcacctcagtgggatcaagcaaacgggaggaagaagccaagtcggagcttagagcagcaattgacaggtacgtgcaggagaagatcgtgctcgccgcccaggccatctcaagattcgcatatcagaaaatttcaaatggggacgtcatacttgtctacggatgttctagcttggtctcacgtattttgcaggaagcctggactgagggacgcagatttcgggtcgttgtggtcgatagcaggccatggctggagggtagacatacacttcggtctctggtgcatgcaggagtgccggcaagttacctcttgatcccggctgcctcttatgtgctccctgaggtgtccaaggtgcttctgggcgcacatgccttgcttgcaaatggctctgtgatgtccagagtggggaccgcccaacttgccctggtcgctcgcgctcacaacgtgcctgtcttggtctgctgcgagacatacaaattctgtgagcgcgtccaaactgatgcttttgtgtcaaatgaactcgatgatcccgacgatctccaatgtaagagaggagagcatgtcgcccttgcaaactggcagaaccacgcctccctgagattactaaatctcgtgtacgatgttacacctcccgagcttgtagatctcgtaatcacagaactggggatgatcccctgttcgtccgtgcccgtggtcctccgcgttaaatcatccgaccagtag

SEQ ID NO: 187069 - DNA, 1563 bp, Artificial Sequence
  Description of Artificial Sequence: Synthetic coding sequence
atggccgccgtggccgtggccgtgcgggaggacagcggcagcggcatgaaagctgaatccccttgggcgtgggtcggcagagagatgacgaaggaggagaagctgcaactgcgaaaggagaaaaagcagcaaaagaagaaacgcaaagaggagaagggagcagaacctgaaactggatctgcagtgagcgccgctcaatgtcagggccctaccagagagctgccagaatctgggattcaacttggcacccctcgcgagaaagtgcctgccggccgttccaaggccgagctaagggctgaaagacgggcaaagcaggaagccgagcgagcactgaaacaagcccggaagggggagcaagggggcccaccacccaaggcctccccatcgaccgcaggcgaaacaccttcaggagtgaaacgacttccggaatatccccaagtcgacgacctgctattgcgcaggctggtgaagaagccagagaggcagcaggtccctacacgcaaggactacggctccaaggtgagcctcttttcccatctaccccagtacagtcgccaaaactcactaacccagttcatgtcgataccttcaagtgtcatacatcctgcaatggtgaggttgggacttcaatactcacagggcctcgttagcggtagtaatgcaagatgcattgcattgctgcgggccctccaacaggtgatacaggattacaccaccccacctaatgaagaattgagcagggacctagtcaacaagctcaagccgtacatgtccttcctgactcagtgccgtccactctctgcctccatgcataatgctataaaattcctgaataaagagatcacgtctgttgggagcagcaagcgggaggaagaggccaagagtgagctgagggcagccattgataggtatgtccaggagaagatcgtgcttgcagctcaggctatatccagattcgcctatcagaagattagcaacggggacgtgatccttgtttatggatgtagttcgcttgttagccgcatacttcaagaagcctggactgagggacgtcgttttcgtgtggttgttgtagactcaagaccttggctggagggacgtcacacccttcggagcttggtacacgctggcgtgcccgcctcctatctactaatcccagcagcttcttacgtactgccagaagtcagtaaagtgctgctgggagcccacgcactgctggctaacggaagcgtgatgagtagggtaggaacagctcaactagcccttgtggcgagagctcacaacgttcctgttctcgtgtgttgtgagacttacaagttttgtgagagagtgcagactgatgcttttgtgtctaatgaactcgatgatcctgatgacctccaatgtaaaaggggcgagcacgtggccctcgcaaactggcagaatcatgcgtcgttgaggttactgaatctggtttacgacgttaccccccccgagctcgtggaccttgtgatcacagagttagggatgatcccctgcagctctgtgccagttgtactgagagttaaaagcagcgaccagtag

SEQ ID NO: 187070 - DNA, 2166 bp, Artificial Sequence
  Description of Artificial Sequence: Synthetic coding sequence
atggccgcccccgtggtggccccccccggcgtggtggtgagccgggctaacaagagaagcggagctggtcccggaggttcaggcggtggcggcgcccgaggcgcagaggaggaaccgccacccccactccaggccgtgctagtggccgactccttcgaccggcggtttttccccattagcaaggaccaaccccgggtcctcctgccactggccaacgtagccctgatcgattacaccctggagtttctgactgcgaccggggtgcaggaaacgtttgtcttctgttgctggaaagctgcccaaattaaggaacacctgcttaaatcgaagtggtgtcgccctaccagcctaaacgttgtgaggattattacgtcagagttgtatcgctccctgggagacgtactgagggatgtcgacgccaaagcgctagtgcggtcggatttcctactggtttacggtgatgttatttcaaatataaacatcaccagagccctggaagagcatcgactgaggcgaaaattggaaaagaacgtatcggttatgaccatgatctttaaagagtctagcccttcccaccccacacggtgtcacgaagataatgtggtcgtggccgttgactcaaccacgaaccgggtgttacactttcagaagacgcagggtctacgaaggttcgcattccccctgagtctattccagggatctagcgacggtgtagaagtgaggtatgacctccttgactgtcacatctcgatttgcagcccacaagtagcacagttgtttactgacaactttgactaccagacccgggatgattttgttagagggctgctagtgaatgaagagatcctcggaaaccagattcatatgcacgtcaccgcaaaggaatatggtgctcgggtcagtaatttgcacatgtattcggccgtgtgtgccgatgttatcagacgctgggtgtacccactcacacccgaagctaacttcaccgatagcacaacgcagagctgtacccattctcgacataatatttaccgaggtcccgaagtttcactcggtcacggtagcatccttgaggagaacgtgttgctcgggagtggtaccgtcatcggcagcaactgcttcatcaccaactccgtaattgggcctggctgccatatcggggataatgtcgttctcgaccagacttacctgtggcagggggtgagagtcgctgctggtgcccagatccatcagtcactcctgtgcgacaatgcagaggtcaaggaaagagtgaccctaaagccccggtcggttctcacatcgcaggtagtggtcgggccaaacattactcttcccgagggatcagtgatctcactgcacccccctgacgcagaggaggatgaggacgatggggaattcagtgacgattctggagccgaccaagaaaaggataaagttaagatgaaagggtacaatccggcggaggtgggcgctgccgggaagggatacctgtggaaggccgcgggtatgaatatggaggaggaagaggaacttcagcagaacctgtggggtctgaagataaacatggaggaagagagcgagagcgaaagcgaacagtcaatggactctgaagagccggattcgcgggggggatccccccagatggacgatatcaaggtcttccagaatgaggttctggggacccttcagcgggggaaggaagagaacattagttgcgacaaccttgtcctggaaattaactctctgaaatacgcctacaacatctccctaaaagaggtcatgcaggtgctgtcccacgtggtcttggaattcccactgcaacagatggattctcccctggactcgagtcgctactgcgcattgctgttgcccctcctgaaagcctggtctcctgtctttcgtaactacatcaaacgtgcagccgaccacctggaagctctggctgccatcgaggatttcttcctcgagcatgaggcgctcgggatctcaatggccaaggtccttatggctttctaccagctcgagatcctggctgaggagaccattctatcatggttttcccaacgcgatacaacagataagggccaacagcttcgcaaaaaccagcagctccagcgttttatacagtggctcaaagaagccgaagaagagtcgagcgaagacgactag

SEQ ID NO: 187071 - DNA, 1014 bp, Artificial Sequence
  Description of Artificial Sequence: Synthetic coding sequence
cccccccagcccagcaagatgctgggcctgcaggtggcccagctgttcaccgataatttcgattatcagactagggatgactttgtaagaggcttgctggtcaacgaggaaatcctagggaatcagatacacatgcacgtgactgctaaggagtatggcgcccgtgtatcgaatctacatatgtactctgccgtgtgtgccgacgttatccggagatgggtctaccccctcaccccggaggccaatttcaccgattcaactacacagtcctgcactcactcacgtcacaatatttaccggggccccgaggtttctttaggccatggttccattctggaggagaatgtgctgctgggatccgggacagtcatcgggagcaactgctttatcaccaattcagtaatcggcccagggtgccacattggtgacaatgtagtgctggatcagacatacctgtggcagggcgtgagggtggctgccggggcccagatccaccagtccctcttgtgtgacaatgcggaggtgaaggagagagtgacccttaagccccggtcagtgttaacctctcaagtggtcgtgggtcccaatatcacacttcccgagggctcagtgatttctctacacccacccgatgcggaagaggatgaagacgatggggagttctccgacgactctggtgcagaccaggagaaggacaaggttaaaatgaaaggctacaatcctgcagaggttggggccgccgggaaggggtacctgtggaaagccgccggcatgaatatggaggaggaagaagagctgcagcagaatctgtggggacttaagatcaacatggaggaggagagcgaatccgagtccgagcaaagcatggatagtgaggagccggacagtcggggaggctcgcctcagatggatgatatcaaggtgtttcagaatgaggtgttggggactctacagcggggcaaagaggaaaacatctcatgcgacaatctcgttctcgaaatcaatagtttgtag

SEQ ID NO: 187072 - DNA, 2574 bp, Artificial Sequence
  Description of Artificial Sequence: Synthetic coding sequence
atggaggccggccccagcggcgccgccgccggcgcctacctgcccccactccagcaggtcttccaggccccacggaggcccgggatcggcacagttggaaaacccattaagctgttggctaactactttgaagtcgacattccgaaaatcgatgtctatcactacgaggtagacatcaaacctgataaatgtccgcgacgagtgaatcgcgaggttgtcgagtacatggtgcaacactttaagccccagatatttggtgaccgtaaacctgtgtacgatggtaaaaagaatatctacaccgtcacagctttacccataggcaatgaaagggtggactttgaggttacaattccaggcgaggggaaagatcgaatttttaaggtttcaattaagtggctggcgattgtgagctggagaatgttacatgaagccttggtatcgggccagattccagtgcctctggagagtgtgcaggccttggacgtagccatgcggcatctcgcctccatgagatatacgcccgtcggtaggtcattcttttcaccacctgaaggctactaccacccactgggtggggggagagaagtgtggttcggattccatcaatctgtgcgtcccgccatgtggaaaatgatgctcaacattgacgtatccgccaccgcattttataaagcgcaacctgtgatcgagtttatgtgtgaggtgctggatatcaggaatatcgacgagcagcccaaacccctgacggatagccagcgagtgcggttcactaaggaaattaaggggcttaaagtggaggtgactcactgcgggcaaatgaaaagaaagtatagagtgtgtaatgtgacgcggaggccagcatctcaccagaccttcccactgcagctggagagtggacagacagtcgagtgtactgtcgcccagtatttcaagcaaaaatataacctccagctcaagtaccctcacctgccatgcttacaggtgggacaagaacagaaacatacttacctgcccttggaagtatgcaacattgtggcggggcaaaggtgtatcaaaaaactgaccgacaatcaaacaagcaccatgatcaaagccactgcacgatccgcacctgaccggcaggaggagatctcgaggctgatgaagaatgctagctacaacttggacccctacatccaggagtttggaataaaagtgaaggacgatatgacagaagtgaccggacgcgtcctgccagcccccatactgcagtatgggggccggaaccgggccattgccacacccaaccagggcgtttgggatatgagaggtaagcagttttataatggcatcgaaatcaaagtctgggcaatagcatgctttgccccacaaaagcaatgcagggaggaagtccttaaaaattttacagatcaattaagaaagatcagcaaggatgccggaatgcccatacaaggtcagccatgtttttgtaagtatgcacagggcgctgattccgtagaacctatgtttagacacttgaaaaacacctatagcggcctacagttaatcattgtcatcctgccggggaaaaccccagtctacgcagaagtcaagagggtgggtgataccctgctggggatggccacgcagtgtgtgcaggtgaaaaatgtggttaagacatccccccagacattgtcgaacctgtgcttgaagatcaacgtgaaattgggcgggataaataatattctggtgcctcaccagcgaagcgcagtctttcagcaacctgtaatctttctgggcgctgacgtcacacaccccccggcgggcgacggtaaaaaaccttctataactgcggtggttggatccatggacgcccacccatcccgctactgcgcaaccgtgcgggtgcagcgcccaagacaggaaattatcgaggatctgtcttatatggtaagggagcttttgatccagttctacaaatccacccgctttaaacctaccagaattatcttttaccgggacggcgtgcccgaggggcagctcccccagattctgcattatgaactgctcgctataagggacgcatgcatcaaacttgagaaagactaccagcctggtattacatatattgtggttcagaagcgtcaccacacacggctattttgtgccgataagaatgagcggattgggaagtccggaaacatccccgccgggaccactgtcgacacaaacattactcatccatttgagttcgacttttacttgtgtagccacgccgggatccagggaacctctcgcccttcacactactacgtactgtgggacgataacagatttaccgccgatgagctccagattctgacctatcaattgtgtcacacgtatgtgagatgcacaagaagcgtctctatacccgccccggcctactatgcccgattggttgcctttagagcaagataccacctggttgataaggagcatgactccggcgaagggtctcatattagcggccagagcaatggacgagatcctcaggccttggcaaaggccgtgcaggtgcatcaggacacccttcggactatgtacttcgcatag

SEQ ID NO: 187073 - DNA, 2349 bp, Artificial Sequence
  Description of Artificial Sequence: Synthetic coding sequence
atggtgcagcacttcaagccccagatcttcggcgaccggaagcccgtgtacgacggaaagaagaacatttataccgtgacggcccttcctataggaaacgaacgcgtagattttgaagtgacgataccaggagagggcaaagaccgcatttttaaggtttccatcaagtggctggcaatcgtgtcttggcgaatgttgcatgaagcactcgtctctggacagatcccggtaccactggagtcagttcaggccttggacgtggccatgaggcacttggcaagtatgaggtataccccagtgggaagatcattcttctccccgcccgaaggctactaccaccccttggggggtggcagagaagtgtggttcgggttccaccagagcgtgcggcccgctatgtggaagatgatgctgaacatcgacgtctcagccaccgccttttacaaggcccagcctgtcatcgagtttatgtgtgaagtactggacatcagaaatatagacgaacaaccaaagcccctgacagacagtcagcgggtgagattcactaaggagataaagggcctgaaagtcgaagtcacccattgcgggcagatgaagcgcaagtacagagtgtgcaatgttacccgccgacctgcaagccaccagactttcccactgcaactggagtcaggacagaccgtggagtgcacagtggctcagtatttcaaacagaagtataacctccagctgaaatacccccatcttccttgcctccaggtgggccaagagcagaaacatacttatttgccgttggaggtgtgcaatattgtggccggccagaggtgtatcaaaaagttgactgataaccagacgagtaccatgattaaggctaccgcccgaagtgcccctgacaggcaggaagagatcagcaggctcatgaagaatgcatcttacaacctagacccctatatccaggagtttggaattaaagtgaaggacgacatgacagaagtgactggaagggtgcttcctgccccaatcctgcaatacggagggcgaaacagagcaatcgccactcctaaccagggtgtttgggacatgagagggaagcaattctataacgggattgagattaaagtctgggcgattgcctgctttgcacctcagaagcagtgtagggaggaagttctcaagaactttacagaccagctgcgcaagatctctaaggacgcgggtatgcccatacagggacaaccctgcttttgtaagtacgcccaaggcgccgattccgttgagccaatgtttaggcatcttaagaatacctactccgggctccagctcatcatcgtcatacttcccgggaaaacccctgtctatgcagaggttaagcgggtcggggatacactcctggggatggctacgcagtgtgtccaggttaagaacgtggtgaagacttctccacagaccttgagcaatttatgtcttaaaattaatgtgaagctcggaggcataaataatattctggtgccccaccagcgttctgcagtattccaacaacctgttatctttctgggcgccgatgtgacacatccacccgccggtgatgggaaaaaaccgagcatcacagcagtggtgggctctatggacgctcatccaagcaggtactgtgccaccgtgagagtgcagcggcctcggcaggagattatagaggacttatcatacatggtgcgggaattgctcatccagttttacaaaagtactcggttcaaacccaccaggatcatcttttacagggacggggtgccagaaggccagctgccacaaatcctgcattacgaactgctggcaatccgagatgcctgcatcaagcttgagaaagattaccaacctggcattacatatattgtggtgcagaagcggcaccacacccggctcttctgtgctgacaagaatgagaggatcggaaagtccggtaacattccggctggtacgaccgtggacactaacataacgcacccattcgaattcgatttttacctgtgttcacacgcagggatccagggtactagcagaccctcacattactacgtgctttgggatgataaccgatttactgctgatgagctgcagatcttaacatatcaattgtgtcacacttacgtccgatgtacccgatccgtgtctatccctgctcccgcttactatgctaggctggtggcttttcgcgccaggtaccacctcgtggacaaagagcacgattcaggtgagggcagtcacatcagcggacaaagtaacggtcgggaccctcaggctctagccaaagccgtgcaggtgcaccaggacaccctccggaccatgtacttcgcttag

SEQ ID NO: 187074 - DNA, 1254 bp, Artificial Sequence
  Description of Artificial Sequence: Synthetic coding sequence
atggagttcgtgaagtgcctgggccaccccgaggagttctacaaccttgtcaggttccggatcggaggaaagaggaaagttatgcctaagatggatcaagatagcctgtctagttctctgaagacttgttataaatatctgaatcaaacctcaagaagttttgcagctgttatacaggctctcgatggagagatgcgcaatgccgtatgtatattttacctggttctccgcgctttggatacactggaggatgatatgactatcagtgttgagaagaaagtgcccttgctccacaattttcattcctttctgtatcagcccgactggcgatttatggaatctaaagaaaaggatcggcaagtgctggaggactttcctacaatatccctggaatttcggaatctcgccgagaagtaccaaacagtcatcgcagacatatgtagaagaatggggattggaatggcagaattcttggacaagcatgtgacctccgagcaggagtgggacaaatattgccactatgtggcggggcttgtggggatcggactgtctcgcctattcagtgcttctgaatttgaggatccgctggtgggagaggacacggagagagctaatagcatgggtctcttcctgcagaaaactaacatcattcgtgactatcttgaggatcagcagggtggccgcgaattctggcctcaggaggtctggtctagatacgtgaagaagctgggtgatttcgctaaacctgagaacatcgacctggcggtgcagtgtctgaacgagctaattactaatgctctgcatcacattccagacgtaattacatacctctccagattgagaaaccaatcagtatttaatttctgtgctatccctcaggtgatggctatcgccactcttgctgcctgctacaataaccaacaggtctttaagggggccgtgaaaatccggaaaggccaggcggtgacattgatgatggacgctacaaatatgcccgcagttaaagccataatataccagtatatggaggaaatctaccatagaatcccagacagcgatccctcaagctcaaagacgcggcagataattagtacgatcagaacccagaaccttccaaactgccaactgatctctagaagccactacagccctatctacctgtccttcgtgatgctgttggcagctctgagctggcaatatcttacgaccctttcccaagtgaccgaggattatgtgcaaacgggggagcattag

SEQ ID NO: 187075 - DNA, 2478 bp, Artificial Sequence
  Description of Artificial Sequence: Synthetic coding sequence
atgtacagcggcgccggccccgccctggccccccccgccccccccccgcctattcaagggtacgcttttaagcctccccccaggcctgactttggtacgtcaggcagaacaattaagttacaggcgaatttcttcgagatggatattcccaaaattgacatctaccactatgagctggacattaaaccagaaaagtgccccagacgcgtgaaccgggagatcgtagaacatatggtgcagcattttaagacccagatctttggggatcgcaaaccagtgtttgacggaaggaaaaacttatatactgctatgcctctacccattggccgcgataaagtagaactggaagttaccttaccgggtgagggtaaagatcgtatcttcaaagtgagtataaagtgggtgtcgtgcgtctccttgcaggctttgcatgatgccctctctggaagactgcccagtgtcccatttgagacaatccaggccctggatgtggtgatgcgccacctgccctccatgagatatacgcccgttgggagaagtttttttaccgcctcagagggttgtagtaaccctctggggggcgggagagaagtgtggttcggctttcatcaaagtgttagaccttccctctggaagatgatgctgaacatcgacgtctcagctacagccttctacaaggcacaacctgttatcgaattcgtctgcgaagttttagatttcaaaagtatcgaagagcagcagaagcccctgactgattcccaaagagtaaagtttactaaggaaataaagggtctcaaggtcgaaatcacccattgcggccagatgaagagaaaatacagggtctgtaacgtaacaaggcggcccgctagtcatcaaacatttccactccaacaggagtcgggccaaaccgtggagtgtaccgtggcccagtatttcaaagaccggcataagctggtgctgcggtacccgcaccttccttgtctgcaggttggacaagaacagaagcatacttaccttcccctcgaggtctgcaacatagtagccggtcagcgttgcatcaaaaaactgaccgacaaccagacctcaacaatgattcgtgctacggcaagaagcgctcccgatcggcaggaggaaattagcaagctcatgcggagcgctagtttcaacaccgacccatacgtccgagagttcggcatcatggttaaggatgagatgactgatgtgactgggagggtcttgcagcccccgtctattctgtacggcggcagaaataaagccatcgccacacctgtacagggtgtttgggatatgcgtaacaaacagttccacactggaatcgagattaaggtctgggccatcgcttgcttcgcaccacagcggcagtgtactgaagtccacttgaagagtttcaccgagcaattgcggaagatttcacgggacgccggcatgccaatccaaggacagccgtgcttctgtaagtacgctcagggtgccgacagtgttgaaccgatgtttagacaccttaagaatacctatgcaggtctccagctggtcgttgtgattctacccggaaaaacccccgtgtatgccgaggtgaagcgcgtgggggacactgtgctcggtatggccacccagtgtgtccagatgaaaaacgtgcagcgaaccacgcctcagacgctttccaatctctgtctgaagataaatgtcaaacttggcggtgtgaataacatcctgttgccgcagggaagaccccccgtctttcagcagcccgtgatttttctgggcgcggatgttacccaccctccagcaggcgacggcaagaagcctagtattgcagcagtggtgggttctatggacgctcatccgaacagatactgtgcgaccgtgcgggtccagcagcaccgtcaagagattatccaggatctcgccgccatggtacgagagttgctcattcagttttacaagtctacacggtttaaaccaacccggataatattttacagagatggggtgagtgaggggcaattccaacaggtgttacaccatgaactgctggcaattcgggaggcctgtatcaagttagaaaaggattaccaacctggaattactttcatcgttgttcagaagagacatcatactcggttgttttgtaccgacaaaaatgaaagagggaccagccgcccgagccactaccatgtcctgtgggacgataacagattttcatcagatgagttgcaaattctaacctatcagctatgccatacttatgtgagatgcactcgatcagtcagtatccctgcaccggcatattatgcgcatctggtcgccttccgtgccaggtaccacctggtcgataaagaacatgacagcgcagagggttcccacacaagtggacaatccaatggtagggatcaccaggcactcgcgaaggccgttcaggtacaccaggataccctgaggaccatgtatttcgcttag

SEQ ID NO: 187076 - DNA, 1881 bp, Artificial Sequence
  Description of Artificial Sequence: Synthetic coding sequence
atgtgcgaggtgctggacatccacaacatcgacgagcagccccggcccctgaccgactcacaccgggttaagttcacaaaggaaattaagggcctgaaggtcgaggttacgcattgtgggaccatgagacgtaagtacagggtatgcaacgtcacgagaaggccagcaagtcatcaaacctttccattgcagctggaaaacgggcaaaccgttgaaaggacagttgcccaatactttcgcgaaaaatataccttgcagctgaagtacccccacttaccctgccttcaggttgggcaagagcagaaacacacttacctgcctctagaggtatgtaacattgtggcggggcagcgttgtataaaaaagctgactgacaaccagacaagtacaatgattaaagccaccgccaggtctgctccagaccgacaggaggaaattagtaggttagtgaggagcgccaactatgaaactgatccgttcgtccaggagttccaattcaaggttagggacgaaatggcccatgtgaccgggagagtgctacccgcgccgatgctgcagtacggcggccgcaatcgcacggtggccacaccatcccacggcgtctgggacatgcgtggcaagcaatttcatactggggtggagataaagatgtgggccatagcttgcttcgctacccagaggcaatgtcgagaagaaatattgaagggtttcacagaccaattgcgtaaaatctctaaggacgccgggatgccaatccagggacagccctgcttttgcaagtacgcacagggagctgattctgtagagcctatgttccgacacctcaaaaacacctattcaggtttacagctgatcattgtcatcctccccggaaagacccctgtttacgcagaggtgaagagggtgggcgacactctcttggggatggctactcagtgtgtccaggtcaaaaacgtcataaaaacttcaccacaaaccctctccaatctgtgcctcaagatcaacgtcaaactgggagggatcaataatattctagtcccgcaccagagaccttcagtattccagcagcctgtgatttttctaggggctgacgtaacgcaccccccggctggtgacggtaagaagccttcaattgccgccgtcgtaggatccatggacgcccacccatcaagatactgtgcaaccgtccgcgtacagcgaccccgtcaggagatcattcaggacctggctagtatggtgagagagctcttaattcagttctacaagtccacgcgcttcaagccaacaaggatcatcttttacagggacggggtctccgaagggcagtttaggcaggttctttattatgagcttcttgccatcagggaggcgtgcatcagtctggaaaaggactaccagcccgggatcacctacatcgtcgtgcagaagcgacaccatactcggctattttgtgcagatcggacggagcgcgttggcagatcagggaacattcccgcgggaaccacagtagatactgacatcactcacccttatgaattcgacttttatctctgtagccatgcaggcattcagggaacctcaagaccctcacactaccatgtgctctgggatgacaactgtttcaccgccgatgaactccagctgctgacctaccagctgtgtcatacatatgtaagatgcacacgcagtgtgtccatccccgctcctgcctattatgcccatttagtcgcttttcgggctcgataccatttggtggacaaggaacacgattctgccgagggaagccatgtgtcgggacagtccaatggaagagatccacaggccttggccaaagccgtgcagattcaccaggacacactgcggacgatgtacttcgcctag

SEQ ID NO: 187077 - DNA, 690 bp, Artificial Sequence
  Description of Artificial Sequence: Synthetic coding sequence
atggagatcggcagcgccggccccgccggcgcccagcccctgctgatggttccccggagaccgggctatgggacaatgggaaaacctatcaagctactggcgaactgcttccaggtggaaatccctaaaattgatgtgtacttgtacgaggtcgacattaagccagacaagtgtcccagacgcgtcaaccgggaggtcgtcgatagtatggttcagcactttaaagtcacaatatttggtgacagacgcccagtgtacgatgggaaacggtctttatacacagcaaatcccttgcctgtagccacgactggggtggatttggatgtgaccttaccgggggagggggggaaggacagaccttttaaagttagtataaagttcgtgtcccgggtgagctggcacctcctccatgaagtgttaactggccgaactctcccggagcccttggagctggacaaacctatctccaccaatccagtgcatgctgtggacgttgttctgagacacctgccttccatgaaatataccccagtcggccgctcatttttttcggcacctgagggatatgaccaccctttgggaggtggcagggaggtatggttcggctttcaccagagcgtgagaccagctatgtggaaaatgatgctgaatatcgacgaacgagatctgtggcagcaatgcggcgaatag

SEQ ID NO: 187078 - DNA, 2583 bp, Artificial Sequence
  Description of Artificial Sequence: Synthetic coding sequence
atggagatcggcagcgccggccccgccggcgcccagcccctgctgatggtccctcgcagacccggttatggaaccatgggaaaaccaataaagcttctggccaactgtttccaggtagagatcccgaagatcgacgtctatttatatgaagtggatattaagcctgacaagtgccctcgccgggttaaccgtgaagttgtggatagcatggtgcagcatttcaaggtcacgatcttcggtgaccgccggcccgtgtatgacggcaagcgttccctttacaccgccaaccccctacccgtggcaacaaccggcgtcgatctagatgtgacactccccggcgagggtggcaaggacagaccatttaaggtctccattaaatttgtgagtcgggtaagctggcacctgttgcatgaggtactcactggacgaaccctaccggaacctttggagcttgacaagcctatttctaccaatccagttcacgctgtcgacgtcgttctacgccacttaccctcaatgaaatacacgccagtcggtcgcagcttcttcagcgccccagagggttacgaccatccactgggcggcggccgggaagtgtggttcgggttccaccagtcagtgaggccagccatgtggaagatgatgctgaacatagacgtaagtgccaccgcattctataaagcccagccagttattcaattcatgtgtgaggtcctggatatccataatattgatgaacagccccgccctctcaccgatagtcatcgggtgaagtttaccaaggagatcaaaggacttaaggtggaggtaacacactgtggtactatgcggaggaaatatcgagtctgtaacgtgactcggcggccagccagtcaccaaacatttcccttacagctcgagaatggccagacagtcgaacgaactgtggcacaatattttcgggaaaagtacactctgcagctcaagtaccctcatctaccatgcctgcaggttggacaagagcaaaagcacacatacctgcctctggaagtgtgtaacattgttgctgggcagagatgcataaagaaactcacagacaatcaaaccagtacgatgattaaagccacagcccgctcagccccggaccgccaggaggagatcagccgcttagtgcgctccgctaactacgagacagatccctttgtgcaagagttccaattcaaggtgagggacgagatggcacatgtgacgggacgtgttctgccggcaccaatgcttcaatatggggggcgaaacaggaccgtggctactcctagccatggcgtatgggatatgagaggaaagcagttccatacaggcgtggaaatcaagatgtgggccattgcttgctttgcgacgcagcgccagtgccgggaagaaatcctgaaagggttcactgaccagctgcgcaaaattagtaaggacgccggcatgcccattcagggccaaccatgcttttgcaaatacgcacaaggtgcagacagtgtggaacccatgttccgacacctgaaaaatacctacagtggactacagctcatcattgtgatcctacccggtaaaaccccagtatatgctgaggttaaaagagtgggggatacactactgggcatggccacccagtgtgtacaggtgaagaacgtgatcaagacaagtccacaaacgttgagtaacctgtgtcttaagatcaacgtgaagctgggtgggattaacaacatcctcgttccacatcagcgcccttcagtgtttcagcaacccgtgatctttctgggtgcagacgtcacgcatccccccgctggggatggcaagaagccctcgatagcggctgtcgtggggtcaatggacgcacacccttcccggtattgcgccaccgtgcgagtgcagcgccctcgccaggagattatccaggacctggcatctatggttcgcgaactcctaattcagttctacaagtctacaaggttcaagccaaccagaattatattttatcgggatggggtctccgaaggccagttccggcaggtgctgtactacgagctgctggcaattagggaagcttgtatctcactggagaaagattaccaacccgggattacctacatcgtcgttcagaagagacatcataccaggctgttctgcgccgatagaactgagcgcgtgggtcgcagcggtaacattccagctgggacaacagtggacacagatatcacgcatccatatgaattcgatttttacctctgtagccatgccggaattcagggtacttcccgaccttcgcattaccacgttctgtgggacgacaactgctttacagctgatgaactgcagctcctgacttaccagctttgccatacatacgtaaggtgtactcgatctgtctccatccccgctcctgcatactatgcacatctggttgccttccgcgcacggtatcaccttgtagacaaggaacacgactctgctgagggctcccatgtgtctggccaaagtaatgggcgggaccctcaggcgctggccaaggctgtgcaaatccatcaggatacactccgcacaatgtatttcgcttag

SEQ ID NO: 187079 - DNA, 690 bp, Artificial Sequence
  Description of Artificial Sequence: Synthetic coding sequence
atggagatcggcagcgccggccccgccggcgcccagcccctgctgatggtgccccgaagacccggttatggcaccatgggcaagccgattaaactcctggcaaactgttttcaggtcgaaatcccaaagattgacgtgtatctgtatgaggtggacatcaaaccggacaaatgccctcggagagtgaatcgcgaagttgtagatagcatggtgcagcatttcaaagtcacaatcttcggggatcgccggcctgtgtatgatggtaaacgcagcctttatacagcaaaccccctccccgtagccacaaccggagttgacttagacgtgacgctgcctggcgaaggcggaaaggatcggccctttaaagtttcaatcaaattcgtgtccagggtctcgtggcacctcctccacgaggtactcacaggaagaaccctgccagaacccctggagctcgacaagcccatcagtactaacccagtgcacgctgtggatgtcgtgctccggcatctgccgtcgatgaaatacacaccagtgggaaggagtttcttcagcgcccccgaaggctacgaccacccgctggggggaggtcgcgaggtctggtttggttttcaccagtccgtgaggccggccatgtggaaaatgatgctaaatatcgacgagcgcgatctttggcagcaatgtggggagtag

SEQ ID NO: 187080 - DNA, 2586 bp, Artificial Sequence
  Description of Artificial Sequence: Synthetic coding sequence
atggaggccctgggccccggcccccccgccagcctgttccagccccccagacgcccagggcttgggaccgtgggaaagccaatcaggctgctggctaatcacttccaggtacagatccccaaaatcgacgtgtatcactacgatgtggatattaaaccagaaaaacggcctcgccgagtgaatcgggaagtggtggacacaatggtgcggcattttaaaatgcaaattttcggtgacaggcagcccggctatgacggcaagaggaatatgtataccgctcaccccctgcccatcggacgcgaccgcgtagatatggaggtgacccttccaggcgaggggaaggatcagacatttaaagtgtccgtccagtgggtgagcgtggtttctctgcaactcctgctggaagccctggctggtcacctgaatgaagtgcccgacgactctgtgcaggcgctggacgtgataactcggcatctcccgtctatgaggtacacccctgtgggaaggtccttcttttccccacctgagggctactatcatcctctgggtggtgggcgcgaggtgtggttcggcttccatcaaagcgttcggcccgccatgtggaatatgatgcttaatatcgacgtcagcgcgaccgcattctacagagcccagcccatcatcgagttcatgtgcgaggtgctcgacatccagaatatcaacgagcagactaaacccttaaccgacagccaacgagtaaagtttacaaaagaaatacgcggactcaaggttgaggtgacccactgtggccagatgaaacgcaaataccgggtctgtaacgtgacccggcggcccgcatcccaccagacatttcctctgcagctagaaaatggccaggcaatggaatgtactgtagcccagtactttaagcagaagtacagcttgcagttgaaatatcctcatctgccctgtttgcaggtcgggcaggagcagaagcacacatacctgcccttagaagtctgtaacattgtggccgggcagcgatgcataaaaaaactgaccgataatcagacatcaacaatgattaaggccacggcgcgatctgcgccagatcggcaggaagaaatcagcaggttggtgaaatccaattcgatggtgggcgggcctgacccttacttgaaagaatttggaatcgttgtacataacgaaatgacagaactgaccggtagggtgctccctgcccctatgcttcagtacggaggccggaataaaaccgtcgctacacctaatcaaggcgtctgggacatgaggggaaagcagttctacgcaggcatagaaattaaggtgtgggccgtagcttgctttgctccacagaaacagtgcagagaggacctgctgaagtcctttaccgaccaactgcgtaagatcagtaaagacgcagggatgccaatccagggacagccatgcttctgtaaatatgcacagggcgccgacagtgtggaaccgatgttcaagcatcttaagatgacatatgtcggactccagcttatcgtggtcatcctgccaggaaaaaccccagtgtacgcagaggtaaagcgggttggcgatacacttctgggcatggcaacgcagtgtgttcaggtgaagaacgtcgtaaagacgtctccgcaaacattgagcaatctttgtcttaagataaatgcaaagctcggtggcatcaataatgtgctggtgccacatcagcgaccctcggtcttccagcagccggtcatcttcctgggggccgatgtgacacaccctccagctggggacggaaagaaacccagtatagcggctgtggtgggcagtatggacgggcatcccagcagatattgcgcaactgtccgcgtccagacaagccggcaggagatttctcaggagctcctgtatagccaggaggtcatccaggatttgaccaacatggtgcgggaactgttaattcagttctacaagagtacacgcttcaaacccacgagaatcatctactatagggggggagtaagcgagggccagatgaagcaggtggcctggcccgagctcatcgcaattcggaaggcttgcattagtctggaggaggactatcgtcctggaataacttatatcgtcgtacagaagcgacatcacaccagactcttctgcgccgacaagactgagcgggtcggaaaatcagggaatgtgcccgccgggacgactgtggactccaccattacccaccctagtgagttcgacttctatctttgcagccatgccggtattcagggcacctcacgcccttctcactatcaagtactatgggacgacaactgctttacagcagatgaacttcagctactgacttatcagctctgtcacacatacgtgcggtgtacccgctctgtctccattccagctcccgcttattatgcccggcttgttgcgttcagggctcggtatcatctggtcgataaagaccatgacagtgcagagggctctcacgtgagcggacagagcaatggacgagaccctcaagccctggcaaaagccgtacagatccaccacgatacccaacacaccatgtattttgcctag

SEQ ID NO: 187081 - DNA, 1755 bp, Artificial Sequence
  Description of Artificial Sequence: Synthetic coding sequence
atgttcgccaaggccttccgggtgaagagcaacaccgccatcaagggatctgacagaagaaaactcagagctgatgttactaccgccttcccgactctcggaaccgaccaggtcagtgagttagtgcctgggaaagaggaattgaatatcgtgaagttatatgcccacaaaggagatgccgtgaccgtctacgtctctgggggcaatcccatcttgttcgagcttgaaaagaatttgtatccaactgtctatacattgtggtcttaccccgatctgttaccgacattcactacctggccactggtgctggaaaagctcgtgggcggggccgacctgatgctgcccggcctcgtcatgcctcctgccgggctcccccaagtgcagaagggtgatctgtgtgctattagccttgtgggcaatcgggcaccggtggccattggggttgctgcaatgtcaactgcagagatgttgacatccggcctgaaggggcgcggattctccgtgttgcacacctaccaagatcatctgtggcggtccggtaataagtcatcaccaccttcaatcgcaccattggccctggactcagcggacttgtcagaggaaaaggggtctgtccagatggattcaacgcttcagggggatatgcggcatatgaccctggagggcgaggaagagaatggagaagtgcaccaagccagagaagacaagtcgttgagcgaggcccccgaggacactagcactcgaggcctgaaccaagatagcacagactccaaaactctacaggaacagatggacgagctcctgcagcagtgcttcttgcatgcactcaagtgccgcgtgaagaaggctgacttgcctctccttacctccaccttcttaggatcacatatgttttcctgctgtcctgagggcaggcaactcgatatcaaaaaatccagttacaagaagctgagtaaatttcttcagcagatgcagcaagagcagattatacaggtaaaggaactttcaaagggagtagagagtattgtagccgtggactggaaacatcccaggattacatcatttgtcattccagagccctctcctacatcccagacaattcaggagggatcgagagaacagccttatcacccacccgatatcaaaccattgtattgcgtacccgccagtatgaccttgctgttccaggagagcggtcataagaagggcagctttctcgaggggtctgaagttcgcaccatagtcataaactacgccaaaaagaatgacctggtggacgctgacaacaagaatctcgtgagattggaccccatcctgtgtgactgcatactagagaagaacgagcagcataccgtgatgaaactgccgtgggatagcctgctgactaggtgccttgaaaagctacagcccgcttaccaggttacgctgccaggccaggaacccatcgtcaagaaggggaggatatgcccaattgatatcaccctggcacagcgggcttctaacaaaaaggttaccgtagtcagaaacctagaagcctatgggttagatccctactctgtggccgcaatcctccagcagcggtgtcaggcgagtactaccgtgaaccccgccccaggcgccaaagacagtctacaggtgcagatccaaggaaaccaggtacatcacctggggtggctgctccttgaggagtaccaactcccacggaagcacatccagggcctcgaaaaggccctgaagccaggaaagaagaagtag

SEQ ID NO: 187082 - DNA, 816 bp, Artificial Sequence
  Description of Artificial Sequence: Synthetic coding sequence
atgttcgccaaggccttccgggtgaagagcaacaccgccatcaaggggtcagacaggcgtaagttgcgtgctgacgtcactacagcctttcccacgctgggaacagatcaggtctccgagctggttccaggcaaagaagaactgaacattgttaaactgtacgcacacaaaggcgatgccgtcacagtgtatgtgagcggcggcaatcccattctgtttgaactcgagaagaatctctaccccactgatcttatgctgcccggtctcgttatgccccccgctgggctgcctcaggtccagaagggtgatctgtgcgccatttcgttagtgggaaacagggccccggtcgccatcggcgttgctgccatgtctacagcagaaatgctgacctccgggctgaaaggccggggattcagcgtcctgcatacttatcaggatcacctctggcggagtgggaacaagtcttcgccgcccagtatcgcgcccctggctcttgactctgctgatctttccgaagaaaagggtagcgttcagatggacagtacattgcagggcgatatgcgccacatgaccctcgagggggaggaggagaatggggaagtgcatcaggctcgggaagacaaatctctgtccgaagccccggaggatacttcgacaaggggactcaatcaggactccaccgactccaaaactttgcaggagcagatggacgagcttctacagcagtgtttcttgcacgccctgaaatgcagggtcaaaaaggctgatttgccactgctcactagtacgtttttgggctcccacatgttttcctag

SEQ ID NO: 187083 - DNA, 1383 bp, Artificial Sequence
  Description of Artificial Sequence: Synthetic coding sequence
atgttcgccaaggccttccgggtgaagagcaacaccgccatcaaggggtcagatcgacgcaagcttagagccgatgtgactaccgcttttcccaccctgggcacagaccaggtcagtgaattggtgccaggcaaggaagagctgaacattgttaaactgtacgcacataaaggcgatgccgttaccgtatacgtgtcgggcgggaatcccatcctgttcgagctggaaaagaatctgtatccaaccgtctatacactctggagttaccccgatctgctgccaacgttcactacttggcccctggtgcttgagaaactggtgggaggagccgacctgatgctgcctgggctagtcatgcccccagccggcctgccacaggtgcaaaagggcgacctgtgtgccatttcactcgtcggcaatagagcacccgttgccatcggggtcgccgccatgagcaccgccgagatgctcacctcagggctgaaaggccgcgggttcagtgtgctccacacataccaggaccacctctgccccgaggggcgccaactcgatattaagaaaagctcatataagaagctgagcaaattccttcagcagatgcagcaggagcagattatccaggtcaaagaactgagcaaaggcgtggagagcatcgttgctgtggactggaaacatcccagaatcaccagcttcgtgattcctgagcccagcccaaccagccagactatccaggaagggtcaagggagcagccctatcaccccccagacattaagcctctctactgcgtgcccgctagcatgaccctgctgttccaagagagcggccacaaaaaaggaagtttcctggaggggagcgaggtgagaacaatcgtcatcaactacgcgaagaaaaacgatcttgtggacgctgacaacaagaaccttgtgcgactcgaccctattttatgcgactgtattctggaaaagaatgagcaacacaccgtgatgaagctcccctgggacagcctgctgaccagatgcctcgaaaaactccagccagcttaccaggtcaccctcccagggcaggaaccgatcgttaagaagggccggatttgccctatcgacattactctggcccagcgggcctctaacaagaaagtcaccgtggtgagaaacctggaggcctacggcctggatccttattccgttgccgccatcctgcaacagcgttgccaggcctctaccactgtcaaccccgctccaggagccaaggacagtcttcaggtccagatccagggtaatcaggtgcaccatctgggctggttgctgctggaggagtatcagttgccaaggaaacatattcagggcctggaaaaggccctgaagccgggcaaaaaaaaatag

SEQ ID NO: 187084 - DNA, 816 bp, Artificial Sequence
  Description of Artificial Sequence: Synthetic coding sequence
atgttcgccaaggccttccgggtgaagagcaacaccgccatcaagggcagcgaccgaagaaagctgcgagccgatgtcacaactgcctttccaacacttggaaccgaccaggtatccgaactcgtcccaggaaaggaagaactgaacatcgtgaagctgtacgcacataaaggtgatgccgtaacagtctacgtctcaggaggaaatcctatattgttcgagttggagaaaaatttataccccactgacctgatgttgcctggacttgtcatgccaccagccgggttgccccaggttcagaagggagacctctgcgcgatttcgcttgtcgggaaccgtgcacccgtggccattggcgtggctgcaatgagtaccgctgagatgttaacttctggtcttaaaggtcgcggattcagcgtgttgcatacttatcaggaccatctgtggagatctggcaataagagctcacctcctagtatagctccactggctctggacagcgcagacttatcagaggagaaaggaagcgtgcagatggattctaccctgcagggagatatgcgacacatgactctggagggcgaagaggaaaatggcgaagtgcatcaggctagggaggacaagtctctgagcgaggcgcctgaggatactagtacacggggactaaaccaggattcaaccgattccaaaactttgcaagaacagatggacgagttactgcaacagtgttttctacacgctctcaagtgcagggtgaagaaggctgacttacccctgttgacgagtacattcctggggagccatatgttttcttag

SEQ ID NO: 187085 - DNA, 2742 bp, Artificial Sequence
  Description of Artificial Sequence: Synthetic coding sequence
atgagccggttcttcaccaccggcagcgacagcgagagcgagagctccctgtctggtgaagagctcgttacgaagcccgttggcggaaattatggcaagcaacctttgctcctttcggaggatgaagaggataccaaaagagtggtgagatctgcgaaggataagagatttgaggaactcaccaatctgattaggacaattcggaacgccatgaagatccgcgatgtcacaaaatgcctcgaggagttcgaactactcggtaaggcatacggcaaagctaagagcatcgtagataaagagggtgtgccacgcttctatattcggatcctggccgacctggaggactacttgaatgagctgtgggaagacaaggagggtaagaagaaaatgaataagaacaacgccaaggccctatccactcttaggcaaaaaattcgaaaatacaacagggactttgaatcgcacattacaagctacaaacagaacccagagcaaagcgctgatgaggatgccgaaaagaatgaggaggattccgagggatccagtgatgaggatgaagacgaggacggtgtatccgctgccaccttccttaaaaagaaatccgaggcacccagcggggagagtaggaaatttttgaagaaaatggatgatgaggatgaggatagcgaggattctgaggatgacgaagattgggataccggctccacgtctagcgactcagactccgaggaagaagaaggaaaacaaacggccttggcaagcaggtttttgaaaaaagcaccaaccaccgatgaagacaagaaggctgccgaaaaaaagcgtgaagataaggctaagaaaaaacacgacagaaagtctaagaggctagacgaagaagaagaggacaatgaggggggggagtgggagagagtgagaggaggggtcccgctggtgaaggagaagcctaagatgttcgccaaaggcacagagattacacatgcggtcgtgataaagaagttgaatgagattctgcaggcccgcgggaaaaaggggacggaccgagcagcgcagatcgagttgctacagttacttgtgcaaatcgcagccgaaaataaccttggtgagggtgttattgtcaaaatcaaattcaacatcattgccagcctctacgattacaatcccaatctagctacttacatgaagccggagatgtgggggaaatgtctcgattgcattaatgaattgatggacattctatttgcaaatccgaacatctttgtgggcgagaacatcctggaggaaagcgaaaatctgcataacgccgaccagcccctgcgggtgagaggatgcatcctgacgttggtggagaggatggacgaggaattcaccaagatcatgcaaaataccgatccccactcccaggagtacgtcgagcatctcaaagacgaagcccaggtatgcgcaataattgagcgcgtgcaacgatacctggaggagaaaggcacaacagaggaggtgtgtcggatttatctcttgagaatactgcacacttactacaagtttgattacaaagcccaccagcgacaactgacaccaccagaggggtcttccaagtccgaacaggatcaggctgagaacgagggagaggacagtgcagtgttgatggagagattgtgcaaatatatctatgctaaggatcgcactgaccgaatcagaacctgcgcgatcttgtgtcacatctatcaccacgcactgcacagtagatggtatcaagcccgtgatttaatgctcatgtctcacctccaggacaatatccaacatgccgacccacctgtccagatcctctataacagaacaatggtgcaacttggaatctgtgcctttcgtcagggtctgactaaagatgctcataacgccctgttggatatccagtcatctggaagggcaaaggaactcttaggccaaggcctactgcttcggtcactgcaggagcgcaatcaggagcaggagaaagtagaaagacgccgccaagtgccttttcatctgcatataaatctggagttactagaatgcgtatatttggtgtcagccatgctcctggagattccctatatggccgcccatgagtccgacgctaggagacgtatgattagtaagcaattccaccaccagctgcgtgtgggcgaacggcagccactgctcgggccgcctgagtctatgagagagcacgttgtggccgcgtctaaggccatgaaaatgggagactggaaaacctgccactcgtttatcattaacgagaagatgaacggcaaggtgtgggatctcttccctgaggcggacaaggttcgtaccatgctggtcaggaaaattcaagaagagtctcttcggacctatttgttcacatactcttctgtatacgattcaattagtatggaaaccttgagtgacatgtttgaactcgacttaccgacggtgcactcaataatctctaaaatgataatcaacgaagagctcatggcatcattagatcaacccactcagacagtggtcatgcacagaactgaacccacagctcagcagaatctggcgctacagctggctgagaaactgggctctttggtggagaacaacgagcgtgtattcgatcacaagcaggggacttacgggggatatttccgggatcaaaaagatggatacagaaagaacgaagggtatatgcgtaggggagggtacagacaacagcagagccagacagcatattag

SEQ ID NO: 187086 - DNA, 4149 bp, Artificial Sequence
  Description of Artificial Sequence: Synthetic coding sequence
atgcccgcctacttccagcggcccgagaacgccctgaagcgggccaatgaattcttggaggtaggtaaaaaacagccggccctggatgtcctctatgacgtcatgaaatcaaaaaagcatcgtacctggcagaagatccacgagcctatcatgcttaagtatctggagctgtgcgtcgaccttcggaagagccatctcgccaaggaaggcttgtatcaatataagaatatatgccagcaggttaatattaaatccctggaggatgttgttcgtgcatacctgaagatggcggaggagaagaccgaagccgcgaaggaggaaagccagcagatggtcctggatatcgaagacctagacaacattcagacacctgagtcagtattgcttagcgctgtcagtggggaagacactcaagatagaaccgacagactgctgctgactccatgggtgaaatttctgtgggagagctaccggcaatgcctcgaccttttgaggaacaatagccgagtggagaggctttatcacgacatcgcacagcaggctttcaaattctgtctgcagtatacgcggaaggccgagttcagaaaattgtgcgataacctgagaatgcatctgagccagatacaacgacatcacaaccagtccacggccattaatctcaataaccccgagagccaatccatgcacctagagacccgccttgtgcagctcgacagcgcaatctcaatggagctgtggcaggaggcttttaaagccgttgaggatattcatggacttttcagcttgtctaaaaagccccccaagccccagctgatggccaactattataacaaagtctcaaccgtcttctggaagtcaggaaacgctctgttccacgcctccaccctgcatagactctaccatctgagcagggaaatgcgaaagaatctcacccaagatgaaatgcagagaatgtccacccgcgtgctgctggcgacactctccatcccaatcaccccggagcggacggacattgccagactgctggacatggatggcattattgtggagaaacagaggaggctggcaactctcctgggcctccaagctccgcctactcggattggcctcatcaatgacatggtgcgctttaatgtacttcagtatgtggtccccgaagtgaaagacctttacaactggttggaggtggaatttaatccactaaagctgtgtgagagggtgaccaaggttctgaactgggtcagagaacagccagagaaggaacccgagttacagcagtacgtgccacaacttcagaataataccatccttcgcttactccagcaagtttcccaaatctaccagtccatcgaattcagccggcttacttctctggtcccattcgtagacgccttccagctggaacgcgccatcgtcgacgccgcgcggcattgtgacttgcaggttcggatagaccacacttcccgcactttgagctttggctctgacctgaactatgcgacccgagaggacgctccaataggcccccacctgcagtccatgccttcagaacagatacgaaaccaactgaccgcgatgagttccgtgctggccaaagctctggaggtgataaaaccagcccacatactgcaggagaaagaagagcagcaccagcttgcagtgaccgcctacctgaaaaacagtaggaaagagcatcagaggatcttagctcggcgacagacaatcgaggagcggaaggaaaggctcgaatccctcaatatccagcgagagaaagaagagttggagcagagagaagccgagttgcaaaaagttcgaaaggcagaggaggagcgtttgcgccaagaggccaaggagagagagaaagagcgtatactccaggagcacgagcagatcaagaaaaaaaccgtgcgagagcgcctggagcaaatcaagaaaactgagctcggggctaaggccttcaaggatattgatattgaagatctggaggaacttgatcctgatttcataatggcaaagcaggtggagcagttggagaaagagaaaaaagaactgcaggaacgactgaaaaatcaggagaagaaaatcgactacttcgaacgtgcaaagaggcttgaagaaatacccctgatcaagtcagcctatgaagagcagcgtataaaagacatggatctgtgggaacagcaggaggaggaacgcattactacaatgcaactcgaaagagagaaggccctggaacacaaaaaccgtatgagcaggatgctggaggaccgcgatctcttcgtcatgagactgaaggctgctaggcagagcgtgtacgaagagaaactgaagcagtttgaggagcgcctggccgaggagaggcataacaggctggaggagaggaagagacagcgcaaagaagagcgccgcatcacatattaccgcgagaaagaggaggaggaacagaggcgggccgaagagcagatgttgaaagaacgcgaagaacgggagagagccgagagggccaagagggaggaagagctacgggagtaccaggagcgagtcaagaaacttgaggaagtggagcgcaagaagagacagagagagctggagattgaagagcgcgagcgcagaagggaggaagagagacgcttgggagactcaagcctgtcccgaaaggatagtagatggggcgaccgagacagcgaagggacctggcgaaagggtcccgaggctgatagtgaatggcgaagaggaccgcccgagaaggaatggcgtcgtggcgagggtcgggatgaggaccgaagccaccgacgcgacgaggagcgtccccgtcggctgggtgatgacgaggatcgggagccctccctgcgccccgacgacgatcgcgtgccgcggcgtggtatggatgacgacagaggcccgcgtcgtggccctgaggaggatcgcttcagcagaaggggcgccgacgatgatcgcccatcatggaggaatacagatgatgacaggcctccacgaaggattgcagacgaagatagggggaattggagacacgccgatgatgataggcctcccagaaggggcctggatgaggatcggggcagctggaggaccgcggacgaggacagaggccccagacgcggaatggatgacgaccgcggaccaaggcggggtggcgccgacgatgagcgctcctcttggagaaacgccgacgacgacagaggtccgagacgcggacttgatgacgatcgcgggcccaggaggggaatggacgacgataggggtcctagaaggggcatggacgacgaccggggcccccgaaggggaatggacgacgatagggggcctcggcggggtctcgacgatgatagaggcccttggagaaacgccgacgacgataggatacccagaagaggagccgaggacgaccggggtccttggagaaacatggacgatgatcggctcagccggcgggcagatgacgatcggtttccgcggcggggcgatgactcccgccccgggccatggcggcccctggtcaagcctggagggtggcgcgaaaaagagaaagcccgcgaggagtcttggggaccacctagggagtcacgccccagtgaggagagggagtgggatagggagaaggagagagacagggacaaccaggacagagaggagaatgataaagatcccgagcgcgaacgagaccgcgaaagagacgtcgacagagaggaccggttcagaaggccgcgcgatgagggtggatggcggcgcggcccagccgaagagagttctagctggcgtgattcctcgcgccgggacgaccgggaccgagatgatcgccgcagggaacgagacgaccgtcgagaccttcgtgaaagacgagacctgcgcgatgacagggataggaggggcccaccactcagatccgagagagaagaagttagcagttggcgaagagctgacgataggaaagacgatcgggtggaggaacgcgatccccctcggcgtgtgcctccaccagctttgtcccgcgatagggaacgcgaccgcgacagagaaagggagggagagaaagaaaaagcgtcatggcgggccgagaaagaccgggagtctcttcgccggactaagaacgaaacggacgaagacggatggacaacagtgcgccgctag

SEQ ID NO: 187087 - DNA, 4047 bp, Artificial Sequence
  Description of Artificial Sequence: Synthetic coding sequence
atgaagagcaagaagcaccggacctggcagaagatccacgagcccattatgctgaagtatctggaactctgcgtagatctccggaagtctcatttggccaaagaggggctatatcagtacaagaatatttgtcagcaggtcaatatcaagtctctggaggacgtcgttcgggcatacctgaagatggctgaggaaaagacggaagcggccaaagaggaatcacagcagatggtcttagatatcgaagatttagacaacattcaaactcctgagagcgtgttgctgagtgctgtgagtggggaagatactcaagacagaacggatagactgctgctcactccatgggtcaagtttctgtgggaaagttaccgacagtgcctggacttgctgcgcaacaactcgcgggtggaacgcctgtaccatgacatcgcccagcaggcttttaagttttgtctgcagtataccaggaaggctgagttcagaaaactgtgtgataacctgagaatgcacttatcacagatccaacggcaccataaccaaagtacagcaatcaatctgaataatccagagagtcaatcgatgcacctcgagactagattggtacagcttgatagtgctatttcaatggagctgtggcaggaggcatttaaggccgtcgaggatatacatggccttttttcactcagcaaaaaaccacctaagccacaattaatggccaactactacaacaaggtgtctactgttttttggaaatccggaaacgccctctttcacgctagcacactgcaccgactctatcatttgtcccgagagatgcgcaagaacttgacccaggacgaaatgcagagaatgagcacaagagtgctgctggctacactaagtattcctatcacacccgagcgcactgatattgccagacttttggacatggatgggatcattgtggaaaaacaacgaagactcgccaccctccttgggctccaggccccaccgactcgcatcggcctaataaatgacatggtgagatttaacgtcctgcagtacgtggtccccgaggtgaaggatctatataattggctcgaggtggagttcaacccactgaagctttgtgagcgagtgactaaggtcctcaattgggtgagagagcagcccgagaaggaacccgagctgcagcagtatgtgccccagctgcaaaacaatacaattctcagacttctacaacaggtcagccagatctaccaatccatcgaattcagccgtctcacctcactggtgccattcgtcgatgcttttcagctggagcgcgcaatagtggatgctgcgagacattgcgaccttcaggtaagaattgaccatactagcagaacactgagcttcggctctgatttgaattatgccaccagagaggatgcaccaatcggaccacatttgcagagcatgccctcagagcagattagaaaccagcttactgcgatgtccagcgtgctcgccaaggcattagaggtgatcaaacccgcccatattctacaggagaaagaggagcagcaccagttagcggtaaccgcttatttaaaaaactcaagaaaagaacatcagaggatcctcgccagacgacagaccatagaagagcgcaaagaaaggttggagagcctcaacatacagagagagaaggaggagctcgagcagcgtgaagctgaactgcagaaggtgaggaaggccgaggaggaaagactccggcaagaggccaaggagcgcgagaaagagcgaatccttcaggaacacgagcagatcaagaagaagactgtgagggaacggttagagcaaattaaaaagacagaacttggtgctaaagctttcaaagatattgacatcgaagacttggaggaactcgacccggactttatcatggccaagcaggtggaacaacttgagaaggagaaaaaggagctgcaggaacgcctgaaaaaccaggaaaaaaaaattgattattttgagcgggcaaaaaggttggaagagatacctctgattaaatcagcctatgaagagcaaaggatcaaggacatggatctttgggaacagcaagaagaggagaggatcacaactatgcagcttgaacgtgagaaggcactggaacacaagaatcgcatgtctaggatgctggaagaccgagaccttttcgtcatgaggctgaaagcggcgcggcaatccgtttatgaggagaaactgaaacagttcgaagaacgtctggctgaggagaggcacaatcggctcgaggagcggaagcgtcagagaaaagaggagcggcgcattacttattatagagagaaggaagaggaagaacagagaagggcagaggagcagatgttgaaggaaagagaagagagagagcgtgcagaacgggcaaagagggaagaggaactccgagagtaccaagaacgagtcaagaaactggaagaggtggaaagaaaaaagcgccaaagagagctggagattgaagaaagagagcggcgacgcgaggaagaacggcgactcggagactccagcctgtcaaggaaggacagtcggtggggcgatcgtgattctgaagggacttggcgcaagggcccagaagccgactcagaatggaggcgtggtccacctgaaaaggaatggcggcggggggagggaagagatgaagatcggtcacaccggagagatgaggagcggcccagacgcctaggagacgatgaagaccgcgaaccctctcttcggccagacgatgatcgggttccgcgtaggggaatggacgacgacagaggcccgcggcggggcccagaagaagaccgattttctcgacggggggcggatgatgatcggccgagctggaggaatacagacgacgatcgacccccccggagaattgcagacgaagatcgcggtaattggcggcatgccgatgatgatcgtcctccccgcaggggactagatgaagatcgaggctcttggaggaccgcagatgaggaccgcggccctagacgcgggatggatgacgatagaggaccgcgcagggggggggcagatgacgagcgctcctcctggcgcaatgcagatgatgatagaggtcctcggagaggtctcgatgacgataggggcccccggcgtgggatggacgacgaccgggggccccggcggggtatggacgatgatcggggtccacggaggggaatggacgatgaccggggacctagacgaggactcgacgacgatcgaggcccttggaggaatgccgatgatgataggatcccccgtcgaggtgccgaagacgaccgaggaccttggaggaatatggacgacgacagactctctcgaagggccgatgacgacagattcccacgccggggagacgattcacggcccggcccctggagaccactagttaaacccggcggctggcgggagaaagagaaggcccgcgaggagagttggggccctccccgcgagtctcgtccttccgaagagagggagtgggacagagaaaaggaaagggacagagataaccaggatcgcgaggagaatgataaggaccccgaaagggagagggacagggagcgagatgtagaccgtgaggatcgcttccgcagaccaagggacgaaggaggctggcgcaggggacccgccgaagagagctcttcttggagggattcgagccgtagggatgatagggacagagatgatcggcgaagagagcgcgacgacagacgggacctcagggagcggcgggacctgagggacgatcgtgatcgaagagggccacccctacggtccgaacgcgaggaggtgagctcctggcggcgcgccgacgatcgaaaagacgatcgggtagaggagagagaccctccaaggagagtcccaccaccagcgttgtcccgtgatagggagcgggatagggaccgggagagagaaggggagaaggagaaggcttcttggcgagccgagaaagaccgggagtctctgcggagaactaagaatgagactgacgaggatggctggactaccgtgcgccgatag

SEQ ID NO: 187088 - DNA, 2619 bp, Artificial Sequence
  Description of Artificial Sequence: Synthetic coding sequence
atgcaggacgccgagaacgtggccgtgcccgaggccgccgaggagcgggctgagcccggccagcagcagccagcggccgaaccacccccagcagaagggttgctcaggcccgctggccccggcgcgccagaagcagcagggaccgaagcttcaagtgaagaggtgggaatcgctgaggccgggccagaatctgaagttcgaactgaacctgcagctgaagctgaggccgctagtggcccttctgaatcaccttcgcccccagcagcggaagagctgcccggaagtcatgccgagcccccagtcccagctcaaggggaggctccaggtgagcaagccagagacgaacgttctgattcccgagctcaagctgtgtcagaagacgccggcggcaatgagggccgggctgccgaagccgagccacgcgctctggaaaacggggacgcagacgagcccagctttagcgatcctgaagatttcgtagacgacgtctccgaagaggagttgttaggtgacgtccttaaggaccggccacaggaggccgatggcatcgactcagtaatagtggtcgataatgtccctcaagtcggacctgaccggctggagaagctcaagaacgtgattcacaagattttctcgaagttcggaaagattacaaatgatttttaccctgaggaagatggcaagacaaaggggtatatttttctggagtatgcctcacctgcccatgctgtagacgctgtaaagaacgccgacggctacaagcttgataaacagcacacctttcgggtcaatctgtttactgatttcgacaagtacatgaccatcagcgacgaatgggatatacctgaaaagcaaccttttaaggatcttggcaacctgcggtactggttggaggaggccgagtgccgagaccaatatagcgtgatatttgagagcggcgataggacaagcattttctggaacgatgtgaaggaccccgtgtccattgaggaacgggcccgttggactgagacatacgtgcgctggtcccccaagggaacatatctagccacgtttcaccagagggggatcgccctatggggaggggagaaattcaagcagatccagcggttctcacaccaaggcgtgcagttgattgattttagtccatgcgaacggtatcttgtaaccttttcaccactgatggacacccaggacgaccctcaggccataattatctgggatattctaactggtcacaagaagaggggtttccactgcgaatcgagtgctcactggcccatcttcaaatggtcgcacgatggcaaattttttgcacgcatgaccctggacaccctcagcatttacgagaccccaagcatggggctgctggataagaagagcctcaagatcagcggaataaaggacttcagctggtcacccgggggcaatataattgccttttgggtccccgaggacaaggatatccctgcaagggtaactctgatgcagctccctactcgacaagaaatacgtgtgagaaacctatttaacgtcgtggactgtaagctgcattggcagaagaacggtgattacctctgcgttaaggtggatagaacacctaaaggaacccagggcgtagtgacaaactttgaaatcttcaggatgagagagaaacaagtgcctgtcgacgtggtggaaatgaaagaaaccatcattgccttcgcttgggagcccaacgggtcaaaattcgccgttttgcacggggaggcgccacgaatttcagtaagcttctatcatgtgaagaataatggtaaaattgaacttatcaaaatgttcgacaaacagcaggccaacacaattttctggagtcctcaaggccaattcgtggtactggctggcctacggtctatgaacggcgcgcttgcatttgtcgacacgagcgattgcacagtcatgaacattgccgaacactacatggctagcgacgtggagtgggatccaacagggcgttacgtggtgacaagcgtgtcctggtggagtcataaagtcgataatgcttattggctatggactttccaaggcagattactccagaaaaataacaaggaccggttctgccagctgttgtggcgccctcgccctcctacgctgctctcacaggagcagatcaagcagatcaagaaggacctgaaaaagtattctaaaatcttcgagcaaaaagatcgtctgagtcagagtaaggcctctaaagagttggtcgagaggcgaagaactatgatggaagattttaggaaatatcgtaaaatggcacaggagctgtacatggaacaaaagaacgaacgcttggagctgcgaggtggcgtggacacagatgagctcgattctaacgtagacgactgggaggaggagacaattgagttcttcgtcacagaggagatcattcctggaatcagaagtgatcttgaacactgtgcacagccatgcgttctctggagtcggggacgaccagctgggagccgcgttacccctgcctcatccctctgctctctagccctagactgtgactgcgcttggatcttgcctctacggcacatcttcgttcctttctccccttggtgcttgcagtggggaatctag

SEQ ID NO: 187089 - DNA, 2445 bp, Artificial Sequence
  Description of Artificial Sequence: Synthetic coding sequence
atgcaggacgccgagaacgtggccgtgcccgaggccgccgaggagcgagccgagcccggacagcagcagccagctgctgagcctccgcccgcggagggactgctccgacccgccggccctggggcccctgaagcagcgggtaccgaggcttcttccgaggaagtgggaatcgccgaggctggaccggagtctgaagtgcgaacggaacccgctgccgaggcagaagccgctagtgggccctctgagtcacctagcccacccgccgcagaagagctgcccggatcacacgcagaaccaccggtcccagcccagggggaggctccaggggagcaggcacgcgacgaacgctcagatagtcgagctcaggctgttagtgaggacgcgggtggcaatgaaggaagagccgccgaggctgagccccgcgcattagaaaacggtgatgctgacgaaccttcctttagcgatcctgaggatttcgtggacgacgtcagtgaagaagagttgctgggcgatgtcctgaaggaccgccctcaggaggctgacggcatagactccgtcatcgtggttgacaatgttccacaagtgggacccgaccgcctggaaaagcttaagaatgtgatccacaagatcttctcaaagttcggaaagattactaacgatttttatccggaggaggacggtaaaacaaagggatatatatttcttgaatatgcttcgcccgcccacgctgtggacgccgtaaagaacgctgacgggtacaaattagacaagcagcacactttcagagtcaatctcttcacagatttcgacaaatatatgaccatatccgacgaatgggatatcccagagaagcaaccgttcaaggacctgggaaatctgaggtattggctggaggaggccgagtgtcgtgaccagtactccgttatattcgagtcaggggaccgcacctctatcttctggaacgatgtgaaagaccctgtgtccatagaagagcgagcaaggtggactgagacatatgttcgctggtctcccaaagggacttacctcgccactttccatcaaagaggaatagcactttggggcggggagaagtttaaacagattcaacggttctcacaccaaggcgtgcaacttattgacttcagcccatgtgagcgctatctggtgacattcagccctcttatggacacacaggacgacccacaggcgataatcatttgggacatcctgaccggccacaaaaaacgcggattccactgcgaatcttcagcacattggccaattttcaagtggtcgcatgacggcaagttcttcgcgcgaatgactctggacacattgagcatctatgagacgcccagtatgggcctccttgacaaaaaaagtcttaaaatcagcggcataaaagatttttcttggagtcctggtggaaacattattgctttctgggtccctgaggacaaggacatcccagctcgcgtgacactgatgcaactaccgactaggcaagaaatacgtgtccgaaatctgttcaacgttgtagactgcaagctgcattggcagaagaatggagactatctgtgtgtgaaggtggacagaacacccaaggggactcagggagtggtcactaacttcgagatcttcagaatgagagagaagcaggttcctgtggacgtcgttgagatgaaggagaccattatcgctttcgcctgggaaccaaacggcagcaaattcgcagtcctgcacggcgaggcgcctcgaatcagcgtctctttctatcatgtgaagaataacggcaagatcgagcttatcaaaatgtttgataagcagcaagccaatacaatcttctggtccccacagggacagtttgtcgttctagctggtctgcgaagcatgaatggagccctggcattcgtggatacaagcgattgcaccgtcatgaatattgcagaacactacatggccagcgatgtggaatgggacccgaccggtcgatatgtggtaacgtccgtaagctggtggagtcacaaagttgataacgcgtactggctgtggacctttcaggggcgtctcctccagaaaaacaacaaggatcgcttctgtcagcttctctggcgccctaggccgccaacgctccttagccaagaacagattaagcagattaaaaaggatctgaaaaaatatagcaaaatcttcgaacaaaaggataggttaagccagtcgaaggccagcaaggaactggtggagaggcgcaggacgatgatggaggacttccgcaagtacaggaagatggcacaggaactttatatggagcagaagaatgaaaggctcgagctccgaggtggagtagacaccgacgaactggacagcaatgtggatgactgggaggaggagacaatagaattctttgtgaccgaggaaatcattcccctgggcaaccaggagtag

SEQ ID NO: 187090 - DNA, 2445 bp, Artificial Sequence
  Description of Artificial Sequence: Synthetic coding sequence
atgcaggacgccgagaacgtggccgtgcccgaggccgccgaggagagggcagaacccggacagcagcagcccgccgccgagcccccacccgccgaaggtctgctaagacctgccgggcctggagccccagaggcagctgggactgaagcatccagcgaagaggtgggcattgccgaagccgggcctgagtccgaggtgcgaactgagccagcagccgaagcagaagcagcttctggccctagcgagagcccttctcctccagccgctgaggagctccccgggtctcacgcggaaccacctgtgcctgcacagggggaggctccgggagagcaggcccgcgacgagcggagcgattccagggcccaagccgtgtccgaggatgccggagggaacgaagggagagccgccgaagcagaaccgcgcgctctcgagaatggcgacgctgacgaacctagtttctctgaccccgaagatttcgtggacgatgtgagcgaagaggagctcctcggggatgttcttaaggacaggccccaggaggccgatggaatcgactccgtcatcgttgttgacaacgtgccacaggtcggacccgacagactggagaagctgaagaatgtcatccacaaaatctttagtaaattcggcaagattaccaatgatttttaccctgaggaggacggcaagactaaggggtatatttttttagagtatgcctcgccagctcatgcagttgatgccgtgaagaacgctgatggatacaagctagacaagcagcacacctttcgggtcaacctgttcaccgactttgacaaatacatgacgatctcagacgagtgggatatcccagaaaagcagccctttaaggacctggggaacctccggtattggctggaggaggcggagtgcagggaccagtacagcgtgatatttgagtctggcgatcggacctccatcttctggaacgacgtgaaggaccctgtgagcattgaggaaagagctcgttggaccgaaacatatgttcgttggtcccccaagggaacttacttggctaccttccatcagagaggcatcgcactgtggggaggcgaaaagtttaagcagattcagcgattttcccaccagggcgtacagcttatagatttcagtccatgtgagcgatatctggtcaccttcagcccgcttatggatactcaggatgacccccaggccataattatctgggacatcttgaccggccataaaaaacggggctttcactgcgagtcaagcgcgcactggcctatatttaaatggagtcatgacgggaagttttttgcacggatgactttagatacgctgagcatctacgagacgccatcgatggggctgctggataaaaaaagcctgaagattagtgggataaaggacttcagctggtcccctggaggcaatattattgccttctgggtgcctgaagataaggacatcccagctagagtaacccttatgcaactgccaacaaggcaggaaatcagagtcagaaacctgttcaacgttgtggactgtaagttgcattggcagaaaaacggagactacctctgcgtgaaagtcgatcggaccccaaaaggtacacagggtgtggtcaccaattttgagatctttagaatgagggagaaacaggtcccagtcgacgtggtagagatgaaggaaacgatcatcgccttcgcctgggagcccaacgggagcaagtttgcagtactgcatggagaggcaccccgaatctccgtttctttttaccatgtgaagaacaatggcaaaattgagctcatcaaaatgtttgataagcagcaagctaacaccattttttggagcccacagggccagttcgtcgtgcttgcaggccttagaagcatgaatggcgcccttgcttttgttgatactagcgactgcactgtcatgaatatcgccgagcactatatggcttccgatgtggagtgggatcccaccggccggtatgtggttacgtctgtcagctggtggtcccataaggtggacaatgcatactggctgtggaccttccagggtagattgctgcagaagaacaataaggaccgtttctgtcagttgctctggaggcctcgtccccccactttgctgtcccaagagcagatcaaacagatcaaaaaagacttaaagaagtactctaaaatctttgaacaaaaggatcgactttcccagtcaaaagcctctaaagaactcgtcgagcggcgaaggaccatgatggaggactttcggaagtatcgaaagatggctcaggaactctatatggaacagaaaaatgagcgtctggagcttcgaggcggtgttgataccgacgaacttgactcgaacgtggatgattgggaggaagagacgatcgaatttttcgtcacagaggaaatcatccccctgggaaaccaggagtag

SEQ ID NO: 187091 - DNA, 2217 bp, Artificial Sequence
  Description of Artificial Sequence: Synthetic coding sequence
atgcaggacgccgagaacgtggccgtgcccgaggccgccgaggagagagcaggtagtcatgccgaaccacccgttccggcgcagggagaggccccaggagaacaggcgagggatgaacggtctgatagtcgtgcccaggcagtgtctgaggacgccggtgggaatgagggcagggctgccgaagcggagccacgcgccctagagaacggcgacgccgacgagccaagcttctcagacccggaggattttgtagatgacgtttctgaggaggagttgctcggcgacgtcctgaaagacaggccccaggaggccgatggcatcgacagtgttattgttgtagacaacgtgccccaggtgggcccagatcggctcgagaaactcaaaaacgtgattcataagattttcagtaagttcggaaagattacaaatgacttttacccagaggaagacgggaaaacaaaaggctacatcttcctggagtacgcctccccggcccatgcagtcgacgcagtgaagaatgccgatggttacaagctcgacaaacagcatactttccgggtcaatctatttaccgatttcgacaagtatatgactataagcgacgagtgggatattccagaaaagcaaccctttaaggacctggggaatctgcggtattggttggaggaggcagagtgtcgagatcaatactccgtaatctttgagagcggagatcgaacgtcaatcttttggaacgacgtgaaagaccctgtttcaatcgaggaaagagcccgctggacagaaacgtatgttcggtggtctcccaaaggtacctatctcgcaacttttcaccagcgaggcatcgcactatggggaggcgagaagttcaagcagatacagaggttttctcatcaaggggtccagttaatagacttttccccttgcgagcgctacctcgttaccttcagccccttgatggatacacaggatgacccccaggccattataatctgggatatcctgaccggacataaaaaaagaggcttccactgtgagagcagtgcccattggcctatctttaagtggtcacatgatggtaagttctttgctcgaatgactctggacaccctcagtatctatgaaaccccctccatgggcctcctcgataaaaaaagcctgaagatctcaggaatcaaggattttagttggtccccagggggcaatatcatagcgttctgggtccctgaagacaaagacatcccagccagggtgacactcatgcagctgcctactcggcaggaaatcagggttcgaaatttgttcaacgttgtagactgtaaactgcattggcagaaaaatggggactatctgtgtgttaaggtggaccggacgccgaaaggtacgcagggcgttgtaacaaacttcgagatatttcggatgcgcgaaaagcaagtccccgtggacgtcgttgagatgaaagaaactatcattgcatttgcctgggagccaaatgggtcaaaattcgcagtgttgcacggggaggccccacgcatatccgtgagcttctaccacgtgaaaaacaacgggaagattgagctgattaagatgtttgacaagcaacaggccaataccattttctggtctcctcagggacaattcgtcgtcttagccggtctgagatctatgaatggtgccctggccttcgttgacacgtccgattgcaccgtcatgaatatagctgaacactatatggcgagcgatgtcgaatgggaccccactggccggtatgtggtgaccagtgtctcttggtggtcccataaggtcgataacgcctactggctgtggacattccagggacgactgctgcagaagaacaacaaggatcgcttctgtcagctgctctggagaccacgacccccgaccctgcttagccaggaacagataaagcagatcaaaaaggacctcaaaaaatactctaagatttttgagcagaaggaccggctgtcccagagcaaagcgagtaaagagctggtggagaggcggagaacaatgatggaagatttccgaaagtaccgaaaaatggctcaggagttgtacatggaacagaagaatgagcgcctggagctgcgaggtggagtggacaccgatgaactggattcaaacgttgacgactgggaggaggagacgatcgagttcttcgtgaccgaagagattattcctctcggcaatcaagaatag

SEQ ID NO: 187092 - DNA, 2742 bp, Artificial Sequence
  Description of Artificial Sequence: Synthetic coding sequence
atgagccggttcttcaccaccggcagcgacagcgagagcgagagctccctgagcggggaggaactcgtgacaaagccggtgggcgggaattatggtaagcaacctctgttgttatctgaggacgaagaggacacaaaacgcgtggtccgctccgcaaaggacaagcgttttgaggaactgaccaatctgataagaactattcgtaacgctatgaaaattcgcgatgtgactaagtgcctcgaggaattcgagctactggggaaggcctacggtaaggctaagagcatcgttgataaggagggagtcccaaggttttatattcgcattctcgccgaccttgaggactatctcaatgaactttgggaggataaggagggaaagaagaaaatgaataaaaataacgccaaagccctttccaccctcaggcaaaagattcgtaaatataatcgcgactttgagagtcatatcacgagttataagcagaatcccgagcagtctgcagacgaggacgccgagaaaaacgaggaggacagcgagggcagctcagacgaggacgaggatgaagatggagtcagcgccgctactttccttaaaaagaagtctgaggcgccttccggcgagtcccggaagttcctaaaaaagatggacgatgaggacgaagatagtgaagactctgaggatgatgaggactgggacaccgggtcaacgtccagcgattctgactccgaggaagaagaggggaagcagacagcactagctagtcggtttttgaagaaggctcccaccacagatgaagataagaaggccgccgagaagaagcgggaggataaggcaaagaagaaacatgatagaaagagcaagcgcctggacgaggaagaggaggacaatgagggcggagaatgggagagggtgcgggggggtgtgcccctggtaaaagaaaagcccaaaatgtttgctaagggcactgaaatcactcatgcagtggtcatcaaaaagctgaatgaaattttacaagcccggggaaagaagggtactgaccgggcagcccagattgaattattacagctccttgtccagattgctgccgaaaataatttgggcgagggcgtaatagttaagattaagtttaatattattgcctccctttacgattacaatcccaatttggctacctatatgaaacctgagatgtgggggaaatgtctcgactgtatcaatgagcttatggacatactatttgctaacccaaatattttcgtcggcgaaaacatcctggaagagtctgagaatcttcacaacgcagaccagccactgcgggtgcgcggctgcatacttacactcgttgagagaatggatgaggaattcacaaaaataatgcagaatacggacccccactcacaggaatatgtagaacacctgaaagatgaagcccaggtctgtgctattattgaaagggtccagcggtacctggaagagaaagggaccactgaagaagtttgcaggatatacctcctgcgtatcctacatacatattacaagttcgactataaggcgcaccagcggcagctgacccctccagaaggtagctctaaatctgagcaggatcaggctgagaacgagggagaggacagcgctgtacttatggaacgtctctgcaaatacatctacgcaaaggatcggaccgatagaataaggacatgtgccatcctttgtcatatttatcaccacgcccttcatagccgctggtatcaggctcgagacctgatgctaatgtcacacttacaagacaatatccagcacgccgatcctcccgtccagattctgtacaataggacgatggttcagcttggcatatgcgcttttcggcagggtctaacaaaggacgcccacaacgcattgttggacatacagtctagtggcagagccaaggaactgctggggcaaggactcctcctgcgctccctgcaagagaggaaccaagaacaggagaaggtagaaagaaggcgccaggtgcctttccatttacacatcaacctcgagctcctggagtgcgtatatcttgtgtcagctatgctgcttgaaattccgtatatggccgcgcacgaaagcgacgccagacgtcgaatgatcagcaagcagttccatcaccagcttagggtgggggagaggcaaccccttcttggcccaccggagagcatgcgggagcatgtcgtcgcagcctctaaggcaatgaagatgggcgactggaagacttgtcattccttcattatcaatgagaaaatgaacggaaaagtctgggatttgttccctgaagccgacaaggtaagaacaatgttagtgcggaaaattcaggaagagtcactccggacctatctgttcacgtactcgtctgtgtacgactctatcagtatggagacattatcagatatgtttgagttggacctgcctacggtgcatagcatcataagtaagatgattatcaacgaagagctgatggcgtccctcgatcaaccaacccaaacggtggtaatgcataggaccgaacctactgcacagcagaatctcgcgctgcaacttgctgagaagctggggagcctggtcgagaacaacgagcgggtctttgaccacaaacagggcacatacgggggatacttcagggaccagaaggacggataccgaaaaaacgagggatatatgaggagagggggttaccggcagcagcagtcacagaccgcatattag

SEQ ID NO: 187093 - DNA, 2286 bp, Artificial Sequence
  Description of Artificial Sequence: Synthetic coding sequence
atgagccggttcttcaccaccggcagcgacagcgagagcgagagcagcctgagtggtgaagagttagtcacgaaaccagttggtggaaactatggaaaacaacctcttctgctttccgaagatgaggaagatacaaaacgggtcgtcagatccgccaaagacaagaggtttgaggaattgactaatctcattcgaactatccggaatgcaatgaagatacgggatgttaccaaatgtctcgaggagttcgagctgctgggtaaggcgtacgggaaggcgaagagtatcgttgataaagagggagtgccccggttttacatacgtatcctcgcggatttggaggactacttgaacgaactgtgggaagacaaagagggaaagaaaaagcacgatcgtaagagtaaaagactggatgaggaagaggaggataacgagggaggggagtgggagcgcgtcagaggcggcgtcccactcgtgaaggaaaagcccaagatgttcgcaaaaggcaccgaaattacccacgccgtcgtcatcaaaaaattgaatgagattctccaggcgcgggggaagaaaggaaccgacagagcagcacagatagagctcctgcagcttctcgtgcaaatcgccgccgagaataacttgggggagggagtgattgtgaagattaagtttaacattatcgccagcctttacgattacaaccccaacctggcaacttacatgaagcctgaaatgtggggaaagtgcctcgattgtatcaatgaactaatggatatattatttgctaaccccaatatttttgtgggagaaaatattctcgaggaatccgaaaatctgcacaacgccgaccagccactgagagttagagggtgcatcctaacactggtagaacgcatggatgaggaattcacaaaaattatgcaaaacactgatcctcactctcaagaatatgtggagcatctgaaagatgaggcccaggtgtgcgctattatcgaaagggttcagagatacttagaggagaaagggaccaccgaggaggtttgccggatttaccttctgcggatcctgcatacatactataaattcgactataaagcccaccagcgccagctgacaccccccgagggaagctcaaaatccgagcaggaccaagctgagaatgaaggagaggactcagcagtcctgatggagcgtctctgtaaatacatttatgcgaaggatagaaccgatcgaatacgcacctgcgctatcctctgtcatatatatcaccacgcccttcattctaggtggtaccaggctcgcgacctcatgctgatgtcccatctgcaggacaacattcaacacgctgatccgcctgtgcaaatcctctataatcgaaccatggtccagctgggcatttgcgcatttagacagggccttaccaaggacgctcataatgctctgctggatatacagtcctctgggagagccaaggaactgttaggtcaaggactgctgctgagaagtctccaggagagaaaccaggaacaggaaaaggtggaaagacggcggcaggtgcccttccacctccatataaatcttgagttgttggagtgcgtctaccttgtgagtgcgatgttactcgagatcccctacatggcagcacacgaatctgatgctagaagacgcatgatcagtaagcagttccatcatcagcttcgagtaggggaacggcagcctcttctgggacctcctgaaagcatgagggaacatgtagtggccgccagtaaagccatgaagatgggggactggaagacttgtcactcctttataattaacgaaaagatgaacggcaaggtttgggacttgtttccagaagcagacaaagtgcggactatgctggtcaggaagatccaagaagagagtctcaggacctatttgtttacatacagcagcgtgtacgactccattagcatggagactctgtctgacatgtttgaactagatctccctaccgtccactcaattataagcaaaatgattatcaatgaggagctgatggcttctctggatcagcccacgcagaccgtggtcatgcatagaacagaaccaaccgctcagcagaatctggcactccagctggctgaaaaacttggatctctggtggagaacaacgaacgagttttcgatcacaagcagggaacctacggggggtattttagagaccaaaaggacgggtaccgtaagaacgaaggatacatgcgcaggggtggttacagacagcagcagtcccagacagcctattag

SEQ ID NO: 187094 - DNA, 2742 bp, Artificial Sequence
  Description of Artificial Sequence: Synthetic coding sequence
atgagccggttcttcaccaccggcagcgacagcgagagcgagagcagtctaagtggcgaggaactcgtgaccaagcctgtaggggggaattacgggaagcagcctttacttctctcagaagacgaggaggacaccaagcgtgtggtgcgttctgcaaaggacaagaggtttgaggaactgacgaatctgattcgaactatacgtaacgctatgaagatccgcgacgtaaccaagtgcctcgaggaatttgagcttttgggtaaagcctatggcaaagcaaagtcaattgtcgataaggaaggagtgccacgcttctacattagaattcttgctgatctcgaagactacttaaatgaactctgggaagataaggaggggaaaaaaaagatgaataagaacaacgcaaaagccctgagcacgctccgtcagaagatccgtaaatataacagagatttcgaatcccatatcacctcttacaagcagaaccctgagcagtccgccgatgaggacgccgaaaagaatgaagaagacagtgaggggagctccgatgaggatgaagacgaggatggtgtatccgcagcaacgtttctgaaaaagaaaagcgaggctccatccggagaatccagaaaatttcttaaaaagatggatgacgaagacgaagacagcgaggacagtgaggatgatgaggattgggatactgggtccacctcttcagattccgattccgaagaggaggaaggaaaacaaaccgccctcgcttccagattcctgaaaaaagcacctacaacggatgaggacaaaaaggctgcagaaaagaagagggaagacaaagcgaagaaaaagcatgaccggaaatctaaaaggctcgacgaggaagaagaagataacgagggcggcgaatgggaaagagtgagaggtggggtaccccttgtgaaagaaaagcctaagatgtttgccaaaggaaccgaaatcacacacgccgtggtaatcaagaaactcaacgagatcctacaggctcgtggaaagaagggtaccgatcgcgcagcgcagatcgaactgctacaacttctggtgcaaatcgccgccgaaaataatttaggtgagggggtcatcgtgaaaatcaaattcaacataatcgcttcattgtatgattataaccccaaccttgccacatacatgaagccagagatgtggggcaagtgtttggattgcatcaacgagttaatggatatcctgttcgcaaatccaaatatctttgtcggcgagaacatcctggaggaaagcgaaaatctgcacaatgccgaccaacccctgcgggtacgcggttgtatcttgacactggttgagcgaatggacgaggagttcacgaagattatgcagaatacagatccccattcacaagaatatgtggaacacttaaaggacgaagcccaggtatgcgcaataatcgagagggttcaacggtacctcgaagagaagggtactactgaagaggtctgcagaatttatttactgaggatactacacacgtattacaagttcgactacaaggctcaccagcgacaattgaccccaccggaggggtcatctaagtcagaacaggatcaggcggagaatgagggcgaagacagtgcagtactgatggagcggctatgtaagtacatttacgccaaggaccggaccgataggatcagaacttgcgctattttgtgccacatttaccatcatgctcttcactcacgatggtatcaggcacgcgacctgatgctaatgtctcacctccaggacaacatccagcacgccgatccgcctgttcagattctctataatcggacgatggtgcaactgggtatctgcgccttccgacagggacttaccaaagacgcgcacaacgcccttctcgatattcaatccagcggtagagccaaggaattgctcggccagggcttactgcttcggtccctacaagagcgtaaccaggagcaggagaaggtggaacggcggcgtcaggtaccattccacctgcacatcaaccttgagctcctagagtgcgtgtatctggtctctgcaatgctcctggagattccatacatggcagcccatgaatcagacgcgaggcgccgtatgatttctaagcagttccaccatcaactgcgcgtgggggagaggcaaccgctgctcggcccgccagagtccatgcgagagcatgtggttgctgctagtaaagccatgaaaatgggcgactggaagacctgccattcctttatcataaatgagaaaatgaacggtaaggtctgggacctgtttcccgaagcggataaagtgagaacaatgctggttcgtaaaatccaggaagagtcacttagaacctaccttttcacatactcttcggtatacgactcaatttccatggagactttgtctgacatgtttgaactagatctccccacagtgcactccattattagcaagatgatcataaacgaggaacttatggctagcttggaccagccaactcagactgtagtgatgcatagaacagagcctaccgcccagcagaacctggccctccagctggcggaaaaattggggtctttagtggagaacaatgagagagtctttgatcacaaacaggggacttacggtggctattttcgggaccagaaggacgggtatcgtaaaaacgaagggtacatgcgaagaggtggatacagacagcagcagagccagaccgcctactag

SEQ ID NO: 187095 - DNA, 2208 bp, Artificial Sequence
  Description of Artificial Sequence: Synthetic coding sequence
atgagccggttcttcaccaccggcagcgacagcgagagcgagagctccctctccggcgaagagctggttaccaagccagtaggcggaaattacggcaagcaaccacttctactgtctgaggatgaggaagatacgaaacgcgttgtgcgaagtgctaaggacaagcgttttgaagagctgactaatctgatcagaaccatccggaacgcgatgaaaataagagacgtaacaaagtgcctggaagagttcgagttgcttggaaaggcatatgggaaggccaagagcatcgtggacaaggctaagaagaagcacgatcgcaaatccaaaaggctggatgaagaggaagaagataatgaaggaggcgaatgggagagggtgaggggcggggtgcctcttgtgaaagaaaagcccaagatgttcgcaaaaggtaccgaaattacccacgccgtggtgatcaaaaaactcaacgaaattcttcaggctagaggtaaaaaaggtaccgatcgggcggctcaaattgagcttctgcagcttctggtgcagattgctgccgagaacaatctgggagagggggtgatcgtgaaaattaaatttaatatcatcgccagcttatatgattacaatcccaatttagccacttacatgaagccagagatgtggggcaagtgcctggattgtattaacgagctcatggatatcctttttgctaacccgaacatctttgtgggtgagaacatattggaagagagcgaaaatctccacaacgccgaccagccgttgagggttcgcgggtgtatcctgacccttgtggaaagaatggacgaagaattcacaaaaatcatgcagaatacagacccccattcacaggagtatgtggagcatctgaaagatgaagctcaagtttgcgccattatcgagcgcgtgcaaaggtatctggaggaaaagggcaccaccgaggaggtgtgtaggatctacctgctgcgaattctgcacacctactacaagtttgattataaggcccatcagcggcagctgactccaccagaagggagcagcaaaagcgagcaggatcaggccgaaaatgaaggggaggactccgccgtgttaatggagaggttgtgcaagtatatttacgcaaaggacaggaccgaccggatcaggacctgtgctatcttatgccatatttatcatcatgccctccacagccgctggtatcaagccagagacctgatgctgatgagtcacttgcaggacaacattcaacatgcggatcctcccgtccaaatactttataacaggacgatggtccaacttggaatctgcgctttccgccaggggctcacaaaagatgcccacaatgccctgttggatatacagtcctccggacgcgctaaggagctgctcgggcagggtctcttgttgcgctccctgcaggaaaggaaccaggagcaggagaaggtggagcggcgccggcaggtgcccttccatttacatatcaacttagagttattggagtgcgtctacttggtgtctgctatgctgctggagatcccctacatggcagcacacgaatctgatgcacgccggcgcatgatcagtaaacagtttcaccatcaactcagggtcggagagcgacagcctttattgggaccacccgaatccatgagggagcacgtagtggcagcttctaaggcaatgaaaatgggcgattggaagacatgccattccttcattatcaatgagaaaatgaacggtaaggtgtgggacctcttccccgaggcagataaggtgaggaccatgcttgtcagaaaaattcaagaagagtcactgaggacatatctatttacgtattcgagcgtctacgatagcatctctatggagacgctctctgatatgtttgagctggatcttcccacggttcatagcatcatctccaagatgattatcaacgaggagctgatggcttctctggaccagcccacacagaccgtcgtgatgcatcgtacggagcccacagcacaacagaatctggcactacaactagcggaaaaactgggatccctagtagagaacaacgagagagtatttgaccacaagcaagggacatatggaggctattttagggatcagaaagacgggtatagaaagaatgagggctatatgcgccgagggggataccgccaacagcagagtcagactgcgtattag

SEQ ID NO: 187096 - DNA, 2697 bp, Artificial Sequence
  Description of Artificial Sequence: Synthetic coding sequence
atgagccggttcttcaccaccggcagcgacagcgagagcgagagctcactgtccggagaggaattagtaactaaaccagtgggcggaaactatgggaaacagcctttgctcttatcagaggacgaggaggacaccaagcgggtggtgcggagcgctaaagataagcgcttcgaagagctcaccaacctgataaggacaatcaggaacgctatgaagatccgggatgtgaccaaatgcctcgaggagtttgagctcttgggcaaggcgtacggcaaggccaaatccattgtggacaaagaaggagtccccaggttctacattcggattcttgctgacctggaggattatttgaacgaactctgggaggataaagaaggaaagaaaaagattcggaaatataaccgggactttgaatctcatattacctcgtacaagcaaaaccccgagcaatcggccgacgaggacgccgaaaaaaacgaagaagactcagaaggatcttctgatgaagacgaggacgaggatggcgtatctgccgctacattcctaaaaaaaaagagcgaggctccaagcggggaatctcgtaagttcttaaagaagatggacgatgaggatgaggatagcgaggatagtgaggatgacgaggactgggacaccggttcaacaagctcagattcagactctgaagaggaagagggcaaacagacagcccttgcgagccgattcctcaagaaggctcccaccaccgatgaggataaaaaagcagctgagaagaaaagagaagacaaggcaaagaagaagcatgatcggaagagcaagcgtttagacgaggaggaagaagataacgaagggggggaatgggaaagagtacgcggaggtgtcccactcgtcaaggagaagcctaaaatgttcgccaaaggaaccgagattacacacgccgtcgtgattaagaagctcaacgagattcttcaggcccgggggaagaaaggcaccgatcgcgcggcacagatcgaactactccagctgctggtgcaaatcgcagccgaaaataacctcggcgaaggagttatcgtgaagataaaattcaatattatagccagtctctacgactataacccaaatttggcaacgtacatgaaaccggaaatgtgggggaaatgtctggattgtattaacgaattgatggacatcctgttcgccaacccgaatatatttgtcggagagaacatactggaagaatctgagaaccttcacaatgcagatcaaccattacgagtacggggctgcatcttgaccctggtcgaacggatggatgaagagttcacaaaaattatgcaaaatacagatcctcactctcaggagtatgtcgagcacctcaaggacgaggcccaagtctgtgcaatcatagagagggtccagaggtatttggaggaaaagggaacaacagaggaggtttgccggatctacttgctgagaattctccacacttattacaaattcgactacaaagcccatcaacgccagttgacccccccagaggggtcctccaagagcgagcaggaccaagcagagaatgagggagaggactccgccgtgctaatggagagactgtgcaaatacatttacgctaaggatagaaccgacagaatacgaacctgtgctatactgtgccacatctaccatcacgccttgcattctagatggtaccaagccagagacctgatgctgatgagccacctacaggataatattcagcacgccgaccccccagtacagatcctatataatcggacaatggtgcaattgggtatttgtgcctttcggcaggggcttaccaaggatgcccataacgccttactcgacattcagtcctcgggtcgggcaaaggagctgctcggccaagggttgcttctcaggtcattgcaggagcgcaatcaggaacaggagaaggtggagcggcgcagacaggtgcccttccacctacacatcaatctcgagctgctggaatgtgtgtacctggtgtccgccatgctgttggaaataccatatatggctgcacacgaaagcgatgcaaggcggcgaatgatatctaagcaatttcaccatcagctccgagtaggggagcggcaacctctactgggacctcctgagtccatgagagagcacgtggtcgcagcctctaaggctatgaagatgggagactggaagacatgccacagtttcatcatcaatgagaaaatgaacggcaaggtatgggacttgttccctgaagctgacaaggtgcggactatgttggtacggaagattcaggaagaaagtcttcgaacttacctgttcacgtacagttccgtatacgatagtatctctatggagacgctctctgatatgttcgagctggacttaccaaccgtccactcaattatttctaagatgataataaacgaagagctgatggcctctctggatcaacccacacagacagtggttatgcatcggaccgagcccacggcacagcagaaccttgctttacaactcgcagagaagctggggtccctggtggaaaataacgagcgcgtatttgatcataagcaggggacttacgggggttattttcgggaccagaaagatggctacagaaaaaatgaggggtacatgaggcggggaggataccgccaacagcagagccagaccgcttactag

SEQ ID NO: 187097 - DNA, 2055 bp, Artificial Sequence
  Description of Artificial Sequence: Synthetic coding sequence
atgggcctgagcgccgccgcccccctgtggggcccccccggcctgctcctcgctatagctctccaccctgccctcagtgtaccaccacggagggactattgcgtactgggagccggtcccgcgggcctccagatggcttattttctacaaagagccggccgggattacgctgtttttgagcgagcaccgagaccaggctctttcttcaccaggtatcccagacacagaaaattgatcagcatcaataaaaggtataccggcaaagcaaacgccgaatttaacctcaggcacgactggaacagcttactgagccatgacccccgcctcctttttaggcattattccagagcgtacttcccagacgcacgggacatggtacgctacctgggtgatttcgcggatactctgggcctcagggtgcaatacaataccaccatagcccacgtcacactggataaggaccgtcaagcctggaacggacattacttcatccttacagaccagaaagggcaggtccatcaatgttccgtgctgttcgtggcaacgggactgtccgtcccaaatcaggtcgattttcccggctccgagtatgcggaaggatacgagagtgtaagcgttgatcctgaggatttcgtgggtcagaacgtgcttattcttggacgcggaaattccgcctttgaaacagccgagaacatcctgggcgtgacgaattttatccacatgctatctagaagccgcgtccgattgtcgtgggcaactcactacgtaggcgatcttagagcaattaataacggccttctggacacctaccagctgaagtctttggacggtcttcttgaatccgacctgaccgacctggcaatcctcaaggattctaaaggcaaatttcatgtgacgcctaaatttttcctggaggaggccaatacaaaccagtctgcagattctattacactgcctcaggacgacaatgacaacttcgccatgagggtgccatacgaccgggtgatccgctgcctgggctggaatttcgatttttctatcttcaataaaagcctccgccttaactcgggcaatgcctttggaaagaagtatccactgattagagcatcctacgagtccaagggcagtcgtggactgttcatcttgggcacggcaagtcactcggtagactacaggaagagtgctggaggatttatccacggctttaggtacacagtgagggcagtccacaggctattagaacacagacatcacagcgtcacctggccggcaacagaactcccaataacccagctgacgtcctctattgttagacgggtcaatgaggctagcggcctgtatcagatgtttggagtgctcgcggacgtcatcctgctgaaagaaaactctaccgcattcgaatacctggaggagtttcccatccagatgctggcccagctcgaaaccctcaccggaagaaaagctaaacacggtctatttgtcattaatatggagtatggacgcaatttctccggacctgacaaggacgtctttttcgacgaccgcagtgtcggtcatacagaagacgcgtggcagagtaatttcctccaccctgtgatctactactaccgatatctcccaaccgaacaagaagtacggttccggcccgcccattggccacttcctcgacctacagccatccatcatattgtagaggacttcctgacagattggaccgcgcctataggccacatcctgccccttcggagatttctggagaactgcctggacaccgaccttaggtccttctacgccgaaagctgtttcctctttgccctcacacggcaaaaattaccccctttctgccagcagggatacctcaggatgcagggcttggtatcgaccgagagcctgtggcaacatcgcgtagagtcaaggcttctcagggactacgcccccactggacgacgactcgaggacagcagccagcaactaggggaccaggaaccattgggcagtcctctggccccaggccccctcgcccagagtgtagactccaacaaagaagagttgtag

SEQ ID NO: 187098 - DNA, 1602 bp, Artificial Sequence
  Description of Artificial Sequence: Synthetic coding sequence
atggccaagttcatgacccccgtgatccaggacaaccccagcggctggggtccctgcgcagtaccagagcagttcagggatatgccttaccaaccctttagtaagggcgataggctgggcaaggtggcagattggacaggtgccacttatcaggacaagagatacaccaacaaatatagctctcagtttggcggcggttctcagtacgcctattttcatgaggaagacgaaagttccttccagttggtggatacagctcggacgcaaaagacagcctatcagagaaaccgaatgaggtttgcccagcgaaacttgcgtagagacaaagaccggagaaatatgctgcagtttaacttacaaatcctgccaaagtctgccaagcagaaggaacgcgagcgcatcaggctccaaaaatcgcaaaagcctcgcgatagttctgtggaagtgcggtcagactgggaagtgaaggaggagatggacttccctcaactgatgaaaatgagatacctagaagtcagtgagcctcaggacatcgaatgttgcggcgccctggaatattacgacaaagcatttgatcgcatcacaacccgtagcgagaagcccttacgctcaataaagcgcatcttccatacggtgacgacaaccgacgatcccgtcatcagaaagctggccaaaacccaggggaatgttttcgccaccgacgcaatattggcaactttgatgtcctgtacacgcagcgtctattcctgggatattgttgtacagagagtcggatctaagcttttcttcgacaagagggataactctgatttcgatctgctcactgtctctgagactgcaaacgagcctccccaggacgaaggtaacagctttaactccccgcgaaacttagccatggaagctacctacatcaaccacaacttctctcagcagtgcctgcgaatggggaaggaaagatacaacttcccaaaccctaatccgtttgttgaggatgatatggataaaaacgagatcgcctctgtagcttatcgatatcggcggtggaaactgggtgacgacatcgatcttatcgtacgatgtgagcatgacggcgtgatgaccggagccaacggcgaagtaagcttcattaacatcaagacactgaatgaatgggactctcgacattgcaatggggttgattggcggcagaaattagactctcaaagaggcgccgtgattgccacggagttgaaaaataacagttataagctggctcgctggacttgttgtgctttgctggccggttcagagtatctcaagctcggttatgtttcaaggtaccacgtgaaggactcatccagacatgtgatactgggcacacagcagttcaagcccaacgaatttgcctcccagatcaacttgtccgtggagaatgcgtggggaatcctgagatgcgtgatagacatctgtatgaaactcgaagagggcaagtacctgatattgaaagacccaaataagcaggtcatacgcgtctacagcctgccggatgggaccttctcttctgatgaggacgaggaggaagaagaagaggaggaggaagaggaggaggaggaagagacttag

SEQ ID NO: 187099 - DNA, 372 bp, Artificial Sequence
  Description of Artificial Sequence: Synthetic coding sequence
atggccaagttcatgacccccgtgatccaggacaaccccagcggctggggaccctgtgccgtgccagagcagttcagggacatgccctaccagcctttctctaagggcgacagactgggaaaggtggccgactggacaggcgctacttatcaggataagcgctatactaacaaatatagctcacaatttggtggaggctcgcagtatgcttactttcacgaggaagacgagtcaagcttccaactggtggacactgcccgaactcagaagaccgcatatcaacggaacagaatgaggtttgcccagcgaaatctcagacgtgataaggataggcgcaatatgttgcagtttaatcttcagatactgccctag

SEQ ID NO: 187100 - DNA, 1647 bp, Artificial Sequence
  Description of Artificial Sequence: Synthetic coding sequence
atggccaagttcatgacccccgtgatccaggacaaccccagcggctgggggccctgcgccgtgccagagcaattccgcgacatgccatatcaacccttcagcaagggggatcgactggggaaggtcgctgactggaccggtgctacataccaggataagcggtataccaacaagtactcctcccagttcggtgggggcagtcagtatgcctactttcacgaggaagacgaaagctcctttcagctcgtggatactgctagaacacagaagacagcataccagcggaaccggatgagattcgcacaaagaaacttgcggagagacaaggaccgacggaatatgcttcagtttaatctgcagatactgcctaagagcgccaaacagaaggaacgcgagcgcatacgcctgcagaaaaagttccagaagcagttcggcgtgcgccagaagtgggaccagaaatcacagaagcctcgcgattcctcagtggaggtgagatccgattgggaagtcaaagaagagatggacttcccacagctgatgaagatgagatatctggaagtgagcgaaccccaagatattgaatgctgtggtgccctcgaatactacgataaagcctttgatcggattacaacaagatccgaaaaaccactgagaagtatcaaacgcattttccacactgtgacgaccactgatgatcccgtcatacggaagcttgcaaagactcagggcaatgttttcgccaccgacgcaattctggcaacattaatgagttgcacccgatctgtctacagttgggacattgtggtacagagggttggaagtaaactattctttgacaagcgagataacagtgacttcgacctgttgaccgtttccgagacggctaatgagcctccacaggatgagggcaattccttcaatagtccgagaaacctggccatggaggccacttacatcaatcacaattttagccagcagtgtctgagaatggggaaagaaaggtataactttccaaatcctaaccctttcgtggaagacgatatggacaagaatgagatagccagcgtggcataccgttaccgtaggtggaaactcggcgatgacatcgacctgatagttcgatgtgagcatgacggggtgatgacgggtgccaatggagaggtgtctttcatcaatataaagacattgaacgagtgggattctcgacattgtaacggcgtggattggcggcagaaattggactcacaaaggggggccgtgatcgctaccgaactcaagaacaattcatataagttagctcgatggacctgttgcgctctgctggccgggtcagagtacctgaagttggggtacgtgtcacgttaccatgtgaaggattcgtcaaggcacgtgattctgggaacccagcaatttaagcctaatgaatttgcaagccagataaacttaagcgtagagaacgcctgggggatcctacgatgcgtgattgatatctgtatgaaactggaggagggtaagtacctgattctgaaagacccaaataagcaggtgatcagggtatattcactaccagatgggacttttagttcagacgaggacgaggaagaggaggaagaggaggaggaggaagaagaagaggaagaaacatag

SEQ ID NO: 187101 - DNA, 519 bp, Artificial Sequence
  Description of Artificial Sequence: Synthetic coding sequence
atggacaagaacgagatcgccagcgtggcctaccggtaccggcggtggaaactcggggacgacattgatctgattgtgagatgcgagcatgacggggtgatgaccggtgcaaacggcgaagtgagctttattaatattaaaaccctgaacgaatgggatagtagacactgtaacggcgtggactggaggcagaaactggactcccagcggggagctgtgatcgcgaccgagcttaaaaacaactcctacaagctggccagatggacttgctgtgcgctgctggcagggtcagagtacctcaaactcggttacgtctcacgataccatgttaaggactcttctcggcatgtaattctgggtacacaacagttcaagccaaacgaatttgcttctcagatcaatctgagtgtggagaatgcatgggggatccttcgctgtgtcattgatatctgtatgaagctggaggaagggaagtatctgattttgaaagatcccaataaacaagtcatccgcgtgtag

SEQ ID NO: 187102 - DNA, 561 bp, Artificial Sequence
  Description of Artificial Sequence: Synthetic coding sequence
atggccaagttcatgacccccgtgatccaggacaaccccagcggctggggcccttgtgcggtgcctgaacagttccgagatatgccttatcaaccattttctaagggcgaccgcctcggaaaggtagctgattggactggagccacctaccaggacaagcggtacacaaacaaatactcatctcagttcggaggtggatcccaatatgcttacttccatgaagaggatgaaagcagctttcagttagtggatacagctagaactcaaaaaaccgcatatcaaagaaaccggatgcggttcgcccagcggaatcttcgacgggacaaggataggcgaaatatgctacagtttaatctacaaatacttcctaagtccgctaagcagaaggaaagagagcggatacggctgcagaaaaagtttcaaaaacagttcggggtgaggcagaagtgggatcagaaatcacaggtgatgtatttgtatcagaatagcgccttggaattcgggtctgtgtacctggtggtcttcattaactcactggacgaaatctacttcacttactag

SEQ ID NO: 187103 - DNA, 810 bp, Artificial Sequence
  Description of Artificial Sequence: Synthetic coding sequence
atggccaagttcatgacccccgtgatccaggacaaccccagcggctggggcccttgcgccgtgccagagcagttccgggacatgccctaccagccattttctaaaggagatagactggggaaggtggcagattggaccggggcaacatatcaagacaaaaggtataccaataagtatagtagtcaatttggaggcgggtcacagtatgcttacttccatgaggaggacgaaagttccttccagttggtcgacactgcccgcacgcagaaaacggcttaccagagaaatcgcatgcgttttgcacagaggaacctgagacgggataaggatcggcggaatatgctccagttcaatttgcagattctgccaaagtctgcaaaacaaaaggaacgggaaaggattaggctgcaaaagaaattccaaaagcaattcggtgtgaggcagaagtgggaccaaaaaagccagaagccaagggattcctctgtcgaagtgcgctctgattgggaagttaaagaggagatggatttcccccagcttatgaaaatgcgctatctagaggtgagcgaaccacaggacatagaatgctgcggagccttggaatactacgataaggcatttgatcggataactacaagatccgagaaaccgctgcggagcattaagcgcatcttccacactgtcactacaacagacgatccagtaatccgcaagctggctaagactcagggcaatgtgtttgcgacagacgcaatactcgctacactgatgtcatgcacccggtccgtgtactcatgggatatcgtagtctag

SEQ ID NO: 187104 - DNA, 522 bp, Artificial Sequence
  Description of Artificial Sequence: Synthetic coding sequence
atggccaagttcatgacccccgtgatccaggacaaccccagcggctggggcccttgcgctgtccccgaacagtttcgagacatgccttatcaacctttctctaaaggggaccgtctgggcaaagtggctgactggacaggcgccacctaccaggacaaacgatacacgaacaaatactctagtcaattcggggggggatcccagtacgcctattttcacgaggaagacgaaagtagctttcagctggtggatacagctagaacccagaaaaccgcttatcagcgaaacagaatgagattcgctcagagaaatctgcgtagagacaaagaccggcgaaacatgttacaatttaatctgcagattttgcccaaatctgctaagcagaaagaacgagaaagaatcagactccaaaaaaaattccagaaacaattcggggtgcgacagaaatgggatcagaaatcacagaaaccccgcgattcttccgtggaggtgagatctgactgggaggtgaaggaggaatag

SEQ ID NO: 187105 - DNA, 498 bp, Artificial Sequence
  Description of Artificial Sequence: Synthetic coding sequence
atggaggccacctacatcaaccacaacttcagccagcagtgcctgaggatggggaaagaaagatacaacttcccaaatcctaatcctttcgtggaggatgatatggacaaaaatgaaatcgcttctgtggcttacagatacagacggtggaaattgggagacgacattgaccttatcgttaggtgtgaacatgacggagttatgactggcgcgaatggcgaagtgtcctttattaatataaaaactctgaatgagtgggacagtcggcattgcaatggcgtcgattggaggcagaaacttgacagtcaacgcggagccgtgattgctacagagctcaaaaacaattcctataagctggcaagatggacttgttgtgcactacttgccggtagcgagtacctgaagttgggctacgtgtcccgatatcacgttaaagatagctctaggcatgttatcctgggcacccagcagttcaagcctaatgaatttgcatcgtag

SEQ ID NO: 187106 - DNA, 1500 bp, Artificial Sequence
  Description of Artificial Sequence: Synthetic coding sequence
atggccaagttcatgacccccgtgatccaggacaaccccagcggctgggggccgtgcgctgttccagagcaatttcgggacatgccatatcaacccttctctaagggggatagattgggaaaagttgctgactggactggagcaacgtaccaggacaaaagaaaccttcggcgggacaaggacaggagaaacatgttgcagtttaatctccagatcctgccaaaatcagcgaaacaaaaggaacgtgagcgaataaggctccaaaagaagttccaaaagcagttcggcgtacggcaaaaatgggatcaaaaatctcagaaaccaagggattcctctgtcgaggtgcgatcggactgggaggtgaaagaagagatggacttcccacagctgatgaaaatgcggtatttagaggttagcgaacctcaggatatcgaatgctgtggcgccctagaatactacgacaaggccttcgaccgaatcaccacccgctcggaaaagccactccggagcataaagaggatatttcacactgtgacaacgactgatgatcctgtcatcaggaagttggctaagactcaggggaatgtattcgcaacagacgcgatcctggcgactctgatgtcgtgcacaagatccgtgtactcttgggacattgtagtccagcgggtgggctccaaactcttcttcgacaaaagagacaactctgattttgatctgctgaccgtgagcgagacagccaatgagcccccacaggatgaaggaaactcgtttaattctccaagaaacctagcaatggaagctacgtacatcaaccacaacttttctcagcagtgtttacgcatgggcaaagaacgatacaacttcccaaatccgaatccctttgttgaggacgacatggacaagaacgaaattgcaagcgtggcatacaggtatcgccgctggaaacttggcgatgacatcgacctcatcgtcagatgtgagcatgatggggtgatgacaggagccaatggagaagtgtccttcatcaacatcaagacactcaatgaatgggatagtcggcattgcaatggagtggactggcgacagaagttagatagccagcggggcgcagtgatcgccactgaattgaaaaataatagttacaaactggcaagatggacatgttgtgcattactggccggatcagagtacctgaaactgggttacgtgagccgatatcatgtgaaggactcctccagacacgtgatattgggcacacagcagtttaagcctaatgaatttgctagccagattaatctttctgtcgaaaatgcctgggggatcctgaggtgcgttatcgatatttgtatgaagctcgaagaaggtaaatatctgatactgaaagaccccaataagcaggtcattcgggtatattccttgccagacggaactttcagctcagacgaggacgaggaggaagaggaggaggaggaggaggaagaggaagaagaagagacttag

SEQ ID NO: 187107 - DNA, 1215 bp, Artificial Sequence
  Description of Artificial Sequence: Synthetic coding sequence
atgttcaccgagaagaccaccacctaccagtacccccgggccatcctatctgttgatctctctggcgagaacctgagcgacgtagatttcctggatgacagctccacagagtctttgctgttgtctggggacgagtacaaccaggatttcgactccacaaacttcgaagaaagccaagacgaggacgatgcactgaacgaaatcgtgaggtgtatctgcgaaatggacgaggaaaacggttttatgattcaatgtgaagagtgtctgtgctggcagcacagcgtctgcatggggttgttggaggaatctatcccagagcagtacatttgttacatctgtagagaccctcctggccagaggtggagtgctaagtatcgctatgacaaggagtggctgaataatgggagaatgtgtggcctcagcttttttaaagagaactacagtcatctcaacgctaagaaaatcgtcagtacccaccatctgttggccgatgtgtacggcgtcacagaggtactgcatggactgcagctgaagataggcattctgaagaacaagcatcacccagatctgcatctttgggcttgtagcggcaaaaggaaggatcaggaccagattattgcaggagtggagaaaaagatcgcccaggacaccgtgaacagagaagaaaagaaatacgttcagaaccataaggagccacctagattacccctgaaaatggaaggtacttacatcacgtctgagcattcttatcaaaagcctcagtcttttggacaagactgtaaatctctggctgaccccggttcaagtgatgatgatgatgtgtcgtctctggaagaagaacaggagttccatatgcggagtaagaactccttgcagtacagcgcaaaggaacacggcatgccagagaagaatccggccgaagggaatacggtgtttgtctacaatgataagaaggggacggaggaccctggagacagtcaccttcagtggcagctgaatttactgacccacatcgagaacgtccagaacgaagtgacatctcggatggatttgatagaaaaagaggtcgatgtgttggaatcttggctcgactttactggcgaactggaacctccagaccctctggcgaggctcccgcagttgaagaggcacatcaagcagttactgatcgacatgggcaaagtgcagcagatcgccactctctgttctgtgtag

SEQ ID NO: 187108 - DNA, 1074 bp, Artificial Sequence
  Description of Artificial Sequence: Synthetic coding sequence
atggccacccccgccgtgcccgtgagcgccccccccgccacccccactcccgtgcccgccgcggcccctgcttcagttcctgctccgacccccgcccccgccgctgctcctgtgcctgccgctgcccccgcttcatcttcagacccagccgccgccgcagcagccactgcagcccccgggcagacaccagcttctgctcaggctcctgcccaaactcccgcccccgccttgcctggcccagctcttcctggaccattccctggtggccgcgtggtgcgcttgcatcccgtgattcttgcgagcatagtcgattcctacgaacgaaggaacgaaggtgccgctcgcgtaatcggcacattgctgggcaccgtggataagcactctgttgaagtgaccaattgtttctcagtgccccacaatgagtcggaggacgaggtggcagtggatatggagtttgccaaaaatatgtatgaactccacaagaaggtgagcccaaacgagcttattctgggttggtacgccactgggcatgacatcactgagcatagcgtgctgattcacgagtactatagcagagaggcccccaatcctatacacctgaccgtcgacaccagcctccagaacggacgcatgtcgatcaaggcttacgtcagtaccctgatgggagtacccgggcggacaatgggcgtaatgtttacaccactgaccgtgaagtacgcctactacgacacagaaaggatcggggtcgatttgatcatgaaaacctgcttctcccctaaccgtgtgataggtctgtcctcagacttgcagcaggtggggggcgcctcagctagaatacaggatgctctcagcaccgtgttgcagtatgcagaagacgtcttgagcggaaaggtgagtgccgacaatactgtgggacgatttctcatgagtctcgtgaaccaggtacccaagatcgtgcccgatgattttgagactatgcttaactccaatatcaacgacttactaatggtgacctatttggcgaatctaacacagagccagatcgctcttaatgagaagcttgtgaacctctag

SEQ ID NO: 187109 - DNA, 627 bp, Artificial Sequence
  Description of Artificial Sequence: Synthetic coding sequence
atggagttcgccaagaacatgtacgagctgcacaagaaggtgagcccgaatgagttaatcctcggctggtacgcaacaggccatgacataactgagcattcagtcctgatacacgaatattattcccgcgaggcacctaaccccattcatcttactgtcgacacatccctgcagaacggccgcatgtccataaaggcttatgtcagcaccctgatgggggtgcccggccggacgatgggtgtaatgttcacccccctgactgtaaaatatgcttactacgataccgagagaatcggggtggacttgattatgaagacatgtttctctcctaacagggttatagggctgagcagtgacctgcagcaggtggggggcgcatccgctcgcattcaggacgcgctttcaacggtgctgcagtatgctgaagacgtccttagcggtaaagtgtccgcggacaatacggtgggcagattcctcatgtctctggtgaatcaggtaccaaagattgttcccgatgatttcgaaacgatgctgaactccaacatcaacgacctactgatggtgacttaccttgcaaacctgactcagagtcagattgccttgaatgaaaagctggtgaatctatag

SEQ ID NO: 187110 - DNA, 1074 bp, Artificial Sequence
  Description of Artificial Sequence: Synthetic coding sequence
atggccacccccgccgtgcccgtgagcgccccccccgccacccccactcctgtgccagccgctgctcccgctagcgtgccggcgccaacacccgccccagccgcagcaccggtgcctgcagccgcgcctgcttccagcagtgatcccgctgctgccgctgccgctacagctgcacccgggcagacacccgcatccgctcaagctccagcgcagacgcccgctcccgcgctgccgggccctgccctccctggccctttcccaggcggaagagtagtccgtctgcaccctgtgatcttggccagtatcgtagactcttacgagcggcgcaacgagggtgcagccagggttataggcactctgcttgggacagtggacaaacacagcgtcgaagtaaccaactgcttttccgtgcctcataatgaatctgaagatgaggtggccgtggatatggaattcgctaaaaacatgtacgaactccacaagaaagtatccccgaatgagcttattttgggatggtatgctacaggacacgacattacagaacattctgtccttatacatgaatattattctcgcgaagcaccgaatccaattcacctcacagtggataccagtctgcagaacggccggatgtccatcaaggcctacgtgagcactctgatgggagtgcccggccgaacaatgggtgtaatgtttaccccactgactgtgaagtatgcttattatgacaccgaacgtatcggagttgacctgattatgaaaacatgcttctctcctaaccgggtcattggcttgagtagcgatcttcaacaggtaggtggtgcatctgcacgcattcaggatgcattgagcaccgtgctccagtacgcagaagatgtgctgtctgggaaagtaagtgcggataataccgtcgggagatttctgatgtccttggtcaatcaggtaccaaaaattgtaccagacgattttgaaacaatgttaaattcaaatatcaatgacctgctgatggtaacatacctggccaacctgacccagagccagatcgcactcaacgaaaaactcgtgaatctctag

SEQ ID NO: 187111 - DNA, 1119 bp, Artificial Sequence
  Description of Artificial Sequence: Synthetic coding sequence
atgaacgccgtgatcagcgccagcgccagcttcttcctggacaagatggccacacctgcggtgcccgtgtctgctccacctgccactccaactcctgtacctgccgccgccccagcatctgtacccgccccaaccccagcacctgctgcggcccctgttccagctgccgcgcctgccagctcaagcgaccccgcagccgccgctgctgccacagcagctcctggacagactccggccagtgcgcaggcccccgctcagaccccagcccctgctctaccgggccctgcactccctggaccattcccaggtggccgagtggttcgtcttcatcccgtcatcctcgcaagcatcgttgattcgtatgaaagaaggaatgaaggcgctgccagggttattgggacactgcttgggactgtcgataagcactctgtcgaagtgacgaactgttttagtgtgcctcataacgagtcagaggatgaggtagcagtggacatggaattcgccaaaaacatgtacgagctgcataagaaggtatcccctaatgaactgatcctcgggtggtatgcgacaggccacgatataaccgagcactccgtgctcatacacgaatattactcaagagaggctcctaaccctattcacctcacagtggataccagtcttcagaacgggcgaatgtcgatcaaagcgtacgtgtccacgttgatgggtgtgccaggacggaccatgggtgttatgttcacacccctgactgtgaagtatgcctactacgatactgaaaggattggcgtggacctcatcatgaagacgtgcttttcccccaatagggtgattggcctgtcttctgacctgcaacaggtgggaggggcaagcgctcgcatccaagacgcactctctacagtgctccagtatgcggaggatgtgctgtccggaaaggtctccgctgacaacactgtcgggcgttttttgatgagcttggtgaatcaagtccccaagattgtccccgacgatttcgaaactatgctgaattctaatataaatgatctgctgatggtcacatatctggcaaatctgacacagtcacagattgctctgaacgagaagttagtcaacctgtag

SEQ ID NO: 187112 - DNA, 924 bp, Artificial Sequence
  Description of Artificial Sequence: Synthetic coding sequence
atggccacccccgccgtgcccgtgagcgccccccccgccacccccacccccgtgcctgccgcagctcccgcaccagcattaccaggaccagcactgcccgggcccttcccggggggacgcgtagtgagattacaccctgttatactcgcgagcattgtcgactcatacgaacggagaaatgaaggcgcggccagagtgatcgggaccctactgggcacagttgataaacacagcgttgaagtaacaaattgtttttctgtgccgcacaacgaatcagaggatgaagtcgcagttgacatggaattcgcaaagaatatgtacgagttgcataaaaaggtgtcccccaacgagttgattctgggctggtacgccactgggcacgacatcacagagcattctgtacttatacatgagtactatagccgggaggctccgaatcccatacacctgaccgtcgataccagcctgcagaatgggcggatgagcatcaaagcctacgtctcgaccctaatgggcgtgcccggaaggaccatgggggtgatgttcacacccctaactgtcaagtacgcttactatgacacggagagaattggcgtcgacttaattatgaagacttgctttagcccaaatagagtcatcggcctgtccagtgatctgcagcaagtcggcggagcctcggctaggatccaggacgcccttagtacggtacttcagtacgcggaggatgttctgagcggtaaggtatcagccgacaatacagtggggcgatttctcatgtctttagtaaatcaggttcccaaaattgttcccgacgacttcgagactatgttaaacagcaatatcaatgacctgctcatggtaacctatctcgctaatctgacccagtcccagatcgcattgaatgaaaagctggtcaatctctag

SEQ ID NO: 187113 - DNA, 963 bp, Artificial Sequence
  Description of Artificial Sequence: Synthetic coding sequence
atgcccaccggcgacttcgacagcaagcccagctgggccgaccaggtggaggaggagggtgaggacgataagtgcgtgaccagcgaactactgaaaggcatcccattagcaaccggcgataccagcccagaaccggagctcctgccaggcgcgccactgccgcctccgaaggaggtgatcaacggaaatatcaagaccgtgaccgaatacaaaatcgatgaagatggcaagaagttcaagatcgtgaggactttcaggattgagacacgtaaagcatccaaagctgtagcgcgccgtaagaattggaagaagtttggaaattctgagtttgatcctccgggacctaatgtagcaacaacgacggtaagcgatgacgtgtctatgacattcataactagcaaagaggatctgaactgccaggaggaggaggatcccatgaacaagttgaagggccagaagatcgtgtcatgccgaatctgcaaaggagatcactggactacccggtgcccttataaagacacccttggaccgatgcaaaaggaattggcagaacaactcggcctgtccaccggcgagaaggaaaagttacccggtgaactagaacccgtgcaggcgactcagaataagaccggaaagtacgttcctccctccttgcgcgatggtgcctcaaggcggggggagagtatgcagccaaaccgaagggcggatgataatgccactatcagagtcaccaacctctcagaagatacccgagagaccgacctgcaagaactcttccgaccctttggatccattagtcgaatttacctggctaaggataaaactaccggccagagcaaagggtttgcctttatctctttccacaggcgtgaggatgcagcaagagcaatcgccggagtttctggattcggatatgatcatctcatactcaacgtggaatgggccaagccttcaaccaactag

SEQ ID NO: 187114 - DNA, 1101 bp, Artificial Sequence
  Description of Artificial Sequence: Synthetic coding sequence
atgtacagccggcacgcccagcggatcccccccggcaagaagatggctagtcgtaaggagggtaccggttctaccgctaccagttcttcgtctaccgccggcgcagcgggtaaaggtaaaggtaaaggaggctccggcgacagtgcagtgaaacaagttcagatcgacgggcttgttgtgctgaagatcatcaaacattaccaggaagagggacagggaaccgaagttgtgcagggggtgttgttagggcttgtggtcgaagaccggctcgagataacaaattgtttccctttcccacagcacaccgaggatgacgctgattttgatgaggtacagtaccaaatggagatgatgcgatcgctccggcatgttaacattgaccatctgcatgtgggatggtatcaaagcacttactatggaagcttcgtaacccgagccctgctggatagccaattttcttatcagcatgccatcgaagaatctgttgtgctgatatacgaccccatcaagactgcccaaggctctctttctctgaaggcctatcggctcacccccaaactcatggaagtctgcaaggagaaggatttctctccagaagctctgaaaaaggccaatatcacatttgagtatatgtttgaggaagtgcctatagttattaagaattcccatttgattaatgttctgatgtgggaactcgaaaaaaaaagcgcggttgctgacaagcacgagctactgtccctggcctctagtaatcacctcgggaagaacctgcagttgttgatggacagagtggacgagatgagccaggatatcgtcaagtacaacacctacatgaggaatacctcaaaacagcaacaacagaagcatcagtaccagcaacgtcgacagcaggaaaatatgcagagacagtcccgaggtgagcctccgctgccggaagaggacttaagtaagctgttcaagccaccgcaaccccctgcaagaatggattctcttctgatagccgggcagataaatacttattgccagaacatcaaagagtttacagcccagaatcttgggaagctgtttatggcccaggctctgcaagagtataataactag

SEQ ID NO: 187115 - DNA, 1059 bp, Artificial Sequence
  Description of Artificial Sequence: Synthetic coding sequence
atggccagccggaaggagggcaccggcagcaccgccaccagcagcagcagcaccgcaggtgcggcagggaaaggaaaaggtaagggaggttccggcgatagcgccgtcaaacaggtgcagatcgacggccttgtggtcctgaaaataatcaaacattaccaggaggagggccagggcaccgaagtggtccagggggtcctgcttgggctcgtcgtcgaagaccggctggaaatcacaaactgtttccctttcccacagcacacggaagacgacgccgattttgacgaggttcagtatcaaatggagatgatgagatctcttcgtcacgtaaacatcgatcaccttcatgttggctggtatcaatccacatattatgggtcttttgtcacgagagccttattagactctcagttttcataccagcatgcaatagaagaaagcgtggtgctgatttatgatcctataaaaactgctcagggaagtctctccctgaaagcataccgcctaacccctaaattaatggaggtctgcaaggaaaaggatttctctcctgaggccctcaagaaagctaatattacgtttgaatatatgtttgaagaggtgccgatcgtgataaagaattcccatcttatcaacgtgttaatgtgggaactcgagaaaaagagcgcagtcgcggataagcacgaactgctcagcctcgcctcctcaaaccatctggggaaaaatctgcagctcctaatggaccgcgtggacgaaatgtcacaggacattgtgaagtataatacttatatgcggaacacgtccaagcaacagcaacaaaagcatcagtatcagcaacgcagacagcaggagaatatgcaaagacagagtaggggggaacccccgctgccagaggaagacctttctaagttatttaagccaccccagccacccgcgcggatggacagtctcttgatagcggggcagattaatacctattgtcagaacattaaagagtttacagcacagaatttagggaagctgttcatggctcaggccctgcaggaatataataactag

SEQ ID NO: 187116 - DNA, 378 bp, Artificial Sequence
  Description of Artificial Sequence: Synthetic coding sequence
atgaagcccatcctgctgcagggccacgagcggagcatcacccagattaagtacaaccgagagggcgacctgctctttaccgtcgcgaaggaccctatagtcaacgtctggtattctgtaaacggtgaaaggttaggtacatacatggggcacactggcgcagtatggtgtgttgacgctgactgggatacaaagcatgttctgacaggcagcgccgataactcctgccgcctttgggattgcgaaactggcaaacaactggctttgctgaaaacaaacagcgccgttcggacctgtgggttcgactttgggggcaatataattatgttctcaaccgataagcagatgggatatcagtgctttgtgtcgtttttctag

SEQ ID NO: 187117 - DNA, 978 bp, Artificial Sequence
  Description of Artificial Sequence: Synthetic coding sequence
atgaagcccatcctgctgcagggccacgagcggagcatcacccagattaaatacaaccgcgagggagacctcctttttacagtggccaaagaccccatcgtcaacgtgtggtacagcgtgaatggcgaaaggctcgggacatatatgggtcacactggagccgtctggtgtgtggacgcagactgggatacgaaacacgtgctgacagggtcagccgacaacagttgtcggttgtgggactgtgagacagggaaacaactcgcactgctgaaaactaacagcgctgtgcgtacctgcgggttcgactttggcggcaacataattatgttcagcactgacaaacagatggggtatcagtgttttgtgagcttcttcgatctgcgggatccttctcaaattgacaacaacgagccatatatgaaaataccttgtaatgattccaagattacatctgctgtgtggggccctctgggagagtgcattattgctggccacgaaagtggagagttgaatcaatatagcgctaaatcaggcgaggtgctcgtgaacgtcaaagagcactcacggcagattaacgacatacaactgagccgagacatgaccatgttcgtgaccgcctccaaggacaataccgctaaactgtttgacagcactaccctggagcaccagaagaccttccgaaccgaaagacccgtgaattcggcagcattgtctcccaactatgaccatgtcgtcttggggggcggccaggaagccatggacgtcaccaccacctccacacgtatagggaagtttgaagctcgcttttttcacttagcctttgaagaggagttcggacgagtgaagggccatttcggcccgataaatagcgtggcctttcacccagacggcaaaagttatagtagtgggggagaggacgggtacgtccggatccattacttcgaccctcagtactttgaatttgagttcgaggcctag

SEQ ID NO: 187118 - DNA, 777 bp, Artificial Sequence
  Description of Artificial Sequence: Synthetic coding sequence
atggccgccgccgccgccgccgccggcgacagcgacagctgggacgcggatgctttcagtgtagaagacccagtacgtaaagtcggcggtggtggtaccgcagggggagacaggtgggagggagaggatgaagacgaagacgttaaggacaactgggatgatgatgacgacgagaaaaaggaggaggccgaggtcaaacctgaagtgaagattagcgaaaaaaagaagatcgcagaaaagatcaaggaaaaagagcgacaacagaagaagcggcaggaagaaattaaaaaacggctggaggaaccagaagaaccgaaggttcttacacctgaggaacagctcgcagataaactgaggctcaaaaaacttcaagaggaatccgatctggagctggctaaggaaacctttggagtgaacaacgccgtttacgggattgatgcgatgaacccatcctcacgggacgactttaccgagttcgggaagctactgaaggataagataactcaatacgagaaatcgctctactatgcatccttcctggaggtgctggtgcgtgatgtgtgcatctctctggagattgacgacctcaagaagatcacaaattcattgactgtcttatgcagcgaaaagcaaaaacaggaaaagcagtccaaggctaagaagaagaagaagggagtagtccccggcggcggcttgaaagccacgatgaaggacgacctcgccgattatggcggatatgacggcggttatgtgcaggattacgaagatttcatgtag

SEQ ID NO: 187119 - DNA, 657 bp, Artificial Sequence
  Description of Artificial Sequence: Synthetic coding sequence
atggccatgttcgagcagatgcgggccaacgtgggcaagctgctgaaaggcattgatcgatacaatccggaaaatttggctacactggagcgctacgttgaaactcaggccaaagaaaacgcgtatgatttggaggccaacctggccgtgctcaaactctatcagttcaaccccgctttttttcagacaaccgtgactgctcagatcttgttgaaggctttaacaaatctcccacacaccgacttcacactatgtaagtgcatgatagatcaggcccaccaggaggaacggcccatccggcagatcctctatctgggtgatctcctggaaacctgtcacttccaggccttctggcaagccctggatgagaatatggacctcctcgagggcataaccgggttcgaggactccgtgcgaaaatttatctgtcacgtggtgggtattacctaccagcacattgatcgctggctgcttgcagagatgctgggggacctgagcgatagccaactgaaagtttggatgagtaaatacggctggtccgccgacgagtcgggccagatattcatctgctctcaggaggaatccattaagccaaagaacattgtggagaagatcgattttgattcggtaagtagcatcatggctagtagccagtag

SEQ ID NO: 187120 - DNA, 375 bp, Artificial Sequence
  Description of Artificial Sequence: Synthetic coding sequence
atgatcgaccaggcccaccaggaggagcggcccatccggcagatcctgtacctgggtgatctgctggaaacatgccatttccaagcattttggcaagccctggatgagaacatggacctcttggagggaatcacaggctttgaagattccgttcgcaaattcatatgccacgtggttggcatcacatatcagcacattgacaggtggttactggccgagatgcttggcgatctctccgacagtcaacttaaagtgtggatgtcaaagtatggatggtccgccgatgaaagcggtcagattttcatttgctcccaggaggagagcatcaaaccgaagaacatcgtggaaaaaattgacttcgacagcgagtggtag

SEQ ID NO: 187121 - DNA, 636 bp, Artificial Sequence
  Description of Artificial Sequence: Synthetic coding sequence
atggccatgttcgagcagatgcgggccaacgtgggcaagctgctgaagggaatcgaccggtataatcccgaaaacctcgccactcttgaacgatacgtcgagactcaagcgaaagaaaacgcctatgatttagaagccaacctcgcggtgctgaagctttaccaatttaaccccgcgttctttcaaaccaccgtgaccgcacagatcctcctgaaagccctgacaaatctaccgcacactgatttcaccctgtgcaaatgcatgatcgaccaggcccatcaggaagagcgcccgatccgacaaattctgtacctgggtgatcttctggagacatgccactttcaggctttttggcaggcgctagacgagaacatggacctgctggaaggaatcactggtttcgaagacagcgtgaggaagtttatttgtcacgtggtggggattacctatcaacacatcgatcggtggctgctggcagagatgttgggcgacctgtccgactctcagctcaaagtctggatgtctaagtacggctggtccgcagacgagtccggccagatcttcatatgttctcaggaggaatctattaaaccaaagaatattgtggaaaaaatcgactttgattctgaatggtag

SEQ ID NO: 187122 - DNA, 1125 bp, Artificial Sequence
  Description of Artificial Sequence: Synthetic coding sequence
atgagcgtgcccgccttcatcgacatcagcgaggaggaccaggccgccgaactgagagcatacctgaagagtaaaggggcagagatctcagaagagaactcggaggggggcctgcacgtagatctggcccagattatcgaagcatgcgatgtttgcctcaaagaggacgacaaagatgtggaatccgtgatgaattccgtcgtcagcctgctactgatcttagagccggacaagcaggaggccctgattgagtctctgtgtgaaaaactggtgaaatttcgagaaggagagcgaccttcgctgcggctgcagctacttagcaacttatttcatggtatggataaaaatactccagtgaggtacacagtgtattgctcactgatcaaagtcgcagcctcctgtggggccatccagtatatcccgacagaacttgatcaagttcgaaaatggatcagcgattggaatctgaccacagaaaagaaacataccttgctgaggctgttgtacgaagccctggtggattgcaagaaaagcgacgccgcatccaaggttatggtggaattattaggcagctacaccgaggacaatgcgtctcaagctcgggtggacgctcacaggtgcatcgtgagggccctgaaagaccccaacgcctttctgttcgatcacctcctgaccctgaagcctgtgaagttcttggaaggagagttaatccacgatcttttgacaattttcgtttccgccaaactcgcctcttatgtcaaattttaccagaacaacaaggacttcatagacagcctgggactccttcatgagcagaatatggctaagatgaggctcctgacatttatgggcatggcagtggagaacaaagaaatctcatttgatactatgcagcaggagttacagattggtgccgacgatgtggaagcctttgtaattgacgctgttagaacaaagatggtgtattgtaagatcgaccagactcaaaggaaagtggttgtgagtcatagcacccaccggaccttcggaaagcagcagtggcagcagctatacgacactcttaatgcctggaagcagaaccttaataaggtgaaaaattcactcctgagcttgagcgatacctag

SEQ ID NO: 187123 - DNA, 2724 bp, Artificial Sequence
  Description of Artificial Sequence: Synthetic coding sequence
gtggagagcgccatcgccgagggcggcgccagccggttcagcgccagttcagggggcggcggcagcagaggggccccccaacactatcccaagactgctggaaattctgagtttctgggtaaaaccccaggacagaatgcacagaagtggattcccgcccggtctaccagacgcgacgataatagcgccgcaaacaatagcgcaaatgagaaagagcgacacgacgccatctttcggaaagtccgcggcatattaaacaagctgacccctgagaagttcgacaaactgtgcctggaattactcaacgtgggcgtcgaatccaaactgatccttaaaggtgtaatcctgttgattgtcgacaaggcccttgaggagcccaagtactcctccctctacgctcagctatgcctaagactggcagaggatgcccccaactttgacgggcctgctgccgaagggcagcccgggcagaagcaatctacgactttcagacggctgttaatcagcaagttgcaggatgagttcgaaaataggactagaaatgtcgacgtgtacgataagagagagaacccactgctgcccgaggaagaggaacagagggctattgcaaaaatcaagatgttagggaacatcaagttcatcggcgagttgggaaagttggatctgattcacgagagcattttgcacaagtgcattaagactctgcttgaaaagaaaaaaagagtgcagctgaaagatatgggagaggatctggagtgcttgtgccagatcatgcggacagtcggcccacgactggaccatgagcgggctaagtctttgatggaccagtacttcgccagaatgtgctcgctaatgctgagtaaggaactgccggccagaatcagattcctccttcaggacactgtagaacttagggaacatcactgggtcccccgcaaagccttcttggacaacgggccaaaaacaatcaatcaaatcaggcaggacgctgtgaaagacctgggcgtgtttatccccgcacctatggcgcaaggtatgcgaagcgatttttttctggaaggccctttcatgcccccaaggatgaagatggatcgtgatccgctgggtggccttgctgacatgtttggacagatgccaggatccggtatcggaacgggacccggggtgatccaagaccggtttagtcccactatggggcgtcaccggagtaatcaactgttcaacggccacggggggcacatcatgccccctacacagtcccagttcggagagatgggaggtaagtttatgaagtcccaaggcctgtcgcagctctaccataatcagtcacaagggttactgtctcagctacaggggcaatctaaagacatgccaccacgctttagtaagaagggacagttaaacgctgacgagatctcacttcgccctgctcaatctttcttgatgaacaagaatcaggtgcctaagctgcagccacagatcaccatgatacccccatctgcccagcccccccgtactcagacccccccacttgggcagaccccgcaattagggctgaagactaatccacctctgattcaggaaaagcccgccaagacttcaaagaagccccctccatctaaagaagagctactcaagctcacagaaacagttgtcaccgaatacctcaatagtggaaatgcgaacgaggccgtaaacggagttcgtgagatgagggcacctaaacattttttacccgagatgctgagcaaggtgataatactgtctttggacaggagcgacgaagacaaagagaaagcgtcctccctaatctcgttgctcaaacaggaggggatagcaacctcggacaactttatgcaggcctttctgaatgtcttagaccaatgtcccaagctggaagtggacatcccactggtgaagtcttaccttgcacagtttgctgcccgagccatcataagcgaacttgtaagcatctccgaattagcgcagcccttggagagtggcacacacttccccctgttccttttatgtctgcaacagctggcaaagttacaggacagagaatggctcacagagttgtttcaacagtctaaagtgaatatgcagaagatgctgcccgaaatagaccagaacaaagacaggatgctagaaatactcgaggggaaaggcctgtccttcctgtttcccctgctcaagctggagaaggagcttctgaaacaaattaagctcgatccgtccccacaaaccatctacaagtggataaaggacaacatatcaccaaagcttcatgtggacaaagggtttgttaacatccttatgacatcattccttcaatatatcagttccgaggttaacccacctagcgatgaaacagattcctccagcgctccgtccaaggagcaactcgaacaagagaagcagctgttgctttcctttaagccggtgatgcaaaaattcctacacgaccacgttgatctgcaggtcagcgcgctgtacgcactgcaggtgcactgctacaattccaattttccgaagggaatgctgctgcgtttctttgtgcacttttacgatatggagattatcgaggaagaagcgtttcttgcctggaaagaggatataacccaggagttccctggtaaagggaaggcgctttttcaagtcaaccaatggcttacttggttggagactgcagaggaagaagagagcgaggaggaagctgattag

SEQ ID NO: 187124 - DNA, 762 bp, Artificial Sequence
  Description of Artificial Sequence: Synthetic coding sequence
atgcaggccttcctgaacgtgctggaccagtgccccaagctggaggtggatatccctcttgtaaagtcttacctggcgcagttcgcagcgcgggccatcattagtgaacttgtgtccatttctgaactagcacagcctctggagtccggcacacactttcctctgttcttactatgccttcagcagctggccaagctgcaagatagggaatggttaacagagctgttccagcaatcgaaagtcaacatgcagaagatgctccctgagattgaccagaataaagacagaatgctggaaatcctagaggggaaaggcctgtcctttctgtttccgcttctgaagctggaaaaggaattactgaaacaaatcaaactggatccatcgcctcagaccatatacaagtggatcaaagacaacatctcaccaaagttgcacgtcgataagggcttcgtgaatatcttgatgacaagctttttacaatacattagcagtgaggtgaatccccccagcgatgagactgacagctctagcgccccaagtaaggaacaactcgagcaggaaaagcaacttttgttaagttttaaaccggtaatgcagaagttcctgcatgaccacgtggacctacaggtatccgccttgtatgcgttacaggtgcactgttacaactcaaatttccccaagggtatgctgctatttctgtgtacaagtatgacatggaagctgctcaagaaaaaactctcatggctgggtaaaaagatttag

SEQ ID NO: 187125 - DNA, 2610 bp, Artificial Sequence
  Description of Artificial Sequence: Synthetic coding sequence
gtggagagcgccatcgccgagggcggcgccagccggttcagcgccagctcaggtgggggagggagcaggggcgcaccccagcactacccaaaaaccgctggtaacagtgagttcctggggaagactcctggacagaatgcccagaagtggatccccgcaaggagtactcgcagagatgacaactcagccgctaacaattcagcgaatgaaaaagagagacacgacgccatatttagaaaagttcgggggatccttaataagctaacccccgagaagtttgacaaactctgcttggagttgcttaatgtgggtgttgagagcaagctgattctcaagggtgtgatcttattaattgtagataaagctctcgaggaaccgaagtactctagtctttacgcccaactctgcctaagacttgctgaggatgcgcccaatttcgacggccccgccgccgaaggccagcctggccagaaacaatccactacattccgccgcttgcttatctctaagcttcaagacgaattcgagaacaggactaggaatgtggacgtgtatgacaagagagagaatccgctcctgcctgaggaagaggaacagagagccatcgccaaaatcaagatgctcggcaatattaagtttattggagagctagggaagctcgacctcattcacgaaagcattctccataagtgcattaaaacacttctcgagaagaaaaagagagtgcagctgaaggatatgggtgaggatttggaatgcctgtgtcagattatgcgaacagtaggcccccgattagaccatgaacgcgcaaagagcctcatggatcagtactttgccagaatgtgctccctgatgctcagtaaggaactccctgctaggatccgtttcctgctccaggacactgtcgagttgcgggagcatcattgggttcctagaaaagctttcctggacaacggccctaaaaccataaaccagatcagacaggacgcagttaaggatcttggtgtgtttatcccagcgccaatggcccaaggcatgaggtcagacttcttcttagagggtccatttatgccacctaggatgaaaatggatcgggatccattgggtggtctagctgacatgttcggccaaatgccagggagtggaatcggcacaggacccggggtgatccaggataggttttcccctacgatgggccggcaccgaagcaaccagctctttaatggtcatggcggccatattatgccaccaactcagtcgcagttcggagagatgggagggaaatttatgaagtctcaaatctctttgcgtcccgcccagtcattcctgatgaacaaaaaccaagtgcctaagctccagccccaaattaccatgatccccccgtccgcccagcccccacgaacacagacaccacccctgggacagacgccacagctcggattaaaaacaaacccacctctcatccaggagaagcctgcaaaaacttcgaaaaagcctcccccgagcaaagaagagctcttgaagttaacagagacggtggttacagagtatcttaactccggcaatgcgaatgaagccgtgaacggtgttcgcgagatgagagctcccaaacatttcctccctgagatgctgtccaaagtgattatcctctctctggataggtccgatgaggacaaggagaaggcctcatctttgatctccctactgaagcaagagggaatcgccacgtccgacaactttatgcaggcgtttcttaacgttttggaccagtgtccgaaactggaagtggacatccccctggtaaaatcataccttgcccagtttgccgctagggccatcattagcgagcttgtgtccattagcgagcttgcccagcctctggagtctgggactcatttccctctgttcctactctgtctccagcagttggccaagctccaggaccgcgaatggttgaccgagctgttccaacaatcaaaagtaaacatgcagaaaatgctccccgagattgatcagaacaaagaccggatgctcgagatactggaaggtaagggcctttccttcctgttccctctgctcaaactagaaaaggaactgcttaagcagatcaagctggacccctcgccccagactatttataagtggattaaagacaatatttcccccaagttgcacgttgataaggggtttgtcaatattctgatgacaagcttcctccaatatatcagttccgaggtgaatcctccgtcagacgagactgactcgtcaagcgcaccgagtaaggagcagctggagcaggagaaacagctgttactgagttttaaacctgtcatgcagaagtttctgcacgaccacgtagatttacaggtgtccgccctttatgctttgcaggtgcactgttataatagtaatttccctaagggcatgctgcttagatttttcgttcacttctacgatatggagatcattgaagaggaagcttttttggcctggaaagaagatattacccaggaattccctggaaagggcaaggcattgttccaggtgaaccagtggctaacctggctggagactgctgaagaagaggagagtgaggaagaggccgattag

SEQ ID NO: 187126 - DNA, 2943 bp, Artificial Sequence
  Description of Artificial Sequence: Synthetic coding sequence
atggccggctggcccacccccgccggcacccggccctggcggaccgaagcaaggctctgcagtgacggcgagggcgcatggcttgggccactggccccatggcgggaagccaggctagccagcagacggggaggtattagctttctgcttagtcctccgttacccaccccctcaataaacattatcctgctcaaaattctccgatgccaggccgccaaagtggagtctgctatcgcagaggggggtgcttccaggttctccgcttcctcaggcggagggggctcacgtggagcaccacagcactaccctaaaacagctggaaatagcgagtttctgggtaaaacacccggtcaaaatgcccagaagtggattcccgccaggagtactcgcagggatgacaatagtgcagccaacaatagcgccaacgaaaaagaaaggcacgacgctattttcaggaaggtccgggggatcctcaataaattaaccccggagaaatttgacaaactctgcttagagctgcttaatgtgggagtcgagtccaaactgattctcaagggggtgatcctcctaattgtcgacaaggccctcgaggaacctaaatatagcagtttatacgcccagctgtgccttcgcctggctgaggatgcaccaaacttcgacggtcctgcagcagagggccagccaggccagaagcaatcgaccacattccgtaggctcctcatatccaaactgcaggacgaatttgaaaacagaacgcgaaacgtcgatgtgtacgacaaaagggagaacccactgttgcccgaagaagaggagcagagagccatcgctaagattaagatgcttggaaacatcaaattcatcggtgagctgggcaaactggaccttattcacgagagcatcctgcacaaatgcatcaagactcttctggagaagaagaagagagtgcaactcaaagacatgggggaagacctggagtgcctatgccagattatgaggaccgtgggacctcggctggaccacgagcgcgcaaaaagcctgatggatcagtacttcgctagaatgtgttccttgatgctcagtaaagaactgcccgcccgtataaggttcctgctgcaggataccgtggaactgagagagcaccattgggtacctcggaaggcctttttggacaatggccctaagacaatcaaccagatccggcaggacgccgtaaaagacctcggagtgtttatcccagctccaatggctcaaggaatgagaagcgacttttttctggagggaccctttatgcctccacgtatgaaaatggaccgcgatcctctggggggactggctgacatgttcggtcagatgcccggatccggtatcgggactggccccggggtaatccaagacaggttcagcccaactatggggcgtcacagaagcaatcaactgtttaatggccatggaggtcacatcatgccccctacacagtcacaatttggcgaaatggggggaaagtttatgaaatcacaagggttatctcagctctatcataaccagagccagggcctcctctcccaactgcaagggcagagtaaggacatgccgccaaggtttagcaaaaaggggcagcttaatgctgacgagattagtctgagacccgcgcagtcgttcctgatgaataagaaccaagtgcctaaactgcagccgcagattacaatgattcccccatctgcccaaccacctcggactcaaactcctccgttaggacagaccccacagttgggcctgaaaaccaatcctcctctgatccaggaaaaaccggctaaaacatccaagaagccacctcctagcaaagaggagctgctgaaactcacagagacagttgtgactgaatacctgaacagcggaaacgccaacgaagctgtcaatggcgtgcgggaaatgcgggcccctaagcattttttgccggagatgctatccaaggtgataattctgtccctggacaggagcgatgaggataaggaaaaagcctccagtctgatttctttgttgaaacaggaaggtattgcaacatctgacaactttatgcaggcctttctgaatgtgctggatcagtgtcctaaattggaagtggatatcccacttgttaagtcttacttggcccagtttgcggccagggccatcataagcgagctggtctctattagtgagttggctcaaccactagagagcggcactcacttccccctctttttactctgcctgcagcagctggcgaagctgcaggatcgagaatggctcactgaactgtttcaacaatccaaggtgaatatgcagaagatgctgccagagattgaccagaataaggatcggatgttagagatcctggaagggaaaggactgagcttcctgttcccactactcaagctcgagaaggagctattgaagcagattaagcttgacccatctccgcagacaatatacaagtggatcaaggataacatttcaccaaagttgcacgtcgacaaggggtttgtaaatattctgatgactagcttccttcagtatatctctagcgaagttaatccaccgagcgacgagaccgatagtagctctgctccgtccaaagagcagctggaacaggagaagcagctgctattgtcgttcaaacccgtaatgcagaagttcctgcatgatcatgtcgatctgcaggtctccgccctgtatgcgctgcaagttcattgctacaattccaactttccaaagggaatgctcctgcgctttttcgtccatttttatgacatggaaatcatcgaggaggaggcttttctcgcctggaaggaagacataacgcaggagttccctgggaaaggaaaggccctgttccaggttaatcagtggttaacctggctcgagactgctgaggaggaggaatccgaggaggaggccgactag

SEQ ID NO: 187127 - DNA, 735 bp, Artificial Sequence
  Description of Artificial Sequence: Synthetic coding sequence
gtggagagcgccatcgccgagggcggcgccagccggttcagcgccagctccggagggggcggctcgagaggagccccacagcattatcccaaaactgctgggaactccgaattcctcggaaaaaccccaggccagaacgcgcagaagtggattcctgcccgctccacccgtcgcgacgacaactcagccgcaaataatagcgctaacgaaaaagaacgtcatgacgcgatcttccgcaaagtgaggggcatcctgaataaattgacccccgagaaattcgacaagctgtgtctcgaactgctgaacgtgggggtggagagcaagcttatcctgaagggtgttatcctgcttattgtcgataaggccttggaagaaccaaagtattcgtctctttacgctcaactctgcctgcgcctggcagaggacgctccaaatttcgatggccctgcagctgaagggcagccaggacagaagcagagcacaacgttccgcagacttttgatatctaaacttcaggacgaattcgagaataggactcggaatgtggatgtctatgataaacgcgagaaccccctgctacccgaggaggaagaacagagggccatcgccaagattaaaatgctggggaacatcaaattcattggcgagttaggcaaactggatctgatccatgagagtattctccataaatgcatcaagacattgctagagaagaagaaaagagtacagctatag

SEQ ID NO: 187128 - DNA, 2724 bp, Artificial Sequence
  Description of Artificial Sequence: Synthetic coding sequence
gtggagagcgccatcgccgagggcggcgccagccggttcagcgcctcatcaggaggtggtgggtcccgcggcgccccgcaacactaccctaagacagcgggaaactccgagttcttgggcaagacccccggacagaacgcccagaagtggattcccgcccgtagtactcggcgggacgacaacagtgctgccaacaactcagctaacgaaaaagagagacatgacgcaattttccgcaaggtaagaggcatccttaataagctgaccccggaaaagttcgacaaattgtgtctggagctgctgaatgtcggagtcgagtcaaagcttatactaaagggagtcatattacttattgtggataaggccctggaggaaccaaagtactcaagcctctatgcccagctttgcctgcggctggcagaggacgcacctaatttcgacggacctgcagcagaaggacagcctggccagaaacagtcaactacctttcgcagattgctgatttcaaagctccaggatgagttcgagaataggacgcggaacgttgatgtctacgataagagggaaaacccactgctacccgaggaagaggaacagcgagccatcgcgaagatcaagatgctgggaaacataaagtttatcggagagctgggtaagctcgacctgatccatgagtcaattttgcacaagtgcataaagacactcctggagaagaaaaaacgcgtccaacttaaggatatgggcgaagatttggagtgcctttgccagattatgagaacagttggtccacgtcttgaccatgaaagggccaagtctcttatggaccagtattttgcaagaatgtgtagcctgatgcttagtaaagagctgccggcgcggatacgcttcctactacaagatactgttgagctgcgggagcaccactgggtcccacggaaagcctttctggacaatggcccgaagaccatcaaccagatccgccaagacgccgttaaagaccttggcgtatttattcccgctcctatggcacagggcatgaggtccgatttctttcttgaggggcctttcatgccccctcgcatgaaaatggatcgcgacccactgggggggctggctgatatgttcggacagatgccaggctcaggtatagggaccggcccaggggtgatccaggatcgcttttcaccaactatggggaggcaccggtccaaccagttgtttaacggacacggaggccacatcatgcctcccacccaaagccagttcggagaaatgggcgggaagttcatgaagtcacaaggattgtcccagctgtaccataaccagtctcaggggcttctatcccaactgcaaggccagagcaaggacatgcccccaaggtttagcaagaagggacagctaaacgctgacgaaatttctctgcgtccggcccagtcttttctgatgaataaaaaccaggtgccgaagctgcaaccccagatcaccatgatcccaccctccgctcagccacccaggacgcaaacgccccccctgggccagacaccccaactggggttaaaaaccaacccacccctcatacaggaaaaaccagctaaaaccagtaagaagccccctcccagtaaggaggaactgctgaaactgacagagaccgttgtcacagagtacttgaattccggcaacgctaacgaggccgtgaatggggtccgtgaaatgcgtgcacccaaacacttcctccccgagatgctgtctaaggttattatcttatccctggatcgcagtgatgaagacaaggaaaaggcgagttcgctgatttccttgttgaaacaggagggcattgcgacctctgacaacttcatgcaagcgtttctgaatgtgctcgatcagtgcccaaaactggaagtggatataccgctggtgaaatcctacctagcccaatttgccgcccgtgccatcattagcgaactcgtaagcattagcgagctggctcaaccattggagtctggtacccactttccgctcttcctactttgtcttcaacagctggcaaaacttcaggaccgagagtggttgacagaattatttcaacagagtaaggtgaacatgcagaaaatgctgcccgaaatcgaccagaacaaagaccgtatgcttgaaatattggaaggcaaggggttatcctttttattccctctactgaaactcgagaaagagctattgaagcagattaaattagacccctctcctcaaactatttacaagtggataaaggataacatctcccctaaactccatgtagataagggatttgtgaacatcctgatgacctcctttcttcagtatatctcaagtgaagtgaaccccccaagcgatgagactgactcgagttctgccccatcaaaagagcagctcgaacaggagaaacagctccttcttagctttaagccagttatgcagaagttcttgcatgaccacgttgacctgcaggtctcagctttgtatgctctgcaggtccattgttataattccaattttcccaagggaatgttactgaggtttttcgttcacttttatgatatggaaatcattgaagaggaggcctttctggcttggaaagaggacataacgcaggagttccccggcaagggtaaagctttgtttcaggtgaaccaatggctgacttggctcgaaactgccgaggaggaggagagtgaggaagaagccgactag

SEQ ID NO: 187129 - DNA, 2724 bp, Artificial Sequence
  Description of Artificial Sequence: Synthetic coding sequence
gtggagagcgccatcgccgagggcggcgccagccggttcagcgcctccagcgggggcggaggtagccgaggcgccccacaacactatccgaaaaccgccggtaattccgaatttttggggaaaacccccggacagaacgcccagaagtggattccagcacgaagcacacgcagagacgataatagcgctgcaaataacagtgctaatgagaaggaacgccacgatgcaattttcagaaaggtgagaggaattctgaacaaactgactcctgaaaaatttgataagctctgtcttgagctcctcaatgttggagtggaatccaagctaattctgaagggcgttatcctgttaatcgtggataaggcacttgaggagcccaagtatagttctctctacgctcagctctgcttacggctggccgaggatgcccccaacttcgatggcccggcagcagagggacagcctgggcagaagcagtcaactaccttcagaaggcttctcattagtaaattgcaagacgaattcgagaatagaactaggaatgtcgacgtctacgataagagagagaatcctctcttaccagaagaagaggaacagagagccattgcaaaaataaaaatgctagggaatattaagtttattggggagcttggcaaactggacctgatccatgaaagtattcttcataagtgcattaagacgctcctggaaaagaagaagagggttcagctgaaggatatgggcgaggacctcgaatgtctgtgccagataatgcgtactgtgggaccacgtctggatcatgagcgggccaaaagtcttatggatcagtattttgccaggatgtgcagcctgatgctaagtaaggagcttcccgccagaatccggtttttactccaagacaccgtggagcttagagaacaccattgggtaccaagaaaagcattcctggataacggtccaaaaacaatcaatcagatcagacaggatgccgtgaaagacctcggggtgttcattccagccccgatggcccagggaatgaggagtgatttcttcctggaggggccttttatgcctcctagaatgaaaatggatcgcgatcccttaggcgggctggccgacatgtttggccaaatgccagggtccgggattggtactggccccggcgtcatccaggatcgctttagtccgacaatgggtcgtcaccggtcaaaccaactctttaacggccacggagggcacataatgcctcccactcagagccagtttggcgaaatgggaggaaagttcatgaagagccaaggcctgtcccagctctaccacaatcagagccagggactcctgagccaactgcagggccagtccaaggacatgccccctcggttcagcaaaaagggacaacttaacgccgatgagattagcctccggccagcccagagcttcttaatgaacaagaaccaggtccccaagctccaacctcagattacgatgattcctccttcggctcagcccccacgtacccagacccctcctctgggacagacaccacagcttgggctcaaaaccaatcctcccctgattcaggaaaagccggctaagacatcaaaaaaaccccctccaagcaaagaggaattactaaaattgaccgagacagtggtaacagaatacctgaatagtggcaacgcaaacgaggcagtaaatggcgtacgagagatgagagcccccaagcactttctccctgagatgctttccaaagtgataattttgtccctggatcgctctgacgaggacaaggaaaaggcaagctccctgattagccttttgaagcaggagggcattgcgaccagcgacaattttatgcaggcctttctgaacgtgttggaccagtgccccaaactggaagtcgatatcccactggtgaagagctaccttgctcagtttgcagccagagcgatcatcagcgagcttgttagtatcagtgagcttgcacagccccttgagagcggcactcatttcccactgtttttgctctgcctgcagcagctggccaaattacaggaccgtgagtggttaactgaactcttccagcagagcaaggtgaatatgcagaaaatgctgcccgaaatcgatcaaaacaaggatcgcatgctggagattttggagggcaaaggtctttcctttctgttccccctgcttaagttggagaaagagctcctgaaacagattaagctggatcccagccctcagaccatctacaagtggattaaggacaatatctcacctaagcttcatgtggacaagggatttgtaaacatccttatgacctcctttttgcagtacatcagcagcgaggttaatccaccctccgatgaaaccgactcttcgtccgcaccttctaaagagcagctggaacaagagaaacagttgttgctgagtttcaagccagttatgcaaaagttcctgcatgatcatgtggacttacaggtcagtgcgctttacgctctgcaggtccattgttacaattcaaattttccaaaaggaatgctcctcaggtttttcgtgcacttctatgacatggaaatcatcgaggaggaggctttcctcgcatggaaagaggatatcacacaggagtttcctggcaaaggcaaggcactgttccaggttaatcaatggctgacttggctcgaaacagctgaggaggaggaatccgaggaggaggcagactag

SEQ ID NO: 187130 - DNA, 375 bp, Artificial Sequence
  Description of Artificial Sequence: Synthetic coding sequence
gtggagagcgccatcgccgagggcggcgccagccggttcagcgcctcaagcggtgggggcggatctaggggagcaccgcagcattatcctaaaacagccggaaactctgaattcctgggtaaaacaccaggccagaacgcgcaaaagtggatccccgcacggagtacacgccgggacgataacagcgccgcgaataacagcgctaacgaaaaagaacggcacgacgctatcttccggaaggtgaggggcatcttgaacaaactaacgcccgagaagttcgacaagctatgtctggagctcctcaatgttggtgtggagagtaagctgatacttaagggagttatcctgcttatcgtggacaaggctctggaatag

SEQ ID NO: 187131 - DNA, 339 bp, Artificial Sequence
  Description of Artificial Sequence: Synthetic coding sequence
gtggagagcgccatcgccgagggcggcgccagccggttcagcgccagctccggtggcggagggtcccggggggctccacagcattatcccaaaaccgccgggaatagtgaatttttgggaaaaacccccggacagaacgctcagaagtggattcctgcccgcagcacaaggagagacgacaactccgcagcaaacaactcagcaaacgagaaagaacggcacgatgctattttcaggaaggttaggggcatcctgaataagctcaccccagaaaaattcgataagctgtgccttgagctgttaaacgtgggtgtagaatcgaagcttatcctcaagtag

SEQ ID NO: 187132 - DNA, 351 bp, Artificial Sequence
  Description of Artificial Sequence: Synthetic coding sequence
gtggagagcgccatcgccgagggcggcgccagccggttcagcgcctccagcgggggtggagggagcaggggcgctccccagcattaccctaagacggctgggaacagcgagttcttggggaaaacaccggggcagaacgctcaaaaatggatccccgctaggagcacccggcgagatgacaactctgccgccaacaacagtgccaacgagaaagaacgtcatgacgccatatttaggaaagtccgcggaatcctcaacaagctcacgcccgaaaagtttgataagctgtgcctggagttgcttaatgtgggagttgaatccaaactgattcttaagggcgtcatcttgtag

SEQ ID NO: 187133 - DNA, 1335 bp, Artificial Sequence
  Description of Artificial Sequence: Synthetic coding sequence
gtggagagcgccatcgccgagggcggcgccagccggttcagcgccagcagtggcggaggtggatcacgtggtgctccccagcactatcccaagacagctggaaacagtgagttcctgggcaaaactccggggcagaacgcgcaaaaatggatccccgcaagatctacacggagagatgataattcagccgcgaacaactctgccaacgaaaaggagcgccacgacgcaatctttagaaaggtgagaggaattctgaacaagcttaccccagagaaattcgacaaattgtgtttggagctgctgaatgtaggcgtggagtcgaaattgattctgaaaggagtaattctcttgatcgttgataaggcccttgaggaaccaaagtattctagtctgtacgcacagttatgcctccgcctcgccgaagacgctccaaacttcgacggacctgctgccgaggggcagccgggacagaagcagagcacaacgttccggcggctcttaatctcaaagttgcaagatgagttcgaaaatcggacaaggaacgtggacgtctacgacaaacgggagaaccctctcctccctgaggaagaggagcaacgggccatagcaaagatcaaaatgctgggcaacataaagttcatcggcgagctcgggaaactggatctgatacatgaaagcatccttcacaaatgcataaagacccttttggaaaagaagaagcgcgtgcaattgaaggatatgggtgaggatctggaatgtctatgccagataatgagaactgttggacccagactggatcatgagcgagccaagagcctcatggatcagtacttcgcgaggatgtgttcgctcatgttgtcgaaagagctgccagccaggattcgatttcttctccaggatacagtcgagttacgggaacaccactgggtgccacgcaaggccttccttgacaacggccctaaaaccatcaatcagattcgacaggacgcagtgaaggacttgggcgtcttcattcccgcccccatggcccaggggatgaggagcgacttcttcttggagggtccttttatgcctccaaggatgaaaatggatagagacccgctcggcggcctggccgacatgtttggtcagatgcccgggagcggaatagggacagggccgggcgtgattcaagacagattcagccccactatgggtcggcaccgctcaaatcagcttttcaatggacacggaggccacatcatgccccccacgcagagtcaattcggtgaaatgggaggtaagttcatgaagtctcagatttccctgcgcccagctcagagctttctcatgtag

SEQ ID NO: 187134 - DNA, 849 bp, Artificial Sequence
  Description of Artificial Sequence: Synthetic coding sequence
gtggagagcgccatcgccgagggcggcgccagccggttcagcgcctcttccggtggaggtgggtcccgtggtgcgccccaacactaccctaagaccgcaggaaactccgaatttttaggaaagactccaggtcagaatgctcagaagtggatccctgcgcgatccacccgaagagacgacaatagtgcagctaacaactcagccaatgagaaagagcggcacgacgctatctttcgcaaggtccggggcatcttgaacaaattgacgccagaaaaatttgacaagctctgtcttgagctgttaaacgtcggcgtcgagtcgaaactgatcctgaagggagttattttactaattgtggacaaagccctggaggagccaaagtactcaagcctgtacgctcagctctgtctgcgcctcgcagaggatgcaccaaattttgacggaccagcagccgaaggtcaaccagggcagaaacagtctacaactttcagaaggctactgatcagcaaactccaagacgagtttgagaacaggacccgcaacgtcgatgtttacgacaaacgagagaacccactgcttccagaggaggaagagcagcgggccatcgcgaaaatcaagatgttgggcaacattaaattcatcggagaactgggaaagcttgacctgatccacgagtccattttacataagtgcatcaagaccctgctggagaagaagaagcgggtacagctgaaagacatgggagaggatctggagtgcctatgtcagatcatgcggacggtaggtccaagattagaccacgagagagcaaagagcctgatggaccagtactttgccaggatgtgttag

SEQ ID NO: 187135 - DNA, 393 bp, Artificial Sequence
  Description of Artificial Sequence: Synthetic coding sequence
gtggagagcgccatcgccgagggcggcgccagccggttcagcgccagcagtggcggtggaggttctcggggagccccgcagcattatcctaagactgccgggaacagcgagttcctgggtaagactcccggccagaatgctcagaaatggatccctgccaggagcaccaggcgagatgacaattccgctgcaaataattctgctaatgaaaaagaacgacacgatgcaatcttcaggaaagtgcgaggaatcctgaacaagttgacacccgagaaatttgacaagttgtgcctagagttgctgaacgtgggcgtcgaatccaagctgatcctcaagggagtgattcttttaatcgttgacaaagccctggaagagcccaaatattcctcctag

SEQ ID NO: 187136 - DNA, 1221 bp, Artificial Sequence
  Description of Artificial Sequence: Synthetic coding sequence
atgagcgccagccaggacagccggagccgggacaacggccccgacggtatggaacctgaaggcgtgatcgagagtaactggaatgagattgtggacagctttgacgacatgaaccttagcgagtctctgttgagaggaatttacgcctatggcttcgaaaaaccgtcagctattcagcagcgcgctatacttccctgtattaaagggtatgatgtgatcgcacaagctcaaagtggtacaggtaaaaccgctacttttgccatctctattctgcagcagattgaattggacttaaaagccacccaggccttagtcctagctcctacccgagagcttgctcagcagatccaaaaggtagtcatggcgctcggagactatatgggcgcaagttgtcatgcctgtattggcggcaccaatgttcgggcagaggtgcagaaattgcaaatggaagccccccacatcatcgtgggaactcctggacgcgtttttgacatgctcaatagaaggtatctctcccccaaatacatcaaaatgtttgtcctcgacgaagccgatgaaatgttgagccgcggattcaaggatcagatctatgatatatttcaaaaactgaattcaaacacgcaggtggtgctgttaagcgccaccatgcccagtgacgtcttagaggtgacaaagaaatttatgcgggaccctatcagaattctggtaaagaaagaggagttgaccctggaggggattcggcagttttatataaacgtggagagggaagaatggaagctggatacgctgtgcgatctatatgagacactgacgatcacccaagcagttatctttatcaacaccagacgcaaagtcgactggcttacggagaagatgcatgcccgagactttaccgtatctgccatgcatggtgacatggaccagaaggaacgggacgtaattatgcgcgagtttaggagtggaagtagtcgagtgctaatcacaactgacctcctagccagaggcatcgacgtacagcaggtgtccctcgtcatcaattacgatttgccaacaaaccgggagaactatatccacaggatcgggaggggcggtcgcttcggtagaaaaggggtcgcgatcaatatggttacggaggaagataaaagaaccctgagggacattgaaacgttctacaacacttccatagaagagatgccattgaatgtcgccgatctaatttag

SEQ ID NO: 187137 - DNA, 441 bp, Artificial Sequence
  Description of Artificial Sequence: Synthetic coding sequence
atggagcccgagggcgtgatcgagagcaactggaacgagatcgtggattccttcgacgacatgaacctgtcagaaagcctcttgagaggcatatacgcgtacggattcgaaaagcctagcgccattcagcagcgagccattctcccctgcattaagggttacgatgtcatagcccaggctcaatcagggaccggaaaaacagctacgttcgccatcagtattctgcagcagatcgagcttgatttaaaggcgacgcaggctttggtgctggcacctacccgcgagctcgcccaacaggtgcgggtggcgagtataccttcattccgagcagacctgggcatgatgtctatcattcagggtccagagaaatcctctctcataaccaccttaggaggcaggcacggttgccctaataccctggaaacatgctgggtgaactag

SEQ ID NO: 187138 - DNA, 603 bp, Artificial Sequence
  Description of Artificial Sequence: Synthetic coding sequence
atgttcgtgctggacgaggccgacgagatgctgagccggggcttcaaagatcaaatctacgacatttttcagaagctcaactccaatacacaagtggtgctgctcagcgccactatgccaagcgacgtgctggaagttaccaaaaaattcatgagggacccaatcagaatcttggtgaagaaggaggagctcactttagagggtattcgtcagttttatatcaacgtcgaacgcgaggaatggaagcttgacacactgtgtgacctgtatgaaaccctgacaatcactcaggccgtcatctttatcaacacgaggcgcaaagttgattggctgaccgaaaaaatgcacgcccgggattttacagtcagtgcaatggtgtgcctccctgccgcctccctcctgtgggtatgcccaagcgaggtgtcctatcttaagcctggttttcttgagcctcgttgcctgcccggactgctccacatttgtttcctcttccaacacggggacatggaccagaaagagagagatgtgataatgagggagtttagatctgggtcctcccgcgtcctgatcaccaccgacttgctcgtgtctaggggcaattag

SEQ ID NO: 187139 - DNA, 1026 bp, Artificial Sequence
  Description of Artificial Sequence: Synthetic coding sequence
atgagcgccagccaggacagccggagccgggacaacggccccgacggaatggagccagagggggtcatagagtctaattggaacgaaattgtggactccttcgacgacatgaacctgtcagagagtctgttgagaggaatctacgcctacgggtttgagaagccgtctgcaattcagcaaagagccattctcccctgtattaagggctatgacgtgatcgctcaggcccagtctggcacagggaagacagcaaccttcgcaataagcattctacagcagatcgaactggatctcaaagcaactcaggctcttgtcctcgcccccaccagggaactggcccagcagattcagaaggtcgtaatggcactcggagattacatgggagctagctgtcacgcttgtataggaggaacaaacgtgagggccgaggtgcagaaattacaaatggaagctcctcacatcattgtaggcaccccaggcagagtgtttgacatgcttaaccggaggtatctatcgcccaaatacatcaaaatgttcgtcctggatgaagcagacgagatgttgtcaaggggatttaaggaccaaatttacgacattttccagaaactcaactcaaacacccaggtggtgttgttgtcggcaactatgccaagcgatgtcctagaggtgacgaagaaatttatgagagaccccattaggattcttgtgaagaaggaagaactgacacttgaagggataagacagttctatatcaacgtggagagggaggaatggaaattggacaccctgtgcgatctgtacgagacactgaccattacccaggccgtgatcttcataaatacccggcggaaggtggactggctcactgaaaagatgcatgccagggactttacagtgtcggctatgcacggcgacatggaccaaaaagaaagagatgtgatcatgagagagtttcgttccggaagctcccgcgtcttaattacgaccgacctcctgaatcgttctcgatggacagtttggccttag

SEQ ID NO: 187140 - DNA, 1224 bp, Artificial Sequence
  Description of Artificial Sequence: Synthetic coding sequence
atgagcggcggcagcgccgactacaaccgggagcacggcggccccgagggtatggaccctgatggagtgatcgagagtaattggaatgaaattgtggataacttcgacgacatgaatctgaaggagagtctattaaggggcatatacgcgtatggcttcgagaagcctagtgcgatccaacagagggccattatcccttgcatcaagggttacgacgtgattgcacaagcccagtccgggacgggaaaaaccgctacatttgcaatatccattttacagcaactagaaatcgagtttaaagagacacaagcattggttttggctcccactcgtgaactggcgcagcaaatccagaaggtgattcttgcactcggggattatatgggcgctacgtgtcacgcatgcatcggcggtacgaacgtccggaatgagatgcagaagcttcaggccgaagctccacacatagtggtaggcacacctggcagggtgtttgatatgctgaaccggagatacctgtctcctaagtggatcaagatgttcgtgctggacgaagcggatgaaatgctatctcggggattcaaggaccagatctatgagatctttcagaaactcaacacctctatccaggtggttttgctgagtgccacaatgcctaccgatgtgctcgaagtaactaaaaagtttatgcgcgatccgattaggattctagtgaagaaagaggaactgacacttgaaggaataaagcagttctatatcaatgtggaaagggaagagtggaagcttgacacactgtgcgacttatacgagactctgactattacacaggcagtgatttttttaaacacacggagaaaagttgactggctcacagaaaagatgcatgcgagagacttcaccgtgtcagctctgcacggggacatggaccagaaggaacgagacgtcattatgagggagttcagaagcggcagttcaagagtcctcatcactactgacctgctcgctcggggcatcgatgtgcagcaagtttcattggtgattaattacgacctccccacaaatcgcgaaaactatatccatagaatcgggcgtggcgggaggttcggaaggaagggcgtagcaatcaatttcgtaaccgaagaagacaagaggatcttacgcgatattgagacattctacaacactaccgtggaggagatgccgatgaacgtggcagatctgatctag

SEQ ID NO: 187141 - DNA, 939 bp, Artificial Sequence
  Description of Artificial Sequence: Synthetic coding sequence
atgctgaccgtgctgcggagcctgcccctgttcagccgggagctgttattccctgtcctgaagatccaaaaggtgatcctggccctcggggactatatgggggcaacttgtcatgcttgcataggcggaacaaatgtgagaaatgagatgcagaaactccaggcagaagctccccatatcgtggtgggcacgccaggaagggtgttcgacatgctaaacaggagatacctgtccccaaagtggataaaaatgttcgtactcgacgaagccgatgagatgttgtcaagaggattcaaggatcagatatatgaaatcttccaaaaactcaataccagcattcaagtcgtactgctatccgcgacgatgcctaccgacgtgctggaggtaactaagaaattcatgcgagatcccattcggatactggtaaaaaaagaggagcttactctggagggtattaagcagttttacattaacgtggaacgtgaagagtggaaactggacactctctgtgatctttacgaaactttgaccatcacacaggccgtgatctttctgaatactcgcagaaaggttgactggctaaccgagaagatgcacgcgagagacttcacagtaagcgctctgcacggggacatggaccagaaagaaagagacgtcatcatgagagaattcaggagcgggtcatcccgggtcctcatcaccacggacctgctggctcgagggatcgatgttcagcaggtaagccttgtgattaactacgacctgcctaccaacagagaaaattacatccacaggattggccggggcggccggttcgggagaaaaggcgtggccattaatttcgtcacggaggaggataagaggatcttgcgggacatagaaacgttttataatacaaccgtggaggaaatgccaatgaatgtggcagacctaatttag

SEQ ID NO: 187142 - DNA, 1227 bp, Artificial Sequence
  Description of Artificial Sequence: Synthetic coding sequence
atgagcggcggcagcgccgactacaacagccgggagcacggcggccctgaaggcatggatcccgacggtgtaatcgaaagcaattggaatgagattgttgataacttcgatgacatgaatctgaaagaatctctgctgcgcggcatttatgcctatgggtttgagaagccgtccgcgatccagcagagggctatcatcccctgcattaaaggttacgacgtgattgcccaggctcagtcaggtactgggaagactgccacctttgctattagcatattgcagcagctcgagatagagttcaaagaaacccaggccctggtgcttgccccaacacgggaattggcacagcagatacagaaggtcatcctcgcccttggtgactacatgggcgcaacatgccatgcatgtataggtgggactaatgttcggaacgagatgcagaaactgcaggctgaggcacctcacattgttgtgggcacaccaggccgagtttttgatatgctgaaccggaggtacttatcccccaaatggatcaaaatgttcgtgctggatgaagccgatgagatgctaagcagaggctttaaggatcagatctatgaaatcttccagaagctcaatactagcattcaggtagtactgctttcagccactatgccaacggacgtccttgaggttacgaaaaagtttatgcgagacccaatccgaattctggtgaagaaggaagagctgacgctggaaggtattaagcagttctacatcaatgtagaaagagaagagtggaagttagatacactgtgcgacttatacgaaaccctgacaattacccaagctgtgatctttcttaatactcgaaggaaggtggattggttaacagagaaaatgcatgcccgggactttaccgtgtccgctctgcatggtgacatggaccaaaaggaaagggacgtgattatgagagagtttcggagcggatccagtagagtcctcattactaccgatctactggccagaggcattgatgtacaacaggtcagcctcgtgattaactacgatctgcccaccaaccgagaaaattacattcaccgtatcgggagggggggacggttcggcagaaagggcgttgccataaattttgtgactgaggaagacaaaaggatccttcgggatatcgagactttctacaatacgaccgtggaagaaatgcccatgaatgtggcggatctgatttag

SEQ ID NO: 187143 - DNA, 174 bp, Artificial Sequence
  Description of Artificial Sequence: Synthetic coding sequence
atgagcggcggcagcgccgactacaaccgggagcacggcggccccgagggtatggacccagacggagtgatcgagtcaaattggaatgaaatcgttgataattttgacgatatgaacctgaaggagtcactcctcaggggtatttatgcatatggatttgaaaaaccatcatag

SEQ ID NO: 187144 - DNA, 297 bp, Artificial Sequence
  Description of Artificial Sequence: Synthetic coding sequence
atgagcggcggcagcgccgactacaaccgggagcacggcggccccgaggggatggatccagatggggttatcgagtccaattggaatgaaattgtggacaattttgatgacatgaacttgaaggagtcactgctgagaggtatatatgcatacgggtttgagaagccctccgccattcagcagagggcaatcattccgtgcatcaaagggtacgacgtcattgctcaggcccagtctggtacaggcaagactgcaacgtttgcgataagcatcttacagcagcttgagatcgagtag

SEQ ID NO: 187145 - DNA, 363 bp, Artificial Sequence
  Description of Artificial Sequence: Synthetic coding sequence
atgagcagcagcgccggcagcggccaccagcccagccagagccgggcaatacccactcggacggttgccatctcagacgcggcgcagttaccccatgactactgtaccactccaggcgggaccctgttcagcacaacccctggcggcactcgcatcatatacgatcgcaagttcctgctggacagaagaaattctcctatggcccagactcctccctgtcacctgcccaacatcccaggagttacgtcgccaggaacattaatcgaggatagtaaggtagaggttaacaatttaaataacctcaacaaccacgaccggaaacacgccgtgggcgacgacgctcaattcgagatggacatttag

SEQ ID NO: 187146 - DNA, 738 bp, Artificial Sequence
  Description of Artificial Sequence: Synthetic coding sequence
atgaacaacaagttcgacgccctgaaggacgacgacagcggcgaccacgatcaaaatgaagagaattctacacaaaaagatggcgagaaagagaagaccgaaagagacaaaaaccagtcctcttcaaaaaggaaagccgtcgtgcctggcccagctgagcatcccctgcagtataattacaccttctggtatagtaggcgaactcccggccgacctacatcctcgcagtcatacgaacagaacattaagcagatcggaactttcgcaagtgtggaacagttctggagattttactcacatatggtgaggcctggtgacttaaccggccactctgatttccacctgtttaaggagggaatcaagcccatgtgggaggatgatgccaacaaaaacggcggaaaatggatcatcaggttgaggaagggccttgctagcagatgttgggaaaacctcattctggccatgctgggagaacagtttatggttggggaggagatctgtggagctgttgtgtctgtgcgcttccaggaagacatcatttctatctggaataagaccgcttcagaccaggcgacaaccgcccgaatccgggatacgcttaggcgggttctcaatctccctcccaatactattatggagtataaaacacatacagacagcattaagatgcccggacgcttaggcccccaaagattgttatttcagaacctctggaaacccagactgaacgtgccttag

SEQ ID NO: 187147 - DNA, 705 bp, Artificial Sequence
  Description of Artificial Sequence: Synthetic coding sequence
atgaacaacaagttcgacgccctgaaggacgacgacagcggcgaccacgaccaaaacgaagagaattctacacaaaaagacggggaaaaggaaaagacagagcgggataagaatcagagcagtagtaagcgaaaagcggtcgtcccaggccccgctgagcacccactgcagtacaattatactttctggtactctcgcaggacacctgggcgccctacctcttctcagtcctatgagcaaaacattaaacagatcggcacctttgcctccgttgaacagttttggcgcttttactcacatatggtccggcccggggacctgaccggccactccgatttccacctgttcaaagaggggattaaacctatgtgggaggacgatgccaacaagaacggcgggaaatggatcatacgactgcggaaagggttggcctcaaggtgttgggagaatctcattctggcaatgcttggcgagcaattcatggtaggcgaagagatctgtggagccgttgtctccgtgagattccaggaagatatcatttctatctggaataagaccgcttcggaccaggctacaacagctaggattcgggatactttgcgcagagtacttaacctgcctccaaatacgattatggagtacaaaacacacacagattccattaaagataacagcagcttccggaatactaagatcaccttgtag

SEQ ID NO: 187148 - DNA, 567 bp, Artificial Sequence
  Description of Artificial Sequence: Synthetic coding sequence
atgaacaacaagttcgacgccctgaaggacgacgacagcggcgaccacgatcagaatgaggagaatagcacacagaaagatggggaaaaggagaagacggaacgcgataagaatcagtcctcttcgaagcgtaaagtcgaacagttctggagattttacagccatatggtgcggcctggagacttgacaggccactccgatttccatctctttaaggaagggattaaacccatgtgggaggatgacgccaacaagaatggggggaaatggatcattagattgcggaaaggcctggccagcaggtgttgggaaaacctaattctcgccatgcttggggagcagttcatggttggagaggaaatttgtggagccgtagtgagcgttcggttccaggaagacataatctccatttggaacaaaacagcctctgaccaagccactactgcaagaatccgagacacacttcgcagggtgctcaatctccccccgaacacaatcatggaatacaagactcacactgacagtatcaaatatgtgctggggggatacgggagaacatgtccatag

SEQ ID NO: 187149 - DNA, 357 bp, Artificial Sequence
  Description of Artificial Sequence: Synthetic coding sequence
atgcggggcgagcggcggcccctgtgggaggaggagagcaacgccaaaggcggggtctggaagatgaaagtgcctaaagattctacctctaccgtctggaaagagctgctgctcgcaacgattggagaacagtttactgactgtgccgcagcggatgacgaggtgattggagtgagcgtgagcgtgagggacagagaagacgtggtgcaggtgtggaatgtgaacgcctccctcgtgggtgaagctactgtgctcgagaaaatctatgaactgctcccccatattacttttaaagcggtgttctacaaaccacacgaggaacatcacgcctttgagggcggcaggggcaaacattag

SEQ ID NO: 187150 - DNA, 357 bp, Artificial Sequence
  Description of Artificial Sequence: Synthetic coding sequence
atgcggggcgagcggcggcccctgtgggaggaggagagcaacgccaaagggggagtgtggaagatgaaagtgcccaaagactcgacttctacagtctggaaggagctactgctcgccacaataggcgaacaatttactgactgcgctgccgcggacgatgaggtcattggcgtgagtgtttctgtgagggatagggaagatgtggtccaggtgtggaatgtcaatgcctcactcgtgggcgaggctactgtgctcgaaaaaatctatgaactcctcccccatatcaccttcaaggccgtcttttacaagccgcacgaagagcaccacgcatttgaagggggcaggggcaagcactag

SEQ ID NO: 187151 - DNA, 357 bp, Artificial Sequence
  Description of Artificial Sequence: Synthetic coding sequence
atgcggggcgagcggcggcccctgtgggaggaggagagcaacgccaaaggcggagtgtggaagatgaaggtgcccaaggactccacatctactgtctggaaggagctcctgctggccaccatcggcgagcagttcactgactgcgcggccgccgacgacgaagtgattggagttagcgtcagcgtgcgcgatagggaggacgtggtacaggtgtggaatgtaaatgcgagcctggttggggaagctacggtgctagagaagatctatgagttgcttccacacattaccttcaaggccgtcttttataaaccacacgaagaacatcacgccttcgaagggggccgtggtaagcactag

SEQ ID NO: 187152 - DNA, 675 bp, Artificial Sequence
  Description of Artificial Sequence: Synthetic coding sequence
atggccctgccccccgccgccgccccccccgccggcgcccgggagccacccggatcccgggccgctgccgctgcggcagcccccgaacctccactggggttacagcagctaagcgctctgcagccagaacctgggggtgttcctttgcattcaagctggacattttggctcgataggtccctgcctggcgctacagctgccgagtgcgcctctaatctgaagaagatttacacagtgcagactgtccagatattttggagcgtgtacaacaacatcccccccgtgacatccttacctctgcgctgcagttaccacttgatgaggggcgagagaaggcctctctgggaagaggaatctaacgccaaaggtggagtgtggaagatgaaagtacccaaggactcaactagcaccgtttggaaagaacttctcctggccaccattggcgaacagttcacagattgcgctgccgccgatgatgaagtgatcggtgtgagcgtgagcgtccgtgaccgtgaggatgtggtgcaggtgtggaacgtaaatgcctcacttgtcggcgaggccaccgtattagaaaaaatttatgagttgttaccacacattacattcaaggcggtgttttacaaacctcatgaggaacaccacgcatttgaaggcggcaggggaaagcactag

SEQ ID NO: 187153 - DNA, 357 bp, Artificial Sequence
  Description of Artificial Sequence: Synthetic coding sequence
atgcggggcgagcggcggcccctgtgggaggaggagagcaacgccaaggggggggtgtggaagatgaaggttccgaaggacagtacctcaactgtctggaaggagctgctgctggctacgataggtgaacagtttacagattgcgcagctgccgatgatgaagtcattggggtttctgtttctgtcagggatcgcgaggatgtggtacaagtgtggaatgtgaatgctagcttagttggcgaagccacagtgttagagaaaatctacgaactcctcccccatattaccttcaaagctgtgttctataaaccacatgaggagcatcatgcttttgagggaggtcgggggaagcactag

SEQ ID NO: 187154 - DNA, 135 bp, Artificial Sequence
  Description of Artificial Sequence: Synthetic coding sequence
atgcggggcgagcggcggcccctgtgggaggaggagagcaacgccaaaggcggggtctggaagatgaaggtacccaaggattcaacgtccactgtgtggaaagagctgctgttggcaacaataggtgagcagtag

SEQ ID NO: 187155 - DNA, 156 bp, Artificial Sequence
  Description of Artificial Sequence: Synthetic coding sequence
atgcggggcgagcggcggcccctgtgggaggaggagagcaacgccaagggtggggtgtggaaaatgaaagtgcctaaggactctacatcaaccgtctggaaggagctacttctggccacaattggagagcagttcactgactgtgccgccgcgtag

SEQ ID NO: 187156 - DNA, 282 bp, Artificial Sequence
  Description of Artificial Sequence: Synthetic coding sequence
atgcggggcgagcggcggcccctgtgggaggaggagagcaacgccaaggggggggtctggaaaatgaaagtaccaaaagattccacctctacagtttggaaggagctgcttcttgccaccattggggagcagtttacagactgcgcggccgccgacgatgaagtaataggggtgtctgtctcggtacgagatagagaagacgtagttcaggtgtggaatgtcaatgcatccctagtcggagaagcaaccgtcttggagaagatttatgaacttctgccatag

SEQ ID NO: 187157 - DNA, 2958 bp, Artificial Sequence
  Description of Artificial Sequence: Synthetic coding sequence
atggaccggcggagcatgggcgagaccgagagcggcgacgccttcctagatctgaagaaaccccctgctagcaaatgtccccacagatacaccaaagaggaactgcttgatatcaaggaactaccccattccaaacagcgaccatcgtgtctgtccgagaaatacgatagtgatggtgtttgggatcccgagaaatggcatgcttccctttatccggctagcgggaggtcttctccggttgagagtttgaaaaaggaacttgacaccgataggccatcactggtcagaagaatcgtggaccctcgtgagagagtaaaggaggatgaccttgatgtcgtactgagtccccagaggagaagcttcggcggggggtgccacgtcactgcagctgtaagttcgagaaggagcggctccccacttgaaaaagacagcgacggcctgcggctgctgggcggacgtcgaatcggcagcggcagaattattagcgcacgaacatttgaaaaggaccataggctgagcgataaggacctgagagatctgcgagacagagatcgagaaagagacttcaaagataaaagattcaggagagaattcggggattctaagcgcgtgttcggcgagagaagaaggaatgacagctacaccgaggaagaacctgaatggttttctgctgggcccacaagccaatctgagacaattgagctgacaggattcgacgacaaaatactcgaggaggatcacaaggggcggaagcggacgagaaggcgcactgcatctgtgaaggaaggcatcgtggagtgcaacgggggggttgcagaggaagatgaagtggaggttattttggcacaggagccggcagctgaccaggaggtgcctcgggatgccgtgctcccagagcaaagcccaggcgattttgattttaatgagttcttcaatctcgacaaggtcccttgtctcgcctccatgattgaagacgtgttgggagaggggagcgtctctgcatcgagattctcaagatggttttctaatccatctcggtcagggtctaggtcttcctcactggggagcacccctcacgaggagcttgagcggctcgcaggtctagagcaagctatcctttctcccggccagaacagtggaaactacttcgctcccattcctctcgaggatcacgccgaaaataaggttgatatattggaaatgctgcagaaggccaaagtggatcttaagccactgctctcttcgctgtccgctaacaaagaaaagctgaaagagtcaagccattcaggggtcgtcttgtccgtagaggaggtggaggccgggttgaaagggctgaaagttgaccagcaggttaagaacagcactcctttcatggctgaacacctggaggagactctgagtgccgtgacaaacaacaggcagttaaaaaaggacggcgacatgaccgcattcaacaagctagtgtctacaatgaaggcctccggcaccttgccctcccaacccaaggtgtctcggaatctggaaagtcacctgatgtctccagcagaaatcccaggccaacctgtgcctaagaatattcttcaagaactgctgggacagcctgtacaacgacccgctagttcaaatctgctgagcggtcttatgggcagtctggaacccaccacctccctcctgggacagagggcccccagccctccattgagtcaggttttccagacacgcgccgcttctgctgactacctgagacctcgcatcccctctccaatcggttttacccctgggccccagcagctgctgggggatccctttcagggcatgcggaaacctatgtccccgattacagcccagatgagtcagttggagctacagcaagccgctctcgagggcctggccttgccccatgatttggccgtccaagcggctaatttctaccagcccggcttcgggaagccccaagtcgaccggacccgcgacggtttccgaaacagacaacagcgagtcacgaagtccccggcccccgtgcacaggggaaatagttcttccccggcccccgccgccagtataaccagtatgttgtcccccagttttactccaacaagcgtgataaggaagatgtacgaaagcaaagaaaagtcaaaagaggaaccagctagcggtaaggcagccctcggagattcaaaggaggacacccaaaaggccagcgaggagaatctgctgtcttcgtcaagcgtgccgtcagccgacagggacagtagcccgactactaatagcaagctcagcgcacttcaacgctcaagctgctccaccccactgtcacaggctaacaggtacactaaagagcaggactacagacctaaggccactggccgcaagaccccgaccttggcaagcccagtgccaaccactccattcctgagacctgttcaccaagtccccctggtgccgcatgtcccgatggtgagacccgcccaccaactgcacccgggactcgtccaaagaatgctcgctcaaggcgtgcacccacagcacctgccaagcctgttgcagacaggcgtgcttccccctgggatggacctgtcccatctacaggggatcagtggccccatactcggtcagcccttttacccactccctgcagcctctcaccccctcctcaacccacgtccgggcacccccctgcacctagccatggtgcaacagcagctacagagaagtgtcctacaccctcctggcagtggctcgcatgcggcggctgtgtcagtgcagactactccacagaatgtaccatctagatccggtctcccccatatgcatagccagctcgagcaccgccccagccaaaggagcagcagtcctgtcggcctggcaaagtggtttggctctgatgttcttcagcagcctttaccatctatgcctgccaaagtgatcagcgtggacgaactcgagtatcgccagtag

SEQ ID NO: 187158 - DNA, 2436 bp, Artificial Sequence
  Description of Artificial Sequence: Synthetic coding sequence
atggaccggcggagcatgggcgagaccgagagcggcgacgccttcctggaccttaagaaaccccctgcttctaagtgcccgcaccgctacaccaaggaagagctactagatattaaggagttgccgcatagcaagcaacgcccatcttgtcttagcgaaaagtatgattcagacggtgtgtgggacccggagaagtggcacgctagcctgtatcctgcctccggtcgctcaagcccagtcgagtctcttaaaaaggagctggacacggatcgaccgtctctcgtaaggcggatcgtgggaatagttgaatgtaatggaggcgtggctgaggaggatgaagttgaagtcattctggcacaggaacccgcggctgaccaggaagttcctcgcgatgctgtgctccctgagcagagcccgggcgatttcgatttcaatgagtttttcaacctggataaagtcccttgtctggcttcaatgatagaggatgtgcttggggaaggcagcgtgtctgcgagcaggttcagccgctggttttccaacccctcacgcagcggctctcggtcttccagcctcggcagtacccctcacgaggaactcgaacggctggccggtctggagcaggcaatactatcgccagggcaaaattccggcaattacttcgcacccattccactggaggatcatgcagagaacaaggtagacatactcgaaatgttacagaaagctaaggtcgacctgaagcctctgctttcgtctctttcagccaacaaggaaaaattaaaggaaagttcccacagcggggtggtgctatccgttgaggaggtcgaggccgggctcaagggactcaaagttgatcagcaggtaaagaactccacaccattcatggctgagcacctggaagagaccctttctgctgtgacaaataacaggcagctcaaaaaagatggagacatgactgctttcaataagttggtttccacaatgaaaaggaatctggagtcacacctcatgtcccccgccgaaatcccagggcagccagtacccaaaaatatcctgcaggagctgcttggtcagccagttcagagacctgcctcctccaatctgctgtccggactgatgggctccctcgagcccactacgtcattgctcgggcagcgagccccatctccccctctgagccaggtgtttcagacacgggcagcatcagccgattacctccggcctcgcatcccgtcccccattggctttacgccaggaccccagcagttacttggggaccccttccaagggatgcgtaaaccaatgagccccatcactgctcagcagatgtcgcagctagaactgcaacaagccgcccttgagggtctcgctctccctcatgacctcgctgtgcaagccgccaacttctaccagcctggttttggcaagccacaagtcgatagaacacgagacgggtttagaaacaggcagcagcgagtaacaaaatcccctgctcctgtccacaggggaaacagttccagcccggcacccgccgccagcattactagcatgctctccccctcttttacaccaacctccgtcatccgcaagatgtacgagtcgaaggaaaagtccaaggaagagcccgctagtggtaaggcagccctgggagatagcaaagaggacacacaaaaagctagcgaggagaacctcctgtcttcctctagtgtcccctccgctgatcgcgactcgagtcctactactaactcaaagctatctgccctgcagcggtcgtcgtgttccactcccttgtctcaggcaaacagatataccaaggagcaggattataggcccaaagcgaccgggagaaagacgcctacgctggcatcccccgtgccaactaccccctttcttagacccgttcaccaggtcccactggtgcctcatgtcccgatggtcagaccagcccatcaacttcatccgggactggtgcaacgcatgcttgctcagggggtgcatccccagcacctgccaagcctgttgcaaaccggggtgctccctccagggatggatttgagccatcttcagggcatcagcgggccaattttgggtcaacctttctatcccctgcctgctgcttcacacccattgcttaacccacgccccggtacacccctccatttggcaatggtccagcagcagcttcagcggtcagtgctgcacccccctggatccggctcccatgcagccgccgtgtctgttcagaccaccccacagaatgtgccttcaaggtcaggcctgccccacatgcattcgcaacttgagcaccgtcctagtcagcggagctcctctcccgtcggtttagccaaatggtttgggtccgacgtactacaacaacccctaccttccatgccggcaaaggtaatatccgtggatgagcttgagtatcggcagtag

SEQ ID NO: 187159 - DNA, 1923 bp, Artificial Sequence
  Description of Artificial Sequence: Synthetic coding sequence
atgatcgaggacgtgctgggcgagggcagcgtgagcgccagccggttctctcggtggtttagtaatccgtcaaggtccggcagccgatcttcatctctaggctccacaccccatgaagagctggaaaggctggccggactggagcaggccatcctgtcccccgggcaaaattctgggaattacttcgcaccgatacccctcgaagatcacgcagagaacaaagtcgatatcttagagatgctgcaaaaagctaaagtcgacctgaaacctctgctgtcttcactctccgcaaataaggaaaagctgaaagagtcctcccattctggcgtggtgctaagcgtggaggaagtagaggccggtctgaagggcttgaaggttgatcaacaagtcaaaaactcaacacctttcatggcggagcacctggaggaaaccctgagcgcggtcaccaacaatcgccagctgaaaaaagatggtgatatgactgccttcaacaagctggtgagtaccatgaaggcctcaggcacgctgcctagtcagccaaaagtgagcgaactactgggccagccagtgcagaggcccgcttccagcaacctgctctccggtctgatgggctctctggagccaacaacgtctttgctgggtcagcgtgctccctcaccaccactgtcgcaggtcttccagactagggccgcttcggccgactatctcagaccaaggatccccagccctatcggctttacccccggaccacagcaactgctcggggacccattccaggggatgcgcaaacctatgagccctattacagctcagatgtcgcagctcgagcttcagcaggctgcactagaaggtctagccctgccacatgatctcgccgtgcaagctgcaaatttctaccagcccggcttcgggaagccacaagtggaccgtaccagagacggattccggaataggcagcaacgcgtcactaagtcaccagccccagtgcataggggaaacagcagctccccggccccagcagccagtataacaagtatgctgagcccaagcttcacccccacctctgtcattaggaaaatgtatgagtctaaagagaaatccaaggaggagccagcttctggaaaggctgcgctaggggattccaaagaagacacccaaaaagcgagtgaagagaacctactgtcctcatcgtctgtcccttctgcagacagagacagcagtccaacgacaaatagcaagctatccgctttgcagaggtcctcgtgctcaactccactgtcacaggcaaataggtatactaaggaacaggattataggccaaaggcaactgggcggaagactccaacactggcgagtcctgtccctaccacccctttccttaggccggtccaccaggtcccactggtgccccatgttcccatggtgcgcccagcccatcagcttcaccccgggctggttcaacggatgctcgcccagggagtccatccccagcatctgccatccttgcttcaaactggcgtcctcccacccgggatggacctgagtcacctgcaggggatcagtgggcccattctcggacagcccttttacccgttgcctgccgcatctcacccactcctcaatccccgaccgggcacccctctgcacctggccatggttcagcagcagcttcaaagaagtgtgctgcatcctccggggtctgggagccatgctgccgcagtttctgtacagactactccacagaatgtgcccagtcgttccggcctcccccacatgcactctcagctggaacataggcccagccagcgttccagctcacctgtgggacttgccaaatggtttggttccgacgtcctgcagcagccgctgccatctatgccggcgaaagtgataagcgtggacgaattggagtatagacagtag

SEQ ID NO: 187160 - DNA, 192 bp, Artificial Sequence
  Description of Artificial Sequence: Synthetic coding sequence
atggaccggcggagcatgggcgagaccgagagcggcgacgccttcctggatcttaagaaacctccagcatcaaagtgcccccatcggtacactaaagaggagctgttggatatcaaggaacttcctcatagcaagcaaaggccgtcgtgtctgagcgaaaagtacgacagcgacggagtgtgggacccctag

SEQ ID NO: 187161 - DNA, 192 bp, Artificial Sequence
  Description of Artificial Sequence: Synthetic coding sequence
atggaccggcggagcatgggcgagaccgagagcggcgacgccttcctggacctgaagaaaccgccagcaagcaagtgtccacaccggtatactaaggaggagttgctggacattaaagaacttccacactcaaagcagcggccaagctgtctcagcgagaaatatgactctgacggcgtttgggacccctag

SEQ ID NO: 187162 - DNA, 2886 bp, Artificial Sequence
  Description of Artificial Sequence: Synthetic coding sequence
atggaccggcggagcatgggcgagaccgagagcggcgacgccttcctggatctaaagaaaccccccgcgtctaaatgcccgcaccggtacacaaaggaagagctactcgatatcaaagaactgcctcatagtaagcaacggccctcttgtctaagcgagaaatacgattcagatggagtctgggatccggagaaatggcatgccagcctctatcccgcttcaggcaggagttctcctgtggagtcgctgaagaaggagttggacacagaccgtccttccctcgtgaggaggattgtagatccccgcgaacgcgtaaaggaggatgacctagacgtcgtgctgtctccccagcgccgtagcttcggagggggctgccatgtcaccgcagctgtctctagcaggcggagcggaagccccttggagaaagattccgacggactgaggttactgggcgggagacgaatcgggagcggccgaatcatctcagccagaaccttcgaaaaggatcacaggttatccgataaggatcttagagatctaagagacagggaccgcgaacgcgacttcaaagacaagcgcttccgcagggagttcggagattcaaagcgcgttttcggggagcgccgcaggaacgattcttatacagaggaagaaccagaatggttttcggcgggccccacctcacagtccgagactatagagctaactggcttcgatgacaaaatcctggaggaagaccacaaggggcgcaaacgaactcgaaggagaaccgcctcggtgaaggaaggcatcgtggaatgcaatgggggcgttgctgaagaggatgaagtggaggtgattctggctcaggaacctgctgccgaccaggaagtgccacgcgacgcggtgctccctgagcagagtcctggagacttcgattttaatgagttttttaatttggacaaggtcccctgcctcgcctccatgatcgaggacgtgctgggcgaggggtcggttagtgcgtcccgtttcagtaggtggttcagtaatcctagtcgcagcggttcacggtcgtctagcttgggctctactccccacgaggagctagagcggcttgccggactcgagcaggccatactcagtccagggcaaaactctggaaactacttcgccccaattcctctggaggatcatgctgagaataaagtggacatcctggaaatgcttcaaaaggccaaggttgacctgaaacctcttctgagttcgttatctgccaacaaggaaaagctcaaagaatctagtcactctggcgttgtgctgagcgtcgaggaagtagaagccggcctgaagggcctgaaagtagatcagcaggtaaagaattctactcccttcatggcagaacatctcgaggagaccctaagcgcagtcaccaacaatcgccagcttaaaaaagacggagatatgactgctttcaataagttagtcagcaccatgaaagcctccggcaccctgccttctcagcctaaggtctccgagctgcttggccagccagttcagcgacctgcctccagtaatttgctgtcggggttgatgggcagcctcgaaccaaccacatccttgctgggccaacgcgctccctcacctccgctgagtcaggtcttccagacgagagcagccagtgcagactatctgagaccaagaataccctcgccaatagggtttacccccgggcctcagcaattgctaggcgaccctttccagggcatgaggaagcctatgagtccaattactgcacagatgtcacagctagagctgcaacaggccgcactcgagggtcttgccctgccccatgatcttgctgtccaggccgctaacttctaccagcctgggtttgggaaacctcaagtcgaccgcactagggacggattccgaaatcgtcagcagagggttaccaaaagccctgctcctgttcaccgagggaatagttcaagtcctgcccccgcagcaagcataactagtatgctgagcccctcattcacccccacctccgttattcgtaagatgtacgaatccaaggaaaagtcgaaagaggaacccgcttccggaaaggctgctttgggcgattccaaggaagacactcaaaaggcatccgaagagaacttactgtcctcatcatctgttccttccgctgatcgtgactcaagccctactaccaatagtaagctgtcagccctgcagaggagtagttgttccacaccactcagccaggcaaacagatataccaaagaacaggactaccgacctaaggccactggacggaagacgccgacactcgccagtccagtgcctaccacgccattcctgcgcccagtacaccaagtaccgctggttcctcatgtcccaatggtgcgcccggctcaccagctacatcccggcttggtacagaggatgctagcacagggtgtgcaccctcagcacctcccaagcttacttcagactggcgtgctgcccccagggatggacctgagtcatctgcaggggatctccgggccaatactggggcagcccttttatcccttgcctgcggcatctcaccccctgcttaatccccgcccaggaactccacttcatcttgccatggtacaacagcagcttcagcgatctgtcctccacccacctggatcaggatctcacgctgccgcagtctcagtacagactacaccacagaatgttccatccagatctggattgcctcacatgcacagtcagctggagcacagaccatcccaaagatcttcctcacccgtaggtttggctaaatggtttggatcggatgtacttcagcagcccctgcctagcatgcctgctaaggtgataagcgtcgacgagctggaatatcgacagtag

SEQ ID NO: 187163 - DNA, 2958 bp, Artificial Sequence
  Description of Artificial Sequence: Synthetic coding sequence
atggaccggcggagcatgggcgagaccgagagcggcgacgccttcttggacctaaagaaacctccagccagcaaatgccctcatcgctatactaaggaagagctgctggacataaaggagctgccccactctaaacagcggccctcgtgcctctcagaaaagtacgacagcgatggagtgtgggaccctgaaaaatggcacgcctcactctaccccgctagtggaaggagctcgcccgttgaaagcctgaaaaaggagttggacacagatagaccgtcactggtgaggcgaatcgtagacccaagagaacgagtcaaggaggatgacctggatgtcgtgctaagccctcaaaggagaagttttggcggtggctgtcacgtgacggccgccgtgtcttcacgtcgatctggctcgcccttggagaaggattccgacggtttgcgtctgcttggcgggagaaggattggcagcggtcgaatcattagtgccagaacttttgagaaggaccataggctatccgataaagatctgcgcgatctgcgcgatcgcgaccgagaacgcgattttaaggataaaagattcaggagggagtttggggactcaaaacgggtgttcggagaacggcggcgcaatgacagctataccgaggaagagcccgagtggtttagcgctggtcccactagtcagagtgagaccatagagttgaccggatttgacgacaagattctggaagaagaccacaaaggtcgtaagcgtactcgacgtcggaccgcatctgttaaagaagggatcgtggagtgcaatggaggggtcgccgaggaagacgaggtggaagtgattctagcccaggagcccgctgctgaccaggaagtgcctcgggatgccgtgctgccggagcagtctcccggcgacttcgatttcaacgaattctttaatctggataaggtaccctgtctggcctctatgatagaagatgttcttggagagggatcggtatcagcctctaggttctctcggtggtttagtaatccatctcggtcgggttcgaggtcgtcctcccttggtagcaccccacatgaagaacttgagcggctggccggtcttgaacaagccatcttgtcacctggccaaaactctggcaactattttgcccccatccccctcgaagatcacgctgagaataaagtggatatactggagatgctgcaaaaggccaaagtcgacctcaaacctctcttgtcaagcctgtctgctaacaaggagaaactcaaggagtccagtcacagcggtgtcgtactctcagtggaagaggtggaggccggcctcaagggactgaaagttgatcaacaggtgaagaatagcactccatttatggcagagcacctggaggagaccctctccgcggtcactaacaaccgccagcttaagaaagatggcgacatgacagcctttaacaaacttgtgagtaccatgaaggctagcggcacactcccctcccagcctaaggtgtctcgcaacttagagtcacacctcatgtcgcccgccgagattccaggtcaacccgtccccaagaatatcttacaggagctcctgggccagcccgtgcagcgtcccgcatctagcaatctgctgtccgggctgatgggcagcctggaacctacaaccagtctgctcggacaaagggccccaagtccacccctctcccaggtgttccagacaagagccgccagcgccgactacttacgtcctcgcattccaagtcctatcggattcacccccggaccacagcagctgctgggggatcccttccagggaatgcgtaaacctatgagcccaataacggcacagatgtcccagctcgagcttcaacaggctgctcttgaaggattagctttgccccatgaccttgccgtgcaggccgctaacttttatcagccaggattcgggaaaccccaggtcgatcgtacccgagacgggtttcgcaatcggcagcagagggtaacaaaatcccccgctcctgtgcacaggggaaactcttcatcacctgcacccgccgcaagcattactagtatgctgtcaccatctttcacccccacatcagtcattagaaagatgtacgagtccaaagagaagtccaaagaagaacccgccagcggcaaagccgcattgggagattccaaagaagacacccagaaagctagcgaggagaatctcctctcttcctcgtccgtgccttctgccgaccgcgacagctctcctactacaaatagcaaactctctgctctgcagaggagtagttgtagtacccccctgagtcaagccaaccgttatactaaagagcaagactaccgtccgaaggctacaggtcgaaagacgccgactctggcgtcccctgtgcccacgacgccatttttgcgcccagttcaccaggtccccctggtgcctcatgttcctatggtgaggcccgcccaccagctgcatcccggactggtgcagcgaatgttggcgcagggcgtgcacccccagcacctaccctcactgttacagactggggtgcttcctccaggtatggacctgtctcatctgcagggcatctccggtcctattctaggacagcccttctaccccctccctgctgctagccaccctctgttaaacccgcggccaggaacgccgctccacttggcaatggtgcagcagcagctccaacggagtgtattgcaccctcctgggtctggcagccacgcggccgctgtatcggtgcaaactacaccacagaacgtgccttcaagatccggactgccgcatatgcattctcaactggaacatagaccttcccagcggtcctcatcaccagtggggctggctaagtggtttgggagcgacgtgctgcaacagccactgccttcaatgcccgctaaggttatctcagtggacgaactggagtaccgccagtag

SEQ ID NO: 187164 - DNA, 1311 bp, Artificial Sequence
  Description of Artificial Sequence: Synthetic coding sequence
atggaccggcggagcatgggcgagaccgagagcggcgacgccttcctcgacctcaagaagcctcccgcaagtaagtgtccacatcggtataccaaggaagaactgctggacatcaaggaattgccccacagtaaacagcgtccctcctgcctttcagaaaaatatgattcggacggggtttgggacccggagaagtggcatgcctctctctatcctgcaagtggccggagtagccctgtggaaagcctcaaaaaggaactggacaccgaccggccctccctcgtgaggcggatcgttgatccacgcgagcgcgtcaaagaggacgacctggatgtcgtactcagtccccaacgccgttcatttggcggggggtgtcacgttacagcggccgtttcctctcgcagaagcggcagtccactcgaaaaggatagcgacggactacggctgctgggcggccgtcgtattggtagcggaaggatcatctccgcacgaacattcgaaaaggaccaccggttgtctgacaaggacttgagggaccttagggacagagacagggaaagggactttaaagataagagattcagacgcgaatttggtgatagtaagagagtttttggagagaggaggcgcaacgatagctatacagaggaggagcctgagtggtttagtgccggtcctacgagccaatcagaaactattgaactgaccggtttcgacgataagatactggaagaagatcacaagggtcgcaagcggacacgcaggcgtacagcttccgttaaagagggtatcgtggaatgtaatgggggagtggccgaagaggacgaagtcgaggtcattctggcacaggaacctgccgcagaccaggaggttccccgggatgcggttctccccgagcagtcaccaggtgatttcgacttcaatgagttcttcaatctagataaggtgccatgtcttgcgtcaatgatagaggacgtacttggagagggctctgtaagcgcaagccgattcagtagatggttctcgaatccttccagatctggctcacgttcgtcttccctgggctccacgccacacgaggagctggagaggctcgccggtctcgagcaggcaatcctaagtcctggccagaacagtgggaactatttcgcccctatcccactcgaggatcacgccgagaataaggtcgacatcctcgaaatgctgcagaaggctaaggtggacctgaaacctcttttaagctctctttcagctaacaaagagaagctgaaagagtctttgcggctcagcccgaagaagaagaaaaagtag

SEQ ID NO: 187165 - DNA, 567 bp, Artificial Sequence
  Description of Artificial Sequence: Synthetic coding sequence
atggaccggcggagcatgggcgagaccgagagcggcgacgccttcttggacttaaaaaagccccccgcttcgaagtgcccgcacagatacacaaaagaggaactcctggacattaaggagttaccacattcaaaacagagaccaagctgcctgagcgaaaaatatgattcagacggcgtttgggaccccgagaaatggcacgcgtccctctatcctgccagcggtcgatcctctcctgtggagagtttgaagaaagaactggacactgataggccctccttagtcagacggattgttgatcccagagagcgggtgaaagaggacgacctggacgtcgtgctgtcgcctcagcggaggtcatttgggggcggatgccacgttaccgcagccgttagcagccgaagatccggctcacccctggagaaggattccgatggattgcggctgcttggtggccggcgaattggttccggacgtataatcagtgcccgcacgttcgaaaaggaccacaggttgagcgacaaggatctgagggaccttcgggatcgggatagagagcgggactag

SEQ ID NO: 187166 - DNA, 747 bp, Artificial Sequence
  Description of Artificial Sequence: Synthetic coding sequence
atggccgacttcgacacctacgacgaccgggcctacagcagcttcggggggggacgggggagcaggggatctgccggcggccatggttcacggtcgcaaaaggaattacccactgaacccccgtatacagcttatgttggcaacctgcccttcaacacagtccagggtgatattgatgcaatttttaaggacctaagcatccggagcgtacgcctggtgcgggacaaggacacagataagtttaaaggattctgttacgttgagttcgacgaggtagatagtctgaaagaggcactcacttatgatggtgcgttgctgggggaccggtctctacgagtggacatcgccgaagggcgtaagcaggataaagggggtttcggcttcaggaagggtggcccagatgatagaggaatgggctcatcccgcgagtccagaggtggatgggacagtagagatgacttcaacagcgggttcagagacgatttcctgggcggaagagggggttctaggccaggagatcgccgaacaggccccccgatgggatcccgctttcgggatggcccccctctgcggggcagcaacatggattttagagagcctacagaggaagagagggcacagcggccgaggctccaattaaagcctagaacggtagcaacacctttgaatcaggtcgcaaacccgaacagcgccatctttggcggtgctaggccccgggaggaggttgtccaaaaggagcaggaatag

SEQ ID NO: 187167 - DNA, 687 bp, Artificial Sequence
  Description of Artificial Sequence: Synthetic coding sequence
atggccgacttcgacacctacgacgaccgggcctacagcagcttcggcggcgggcgcggctcccgcgggtctgccggaggtcacggcagccggtctcagaaagaattgcctactgaacccccttacaccgcctatgttggtaatttgccattcaatacagtccagggggatatagacgcaatctttaaggatctgagtattcggagcgtcagactggtgcgcgacaaggatactgacaaatttaaggggttttgctacgtggagttcgacgaggtggactcactgaaagaggctcttacttacgatggggccctgttgggcgatcgctccttgcgggtggatatcgctgagggcaggaaacaagataaggggggctttggcttccgcaaggggggccccgacgatcggggttttcgggatgacttcttaggtggacgtggaggaagtcggcctggggaccggagaaccgggccccccatgggtagccggttccgggatggaccgcctctccgtggcagcaacatggatttccgagaaccaacagaagaggagcgggcccagagacctagactacaacttaagccgcgcacagtggcaactcccctgaaccaggtggccaacccaaactctgctatcttcggcggtgctagaccaagagaggaagtcgtgcagaaggaacaagaatag

SEQ ID NO: 187168 - DNA, 1050 bp, Artificial Sequence
  Description of Artificial Sequence: Synthetic coding sequence
atggaggcccacaacgccagcgcccccttcaacttcaccctgcccccaaactttggaaagaggcctaccgatttagccctgtcagtcatcctcgtttttatgctgtttttcataatgctttctctgggttgcactatggaattctcaaaaataaaggcccacctgtggaagccgaaaggtctggccattgctctcgttgcccagtacggcatcatgccacttaccgcttttgtactcgggaaggttttccgactgaagaatattgaagccttagcaatactggtttgcggctgctcgcccggtgggaatttaagcaatgtgtttagtctggcaatgaagggcgatatgaatttgtccattgtaatgacaacttgttctacattctgcgcactgggcatgatgcccctcttactttacatctatagtagggggatctacgatggggacctgaaggataaagtaccctacaagggaatcgtgattagcttagtccttgtgttgatcccatgtacaataggcatagtgctcaaatctaaaaggccccagtacatgaggtatgtcatcaagggtggtatgatcatcatactcctttgtagtgtggccgtgactgtcctttccgctattaatgttgggaagagtataatgttcgccatgacccccctgcttatcgcgacatccagcctgatgcctttcatcggattcttgctgggttatgtgctatctgcgctcttttgccttaatgggcgttgtagacgaaccgtgagtatggagaccggctgtcaaaatgtgcagttgtgcagcaccattttgaacgtagcctttccgccagaagttatcggtccactgttcttcttccctcttctgtatatgatcttccaacttggtgaagggcttttgttgattgcaattttttggtgttacgagaagttcaagactcccaaggataaaactaaaatgatttatacagccgcaaccacagaagaaacaattccaggcgctctcgggaatgggacctacaaaggagaagactgtagtccctgcaccgcctag

SEQ ID NO: 187169 - DNA, 1296 bp, Artificial Sequence
  Description of Artificial Sequence: Synthetic coding sequence
atgagcgtgaacgtgaaccggagcgtgagcgaccagttctaccggtacaaaatgccacgattaatcgcgaaagtcgagggtaagggtaacgggattaagaccgtcattgtaaatatggtagatgttgccaaggcgcttaacagacccccaacataccccaccaaatattttggctgtgaacttggagcacagacccagtttgatgtcaagaacgaccggtacatcgtcaatggatcccatgaggccaacaagctgcaagacatgctcgatggattcattaaaaagttcgtgctttgtccagagtgtgaaaatcctgaaacagatctgcacgtcaatcccaaaaagcaaacgataggcaattcctgcaaagcctgcgggtatcgagggatgctagatacacaccacaaattgtgcacgtttatattgaaaaatccgcccgagaattccgattctggcacaggtaagaaagagaaggagaagaagaatagaaagggaaaagataaagagaacggatctgtctcctcctctgagacaccccctccccctcctccacccaatgaaatcaaccctccgccacacacaatggaagaagaggaagacgacgactggggggaggacaccacagaagaggctcagcggcgaaggatggacgagattagcgatcacgcgaaagttttgactttatcagacgacctcgagcggactattgaagaacgggtgaatatcctgtttgatttcgtgaagaaaaagaaggaggaaggagttatcgattcctctgataaggagatcgtcgctgaagcagagaggttggacgtgaaggccatgggacctttagtgctcactgaggttctgtttaacgaaaaaattcgggagcaaatcaagaaataccgcaggcatttcttgcggttctgccacaataacaagaaagcgcaaagatatctcctccacggactggagtgcgtcgtcgccatgcatcaagcccagctgatctcaaaaatcccgcacatccttaaagagatgtacgatgctgatctgttggaagaggaggtgattataagctggtccgagaaagcgagtaagaagtacgtttcgaaagagttagcaaaggagatccgtgtcaaggcagaaccgtttataaagtggctcaaggaggcagaagaagaatcaagtggcggggaggaggaagatgaggatgagaacatcgaagtggtatatagtaaagcggcctcagttcctaaggtggagactgtaaagagcgacaacaaagacgatgatatcgacattgacgctatctag

SEQ ID NO: 187170 - DNA, 603 bp, Artificial Sequence
  Description of Artificial Sequence: Synthetic coding sequence
atgagcgtgaacgtgaaccggagcgtgagcgaccagttctaccggtacaagatgccgcgcctgatcgcaaaagtggaaggcaagggcaacggcattaaaacagttatcgtgaacatggttgatgtcgctaaggctcttaatcggccacccacttatcccacaaagtacttcggctgcgagctaggcgcccaaacccaattcgatgtaaagaacgacaggtacatcgtcaacggctcacacgaagcaaacaagttacaagacatgctcgatggattcataaaaaagttcgtattatgccccgagtgtgagaaccccgagacggacttgcacgtgaatcccaagaagcaaactattggcaattcctgtaaggcatgcggatatcgagggatgttagatactcaccacaagctgtgtacatttatactcaagaatcccccagaaaacagtgactccgggaccggcaaaaaggagaaagagaagaagaataggaagggtaaagacaaagaaaacggcagtgtgagcagctccgagaccccccctcctccacctcctcccaatgagatcaaccccccgccccacaccatggaagaagaggaggattag

SEQ ID NO: 187171 - DNA, 441 bp, Artificial Sequence
  Description of Artificial Sequence: Synthetic coding sequence
atgagcgtgaacgtgaaccggagcgtgagcgaccagttctaccggtataaaatgcctagactcatcgctaaagtagaaggtaagggcaatggcattaagacagtgattgtgaatatggtggacgtcgctaaagccttaaaccggcctcctacctaccccactaagtacttcgggtgtgagctgggagcccagactcaattcgatgtcaagaacgaccgctacatcgtgaatggctcccacgaagctaataaactccaggacatgctcgatggcttcatcaagaaatttgtcttatgtcctgaatgcgagaaccctgagaccgatttacatgtaaaccccaaaaagcagacgattggtaactcatgtaaagcttgcggctacagaggcatgctggacactcatcacaagctatgtacctttatcctgaagaatcccccttag

SEQ ID NO: 187172 - DNA, 1296 bp, Artificial Sequence
  Description of Artificial Sequence: Synthetic coding sequence
atgagcgtgaacgtgaaccggagcgtgagcgaccagttctaccggtataagatgccaaggttgatagcgaaggtggagggcaagggtaatggaatcaagactgtgattgtgaatatggtcgacgtcgccaaagccctcaatcgcccacccacataccccacaaagtattttggctgtgagttaggcgcccagacgcaatttgacgtcaaaaacgacaggtatattgtaaacgggtctcacgaagccaataaactgcaggatatgctggatgggttcatcaagaaattcgtcctctgcccggagtgtgagaacccagagacagacctccacgtgaaccctaagaagcagacaatcggaaactcctgcaaggcttgtgggtaccgcggaatgctggacacgcaccacaagctatgcacatttattctcaaaaacccccccgagaacagcgactcgggtacaggtaagaaggaaaaggagaagaaaaacagaaaaggaaaagacaaggagaacggtagcgtcagtagttcggagactcctcctccaccacccccccccaatgagatcaacccaccacctcacaccatggaggaggaagaggacgatgattggggcgaagacacgacggaggaggcccagcgccggcggatggatgaaatcagcgatcacgcgaaggtgttgaccctgagtgacgatctggagaggactattgaggaacgtgtaaacatcctgttcgatttcgttaagaaaaaaaaggaagagggggtgatcgactcatctgataaggaaatcgtggctgaggccgagcgtctggatgtaaaggcaatggggcctctggtattgacagaggtgcttttcaatgagaagatccgggagcagataaagaagtacagacgacactttctgcggttttgtcataacaataagaaggctcagcgctatctgctccacgggctcgagtgcgttgtggccatgcaccaggctcaattgatttctaaaattccacatattctaaaggagatgtacgatgcagacctgcttgaagaggaggtcatcatctcttggtccgagaaggcgtccaagaaatatgtgtctaaagaattagctaaggaaattcgtgtgaaagcggaaccatttattaagtggctaaaagaggccgaggaagaaagttccgggggagaagaggaagacgaggacgagaatatcgaggtggtttactcaaaagcagcaagtgtgcccaaggtggagactgtcaagtctgacaataaggatgacgatatcgatatcgatgcaatttag

SEQ ID NO: 187173 - DNA, 210 bp, Artificial Sequence
  Description of Artificial Sequence: Synthetic coding sequence
atgagcgtgaacgtgaaccggagcgtgagcgaccagttctaccggtataaaatgccccgtctcatcgccaaagttgagggcaagggaaatggcatcaaaacagtgattgtgaacatggtagacgtagccaaagccctgaatcgcccacctacgtacccaacaaaatattttggttgtgaactcggagcacagacccagttcgatgtctag

SEQ ID NO: 187174 - DNA, 330 bp, Artificial Sequence
  Description of Artificial Sequence: Synthetic coding sequence
atgagcgtgaacgtgaaccggagcgtgagcgaccagttctaccggtacaagatgcccagactgatcgcaaaggtggagggaaagggtaatggtataaagactgtgatcgtgaatatggtcgacgtcgccaaagccctgaatagacctccgacctacccgaccaagtacttcggctgcgagcttggagcacagactcagtttgatgtaaaaaatgaccgctatatagttaatggttcccatgaagccaacaagttgcaggacatgcttgatggcttcatcaaaaagttcgtcctttgccctgagtgtgaaaaccccgaaactgatctatag

SEQ ID NO: 187175 - DNA, 306 bp, Artificial Sequence
  Description of Artificial Sequence: Synthetic coding sequence
atgagcgtgaacgtgaaccggagcgtgagcgaccagttctaccggtataagatgcccaggctgatcgcgaaagtggagggtaaaggaaatggaatcaagaccgtcatcgtcaacatggtggacgttgccaaagccctaaatcggcctccgacgtaccctaccaagtacttcgggtgtgaactgggagcccagacacagtttgacgtcaaaaacgatagatatatagtcaacggctcccacgaggctaacaagctgcaagacatgctggacggtttcatcaaaaagtttgtgctatgtcccgagtag

SEQ ID NO: 187176 - DNA, 156 bp, Artificial Sequence
  Description of Artificial Sequence: Synthetic coding sequence
atgagcgtgaacgtgaaccggagcgtgagcgaccagttctaccggtacaaaatgccgagattgatagctaaggttgaggggaaagggaatggcatcaagacagtgatagtgaacatggtggatgttgcaaaggctctgaacagaccccccacctag

SEQ ID NO: 187177 - DNA, 330 bp, Artificial Sequence
  Description of Artificial Sequence: Synthetic coding sequence
atgagcgtgaacgtgaaccggagcgtgagcgaccagttctaccggtataagatgccacggctgattgctaaggtggagggaaaggggaacggaattaaaactgtcatcgtcaacatggttgacgtggctaaggcacttaacaggccgccaacctacccaaccaaatattttggttgcgaattgggtgcccagactcagttcgacgtcaagaacgacaggtatattgtgaatggatcgcacgaggccaacaaattgcaagacatgctagacgggttcattaaaaaattcgtgctgtgtcccgaatgcgaaaacccggaaacggacttatag

SEQ ID NO: 187178 - DNA, 555 bp, Artificial Sequence
  Description of Artificial Sequence: Synthetic coding sequence
atgtgcggcaccggcggcaccgacagcaagacccggcggcccccccaccgcgcctcgttcctcaaacgactagaaagcaagcctttgaagatggctgacgatctcgatttcgaaaccggcgacgctggggcctctgccacgttccctatgcagtgttctgctctgcgaaagaatggtttcgttgtcctcaaaggcaggccctgcaaaattgtcgagatgtccacaagcaaaaccggaaagcatggccatgccaaagtgcacttggttggaattgacatcttcacagggaagaagtacgaggacatctgcccctcaacgcacaatatggacgtcccaaacattaagcgcaacgacttccaattgattgggatacaagatgggtatctctccctcctccaagactcgggtgaggtgcgcgaggatctgcgtttgccagagggggacctgggcaaggagatcgaacagaaatacgattgcggcgaagagattctaattactgtgctctctgcaatgaccgaagaagccgctgtagctatcaaggctatggcaaagtag

SEQ ID NO: 187179 - DNA, 465 bp, Artificial Sequence
  Description of Artificial Sequence: Synthetic coding sequence
atggccgacgacctggacttcgagaccggcgacgccggcgccagcgctacctttcccatgcagtgttctgctttacgcaagaacggattcgtggtgctgaaagggcgaccgtgcaagattgttgaaatgtcgacatctaagacaggtaaacatggccatgcaaaggtacatctcgtgggcatcgatatctttaccggaaagaagtatgaagacatctgtccctctacccataatatggacgtgccgaacattaaaaggaacgactttcagttgataggtatccaggacggctacctgtcactgctacaggattcaggggaagtcagggaggacttgcggctgccagagggcgacttgggcaaagaaattgaacagaaatatgactgcggcgaggaaatactcatcaccgtgctcagtgctatgaccgaggaggctgcagtcgctattaaggccatggcaaagtag

SEQ ID NO: 187180 - DNA, 645 bp, Artificial Sequence
  Description of Artificial Sequence: Synthetic coding sequence
atgacctggaccagccggcaggagatgcagggcccccagcccccctcgcagtgttctgctcagcactatgtgcggatggcactctggtgctctaaggcaggccatgtccgaagtagtcggtgcctgcttcggcgccttgcaagcactgccaccccacggctcgagtttcatctccggattctaccctctccatgcctgcagtacctctggagatcccagcagcaggcagccaactctgcggacttcccactgacactactactgctgagcgattgcttttgcctggccctgtccctccatacacacagcgataactatacttgttccccagtattctccctcttttgtgggtatcccagtgtcccggcttcgttctccggtagcccctccgtgagccccgccctgtgccagagcctccagttcataggtctgtacgctctggccatacagctgcttcttccgtattcttggttctccctgttcctgtcatcactggagccgctgctgtctggatgttttcaccacgtggcccaggggtttagcaactccacaccaagcccaggaggaacccccgcttctatactgtcctttcaagtgacattgctcttacgcagtcccgtcctggccttccccctggaattgtag

SEQ ID NO: 187181 - DNA, 465 bp, Artificial Sequence
  Description of Artificial Sequence: Synthetic coding sequence
atggccgacgacctggacttcgagaccggcgacgccggcgccagcgcaaccttccctatgcagtgcagtgccttgaggaaaaatggcttcgtggtcttgaaaggacgcccttgcaagatcgttgaaatgtccacgtcaaagaccgggaagcatggccatgcaaaggtacacctggtggggatcgatatctttacgggaaaaaaatatgaggacatctgtccttcaacacacaacatggacgtgccgaacataaagagaaacgatttccagctgataggaatccaggacggctacctgtctctattacaggactccggagaagtcagggaggacttgcggctgccggaaggcgatctgggcaaagagatcgagcaaaaatatgattgcggcgaagagatacttataacggtcttaagcgccatgaccgaagaagctgcagtcgccatcaaggccatggctaagtag

SEQ ID NO: 187182 - DNA, 465 bp, Artificial Sequence
  Description of Artificial Sequence: Synthetic coding sequence
atggccgacgacctggacttcgagaccggcgacgccggcgccagcgcaaccttccctatgcagtgcagcgctctccgtaagaatggctttgtggtcctcaaaggtcggccttgcaagatcgttgagatgtcaacttccaaaaccggtaaacacggccacgctaaagttcacctggttgggatagatatttttactggaaaaaaatacgaggatatatgcccctctacccacaatatggacgtgcctaatatcaaacgcaatgatttccagttaatcggcattcaggacggatatctgagccttctccaggattcgggagaggtaagagaggatctgcggctccctgaaggggacctgggcaaagagatcgaacagaagtacgattgtggggaagagattctgattacggtcttatccgcaatgacagaagaagcagccgtcgccattaaggccatggcgaagtag

SEQ ID NO: 187183 - DNA, 462 bp, Artificial Sequence
  Description of Artificial Sequence: Synthetic coding sequence
atggccgacgagatcgacttcaccaccggcgacgccggcgccagcagcacatatcctatgcagtgctctgctctgcggaagaatgggtttgtggttttgaagggccgcccctgtaagattgttgagatgtcaacttcaaaaaccggtaaacatggtcacgctaaggtgcacctggttgggatcgatatttttaccggcaagaagtatgaggacatttgcccatcaactcacaacatggatgtgcccaatatcaaacgcaatgactatcagctcatatgcatacaggatggatatctgagtctgttgaccgagacaggagaagttcgcgaagatttgaagttgcctgaaggcgagctgggcaaggaaattgagggcaagtacaatgcaggagaggacgtgcaggtttcggtcatgtgtgccatgagcgaagagtacgcagtggctatcaagccatgtaagtag

SEQ ID NO: 187184 - DNA, 738 bp, Artificial Sequence
  Description of Artificial Sequence: Synthetic coding sequence
atggccgtgcgggccagcttcgagaacaactgcgagatcggctgctttgccaaactcacaaacacctattgtctggttgccatcggaggctctgagaatttttactctgtgttcgagggtgagctgagcgacacaattcccgtcgtacatgcatctattgccggctgcagaatcatcgggagaatgtgtgttgggaacagacacgggctactggtgccaaataacacaacagaccaagagttgcagcatatcagaaactccctccctgatacagtgcagatccgccgcgttgaggagaggttgtcagccttgggtaacgtgacaacgtgcaacgactatgtagctctggtccatcccgacctcgatcgcgagactgaggaaattcttgccgacgtgctgaaggtagaagtgttccgccagactgttgcagaccaggtgcttgtgggttcttactgcgtgttttctaatcagggaggactagtccatccaaagacttcgatagaagatcaggacgaactgagctccctcctccaggtgcctctcgtggccggcacagtgaatcggggctctgaggtgatcgctgcaggaatggtagttaacgactggtgcgccttttgcggcttagacaccaccagtacagaattatcagtagtcgaatcagtgttcaagcttaacgaagctcagccaagcactattgcaacttccatgcgcgactccctgatcgattccttgacctag

SEQ ID NO: 187185 - DNA, 681 bp, Artificial Sequence
  Description of Artificial Sequence: Synthetic coding sequence
atggccgtgcgggccagcttcgagaacaactgcgagatcggctgcttcgccaaactgactaatacctactgtctggtagccatcgggggatcggaaaatttttaccgttgcgggggcagccctggggcttacggcgggggcgaagcctgtgccggcgttaaaagttctggaagcgggagggtgcctgccccactgcctcgacatcatcgcgttcacgtgcctacggtgtgctcaagagcctcatctcctatcccaagtccttggtgtacgagactcagtcccgcagccgcctcttctggcgcttgtgtgtgggaaaccgaggagatactcgctgacgtgctgaaggtggaagtgttccggcagacagtggcagaccaggtgttggttgggtcttactgcgtctttagcaaccaaggtgggttagtgcatcccaaaacttcaatcgaagaccaggatgaactgtcttccctattacaagttccgctggtagcggggacagtaaatcggggctccgaagtgatagctgccgggatggttgtgaacgattggtgcgctttctgtgggctggacaccacctcgactgagctgtctgtggtggaaagtgtatttaagctgaatgaagcgcagccatcaaccattgcaaccagtatgagggactcccttattgatagtttaacctag

SEQ ID NO: 187186 - DNA, 738 bp, Artificial Sequence
  Description of Artificial Sequence: Synthetic coding sequence
atggccgtgcgggccagcttcgagaacaactgcgagatcggctgcttcgccaaactgaccaacacttactgcctcgttgctattggcggatctgaaaacttctactctgtgttcgagggcgagttatctgataccataccggtagttcatgcaagcatcgccggatgtcgaatcatcgggagaatgtgtgtcgggaatcgccacggcttgctcgttccgaataatacaacagatcaggagctgcagcacatccggaactccctgcccgacaccgtgcagatacgacgcgtggaggagcggcttagcgcgcttggaaacgtgaccacatgcaatgactatgtggccctagtgcacccggaccttgaccgcgaaactgaagaaatcttagcagatgtcctgaaggtggaagtctttcggcagactgttgctgatcaagtgctcgtaggaagctactgcgtgttctctaatcagggaggcctggttcatcctaaaaccagcatagaggaccaggatgaattatccagcctgctccaagtgccgcttgttgccgggacagtcaatcgaggctccgaagtgattgccgctggtatggttgtcaacgattggtgcgcattttgcggccttgatactacaagtacagagctttcggtcgtggagtctgtatttaagttgaatgaagcacagccctccaccatcgctacctctatgagagactctctgattgactctctgacgtag

SEQ ID NO: 187187 - DNA, 327 bp, Artificial Sequence
  Description of Artificial Sequence: Synthetic coding sequence
atggccgtgcgggccagcttcgagaacaactgcgagatcggctgctttgcaaagctgactaacacctactgcctggtggctattggaggctccgaaaacttctattccgtgttcgagggggagcttagcgacaccatcccagtcgtgcacgccagtatagcaggttgccgcattatcggacgcatgtgcgtcgggaataggcatgggctacttgtcccgaataataccacagatcaggaacttcagcatatcagaaattctctgccagataccgtacagatcagaagggtcgaggagaggctctctgcgcttggcaatgtgacatag

SEQ ID NO: 187188 - DNA, 1314 bp, Artificial Sequence
  Description of Artificial Sequence: Synthetic coding sequence
atggccgacgaccccagcgccgccgaccggaacgtggagatctggaaaattaaaaagttaatcaagagtctcgaggccgcccgtggaaatggtacaagcatgatctcgctcattataccacctaaagatcagataagcagggtagccaagatgctggccgatgaattcggaaccgccagcaacatcaaaagtcgcgttaatcgcctctccgtcctcggagcaattacaagcgtgcagcagcgtctcaaactctataacaaagtaccccccaacggactcgtggtctactgcggaacaatagttacagaagagggcaaggagaaaaaagttaacattgacttcgagcctttcaaacctataaatacctctctatacctatgcgataacaagttccacaccgaggccttaaccgccctcctttctgacgactccaagttcggttttatcgtgattgatgggagtggggctctgtttggtacactccaaggaaacacgcgggaggtgctgcacaaatttactgtcgatctgcccaaaaagcacggtcgcggagggcagagcgctttgcgattcgccaggttacgcatggagaagagacataattacgtccgaaaagtggctgagacggctgtgcagctgttcataagcggagataaagtgaatgtggcggggttggtgctggccggctccgctgacttcaagacagagctaagccagtctgatatgttcgaccaaaggctgcaaagcaaagtgttaaagttggttgacataagctatggcggggaaaacggtttcaaccaagccattgaactgtcaactgaggtcctgtctaacgtgaaatttatccaggaaaagaagctaattggtagatacttcgatgagattagccaggacaccggcaaatactgtttcggggtcgaagatacactgaaagcgttagaaatgggcgccgttgaaatactgattgtgtatgaaaacctggatatcatgcgttacgtcctgcattgtcagggaacagaggaagagaaaattctgtacctgacccccgagcaggagaaggacaaatcgcactttacggacaaggaaacaggccaggagcatgagctgatcgaatccatgccacttttggagtggtttgccaataattataaaaagttcggcgctacccttgagatcgtgactgataagagtcaagaaggttcgcaatttgtaaagggatttggtggtatcggaggaattctccggtatcgagtggatttccagggcatggagtatcaggggggggatgacgaatttttcgaccttgacgattactag

SEQ ID NO: 187189 - DNA, 1215 bp, Artificial Sequence
  Description of Artificial Sequence: Synthetic coding sequence
atgatcagcctgatcatcccccccaaggaccagatcagccgggtggccaagatgttggctgatgagttcgggacagctagcaacatcaagtcacgcgtcaaccggctaagtgttctgggcgcgatcacatccgttcagcagaggcttaaactgtataacaaagtgcctccgaatggtttggtcgtttactgtggcacaattgtaactgaggaaggcaaggagaaaaaggtgaatatagactttgagccctttaagcctatcaatacctcattgtatctttgcgataacaagtttcacaccgaggccctcacagccctgctgtccgatgacagcaagtttggctttatcgtaatagatggctcaggagctctgtttggaaccctgcaggggaatactagggaggtattgcacaaattcactgtcgacctgccaaagaagcacgggaggggcggccagagcgctctgcgcttcgcacggctcaggatggagaagagacacaattatgtaagaaaggtggctgagacagctgtccagctattcatctcgggcgacaaagtgaacgtggcggggctcgtgctggccggctccgcggatttcaagacggagttgtcccagagcgatatgttcgatcagaggcttcagagtaaagtcctgaaactcgtcgatatttcctatggaggagaaaatggatttaatcaggccatagagctttccacagaggtcttaagcaacgtgaaattcatccaagagaagaagctgatagggaggtactttgatgaaattagtcaggatacagggaagtactgctttggagtggaggataccctcaaagccctggaaatgggcgctgttgaaatcctgatagtgtatgaaaatcttgatatcatgcgctatgtgctgcactgccaaggaaccgaggaggagaagatcctgtacctgacccccgaacaggagaaggataagtcccactttactgacaaggagaccgggcaggaacacgaactcatcgaaagtatgccgctgctcgaatggttcgccaacaattacaagaaattcggagccacactggagatagtcaccgacaagtcacaggagggttctcagttcgtgaaaggcttcggaggcatcggagggatactaaggtacagagtggatttccagggaatggagtatcaggggggtgatgacgaattcttcgacttggacgactattag

SEQ ID NO: 187190 - DNA, 1272 bp, Artificial Sequence
  Description of Artificial Sequence: Synthetic coding sequence
atgaagcaggacgtgctgaactgcaccgagggccccatccacagcaacggaacttctatgatcagcttaataatcccccccaaagaccagatctctcgtgtggccaagatgctagcagacgaatttgggacggcctccaacattaagagtagagtcaatcgtctgtcagtgctgggagcaattactagcgttcaacagagactcaagctgtataacaaagtgcctcccaatggtcttgtggtgtactgtggtaccatcgtaactgaagaggggaaggagaaaaaggttaatatcgatttcgagcccttcaaacctatcaataccagcctttacctctgtgacaacaagttccatactgaggccctgactgctttgctgtctgatgacagcaaatttgggttcattgtcatcgatggttcgggcgccctgttcggcacactgcaaggtaacactcgagaggttctgcataaatttactgttgatctgcccaagaagcatgggcggggaggacagtccgccctgaggttcgcccgtctaaggatggagaagcgacacaactatgtgcgcaaggtggcggaaacagctgtgcagttgtttatctctggggacaaggttaacgtggctggtctcgtgctcgctggatccgccgactttaagactgagttgagccagtccgacatgttcgatcagcgcctgcagtcaaaggtgctgaagctggtggacatatcctatgggggcgaaaatggatttaatcaggcaatcgaactgagcacagaagtactgagcaatgtgaagttcatccaggaaaaaaagctgatcggtaggtattttgatgaaatatcacaggatacggggaaatattgtttcggagtcgaagacacgctgaaagcgctggagatgggagccgtggaaattctgatcgtgtacgaaaacctggacattatgcgctacgtgctgcattgtcagggaacagaagaagaaaagatactctatctcaccccagagcaggaaaaagataaatcacatttcacagacaaagagacagggcaagagcacgaactgattgagagcatgcccctgcttgagtggttcgccaataactataaaaaatttggtgccaccttagaaatcgtgaccgacaaatctcaggaagggtcacagtttgtgaaaggatttgggggcatcggaggcatactccgttacagggttgattttcaagggatggagtatcaggggggcgatgatgagtttttcgatctcgacgactattag

SEQ ID NO: 187191 - DNA, 1224 bp, Artificial Sequence
  Description of Artificial Sequence: Synthetic coding sequence
atggagagccggaaggacatggtggtgttcctggacggcggccagctcggaaccttggtcggaaagcgggtctccaacctctcagaagctgtggggagccctctgcctgagccccccgagaaaatggtgccccgcggctgccttagcccacgcgctgtccctcctgccacccgagagcggggcggtggaggcccagaagaggagcccgttgatggactggccggatcggctgccggccccggggctgagcctcaagtggcaggtgctgcgatgctgggcccggggcctccagccccgagcgttgactcgctgtctggccaggggcaaccgagttcaagtgataccgaaagtgacttctatgaagagatcgaggtttcctgcacacccgactgcgccactggcaacgcagagtatcagcattcgaaggggagcggatcagaggctttggttggatccccaaacggaggatcggagacacctaaatccaacggcggcagcggcggcggcggttcccagggaacacttgcttgtagcgctagtgaccagatgagacgctacaggacagcctttaccagggagcagattgcccgattggagaaagaattttatcgagagaattacgtctctcgtcctcgtagatgtgagctagcagccgcactgaatctgccagagactacaatcaaggtctggtttcagaacaggcggatgaaagataagcggcaacgtcttgcaatgacctggcctcaccctgcagacccagccttctatacctatatgatgtctcatgctgccgcagccggcggcctgccttatcctttcccgagtcacttacctctaccatattactctcctgtcggactcggcgctgcttcagcagcttccgctgcagcctcccccttcagcggctctctgagacccttagatacattccgggtgctgagccagccctatcccaggcccgaactcctgtgcgcattccgtcaccccccactgtacccaggcccggcgcacggtctgggcgctagcgcaggcggcccctgttcttgtctggcatgtcatagcgggccagcgaatggattggcacctcgcgcggctgctgccagcgacttcacttgcgcctccactagcaggagcgactcgtttctgaccttcgcacccagtgtcctgagtaaggcttcatccgtggccctcgatcagagggaagaggtgcctttgaccagatag

SEQ ID NO: 187192 - DNA, 678 bp, Artificial Sequence
  Description of Artificial Sequence: Synthetic coding sequence
atgcggcggtaccggaccgccttcacccgggagcagatcgcccggctcgagaaagagttctaccgcgaaaactacgtgtctcggccgaggagatgtgaactcgcggcagccttaaacctccccgagactaccattaaggtgtggttccaaaaccggcgaatgaaggataaaagacaacgtctcgctatgacatggccccatcctgctgatccggctttctacacatacatgatgtctcatgctgctgccgctggcggacttccctatccctttcctagtcatctccccttgccatattattccccggtgggccttggtgcggccagcgcagcttcagccgccgcctctccgttcagtggcagccttcggccgctcgacacctttcgggtattaagccagccttaccccaggcctgagctcctatgcgctttcagacacccgccattatatcctggacccgcacacggcctgggggctagtgcgggtggtccttgttcctgcctcgcctgccactctggccctgcgaatggcctggctcctcgagctgcagccgctagtgatttcacatgtgcatccacatcccggtccgatagctttctgacttttgcacccagcgttttgtccaaggcaagcagcgtcgctcttgaccagcgagaggaggtgcccttgactcgatag

SEQ ID NO: 187193 - DNA, 1431 bp, Artificial Sequence
  Description of Artificial Sequence: Synthetic coding sequence
atgatggagcggatccggaaggagatgatcctgatggagcggggcctgcacagtcctactgctggcaaacggttttctaatctgtccaactccgcggggaatgccgtgctggaagccctggagaattcacagcatcccgctagattatccccgcgtctgccctccgcgcccctccactcggccttgggggaattacccgctaagggtaagtttgagatagatacactttttaatctgcagcacacagggagtgagagcacagtgtcttccgaaatttcatcagctgctgaatcccgaaagaaacctggccattatagcgaggccgcagcagaggctgacatgtcctccgacgtggaggtcgggtgctccgccctgcggtcgcctggtggactgggggccgcacagttgaaggagaataacggcaagggatatgccgaatccggcagtgccgccggcacaaccacttccgcctcaggcagtgggttaggttctctgcatggaggttcagggggcagcggaggcagtgccgcactgggtggctctggctcaggcgcggatcaagtccgcagataccgaaccgcctttacccgagagcagattgctcgcctggaaaaggaattttacagagaaaattatgtctcgagaccacgccggtgtgagctggccgccgcactcaacttacccgaaactaccattaaagtctggttccagaaccgaagaatgaaggacaagcggcagagactggcgatgtcatggccccaccctgctgacccctctttctacacttacatgatgactcacgctgccgccactggttcactaccatatcctttccacagccacgtgccattacactactatccccacgtgggagtaaccgctgctgccgccgctgcagctgcaagcggagctgctgccgcggcgagctccccattcgcgacaagcattaggcctctggacacttttagggccctgagccatccctactcccgcccagagctgctatgtagctttcgtcatcccggtctgtaccaggcccccgcagccgccgccggccttaactcagctgccagcgcggctgctgctgcagctgccgccgctgcggcggcatccagcgccgccgctgccggggccccaccgagcggaggctctgctccatgctcatgcctgtcgtgccattccagccaaagcgcagcagctgctgctgcggctgctgctgccgctcttgggagccgcgggggaggaggtggaggaggtggcgggggaggcggcggcggcgggggcgccggagcagggggtgggtcagattttggttgcagtgcggcagcaccccggagtgagtccggattccttccctacagcgctgccgttttgtctaaaacagccgtgtccccgcccgaccagagagacgaagcccctctgaccaggtag

SEQ ID NO: 187194 - DNA, 2781 bp, Artificial Sequence
  Description of Artificial Sequence: Synthetic coding sequence
atgagccggcggcggaagcacgacgacagccccagccccaagaagaccccccacaaaactgtcgcagcggaagaatgtggtagcgtcgtagagccgggcaggaggcggttacggagtgcaagaggcagctggccgtgtggagcacgcgagggcccacctggacccgtgagacagagagagcagcctcccaccgccgccctgtgttcaaagtctaacccggaagaacgctatgagacccccaagagagctcttaaaatggactccttatccagcagcttcagctctcctaatgatcccgatggacagaatgacatcttctgggatcagaattcacccttaaccaagcagctaggtaaaggacggaagaaacagatttatacgacagatagcgatgagatttctcatatcgtcaaccgtatagccccccaggatgagaagcccacgaccaatagcatgctggacatgtggatcggcgagacggccatcccgtgcaccccttcggtggccaagggtaagagtcgagccaagatttcctgcaccaagctgaagacccagtcacaagaagaagagctgatgaaacttgccaagcaatttgataaaaatatggaggagttggacgtcatccaagagcagaacaaaaggaattacgacttcacgcagatgattagtgaaacagagatcctctctaactacaaagataacatccagatgtggagccttcataatatcgtcccagagatcgacaacgccacaaaaaagcctatcaaagggaacaccaagatctcagtggctaacaatcagaacagttctcagaagcccttcgaccagatcgcagaggcagcctttaacgctatttttgatggctctacacagaagtgcagcgggcagctaagtcaagaactgcccgaagcattttggtctacatctaacactacgttcgttaagactaacgctctgaaggaggaaaaaattattacaaacgagactttggttatcgaaaaactgagtaataagacgccaagaagtctgagctcacaagttgatacccctattatgaccaaatcctgcgtgacaagctgtactaaagagcccgaaacctcgaataagtacattgatgccttcacgacctcagacttcgaagacgactgggagaatctactaggcagcgagcccttcgcgatgcagaatatagatatgccagaactgttcccgtccaagactgcccacgtgacagatcagaaggaaatctgcacctttaactccaaaactgttaagaatactagccgggccaacacttctccagatgctcgattgggagacagcaaagtgcttcaggatctctccagtaagacctatgatagggagctgatcgatgcggaatatagattctctcctaactcaaataaatcaaataaacttagtactgggaataagatgaagtttgagaacagtagtaataagatcgtgatccaggacgaaatccagaactgcatcgtgacctcgaacctgaccaaaattaaagaggacatattgacaaactccactgaggcaagcgagcgaaaatccgcccttaacacaaggtacagtaacgaacagaagaacaaatgtatccttaaccagagcatcaaagcccctgtgaatactgacctgtttggatctgcaaatctggggtcaaaaacctcagttagcaatcccaatcagaccagcgcgagcaaggtcggctctttttttgacgactggaatgacccaagcttcgcaaacgagataatcaaagcctgccaccagttagataatacgtgggaagccgatgatgttgacgatgacctgctataccaagcctgcgatgacatagaaaggttgactcagcagcaggatattcggaaagattctaaaacatccgaatccatctgcgagataaacaacaactctgaacatggagccaagctgacacagcagcaggatattcgcaaggactcgaaaacaagcgaatctatctgtgagattaacaacaattccgagcacggcgcaaagaatatgttcgcgatttcaaaacagggtagcaatctggtgcagagcaaacatctcaatcctgggagcatttctgttcaaacatcactgaccaatagctcgcagatcgataagccaatgaaaatggagaagggggaaatgtatggcaattccccccggttccttggggccactaatctgaccatgtacagcaagatttccaattgtcaaatcaataatttgcacgtttcttacacaaacaccgacgtacccatacaggttaactcttccaaattagtgctccctggctctagtagcctcaatgtcactagtgaccacatgaatacagagattacaacttataaaaagaagctgagtaccaaccagccttgccataaaaccgtcactgatgaggctcaatcaaatcttaacactacggttggattttctaagtttacattcacccggatgaaaaattcccaaatactgtctcagtttaaccaaaattgtatcacggggtcgatgtctgatactaagataacacagggcgtcgagaaaaaaaagggagttaacccattgctcgaagaggcagttggccagcagtcccttgtgaaactgtccgagtcactgaagcagtccagtaaggaggaagaggaaaaaaaccgaaaatgctcgccagaagaaatccagcggaagaggcaggaagccttagtccggcggatggcgaaggcccgtgccagttctgtgaatgcggctccaaccagttttctgtag

SEQ ID NO: 187195 - DNA, 2349 bp, Artificial Sequence
  Description of Artificial Sequence: Synthetic coding sequence
atgggcaagcgggaccgggccgaccgggacaagaagaagagccggaagcggcattatgaggacgaagaagacgacgaggaagacgcccctggtaacgacccacaagaagcagtgcctagcgctgcagggaagcaagttgatgaatctggcacaaaggtggatgagtatggggccaaggattatcggctgcagatgcctctaaaggacgatcatacgagccggcctctgtgggtcgccccggacggacacattttccttgaagctttttcccctgtatataaatacgcccaggactttctcgtggctattgcagaacccgtttgccggcctactcatgttcacgagtacaagttgaccgcatattccctgtacgcagctgtgagcgtgggcctgcagacctccgacattaccgaatacctgcgcaagctgagtaaaactggagtgcccgatggcattatgcagttcatcaagttgtgcaccgtgagctatggcaaggttaaattggtgctgaagcacaacaggtacttcgtggaatcatgtcacccggacgtaattcagcatttgctccaggatcctgtaatccgtgagtgccggcttagaaattccgaaggcgaagccacagaattaattacggagactttcactagtaaaagtgccatctccaagacagctgagagctctgggggcccatccacgtcgagggtaacggatccccaagggaaatctgacattcctatggatctgtttgacttttatgagcagatggacaaagacgaagaagaagaggaggagacccaaactgtctctttcgaggtgaagcaggagatgatagaagaactccagaaacggtgtattcacttggagtatccattattagccgaatatgattttcggaatgacagtgtgaaccctgatatcaatattgacctcaaacctactgctgttctgagaccttatcaggaaaagagtttaagaaaaatgtttggaaacggtcgggcgagatcaggcgtaatcgttctcccatgtggcgccggcaagtcattagtgggtgtcactgctgcctgtacagttcgcaagcgctgtctggtgctgggtaactctgcagttagtgtggagcagtggaaagctcagttcaaaatgtggtctacaatcgacgactcccagatttgtcggttcacgtccgatgctaaggacaaacctattgggtgtagtgtcgctatttcaacctacagcatgttgggtcatactaccaagcgctcttgggaggccgagcgcgtgatggaatggttgaaaactcaagagtggggcctaatgattttggatgaggtgcacacaatcccagccaagatgttccgccgtgtcctcacaatcgtgcaggcgcactgtaagctggggctgaccgcaaccctcgtacgcgaagatgataagatcgtggatttgaactttctgattggtcccaaactatatgaggctaattggatggaacttcagaataacgggtacatcgccaaggttcagtgcgccgaggtatggtgtccaatgtcgcctgagttttaccgagaatatgtagctataaaaacaaagaagcgaattctgctgtacacaatgaatcctaataagtttagagcctgtcagtttctgataaagttccatgagcgccggaacgacaaaataatcgtgttcgcagataacgtgttcgctctcaaagagtacgcaatccggctgaataaaccctatatttatggcccaactagccagggcgagcgcatgcagatcttgcagaacttcaaacataaccctaaaatcaacaccatattcatatcaaaggtgggtgatacgagtttcgacctgcccgaggctaatgtactgatccagatcagttctcacggaggttccaggaggcaggaggcacaacgcctgggccgcgtgctgagagctaaaaagggtatggtcgctgaagagtacaatgctttcttttacagcctggtgagccaagatacacaggaaatggcatacagtactaagagacagaggtttctagtagaccaggggtactccttcaaagttataacaaagcttgccggtatggaagaggaagatttggccttcagtaccaaagaagaacagcagcaactgctgcagaaggtcctggctgctacggatttagacgcggaggaggaggtggtggcgggggaattcggcagcagaagctcacaagccagtcgccgatttggcacaatgagctctatgtccggagcagacgacacagtttacatggaataccatagttctcgcagcaaagccccctcgaaacatgtgcaccctctgttcaaacgctttcggaagtag

SEQ ID NO: 187196 - DNA, 2157 bp, Artificial Sequence
  Description of Artificial Sequence: Synthetic coding sequence
atgcccctgaaggacgaccacaccagccggcccctgtgggtggccccagacggccatattttcctggaagcttttagtcctgtgtacaaatacgcccaggactttttggtggccatagctgagccagtgtgcaggccaacacacgttcacgagtacaaactcacagcttacagcctgtacgccgctgtctcggtcggactgcaaacctctgatattaccgagtacctacgtaagctttccaaaactggggttcccgacggtattatgcagtttatcaagctgtgcaccgtatcatacggcaaggtgaagctcgttcttaaacataatcgctactttgtcgaatcctgccatccagacgtcatccaacatctcctgcaggaccctgtcatccgggagtgccgactacgcaactccgagggcgaggccaccgaactgatcaccgagactttcacttcgaagagtgcaatttcaaagacagctgagagcagtggcggcccctctactagccgcgtgactgaccctcagggtaaaagtgacattccaatggatttgttcgacttctatgagcagatggataaggacgaagaggaagaggaggaaacgcagacggtgtcatttgaggtgaagcaggaaatgattgaagagcttcagaagaggtgtattcacctcgagtaccctttactggccgagtacgatttccgtaatgacagcgtgaatcccgatattaacatagacttgaaaccaacagccgtgcttcggccgtaccaggagaagtcactgcgcaagatgtttggcaatggtagagcccgctccggggtcattgttttaccttgtggggcaggaaagtcactggtgggcgtgactgccgcatgtacggtcagaaagagatgcctcgtactgggcaacagtgcagtgtccgtagaacagtggaaagcccagtttaagatgtggtctaccatagatgacagccagatctgtcggttcacgagtgatgccaaagacaagcctataggctgttctgtggccatcagtacctatagtatgcttgggcatacaaccaaaagaagctgggaggcagaaagggttatggagtggcttaaaacccaggagtggggtctcatgattctggatgaggtccataccattcccgctaagatgttccgtcgggttctgactatcgtccaggcacattgcaagctaggcttgactgcaacgttagtgagggaggacgacaagatcgtagatcttaacttcctcatcgggccaaaactgtatgaagccaattggatggagctgcagaacaatggctatattgccaaggtccagtgtgccgaggtttggtgtccaatgtcacccgaattctatagggagtatgtggctataaaaacaaaaaagcggatcctcctgtacacaatgaaccccaacaagttcagagcctgccagtttctaatcaaatttcatgagcgacgcaacgataagatcattgtgttcgcggataatgtatttgccctgaaggaatatgccatcaggctcaataaaccttatatctacggtccgacatcacagggagaacggatgcagatcctacaaaattttaagcacaacccaaagatcaataccatttttatttccaaagttggggacacatctttcgacctaccagaggcgaatgtgcttatacagatttcatctcacggaggatccagacggcaagaggctcagcgcctaggacgggtcctgcgcgcaaagaagggcatggtagcagaggaatataatgcctttttctacagcctggtatcccaggatacccaagaaatggcctactctaccaaacgtcagcgatttcttgtggaccagggttatagcttcaaagttataaccaagctggccggaatggaagaagaggacttggccttcagtacaaaggaggagcagcagcagctccttcaaaaggtgctggctgccactgatctagacgcagaggaggaggtcgtcgctggagaatttggcagtaggagcagccaagcctcccggcggtttggtacgatgagctccatgtcaggtgctgatgacacagtgtatatggaatatcacagctcacggagtaaggctccatccaaacacgtacacccacttttcaaacggttcaggaagtag

SEQ ID NO: 187197 - DNA, 3753 bp, Artificial Sequence
  Description of Artificial Sequence: Synthetic coding sequence
atggaggccagccggcggttccccgaggccgaggccctgagccccgagcaggcggctcactatctcagatacgttaaagaggccaaggaggcaacaaagaatggcgacctggaggaagcatttaagctatttaacctagcaaaggacattttcccaaacgaaaaggtgctgtcacgaatccagaaaatccaggaggcactcgaagaacttgcggaacagggcgacgacgaatttacagatgtctgtaatagcggcctgctcctttaccgggagcttcataaccagctgttcgaacatcagaaggagggcatcgcctttctctattccctgtatcgagatgggcgcaaagggggcatcctggctgatgacatgggcttaggaaagaccgtgcaaattattgcctttctcagtggcatgttcgacgcttccctcgttaatcacgtgcttctcatcatgcccactaacctgataaacacatgggttaaggaatttattaagtggacccccgggatgcgcgtgaaaacatttcatggccccagtaaggacgagcgcacccgtaaccttaaccgcatccagcagcggaacggcgtgatcatcaccacttatcaaatgcttattaataactggcaacaactctcctcctttagaggccaggaatttgtctgggattatgtaatccttgatgaggcccacaagattaagaccagttccacgaagagcgcaatttgtgccagggccatccccgcctcgaatcgcttgctgttgaccggcacgcctattcaaaacaatctccaagagctgtggagcctgttcgattttgcgtgtcagggctctcttttgggaactctcaagactttcaaaatggagtatgagaatcctatcactcgggccagagaaaaagatgccactccaggagagaaagcactggggttcaagatctccgagaacttgatggcgattatcaagccttactttctcagaaggacgaaggaagacgttcagaagaagaaatcttccaacccggaggcaaggctgaatgagaaaaacccagacgtcgacgcgatctgcgaaatgcccagtctgagccgaaaaaatgacctgatcatttggatccgcctggtacctctgcaagaggagatctatcggaaatttgtgagcctggatcacattaaggaactcttaatggaaacgcgcagcccattggctgaactgggagtgctgaaaaagctctgcgatcatccgaggttgctctccgctcgcgcttgctgtttgctgaatttaggcaccttttcagcccaggacggcaatgagggcgaggactctcctgatgtggatcatatagatcaagtgaccgatgacaccctcatggaggagagtggaaaaatgatattcctcatggatctgctgaaacgcctcagggacgagggccaccagacactggtgttttcccagtcgaggcagatcctgaatattatcgagagattattgaagaacaggcactttaaaaccctccggatcgatggaacggtcacgcacctcctcgagagagaaaaacggataaacttattccaacagaataaagactattctgtgttcctgcttactacccaggtcgggggagtgggcctgaccctcactgccgctaccagggtggtgatttttgaccctagttggaacccagctacagatgctcaggccgtggatagggtatataggataggccagaaggaaaatgtggtagtgtaccggctgattacatgcggtacagtggaggagaagatctaccgccgacaagttttcaaggacagcctcatcagacagacgaccggagagaaaaagaaccccttccggtacttttcaaagcaagagctgcgggagctattcaccattgaggatttacagaacagcgtaacacagctccaattacagagcctacacgccgcccagaggaaatccgatatcaagttggatgagcatatcgcatacctacaaagtctcgggatagccgggatctccgaccacgacctgatgtacacctgtgacctgtcagtgaaagaggagttggatgtggtggaggagtctcactacattcaacagcgggtccagaaggctcagtttttagtggagttcgagagtcagaacaaagagttcttgatggagcagcagaggacccgcaacgagggagcctggttacgggaacccgtctttccctcctcgactaagaagaaatgtcctaagctgaacaaacctcagccacagccctcccccttgcttagtactcatcacacccaggaggaagatatctctagcaagatggcctcggtcgtaatcgacgatctgcccaaggagggcgagaagcaggacttaagctcaatcaaggtgaacgtgacaacgctgcaggatgggaagggcacaggttccgccgacagtatcgctactttacctaaaggattcgggtctgtggaagaactatgcaccaattcctcgttgggaatggagaagagtttcgccactaagaatgaagccgtccagaaggagactctgcaggagggccctaaacaagaggccctacaggaggacccattggaaagctttaactatgtcttatccaagtcaacaaaagccgatatcggccccaatcttgaccaactgaaggatgatgagatcctgcggcactgcaacccttggccgatcattagcatcacaaacgaatcacagaacgctgaatcaaacgtaagtatcatcgagatagctgatgacctgtctgcttcccacagtgcgctgcaggacgcacaagcgagcgaagccaagctggaggaagagcctagcgcctccagtccccagtatgcgtgcgacttcaatctatttctggaggactcagccgacaatcgacagaattttagctcccaatctctcgagcatgttgaaaaagaaaactcactttgcggatccgcccctaacagccgggccggctttgtccacagcaaaacatgcttgtcctgggaattctctgagaaagatgacgagcctgaagaggtcgtggtcaaagcgaagattagatccaaggcacgaaggatcgtgtctgatggggaggacgaggacgactcgttcaaagacacgtcttccattaaccctttcaacacaagcctgttccaattttcgtccgtaaaacagtttgatgcgtctacacccaagaatgatatttcgcctcctgggagattttttagctctcaaatcccaagttccgtcaataaaagcatgaacagcaggcgctccctggcgtcgaggcgctctttaattaacatggtgctggaccacgtggaagacatggaagaacggctggacgattcctccgaagcaaaaggaccagaagactaccccgaagagggggtggaagagtcttccggcgaagcatcaaagtacaccgaagaagacccttccggtgagacactatcatccgagaataagtcctcctggttgatgacaagcaagccgtccgcgcttgctcaggaaactagcttgggcgctcccgaacccctgagcggggagcagcttgtgggctctccccaggataaagctgccgaagccactaatgactatgaaaccctggtcaagcggggcaaagaattgaaagagtgcgggaaaatccaagaagctctgaactgcctggttaaagcccttgacatcaagtccgctgatccagaggtgatgctgttgaccctaagtctctacaaacagctaaacaacaattag

SEQ ID NO: 187198 - DNA, 2685 bp, Artificial Sequence
  Description of Artificial Sequence: Synthetic coding sequence
atgaccgccatcaagcacgccctgcagcgggacatcttcacccccaatgacgagaggctgctgagcattgtgaacgtctgtaaggccggaaaaaagaagaagaattgctttctttgtgctacagtgaccaccgaaagaccggtccaggtgaaagtggtcaaagtgaagaaaagcgataagggagacttttacaaacgccagatcgcatgggctctccgcgacctggcagtggtcgatgcaaaggacgctatcaaagagaacccagagttcgatctccactttgagaaaatttataagtgggtggcttcttctaccgccgagaagaatgcatttatctcatgtatttggaagctgaaccagcgatacctgaggaaaaaaatcgacttcgttaatgtgtcctcgcagctcctggaagagtctgtaccctccggagagaaccagagcgtcaccggcggggacgaggaagttgtggacgagtaccaggagctcaatgcgcgcgaagagcaggatatcgaaattatgatggaaggatgtgagtatgcaatctctaacgccgaggcttttgcagagaagttgtcccgcgagctgcaggtgttggacggcgcaaatatccagtcaattatggcatccgagaaacaggtgaacattctaatgaagctgctggacgaagcactcaaggaagtagatcagattgagttaaaactgtcatcatacgaagagatgctacaatccgtgaaagaacagatggatcagatttctgagagcaatcatttgatacacctcagtaatacaaacaatgtgaagttactgtccgaaattgaatttctggttaatcatatggatctggccaagggtcacatcaaagctttacaggagggcgacttggcttcgtcaagaggcattgaagcttgcaccaatgcggccgatgccctattgcaatgcatgaatgtcgctctgcgccccggccatgacctgctcttggcggtgaagcagcagcaacagagattcagtgatttgcgggaactcttcgccaggcgactggcctcccacctgaataacgtgttcgtccagcagggacatgatcaaagctccaccctggcccaacactctgtggagctgacactgcctaaccaccacccttttcaccgtgacttacttagatacgcaaagctaatggaatggctgaaaagtactgactacggtaagtacgagggcctgactaaaaactatatggactatctaagtaggctgtatgaacgggaaatcaaggattttttcgaagtggcaaaaatcaagatgacaggcaccacaaaggagtcaaaaaaattcgccaccctgcctcgtaaagaatcagctgtgaaacaggagaccgagtcactgcatgggtcaagcggaaaactgacagggtcaacaagcagtctcaacaaactgagtgtccagagcagtggcaatcgaaggtctcagagcagctccctgttggatatgggcaacatgagtgcttctgaccttgacgttgctgaccgaaccaaattcgacaaaattttcgaacaagtgctctctgaattggaacccctatgtctggccgagcaggattttatttcaaaattcttcaaattacagcagcatcagtctatgcccggcactatggctgaggccgaagacctagacggcgggacactgtcaaggcagcataattgtgggacacccttacccgtttccagcgagaaggatatgatccgtcagatgatgataaaaatttttcgctgtatcgagccagaactcaacaatctgattgccctgggtgataagatagatagctttaattccctctacatgctggtgaaaatgagccaccacgtctggacagcacaaaacgtagacccagcaagcttcctgtctaccacactggggaacgtcctcgtgacagtgaaacgaaatttcgacaaatgtatatctaatcaaatcagacaaatggaggaggtaaagatctccaaaaaatcgaaggttgggattctcccatttgtcgcagaattcgaggaatttgccgggcttgccgagagcatttttaagaacgcggagagaagaggcgaccttgacaaggcctacacaaaactgattcgaggggttttcgtaaacgtcgagaaggtcgcaaacgagtctcagaagacacctcgcgacgtggttatgatggaaaactttcaccacattttcgccacgctctcccggttgaagatctcctgtttggaggccgaaaagaaggaagcaaagcaaaaatatacagatcacctgcagtcgtatgttatttactctctggggcagcccctggaaaaattaaaccactttttcgaaggagtggaggctcgagtggctcagggaatccgggaggaagaggtctcttatcagctggcatttaacaaacaggagttgagaaaggttatcaaggaataccctggaaaggaagtgaaaaaggggttggataatctgtacaagaaagttgacaagcacttgtgtgaagaggagaacctgctccaagtcgtgtggcacagtatgcaggatgaattcatcaggcaatacaagcattttgaaggactcattgctcgttgttaccccggtagcggtgttaccatggaatttactatacaggatatcctggactactgctctagcatcgcccaatcccactag

SEQ ID NO: 187199 - DNA, 2640 bp, Artificial Sequence
  Description of Artificial Sequence: Synthetic coding sequence
atgaccgccatcaagcacgccctgcagcgggacatcttcacccccaacgacgagaggctgctctctatcgtcaatgtgtgcaaggcagggaagaagaaaaagaattgcttcttgtgtgctacagttaccaccgaaagacccgtgcaggtgaaggtcgttaaagttaagaagtcggataagggtgatttctacaaaagacagatagcatgggccctgagggatctggctgtggtggatgcaaaggatgccattaaggagaaccccgagtttgacctccacttcgagaaaatttacaagtgggtcgcttcatcaactgccgagaagaacgcatttatcagctgtatatggaagcttaaccagcgttacctgaggaagaaaatcgactttgttaacgtgtcaagccagctactagaggagagtgtgccatctggcgagaatcaaagcgtcaccggcggagacgaggaagtggtggacgaatatcaagagctcaatgcccgagaggaacaggatatcgagattatgatggagggctgtgaatacgctattagtaatgctgaggcatttgcagaaaaattgtcacgagagctgcaggtgctggatggtgcaaatattcagtctatcatggcatcagaaaagcaggtgaacattctcatgaagctgctggacgaggccctgaaggaagtagaccagattgaactcaagctaagctcctacgaagagatgctgcagagcgtgaaggagcagatggaccagatcagcgaatctaaccatctgattcacctgagcaatacaaacaacgtgaaactgttaagcgaaatagagttcctcgtgaaccatatggacttggctaagggacacatcaaggcattgcaggagggggacctggcatctagcagggggatcgaagcttgtacgaacgctgccgacgcattgctccagtgcatgaatgtggccctacggccaggccacgacctcctccttgcggttaaacagcagcagcagcggttctctgacctcagggagttatttgcgcgccgactggcgtcacacctcaacaacgtcttcgttcaacaagggcacgaccaaagtagtaccctcgcccagcactccgttgagctgactctgcccaaccatcatccatttcatcgtgatctgctgaggtacgccaagcttatggaatggctgaaatccactgactatggaaagtatgagggactgaccaaaaactacatggattatttgtcacggctgtacgaacgtgagatcaaagacttcttcgaggtagcaaaaatcaagatgaccgggacgaccaaggagagtaaaaaattcggtttacacgggagctctggcaaactgaccggctctacatcctctcttaataaactcagcgtccagtcctccgggaacagaagaagccagtcatcgtcactgctggacatgggcaacatgagcgcgagtgacctggatgtggccgacaggactaagttcgataaaatctttgagcaggtgcttagcgagcttgagcctctttgcttggccgagcaggactttatctctaagtttttcaagttgcagcaacaccagagcatgccggggaccatggcggaagcagaagatctcgacggtgggacactgtcgaggcaacataattgtgggactcccctgcctgtaagctctgagaaggacatgatacgccagatgatgataaagattttccgctgtatagaacccgagctgaacaaccttatagctctcggggacaagatcgacagttttaattctctgtatatgcttgtgaaaatgtcccatcatgtttggacagcccagaatgtcgatccggcgtcatttctgtcgacgaccttgggaaacgttctcgtgacggtaaaaagaaacttcgacaagtgtatatctaatcaaatccggcagatggaagaggtcaaaatctctaagaagtccaaagtgggcatcctccccttcgtagctgagtttgaagaatttgccggcttagccgagagtatttttaaaaatgccgagcgccgtggagatctggataaggcctacaccaagctgattagaggagtgtttgtgaacgtggaaaaagtcgccaatgagagccagaaaactccccgggacgttgtcatgatggaaaacttccaccatatcttcgcaacgcttagtcgtctcaagatctcctgtctagaggctgagaagaaggaagccaagcaaaagtacacagaccacctccagtcctatgtgatttatagcctgggtcaacccctcgagaaactgaaccactttttcgagggagtggaggcacgagtagcacagggaatcagagaggaagaggtgagctaccagttggcatttaacaaacaggagctcaggaaggtgattaaggagtatccgggaaaagaggtgaagaagggtctggataatctttacaaaaaggtggataagcacttgtgcgaggaagaaaacctgctgcaggtggtgtggcactctatgcaggacgagtttatccgccagtacaagcacttcgaaggtctcatcgcccgctgctaccctggcagcggggtcacaatggagtttacaatacaggatattctcgactattgttcatccatagcccagtcgcattag

SEQ ID NO: 187200 - DNA, 2685 bp, Artificial Sequence
  Description of Artificial Sequence: Synthetic coding sequence
atgaccgccatcaagcacgccctgcagcgggacatcttcacccccaatgatgaacgtctcctcagcattgtgaatgtatgcaaggccgggaagaagaagaagaattgcttcctatgtgccaccgtcacgacagagagaccggtccaggtgaaggtggtaaaagtgaagaagagcgataagggagacttctacaagcggcagattgcgtgggccctgcgcgatttagcagtcgttgacgccaaggatgccatcaaggagaaccccgaattcgatttacactttgaaaaaatttacaagtgggtggcaagctcaacggcagaaaagaatgccttcatttcatgcatctggaagctaaatcagcgatatctcaggaaaaagattgacttcgttaacgtatccagtcaattattagaagagtctgttcctagcggggaaaatcagtccgtcactggcggagacgaggaagtcgtggacgaatatcaagagctgaatgccagagaagaacaagatatcgaaatcatgatggaaggatgcgaatatgccattagtaatgctgaagctttcgccgagaagctctcaagagagttgcaggtgcttgacggcgctaacatccaatctataatggcctctgagaagcaggtcaacattctgatgaagctgttggacgaagccctgaaagaggtcgatcagatcgaactcaagctctcatcctatgaagagatgctccagtctgtgaaggagcagatggatcagatcagtgaaagtaaccacttgatccacttatccaatactaacaacgtcaagctcttgagcgaaattgaatttctggtgaatcatatggacctcgccaaaggtcatatcaaggctctgcaggagggagacctggcttcctccaggggaatcgaagcctgcacaaatgccgctgacgcactactgcagtgtatgaatgtggccctccgccccggacacgacctccttctcgccgtgaagcaacagcaacaaaggtttagcgacctgagagaactctttgcaaggcgtctggcctcccacttgaacaacgtgttcgtgcagcaagggcacgatcagtcctctacccttgcacagcatagtgttgagttaactctaccgaaccatcaccctttccaccgggatctgctgcgctatgccaaactaatggagtggctgaaaagtaccgactatgggaaatatgaggggttaaccaaaaattacatggattacctgagccggttatacgaaagagagatcaaggacttcttcgaggtggctaaaatcaagatgaccggtacgaccaaggagtcaaaaaagtttgctactttgcctaggaaggagagcgccgtaaaacaggaaactgagtcattgcacggcagctccggtaagctcacagggagtacctcttccctgaataagctttccgtgcagtcatctggcaatcgccgatctcagtcgtcctcgctgctggacatggggaatatgagcgctagcgatcttgacgtggccgaccgcacaaaatttgacaagatctttgagcaagtgctgagtgagctggagcctttatgcctcgcagaacaagacttcatatcaaagttctttaaactacagcagcaccagtccatgcccggaactatggccgaggctgaggatctggatgggggaacactgtccagacagcacaactgcggtacccccttaccagtgtccagcgagaaagatatgataagacagatgatgataaaaatatttcgatgtatcgaacccgaattaaataatttgatcgctttgggcgataagattgactcttttaactccttatacatgctggtgaaaatgtctcatcacgtgtggactgctcagaacgtggaccccgctagctttttgagcactactttaggtaatgtgctcgtaaccgtcaaacggaactttgacaagtgtataagcaaccagatcagacagatggaggaggttaaaatcagtaagaaatctaaagtgggtattttacccttcgtcgctgagttcgaggagttcgcaggactcgccgagtctatatttaagaatgcagagcgccggggggacctggacaaggcctacaccaagctgatccgcggggtcttcgtcaacgtcgagaaggtggcaaatgaatcgcagaagactccaagagatgtcgtgatgatggagaatttccaccatattttcgccacactgtccaggcttaaaataagttgcctggaggctgaaaagaaggaagccaagcaaaagtatacagatcaccttcaatcctacgtgatatactcgctcgggcaacctcttgagaaacttaaccatttctttgaaggtgttgaggctagagtcgcacaagggattagggaggaggaagtgagttaccagctggcatttaataaacaggagctgcgtaaggtgatcaaggaataccctggcaaagaggttaaaaagggcctggataatctgtacaaaaaagtggacaaacatctgtgtgaggaagagaatctccttcaggtggtgtggcactctatgcaggacgagtttataaggcagtataagcactttgaaggcctgatagcccgttgttacccgggctccggcgtgactatggagttcaccattcaggatattttggactactgtagcagcatagcccagtcacactag

SEQ ID NO: 187201 - DNA, 2238 bp, Artificial Sequence
  Description of Artificial Sequence: Synthetic coding sequence
atgaaggagaccgaccgggaggccgtggccaccgccgtgcagcgggtggcaggtatgctgcagagaccggaccaattggacaaggtggagcagtatcgtagacgcgaggccaggaagaaggcctccgttgaggctaggctgaaagccgcaatccaaagccagctggacggcgtccggacagggcttagccagttacacaacgcacttaatgacgtgaaagatatccagcagtccttggccgacgtttctaaggactggaggcagtccatcaacacaatagagtccttgaaagacgtcaaggacgcagtggtgcaacactcacagttggccgctgcagtcgaaaatctcaagaatatcttcagcgtcccagaaattgtgagagaaacacaggacctcatcgaacagggggctttgctgcaggcacataggaagttgatggatcttgaatgttccagggacgggttaatgtatgaacagtaccggatggatagtggcaatacccgtgacatgaccctaattcatgggtattttggttccacacagggactgtcagacgaactggcgaaacagttatggatggtgctgcagaggagtcttgtaacagtcaggcgggatccaacactgcttgtgagtgtggtgcgtattattgagagagaggagaaaatcgatagaaggatcctggatcgaaaaaaacagaccggttttgtgccacctggccggcccaagaattggaaggagaagatgttcaccatactggaacgcacggtgacaacccgcatagagggcactcaggctgacacccgggaatctgacaagatgtggctggttcgccatcttgagataataaggaagtacgtgctcgatgatctgattgtagccaaaaacctcatggtgcaatgcttccctcctcactacgaaatctttaagaatcttcttaacatgtaccaccaggcccttagtactagaatgcaggatctggcaagtgaggacctcgaggctaatgaaatcgtgagccttctgacttgggttttgaacacatatacaagcaccgaaatgatgcggaacgttgaacttgcccccgaagtggacgttgggactcttgaacctctgctaagcccccatgtagtctctgaattactagacacttacatgagcacattaacctccaatattattgcctggctgcgtaaggcccttgagactgacaaaaaggattgggtgaaggagacggagccagaagcagatcaggacggctattaccagacaacactccccgccatagtcttccaaatgtttgagcagaatcttcaggtggcagcccagattagcgaggaccttaagaccaaggtgctcgttctgtgcctgcaacagatgaactcctttctaagtaggtacaaagacgaagctcagctatacaaagaggaacacttgcggaatcggcagcacccacactgctacgttcagtatatgattgctatcattaacaattgccaaacatttaaggagagcatcgtaagtctgaagaggaaatacttgaagaacgaagttgaagagggggtgtcgccaagccaaccctctatggatggtatcctggacgccattgccaaggaggggtgcagcggactcctggaggaagtgttccttgatcttgaacaacacctaaatgagctgatgactaaaaaatggttattgggcagcaatgccgtggacatcatctgtgtgacagtagaggactattttaacgactttgcaaagatcaagaagccatacaagaaaagaatgacagctgaagcccatcgacgggttgtggtggaataccttagggctgtgatgcagaaacggatcagcttccgatcacctgaggaacgcaaggagggcgctgagaaaatggtgagagaagcagagcagttgcgctttttgtttagaaaactggccagcggctttggcgaagacgtagacggttactgcgatactatagtggccgttgccgaagtcattaagctgacagacccctcactcctgtacttagaggttagtaccctggtttccaagtatccggatatccgagacgaccatatcggtgctctactcgctgtgcgtggggacgctagccgggatatgaaacaaacaattatggagaccctcgagcagggccccgcgcaagccagcccctcttatgtgccactcttcaaagatattgtggttccttccctgaacgtggcaaagctcctgaagtag

SEQ ID NO: 187202 - DNA, 1923 bp, Artificial Sequence
  Description of Artificial Sequence: Synthetic coding sequence
cagtgcgaggacagcaccagcttcttcaccatgaaggagaccgacagagaggcagtagccactgcggttcaacgcgttgcgggaatgctccagagacccgatcagctcgacaaagttgagcaataccgacggcgcgaagcaagaaagaaagcttcggtcgaggcccgattaaaagccgccatccagagccagctggatggcgtgaggaccggcctgtctcagttgcataacgctctgaacgatgtgaaggatatccagcaatctctggccgacgtatcaaaggactggcggcagagcatcaatacgatcgaatcgctcaaagacgtcaaggatgcggtggtccagcacagccaactggccgctgctgttgaaaatctcaagaatatcttctcggtccccgaaatcgtgagagaaacccaagacttaatcgaacagggggcgcttctgcaggcacaccgtaaactgatggatcttgagtgttcacgagacgggttgatgtatgaacagtataggatggatagtggtaacacaagggacatgaccttgatccatgggtactttggaagcacccaaggactgtctgacgaactcgcgaaacaactgtggatggtcttacagaggagccttgtaaccgtacgtcgagatcctacgcttcttgtgtccgtggtgagaatcattgagagggaggagaagattgatcgaagaatactggatagaaagaaacaaaccggttttgtcccaccaggacgcccaaaaaactggaaggagaagatgtttaccattctggaacgaacagtcactacacggattgaggggactcaggccgacacacgcgaaagcgacaaaatgtggcttgtccgacaccttgaaatcatcagaaagtatgtactagacgacctcattgttgcgaagaatcttatggtccagtgtttccccccccattacgaaatcttcaagaacctgctcaacatgtaccaccaagccctgtcaacacgaatgcaggatctggctagtgaggacctggaggctaatgagattgtatctctcctgacctgggtcctcaatacctacacacggtacaaggacgaggcacagctctataaggaggaacacctgaggaatcgacagcacccacactgctatgtccagtatatgattgcgatcattaataactgccagaccttcaaagaatctattgtcagtctgaagcgtaaatatttgaagaatgaagtcgaggaaggagtcagtcccagtcagccctcaatggacggaatcctggacgctattgccaaagagggttgctcagggctgctcgaagaggttttcttggacctcgaacagcacttgaatgagctgatgaccaaaaagtggctgctgggcagtaacgccgtagacattatatgtgtaaccgtagaggactactttaacgactttgctaaaattaaaaaaccgtataagaagcggatgaccgcagaggcccaccgcagggttgtggtggagtaccttcgcgctgtgatgcagaaacgaatcagcttccggtcccccgaggaacgtaaggagggggccgagaaaatggtcagagaggccgagcagctgcggttcctgttcaggaaactggcgagcgggttcggagaagacgtggatggatattgtgataccatagtcgcagtcgcagaggttatcaagctgacagacccaagcttattgtatctggaagtcagcactctcgtgtctaaatatcccgatattagagacgaccatatcggggcgttactcgctgttcgcggggacgcctccagggacatgaagcagacaatcatggagacacttgagcaggggcctgcacaggccagcccttcatacgtgccactgtttaaagacattgtcgtgccctccttaaacgtcgccaagctactcaaatag

SEQ ID NO: 187203 - DNA, 210 bp, Artificial Sequence
  Description of Artificial Sequence: Synthetic coding sequence
atgaaggagaccgaccgggaggccgtggccaccgccgtgcagcgggtggccggcatgcttcagcggcctgaccagttggataaggtagaacaataccgaaggcgcgaagcccgcaagaaggctagcgtggaagctcggctgaaagcggctattcagtctcagctggacggcgttcgcaccggtctgagccaactccataatgccctatag

SEQ ID NO: 187204 - DNA, 2238 bp, Artificial Sequence
  Description of Artificial Sequence: Synthetic coding sequence
atgaaggagaccgaccgggaggccgtggccaccgccgtgcagcgggttgcaggcatgctgcaacgaccggaccagctcgataaagtggagcagtatagacggcgggaagcaaggaagaaagcatcagttgaggctaggctgaaggcagctatccaatctcagttggacggagtcaggaccggactgtctcaactccacaacgcgctgaatgacgtgaaggacatccagcagagcctggccgacgttagtaaagattggcggcagagtatcaataccatcgagtctctgaaagatgtaaaggacgccgtagtacaacactctcaacttgccgcagccgtggaaaacctcaagaacatatttagcgtcccagagatagtgagggagacccaggacctcatcgagcaaggggctctgctacaagcccacaggaagctgatggaccttgagtgctcccgcgacggtctgatgtatgaacaatatcgtatggattcaggtaatacacgcgatatgaccctcatccacggatacttcggatcgacccagggattgtcagatgagctggccaagcagttgtggatggtgctgcagcgttcattggtgactgtgaggagagatccgactttacttgtgtctgtcgtgaggattattgagagggaggaaaagattgaccgccgtatcttggataggaaaaagcagacagggttcgtgccacctggacgccctaaaaactggaaagagaagatgtttacgattttggagcgcaccgtcacgacccggattgagggtacacaagctgatacccgggaaagtgataagatgtggctcgtccggcatcttgaaatcattagaaaatatgtgttagacgatctcatagtagcaaagaatcttatggtgcagtgcttcccaccccactatgagatcttcaaaaacctcctgaatatgtaccaccaagcactgtcaacacgcatgcaggacctggcaagcgaggatctcgaggcaaacgagatcgtatccttacttacctgggtgctgaacacgtacacgtctacagaaatgatgcgcaatgttgaacttgctcctgaagtcgacgtcggcacacttgagcccctgctgagtcctcatgtggtatctgagctactggatacttatatgtcaacactgacttctaacattattgcttggctccggaaagctctggagacggacaaaaaggactgggtcaaggagaccgaaccagaagctgatcaggacggctattaccagacaacccttcccgcaattgtgttccaaatgttcgagcagaacctccaggttgccgctcaaatcagtgaggacctcaaaactaaggtactggtgttgtgtctgcaacagatgaattcatttctgtctcgttacaaggatgaggctcagctttacaaggaagagcacctccgcaaccgccagcaccctcactgttacgtgcagtacatgatcgcaatcatcaacaactgccaaacttttaaggagtctatcgtgagtttgaagaggaagtacttgaaaaacgaggtggaggagggggtatccccctcccagcctagcatggacgggattctggacgctatcgcaaaagaaggctgtagtggactgctagaagaggtcttcctggacctggaacagcacctcaatgagctcatgaccaagaaatggttactcggctccaatgccgtcgacatcatctgtgtaaccgtggaggactattttaatgacttcgccaagatcaagaagccctataaaaagcgtatgaccgcggaggcccataggcgagttgtggtggaatatttacgggcggtcatgcaaaaaaggatatcatttagaagcccggaagaacggaaggagggtgccgagaagatggttagggaggctgagcagcttcgattcctctttcgcaaactggcgagtgggtttggggaagatgtggacggatactgtgatactatagtggccgtggccgaggtcattaagctaacggatccttcactgctatacctggaggtttctactctggtgtccaaatatcctgatatccgtgatgaccatattggagccctgttagccgtgcgtggggatgccagcagggacatgaaacaaacaattatggagaccctggaacaaggtccggcccaagcttcccctagctacgtcccattgttcaaggacatcgtcgtgcccagtctcaatgtcgctaaactccttaagtag

SEQ ID NO: 187205 - DNA, 2034 bp, Artificial Sequence
  Description of Artificial Sequence: Synthetic coding sequence
atggacagcgccgccaaggacgagatgcagcccgccctgagccccggaagctcctttccaggaccggagtggcctgagcaggagagagccgagcagttggcccggggcgcagctctgaagtgggcatctgggatcttctatcggcccgaacagctcgcccggctgggtcagtatcggtcgcgggaggtccaacgcacgtgctctctcgagtctcggctgaagtccgttatgcagtcatatctcgaaggcgtgcagaccgtgcctgctgcagttagtcatactcagactctgatcgatggccaacagttcctagaggcatatgtgtctctgcgtgagctcgagcagttgcgggaggatacctgggccccgcttggcggcctggagttacccgtctttcagggtctggatctgcttttcgaagcgttgggtcaggccgtcgaggctgccgctggcgccgcagggaagctggcccgcgaggatccggcactgctggtggccgccgttcgggtggcagaggtcgaaaccggacggaccactccactaggacaggtcccccgtgattggaggcagaggtgtctgcgtgctctccaggaaggccttgaacaggcgcattttggctcccctctattgccagcccctggggcattgccagggtggctcgaagctttgagggtcgcgctgccagtggaactcgcaacagccgaggccttagttgcaccctgctgtcccccccagtataacgtagtgcagctgtgggctcatactctgcattccggattgcgtcgctccctccagaacctcctagccgggcctgagctcgaggccgctgacgcattcgcgctgcttcattgggctttacacgtctacctggggcaggagatgatgggtagcttggagctgggccctgaggccgatgtgagccagctcgagccgctcttgacactggagaatatcgaacagctggaagctacttttgttgctaacattcagatcttagaagagaatattcgggtggcatctctcgtatccgagtccctgcagcaacgcgtccatggaatggccttaagtgaactgggtacgttcttgaggtccttctcggacgctctgattcggttttctcgagaccactttaggggtaaatccatggctccccattacgtaccataccttctggccgctctcaatcacaagtcagccttgtcctcatctgtctcagtcctgcagctcgatggtgccccctccggggcgctggccccagtggaggccgccctggacgagttacaacgccgcatttataggctggttttggaagccctgcaagccgaactgcaacctctattcgcggatctgccctctagacagtggctgtcgagtcccgaactgctccagagcgtatgtgagcggactggacgattttgtcgcgacttctggagggtgaggaatccgactgtgcagctcctgttagctgaggccgaacgtgctgtggttctgcagtatctttcggctttaatgcagggccggctcgtctgtcggggggccgatgagaggactcaagctgctgagaggctaagacatgacgcagcacaattacagcagctgttccttagccttgtcagagctagctgggcagggcgtcgagcaagggtgtctgttgcgggctgggagagagggctggcccgtgatccaacccctacatgctcagggccaggaggcgagcgggccctgagggcaggtgccgctcgacctgaaggggcggccaaaccgccgcgacccagggccgccggtccaggcggaggctggccagcagccacaatatctcgaagagaacggggcccgagactcaggcccttagggccagcacgcgggctggtccccggagccgctcctggtcgggctcaactgcctgccgggtgtgcagcagctgttgcccccagagaaccccctaggccacttcagccatctgcccgtgctcgggccccggcttcttgtctgcccagcggtagctgtgcccgagcgctgttgctcgctgagtag

SEQ ID NO: 187206 - DNA, 2241 bp, Artificial Sequence
  Description of Artificial Sequence: Synthetic coding sequence
atggacagcgccgccaaggacgagatgcagcccgccctgagccccggacctgaatggcctgaacaggagcgggccgagcagctggcacggggagccgccttgaagtgggccagtgggatcttttatcgcccggaacagcttgctaggttaggacagtatcggtcacgggaagtccagcggacatgttccttggaatcccgcctcaagtcagtgatgcaaagctatttggagggtgtgcagacgggagtctggcagctggcgcaggccatcgaagtggtccagggtacaagagaagccctctcccaggcaagagggctgttgcaggggatgtcccaagcacttcagacactggaaccactgagagagagggtcgcccagcataagcaactgcaagctctctcccacttactgcccaggctgagggcagtgccagcagccgtgtcccacacacaaacgctgattgacgggcagcagttcttggaggcgtacgtaagtttgcgtgaactggaacagttgcgtgaggacacttgggcgcccctgggaggattggaactgcctgtctttcaggggctggaccttctgttcgaagccctaggccaggcggtggaggccgccgctggggccgcaggcaagttagctcgggaggatccggcgctccttgttgctgcagtgcgggtggccgaggttgaaacagggcggacaacaccactcggtcaggtgcctagagactggcgtcagcggtgcctccgcgcacttcaggaaggccttgagcaagcccattttggcagccccctgcttccagcaccgggggcactgcctggctggttagaggcactgcgcgttgccctgcctgtggagttggccactgcagaggcactggttgccccatgctgtcctccccaatacaatgtcgttcagctctgggcccacactctgcactccgggttacgacgttccctacagaacctgctcgccggcccagaacttgaggccgctgacgcctttgcactgctgcactgggctctgcacgtatacctcggccaggagatgatgggctccctcgagctcggaccggaggcagatgtgtcacaactcgagcctctcttaacccttgagaacatcgagcagctcgaggccacatttgtggcgaatatccaggcatcagtgagccagtggcttcagaacgccttagacggagaggtggccgaatggggcagagagcatggaccaaataccgacccaagcggcagctattactcgcctatgccagcgatcgtgctgcaaattttggaagagaacatcagggtagcttccctggtctcagaaagtttacagcagagagtacacggtatggctctgtcagagctgggaaccttcctgcggagctttagtgacgccctgatccgcttttcacgggaccactttcgcggtaaatcaatggctccccactacgtgccttaccttttagctgcgctgaatcataaaagcgcactcagttcatccgtgtccgtcctgcagttggatggcgcacccagtggggcgctggcaccagtggaggcagcccttgatgaactacagcgccgcatttacagactggttctggaggccctacaggcagagctgcagcccttattcgccgatctgccctccagacaatggctaagtagtcccgagctgcttcaaagcgtgtgcgagaggacaggacgattctgtcgcgacttctggcgcgtccgaaaccctaccgtgcagctgttgctcgccgaagcagagcgggcagttgtgcttcagtatctaagcgccctgatgcaggggagactcgtgtgtcgcggagctgacgaaagaactcaggcggctgagcgacttcgccatgacgcagctcaactacagcaactgtttttatccctcgggcttgaggagaatgcacattgcgcacccgtgctgctcgcactccgagagctgctgaatcttagagaccccgccctgcttggcttggaagttgctggactgagacaacagttcccggatgtgagtgaagatcatgtgtcagcccttctgggcctgcggggcgacctgtccagggagcagcacctggccgccctttcttcccttcaggccgcacttccacctagccccagggcctcaaggagggtgctgttctcattggtgcctgcacctgcactggctcctgcaagctgtctgccttctggttcctgtgctagggccctgctgctcgctgagtag

SEQ ID NO: 187207 - DNA, 2040 bp, Artificial Sequence
  Description of Artificial Sequence: Synthetic coding sequence
atggacagcgccgccaaggacgagatgcagcccgccctgagccccggccccgagtggcctgaacaggagcgtgctgagcaactcgcccgcggggcggcactgaagtgggcatcaggcatcttttaccggcctgaacagctagcgagactcggccagtaccgctccagggaagtgcagcgaacctgctctcttgaatcccgcctgaagagcgtgatgcaaagttacttagagggggttcagactgtgcctgctgctgtctcccatacccagacactgattgacgggcagcagtttcttgaggcttacgtttcactgagggaacttgagcagttgagggaggacacatgggcacccctcggcggcctggagttgcctgtttttcaggggcttgatctgctctttgaagcgcttggccaagcggtcgaagccgcagctggcgcagctgggaagctagcaagagaagacccggccctgttagtggccgcagtacgcgtcgccgaggtcgaaacgggtcgaactacaccactagggcaggtcccccgagactggagacagcggtgtttaagagcgctccaagagggcctagaacaggcgcacttcggaagtcctcttctgcccgctcctggcgcccttcctggctggctggaagctctcagggttgctctgcctgtcgaactcgcgactgcagaagcactggttgcaccttgttgtccacctcagtacaacgtggtccagctatgggctcataccctgcattccggcctgcgaagaagtcttcagaacctgctcgcgggaccagagcttgaggctgccgacgctttcgctctgcttcattgggcacttcatgtttacctggggcaggagatgatggggagtctggaactcgggccggaggccgatgtatcccagctcgaacctttgttgacactggagaacatcgaacagcttgaagcgacgttcgtggcaaatattcagattttggaagagaacatccgggtcgcttctctggtctccgagagcctccaacagcgtgtgcatggcatggctttatccgagctaggcacctttctcagaagtttttctgatgctttgatcagattcagtcgtgaccactttcgaggaaagagtatggccccacactatgtgccttacctcttggctgctctgaaccacaagtcagcactgtcatcctcagtatcggtgttgcagctagatggcgctcctagtggtgctctggctcccgttgaggcagctctagatgagctgcagaggcgtatataccgcctcgtactcgaggctctgcaggctgagctgcagccattgtttgccgatctcccgtccagacagtggctttccagtcccgagctgctacagagtgtctgcgaaaggacaggccggttttgcagggacttttggcgagtaaggaatcccactgtccaactgctgctcgcagaagctgagagagcagtggtattacagtacctgtccgcactgatgcaggggcgcctggtgtgcagaggcgcagacgaacggacccaggcagcggagagactgcgccatgatgctgcgcaattgcagcagctgttcctgtcactggtcagagccagttgggccggacgccgtgctcgtgtgtccgttgctgggtgggagcggggccttgcaagagatccaactcctacttgttctggacctggtggggaacgcgctctgcgcgccggagcagctcgccctgagggcgcagccaagcccccacggccccgagcggcagggccgggtggaggctggcccgcagccaccatctctaggcgcgagcgcggtccacgactccgcccgctcggaccggcccgcggtctggtgcccggtgccgccccaggtagagcccaattgcccgccggttgcgctgcagctgtggctccaagagagcccccaaggccacttcagccttctgctagagcacgtgcacgtgccggattactgcctgctctgggcgtcctgcgcccctctcccgctgccagaaggattaaccacggttgccgatag

SEQ ID NO: 187208 - DNA, 2925 bp, Artificial Sequence
  Description of Artificial Sequence: Synthetic coding sequence
atggccgccgaggccgccggcggcaagtaccggagcaccgtgagcaagtccaaagacccgtcaggtctgctgattagtgtcatccgcacactctccaccagtgacgatgtggaggaccgtgaaaacgagaaagggcggttggaggaagcatatgagaaatgcgacagggatctggacgagcttattgtgcagcattacaccgaacttacaacagctattagaacctatcaatcaatcacagaaaggatcaccaattcaaggaacaagatcaagcaggtgaaggaaaatctcctatcctgtaagatgttgctccactgcaaacgagatgaactcaggaagctgtggattgagggcattgagcataagcacgtactgaatctcctggatgagatcgaaaatatcaagcaggtgccacagaagctggaacagtgcatggcttccaagcattatctgtctgcaaccgatatgctggtatctgctgttgaatctctcgagggtcccctgttacaagtggaaggtctgtctgatttacggctggagctgcactccaaaaagatgaatcttcacctcgtcctcattgacgaattacatcgccacttgtatatcaaaagcacatctcgagtggtccagcggaacaaagagaagggaaagatcagttctctagtgaaagacgcctctgtacccctgatcgacgtgacgaaccttcccaccccccgtaaatttctcgataccagtcactattcaacggcaggttcctcctctgtccgtgaaataaatctgcaggatataaaggaagacctggagttggatcctgaggaaaatagcacgctcttcatgggcatcctgattaaggggctggccaaactgaagaagatccctgaaacagtgaaagcgatcatagaacggctggagcaggagctgaagcagattgtcaagcgttctaccactcaggttgctgacagcggataccaacgcggagagaatgtgactgtggagaatcagccccgactgctgctcgaacttctcgaactcctgttcgataagtttaacgccgtggccgcagcccattccgtcgtgctaggatatctacaggacaccgtggtgactcctttgacacagcaagaggatatcaagctctatgatatggctgacgtgtgggtgaaaatacaggacgtgttgcagatgctccttaccgaatacctcgacatgaaaaatacacggacggccagtgagccaagtgcacagctgtcctacgcgtcaaccgggagggagtttgctgctttttttgcaaaaaagaaacctcaaaggccaaagaattcgctgtttaagttcgaatcatcctctcacgccatcagtatgtccgcatacctacgcgagcagaggcgcgaactctattcgcgctctggcgaattgcagggaggcccagatgacaacttaattgaaggaggtgggacaaaattcgtgtgtaaacccggggcaaggaatattactgtaattttccaccccttactgcgtttcatccaagaaattgagcatgctctcggacttgggccagccaagcagtgccctctccgagaatttctgaccgtgtatatcaaaaatatcttcttgaaccaggtcctggcagaaattaacaaggaaattgaaggggtcaccaagacatccgatccgctgaaaattctggctaacgcagatactatgaaggtccttggcgtacagaggccccttcttcagagcaccattattgtggaaaaaaccgtgcaggacctgctgaatcttatgcacgacctttccgcatattccgaccaattcctgaatatggtatgtgtgaaactgcaggaatataaggacacttgtactgccgcctatagaggcatcgtacaatctgaagagaagctggtgattagtgcatcttgggcaaaagacgacgatatcagtaggcttctgaagtccttgcccaattggatgaacatggcccagccgaaacaactaagacccaagcgcgaagaggaagaggacttcattagggccgccttcggcaaggagtctgaagttctcatcggcaatctgggcgacaagttaattcctccccaggatattttaagagacgtctctgatctcaaagccctcgccaatatgcacgaaagcttggagtggctcgcttctcgcactaaatccgcgttctcgaatctttccacatcccagatgttatcaccggcacaagactcccacacgaatacagatctaccccctgtgagtgagcagataatgcagacactgtctgagctggccaaatcttttcaagatatggcagatcgctgcctcctggtgctccatctcgaggtgagggtacactgctttcactaccttattccccttgccaaggagggcaattacgccatagtcgctaatgtggaaagcatggattacgatccactcgtagtgaagttgaataaggatatctccgctatagaagaggcgatgtcagcttcattgcagcagcacaagttccaatatatcttcgaaggcttagggcaccttatttcatgtattctgatcaatggggcgcagtatttccgaaggatctccgagagcggcatcaagaagatgtgccggaatattttcgtactgcaacagaacctaacaaacatcactatgagccgagaggccgatttggatttcgcccgacagtactacgagatgctgtacaataccgcggacgagcttctgaatcttgtcgtggaccaaggtgtaaaatacactgagctcgaatacatacacgctcttaccctcctccaccggtcacagacgggtgtgggtgaactcaccacacaaaatacgcgactacagcgcctgaaggagataatctgcgagcaggccgcaattaagcaagccaccaaggacaaaaagatcactacagtttag

SEQ ID NO: 187209 - DNA, 1422 bp, Artificial Sequence
  Description of Artificial Sequence: Synthetic coding sequence
atggccgccgaggccgccggcggcaagtaccggagcaccgtgagcaagagtaaagatccctcgggcttgctgatctccgtgatccggacattgtccacatccgacgacgtcgaagacagagaaaacgagaaggggcggctggaagaagcttatgaaaagtgcgacagagatctggacgagctaatagtccaacattacactgagttaaccactgctataagaacttaccagtcaatcaccgagcgcataacaaattcacggaataaaataaaacaagtgaaagagaatctcttaagctgcaagatgcttctccattgcaaacgtgatgagctaagaaagctgtggattgaaggaatcgagcacaagcacgtcctaaacctcctcgacgagatagagaatattaagcaggtcccccagaaactggaacagtgcatggcttccaagcattatctgtccgctaccgacatgctagtgtcggccgtcgagagcctggaaggtccgctcctgcaggtggaggggctgtccgaccttagactggagctacactccaagaagatgaatctgcatttagtgctcatcgacgaactgcacagacacttgtacataaaatctacctcccgtgtggtgcagaggaataaggagaagggcaaaatcagttctcttgtgaaagacgcgagcgtacccctgatcgacgtcaccaacctgcccacccctagaaagttccttgacacctcacattacagcactgcaggatcaagcagtgtgcgtgagattaacctgcaggacataaaagaggacctcgaactggatcccgaagagaattccactctgtttatgggcattctcattaagggtctcgccaagttaaaaaagatcccggaaactgtgaaagcaattatcgaacggctggaacaggaattgaagcaaatcgtcaagagaagcaccactcaggtcgctgatagcgggtaccagcgcggggagaacgtaaccgtcgagaaccagcctagacttctcctcgagctactcgagttactgttcgacaaatttaacgccgtagctgctgctcactctgttgttctcggctatcttcaagatactgtcgtgacacccctcacacagcaggaggatatcaaactttacgacatggcagatgtctgggtgaagatccaagatgtgctgcagatgctgcttaccgaatacttagatatgaagaatactcgaacagcaagcgagccgagcgcacagctgtcgtatgcatcaacaggccgcgaattcgccgcctttttcgcgaaaaaaaagccgcaaaggccaaaaaattctctgttcaagttcgagagctcttcccatgccataagtatgagtgcatacctgcgtgagcagcggcgggagctgtattccagaagcggagagctccagggctag

SEQ ID NO: 187210 - DNA, 2622 bp, Artificial Sequence
  Description of Artificial Sequence: Synthetic coding sequence
atgctgctgcactgcaagcgggacgagctgcggaagctgtggatcgagggtatagagcacaaacacgttttgaacctactggacgagatagaaaatattaagcaggttccccaaaaacttgagcagtgcatggcctctaaacactacctgagcgctactgacatgctcgtaagcgccgtggagagtctcgaaggcccacttctccaggttgagggcctctcagacctgcgactcgagttgcacagtaagaaaatgaatctgcacctggttctgatcgacgaattacacagacacctctatatcaagagcacctcaagagtggtccagagaaataaggagaagggcaagatttcaagcctggtcaaggatgcctccgtgcccctaatagatgtgaccaacctgccaactcccaggaagtttctggacacttcacactactccacagccggatcgagcagtgttcgcgaaattaacctgcaggatatcaaggaggatctcgagctagatcctgaagagaacagtacactgtttatggggatcctgattaagggcctggccaagctcaagaagatcccagaaacggtgaaggcgattatcgagcgactggagcaggagctgaagcagattgttaagagatccacaacacaggtggcagactccgggtaccagcgcggtgaaaatgtcactgtggaaaatcaaccccggctgctgttagagctgttggaacttctgttcgataaattcaatgctgtcgccgcagcccactccgttgttttaggttacctgcaggacactgtggtcactcctctcacccaacaggaggacattaagctttacgatatggccgatgtgtgggtgaaaattcaggacgtgctgcaaatgctgctaacggaatatctggatatgaaaaacacccgaactgcctcagagccaagcgcccagttatcctacgccagcaccgggagagagtttgccgctttcttcgccaagaaaaaaccgcagagacccaaaaattcgttattcaaattcgaatctagtagccatgctatctcgatgtccgcttatctccgggagcagcggcgggagctgtacagtcgctccggcgaactgcaggggggaccagacgacaacttgatcgaaggtggcggcaccaaattcgtgtgcaaaccaggtgcacggaatattacggttattttccaccccctcctgagatttattcaggagattgagcacgccctaggcttaggacccgctaagcaatgccccttgcgcgaattcctgaccgtctacattaagaatatcttccttaatcaggtcctggccgagattaacaaagagatagagggggtgactaaaacttctgatccgctgaagatcctggctaatgccgatacaatgaaggtgctcggcgtgcagaggccgctgctccagtcaactattatcgtagaaaagaccgtccaagacctcttgaacctgatgcatgatctgtcagcgtactcagaccaattcttgaatatggtatgcgtgaagttacaagagtacaaagacacttgcactgccgcatacaggggtatcgtccagagtgaagaaaagttagttatcagcgcatcgtgggcaaaagacgatgacatcagtaggctgttaaagtccctacctaactggatgaatatggctcagccaaaacagttacgcccaaagagggaggaagaagaagattttattcgcgccgcatttgggaaggagagcgaagttttgattggaaacctcggcgacaaactcataccaccgcaggacattctgagggatgtgtccgaccttaaggcactcgctaatatgcacgaaagccttgagtggctggcttctaggacgaagagcgcgttcagcaatctgtctacttctcagatgctctcacctgcacaagatagccatactaacacagacctccctccggtctccgaacagattatgcagactttgtccgaactagctaagagttttcaagatatggcagatcgttgtctgctggtcttacatttagaggtgcgggtccattgctttcactatctcatcccactggctaaagaaggtaactatgcgatcgttgctaatgttgagtccatggattacgatcccctcgtcgtgaaacttaacaaggatatcagcgccatcgaagaggccatgagtgcatctctgcagcagcacaagttccagtacattttcgaggggctgggtcatcttatctcatgcatcctcattaacggagcacagtactttcgcagaattagcgaaagcggcattaaaaaaatgtgtcggaacatcttcgtccttcagcagaacttgaccaatataacaatgtcacgcgaggccgacttggatttcgccaggcagtattacgaaatgctctacaataccgcagatgagttattgaatcttgtggtggatcaaggagtcaaatatactgaactggagtatatccacgccctgacacttcttcacaggtcacagactggggttggagaacttacgacgcagaatacgcggctccaacggcttaaagagatcatttgtgagcaggctgccattaagcaggcgaccaaagacaagaagattaccacagtgtag

SEQ ID NO: 187211 - DNA, 789 bp, Artificial Sequence
  Description of Artificial Sequence: Synthetic coding sequence
atgcacgagagcctggagtggctggccagccggaccaagagcgccttctctaacttgagcacatcccagatgctcagccctgctcaagattctcatactaacaccgacctgcctcctgttagtgagcagatcatgcaaacactgagcgagctggcaaaaagcttccaggacatggctgaccgctgccttctagtgctacatctcgaagtcagggtgcattgtttccactatcttatccccttagctaaggaagggaactatgcgatcgtagctaatgtggaatccatggattacgatcctctcgtcgtgaagcttaataaggacataagcgcgatcgaggaagccatgtctgccagcttacagcagcataagttccagtatatcttcgagggcttagggcaccttatttcgtgcattctgattaacggcgcacaatactttcgacggattagcgagagtggaattaagaaaatgtgtaggaacatcttcgtgctgcagcagaacctgacaaatatcaccatgtcacgagaggcagatcttgactttgcgcgacagtactatgagatgctttataacacagcagatgagttgctgaatctggttgttgaccaaggtgtcaagtacaccgaactggaatacatccatgccctcaccctgctacacagaagtcagacgggtgtgggcgaactaacaacccagaacacccgcctgcagcgactgaaggagattatatgcgaacaggcggctattaagcaggccaccaaagataaaaaaatcacgactgtgtag

SEQ ID NO: 187212 - DNA, 1755 bp, Artificial Sequence
  Description of Artificial Sequence: Synthetic coding sequence
atggccaacctggtgaccgccagcaagaccaagatgagcaagggcgaggatccaaacaatcctaggtccatcaaacggatttcccagggtggacgcgacaaccacctggccattgctaaatgtgatctcactcagttgaagaaaaaacaatccgaggtgtctaacggctcccgggaaaccataagtatgaaaacctgctgtcaacacggcgacagagggtactggagtacggggtactattggaggggcgggccagacgataacttaatcgaaggtgggggaaccaagttcgtgtgcaaaccaggagctcgcaatataacagttatttttcacccgctgctgagattcatccaggaaatcgaacacgccctaggtttaggccccgctaaacagtgcccattacgcgagttccttaccgtgtacattaaaaatatatttctgaaccaggtcctggcagaaatcaacaaggaaattgaaggggtgaccaagacatccgatccgttgaaaattctggccaatgcggatacaatgaaggtgctaggcgtacagcggcccctcctccaatctacaatcatagtcgaaaagaccgtgcaggacctgctgaacctgatgcacgacctttctgcatatagcgatcagtttttaaatatggtgtgcgtgaagctgcaggagtataaggacacttgcactgcagcctaccgcgggattgttcagtcggaggagaagttggtgatcagcgcatcttgggcaaaggacgatgatatttctaggctcctaaagtctctccccaactggatgaatatggcccagcccaaacagcttagacccaaaagagaagaggaagaagacttcatcagggctgctttcgggaaggagagcgaggtgcttattggcaatttaggagataaattaatacctcctcaggacattctcagggacgtctcagacctgaaggcccttgctaatatgcacgaaagccttgaatggttggcaagccgaacaaaatcagccttctcaaatctgtctactagtcagatgctctctcccgcccaggattctcacaccaacaccgatttgccccctgttagtgaacaaataatgcagactctctcggaactcgcaaaatcctttcaggatatggccgacagatgtctgctggtgcttcatctggaggtccgcgtacactgctttcactatctcatccctttagctaaggagggcaactacgctattgttgccaacgttgagtctatggactatgaccctcttgtcgtgaaattgaacaaggatatctctgccatcgaagaagcgatgtctgccagcctccagcaacataagttccagtatatatttgagggactgggacacctgatctcttgcatcctgattaatggagcccagtactttcggcgcatcagcgagtcgggcattaagaaaatgtgccggaacatcttcgtcttgcaacaaaacctaaccaatatcaccatgtcaagagaggcggatcttgatttcgccaggcagtactacgagatgctttacaacaccgccgatgaacttcttaatctcgtggtagaccagggggtcaaatacacagaactcgagtatattcatgcgctcaccctgctgcacagatctcagaccggggttggcgagttgactactcagaataccaggctccagcgtctaaaggagattatctgtgaacaggcagctattaaacaagccaccaaggacaaaaaaattactaccgtgtag

SEQ ID NO: 187213 - DNA, 1782 bp, Artificial Sequence
  Description of Artificial Sequence: Synthetic coding sequence
atggccgacgtgtgggtgaagatccaggacgtgctgcagatgctgctaaccgaatatctcgatatgaaaaataccaggaccgcatccgagccttcagcccaactctcctatgcctcgacaggccgagaattcgccgccttctttgcaaaaaagaagcctcagaggcctaaaaactcgctcttcaaatttgagtctagttcccacgccataagcatgtccgcctatttgcgtgagcaaagacgagagttgtactctaggtctggcgagctgcagggaggtcccgatgataacctgatagaaggcggtggcactaagttcgtttgtaaaccaggcgcgaggaacatcaccgtcattttccaccctctcctccgcttcattcaagaaatcgagcatgctctgggcctaggacccgcaaagcagtgtccgctaagagaattcctgaccgtctatattaagaacatatttctgaaccaggtcctggccgaaatcaataaagagattgaaggcgttactaaaacttccgaccccctgaaaattctggccaatgccgacacgatgaaagtcctgggcgtgcagcgccccctgctgcagtccaccattatcgtggagaaaaccgtgcaggacctgcttaaccttatgcacgatctgtccgcatattctgatcagttcttaaatatggtgtgcgtgaagcttcaggagtataaagacacctgcacggcggcctacagagggatcgtgcaatccgaggagaagcttgtaatctcagcttcatgggccaaagacgacgacatttccagactcctgaaatccctcccgaattggatgaatatggcgcagcctaaacagttgagaccaaagcgggaggaagaggaggactttattcgggccgcctttggcaaagaatccgaggtgttgatcggaaatttgggcgacaaactgatccctcctcaggatattttacgggacgtgtctgatttgaaagcccttgcaaacatgcacgaatcgttggagtggctcgctagtaggaccaagagcgccttcagtaacctgagtacgtctcagatgctgagccctgcgcaggattcccacactaacaccgacctcccccctgtcagcgagcagatcatgcagactctctccgagctcgctaagagctttcaggacatggccgatcgctgtctgttggtgctccatctggaagttcgagtgcactgttttcactatttaataccactagccaaagaaggcaactacgctatagtggctaatgtggagtctatggactatgacccacttgtagtgaaactcaacaaggatatcagcgctatcgaagaagcaatgtccgcttccctccagcagcacaaattccaatacatatttgaaggcctgggacatctcatttcctgtatcctgatcaatggagcccagtacttccgtcgcatctctgaaagtggaatcaaaaaaatgtgccgtaacatcttcgtcttgcagcagaacttgaccaacataaccatgtcccgtgaggccgacctcgacttcgctcgacagtattacgaaatgctctataatacagcagacgagctgttgaacttggtggtcgaccaaggagttaagtacactgagttggaatacattcatgcgcttacactcctccaccgctctcagacaggcgtgggcgaactaacaactcagaatacccgtttgcagcgcctgaaggagatcatatgtgaacaggccgccatcaagcaggcgaccaaagataaaaagattaccactgtgtag

SEQ ID NO: 187214 - DNA, 1932 bp, Artificial Sequence
  Description of Artificial Sequence: Synthetic coding sequence
atggccaccaccgccgagctgttcgaggagcccttcgtggccgacgagtacatcgagcgcttggtgtggagaacacctgggggggggtcacgaggcggccctgaggcttttgatcccaaaagactgctggaggaatttgtgaatcatatacaagagctccagatcatggacgaaaggatccaacgcaaagtggagaagctagagcagcaatgccagaaagaggctaaggaattcgccaagaaagtccaagagctgcagaagtcaaatcagatcaaggaggccgctgatatcatccagaaactgcatctcatcgcacaggagctaccgttcgatcgtttttcagaagtgaagagtaaaattgccagtaaataccatgacctggaatgccaactcattcaagagtttacaagcgcacagagacgcggggaaattagcaggatgcgggaggtggctgcggtccttctccacttcaagggctacagccactgcgtggacgtgtacattaagcagtgtcaggaaggtgcctaccttcgcaatgacatctttgaggacgcaggaatcctgtgccaacgggtcaacaagcaggttggcgacatattcagcaatccggaaacagttctcgccaagttgatccagaatgttttcgaaataaaactccagagttttgtcaaagagcagctggaggagtgtcgcaagagtgatgcggaacagtatctgaagaacttgtacgatctttacacaagaacaaccaacctgagttcaaagctcatggagttcaatctcggaacagataaacaaactttcctctcaaaactgataaagtcaattttcatcagctacctcgagaattacattgaggtggaaacaggctatcttaaaagcaggagcgctatgatcctacagagatattacgattcaaagaaccatcagaaaagaagcataggcacggggggaattcaggatctcaaggagcggattcgacagcggacaaatctgcctctgggaccttcgatagatactcatggcgagactttcctttcccaggaggtggtcgtgaacctgcttcaggagaccaagcaggcattcgagcgctgccataggctctcagatccttccgatctgcctaggaacgccttccgaatttttactattctagtggaattcctttgcatcgaacatatagattacgctctggaaaccgggttagctgggattcctagttctgacagccgtaacgcaaatctttacttcttggacgtggtgcagcaggccaatacaatcttccacctgttcgataaacaatttaatgatcaccttatgccactgatatcttcttcacccaagctttccgagtgcttgcagaaaaaaaaggaaattatcgaacagatggagatgaagctagacaccgggattgatagaactcttaattgcatgatcggccagatgaagcacatcctggcagccgagcagaaaaagactgatttcaagccggaggacgaaaataacgtcctgattcagtacaccaacgcttgcgtcaaggtgtgcgcatatgtcagaaagcaagtggagaagataaaaaactctatggacggcaaaaacgtcgatactgtcctaatggagctgggcgtgcggtttcatcgtttaatctatgaacacctgcagcagtactcttacagctgtatgggcgggatgttagccatttgcgatgtcgctgagtaccgcaaatgtgcaaaggacttcaaaattcccatggtgctgcatctgtttgataccctccatgcactatgtaacctgcttgtggtggcccccgataatttgaagcaggtgtgctccggggaacagctggccaacctggacaaaaatatcctccatagcttcgtgcagctgagggcagattacaggagcgcccgtttagcacgccatttctcttag

SEQ ID NO: 187215 - DNA, 2127 bp, Artificial Sequence
  Description of Artificial Sequence: Synthetic coding sequence
atggccaccaccgccgagctgttcgaggagcccttcgtggccgacgagtacatcgaaaggctagtgtggcggacccctggggggggcagtcgcggggggccggaagccttcgatccaaagcgtctattggaggaattcgtgaaccacatccaggagctacagatcatggacgaacgaattcagcgcaaagttgaaaaactggagcagcagtgccagaaggaggctaaggaattcgccaagaaagtgcaggagttgcagaaatctaaccaggtagcctttcagcatttccaggaactggacgaacacatatcctacgtggcaactaaagtctgccatctgggcgaccaattagaaggagtgaacacccctagacagagagcagtcgaagcccaaaagcttatgaagtacttcaacgagttcttggacggagaacttaaatctgatgtattcacaaatagcgaaaaaataaaggaggcggccgacattatccaaaaactgcacttgatcgcccaggagctgcctttcgacagattttccgaggtgaaaagcaagatagcatccaaatatcacgacctggagtgccaactgatacaggaatttacgtcggctcagcgacggggagaaatcagtcggatgagagaagttgcagccgttctattgcacttcaagggctattcgcactgcgtggacgtttacataaagcagtgtcaggagggtgcctaccttaggaatgacatctttgaggatgcgggcatactttgccagagagttaacaagcaggtcggtgacatcttcagcaatcccgagactgtgctggccaagcttattcagaatgtattcgaaataaaactgcaatctttcgtgaaggagcagctggaggaatgccgcaagtcagacgctgaacaatatcttaagaatttatacgatctctatactaggaccacgaatctgtcatctaagctcatggaatttaatctgggcactgacaaacaaacattcctgagcaagcttattaagtccatctttatctcctatctggaaaactacatcgaggtggagacgggttacctcaagtctcgaagcgcgatgatcctccagcgttactacgattcaaagaatcaccaaaagagatccatcgggactgggggtatccaggaccttaaagaacgtattcgccagaggactaacttgcctcttggccccagcatcgacacacatggagaaacttttctatctcaggaggtggtggtcaatttgctacaagaaacaaaacaggcctttgaaaggtgccaccgcctgtccgaccccagcgatctcccccggaacgcgtttcgcatcttcactatcctggtggagtttctctgcatcgagcacatagactacgcattagaaactggtctggccgggattccttcctcagactccaggaacgctaatctttattttctggatgtcgtgcaacaggccaataccatctttcacctgttcgacaaacagttcaacgaccacctgatgccgctgattagttccagtcccaagctgagcgaatgtttacagaaaaagaaggagattatcgaacagatggaaatgaagctggatacagggatcgatcgcaccctcaactgtatgattggtcagatgaagcatattttggctgctgagcaaaagaaaacagattttaagccagaggacgagaataacgtgctcatacaatatactaatgcctgcgtgaaggtgtgtgcctacgtgagaaagcaggttgagaagattaaaaactcgatggacggcaagaacgtcgacacggtgcttatggaattaggagtgagatttcataggctaatctatgagcatttgcagcagtactcttactcatgcatggggggcatgttggcgatctgtgacgtggcggagtatcgtaagtgcgccaaggacttcaaaattcctatggtgttacatctgtttgatacgttgcatgccctatgcaatttactcgtggtcgcccccgacaacctgaaacaggtctgttcaggagagcagcttgccaatctggataagaacattctgcactcttttgtgcaactcagagcagactatagatccgcaagactggcgcggcacttctcctag

SEQ ID NO: 187216 - DNA, 2415 bp, Artificial Sequence
  Description of Artificial Sequence: Synthetic coding sequence
atggccgagaacagcgagagcctgggcaccgtgcccgagcacgagcgcattcttcaggaaatcgagtccacggataccgcgtgcgtaggacctacattgcggagcgtgtacgatgaccagccgaatgctcacaaaaagttcatggagaagctggacgcatgtattcgaaatcacgataaagagatcgaaaagatgtgtaattttcaccatcagggatttgtggacgccattaccgagctgctgaaggtccgtacagacgcagaaaagctgaaagtgcaggtgacagacacaaaccgcaggtttcaagacgccggtaaggaggtgattgtgcacacagaggacatcattagatgccgcattcagcagcgcaatatcacgactgtcgtggaaaaactgcagctgtgtttacccgtcttggagatgtactcaaagctgaaggagcagatgtcagcaaaacggtactactcagccttgaaaacaatggagcagttggagaatgtctatttcccgtgggtcagccagtatagattctgtcagctcatgatagaaaacctgcctaagctacgcgaggatatcaaggaaatcagtatgtctgacctgaaagactttttagagagcattcgaaaacacagtgataagattggcgaaacagcaatgaaacaagcccagcatcagaaaacctttagcgtaagcctgcagaagcaaaacaaaatgaaattcggcaaaaatatgtatattaatagggatagaatacctgaagagcggaacgaaactgtgctcaagcacagtttggaggaggaagatgaaaatgaagaggagatactgactgtccaggacctggttgacttttcgcccgtgtatcgttgcctccatatttactctgtgctaggggacgaggagacgttcgagaattactaccgtaagcagcgcaaaaaacaggcccgtctggtgctccaaccccagagtaacatgcacgagaccgtggacggatatcgaagatacttcacccagatcgtgggtttctttgtcgtggaggaccacattctacacgttacacaggggctggtcacccgagcctatactgatgaactctggaatatggccctgtccaaaatcatcgctgtgctgcgtgcacattcctcctactgcaccgaccccgatctggtcctggagctgaaaaatctcaccgtaatcttcgctgacacgctgcaaggctatggattccctgtaaaccggctgttcgacttactgtttgagatccgagatcaatacaatgagacactgttgaagaaatgggctggcgtttttagggatattttcgaggaagacaactactcgcccattcccgtagtaaacgaagaagagtacaagatcgtaatctcaaaatttccttttcaggaccccgacctcgagaaacagtcgttcccaaaaaaatttcctatgagccagagcgtcccacacatctacattcaggtaaaagaatttatttatgccagcctaaaattttctgagtccctgcaccgatcatcaacagagatagatgacatgctgagaaagtcgactaatttgctgctgacacggacactgtcctcatgtctgctcaatctgatcagaaagccccatattggcctgaccgagttagtacagattatcattaacacgacacacctggagcaagcctgtaaataccttgaagactttatcaccaatatcaccaacatatctcaggagacagttcacactacacgcctttacggcctttcaaccttcaaggatgcgcggcacgcagctgaaggcgagatttataccaagctgaatcaaaaaattgacgagttcgtgcagctagctgactacgactggaccatgtccgagcctgatggccgagcatctggctacctaatggatctgataaactttttgaggagcatcttccaggtctttacacatctgcctggcaaggtcgcgcagacggcttgtatgtcggcatgccagcacttaagcacttctcttatgcagatgttactcgactcggagctcaagcaaattagcatgggggctgtgcagcagttcaatctggacgttatacagtgtgagctttttgcaagtagtgaacccgtccccgggtttcaaggcgatacattgcaactggcgttcatcgacctccgacagctgctggatctatttatggtgtgggactggagcacatacctcgctgattacggccagcccgcttctaaatatctgagagtgaacccaaatactgcgctgaccctactggagaagatgaaggataccagcaagaagaataacatcttcgctcagtttcgaaaaaacgaccgagacaaacagaagctgatcgaaaccgttgtgaagcagctccggagtctggtcaatggaatgtctcagcacatgtag

SEQ ID NO: 187217 - DNA, 462 bp, Artificial Sequence
  Description of Artificial Sequence: Synthetic coding sequence
atggccgagaacagcgagagcctgggcaccgtgcccgagcacgagcggatcctccaggagattgagtccacagataccgcatgcgtgggcccaacactcaggtcagtgtacgatgaccagccaaatgctcacaaaaagttcatggaaaaacttgatgcctgcatcagaaatcatgacaaagaaatcgaaaagatgtgtaactttcaccaccagggcttcgtggatgcaattaccgagcttttgaaggtgcgtacagatgctgagaagctcaaggtgcaggtcactgatacaaatcggcgcttccaggacgcgggaaaagaagtgatcgtccataccgaggacattattaggtgcagaatccagcagagaaatatcactacagtcgtagaaaagctgcaactgtgtcttccggtgctggagatgtactctaaactgaaagaacagatgagcgccaaaagatag

SEQ ID NO: 187218 - DNA, 2463 bp, Artificial Sequence
  Description of Artificial Sequence: Synthetic coding sequence
atgtgctgcgtgggcggcgccggcagctgcagcgacaccggcaagcttggagcctgcagagcgatgctggaagaagagacggaccagacctacgagaatgtgctcgccgagattcaatccttcgagttgcccgtggaagctactctgcgatcagtgtacgatgaccaacccaacgcgcacaaaaaatttatggaaaagttggatgcctgcattcggaatcacgataaggaaatcgaaaagatgtgcaacttccatcatcaggggtttgtggacgccattacggagcttttgaaggtccgaaccgatgctgagaagcttaaagtccaggtgactgataccaacaggcgcttccaagatgcagggaaagaagttattgtacacaccgaggacatcatccggtgtcgcatacaacagagaaatattactaccgtggtggagaaactgcagctttgcctccccgtcttagagatgtatagtaaactgaaagagcagatgtctgccaagcggtactacagcgccctgaaaacaatggaacagctggagaacgtctactttccctgggtgagtcaatacaggttctgtcaactcatgatcgagaaccttcccaaattaagggaggacataaaagaaatctctatgtcagatctgaaagatttcttggagtccatccgcaagcacagcgataagattggggagactgcaatgaagcaggctcagcatcagaagacatttagcgtttccctgcagaagcaaaataagatgaagttcggcaagaacatgtacatcaacagggataggatccccgaggaacggaacgaaaccgtgttgaaacacagtttggaggaagaagatgagaatgaggaagaaatccttacagtgcaggacctcgtggattttagtcccgtttaccgctgcctgcacatctattcggtcctgggggatgaagaaacctttgagaactactacaggaaacaacggaaaaaacaagctcgccttgtcctgcagccacaatcaaacatgcacgaaactgtcgacggctatcggcgttatttcacccaaatcgtgggctttttcgtggtggaagatcatattctgcatgtgacacagggactggtcacccgggcctatacagacgaactctggaatatggccctgtctaaaatcatcgcagtcctgagggcccatagctcctattgtaccgatcctgatctagtcttggaactcaaaaacttgaccgttatcttcgcggacacgctgcaaggatatgggtttccagtaaatcggctgttcgacctgctgttcgagatcagagatcagtataatgagaccctgctgaagaagtgggcaggcgtgttccgtgacattttcgaggaggacaactactccccgattcccgtggtcaacgaggaagaatacaaaatcgtaatttcaaagttcccattccaggaccctgacctcgagaagcagtcctttcccaaaaagttcccaatgtctcaatcagttcctcatatctatattcaagtcaaagaattcatctacgctagtcttaagttctcagaaagcctgcaccggtccagtactgagatcgatgacatgcttcggaagagcaccaaccttttactcacgagaaccctgagctcctgtttactgaacttaattaggaaacctcatattgggctgaccgagctggtccagattatcattaatacaacccaccttgaacaggcatgtaagtatctcgaggacttcattacaaacattacaaacatatctcaggaaactgtccacactacccggttgtacgggctgagcacattcaaggacgctaggcacgcagctgagggcgagatttatactaaactaaatcagaaaatagacgagttcgtgcagctcgctgattatgactggaccatgtccgagcctgatggacgtgccagcggctacctgatggatttaatcaatttcttgagatccatatttcaggtgttcacgcacctccccgggaaggtcgcccagacggcttgtatgtccgcttgccagcacctatcaacatcacttatgcagatgctcctcgacagtgaacttaaacagatctccatgggggccgttcagcagttcaatctggatgttattcaatgcgaactgtttgcttcaagtgagccagttcccggttttcaaggcgacactctgcagttggccttcatagacctccgacaacttctggacttgtttatggtttgggactggtctacctatctggccgactacggacagcccgcctcgaagtacctgcgggtgaatcccaataccgcccttactctgttggaaaaaatgaaggacacctctaaaaaaaacaacatctttgcccagtttcgtaagaacgatcgtgacaagcaaaaactcatcgagacggtggttaaacagctaaggagcctggttaacggcatgtcccagcatatgtag

SEQ ID NO: 187219 - DNA, 2400 bp, Artificial Sequence
  Description of Artificial Sequence: Synthetic coding sequence
atgctggaggaggagaccgaccagacctacgagaacgtgctggccgagatacagtccttcgagctcccagtcgaggcgacactgcgctccgtgtacgacgaccagcccaacgcccacaagaaattcatggaaaaactggatgcatgtattcggaaccacgacaaagagatcgaaaaaatgtgtaatttccatcaccagggcttcgtggacgcgataaccgaactgctgaaagttagaacagatgccgagaagctcaaggtgcaggtgacagatacgaatagacggttccaggacgcaggcaaagaggtgatcgtgcatactgaggatataatccggtgccgcatccagcaacgaaatataacaactgtcgtggagaagctccagctctgcttgcctgtccttgagatgtactctaagctcaaggagcaaatgtcggccaagcggtattacagtgcgttgaagaccatggagcagctggagaatgtgtatttcccttgggtctcccagtacaggttctgtcagcttatgatcgagaacttgccgaagttgcgtgaggacatcaaggaaatatctatgtcagatttgaaggatttcctcgagtccatccggaagcactcggataaaatcggcgaaacagccatgaagcaggcgcagcatcaaaaaaccttttctgtaagtttgcagaaacaaaataaaatgaagttcggcaaaaatatgtacattaatagggatagaatccccgaagaacggaacgagactgtgctgaagcactcactggaggaagaggatgagaacgaggaggaaatactaacagtccaagatttggtggatttctcccccgtttatcggtgcttacatatctacagtgtcctgggcgacgaagagacatttgagaactactatcggaagcaacgaaaaaaacaagcgaggttggtgttacagccccagtctaatatgcatgagactgtcgacggctataggagatattttacccagatcgtgggcttcttcgttgtagaagatcacatcctccacgttacgcagggcttagtaacccgtgcctatactgacgaactgtggaatatggcccttagtaaaattattgcagttctgcgggcccacagcagctattgcacagatccagatctggtgctagaattgaagaatcttaccgttatctttgcggatacccttcaggggtacgggtttccagtcaatagactgtttgatctgttgtttgaaattcgggatcaatataacgagacgctcttgaagaaatgggctggagtattcagggacatattcgaagaggataactattccccaatcccagtggtcaacgaagaagaatataagattgttatatctaaattcccttttcaagaccccgatctggagaagcagagctttcctaaaaaattccctatgagccagagcgttccgcatatatacattcaggttaaagagtttatttatgcatcactaaaattttcagagtctctccacaggtcatcaacagagattgacgatatgttgcgtaaatctacgaatctgctgctcacacggaccctgtcatcttgtttgctcaacctgattaggaagccacatatcggcctgacagagcttgtgcagataatcattaacaccacccatctggaacaggcatgtaaatacctggaggacttcatcacaaatataacaaatatcagccaagaaaccgtgcacacgactcgtctgtacgggctaagcacttttaaagacgccaggcacgctgcggaaggggagatctacaccaaactcaaccaaaagatcgatgagttcgtgcagctcgccgattacgattggactatgtctgagccagatggccgagcatcaggctatctgatggatttgatcaacttcctcaggagtatctttcaagtgttcacccatctgccaggtaaagtcgcacagacagcgtgtatgagcgcttgccaacacttgagcacctcgctcatgcagatgctactagacagcgagctgaaacaaataagtatgggcgccgttcagcagtttaacctggatgtaatccagtgcgagcttttcgcaagttctgaaccggtgcccgggtttcagggtgacaccctgcagctggctttcatagatcttcggcagctccttgacctctttatggtctgggactggtccacttacctcgccgattatggccagcccgccagcaagtacttgcgtgtcaaccccaatactgccctgacattgttggagaagatgaaggacacatccaaaaagaataacatttttgctcagttcagaaagaatgaccgcgataagcagaagttgatcgagacagtcgtgaagcagttgagatcacttgtcaacgggatgtcccaacacatgtag

SEQ ID NO: 187220 - DNA, 2106 bp, Artificial Sequence
  Description of Artificial Sequence: Synthetic coding sequence
atggccgagaacagcgagagcctgggcaccgtgcccgagcacgagcggattctgcaggaaatagaatctaccgataccgcctgtgttgggcccacgttgagaagcgtttatgacgatcagcccaacgcccacaaaaaatttatggaaaaactcgatgcgtgtatcaggaaccacgacaaagagatcgaaaagatgtgcaactttcaccaccagggcttcgttgatgcgatcaccgagctgctcaaggtgcgtacagacgcagaaaaactgaaagtacaggttacggacactaacaggcggtttcaggacgccggaaaggaggtgattgtgcacactgaggatattattagatgccgcatacagcaacggaacattactacagtcgtggaaaaactgcagttatgcctgccagtcctggagatgtactccaagttaaaggagcagatgtcggccaaaaggtactatagcgccctcaagacaatggagcagctggagaacgtgtatttcccttgggtgtcacaatataggttctgccaactcatgattgagaacctacctaagctccgggaggacattaaagaaatcagtatgtccgacctgaaagacttcttagaaagtattaggaaacatagcgacaagatcggcgaaactgccatgaaacaggcgcaacaccagaaaactttctctgttagcttgcaaaagcaaaacaaaatgaaatttggaaaaaacatgtatatcaacagggatcgcattccagaggagagaaatgaaacggtgctcaagcactctctcgaggaggaggatgaaaacgaagaagaaggtgatgaggagacctttgagaactactataggaaacagaggaaaaaacaagcgcggctggtccttcagccgcagagcaatatggggtacggatttcctgttaaccgacttttcgatctcctctttgagatccgcgaccagtacaacgaaactctgctgaaaaaatgggccggggtgtttcgagacatctttgaggaagacaattactcacccatcccagtcgtaaacgaggaggaatacaaaattgtgattagtaagttcccattccaagatcccgatctggagaaacagagctttccaaaaaaatttcccatgtctcagagcgtaccgcacatttacattcaggtcaaagagtttatttatgcgagtctgaagtttagcgaatctctgcacaggtccagcaccgaaatcgatgacatgctgaggaaatcaaccaacttattgcttactaggacactgtcctcatgtcttctcaatctcattagaaagccccatatcggcctgacagagcttgttcagattataataaatacaacacaccttgagcaggcctgcaaatacttggaggactttataaccaacatcacgaatatatcgcaagagacagtccacacaactcgcctctacggcctcagcacttttaaggatgcacggcacgccgctgaaggggagatttatacaaagctgaaccaaaagatcgacgaattcgttcaactagccgattatgactggaccatgtcagagcccgacgggcgagcttcgggctacttaatggacctgattaactttctgaggtctattttccaggttttcacacacctgcccggaaaggtagcacagacagcctgtatgtctgcttgccagcatctgtcaacaagcctgatgcagatgcttctggactctgaattgaagcagatcagcatgggtgccgtgcaacagttcaacctggatgttatacagtgcgagctcttcgccagcagcgaaccagtccccgggttccagggagataccctgcagttggctttcatcgaccttagacagctactggacctctttatggtgtgggattggtcaacctacttggctgactacgggcaaccggccagcaagtatttgcgcgtcaatcccaatacggccttgaccttactagagaaaatgaaagacaccagcaagaaaaacaatatctttgcgcagtttcgaaaaaacgaccgggacaaacaaaagctaattgagactgtggtcaagcagctcagaagcttggtgaacgggatgtcacaacacatgtag

SEQ ID NO: 187221 - DNA, 219 bp, Artificial Sequence
  Description of Artificial Sequence: Synthetic coding sequence
ggcaaggtggcccagaccgcctgcatgagcgcctgccagcacctgtcaactagtttgatgcagatgctgttggactctgagctaaaacagatttctatgggagctgtacagcagtttaacctcgatgtcatccagtgcgagctttttgcatcgtccgaacctgttccaggttttcagggtgataccttgcagctggcatttatcgacctaaggcagtag

SEQ ID NO: 187222 - DNA, 2436 bp, Artificial Sequence
  Description of Artificial Sequence: Synthetic coding sequence
atggagcggggcaagatggccgaggccgagagcctggagaccgccgccgagcacgagcgcatcctccgcgaaattgaaagcaccgataccgcatgcattggaccaactcttcgatcagtctatgatggcgaggaacacggtcggtttatggagaaactggaaacacggattcggaaccacgacagggagatcgaaaaaatgtgcaatttccattaccaagggtttgttgatagcatcaccgaactgttgaaggtcagaggggaagcgcagaaactgaaaaaccaggtcaccgatactaacaggaagttacagcacgaaggcaaagagctagtgattgctatggaagaacttaagcagtgtcggcttcagcagcggaacataagtgctactgtggataagctgatgctgtgtctgccagtgctcgagatgtactctaaactgagggatcagatgaaaacaaagaggcattatcctgcactgaagaccctggagcacctggaacatacctacctgccacaggtgtcacactatcgattctgtaaagtaatggtagataacattccaaaactcagagaggaaataaaggacgtatcaatgtcagacttgaaggattttttggagagcatcaggaaacactctgacaagataggcgagacggccatgaagcaggcccagcaacagaggaacctggataatatcgtgctgcagcagccacgtatcggcagcaaacgcaagtccaagaaggacgcttacatcatctttgataccgagatcgaaagcacctctccgaaaagcgagcaagactcgggtatcctggacgtcgaagacgaggaggacgatgaggaagttcccggcgcccaggatctagtcgatttctcaccagtctacaggtgtttacatatttatagtgttctgggagcacgtgaaacgttcgagaattactataggaaacagcgccggaaacaagcccgccttgtcctgcagccccccagcaacatgcacgaaacactggatggttacaggaaatacttcaatcaaattgtagggtttttcgttgtcgaggaccatattcttcacaccactcaaggtctcgtcaaccgtgcctatattgatgaactgtgggaaatggccctgtctaaaacgatcgcggccctgaggacgcactctagctactgcagcgacccaaacttagtacttgatctgaagaatttaatcgtgttgttcgctgacactctccaggtctacggtttccctgtgaatcagttgttcgatatgctgctggagattcgcgatcagtacagtgaaactctgctcaagaaatgggctgggatatttcggaacatccttgatagtgacaattacagccctattcccgtaaccagcgaggaaatgtacaaaaaggtagtgggacagttcccattccaagacatcgaactggagaaacaacctttcccaaaaaagttccctttcagcgaatttgtccccaaagtgtataatcaaattaaagaatttatctacgcctgcctaaaattctctgaggacctgcacctttcctcaacagaagtcgacgatatgatccgcaaatccacgaacctcttgctgacaaggactctcagtaattcattgcagaatgtgatcaaacgcaaaaatataggcctgacagagcttgttcaaatcattattaacaccactcacttggagaaatcttgcaagtacttggaagagtttatcacaaacattaccaatgtgctgcccgagaccgtgcacacaactaaactctacgggactactactttcaaagacgcacggcacgcagccgaggaggagatatataccaacctgaaccagaagatcgatcagtttctgcagctcgctgactatgattggatgaccggggatctcggcaataaagcatccgactacctggtggatttgatcgctttcctccgttccacatttgctgtatttacacacttacccggaaaagtggcccagacagcctgtatgtctgcatgcaagcaccttgctacctctctcatgcagctgcttttagaggctgaggtgagacagcttacattaggggcattacagcagttcaatcttgacgtgagggagtgtgaacagttcgctcgcagcggtcctgtgcccggttttcaggaggacacactccagttggcctttattgacctgcggcagctacttgaccttttcatccagtgggattggtccacttacctcgccgactatgggcaaccaaactgcaagtacctgagggttaaccctgtgacagccttaactctcctggagaagatgaaagacacaagccgcaaaaataacatgtttgcccagttccgcaagaacgagagagacaagcaaaagctgattgacacagtggccaagcagctgcggggccttatatctagtcaccacagctag

SEQ ID NO: 187223 - DNA, 2016 bp, Artificial Sequence
  Description of Artificial Sequence: Synthetic coding sequence
atggagcggggcaagatggccgaggccgagagcctggagaccgccgcggagcacgagcggattcttagggagatcgagtcaaccgacactgcctgcatcggtccaactctgcggtcggtgtatgacggtgaggaacacggcaggttcatggaaaagttagagactagaatccgcaatcatgatcgcgagattgagaagatgtgcaacttccactaccagggtttcgttgactctatcactgagctgctcaaggtgaggggcgaggcccagaaattgaaaaatcaggtcaccgacactaaccgtaaattgcaacatgagggaaaggaactggtgatagccatggaagagctcaagcagtgtcgtttacaacagaggaacatctccgctactgtggacaagttgatgctgtgtctgcctgtgctggagatgtatagcaaactgagggaccagatgaagacgaagcgccattatcccgcccttaaaactctggagcaccttgaacacacatatctgccgcaggtctcacattataggttctgtaaagtcatggtagataatattcccaagcttcgtgaggaaataaaggacgtttccatgtccgatctaaaagatttcctagaatccataaggaagcactccgacaagattggcgaaacggcaatgaaacaggcccagcagcaacgcaacttagacaacatcgttctgcagcagccacggatcgggtccaagcggaagagcaagaaggacgcgtacatcattttcgataccgagatcgagtccacaagcccgaagagcgaacaggacagtggaatcttagacgtggaggacgaggaggatgatgaggaagtccccggggctcaggacctagtcgacttcagcccagtgtatcgctgcctacacatctactcggttctgggggccagagaaacctttgaaaattactaccgcaagcagcgtcggaagcaggcccggctggtattacagcccccctctaacatgcacgagaccctcgatggctaccgcaaatacttcaatcaaatcgtggggttttttgtggtggaggaccacatccttcacaccacccagggattagttaaccgtgcttacatagacgagttgtgggagatggctttgtccaagacaattgccgcgctcaggactcactcctcctactgcagtgacccaaatttggtgttagacttaaagaacctgatcgtgctgtttgccgataccctgcaagtttacggcttccctgtcaaccagctttttgatatgctgctagagataagggaccaatacagcgagactcttctgaaaaagtgggccggcattttccgcaatattctggacagcgacaactatagcccgattccggtaacatctgaagagatgtacaaaaaggttgtggggcagttccccttccaggatatcgaactggaaaagcagcctttcccaaaaaaattcccattctcagagttcgtgcctaaagtgtataaccagataaaggaattcatctatgcctgcctgaagttttcagaggatttacacctgtccagtacagaggttgatgatatgataagaaaatccacgaatcttctactgacacgtacgctgagtaacagcctccaaaacgtgattaagaggaagaacatcggattaacagagctcgtccaaatcatcattaataccacacatttggaaaaatcctgcaagtacctggaggaatttataacgaacattacaaacgtgttgcctgagacagtccacacgaccaagctatacggcactacaactttcaaggacgccaggcacgctgctgaagaggaaatttataccaatctcaatcagaaaatcgatcagtttttgcagctggccgattacgattggatgactggagacttgggtaacaaggcgagtgattacctcgtcgatttgattgctttcctcagatcgaccttcgcagtattcacgcatttgccagtcagcggctcttgttatttcgttctatatatctag

SEQ ID NO: 187224 - DNA, 5970 bp, Artificial Sequence
  Description of Artificial Sequence: Synthetic coding sequence
atgaccaaggtgccccccgccttcgacttcagcttcctgaacgacgaagaggctaggaaaattctgcaggtgctagagcggaacgaggagctgcagcgtgctgagaaagaccggatcagcaaactacagaagactaagagagatataaggtggctgcagggcgtgacaggagaatggtttgaggaaatccaacggaagaagttctgtaatgaaaccgacgtgtctcagatgctgaaacaacctctcacatatcgcctgtctaaagagatggcgaaaaacgatcccatcgagctccccacaagccgaagcaagaatgtcaccaatcaaaaaaagcccacacctttcagtagccgtatgagcttcagatccagcttcgctagtctgttcagctttaggaagagcggaaaggagacatccaaactgccttctcttggccaaaagggctgcgacggccacgcagggccccccatgccggtgcgcggggccgccgtgcaggctaaaatttataattcaccactggaaaaccatctggtggactctaccttcgtgccaaaaccggcagtgatgcgcgaagaaagcggaatgccaccaccctgggacgcatccctgttggaaaacgagtttttccaggtgctggatgacctggacagcaaactggcccaagagcagagtgccagctcagtcaacactcggactccacttaattatggctctcgcacacagtttggccacttttacagtagtgggaaccgccacgggaacatcactgaaaggcataaaaaacattataatgagacgtccaatatgtctatctacgatattttaagacccgggactccccgagagggttttaagaccttcagccccagaactagcaccatttatgacatgtaccgaaccagggaaccgagagtatttaaagaggactatgtgcagaagaatacctttggaagcacatctctctgttttgacagccgacagagaagcgctctgccagccactggccatttcaccgccaggagcttacactttcccgcaactacccagtctaaaagcgggttcatcccccccaggcaccagcagagccccaaaagaacacctctgagttctattatatggaataggagtgactcaagtagagatcgcgagaatcaggaagagttcttgagagccccttcgccaatggaaattgaccccgcagacaagtacgtgtatccccgaggcttccaggaaaacaagcggtatgagagctatcattctcaaaacgtgtatcagcgcgtgtccctgaatgcacctatggaaaatgccatgagcccagacacattcgaaaactcagagaacatgcctttttaccatcagagtaatacatttaccaggagttttttttccaacacattcggccgatcaggtgagcagaggagattcgggcaagggccattttgggggcaggaaaagggacatagtttttggagcgactttcatcgctctcgcaagtctttctcctcctcagatcgtgacttcgagatgatttccatggaggctaattctgtgtcggcaatccacggtcacaatgtctcctccgagcactgggagtcatttagttcaggctacggcactgacgtctccagaggtcaagaggagccccatccgtggcaattcgactttcagagatctaccctggatagcatggtggtgagccacggaaatgaaacccaattgacaccccacttcggaaccccaaacgtctgcagcatgaccggttctagctaccatgtgaagtcatcagaacttgtctcccagcaggacagttccccggtggaggtgcacatcaacaaagaagcctcttcattcgggattgcccaaacacttgcttcgtccttcaaaacctcctttagccaaatctcagacgatcgacgcaatcctcagagtcccaacctgcagaatcccactgtgacgctgcaaaagattttccctaataaaccagcaagccaccctatgcggagtcacaccgaggtaaccgtgacaagcagtaacagcgtcgactctctgcctttggctaaaagccaaccgaacattctggtcaccgaggtcaataatgaaaaagatcttaatgaatcaatttctgaggaagataagcagttatccaaaatggaccagacaaacaaagcaggcgaaataccacagcctgtctctcaaacgggcatttcaaattcactgcctgatttccagaatcctctgtcccaggacagcgctaaaagtaacgggtttggctttaatgcttctactataattagctccaagaaatctccacgtgtttttagccgcaaggatacttccaaaatgtacataccacataccgataagtcaaacgacattaaacaggataaacgtttcactgagaaccggaagcttggctcaactgctagcctgcctttcatccaagaacatagaacccctcccagttttccaaggaccgatcaagggtgccatcaggaattgactgtgaacaacgaggatataagtcgaattataaccaacaatcactggtcatccgccctgacggacacccagaatgctcagtattcgaaatgcaaactgacacctggacataaaacgtcctgcgatagcctagatctgagtagcgccgccctgccagattccagcccatcaaagaattcttcactcgacgctcctgtggtgccatccaccacggtgttctccagaaggagccccagtgataaagatccctccttgggggaacgcgaagagaaggataatgccggcaagaatcagaaaaaccagttcattgtttcccacagcgagaaccaggagaggaacgactcccccgtacctacacacgacgaggttgtggacgtaaagtgccatagccattcccccttccggaacgaaagaggaaaaggcaagatccggcatcacatctcctgcatcgagaagctttcaaaaacagagtccatctccgtgcctacaagtgatcaccgatctctcatagaagctaaccagagtaactccaaagtatccgaactggataccatatattgcactctgccgcgcaaaagttctagctttctgatacatggcagacaatcggggtccaagatcatggccgcgtcacttagaaacggaccaccaccttttcaaataaaaaacaatgttgaggatgcgatgggcaactatatgctgaataaattttcgcctagctctcctgagtcagctaacgagtgttcaaaggttctctcggattccgcattagaggccccagaagcaaccgagcggatgaccaatgtgaagtcctctgggagcacatccgtgagaaagggaccactgccatttcttattaaccgcgcaatgagctgcccgtctggggaaccccacgcctccactggcagggaaggacgtaaaaaacccctcacaagtgggatggatgcgtctgagctgacgccacgggcctgggaacgcattatcagtcctgttgagtctgatagcagtgtacgagattgctctctcactaagcggcagcatcaaaaggagaattttcaggaatacaccgaaaaggaaggaaagatggcagcttcaaggaggtcggtctttgcgctgagtaacgaggacccgcttcctttctgctctgacttgagcggcaaggaacggggcaagaccttacacaaggtgaagaccacaagcaccttcagtgtgtcaggcgacgaggataacgtaaagtgcttggaagtcgtgtctatctactacaccctgcctaggaagccctcaaaaaaattttgcaacttgctgcagcagtatacgcaaaataccaacttgctcatagagtcacctcaggttgagacggaaacttttcctaacgccctcgaaaaggataaacaaaattattctactcgcgaacagtctgggacaccttcttgcgagaacctgaagatgtccgtcaacagcgaccaaacacttacaacagagaatatgacagctttcaggctgtcaaatagaggtcccttggcgccgacattacaggagatggccagtgtcgaggctgccgtgagcctgccagaggaagaaagcaaggcccgcgaaatcttcagcgacaatctggcaaaaacaccactcggcgattcagagaacaagaaggagcggggaaagaaactgcagagcgaaacgctgcataccagtcttatgctccagaggaagaacgttagtgaggaaaagtctgagaactgtcagcaaagtatcaacagttcaaactctggcccctcatcactcccggcactgagcgaagttaatataggcaatagtcagacacgccggtcctcttgggagtgtactggtagcggccgagctatccccttcaccggcagtggtaagtgtcctcaaaaggatcatacaagcactgccgtgggggacggcagtagtggctctcagccccgggagggaaggggagacattggcacaaactgtcagaaaatgaccaacaagacactctctcacagcgaatcccaagttttcgccctcacgcccgcacttcacaaattacagctcggtgaagaaacacagagtgatgaaccaaacctcgagtcgctgcagagcgagccacgcgaattaccccaaaggtcacaggaagcaaatatgactgagagccgaaaagcggaggacgagatgcagaaatccgcttgggaccaaccctctctgccggaagggaataaaaacaaaactaatttggacgacctggtgaaaggcgaaaaccgcagcagcgtgaaacatcggctggctgccatgtccaaggccagcaggaagtttcccgcgaaagatgtgagccctaggcggcatgtggcaacgattttccctcagagcggatctaggagcgggttcgatcatctctccctgggcacagtagagtgcaatcctctgtttcccgaacccactcccaagagtgctgaaagcatcggggagtcacggttgtcggaaaatggcaagcacgtaaaaaagtcagaaaatctgttgcccattactgttctgcccaaccgggagccctcaacacacgtgagtaatcagaagtctaattcaattagccagagacatcaaaacgagttcaaaaacgtgagtgaatctccctctaaacacgagaactctaaagacgttaccgccgcccagaatctggtccgcgagtctggagccccatctcccatcacatttacgtccctccgggaggccgagtttagtgacaaccagaggaggctcagccccccttttccgttagagcctgctcagaagagtagggtaagctccccactggcaagtttccttcagcagcagcgctccgcatccagcctcgaatgggagcccgaaccacacttgtacaggtcaaaaagcctcaaaagcatcaacgtacatggggacctgttgagaaagagccacccaccaaaggtgcgggagcggcatttttctgagagcacctccatcgacaacgccctgagtaggcttactctgggaaacgagtttagcgtgaataacggctacagccggcgcttccgctcgttcagcgagctgccttcgtgcgacggcaacgagagctgggcctacagatccggtaccaagaccggaccacggtccgccataagcatctacagacctattgactacggaatcttcggcaaggaacagcagctcgcatttttggaaaacgtcaaacggagcctcactcaaggaagattgtggaagccctcctttctgaagaacccgggattcctgaaagacgatctccggaatcctcccaatccctcggaatcactgagttcaaactcaccatcctcccaagtgcctgaggacggcctgagccctagtgaaccgctaaatatctacgaggacgatccggtcgattcaaattgtgacacagacactactacggacgacgagtactatttggatgagaatgacaaggagagtgagctctag

SEQ ID NO: 187225 - DNA, 5742 bp, Artificial Sequence
  Description of Artificial Sequence: Synthetic coding sequence
atgctgaagcagcccctgacctaccggctgagcaaggagatggccaaaaacgatccgattgaactgccaacaagcagatcgaaaaatgtcaccaatcagaagaaacctacacccttttcttctcgcatgagctttcggtcttcctttgcttcacttttcagttttagaaagagcggtaaggaaacctccaaactcccctcccttgggcaaaagggctgcgacggtcacgccggaccacccatgccggtgaggggagctgccgtccaggccaagatttataacagccctctggagaatcacctcgtggatagcaccttcgtgccaaagccggctgtgatgagggaggaatcaggaatgcctcctccgtgggacgcctccttgttggaaaacgaattttttcaggttctggacgacctggactcgaagctggcccaagagcagagcgcctctagtgtcaacacccgcacccccctcaactacggctcccgcacgcagttcggtcatttctattccagcgggaaccggcacggaaatatcacggaacgtcataagaagcactataatgaaacctctaacatgtctatatacgacattctgcgccctgggacgccacgcgaaggattcaaaaccttctctccaaggacaagtactatttacgacatgtaccgcacaagagaaccaagggttttcaaagaggactatgtgcaaaagaatacatttgggtccaccagtctctgcttcgattctagacagcgttcagccctgcccgccacaggccactttacagctcggtccctgcattttccagctaccacacagtccaaatctggctttatcccgcctaggcatcagcaatcccccaaacgcactcccctgagttctatcatatggaatcgaagtgactcctcccgggacagagagaatcaggaggagtttcttcgcgcgccttctcccatggaaatcgatcctgccgacaagtacgtctacccaaggggcttccaagagaataaacgttacgagtcataccatagccagaatgtgtaccagcgtgtgagtctcaacgctccaatggagaatgccatgtctcccgacacctttgagaactcggagaatatgcccttctaccaccagtccaatacattcactaggtcgttcttttctaacacgttcggaaggtccggcgaacagcgcaggttcggtcagggaccattctggggccaagaaaagggccacagcttttggtctgattttcaccggtcaaggaagtctttctcatcgagtgacagggattttgagatgatctccatggaagccaatagcgtgtccgcgatccacggacataatgtctcttcggaacactgggagtccttttcgtcggggtacgggactgacgtgtccagaggccaagaagaaccccatccatggcagtttgactttcagcggtcaaccctggactcaatggtggtcagccatggcaatgagacacagctgaccccacacttcggcactcctaatgtgtgttcgatgacagggagttcttaccatgttaaaagctccgagttggtttcccagcaagatagctccccggttgaggtccacattaataaagaggctagctcattcggcatcgcgcagactttggctagtagctttaagaccagcttctctcagattagtgatgataggcgcaacccccagagcccgaatctccagaaccctactgtgactctgcagaagatcttccctaacaagcccgcctcccacccaatgcgcagccacaccgaagtgacggtaacatcctctaacagtgtagactctctgcccctggccaaatcacagcccaatatcctcgtgaccgaggtgaacaacgaaaaggacctgaacgagtctattagtgaggaagataagcaactatctaaaatggatcaaactaacaaggctggtgaaattccacagcctgtttctcagacagggatcagcaattccctacccgattttcagaaccccctgagccaggatagcgccaagtccaacggattcggtttcaatgcttccactattattagttctaaaaagtctcctcgggtatttagcagaaaggatacatccaaaatgtatatccctcataccgacaagtcaaatgatattaagcaagataaacgtttcactgaaaaccgcaaactggggtctactgcctcactcccctttatccaggaacacagaactcctccatctttcccaaggacagaccaggggtgtcaccaggagttgactgtcaataatgaagacatttctaggataatcactaataaccattggagcagcgctctgaccgacacccaaaatgcccagtattcaaagtgcaaacttacgccaggccacaaaacctcatgtgactctctggacctgtctagtgccgctttacccgattctagccccagtaaaaacagctctttagacgctccagtggtcccatcaactaccgtgttcagccgcaggtccccttcggataaggatcctagtttgggagaaagagaggaaaaagacaatgccggtaagaatcagaaaaatcagttcattgtgtcccattctgaaaatcaggagcggaatgattcaccagtgccaacacatgacgaagtggttgacgtgaagtgtcatagccactcaccctttagaaatgaacgtgggaaagggaaaatccgccatcacattagttgtatagaaaaattgagtaagacggagtctatctctgtccctacttctgaccacaggtccctgattgaggcgaaccagtctaactccaaggtgagtgaactcgacactatttactgcaccctgccccgcaaaagcagtagcttcctgatccacggaagacagtccggatccaaaataatggcggcatccctgcgaaacggccccccccctttccagatcaaaaacaacgttgaggatgcaatgggaaattacatgttgaacaagttcagtccgtcatcccccgagtctgctaatgagtgcagcaaagtgctaagcgattcggctctggaagcacctgaggcaactgagcgaatgactaatgttaaaagcagtgggagcaccagtgttcgcaaagggcctttgccttttctgattaatagagcgatgtcttgccctagcggggaaccccacgcttcaacgggaagagaggggagaaagaagccactgacatcaggaatggatgcctctgaactgacgccccgggcatgggaacggattattagccctgtggagtccgactcctccgttagggattgttccttaaccaaacgtcagcatcaaaaagagaactttcaggaatataccgaaaaggaaggaaagatggcggcctcaagaaggtctgtttttgccctgtctaatgaagatcctctgccgttttgcagtgatttatctggaaaagaaagaggaaagaccctgcacaaggtaaaaacaacctcaacgttttctgtgtctggtgatgaggataacgtcaagtgcctggaggtcgtgtcgatttactatacgctgcctcgcaagccatccaaaaaattttgtaacctcctgcagcagtacacccagaacaccaatctcctcatagaatcccctcaggtggagacagagacttttcccaatgccttggagaaggacaagcagaactactccactagagagcagtccggcaccccaagttgcgagaatctgaagatgtctgtcaattccgaccagactctgactacagaaaatatgactgctttccgcctatccaataggggtccgcttgcccccaccctgcaggaaatggctagcgttgaggccgcggtgagtctgcctgaagaggaatctaaagcgcgggaaattttctccgataatctcgccaaaacccctcttggcgactccgagaataaaaaggagagaggcaagaagctccagtcagagactctgcacacctctttgatgcttcagcggaagaacgtgtctgaagagaaatcggagaactgccagcaaagcatcaacagttcaaatagtggtcctagttcactccctgctttgtctgaagtcaatattgggaattcccagaccaggcgttcctcgtgggaatgtactggctctggccgggccataccattcactggtagcgggaagtgtccacagaaagaccacacttccacagcggtaggcgatgggtcctcaggaagtcagccacgtgagggccgaggagatataggtacaaattgtcagaaaatgacaaataaaacgctgtcccactccgagagtcaggtttttgccctaacacccgctctgcataaactccaactaggagaggagacccagagcgatgagccaaacctcgaatccctccagtccgaacctcgcgaacttccgcagcgcagccaggaagcaaacatgaccgagagcaggaaggccgaggacgaaatgcagaagagtgcatgggatcagccctctctccccgagggcaacaaaaataagactaatctcgatgacttagtgaagggcgagaatcgctcctccgtcaagcatcggctggcagcaatgtccaaggcttctaggaagttccctgctaaggatgtgtctccaaggcggcatgtggccacaatcttcccacaaagtggcagcagatccgggttcgaccatctgtctctcgggactgtagaatgcaatcctcttttcccggaaccaacccccaagtcggctgaatcaattggagagagccgccttagtgaaaatggtaagcatgtaaagaagtcggagaaccttctgcccatcactgttcttccgaatcgggagccttcaacccatgtgtcaaaccagaagagcaacagcattagccaacgccatcagaatgaattcaaaaatgtatcagagagtcccagcaaacacgagaacagtaaagacgtgacggccgcccaaaacctggtgagggaaagcggagctccaagtcctattacgtttactagcctgcgcgaagccgagttctcagataaccaacgacgactgtctcctccttttcccctggaacccgctcagaaatcccgggtaagcagtcccctggcctctttccttcagcagcagaggagcgcctcctccttggaatgggaacctgagccacacctctatcgaagcaaatctttgaagtctattaatgtacatggcgatctgttgcgcaaatcacaccccccgaaggtgcgagaacgacatttcagtgagtcgactagtatagataatgcactgagcaggctgacattgggcaacgagttcagcgtgaataatggttactcacgtcgatttcgatcttttagcgaactgccctcctgtgacggaaacgaaagttgggcctatcgttccgggactaaaacaggtccaaggagcgctatttctatctatcggccgatcgactacgggatatttgggaaggagcaacagctagcgttcttggagaatgtaaagcggtctctaacacagggtcggctctggaaaccctcctttctgaagaaccccgggtttctaaaggatgatttacgaaaccctccaaatccaagtgaatctctgtccagcaactctccctccagccaggtgcctgaggacggcctgtcgcccagcgaacccctcaacatttatgaggacgacccggtggactccaattgtgacaccgacacgactactgatgacgaatactatctcgacgagaacgacaaagaatctgagctgtag

SEQ ID NO: 187226 - DNA, 2460 bp, Artificial Sequence
  Description of Artificial Sequence: Synthetic coding sequence
atgcccgtgcggggcgccgccgtgcaggccaagatctacaacagccctcttgaaaaccaccttgtagattctacttttgtcccaaagcccgccgttatgcgggaggaaagcggtatgcctcccccgtgggacgcatctctgctggagaatgaattcttccaggtcttggacgatctagactctaaattagcgcaggaacagtccgcatcaagtgtgaatacccgcacaccattgaattacggttctcgcacccagttcggacacttctattcatccgggaaccggcatgggaatatcactgaacgccacaagaagcattacaacgaaacttccaacatgagtatctatgatatcttgcggcctggaaccccaagagaaggcttcaagacctttagccccaggactagcacaatttatgacatgtaccggaccagggaacctcgtgtgttcaaggaggactacgtgcagaagaacacattcgggagcacctccctgtgcttcgactctagacagcgcagcgctctgccagccactgggcattttactgctcgcagccttcattttcctgctaccacacagagcaaatccggcttcatccctccaaggcatcagcagagccccaagagaacccctctgagttctatcatatggaaccgttccgactccagcagagatagagaaaaccaggaggaatttctgcgcgccccatcccccatggagattgatcccgccgataagtacgtgtatccccggggtttccaagagaataaaagatatgagagttaccacagccagaatgtgtatcagagagtgagtctgaacgctccaatggagaatgccatgagtccagacacatttgagaactcagaaaacatgcccttctaccaccaaagtaatactttcacgaggtcattcttttccaacaccttcggacgatccggagagcaaaggcgatttgggcaggggccgttctgggggcaggagaaaggtcattctttctggagtgatttccatcggagtcgcaaaagcttctctagttccgaccgagactttgagatgatatcgatggaagccaactcagtatctgccatccacggacataatgtttcctccgagcattgggaaagcttcagttccggctacggtaccgacgtctctcgggggcaggaggaaccccacccttggcagttcgacttccagcggagcaccctggatagcatggttgtgagccacgggaatgaaactcaacttaccccacacttcgggaccccaaacgtgtgctccatgacagggtctagctaccacgttaaatccagcgaactggttagccagcaggatagcagccctgtggaggtccacatcaataaggaggcaagcagtttcggaatcgcgcagacgttagctagcagttttaagacctccttttcgcaaatctcagatgaccgaagaaacccccaatctcccaacctacagaaccctaccgttaccctgcagaagatcttccccaacaagccagcttctcacccaatgcgatcccacactgaggtcacagtgacctcttcgaattctgtggattcactgccccttgccaagtcccagcctaacatattggtgactgaagttaataatgaaaactccaaagacgtgacggcagcacaaaacctggttagggagtctggcgcgccttccccaataacttttaccagcctgcgtgaagcagagttctcagataatcagagacggctgtctccaccgtttcctctggagccggcccagaaatctcgggtgtccagccccctggcctccttccttcaacagcaacgctcagcaagtagcctggaatgggagcccgagccccacctttatagatctaagagtctgaagagcatcaacgtccacggcgacctgctgcggaagtcccaccctcccaaagtgcgtgagcggcacttcagtgaatccacctccatagacaacgccctgtccaggctgacattggggaatgagtttagcgttaacaatgggtactcaagacggtttcgctctttcagtgagctcccatcctgcgatgggaatgagtcctgggcctacagatctggaaccaagacagggccaaggtccgctatttctatctaccgccccatcgattacggcatcttcgggaaagaacagcagttagcttttctcgaaaacgtgaaaagatctcttacgcaaggcagactttggaaaccgtctttcctcaaaaatcccgggttcctcaaggatgatctccggaatccccctaatccttccgaatccctttcttctaatagcccatccagccaggtacccgaggatggccttagcccctccgagcccctgaatatctacgaggacgatcccgtggactcaaactgtgacacagacaccacaaccgatgacgagtactatctagacgagaacgataaggagagtgagctgtag

SEQ ID NO: 187227 - DNA, 5406 bp, Artificial Sequence
  Description of Artificial Sequence: Synthetic coding sequence
atgcgggaggagagcggcatgccccccccctgggacgccagcctgctggaaaatgagttcttccaggtgctggacgaccttgactcaaagctggcccaggagcagtccgcatcgagtgtgaacactcgtactccacttaactacggaagccggacacagttcggtcacttctactcgagcggcaaccggcacggaaatatcaccgaaagacataagaagcattacaacgaaacttcgaacatgtccatttatgacattttaaggcccggaactccccgtgaaggcttcaaaacctttagcccaaggacatcaaccatctacgacatgtatcgcactcgtgagcctagggtgttcaaagaagactacgttcagaaaaacactttcggatccacctcattgtgctttgactccagacagaggtctgccctgcctgccacagggcactttactgctcgcagcctacacttccccgctacgactcagagtaaaagtggcttcattcccccaaggcaccagcagagtcccaagagaactccactcagcagtataatctggaataggtccgacagtagtagggatagggaaaaccaggaagaatttctgcgagctccctcacctatggagatagacccagctgacaagtacgtctatccgagaggcttccaggagaataagaggtacgaatcataccacagtcagaatgtgtaccagcgcgtatccctgaatgcaccaatggagaacgcaatgtcacctgatacttttgagaactcagagaacatgcctttctatcaccagagcaatacttttaccagatcctttttttctaatacgtttgggagaagtggggagcagagaaggtttggacagggccctttttggggccaagaaaagggccactcattttggtctgatttccatcgcagccggaaatccttcagctcgtctgatagagactttgaaatgatatccatggaagcaaattccgtctctgcgattcatggacacaatgtgagcagtgagcactgggagagcttctcaagtggatatgggacagacgtgtcccgaggccaggaagagccacacccctggcagtttgatttccagagatccacgttggatagcatggtggtgtcacacgggaacgaaacacagctaacccctcactttggcacgcctaacgtgtgtagcatgaccgggtccagctaccatgttaaatcgtctgagttagtgtctcagcaagactctagcccagtggaagtgcacatcaacaaggaggccagctcattcggcatcgcacagactttagcctcgtcattcaagacatctttctcacaaatctcggacgaccgacgcaaccctcagtcacctaacctccagaatccgaccgtgactttacagaaaatcttcccaaacaagcccgcaagccaccctatgaggtcacatacagaagtcaccgtcacaagctccaactctgtcgattctctacctctggccaaatcacagcctaacatccttgtaacagaggtcaacaatgaaaaggacctgaatgagtctatttcagaggaagacaaacagttgagcaaaatggatcagacgaataaagcaggggaaattccacagccagtaagccagaccggcatcagtaacagccttccggattttcagaatccactttctcaggattcagccaagagcaatgggttcggattcaacgccagcacaatcatttcctccaagaagtctcccagggtattttcccgtaaagacacctccaagatgtacattccacacaccgataagtcgaatgacatcaaacaggataagagatttaccgaaaacagaaagctcggcagtactgcatcccttccttttatacaggaacaccgaacccccccatctttccccagaaccgaccagggttgtcaccaggaactgacagtaaataatgaggatatcagtagaattataaccaacaaccattggtcaagtgccctcaccgacacacaaaatgcacagtattccaaatgcaagctgacaccagggcataaaacttcatgtgattcactcgacttatctagcgcagctctgccagactcatccccgtccaagaacagttctctggacgccccggtggtacctagcacaactgtgttctcgagacgaagcccaagcgataaagatccctccttgggagaacgggaggaaaaagacaacgccggaaaaaaccagaagaaccagttcatcgtgagccattcggaaaatcaggagagaaatgattccccggttccaactcacgatgaggtcgtggacgttaagtgccattctcacagtccgttcaggaacgaacgtgggaaggggaaaatcagacaccatatctcttgtatcgagaaactgtccaaaacagagagcataagcgtaccaacctcagaccatcggtcactgatcgaagcgaatcagtccaactccaaggtctccgaactggatactatctactgcacgttgccacgtaagagctcctcgttcttaattcacggccggcagtcaggatccaaaataatggcagcctcattaaggaatggtccgccgccatttcagatcaagaacaacgtggaagacgccatgggtaactacatgttgaacaagtttagccccagctcccccgagagcgccaacgagtgtagcaaagtgctgagcgacagtgctctggaagccccagaagccaccgagaggatgacaaacgtaaagagttcgggtagtacctcagtgaggaaaggtccactaccatttctgattaaccgggccatgtcatgtcccagcggagaaccccatgcctccacagggcgggaaggccggaagaaaccgctaacctctggaatggacgcatctgaactcacccctcgtgcctgggaaaggattatctcgccagtcgagtccgatagctccgtccgggactgctctctcacaaagaggcagcaccagaaagaaaatttccaggaatatactgagaaggagggtaaaatggcagcctctagacgatctgtgtttgctctgagtaacgaggacccattacccttttgctccgacctgtccggaaaagaacggggcaaaacattacacaaagtaaagactacatccactttctctgtcagcggtgatgaggacaatgtgaaatgtctggaagttgtgagcatttactacacactgcccaggaagcccagcaagaaattttgtaacctgctccagcaatatacacagaacacaaatttgctgattgaaagcccccaggttgagaccgaaacctttcccaacgcccttgaaaaggataaacagaattattccacaagagagcagagcggaacaccatcttgtgagaacctcaaaatgagcgtgaattcggaccagacactaacaacagagaacatgacagcttttcgcctctcaaacagggggcctttggctcccaccctccaggagatggcctccgtggaagctgccgtgtccctgcctgaggaggaaagcaaagcacgtgagatttttagtgataacctagcaaagacccccctgggagactccgagaacaaaaaggaacgggggaaaaagctccagtccgaaacactgcacacttcacttatgctacagaggaaaaatgtgagcgaggagaagtcggaaaattgccagcagagcatcaatagctcaaatagtggcccttcatctcttccggccctatcagaggtgaatattggtaactcacagactcgtaggagctcttgggaatgtaccgggtcaggcagagctataccctttacaggcagtggaaaatgtcctcaaaaagaccacacatcgacagcagtaggcgacgggtctagcgggagtcaaccacgagaaggaagaggagacatcgggacgaactgtcaaaaaatgacgaacaaaacactgagtcacagtgagtctcaggtattcgccttgacaccagcgctacacaaattgcagcttggggaggagactcagtctgacgagcccaaccttgagtcattgcagtctgagccccgtgagctcccccagcgctcgcaagaagccaacatgacggagtctcggaaggccgaggatgaaatgcagaagtctgcgtgggaccagccaagcctcccggaaggcaacaagaacaagactaatctagacgatctggttaaaggagagaaccgctcttcagtgaaacatagactagcggccatgagtaaggccagtcgcaagttcccagccaaggacgtgagtcccagacgccatgtggctacaatcttcccacagtccggttctagatctgggtttgatcacttatcccttgggacagtcgaatgtaatcctctctttcccgagccaacccctaagagtgcggagtccatcggggaaagccggctgtcggaaaacggtaagcacgtgaagaaatcggagaacctgttgcccattacagtgctgcccaacagagaacccagcacacacgttagtaaccaaaagagtaacagtatatcccaacgccaccagaatgagtttaaaaatgtttccgaatcccccagcaaacacgaaaatagcaaagatgtgactgccgcacagaaccttgtgcgcgaatcaggagccccgagtccgattactttcacgtcattgcgggaggcagaattctctgataaccagcggaggttgtcaccaccttttcccttggaaccagctcagaaatctagggtgagcagtcctctcgcaagctttctccaacagcagcgcagcgccagttccctggagtgggaacccgaaccacacctgtatagaagtaagagccttaaaagtataaatgtccatggagatctgttaagaaagtcccaccctccaaaagtacgtgaacggcatttctcggagtccactagtatcgacaacgccctgtctcgcctgactcttggcaatgagttttcagttaataacgggtatagtcgaaggtttcgatcgttttcagagctcccaagctgtgacggcaatgaaagttgggcctatcgaagtgggactaagacaggaccccggtcagcaattagcatataccgccccatcgattatggcatctttgggaaagagcaacagctggcatttttggagaacgtcaaacgtagcctgactcagggtcgcttatggaaacctagcttcttaaaaaaccccgggtttctgaaggatgacttgcgcaatcctcccaacccctctgagagcctgagcagtaactcaccctcctctcaagttcctgaagacggactgtcaccatccgagcctcttaacatttacgaggacgacccagtggatagcaattgcgacaccgataccactacagacgatgaatattacctcgacgagaacgacaaagaatccgaattgtag

SEQ ID NO: 187228 - DNA, 5949 bp, Artificial Sequence
  Description of Artificial Sequence: Synthetic coding sequence
atgagcctgagcttcctgaacgacgaggaggcccggaagatcctgcaggtactggagcgtaacgaagagctccagcgggccgagaaggaccggatcagtaagcttcagaagacaaagcgggacattaggtggctgcagggtgtaactggggagtggtttgaagagatccaacggaagaaattttgcaacgagacggacgtgagccagatgttgaagcagccgcttacttaccgtctctctaaggaaatggccaaaaacgatcccatcgagctgcccacaagtcggtctaaaaatgtgacgaatcagaagaagcccacacctttttcctcccgtatgagtttccgttccagctttgcctcgctattcagctttcgcaagtctggcaaagagacatctaagttgccctctttgggccagaagggttgcgacgggcacgctggcccgccaatgccagtgaggggcgctgcggtccaggccaaaatctataatagtcctctcgagaaccacctggtagatagtactttcgtccctaaacctgctgtgatgcgcgaggagtcaggaatgccaccgccatgggatgcaagcttgctcgagaacgagttcttccaggtcctggatgatctagacagcaaactcgcacaggaacaaagtgcaagctcggtcaacactcgaacacctctcaactacggatctcggacccagttcggccatttttatagctccggtaatcgtcacgggaacatcaccgaacgccacaagaagcactataatgagacctccaacatgagcatctacgacatccttcgccccggaaccccaagggaaggtttcaaaaccttcagccctcgaaccagtaccatttacgatatgtatcggactagggaaccaagagtgtttaaggaggactacgtgcagaaaaatacttttggttcaacttcactctgttttgactctaggcaaaggtctgccctgcccgcaaccggccatttcaccgccaggagcctgcactttcctgcaacgacccaatcaaagagtggatttattccaccacgtcatcagcagtcccctaaacgcaccccattgtcttcaataatctggaacagatctgattcctcacgcgaccgtgaaaaccaggaggagttcctccgggcaccttcacccatggaaattgaccccgctgacaaatacgtgtatcctagagggtttcaagagaataagcgctacgagtcctaccattcccagaacgtctaccagcgggtgtcactgaacgctccaatggagaatgctatgtctcccgacacttttgaaaatagtgagaacatgcctttttatcatcagagcaacacgttcacaaggagcttcttcagcaacacctttggaagatccggagaacaacgccggtttggacagggaccattttggggccaggaaaaaggacactccttctggagcgatttccacaggtcgaggaaatccttttcaagttccgaccgtgacttcgaaatgatctccatggaggcaaattccgtctcagcaatacatgggcataatgtgagcagtgagcattgggagagctttagcagtggttacggcactgatgtgtcccgggggcaggaggagcctcatccctggcaatttgacttccagcgtagtaccctggactcgatggtagtctcacacgggaatgagacccagctcacgccgcactttggtacccctaacgtgtgctctatgacgggctcttcatatcacgtcaaatcaagcgaactggtgtcccagcaggattcctctcccgtcgaagtgcacattaacaaggaggcatctagcttcggcatcgctcaaactctggcatcatcattcaaaacctctttttctcaaattagtgatgacagacggaatccccagtcacctaacttgcagaatcccactgttaccttgcagaaaatcttcccaaacaaaccggcttctcaccctatgcgatctcacaccgaagtcacagttacatccagcaactcagtggatagcctgcccttagctaaatctcaacctaatattctggtgaccgaggtcaacaatgagaaggatctgaacgaaagtatatccgaagaggataagcaactcagtaaaatggatcaaaccaacaaggcaggcgagattcctcagcctgtgtcccaaaccggaatctctaactctctgccggatttccagaatcctctgtctcaagatagcgctaaaagtaacgggtttggcttcaacgccagcacaattatctcctccaagaaaagtccgcgtgtctttagccgcaaagacaccagcaaaatgtatatccctcacaccgacaagtccaacgacattaaacaggacaagcgatttactgagaataggaaactgggctcaacggctagtttgccttttatccaggagcacaggactcctccatcctttcctcggacggatcagggttgccaccaagagctgactgtcaataacgaggatatttctcgcatcattactaacaatcattggagctcggccctgaccgatacgcagaacgcgcagtactctaaatgtaagctgactcctggccacaagacctcttgtgacagtctggatctgtcctcagctgccctgcctgactcatctccctccaaaaatagtagcctggacgccccggtagttccttcaactactgttttctcgcgcaggagtccctccgacaaggatccttcactgggtgaacgagaggaaaaggataatgccggaaagaaccagaagaaccagtttattgtttctcactccgagaaccaagagaggaatgattcacccgttcccacacatgatgaagtcgtggatgtcaagtgccactcccactcaccctttaggaatgagcgcggcaagggtaagattaggcatcacatctcatgcattgaaaaactgagtaaaacagagtcgatttcagtaccgacttctgatcacaggtcactcattgaggccaatcagtccaactccaaagtctcggaactggacactatatactgcactctcccccgcaaatcatctagtttcttaattcatggtcgccagtctggcagcaagatcatggctgcatcccttcgaaatggccctccgccttttcaaatcaagaacaatgttgaggacgccatggggaattatatgcttaacaagttcagtccctccagtcctgagtcagccaacgagtgttccaaggtgctgagcgatagcgctctggaggccccggaggctactgagcgtatgacaaatgtcaagtcttcaggatcgacgagtgtcaggaaggggccattgccctttctgattaacagggccatgtcttgcccttccggcgagccacatgcatcaactggcagggaaggtaggaaaaagcctctgacctccggcatggatgcttcagaactgactccccgggcttgggaacgtatcataagccctgtggaatccgactccagcgtccgggactgttcgttgactaaaagacagcaccagaaggagaattttcaggagtacaccgaaaaggagggaaaaatggctgcgtccagacggtcagttttcgctttgagtaacgaggatccactccctttttgttccgatctctctggcaaggaacggggaaaaacattgcataaggtgaaaactactagcacattcagcgtgtccggcgatgaggacaatgtgaaatgcctcgaggtagtgtctatctattataccctgccccggaaaccgtctaagaaattctgtaacttacttcagcaatacacgcagaatactaatctcctaatcgagtctccccaggtggaaactgaaacctttcctaacgccttagagaaagataaacagaattattctactcgagaacagtcgggtaccccttcctgtgaaaacctgaaaatgtctgtgaactccgaccagaccctgacaactgagaatatgactgcatttaggctgagtaatagaggacccttggccccaaccctccaggagatggcctctgttgaggccgccgtgagtctgcccgaagaagaaagtaaggcccgggagatcttttcagataacctcgctaagacgcctttgggggatagcgaaaacaagaaagagaggggaaaaaaattgcagagcgagacgctgcatacatctttgatgctccaaagaaaaaacgttagtgaggaaaaaagcgaaaactgtcagcagtcaatcaactctagtaatagtgggccttcttccttgcccgctctttcagaagtaaacatcgggaattcgcaaactagacggtcgagctgggagtgtactggtagtgggcgcgcaattccttttaccggctctggcaagtgtcctcagaaagaccacacctctaccgccgttggggatggtagctctgggagtcaacctcgggaggggagaggtgacattgggaccaactgtcagaaaatgaccaataagacactgtcgcactctgagagtcaggtctttgcactgactcctgcgctgcacaagctgcagcttggggaagaaacccaaagtgacgaacctaacctggaaagtttacagagcgaaccaagggaacttccgcagcgatcccaggaggccaatatgacagagagcaggaaagctgaagatgagatgcagaagtctgcctgggaccagccgtcactaccagaaggcaataagaacaaaaccaacttggatgaccttgtcaagggggagaatcgcagcagcgttaagcatagacttgcggccatgagcaaagcctcacgcaaattccccgctaaggacgtgagtccgcgccgacacgtggccactattttcccgcagtcgggctcaaggagcggctttgatcacctaagtttagggaccgtggagtgcaacccactgtttcctgagcccacccccaagtcagctgaatctattggcgagtcacgactgtccgagaacggaaagcatgtcaaaaaatctgagaatttgttgccaatcactgtgttaccgaacagggaaccaagcactcatgtgtctaatcagaagagcaattccatcagccagagacatcagaacgagttcaagaatgtgagcgagagcccgagcaaacacgagaactctaaggacgtcacagctgcccaaaatctcgtcagggagagtggtgcacctagcccaatcacatttactagcctgagagaagctgaatttagcgataaccagagaaggttgagccctcccttcccattagagcccgcacagaagagcagagtcagcagcccactcgcgtcatttctccagcaacaaaggtcagcctctagcctcgagtgggagccagagcctcatttgtatagaagcaaatcactgaaaagtatcaatgtgcacggcgacctcctacgaaagtcccaccctcccaaggttcgggagcgccatttttccgagagtaccagtatcgataacgcattgtccaggttgacactcggaaacgagttctccgtaaacaacgggtattccagacgattccggtcctttagtgagctaccgtcttgtgatggcaacgagtcttgggcatatcgatcaggaactaaaacaggcccgaggtcagctatctccatctacaggcctatagattatggcatcttcggcaaggagcagcagttagcattcctcgagaacgtaaaacgcagccttacacagggtagattatggaagccttcctttctgaagaaccctggttttctgaaggacgatctgaggaatcctcccaacccgtctgaaagtcttagctctaatagtccgtctagccaagtcccagaggacgggttatctccttccgaacctttgaatatttacgaagacgaccccgttgattccaattgcgacacagatactaccacagacgacgagtattacctggatgaaaatgataaagagagcgaactgtag

SEQ ID NO: 187229 - DNA, 2583 bp, Artificial Sequence
  Description of Artificial Sequence: Synthetic coding sequence
atggccccccccagcacccgggagccccgggtgctgagcgccaccagtgcaaccaaatcagatggcgagatggtattgccgggattcccagacgctgattcctttgtcaagtttgcattaggctccgtggtggcagtaaccaaagcctccggaggattaccccagttcggagacgaatacgatttttaccggtcttttccaggattccaggccttttgcgagactcagggagacagactgctgcaatgtatgagcagggtaatgcagtatcacggatgtcggagcaatatcaaagaccgttctaaggtcactgaactggaggacaaatttgatctgctggtagatgcgaatgacgtcattctggaacgagtaggtatcctcctggatgaagcatccggagtgaataaaaaccaacagcccgtcttgcccgccgggctccaggtaccaaagactgtcgtctctagttggaacaggaaagctgccgaatacggcaagaaggccaagtctgagacctttcgtttactgcacgcgaaaaatatcattagaccacagctcaagttccgcgaaaagattgacaattcgaacactcctttcctgcccaaaattttcataaaaccgaacgcccaaaaaccactacctcaagcgctttctaaagaacggagggagcggccccaggaccggcccgaggaccttgacgtgccacctgcactggccgacttcattcatcagcagaggacccagcaggtggaacaggacatgtttgcacacccgtatcagtacgagctcaaccattttactccagctgatgctgttttacagaagccccagccacaactttacagacctatcgaggagacaccttgtcatttcatctcctcccttgacgagctggtggaattaaacgagaagctcctgaattgtcaagagtttgcagttgatttggaacaccattcttatcggtcctttttgggcctgacatgtctgatgcagatctctaccaggaccgaggactttattatcgacacactggagttacggtccgacatgtatatcctgaacgagtcactgactgaccctgcaatcgtgaaggtcttccatggcgctgattcagacatagagtggctacaaaaagactttggattatacgtggtgaacatgtttgacacacaccaagccgcacgactcctgaatctcgggagacacagcctcgatcacttgcttaaactgtactgcaacgtagactctaacaaacaataccaacttgccgattggcggatcagaccgctcccggaagaaatgctcagctacgcacgcgatgatacacattatttgctatatatctacgataaaatgcgactcgaaatgtgggagcggggaaacggccagcccgtgcagttgcaggttgtgtggcagcggagtagggatatttgtctgaagaaattcataaaaccaatattcaccgacgagagctatctggagctctacaggaagcagaaaaagcacctgaatacacagcaacttacagctttccagctgctgtttgcctggcgcgacaaaaccgctcgtagggaggatgagtcttacggctatgtgctaccaaatcacatgatgctcaagattgcggaggaactgcccaaggagcctcagggtatcatagcttgttgcaacccagtcccaccactggtccgtcagcaaattaacgagatgcatctgctgattcagcaagcacgcgaaatgccgctacttaagtccgaggtggccgcgggagtcaagaaatcagggcctttgccttctgccgagagactggagaatgtattgttcggccctcacgattgcagccatgcccctcctgacggataccccataatcccgacaagtggctctgtgcctgtacagaagcaggctagtctcttcccagacgagaaagaagataatctcctgggaacaacgtgcctgattgccacagcggtcatcactctgttcaacgaacctagtgctgaagactcaaaaaagggcccactcacagtggcccagaagaaggcccagaacattatggaatcattcgaaaacccttttcgaatgatttcaaacagatggaagctagctcaggtccaggtgcagaaggactccaaagaggccgttaagaaaaaggccgctgagcagaccgctgctcgtgagcaagcaaaagaggcatgcaaagccgcagctgaacaggctatcagcgtcaggcagcaggtggtgcttgagaacgctgcgaagaagcgcgaacgcgcaaccagcgatccacgaacaaccgaacagaaacaggaaaagaaacgcctgaagatttccaagaagcccaaagatcccgagcctcccgagaaggagtttacaccttacgattattcacagagcgactttaaggcctttgccggtaacagcaaatctaaagtcagtagtcagttcgatcccaataaacagacacccagcggcaaaaagtgtatcgccgcaaagaagatcaagcaatctgtgggcaataaatctatgtccttcccaaccggtaagtccgatcggggttttcgatacaactggcctcagcggtag

SEQ ID NO: 187230 - DNA, 2658 bp, Artificial Sequence
  Description of Artificial Sequence: Synthetic coding sequence
atggccccccccagcacccgggagccccgggtgctgagcgccaccagcgctaccaagagtgacggggagatggtgttgcctggattcccagacgccgattcattcgtgaagtttgccctcggatccgtggtggcggtgactaaggctagcgggggcttaccccagtttggggacgagtacgacttttaccgctcattcccaggctttcaagcattctgcgaaacgcagggagatcgcctccttcagtgcatgagcagggtgatgcagtaccatgggtgcagatcaaatatcaaagaccggtctaaggtgaccgaattggaagataagttcgacctcctagtggacgctaacgatgttattctagagagagtggggattctgctggatgaagccagtggggtgaacaagaatcagcagcctgtgctacccgctggtcttcaggtcccaaaaacggtggtgtcttcatggaatcgcaaagccgctgaatacggaaaaaaagccaaatctgagacctttcgacttctccacgccaaaaatatcatcaggccacaactgaaatttagagagaagatagataatagtaacacgccattcctgcctaagatattcataaagcccaacgcccaaaagccgctccctcaggctttatccaaagagcgtagagagcggccacaggaccgaccagaggatttggacgtcccaccggccctggcagacttcatccaccaacagcgaacacaacaggttgaacaagatatgttcgcgcatccctaccagtatgagcttaaccattttactcccgcagacgctgttctgcagaaaccacagccccagctctaccgccccattgaggagaccccttgccattttatctctagccttgacgagctcgtggaactgaacgaaaaattactgaattgccaagagtttgcggttgacctcgaacaccacagttacagaagctttcttggacttacctgtttgatgcagattagcaccaggaccgaggatttcatcatagatactttggagctgaggagcgacatgtacattctgaatgaatctctcacagaccctgcaatcgttaaggtctttcatggagctgactcagacattgaatggctccagaaagactttggcctttatgttgtgaatatgttcgacactcaccaggctgccaggttgctgaatctcggcaggcattctctagaccatctgctcaagctgtactgtaatgtggatagtaataagcaataccaactcgcagattggaggattcggccgcttcccgaagagatgttgagctacgcgcgcgacgatacacattacctactatacatctacgataaaatgagactggagatgtgggaacgaggaaacggccagccagtgcagcttcaggtcgtctggcagagaagcagagatatttgccttaaaaagttcatcaagccaatttttaccgacgagagttacctggaactgtaccggaagcaaaaaaagcacctcaacacacaacagttgaccgcctttcagctcctcttcgcatggagggacaagacagcaaggcgggaagacgagtcgtacggatacgtgctgccaaaccacatgatgcttaaaatcgctgaggaactccctaaagagccacaaggaatcattgcctgttgtaatcctgttccgccgctagttcgacaacagatcaatgaaatgcatctgctcattcaacaggcaagggagatgccactgcttaaatccgaggtagccgcgggagttaagaaatcagggccgttgccctccgcagagcgtctcgagaacgtgctgttcggaccccacgactgttcgcacgcacctccggatggataccccatcattcccacttcggggagtgtcccagtgcaaaagcaagcctcgctgttccccgacgagaaagaagacaatttgctcggaacgacatgccttatcgcgaccgccgttattacgttgtttaatgagccatccgccgaagactctaagaaaggccctctcacagtggcacagaagaaagcacaaaatattatggagtcattcgagaacccctttcggatgtttctcccatctctcggccacagggcccccgtgagccaagcagcaaagtttgatcctagtactaagatttatgagatctctaatagatggaaattggcccaggtgcaggttcagaaagatagcaaagaggctgtcaaaaaaaaggccgccgaacaaacagcagctagagagcaggctaaggaggcgtgcaaagccgcggcagagcaagccatctcagttagacagcaagtggttctggagaatgcggcaaaaaagagagagcgcgcaacgagcgatccaagaaccacagagcagaaacaagaaaaaaagcgcctgaaaataagcaaaaaaccaaaggatcccgaaccgcctgaaaaggaatttacaccatacgactactcacagagtgattttaaggctttcgctggcaactctaagtctaaggtctccagtcagtttgaccctaacaagcaaaccccgagtgggaaaaaatgcatcgcagctaaaaaaatcaagcagtctgtgggtaataaatcaatgtctttccccaccgggaaatccgaccgcggctttaggtataattggccccagcgctag

SEQ ID NO: 187231 - DNA, 2040 bp, Artificial Sequence
  Description of Artificial Sequence: Synthetic coding sequence
atggccccccccagcacccgggagccccgggtgctgagcgccacctctgccacaaagagcgatggcgagatggtcctcccaggattcccagatgcggacagtttcgttaaattcgctctggggagtgtggtcgctgtgacgaaggccagcggtggcctcccccagttcggagacgaatacgacttttaccggtcttttccgggattccaggctttctgtgaaactcaaggcgataggctcctccagtgtatgtctcgtgtaatgcaataccacggctgtcgaagtaacatcaaggataggagcaaagtgacagagcttgaggataaatttgaccttctggtggacgcaaacgacgtaattttagaacgtgtcgggatcctcctcgatgaggcgtcgggcgtaaataaaaatcaacagccagtactgccggcgggccttcaagtgcccaaaacagtggtatcttcgtggaacagaaaggcagccgagtacgggaagaaagctaagagcgagactttccgcttgctccacgctaagaatattatcagacctcagctcaaattcagggaaaaaatcgataattccaatacacccttcctgccaaaaatctttatcaaaccgaacgctcagaaaccactcccacaagcgcttagcaaagagcgtagggagagacctcaggatagacccgaagacctggatgtaccgccagctctcgcggacttcattcaccagcagcgaacgcaacaagtggagcaagacatgtttgcacacccataccagtatgaactgaaccacttcacaccagccgacgcagtccttcagaagccacagccccagttgtacaggccaatcgaggaaaccccctgtcactttatctcctccttagacgagttagtggaactgaatgaaaaactactgaactgccaggaatttgcagtcgacctagaacaccacagttaccgttcattcctgggcctcacgtgtctgatgcagatttccacacggactgaggattttatcattgatactctggaattgcgtagtgacatgtatattttgaatgaatcccttacagaccctgctatagtgaaggtcttccacggcgcagatagcgacatcgaatggctccaaaaggattttggactttatgttgtgaatatgtttgacacccaccaggccgcgcggttgctcaatttgggcaggcattcacttgatcatctccttaaattatattgtaatgtagattctaataagcaataccagctcgccgactggcggattcggccactgcccgaagagatgctgtcgtacgctagggacgatacacattacctgctttacatctacgataagatgcgtctggagatgtgggaaaggggaaacgggcagccagtgcagcttcaggtagtttggcagagaagccgagatatttgtttgaagaagttcattaaacctatcttcacagacgagtcatatttggaactctacaggaaacagaagaagcatctgaacacacagcagctgaccgctttccaactgctgttcgcatggagagataagacggcgcgaagggaggatgagtcttatggttacgtgctgcccaaccatatgatgctgaaaatagcagaagagctgcctaaagaaccccagggtattatcgcctgctgcaatcccgtgcctcctttggtaagacagcaaattaatgaaatgcatcttctgatccagcaggctcgcgagatgcctcttctgaagagcgaagtcgcagcgggtgtcaagaagagtggaccactgccaagcgctgaggttgagtgcaggatttgtttccttcctcaggagggtaaacgccaagtcactgccagtgcctccactccactgacagaggcttgtgccgatagctggcagaaagcgactgccggtcttcacgtactccacgcatccctgctggtttccttcaacgcagaaatcggagaatgcagcctgtggacctcaaggctgctgccttgcccaagcggctggctttccaatcatcctaaccagtggtag

SEQ ID NO: 187232 - DNA, 747 bp, Artificial Sequence
  Description of Artificial Sequence: Synthetic coding sequence
atggccgccggcttcaagaccgtggagcccctggagtactaccggcgcttcctgaaggaaaattgtcgacccgacgggagagaattaggggaatttcgaaccaccaccgtcaatatcggtagcatctctactgcagatgggtccgcattagtgaagcttggtaatacgactgtcatatgcggcgtgaaagcgtttagatctgggcctcccggtgaagaggcacaggtagcctcgcaattcatcgccgacgtgattgaaaactcacagatcatccaaaaggaggacctctgcatctccccggggaagctggtgtgggtactctattgcgatctgatctgcctcgattacgatggtaacatcctcgatgcgtgcacttttgccctgctagcagcactgaagaatgtgcaactaccagaggtgacaataaacgaggagacagcgctcgctgaggtcaatcttaagaagaagtcttacctgaacattaggacacatccggtggccaccagtttcgcagtgttcgacgatacactactgattgttgatccaaccggcgaggaagagcatctggcgaccggaactcttaccatcgttatggatgaagagggcaagctgtgttgtctccataagccaggaggatcaggcttaacaggcgctaagctgcaagactgcatgtcacgagctgtgactaggcataaagaggttaaaaaactgatggacgaggtgataaagtctatgaaaccaaaatag

SEQ ID NO: 187233 - DNA, 831 bp, Artificial Sequence
  Description of Artificial Sequence: Synthetic coding sequence
atggccgccggcttcaagaccgtggagcccctggagtactaccggagatttttgaaggaaaactgccgccccgacggtcgcgaactgggggagtttaggacaacaacggtgaacatagggtccataagcaccgcggatgggagtgccttagtgaaactaggcaatacgacggtgatttgtggagtgaaagccgagtttgcagcaccatctactgatgcgcctgacaaaggctacgtcgtgccgaatgtggacctgccccccctgtgtagctccagatttcgttcgggacctcccggcgaagaagctcaggtcgcatcccagtttatcgctgatgttattgagaattcgcaaatcatccaaaaagaggatctttgtataagtcccggaaagctggtctgggtcttatactgcgacctcatctgtctggactacgatggcaatatcctggacgcatgcaccttcgcactcctggccgctcttaaaaacgtccagctgccagaggtgacaatcaatgaagagaccgccttagctgaagtgaacctgaagaagaaaagctatctcaatattcggactcatccagtggcaacatcctttgctgtttttgatgacaccctcctaattgtcgatcccacaggggaggaggagcatttagcgacggggacgcttacaattgtcatggacgaagaaggcaaactgtgctgcctccataaacccggggggtcggggctgaccggtgcaaagctgcaggactgcatgagtagagcagtgactcggcacaaggaagtaaagaaactcatggatgaggtcattaagtccatgaaaccaaagtag

SEQ ID NO: 187234 - DNA, 1320 bp, Artificial Sequence
  Description of Artificial Sequence: Synthetic coding sequence
atgaaggagacccccctgagcaactgcgagcggcggttcctgctgcgcgccattgaggagaaaaaaaggttagacggacggcagacctatgattatagaaatattcgaatatccttcgggaccgattatggctgttgcatcgtggagctaggtaagacgagagttctcggacaggtgtcttgtgagctcgtcagtcccaaacttaaccgcgcaacggagggtatacttttcttcaatcttgagctctctcagatggccgccccagcatttgaacctgggaggcagtctgacctcttggtcaaattgaacaggttaatggaaaggtgcctccggaattccaaatgcattgacaccgaaagcctgtgcgtcgtggccggcgagaaggtatggcagatccgcgtggatctccatctccttaatcacgacggcaacattattgatgctgccagcattgccgctattgtcgccttgtgtcacttccggcggccagatgtcagtgtgcagggtgacgaagtgaccctgtacacacccgaggagcgggaccccgtccctctcagtattcaccacatgcccatatgcgtttcttttgcctttttccagcaggggacttatctccttgtcgatccaaatgaaagggaggaacgagtgatggatggactgttagtgatcgctatgaacaagcacagggagatctgcaccatccaatcaagcggcggtatcatgctcctgaaagaccaagtgctgcgctgttcaaagatagccggggtcaaagtggcggagatcacagagttgatactgaaggcattagagaacgaccagaaggtgcgaaaggaaggcgggaaattcggcttcgctgagagcatcgcaaaccagcggattactgcctttaagatggaaaaagccccaatcgataccagcgatgttgaggaaaaagccgaggagataatcgctgaagccgaacctccatccgaggtcgtgagtaccccagtgctgtggaccccagggactgcacagatcggcgagggagtggagaattcctggggcgacttagaggacagcgagaaagaggacgacgaaggaggaggcgatcaggctattatcctggacggcataaagatggataccggggttgaagtctccgacattggatctcaggacgccccaattatcctgtctgatagcgaggaagaggaaatgattatcttggagccagataaaaatccgaaaaaaatccgcacacagaccacaagtgctaaacaggaaaaggccccctcgaaaaagcccgtgaagcgaaggaagaagaagagggcagctaactag

SEQ ID NO: 187235 - DNA, 1371 bp, Artificial Sequence
  Description of Artificial Sequence: Synthetic coding sequence
atgaaggagacccccctgagcaactgcgagcggcggttcctgctgagagctatcgaagagaagaaaaggttggacggacgtcagacctatgactacagaaacatacgcatcagcttcggtacagattatggatgttgcatcgttgagctgggtaaaacccgcgtgcttggccaggtgagctgtgagctggtcagccccaaacttaacagagcaacagagggtatattgttctttaatttggaattgtctcagatggcagcacccgctttcgaaccgggccgacagagtgacctcctcgtgaaattgaacaggctgatggagaggtgcctccgcaattctaagtgtatagacacagaatctctgtgtgtcgtcgcgggggaaaaggtgtggcaaattcgcgtcgacctgcaccttctgaaccatgatggcaacattatcgacgctgccagtatcgcggccatcgtggctctctgccacttcagaaggcccgacgtgtccgtacaaggggatgaggtgacattatataccccagaagagcgggatccagtgccactgtctatacatcacatgcccatttgtgtttcgttcgccttttttcagcaaggaacctaccttctcgtggacccaaacgaacgcgaggaaagggttatggacggcctgctcgttattgccatgaacaagcatcgcgagatctgtacaatccaatccagtggtggtataatgttattgaaggatcaagtcctccggtgttctaagatcgctggcgtgaaggtggctgagatcacagaactcatcctgaaggccttagaaaatgatcagaaggtccgtaaagaaggcggtaagtttggtttcgcagagagcattgccaaccaacggattaccgcttttaagatggagaaagctccaatagatactagtgatgtggaggagaaggccgaggagatcatcgctgaggccgaaccccctagcgaagtcgtctccacccccgtactctggacgccaggaactgcccagattggagagggtgttgaaaactcttggggcgatttagaagattctgaaaaagaggatgacgagggaggtggagatcaggctattattctcgatggcatcaaaatggacaccggggtggaagtgagtgatatcggctctcaggagctcgggtttcaccatgtgggacagactggcctagaattcctgactagcgatgcccccatcattctgagtgattctgaggaagaagaaatgataatacttgagcctgataagaatccgaaaaagatccgcacgcagacaacgtccgccaagcaagagaaagctccctcaaagaaacctgtgaaaagacgaaaaaagaaacgcgctgccaattag

SEQ ID NO: 187236 - DNA, 2031 bp, Artificial Sequence
  Description of Artificial Sequence: Synthetic coding sequence
atgcagagctggcggcggcggaagagcctgtggctggccctgagcgcgagctggctactgctggtgctgctgggcggcttttcactgctccgcctggccttgcctccacgaccaagacctggagcatcacaaggctggccaaggtggctggacgccgaactgctgcagtccttctcccagcctggcgagctcccagaggatgctgttagccctccacaagccccccacggaggcagttgcaactgggagagttgctttgatacgtctaagtgcagaggcgatggactgaaggttttcgtttacccggctgtagggaccatttcagagacccatcggcgcatcttggcctcgatcgagggatctcgattttatactttctcaccagctggagcctgcttactgttactactgtcactcgatgcccaaactggagaatgctctagcatgcctctgcagtggaacagaggccgcaaccatctggtgctccgactgcatcccgcgccatgccctagaacattccagttgggccaagctatggtggcagaagcctccccaaccgtggactcttttcgcccaggatttgacgtagccttgccctttctcccagaggcacatcctcttcggggcggggcgccagggcagctacgtcaacactcccctcagccaggcgttgcgttattggccttggaggaggagcgcggcggttggagaacagcagacaccggaagcagcgcgtgtccgtgggatggccgatgtgagcaggacccgggccccggccaaacacagcggcaagagacactccccaacgccactttttgtctgatctcaggccatcggcctgaggcagcctcaaggttcctgcaggcgctccaggccgggtgcatccctgttctgttgtccccccgttgggaactgccattctctgaggttatcgattggactaaagccgccatagtggcggacgaacgccttcctctccaggtgctggctgccctccaggagatgtcccccgctcgggtcctggcccttcgccaacagacacagttcctctgggatgcatacttttccagcgttgagaaagtcatccacactactctggaggtaatccaggataggatcttcgggacatccgcccacccatctctcctttggaacagcccccctggggcgctccttgcgttgtctactttctcaaccagcccccaagatttcccattttattatcttcagcagggctcgaggcctgaggggcgattttccgccctgatctgggtagggcccccaggccagccccctctgaagctaattcaggccgttgcgggctcacagcattgtgcacaaatcctcgtgctctggtccaatgaaaggccactgccttccaggtggcccgaaactgctgtgcccttgacagttatcgatggtcatcgcaaggtgtccgacaggttctacccctactcaactattcgcacggacgcgatcttgtcgctcgatgcgcgaagctccctgtctacaagcgaagtcgattttgccttcctggtgtggcagtccttccctgagaggatggtcgggtttctcacctcttctcacttttgggatgaagcgcacggaggatgggggtacactgccgaacgcaccaacgaattcagcatggtgctgacaacagcagcgttctaccaccggtattatcacacactattcacacatagtctccctaaggccttgcggactctggcagacgaggcacctacctgtgtagatgtattgatgaatttcatagtggccgccgtaaccaagctcccgcccataaaggtcccttatgggaaacagcgtcaagaagccgcaccactcgcccccggcggcccaggcccacgacccaagccacccgctccagcacctgactgcatcaatcagatcgctgctgcctttgggcatatgccgctgttgtcttcccgactgcgcctggatccagtgctgttcaaggacccagtctctgtgcaacgcaaaaagtataggagcctggagaaaccctag

SEQ ID NO: 187237 - DNA, 993 bp, Artificial Sequence
  Description of Artificial Sequence: Synthetic coding sequence
atgcggtgctgccacatctgcaagctgcccggccgggtgatgggcatccgcgtactcaggctttcactggtcgtcatactggtactcctcctggtggccggagcgttgacagccctgctgcctagtgtgaaagaggacaagatgttgatgctgagacgggagattaagtcccaggggaaaagcacgatggacagcttcacgcttatcatgcaaacatataatcgaactgaccttctgctgaaactgttgaaccattaccaggcagtcccaaacctgcataaagtgatcgtagtgtggaacaatataggcgagaaggccccggacgagctgtggaactccttgggtccccacccgatcccggttatcttcaagcagcagaccgccaaccgcatgcgtaaccgcctacaggtctttcccgagctggaaactaatgcagtgctgatggtcgacgatgatactttaatcagcacccctgatctcgtgtttgccttctctgtatggcagcaatttccagaccagattgtggggttcgtgccacggaagcacgtctcgacgtcttctggaatctacagctacggaagctttgagatgcaggctcccggaagcggtaacggagaccagtatagcatggtactcataggtgcttcattctttaactctaagtaccttgaactgtttcaacgtcagcctgcagccgtgcacgccctgattgatgatacccagaactgcgatgacattgccatgaactttattatcgcgaaacatatcggaaagacatctggaatctttgtgaaaccagtgaacatggacaacctggagaaggaaaccaattcaggctattctgggatgtggcaccgtgcagagcatgccttgcagcgttcctattgcatcaataaattggtgaacatatatgactccatgccattacgctattctaacatcatgatcagccagttcggttttccttatgccaattacaagcgcaagatctag

SEQ ID NO: 187238 - DNA, 993 bp, Artificial Sequence
  Description of Artificial Sequence: Synthetic coding sequence
atgcggtgctgccacatctgcaagctgcccggccgggtgatgggcattcgggttcttaggttgtccctggtggtgattctcgtattgttgctggtcgccggagctttaactgcactgctgccaagcgtaaaagaagataagatgctcatgctgcgacgagagatcaagtctcaggggaagtcgaccatggatagctttactctgattatgcagacatataaccggaccgacctgctcttgaagctgctcaaccattaccaagccgttcctaaccttcacaaggttattgtcgtgtggaataatatcggcgagaaggcccctgacgaactctggaactctctgggtccacacccaatcccagtcatttttaaacagcagaccgccaataggatgcgtaataggctccaggtgttccctgagctcgagaccaatgcagttttgatggtggacgacgatactctgatcagtactccggatttagtgttcgcattttccgtatggcagcagtttcccgatcagatcgttgggttcgtgcctaggaaacatgttagtacatcttccggaatctatagttatggcagcttcgaaatgcaggcaccagggtcaggtaatggtgaccaatacagtatggtgcttattggcgcgagctttttcaactcaaagtacctcgagctcttccagagacagccagccgctgtgcacgccctcattgatgacactcagaactgtgacgatattgccatgaactttatcatcgccaagcacatcggaaagacgtcaggaatttttgtaaagcctgtcaatatggacaacctggagaaagagacgaactccggctatagtgggatgtggcatagggcagaacatgcactgcaacggtcttactgtatcaataagctggtaaatatctacgactctatgcccctgcggtatagtaatattatgatatcccaatttggattcccttatgctaactataaacgcaagatatag

SEQ ID NO: 187239 - DNA, 354 bp, Artificial Sequence
  Description of Artificial Sequence: Synthetic coding sequence
atgggcatccgggtgctgcggctgagcctggtggtgatcctggtgctgttgttagtggccggcgcactcacggctttgttgccaagtgtaaaggaagataagatgctcatgctcaggagggaaataaagagtcaggggaagagcacgatggactcgttcacactgatcatgcagacgtacaaccggactgacttgcttctgaaactgcttaatcactaccaggccgtccccaacctacacaaagtcatagtcgtctggaataacattggtgagaaagccccagacgaactctggaatagtttgggaccccatccaattccggtcatctttaagcagcagactgcaaacagatag

SEQ ID NO: 187240 - DNA, 801 bp, Artificial Sequence
  Description of Artificial Sequence: Synthetic coding sequence
atgcggacctggaacagcggcggcaccaagtgctgccacatctgcaagttgccaggacgggtgatgggcatacgcgttctgagattgagtttagtggtcatactggtcctgctcctcgttgctggcgcactgactgcactgctgccatcagtaaaggaagacaaaatgctgatgttgagacgagagatcaaatcgcagggcaagtctactatggacagttttacccttattatgcagacctataacagaactgacctgctcctgaaactgttgaaccattatcaagccgtacctaatctgcacaaggtcatagtagtatggaataacattggcgaaaaggctccggacgagctctggaattctctcgggccacatcccattcctgtgatcttcaagcagcagactgcgaaccgcatgcgtaaccgactccaagtcttcccggaactggagacgaatgccgtcttgatggtggatgatgacactctaatctccactcctgatctagtgttcgcgttcagcgtgtggcaacagtttcccgatcagattgtcggtttcgtgccacggaagcacgtgtcaacgtcgtcaggtatttacagttacggatccttcgagatgcaggccccaggcagtggaaatggggatcaatacagcatggtgttgatcggggcctcttttttcaatagcaaatacctggagttgttccagcgccaacctgctgccgtacacgcccttattgacgacacccagaattgtgacgacatcgccatgaacttcataatcgccaaacacatcggtaagtag

SEQ ID NO: 187241 - DNA, 954 bp, Artificial Sequence
  Description of Artificial Sequence: Synthetic coding sequence
atgggcatccgggtgctgcggctgagcctggtggtgatcctggtgttgctgctcgtggctggggccttaactgcgttacttccatcggtgaaagaagacaagatgctcatgctgcggcgggagattaagtctcaaggaaaaagcacaatggactcattcacacttataatgcagacttataatcggacagacctactcctcaagctgctcaaccattatcaggcagtcccaaacctgcataaagttatagtggtgtggaataacatcggcgaaaaagcccctgacgaactctggaattctctgggtccacaccctattcctgtaatctttaagcaacaaactgccaatagaatgagaaatcgtctgcaggtgttccccgaactcgagacaaatgcagtgcttatggtggatgacgacaccttaatatccacacctgatctcgttttcgccttttccgtgtggcagcagtttccagatcagattgttggcttcgtgcctcggaagcatgtgagtacgtcatccggaatttatagttacgggtcctttgaaatgcaggcccctggaagcggcaacggggaccagtactctatggtgctgattggcgcgtctttcttcaactccaaatacctggaactgtttcagagacaacctgccgcagttcatgcgctgattgatgacacgcagaactgcgacgatattgccatgaattttataatcgccaagcacattgggaaaacaagcggtatcttcgtaaagcccgttaacatggataacctagaaaaggaaaccaacagcgggtattctgggatgtggcaccgggctgagcatgctctgcagcgctcttactgtatcaacaagcttgtcaatatctacgattcgatgcctctacgttacagcaacatcatgatctctcagttcggttttccttacgcaaattataaacgcaagatttag

SEQ ID NO: 187242 - DNA, 519 bp, Artificial Sequence
  Description of Artificial Sequence: Synthetic coding sequence
atgagcgtgcccggccccagcagccccgacggcgccctgacccggcccccctattgccttgaggctggggagcccacccctggcttgtctgacacctctcccgacgaaggccttattgaagaccttaccattgaggacaaggctgtcgagcaattagccgaaggactgctatcacactatctcccagacctgcagagaagcaagcaggccttacaggagctcacccagaatcaagtcgtgcttttagataccctggagcaggagatatctaaatttaaagagtgtcactccatgctcgacattaacgcactcttcgccgaagctaaacactatcacgcaaagctcgtgaacatacgcaaggaaatgctgatgctgcacgagaagactagcaaactgaagaaaagagccttaaaacttcagcagaagaggcaaaaggaggaactcgaaagagaacagcagcgggagaaggaattcgagcgagagaagcaactcaccgccaggcctgcaaagcgaatgtag

SEQ ID NO: 187243 - DNA, 1608 bp, Artificial Sequence
  Description of Artificial Sequence: Synthetic coding sequence
atgctgcacaagagcgaggagggccgggtgctggtggagttcacctgcaagaatcagccaaaaccctccctgccaaccgagtgggctctgtgcggggagcgcgaggaccgtttagagctgctgaaactcagcacattcgcactgatcattacacctggcgaccctcgactggtcattagtagcggttgtgctacgagattattcgaagcgctggaagttggcgcagtgcccgttgtcttgggtgaacaggtccaactaccataccaggacatgttgcagtggaacgaggctgctctcgtggtccctaagcctcgcgttactgaggtgcacttcctgttaagatctctgtcagatagcgatctcctggccatgcgacgccaggggcgcttcctttgggagacatattttagtacagccgacagtattttcaataccgtcctggccatgatcagaacacgaatccagatacctgccgctccaatacgggaggaggccgcggcagagattccacaccgtagcgggaaggctgccggaacggaccccaacatggctgacaacggggatctcgatcttggcccagtcgagaccgagcctccatacgccagtcctaggtaccttcggaacttcaccttaaccgtgacagacttctatcggtcgtggaactgcgctcctgggccttttcacctgtttccccacactccttttgatcctgtccttccgagcgaggccaagttcctgggctccgggacaggtttcaggcccatagggggcggagctggtggcagcgggaaagaatttcaggccgccctcggcggcaatgtgccacgcgagcagttcaccgtggtcatgctgacatatgaacgtgaggaagttctgatgaacagccttgagcgacttaacgggctgccctatttgaacaaagtggtggtggtgtggaacagtcccaagcttccctcagaggatctactttggccggacatcggtgttcctatcatggtggtccgaacggaaaaaaactccctcaacaatcggtttttaccgtggaacgagatcgaaacggaggccatcctgagcattgatgatgacgctcacctgcggcatgatgagattatgttcggctttcgggtgtggcgcgaggcgcgtgatcgcattgtaggatttcccggcagataccacgcatgggacatccctcaccaatcctggctctataactctaactactcgtgcgagctttccatggtactgacaggagctgccttttttcacaagtattatgcgtacttgtatagttatgtcatgccgcaggctattagagacatggtggatgagtacataaactgtgaagatattgcaatgaatttcctggtgtcccacatcactcgtaaaccacccattaaggtgacatcaaggtggacctttagatgtcctgggtgtcctcaagcgctcagccacgacgatagtcacttccatgagcgacataagtgcatcaactttttcgtgaaggtttatgggtacatgccactgttatatacgcagttccgggtcgacagtgtgctgtttaagacccgtttacctcacgacaagacaaagtgcttcaagtttatatag

SEQ ID NO: 187244 - DNA, 3216 bp, Artificial Sequence
  Description of Artificial Sequence: Synthetic coding sequence
atgcccgccatcatgaccatgctggccgaccacgccgcccggcagttactcgacttttcgcaaaaactggacatcaacctgctggacaatgtggtgaattgcttgtatcatggagagggagcccagcagaggatggcccaggaggtactaactcaccttaaggaacatcccgacgcgtggacacgggtggacactattcttgagttttcccaaaacatgaacactaaatactacggtctgcagatacttgagaatgtgatcaagactcgatggaaaattctgcccagaaaccagtgcgaaggtattaagaaatacgttgtgggactgattattaagacgagctccgaccctacctgcgtggagaaggaaaaagtctacattgggaagctgaacatgatcctcgttcaaattctcaagcaggaatggccaaagcactggccaacattcatcagtgacattgttggcgcttcacggacgtctgaatccctgtgtcaaaataatatggtgatcctcaagttgttatcggaggaggtgttcgattttagctccggtcagatcacgcaggtgaaaagtaagcacctcaaggactctatgtgtaacgagttctcccagatttttcagctctgtcagttcgtcatggagaacagccaaaacgcacctctagtgcatgcaactttagagacactcctaagatttcttaactggatcccattgggatatattttcgagacaaagcttatcagtacactgatctacaagttcttgaacgtccccatgttccgaaacgtgagcttgaaatgcctgaccgagatagctggagtgtcagtgtcacagtatgaagaacagttcgtgacattattcaccctgactatgatgcagcttaagcaaatgctcccacttaatacaaatatcaggctggcttacagcaacggcaaagatgatgagcaaaattttattcagaacctgagcttgtttttgtgcaccttcttaaaggagcacgatcagctaatcgagaagcggctgaacttgcgcgagacattgatggaggctcttcactacatgctcctggtcagcgaggtcgaggagactgagatctttaagatctgtctggagtattggaaccacctggccgctgagctgtatagagagtcaccatttagtaccagcgcctctcccttactatcaggcagtcagcactttgatgtgcctccccggagacagctgtaccttccgatgttgtttaaagtgcggcttctgatggtgtccaggatggcgaagcccgaggaagtacttgtggttgaaaatgaccagggagaagttgtgcgcgagtttatgaaagatacggacagtataaacctgtataaaaacatgcgggagaccttggtctatttgactcacctggactacgtagacacagaaagaataatgacagaaaaactccataaccaagtcaatggcacagaatggtcctggaaaaatctgaatacgctttgttgggccatcggcagcatttctggcgcaatgcacgaggaagatgaaaaacgcttccttgtcactgtaattaaagacctgctgggcttatgcgagcagaagagaggaaaggataacaaagcaatcatcgcgagcaatataatgtatatagtcggccaataccctcgcttccttcgcgctcattggaagttcttgaagactgtcgtgaacaaactctttgaattcatgcatgaaacacacgacggagtgcaggatatggcctgcgacaccttcatcaagatcgctcagaaatgtcggcgacatttcgtgcaggtgcaggtgggcgaggtcatgcccttcattgacgagattctgaataacatcaatactattatttgcgacctgcaaccccagcaggtccataccttctacgaagcagtgggatacatgattggcgcccagacagatcagacggtgcaggagcatctcatcgagaagtatatgctgctgcccaaccaggtgtgggactcaatcatccagcaagctacaaaaaacgtagacatcctgaaggatccggagactgtcaaacaacttggctcaatcctgaaaactaacgttcgggcatgcaaggcagtcggacaccctttcgtaatacaactcggcagaatctacctggacatgctgaacgtgtacaaatgcttgtccgagaacatttccgcggctattcaggccaatggcgagatggttaccaagcagcctctaatcaggtctatgcgcacagtcaaacgggagacactgaagcttatcagcgggtgggtttctcgctcaaacgatccgcagatggtggccgagaacttcgtcccccccctcttggatgcagtcctcatcgactaccagcgaaatgtgccagccgcacgtgagcctgaggtcctcagcacaatggctatcattgtgaataagctcggcgggcacatcacggctgaaattccccaaatatttgacgctgtgttcgagtgcactctcaacatgatcaacaaggatttcgaggagtatcctgaacataggacaaacttcttcctcctgttgcaggctgttaactctcattgttttccagcctttcttgctattccaccaacccaatttaagctggtcctggattctatcatctgggccttcaagcacactatgaggaatgtcgcagataccgggttgcagatcctttttaccctgctgcaaaacgttgctcaggaggaagccgccgctcagagcttttaccaaacgtacttttgtgacattttgcagcacatcttctctgtggtgacagacacatctcacacggcaggcctgacgatgcacgcctccatcttagcctatatgttcaaccttgtggaggaaggaaagattagcacatctctgaacccagggaatcctgttaataatcagattttcctgcaggagtatgtcgcaaacctactcaagtctgcttttccacatcttcaggacgcccaagtgaaactctttgttaccgggttgttttccctgaatcaggatattcctgcatttaaagaacatttgcgcgatttcctggtacagatcaaggaatttgccggcgaggatacctccgatctattcctggaggaaagagaaattgccctgcggcaggcggacgaggaaaaacacaaaaggcagatgtccgtcccgggtatcttcaatccacacgagatcccggaggagatgtgcgactag

SEQ ID NO: 187245 - DNA, 3216 bp, Artificial Sequence
  Description of Artificial Sequence: Synthetic coding sequence
atgcccgccatcatgaccatgctggccgaccacgccgcccggcagctgctggatttcagccagaaactggacatcaatctgttagataacgtcgtcaattgcctgtatcacggagaaggtgcgcagcagaggatggctcaggaagtcttgacccatctcaaagaacaccctgatgcttggacacgggtcgacaccatcctggagttttcccagaatatgaataccaagtattatggattgcagatcttggaaaatgtcatcaagaccagatggaagattctgccccgcaatcagtgcgaaggtatcaagaagtacgttgtgggactgattattaagacgtcctcggaccctacctgcgtggaaaaagagaaggtctatattggaaagttgaacatgattctcgtccagatcctgaagcaggaatggccgaagcattggcccacttttatctccgacattgttggagctagtcggacgagcgaatcgctctgtcagaacaatatggttattttaaagctcttgtctgaagaagtttttgatttttccagcggccaaataacacaggtgaagagcaagcacctgaaggattctatgtgcaacgaattcagccagatcttccagctgtgtcaattcgtgatggaaaactcccagaacgcaccactagttcacgccacacttgagaccctgctccggtttctgaactggattccattggggtacatatttgaaaccaagcttatctctactcttatctacaagttcctgaatgtgccaatgtttagaaacgttagtctaaaatgtctgacagaaattgctggtgtgagcgtgtctcaatacgaagaacagttcgtgacactttttactctgacgatgatgcagcttaagcagatgttgcccctaaacacaaatattaggctggcttattccaacgggaaggacgatgaacagaattttatccaaaacctctctctgttcctctgcacttttctcaaagaacatgatcaactgatcgagaagagattaaatctgcgagaaaccctgatggaggcgttgcactacatgctgctggttagcgaggtcgaagagactgagattttcaagatctgtttggagtactggaaccacctggccgccgaactctatagagagtcccccttctccacgtctgctagccctctgttgagcgggagtcagcacttcgacgtcccgccccggaggcagttgtatctaccaatgcttttcaaggtgaggctactcatggtgagccggatggccaaaccagaggaagtgttggtagttgagaatgatcagggggaggtcgtgagggaatttatgaaggataccgattcaatcaacctgtacaagaacatgcgagagactctggtctatttaacacatttagattacgttgatacggaacgaatcatgacagaaaagcttcacaaccaggttaacggaaccgagtggtcatggaagaatctcaacactctttgctgggccatcggaagcatttctggggccatgcatgaagaggacgaaaaacggtttctggtcaccgttataaaggacctgctgggtctgtgcgagcagaaaagggggaaagataataaagctatcattgctagcaacatcatgtatatagtgggacagtaccccagatttcttcgcgcacactggaagttcctcaagacagtggtgaacaagctgtttgaattcatgcacgagacacatgatggagttcaggacatggcgtgcgacacctttataaagatagcgcagaagtgtaggaggcattttgtgcaagtgcaggtgggggaggtgatgccgttcattgacgagatcctcaataatataaatacgatcatctgtgacttgcagcctcagcaggtgcacaccttttatgaggcagtcggttacatgatcggcgctcaaactgaccagaccgttcaggagcacttaatagagaagtacatgctgctccctaaccaggtatgggattctataattcagcaggctactaaaaacgtggacatcctgaaagaccccgagaccgtcaaacagctgggaagtatcttgaagactaacgttcgcgcttgcaaagcagttggccatccctttgttatccagctgggcagaatttacttggatatgctgaacgtgtataagtgcctgagcgagaatatatccgccgccatccaggccaatggcgaaatggtgaccaaacagccactgatcagaagtatgcggacggtgaaaagagagaccctgaaactgatctccggttgggtgtctaggtcaaacgacccccagatggtggcagaaaatttcgtgccgcctctgttggacgccgttctgatcgattaccagcgaaatgtaccggccgcccgagagcctgaagtgctgagcacaatggccattatagttaataagctggggggacacatcaccgccgagatccctcagatctttgatgcagtcttcgagtgtacactgaacatgatcaataaagactttgaagaatacccagaacataggaccaatttttttctgctacttcaggccgttaactctcattgttttcctgcatttctggcaattccacccacgcagttcaagctggtcctagactccataatctgggcattcaagcatacgatgaggaacgttgctgatactgggttacagatcctatttacactgctacaaaacgtggcacaagaagaagccgcggcccagtctttttaccagacgtatttctgcgacatcctccagcatatcttctctgttgtgacagatacaagtcatacagccggccttaccatgcacgctagtatcctcgcgtacatgtttaatctggtggaagaagggaaaattagcacaagccttaatccagggaatcccgtcaacaatcagatttttctacaagagtatgtcgccaacttgttgaaatctgctttcccacatctccaggacgcccaggttaagttgttcgtaaccggtctgttttctctgaatcaggacatccccgcatttaaagagcatctgagagacttcctcgtccaaattaaagaattcgctggagaagatacctctgatctgtttctggaagagcgtgagatcgcactgcgccaggccgatgaggagaaacataagcgtcaaatgagcgtgccaggcatctttaaccctcacgagatccctgaagaaatgtgtgactag

SEQ ID NO: 187246 - DNA, 3216 bp, Artificial Sequence
  Description of Artificial Sequence: Synthetic coding sequence
atgcccgccatcatgaccatgctggccgaccacgccgcccggcagctactcgactttagccagaaactggatatcaacctgctggacaacgtggttaattgtctctaccacggtgagggtgcacagcagcgcatggcccaagaggttctcacccaccttaaggagcacccggacgcctggaccagagtggacaccatactcgagttctcacaaaatatgaacactaagtactacggattgcaaattttggaaaacgtgattaagactcgctggaaaatactccccagaaaccaatgcgaggggattaaaaaatacgtggttggattaataataaaaactagctcagatccaacctgcgtggagaaggagaaagtgtatatcggcaaactgaatatgatccttgttcaaattctgaagcaagagtggcccaaacactggccaacctttatttctgatatagtgggcgcatctaggacctccgagtcactgtgccagaacaacatggtgatacttaaactgctgtcagaggaagtgttcgacttctcttccggacaaattactcaggtgaagtcgaagcacttaaaggattcaatgtgcaacgaattttctcagatctttcagctgtgtcaattcgtaatggagaattcccagaatgctccactagttcacgcaaccttggagactctgctaaggttcttgaactggattcctctgggctatatttttgaaaccaagctcatttctacactaatttacaagttccttaatgtccctatgttccgaaatgtcagtcttaaatgcctcactgagatcgccggcgtgagtgtatcccaatatgaagagcagttcgtcacactctttactcttaccatgatgcagttaaagcagatgcttccattgaacactaatatccgactggcatactccaatgggaaagatgacgaacaaaacttcatacaaaatctgtcccttttcctctgtacattcctgaaggagcatgatcagcttattgaaaagcgcctcaatctccgtgaaacactaatggaggctctgcactatatgctgctggtcagcgaggtcgaggagactgagatcttcaagatttgtctcgagtattggaatcacttagcagctgagctgtatagagaatctcctttctccacgtcagcttcccctctcctgagcgggagccagcactttgatgtcccaccacgcagacagctgtatttaccaatgctgtttaaggtgaggttgctgatggtgtctcgaatggctaagccggaggaagtactggttgtggagaacgaccagggcgaggttgtgcgggagtttatgaaggataccgacagcattaacttatataaaaatatgcgggaaaccctcgtgtacttgacacacttggactacgtggataccgagagaatcatgactgagaaactgcataaccaggtgaatgggactgagtggagttggaaaaatctcaatacattgtgctgggcgatcggatctatctctggcgcaatgcacgaggaggatgaaaaacgttttctggtgacggttattaaggacctgcttggactgtgcgagcagaaacgcggcaaagataataaagccattattgcgagcaatattatgtatattgtggggcagtatcctcgatttcttagggctcactggaaatttttaaaaaccgttgttaataagctgtttgagtttatgcacgagactcacgatggcgttcaggacatggcgtgcgacacgtttatcaagatagcacagaaatgcaggcggcattttgtgcaggtacaagtgggagaggtgatgccatttattgatgagatactaaacaatataaatacaatcatctgcgatctccagccgcagcaggttcacaccttttacgaggcagtgggctatatgattggcgcccagaccgaccaaacggtgcaggagcacttgatcgagaagtatatgctgttgcctaatcaggtgtgggattctattatacagcaggccactaaaaacgttgatatcctgaaggaccccgagacagttaagcagctgggcagtatactgaaaacaaatgtgcgagcctgtaaggccgtaggccacccattcgtaatccagctgggcagaatctacctggatatgttgaacgtgtacaagtgcctgtccgagaatatcagcgctgccattcaggcaaacggggaaatggtgactaaacagccgttgattaggagcatgcgcaccgttaagcgggaaaccctaaaactgatctccgggtgggtgtcccgctccaatgacccccagatggtggcagaaaacttcgtccccccccttctagacgctgtgctgattgattatcagagaaacgtccccgccgcccgggagcctgaagtgctctccaccatggcaataatagttaacaagctaggaggacatatcaccgcagagatcccacaaatcttcgatgcagtgttcgaatgcaccttgaatatgataaacaaagattttgaagaatatcctgaacatcggacaaactttttcctcctgctccaagcagtgaactctcactgcttcccagccttccttgcaatccctcctacccagtttaagttagtgctagactctatcatatgggcttttaaacatacaatgcgcaacgtagccgatacaggactgcagatcctgttcacactactgcagaacgttgcccaagaagaggctgcagcccagtccttttatcagacatatttctgtgatattctgcaacacattttttccgtggtgactgacacctcacacaccgcgggcttaactatgcatgccagcattctcgcctacatgtttaaccttgtagaggagggcaaaatttcgacatccctcaatcctggtaatcccgttaataaccaaattttcctccaggagtacgtcgctaatctgctgaagtcggcctttccacaccttcaggacgcccaggtgaaacttttcgtgaccgggctgttctcactgaatcaggacatccccgccttcaaagagcacttgagggattttttagtgcagattaaagaatttgcaggcgaggacacttctgatttgttcttagaagagcgcgagatcgcactgcgccaggctgacgaggagaagcacaagcgacagatgagcgttcccggtatctttaacccacacgagatcccggaagaaatgtgcgactag

SEQ ID NO: 187247 - DNA, 303 bp, Artificial Sequence
  Description of Artificial Sequence: Synthetic coding sequence
atgcccgccatcatgaccatgctggccgaccacgccgcccggcagctgctggacttttcacaaaagcttgatattaacctgctggacaacgtggttaattgtctgtaccacggagaaggtgcacagcagcggatggcacaggaagtgctcacccacctgaaagagcacccagatgcatggacaagagtggatactatcctggaattttctcaaaatatgaacactaagtactacggcctgcagatcctagagaatgtcattaagacgcggtggaagatcctgccaaggaatcaatgcgaatag

SEQ ID NO: 187248 - DNA, 288 bp, Artificial Sequence
  Description of Artificial Sequence: Synthetic coding sequence
atgcccgccatcatgaccatgctggccgaccacgccgcccggcagctcctggacttttcccagaaactggacataaacctcttagacaacgtggttaattgtttataccacggggaaggagcccagcagcgtatggcacaagaggtgctaacccacctgaaggagcatcctgacgcttggacgcgcgtggatacgatcctggaattcagtcagaacatgaacactaagtattatgggcttcagattctcgagaatgtgatcaagactaggtggaagatcttaccctag

SEQ ID NO: 187249 - DNA, 180 bp, Artificial Sequence
  Description of Artificial Sequence: Synthetic coding sequence
atgcccgccatcatgaccatgctggccgaccacgccgcccggcagctgctggatttcagtcaaaaactggatatcaatcttcttgacaacgtggtcaattgtctttaccacggagagggagctcagcagcgcatggcccaggaggtcctcacgcatctgaaggagcaccctgacgcctag

SEQ ID NO: 187250 - DNA, 399 bp, Artificial Sequence
  Description of Artificial Sequence: Synthetic coding sequence
atgcccgccatcatgaccatgctggccgaccacgccgcccggcagcttcttgacttcagccaaaagcttgatattaatctgcttgacaatgtcgtaaattgcctgtatcatggggaaggggcgcagcagcggatggcgcaggaagtgctcacccaccttaaagagcatcctgacgcatggacccgcgtagataccattttggaattcagccaaaacatgaacacaaagtactatggtctgcagattttagaaaacgtgatcaagactcgctggaagattcttcctcgcaatcagtgcgaaggaatcaagaagtatgttgtgggccttatcatcaaaacctccagcgacccaacctgcgtcgagaaggagaaagtctacattgggaagctgaacatgtag

SEQ ID NO: 187251 - DNA, 189 bp, Artificial Sequence
  Description of Artificial Sequence: Synthetic coding sequence
atgcccgccatcatgaccatgctggccgaccacgccgcccggcagcttctcgacttctcccagaaactagatatcaatctactggacaacgtcgttaattgtctgtaccatggtgaaggtgcacagcaaagaatggcgcaggaagtcctgacccacttgaaagagcatccagatgcctggactcgctag

SEQ ID NO: 187252 - DNA, 540 bp, Artificial Sequence
  Description of Artificial Sequence: Synthetic coding sequence
atgcccgccatcatgaccatgctggccgaccacgccgcccggcagcttctggatttttctcagaagctggatatcaatttgctcgataatgtggtcaactgtctgtatcatggggaaggcgcccagcagcggatggctcaggaagtgttgacgcacctgaaggaacaccctgatgcgtggaccagggtggacaccatcctggagttcagccaaaacatgaatactaagtactacggcctgcagattctggaaaatgtgataaagacgaggtggaaaatactacccaggaaccagtgcgaggggataaaaaagtacgtcgtgggtcttatcatcaagacatcgtcggatccaacctgtgtggaaaaggagaaggtatacataggcaaactgaacatgatcctcgtgcagatcttaaagcaagaatggccaaaacactggcccacgttcatctcagacatcgtgggcgccagtcggacaagtgagtcgctctgccagaataacatggtcatattaaaactgctttcggaggaagtgttttag

SEQ ID NO: 187253 - DNA, 285 bp, Artificial Sequence
  Description of Artificial Sequence: Synthetic coding sequence
atgcccgccatcatgaccatgctggccgaccacgccgcccggcagcttctcgacttttctcagaaattggacattaatttactcgataatgtggtaaactgtctgtaccacggagagggcgcacagcagcgcatggcccaggaggtcctgacacatctcaaagaacaccctgatgcttggacgagagtcgatactatcctcgaatttagtcaaaacatgaacaccaagtactacggactccagatcctcgagaacgtgattaaaacgaggtggaagatcctgtag

SEQ ID NO: 187254 - DNA, 3615 bp, Artificial Sequence
  Description of Artificial Sequence: Synthetic coding sequence
atggccatggaccaggtgaacgccctgtgcgagcagctggtgaaggccgtgactgtcatgatggacccgaattctactcagagataccgcttggaggctttgaaattctgcgaagaattcaaggaaaagtgcccaatctgtgtgccttgtggcttaagattagcggagaagactcaggttgccatcgtcagacacttcgggctgcaaatactcgaacacgtcgtgaaatttagatggaatggaatgtcccgtctggagaaagtgtatctcaagaacagcgtgatggaactcattgccaacggtacgctgaatatactggaagaagagaaccacataaaggatgcactgtcgaggattgtcgtcgaaatgattaagagagaatggccacaacactggcccgatatgctcatcgaactcgacacgttgagcaagcagggagaaacccagactgaactcgtcatgttcattctgctccgtctggcagaggatgtcgtgacattccaaacgctcccaccacagcggcgtcgggacattcaacaaacactgacacagaacatggaaaggatctttagtttcctcttaaacactctgcaggaaaacgtgaacaaatatcaacaagtgaaaaccgacacttcccaagaatctaaagcacaagccaactgtagggtgggagttgctgccctcaatactctggctggatacatcgattgggtgtcaatgtcccatattacagcagagaattgtaaactgctcgagatactctgcctgctgttgaatgagcaggaactacagcttggggcggctgagtgcctactaattgccgtcagccgcaagggaaaacttgaagatcggaagccacttatggtgttattcggggacgtagcgatgcattatattcttagtgcagcacaaacggctgatgggggtgggctggtcgagaagcactacgtcttcctgaaacgcctgtgccaggtgctctgcgctctggggaatcaactatgtgcactcctgggtgcggactccgatgtggaaacaccttccaatttcggaaaatacctggaatcatttctagccttcacaactcatccgagccagttcctgaggtcttctacccagatgacttggggtgctctctttcgacacgaaatcctttcaagagacccgcttctgctggcgataataccaaaatatctccgcgcctctatgacgaacctggtgaaaatggggttccctagcaagaccgattccccgtcctgcgaatattccagatttgattttgactcagatgaggactttaatgcatttttcaattcgtcgcgggcccaacagggcgaggtgatgagattagcctgccgattagaccctaagacctcattccagatggccggcgagtggctgaagtaccaactttccacctttctggacgctgggagtgtgaactcatgcagtgctgtgggcaccggcgagggcagcctttgctcagtcttttcccccagctttgtccagtgggaagctatgacactcttcctcgaatctgtcatcacgcagatgttccgaaccttgaatcgggaggagattcctgtcaatgacgggatcgaactattgcagatggtgctgaattttgatacaaaggaccccctgatattatcctgcgtgctgactaacgtgtccgctctgtttccatttgttacataccggcccgagtttttgccccaagtgttcagcaagctctttagcagcgtgacttttgagactgtcgaggaatctaaggcacctagaaccagagctgttaggaacgtccgccgccacgcctgctcctcaatcatcaagatgtgtcgggactaccctcaactggtgttaccaaattttgacatgctatacaatcacgtgaaacagctactgtctaatgagctgttactgacgcagatggagaaatgcgcactcatggaggctctggtgctcatcagcaaccaatttaaaaattacgagcggcaaaaggtattccttgaggaactgatggctccagtggcgagcatttggctgagccaggatatgcacagggtgcttagcgacgtggatgccttcatcgcatacgtggggactgatcagaaatcctgtgaccctggcctcgaagacccttgtgggctgaatcgagctcgtatgtccttttgcgtctattcaattctcggagtagtgaagcgcacctgctggcccactgatctggaggaggccaaggcaggtggatttgttgtgggatacacatcaagcggtaaccccattttcaggaacccctgtaccgagcagatactgaaactgctggacaacctactagccctgatcagaacacacaatactctgtatgccccggagatgctggctaaaatggccgagccctttaccaaggcgctggatatgttagatgccgaaaaatcggccatcctcggcctgcctcaaccactcctcgagctgaatgactcccccgtgtttaaaacagtgctggagagaatgcagcggttcttttctactctctacgagaattgctttcacattctcgggaaggctggtccgagcatgcagcaggatttttacacagtggaggacttagccacgcagctgctctcaagtgcattcgtaaacctgaacaatattccagattatcgcctgcggcctatgttaagggtgttcgtgaagccactggtcctgttttgccctcccgaacattacgaggcactcgtgagcccaatcttaggccccttattcacgtatttacatatgcgcctgagccagaaatggcaggtgattaaccaacgctcattgctctgtggcgaggatgaggcagcggacgagaaccccgaatcacaggagatgctggaagaacaactggtgcgcatgctaacaagagaggtgatggatctcattaccgtgtgttgcgtctctaaaaagggggccgaccacagtagtgcaccacccgcggacggcgatgatgaggaaatgatggctaccgaagtgacaccaagcgccatggcagagttaactgatcttgggaaatgtctcatgaagcatgaggatgtgtgcacagctcttttaataaccgcttttaacagtctggcatggaaggacacgctgtcttgtcagcgcaccacatctcagctgtgctggccccttctcaagcaggtgctcagcggtacgttgctggccgatgcggtgacctggctgtttacctctgtgctcaagggtttacagatgcacggccagcacgatggttgcatggcaagcctggtgcaccttgcctttcagatctatgaagccctgaggccacggtacttggagatccgggccgtgatggagcaaatccccgaaatccaaaaggatagcttggatcagtttgactgcaaacttttaaatccctccctgcagaaagtcgcggacaagcgccggaaggaccagtttaagcggttgattgccgggtgtataggaaaaccactgggtgagcaattccgcaaagaggtgcacatcaagaacttaccttctctgtttaaaaaaaccaaacctatgcttgaaaccgaggtgctagataatgacgggggaggtcttgcaaccatatttgaaccttag

SEQ ID NO: 187255 - DNA, 513 bp, Artificial Sequence
  Description of Artificial Sequence: Synthetic coding sequence
atggccggcgagtggctgaagtaccagctgagcaccttcctggacgctggctccgtaaacagttgcagcgccgtaggcaccggtgagggcagcctgtgctctgttttttcccctagcttcgtccagtgggaggcaatgactctgttcctggagtctgttataacacagatgtttcgcaccctaaatcgggaagagatcccagtgaatgacggcatcgagctgctccaaatggttctgaatttcgatactaaagatcctctgattcttagctgcgtactcaccaacgttagcgctcttttcccgttcgtgacatacaggcccgagttcttgcctcaagtcttttccaagctgttctcttcggtcacctttgagaccgtagaggagagcaagcctccccatttccccccgctgtctgcctggaaggagatccaggtctggagctggagggaacaagccctgtgtagaacccgtagtaactacacaaaggtctcacgcaagggagtcagggcgtag

SEQ ID NO: 187256 - DNA, 2166 bp, Artificial Sequence
  Description of Artificial Sequence: Synthetic coding sequence
atggccggcgagtggctgaagtaccagctgagcaccttcctggacgccggatccgtaaacagttgctctgcagtcggcactggagagggctccctgtgtagcgtattttctccatccttcgtacagtgggaggctatgaccctgtttctggagtccgtcattacacaaatgttcagaacattgaatcgagaagaaatccccgtcaatgacgggattgagctactccagatggtgttaaacttcgataccaaagatccgttgatcctctcctgtgtccttacaaacgtcagtgccctttttccttttgttacgtaccgacctgaattcttacctcaggtgttctccaaactgttttcatcagtgacattcgaaacagtcgaggagtccaaggctccaagaacacgcgccgtaagaaatgtgagaagacatgcatgctcttccatcataaagatgtgccgagactatccacagctggttcttccgaactttgacatgctgtacaatcatgtcaagcagctgctctcaaacgagctgctcctaactcaaatggagaaatgtgcactcatggaggccctggtgttaatcagtaatcagtttaagaactatgaacggcagaaagtgtttctggaggaattgatggcccccgtcgcgagtatctggctgtcacaggatatgcacagggttctgtctgacgtggacgccttcattgcctatgtcgggactgaccagaaatcttgcgaccctggcctcgaggacccatgcggactaaaccgggctagaatgagcttctgcgtgtactccatcctcggggtcgttaaacggacatgttggcccacagacctggaggaagctaaggccggaggattcgttgtcggctacaccagctctggcaatcccatcttccgtaacccctgtacggaacaaatcttgaaactcctcgataacttgcttgccctcattcgtactcacaataccctgtatgccccggagatgttggcgaagatggctgaaccatttacgaaggccttggacatgctcgatgctgagaaaagtgccatactcggccttccccagcctcttctggaacttaatgatagcccagtctttaagaccgtgttagaaaggatgcagagattcttcagcacattatacgagaactgttttcatatcctaggaaaagccggcccatcgatgcagcaagatttttacaccgtggaagacctcgctacccagctgttgtcttctgcattcgtcaatttgaacaacatcccggattacaggctgcgtccaatgttgcacatcctgagcaagccactggtgttattttgtccgccagaacattacgaggcactggtcagccctatcctcggacccttattcacttatttacatatgcgcctctcacaaaagtggcaggtcataaaccagcgatctttactgtgcggggaggatgaggcagcagatgaaaatcccgagtcccaagaaatgcttgaagagcagttggtgcgtatgctcaccagggaggtgatggacctgatcactgtgtgctgcgtctctaaaaagggggcagatcatagctcggcaccccccgcagacggcgacgacgaagaaatgatggctacagaagttaccccctctgcgatggcagagctcaccgatctggggaagtgtcttatgaaacacgaagacgtttgcaccgctttattaatcactgcctttaactctctggcctggaaagacacactgtcatgccagagaaccacctctcagttgtgttggcccctccttaagcaggtgctcagcggcacactcctcgctgatgctgtgacctggctcttcaccagtgtgctgaaaggcctgcagatgcacggacagcatgacgggtgcatggcaagcctggtgcatctcgcttttcagatctatgaggctctcaggcccagatacctcgagattagggccgtgatggagcagattccggagatacagaaagatagcctggatcaattcgattgcaagctcctgaacccttctctgcagaaggttgccgacaaacgtagaaaagaccaatttaaacgattgattgccggttgcatcggaaagcctcttggcgaacagttccgcaaagaggtgcacattaagaatctgccttttgtggccgatctttag

SEQ ID NO: 187257 - DNA, 2211 bp, Artificial Sequence
  Description of Artificial Sequence: Synthetic coding sequence
atgcactacatcctgagcgccgcccagaccgccgacggcggcggcctggtcgagaaacactacgtgtttctgaaacgcctatgccaggtgctgtgcgccttgggtaatcagttgtgcgccctgttgggagccgactccgacgttgagaccccaagtaattttgggaaatacctggagtcatttttggcttttaccacccacccttctcagtttcttcgttcgtctactcagatgacttggggtgccctctttcggcatgaaatcctgagccgcgatccactgttactggccattatacccaagtacttacgcgcaagtatgacaaatctggtgaaaatgggatttccatcaaaaaccgactcaccctcttgtgagtacagtaggtttgactttgactcagatgaggattttaacgcattcttcaattcctcccgagcccagcagggtgaagttatgcggctcgcttgcagattagatcccaaaactagcttccagatggctggcgagtggcttaagtaccagctttccacgtttctggatgccggatcggtcaattcatgtagtgccgttgggaccggagaaggatcattgtgctcggtgttctctccatcattcgtgcaatgggaggcaatgactctgttcttagaaagtgtcataacccaaatgttccgaactttgaaccgtgaggagatcccggtgaatgacgggatcgaattgctccagatggtgctcaactttgatacaaaagaccctttgattctgagctgtgtgctaacaaatgtgagcgccctctttccctttgtcacttaccgccccgaattcctgccccaggtgttttccaagctgttcagtagcgtgacatttgagaccgtggaggagagcaaggctcccaggactcgggccgtgcgtaatgtgagaagacacgcttgctcctccattattaagatgtgccgggactatccgcagctggtgctgcctaactttgacatgttgtataatcatgtgaagcaacttttatctaatgagcttctcttgactcaaatggaaaaatgtgcactgatggaggctctggtactcatttctaatcagttcaaaaattacgagagacagaaggtctttttggaagaactcatggctccagtagcctcaatttggctgagtcaagacatgcaccgagtcctgtcggatgtcgatgccttcattgcatacgtggggaccgaccaaaagagctgcgacccggggcttgaggacccttgtggcctaaatcgggcgcggatgagtttttgtgtgtactctatcctgggagtggttaaacgcacgtgctggccaacagacctggaggaggcgaaggctggcgggttcgttgtcggatatacctcctccggaaacccaattttccggaacccatgcaccgaacagatcctcaaattgcttgacaacttgctggctctgatacgcacacacaacaccctgtatgcacctgaaatgctggctaagatggccgaaccttttactaaggccctggatatgcttgacgctgagaagtccgctatactaggtttgccgcagccattgctggagctcaatgacagtcctgtattcaagactgtgcttgagaggatgcaaaggttcttctccaccctgtacgaaaactgctttcacatacttggtaaagctggcccctctatgcagcaggatttttacacagtcgaagacctggcaacacagttactgtcatccgctttcgttaatctaaacaacatccctgattatcgcttacggcccatgttacatatcctcagcaaaccactggtgctgttttgtcctccagagcactacgaagccctggtaagccctatccttggtcctctgtttacatacttgcatatgaggctctcacaaaaatggcaagtcatcaaccagcggtcactgctgtgcggggaggacgaagccgccgacgaaaatcccgaaagtcaggaaatgctggaggagcagctcgtccgtatgttgacgagggaggtcatggatctgataacggtctgttgcgtgtctaagaagggcgccgaccacagttcggcaccaccagctgatggcgatgatgaggagatgatggctactgaggtaacccctagtgcaatggccgaactgaccgacctggtctccattcagtcaaccgataagcgtgtttccccccgtgcagaagttgattag

SEQ ID NO: 187258 - DNA, 2499 bp, Artificial Sequence
  Description of Artificial Sequence: Synthetic coding sequence
atgacctggggcgccctgttccggcacgagatcctgagccgggacccactgttgttggccattataccaaagtacctcagagcatccatgactaacttggttaaaatgggatttccctccaagactgattcccctagttgcgaatactccaggttcgatttcgactcggatgaagacttcaatgctttttttaacagctcacgcgctcagcagggcgaagtgatgcgactggcctgccggctcgatcctaagacctcattccagatggccggggagtggctgaagtaccaactgagcaccttccttgatgccggcagcgtaaatagctgctccgcagtggggaccggagagggctccctgtgctccgttttctctccttcgttcgtacagtgggaggcaatgacactgtttcttgagtccgtgatcacgcaaatgttccggacgttaaatcgtgaagaaatcccagtcaatgatgggatcgagctgctccagatggtacttaattttgacacaaaggacccattgatactcagctgtgtgctgactaacgtttccgcacttttcccatttgtaacttaccggcccgagttcttgcctcaggtattctctaaactatttagttccgtcacatttgagacagttgaggagtctaaagctccacgaacacgggccgtgcggaatgtgcgtaggcacgcttgtagcagcatcataaagatgtgccgtgactatccccagctggttttgcccaatttcgatatgctgtataaccacgtcaaacagttgctgagtaatgaactgctgttgactcagatggagaagtgcgccctcatggaggctcttgtccttataagcaatcagttcaagaattatgagcggcaaaaagtgtttcttgaggaattaatggctcctgtggctagtatatggctttcccaggacatgcatcgagtgctcagtgacgtggatgcctttatcgcttatgtaggcaccgaccagaaaagctgtgatccaggcctggaagacccctgtggcttaaacagggctaggatgtccttctgcgtatacagtatactcggagtggtaaagaggacatgttggcctaccgacctcgaagaggccaaggccggaggattcgtggttgggtacacaagctctgggaatcccatatttcgcaatccctgcaccgagcaaattcttaaactcttggataacctactagcgctcatccggacacacaacacgttgtatgccccggagatgttggccaaaatggccgagccttttactaaggctctggatatgctggacgctgaaaagtcagccatcctcgggctgccccagcccttactcgaactgaacgattctcccgtgtttaagactgtgctcgaaaggatgcaaaggttcttttctactctgtacgagaactgcttccacattctggggaaggccggaccgagcatgcagcaggatttctataccgtcgaggacctcgccacacaactgctcagttcggcttttgtgaacttaaacaacattcccgattacagattgcggcctatgctgagggtttttgtgaagccactcgttctcttctgtcctcccgagcactatgaagcccttgtgtctccgatcctgggacccctctttacgtaccttcatatgcggctgtcccagaagtggcaggtgatcaaccagagatcccttttgtgcggagaagacgaggctgcagacgagaatccagagtctcaggagatgctggaagaacagttggtgcgaatgctaaccagagaggttatggacctcattaccgtgtgctgcgtgtcgaagaagggcgccgaccattccagcgcaccccctgctgatggggatgacgaagaaatgatggccaccgaagtgacaccttcagccatggctgaacttacggacctggggaagtgtcttatgaagcacgaggacgtctgtacagcactgctgatcactgcatttaattccctcgcatggaaagacacactgagttgccagcgtaccacatctcagttatgttggcctttgctcaagcaggttctctcaggtaccctgctggccgacgcagtcacctggctgtttaccagtgtcctgaagggcctccagatgcacggccagcacgatgggtgtatggcctctcttgttcatcttgccttccagatctacgaggctctgaggccacgctatttggagattcgtgcagtgatggagcagattcccgagatccagaaggattctctggaccagtttgactgcaaactcttaaatccttccctccagaaagtggcagataagcgccgcaaggatcagttcaaacgcctgattgcgggttgcatcggcaaacccttgggagagcagttcaggaaggaagtgcacatcaaaaacttgccctctcttttcaagaaaactaagccaatgctggagacggaagtcctagataatgatgggggcggcctcgcaactatctttgaaccttag

SEQ ID NO: 187259 - DNA, 3378 bp, Artificial Sequence
  Description of Artificial Sequence: Synthetic coding sequence
atggccagcgaggaggccagcctgcgggccctggagagcctgatgaccgagtttttccacgattgtacaacaaacgaacggaaacgcgagatagaggagttattgaataatttcgctcagcagatcggcgcctggaggttttgcctgtatttcctgagctcaacgcgtaatgactacgtaatgatgtattctttgactgtgttcgagaacctcatcaataagatgtggctcggggttccctctcaggataagatggaaattagatcctgcctacccaagctcttgcttgcgcaccacaaaactctgccttactttataagaaataaactatgcaaggttatagtggacatcgggaggcaagattggcctatgttttaccacgatttcttcaccaatattttgcagcttattcagtcacccgtaaccacacctctcggactgatcatgcttaagaccacctccgaagaattggcttgtccgcgggaagacctgtctgtcgcgcggaaggaggagctacgtaaactgctgcttgaccaggttcaaacagtcctggggctgctcactggcattctagagactgtctgggataagcatagcgtgacggctgctaccccacctccatctccaaccagcggggagtccggcgatctcttgagcaacctcttacagtccccctcttcagccaagctgttgaaccagccgattccaatactggatgtggaaagtgagtatatttgctccctggccctggagtgtctggcacacctgttcagctggattccactgagcgcgtctattactccctctcttctaacaaccatctttcacttcgcccggttcggctgtgacatcagggctcgcaagatggcttctgtgaacggcagctcacaaaactgcgtgagcggacaagaacggggccggcttggggttctggccatgagttgtatcaatgagttaatgagtaaaaattgcgtgcccatggaattcgaagagtacctccttcggatgttccaacagacattttacctcttgcaaaaaatcactaaggataacaacgctcacaccgttaaatcacgcctggaagaactggatgagtcttacattgaaaaatttaccgactttttacggttgtttgtgtccgttcatctgaggagaatcgaatcgtatagtcaatttcctgtggtcgagtttctcacactgttgttcaaatatacatttcatcagccgacccatgaggggtacttttcatgtctagacatatggacactgtttctggactacctgacttcaaaaattaaatcccgcctgggggataaagaagccgtgttgaacagatacgaagacgccctggtattactcttgaccgaggtgcttaatcgtatacagttccgttacaaccaagcccaactcgaggaattggacgacgagactctggacgacgatcagcagacagagtggcaaaggtacctgaggcagagcctcgaggtggtggccaaagtgatggagctcttgcccactcacgccttctccacccttttccctgtgctccaagacaacctcgaagtgtacctgggcttacagcagttcatcgtcacgagtgggagtggccacagacttaatattaccgctgagaacgactgcagaagactgcattgtagccttagggacctctcatcgctccttcaggccgtgggccgactggcagagtactttatcggcgacgtctttgccgccaggttcaatgacgcgctgacagtagtcgagcgcctagtcaaagtgaccttgtacggcagccaaattaagctgtacaacattgaaaccgctgtgcctagcgtcctgaagcctgacctgattgacgtgcacgcacagtccttagccgctctgcaagcatactcacactggttggcacagtactgctcagaggtacacagacagaatacccagcagtttgtcaccctgattagtactacaatggatgccatcacccccctcattagtactaaggttcaggacaagttgctgctgagcgcctgccaccttctcgtgtcgctggcaactacggtgcggccggtgtttctcatttcaatcccagcggtgcagaaagtatttaaccggataactgacgcctccgcactgcgcctcgtcgataaggcccaggtgctggtgtgccgcgctctgtccaatattctactcctcccatggcctaacctgcctgagaatgagcaacaatggccagttcgctcgattaaccacgcaagtctcatatcagctctgtcgcgggattatagaaatctaaaacccagcgcagttgcccctcagcgaaagatgccgctcgacgacacaaaacttataatccaccagaccctgtcagtgctagaagacatcgttgagaatatctccggggagtctaccaaatctagacagatctgctaccaatcattgcaggagtccgtgcaagtcagtctagctctcttcccagcctttattcaccagagtgacgtaactgacgagatgctcagcttttttctgactctgttccggggcctgcgcgtgcaaatgggcgtgccgttcacagagcagattatccagacctttttgaacatgtttactcgggagcagctggccgaatccattctgcacgagggatctaccggttgtagagtggtggaaaagttcttgaagattctgcaggttgtcgtacaggaaccaggccaggtgttcaagccgtttctgccttccatcatcgccctgtgtatggagcaagtctatcctatcatcgccgagcgaccatccccagatgtgaaagccgaactttttgagctgctctttcgtactttgcaccataattggaggtacttcttcaagagtacggtgttggctagtgtgcaaagagggattgctgaggaacagatggagaacgagccccagtttagcgccattatgcaagctttcggacagtcttttcttcaacctgatatccacttatttaaacaaaacttgttctacctggagaccctgaataccaagcagaagctctatcacaagaagatcttccgaaccgcaatgctatttcagtttgtgaacgtcctcctccaggttctcgtgcacaagagccacgatctactccaggaggaaatcggaattgctatctataatatggcctccgtagacttcgatggtttcttcgctgcctttctgcctgagtttctcacgagctgcgacggtgtggacgctaatcaaaagagcgtgctcggacggaattttaagatggacagagatctcccttcttttactcagaatgtccacagattagtgaacgacctgcgatactaccgcctttgcaacgattccctgccacctggaacagttaaactatag

SEQ ID NO: 187260 - DNA, 3336 bp, Artificial Sequence
  Description of Artificial Sequence: Synthetic coding sequence
atgaccgagttcttccacgactgcaccaccaacgagcggaagcgggagatcgaagaactattgaataactttgcccagcagatcggggcttggagattctgcctttatttcctatcttccacacgcaacgactacgtgatgatgtatagtctgacggtgtttgaaaatctgattaataagatgtggctcggcgtgcctagccaagataaaatggagattcgcagttgcttgccaaaactgctcctggctcaccacaagactctgccctatttcatccgcaataagctctgcaaggtgatcgtagacatcggccgtcaggactggcccatgttctaccatgatttttttacgaacatccttcagctcatccagtcccccgtgactacgcctctgggcctaatcatgctgaagactacctcggaagaactcgcctgccctagagaagatttgagcgtggcccgaaaagaggagctccgcaaacttttactggaccaggtccagaccgtgttagggctgcttactggcattttagaaacagtctgggataaacacagtgtgaccgcagctactccccctccctcccccacgtccggggaaagtggggatctgcttagcaatctcctacaaagtccctcatcagccaaactcctgaaccagccaatacccatcctggacgttgagtccgaatatatctgcagtctggccttagagtgtcttgcccacctgttcagctggatccctctttccgcttcaatcactccgtcactcctcaccaccatattccatttcgcacgttttggctgtgatattcgagcacgtaagatggcctccgtcaatggcagctcccaaaactgcgtcagcgggcaagagagaggacggctcggcgtcttggcgatgtcatgtattaacgagttgatgtcaaagaactgcgtccccatggaatttgaagaatatctgttgcggatgttccaacagaccttctatctgctgcagaaaataactaaggataataacgcccatactgtgaaatccagactggaagagctcgacgaatcctatatcgagaaattcactgacttcctgcgcttattcgtctcagtgcacttgagacgaattgaatcctactcccagttccctgttgtcgaatttcttactctcttgtttaagtatacctttcaccagcctacccatgaaggatacttctcttgtctggatatatggaccttgtttctcgactaccttaccagcaagatcaagtcgaggctcggagataaggaggccgtgctcaatcgctacgaggacgcactcgtcctactactgaccgaggtgttaaaccgaattcagtttagatataaccaggcccagctggaggagttggacgacgaaacattggacgacgatcaacagacagaatggcagcgatacctgcggcagtcactggaggtggtggccaaggttatggagctcctgccgacacacgcattttcaactttgttccccgttctccaggacaacttggaagtgtatcttggattacagcagtttattgtgacttctggaagtggacacaggcttaacattacggctgaaaacgattgtagaaggctgcactgctcactgcgcgacctttctagccttctgcaagccgtcggccggctcgcagagtattttattggggatgtttttgccgctagattcaacgatgctctgaccgtggttgaaagacttgtgaaggttacactgtacggcagccagattaagctttataacatcgagacagcagtgccatcggtactcaaacctgaccttatagatgtccacgctcagagtctcgccgctcttcaggcatatagccattggctggcccaatactgctccgaggtgcaccggcaaaatacccagcagttcgttaccctgataagtacgacaatggacgccatcactccgttaatttctaccaaagtacaggacaaactgcttttaagcgcctgccacctactggtctctttagccactacggtgcgcccggtatttctgatcagtatacctgccgtgcagaaggtcttcaacagaattactgatgccagcgctctgcgcttagtggacaaggcacaggtcctcgtgtgtcgggctctaagcaatattttgcttctgccttggcctaatctgccagaaaacgaacagcagtggcccgtccgctctatcaatcatgcatcattgataagtgcactgtctagagactatagaaatctcaagccttcggccgtggcgccccagaggaagatgcctctggatgacacaaagcttatcatccatcagactctatccgttctggaagatattgtagagaacatctccggagaatctaccaagagtcgtcagatctgctaccagtctcttcaggagtccgtgcaggtatctcttgccctgtttcctgcattcattcatcagtccgacgttaccgacgagatgctgagtttctttctcacgctttttagagggctgcgcgtacagatgggtgtcccatttacggaacagattatccagacatttctgaatatgtttacccgcgagcagctggcggagagcatccttcacgaaggttcgaccggctgcagggtggtggagaagtttctgaaaattctgcaagtcgtggtacaggaacctgggcaagtatttaagccattcctaccgtctattattgctctttgtatggagcaggtgtaccctatcattgccgagcggcctagccccgatgtaaaggcagagctgtttgagcttttatttcggacactgcaccacaactggcgctactttttcaagtccacagtgttagcttccgttcagagaggcatcgccgaagaacagatggagaacgaacctcaattctccgcaatcatgcaggcctttggacagtcctttctgcagccagatattcatctgttcaagcaaaatctgttttacctggagacccttaatacaaaacaaaaactctaccacaaaaagatttttaggaccgctatgttatttcagttcgtcaacgtgctgctgcaggtactggttcataagtcccatgacctgctacaagaagaaatcggtatcgctatctacaatatggcttctgtcgattttgacggcttttttgccgctttcctgcccgaattcttaacatcatgcgatggggtcgacgctaaccaaaagtccgtgctgggccgcaatttcaagatggatcgcgacctcccaagcttcactcagaatgttcatcggttagtcaatgacctgcgttactacaggctgtgtaacgactctctgccaccagggactgtgaagctgtag

SEQ ID NO: 187261 - DNA, 3264 bp, Artificial Sequence
  Description of Artificial Sequence: Synthetic coding sequence
atggccgaccacgtgcagagcctggcccagctggagaacctgtgcaagcagttatatgagaccaccgacactactacacggctccaagctgagaaggcgctcgttgaattcaccaactcacctgattgcctgagcaaatgccagcttctccttgagagaggaagcagcagctatagtcagttactggccgcaacctgccttactaaactagtctcaaggaccaataatccactgcctctcgagcagagaattgacataaggaattacgtcctgaactacctggctacacggccgaaactcgctacatttgtgacccaggcgctgatccagctgtatgcaaggattactaaactcgggtggtttgactgtcagaaagacgattatgtattcagaaatgctatcaccgacgtaactcgcttcctgcaggactctgtagaatactgtataattggcgttaccatccttagtcagctaacaaatgagatcaatcaggcagacacaacacacccactgaccaaacacaggaagattgcttcaagcttccgggacagttctctgtttgatatttttactctgagttgtaacctgctgaagcaggccagcggaaagaatctgaatctcaacgacgagtcccagcacggactactcatgcagctgctgaagctgacacacaattgtttaaatttcgacttcatcggtacatccaccgatgaatcttccgatgacctttgtaccgtgcagatccccacatcttggagatccgctttccttgatagcagcacccttcagctgttcttcgacttatatcactctatccccccttccttcagccccctggttttgtcttgccttgttcagattgcatcagtgaggcggagtttgttcaataatgcagaacgcgcaaaattcctgtcacatctggtggacggggtcaaaaggattctggaaaatcctcagagcctcagcgatcctaacaattaccacgagttctgccggcttctcgcgcggttgaagtctaattatcagctgggggaactagtgaaggttgaaaattatcccgaggtcatacgtctaatcgctaattttactgtcacctctttacagcactgggaattcgcacctaactcagtccattacttactctctctatggcagcggctggctgcctcggtgccatatgttaaagccactgaaccccacatgctggagacttataccccggaggtgaccaaagcttatatcacatcccggcttgagtctgttcacatcatcttgagagacggtctggaagacccactggaggatacaggcttggtccagcagcagctcgatcagttgagcaccatcggacgctgtgaatatgaaaagacctgtgctttgctggtgcaactgttcgatcagagtgcccaaagttatcaagaactactgcagagcgcgtctgcttcccccatggatatcgcagttcaggagggccgactcacctggctcgtctatattatcggagccgtcatcggtgggcgcgtgtcttttgccagtacggatgagcaggatgcgatggacggggaactggtttgccgcgtgctgcagctgatgaatttaacagactcgcggcttgcccaggcgggtaatgagaagctggaactggcaatgctaagcttttttgaacagtttcggaagatttacatcggagaccaggtgcagaagagtagcaaactgtatagacgtctgtccgaagttttgggcctaaatgacgaaaccatggtcctatccgttttcattggcaaaatcatcaccaatctcaaatactggggcaggtgtgaacccattactagtaaaactcttcagcttcttaacgacctatccataggctatagctcggtcaggaaactcgttaaactatctgcagttcagttcatgctcaacaaccacacaagcgagcactttagttttctcggcatcaacaatcagtctaatctcacagacatgcggtgccgcacgacattctatacagccctggggagactgctgatggtcgatctcggggaggatgaggaccaatatgagcagtttatgttaccattgactgcggccttcgaggccgtcgctcaaatgttttcgacaaattcattcaatgaacaggaggctaaacgcactctcgtgggactggtcagagatctgaggggaatagcgttcgccttcaacgctaagaccagcttcatgatgctctttgagtggatctacccctcttacatgcctatcctccagcgcgccattgagttatggtatcacgatcccgcatgcacgacacctgtactgaagctaatggcagaactggtacataatagaagtcagagactccagttcgatgtctcaagtccaaatggcatactgctgttccgagaaaccagtaaaatgattacaatgtacgggaatcgcatccttaccctgggcgaggtgcctaaggatcaggtgtacgccctgaaactgaagggaatatctatctgtttcagcatgctcaaggcagccctctcaggaagctatgtgaacttcggagtttttaggctctacggcgacgacgctctcgataatgcccttcaaaccttcatcaaactgctcttgagcatccctcactctgatctcttggactatcctaagctgtcccaaagttactacagcctgcttgaagttctgacacaggatcatatgaacttcatagcctcactggagccccacgtgatcatgtacatactaagctctataagcgaaggccttacggcattggacactatggtgtgtacaggatgctgctcatgtctcgatcatattgtgacctacctgttcaagcaactaagcaggagcactaagaagcgtaccacacctctgaatcaggagagcgaccgcttcttacacattatgcaacagcatccagagatgatacagcaaatgctgagcacggtgcttaacataattatcttcgaggactgccgcaatcagtggagcatgagccgcccacttcttggcctgatcctgctgaacgaaaaatacttttccgacttgcgaaattcaattgttaactcgcagccgcctgagaaacaacaggccatgcacctctgttttgagaacctcatggagggaatagagcggaacctgttaacaaagaatagggacaggtttacccagaatttaagcgctttccgacgggaggttaacgattctatgaaaaattctacttacggcgtgaactctaatgacatgatgagctag

SEQ ID NO: 187262 - DNA, 3267 bp, Artificial Sequence
  Description of Artificial Sequence: Synthetic coding sequence
atgcgggaccccggccggaagagcctggcccagctggagaacctgtgcaaacaactctacgaaactacagacactacaactcgcctccaggcggaaaaggccctggtcgagttcacaaatagtccggactgcttgtcaaagtgtcagctcctgttggagagaggatcaagctcttactcccagttacttgcagctacatgcttaaccaagctggtatctcgcaccaacaatcctttgccactcgagcaacgcatcgacataagaaactatgtgctgaactatctagcaacaagacctaagttggctacatttgtgactcaggcgctgatacagctgtatgctcggatcactaagctcggatggtttgactgccagaaggatgattacgtgttccggaacgccatcaccgatgtcacccgttttctgcaagacagtgtggaatactgcattatcggggtgactatactgtctcagttgaccaacgaaatcaatcaagccgataccacccatccactgaccaagcaccgcaaaatcgcttcctcctttcgggatagttccctctttgacatatttactctgtcatgcaacttgcttaaacaggcctccggcaagaacctaaacctgaacgacgaatcccagcacggtttgctgatgcagttgcttaaattgacccataattgtctgaacttcgacttcattgggacctctacagacgagagtagtgatgatctgtgcaccgtccaaatccctacttcctggagatccgccttcttagacagctcgaccctccaactgttctttgacttataccacagcatacctccatctttttcaccactcgtcctttcgtgcctcgtgcagatcgcaagcgtgagacgaagcctgttcaataacgctgagcgcgctaaattcctttcacaccttgtggacggcgtcaagaggattctcgagaatccgcagtcattgtcagacccaaacaattatcacgagttctgccggctactggctagactgaaatcaaattaccagctaggcgagctcgtcaaggtggagaactatccagaagttatccgtctcatagccaatttcacagtcacatccttgcagcattgggagttcgctccaaacagcgtgcactatctactctcgttatggcaacggttggccgcctccgtgccctatgtcaaagcgacagagcctcacatgcttgagacgtatacccccgaggttacaaaggcctatattaccagcagactggagagcgtgcacattattcttagggacggcctcgaggatcctctcgaggacaccggactggtccagcagcagctggaccagctttcaaccatcggcaggtgcgagtacgagaagacctgtgccctcttggtacaactcttcgatcagtcagcccagtcgtaccaagaactgcttcaaagcgccagcgctagcccaatggacatagcagtccaggagggaagacttacctggttggtgtacatcattggagcagtgatcggagggcgcgtgagttttgcctcaactgacgagcaggatgctatggatggagagctcgtgtgccgcgtgctgcagctgatgaacctgactgattcaagactagcacaagcgggaaatgaaaaactggaattagccatgctctctttctttgaacagtttcgcaaaatttatattggcgaccaggtccagaagtccagtaagttgtatcgacgtctgtccgaagtcctcggtctcaacgacgagactatggtcttgagcgtgtttattggcaaaattatcacaaatctgaagtactggggccgatgtgagcctataacgtccaaaactttacagcttctgaatgatttgtccattgggtacagcagcgtaagaaagctggttaagctgtccgccgtgcagtttatgcttaacaatcatacatcggaacatttctctttcttggggatcaataatcagagcaacttaaccgatatgcgctgccgtactacattttacaccgctctcggccgactgctcatggtagatctgggcgaagatgaggaccagtatgaacagttcatgctgcccctaacagcagccttcgaagcagtcgctcagatgttcagcactaattccttcaacgaacaggaagccaagcgcaccctagtcggcctagtgagggaccttagaggcatagccttcgcctttaacgccaagacctccttcatgatgctctttgaatggatctatcctagttatatgcctatccttcaacgcgcgattgaactgtggtaccacgacccagcctgtaccacaccggtcttgaaattgatggcagaactggtgcacaataggtcgcaaagactccaatttgatgtatcctccccgaatggcattcttctcttcagagagacctcaaagatgataactatgtacggaaatagaattttgacattgggcgaagtccctaaggaccaggtgtacgcacttaaactgaagggcatctctatttgcttctccatgctcaaagccgcgctttccggttcttatgtgaacttcggcgtgttccggctgtatggggatgacgctctcgacaatgccctacagacgttcatcaagctgttactgagcatcccccattccgaccttttagattacccgaaactgtcacagtcttactactcactcctcgaggtgcttacgcaggaccacatgaactttatcgcatcactggagcctcacgtgattatgtatattctgtctagcataagcgaaggactcaccgccctggacactatggtctgtaccggttgttgtagctgtttagatcatatcgttacctatctctttaagcagctttcacgttctacaaagaaacgcaccacacccctgaaccaagaatcggacaggttcctgcacatcatgcagcaacatcccgaaatgatccagcagatgctcagtacggtgcttaatatcattatttttgaggattgccgaaatcaatggtccatgtcacgtcctctgctgggcctcattttacttaacgaaaaatatttctcagacctgagaaatagtattgtgaactctcaaccccctgagaagcaacaagctatgcacctttgttttgagaacttgatggaagggatcgaacgtaacctcttaactaagaacagagacaggtttacacagaacttgagtgcttttagaagggaagttaacgatagcatgaagaatagcacctatggagtcaatagcaatgatatgatgtcatag

SEQ ID NO: 187263 - DNA, 3291 bp, Artificial Sequence
  Description of Artificial Sequence: Synthetic coding sequence
atggccgaccacgtgcagagcctggcccagctggagaacctgtgcaagcagctgtatgagactaccgacacaaccacccgactgcaagcagagaaggcccttgtggagttcaccaattccccggactgtttgtcaaagtgccagttactacttgagagagggtctagcagttactcacagctgttggcagcaacctgtttaaccaaactggtgtcacgaacaaataaccctctacctctggaacagcgcatagatattagaaactacgttctgaactacctcgcaaccaggcccaaacttgctacatttgttacccaggcccttattcaattgtacgccagaattacaaaactgggatggtttgactgccagaaggacgactacgtgtttcgaaatgctattacagatgtgacgagatttcttcaggacagtgtggaatactgtatcatcggcgtgaccatcctgtcacagcttacaaacgaaataaatcaagtcagcgccaccgcttttctcatcgaggccgatacaacacaccccttgacaaagcatagaaagattgcctcttcctttcgggattcatcccttttcgacatattcacgctctcctgtaacctcttgaagcaggcttccgggaagaacctcaacctaaatgacgaatctcaacacggacttctaatgcaactgctcaagctgacccataattgcctcaacttcgactttataggtactagtactgacgaatcgtccgacgacttgtgtaccgtacagatccctacttcatggcgctccgcgttcctggactccagtacactccagctgttttttgacttatatcactctatcccaccatctttctctcctttagtgctctcttgtctcgtacaaattgccagtgtgcgccgaagtctctttaataacgccgagagagctaagtttctgtcacatctggtcgatggcgtgaagcggatattagagaatccacagtcactctcagacccaaataattatcatgaattttgccgccttctcgcacggttgaaaagcaattaccagctcggcgaattggtaaaagtggagaactacccagaagtgatccgcctgatcgccaacttcacagtgacctctttgcagcactgggagttcgcaccaaatagcgttcattatctcctttctttatggcagcggcttgcagctagcgtgccatatgttaaagctacggagccacacatgttagagacctatactccagaggtgacgaaggcttacattactagtagactcgaatccgtgcacataatactccgagacggtctggaagatcctctggaagatactggcctcgtccagcagcagctggaccagctgtccaccatcgggagatgcgaatatgagaaaacgtgcgccttattggtgcaacttttcgaccaatccgctcaatcttatcaggagctccttcaatctgccagcgcctcgcctatggatattgccgtgcaggagggcaggctgacctggctggtctatattattggtgcagtgattggaggacgagtgtcatttgcttccactgatgagcaggacgccatggacggggaactggtatgtcgcgtactccagttaatgaatttaaccgacagtcggctggcacaggcggggaacgagaagctggaactggcaatgctaagttttttcgagcagttccggaagatctacattggcgaccaagttcaaaaatcgtccaaactgtacaggcgcttgtcagaagtgctcgggctgaacgacgagaccatggtgctcagtgtgtttatcgggaagataataaccaacctgaaatattggggaaggtgtgaacctataacctctaagacattgcagctgctcaatgacctgagcatcggatacagctctgtccggaagctggttaagctctctgcagtccagtttatgctgaataaccatacctccgagcacttcagcttccttggcatcaacaatcagtccaatttgacagacatgaggtgccgaactacattttacactgcactcgggagactgctcatggtcgacctcggggaagatgaggatcagtatgagcagttcatgctgccactcaccgccgcttttgaggcagtggcacagatgttttcgacaaatagctttaatgagcaggaggcaaagagaactttagtgggactggtaagggatctacgaggtatcgcgttcgcttttaatgcaaagactagcttcatgatgctatttgaatggatctacccatcttacatgcctatcctacagcgggcaattgaactctggtaccacgacccagcatgcactacccccgtgttaaagctaatggctgaactggttcataatcgcagccagcggctgcagttcgacgttagtagccccaacgggatactcctgtttcgggagacctccaagatgatcactatgtacggcaatcgtattctgactttgggggaagtaccgaaagatcaggtttatgctttaaagttgaaagggatcagtatctgttttagcatgttgaaagccgcgctctctggttcctacgtgaactttggagtgttcagactttatggagatgatgctctggataacgcccttcagacttttatcaagctgctgctgtctattccgcacagtgacttgctggattatccaaagctgagccagagctattacagcctgctggaagtcttaacacaggatcacatgaacttcatcgcctcactggagccccatgtaattatgtatattctcagctcgatatccgaaggcttaactgctttagataccatggtgtgtacagggtgctgcagctgcctggaccacatagtcacctacctgttcaaacagctaagccgctcgactaagaagcggactacccctcttaatcaggagtcagaccgcttccttcacatcatgcagcagcatccggaaatgatacaacagatgctctccacagtacttaacattatcattttcgaagattgtagaaaccaatggtccatgtctcggcccttattaggactcattctgctgaacgagaagtacttttccgatctccggaactctatagtgaacagtcagccacccgagaaacagcaggccatgcacctgtgctttgaaaacctgatggaggggatcgagcgcaatctcctcaccaaaaaccgagatcggttcacccaaaacctcagtgcattcagacgggaggttaatgacagcatgaaaaactcaacttatggggtgaattcgaatgatatgatgtcctag

SEQ ID NO: 187264 - DNA, 6363 bp, Artificial Sequence
  Description of Artificial Sequence: Synthetic coding sequence
atgcggagcttcaagcgggtgaacttcggcaccctgctgagcagccagaaggaagccgaagaactgctgccagccttgaaagaattcctgtctaatcccccagcagggttcccatctagcagatccgacgcagaacgacggcaagcctgcgacgccatcctgcgtgcctgtaatcagcaacttaccgccaagctggcatgccctcggcatctcgggtccctcttggagctcgcggaattggcttgcgatggttacctggtatcaaccccacagagacctcccctgtatctggagcgcatcctttttgtgctcttacggaatgctgccgctcagggttctcccgaagcaaccctccggctagcacagcctttgcacgcctgcctggtacaatgttccagggaggctgctccccaagactacgaggctgtggccagggggagcttctcccttctgtggaaaggcgcggaggcgttattagagagacgtgccgcctttgccgctcgtctgaaggccttgagttttctcgtgctcctagaggatgagtccaccccatgtgaagttcctcactttgcatctcccactgcttgcagagccgtcgctgcacatcagctgttcgatgctagtgggcatgggctaaatgaggccgatgccgactttctggatgacctgcttagtcggcacgtaataagagctcttgtgggagaacgaggaagttcctctggcctgctctcgcctcagagagccctgtgcctgctggagctgacactggaacactgccgcagattttgttggtccagacatcacgacaaggccatttccgctgtcgaaaaggctcacagctatctccggaacactaatcttgcgccctccctacagctgtgtcagctgggagtgaaactcctgcaagtgggcgaggaaggcccgcaggcggtagcaaagctgcttatcaaggccagcgcagtgctcagtaaatctatggaggccccctcccctccgctgcgggctttgtatgagtcctgtcagttctttcttagcgggctggaaagaggcacgaaacggcgatatagattggatgctatcctgtcactgtttgccttccttgggggatactgttcgctattgcagcagttgcgggacgacggagtgtacggaggctcgtcgaaacagcagcagagcttccttcagatgtattttcagggcctgcacctgtataccgtcgttgtttacgacttcgcccaggggtgtcagatcgtggaccttgctgatttgacacagctcgtggacagctgcaaaagcaccgtagtgtggatgctggaggcgctggaagggttgtctggacaggaactaacagatcacatgggaatgaccgcttcctacacatctaacctcgcctattccttttactcccacaaactttatgctgaagcatgtgcaatatcagagccactgtgccagcatcttggcctggtaaagcccggcacgtatccagaggttcccccggagaaacttcatcgctgctttaggctgcaggtcgagagtctaaagaagctgggaaagcaggctcaggggtgcaagatggtgatcctgtggcttgcagctctccagccttgctccccagagcatatggcagagcccgtgactttttgggtgcgcgtcaagatggatgccgccagggccggagacaaggaactgcagttaaaaacacttcgggatagtctgagcgggtgggaccccgagaccctggcactgctgttaagggaggagctgcaagcatacaaggcagtcagggcggacaccgggcaggagaggtttaacatcatctgtgacctgctggaactgagtcccgaggagaccccagctggtgcctgggcacgggccacccatcttgttgagctggctcaggtgctttgttaccacgattttacgcaacaaactaactgcagcgccttagacgccatccgggaagccctgcagttgctggacagcgtaaggccagaagcccaggcgcgagaccagctcctggacgataaggcgcaggccctgttatggctgtatatctgtactctggaagccaagatgcaggaaggaattgaaagggaccggcgagcgcaggctcccggtaatctcgaagagttcgaagtgaacgatcttaactacgaggacaagttgcaggaggacaggtttctgtacagcaatattgcctttaatctggccgctgacgcggctcaaagcaagtgcctggatcaggcccttgctctatggaaggagctgctgactaagggccaggcaccagccgtccgttgcctccagcagactgccgcctctctccagattctagccgccctctaccagctggtggcaaagcccatgcaggccttggaagtccttcttttgctccggatcgtcagtgaaagactcaaggaccactccaaagcagctggaagctcctgccacataacccaactgctgctcactttggggtgtcccagttacgcccagttacacctggaggaagctgcatccagcctgaaacaccttgaccagacaaccgacacgtacctcttgctgagcttgacctgtgatctgctccgtagccaattgtactggacccaccagaaagtcactaaaggggtctcactgctgctgagcgtactgcgggacccggcgctccagaaatccagcaaggcatggtacctgctgcgggtgcaagttctacagttagtggctgcctacctgagcctgccaagcaacaatctgtctcattccttgtgggagcagctgtgcgctcagggttggcaaacccccgagatcgccctaattgatagccacaagctgctacggagcatcatactccttctcatgggcagtgatatcctctccacccagaaggcagccgtggaaacctcttttctggactacggggaaaatctggtgcaaaaatggcaggtgctttccgaggtgttgtcctgttccgagaagctggtgtgccacctgggcaggctgggctccgtaagtgaagcaaaagccttttgtctggaggcgctcaagctgacaacaaagttgcagatacccaggcagtgcgcactgtttctggtcctgaagggcgagctagaactcgccaggaatgatatcgacctctgccagtctgatttgcaacaggtgctgttccttcttgagtcttgcacagaattcgggggcgttacccagcaccttgacagcgttaagaaggtgcacttacagaaaggcaaacaacaggcacaggtgccatgtcccccgcaactgcctgaggaagaattattccttcgtggtccagctctggagctggtggcaaccgtggcaaaggaacctggaccaattgcccctagtactaatagctctccggtgcttaaaaccaagccccaacctatcccgaactttttgagtcacagcccgacctgtgactgctcactgtgcgctagcccagtcctcacagcggtgtgcttgcggtgggttcttgtaactgccggagtcagacttgcgatgggtcatcaggcccagggactggatcttctccaggtcgtactgaagggttgtcccgaagctgccgaacgtctcacccaggcgctgcaagcgagcctgaatcataagacgcccccgtccctcgttccttccctgcttgacgaaatcttagctcaagcatacacattgttagctttggagggcctgaatcagccctctaacgagagtctgcagaaagtcttacagtctggattaaagttcgtggccgctagaatcccacatttagaaccttggcgagccagtctcctgctaatttgggccctgactaagctaggcggattatcttgttgcacaacccaactgttcgcatcaagctggggctggcaacccccactcattaaatccgttcccggctcggagccttccaaaacccaaggacagaagaggagcggccgcggccgccaaaaactggcctcggcaccactgcgactgaacaatacaagccagaagggacttgagggaagggggctgccttgtacccccaagccaccggaccggatacgacaggcagggccccatgttccttttactgtatttgaagaggtatgtcctactgaatccaaaccagaagttccccaagcaccccgggtacaacagcgagtgcagacacgcctcaaggtaaattttagtgacgatagcgatttagaggatcctgtctcagctgaggcctggcttgcagaggagcctaaacgccgtggtaccgcttctcgcggcagaggcagagcgcggaaggggctcagcttgaagaccgatgccgtggtggctcccggaagcgctcctggaaatccgggactgaacggcaggagtcggcgagcaaagaaggtcgcctctcggcattgcgaggagaggcgcccacagcgtgccagtgatcaggctcgccctggccctgaaatcatgcgaaccatcccagaagaagagttgaccgacaactggcgaaaaatgtctttcgaaatcttgcgtgggagcgatggagaggacagcgcaagtggaggtaaaacccccgcgccgggaccggaagcagcatcgggagagtgggaactcctgaggcttgacagtagcaagaagaaactaccttctccatgtcccgataaggaaagcgataaggacctcgggccccggctcagactcccaagcgcacccgtggccaccgggctctcgaccctcgacagtatctgtgatagtttaagtgtggcatttcgcggtatttctcattgtcctccctcaggcttgtatgcccacctctgccggtttctagctctttgcttgggccatcgcgatccctatgctaccgcctttcttgtgaccgaatctgtgtcgatcacatgtcgtcaccagctgctgacacacctccatcggcagctatcaaaggctcagaagcacagaggcagtttggagattgcagatcagctacaggggctgtccctgcaggagatgccgggtgacgtaccattagccaggatccagagactcttttccttccgcgccctcgagtcagggcacttcccccagcccgagaaggaatcctttcaggaacggctagctctgatccctagcggagtcaccgtctgtgtgctggccctggccaccctgcagcccggaactgttggaaacacactacttttaacgagactagaaaaagattcccccccggtttcagtccagatcccgactgggcagaacaagttgcacctgaggtcagtccttaatgaattcgatgccattcagaaagcgcaaaaggagaattctagttgtactgataaaagggaatggtggactgggcgattagcactcgaccatagaatggaggtactgatcgctagcctcgagaaaagcgtgctgggctgttggaagggcctgctacttcctagcagcgaggagcccggccctgcccaggaggcttcccggttacaggaactcctgcaagactgcggctggaagtatccggaccggacactattgaaaattatgttgagtggggcaggagccctgaccccacaggatatacaagcgctggcatatggtctgtgtcccactcagcccgagagggcccaggaactcctgaacgaggccgttggcagactccaggggctgactgttccttctaattcccatttggtactggtcttagacaaggacttacagaaactgccttgggagtcaatgcccagcctgcaggcactgccagtgaccagattaccgagcttcaggtttctcctttcctactccatcattaaggaatacggagcttcacctgtgctgtctcagggggtcgaccctcgcagcacattctacgtgctcaatcctcataacaacttgagctctacagaggagcagtttcgggctaacttcagcagcgaagccggttggcgtggcgtcgtgggggaggtacctcgccctgagcaggtgcaggaggccctcacgaagcatgatctctacatttacgcgggtcatggtgcgggggctcgctttctggatggtcaagccgttctgaggctttcttgcagggctgtggccttactttttgggtgttcttccgccgccctggccgtccgcggcaacttggagggtgccgggattgtgcttaagtacattatggctggctgccctttattcctcggaaatctgtgggacgtcacggacagggatatcgatcgttatacagaggcgctcttgcaaggctggctgggtgcaggtccgggcgcccctctgctctactacgtcaatcaagctcgccaggcccctaggctaaaatatctgatcggagcagctccaattgcctacggattgccagtgagtctgaggtag

SEQ ID NO: 187265 - DNA, 6363 bp, Artificial Sequence
  Description of Artificial Sequence: Synthetic coding sequence
atgcggagcttcaagcgggtgaacttcggcaccctgctgagcagccagaaggaggccgaggagctccttcctgctctcaaggagttcctgtctaaccctcctgccggttttccaagctcacgcagcgatgccgaacgccgccaggcttgtgacgcaattctgagggcatgtaatcaacagctgaccgccaagctcgcatgtcccaggcacctcggaagtctgcttgaactggctgagcttgcctgtgacgggtacctcgtgagcactccacagcggcctcccctttacttagaacgaatcctattcgtgttacttagaaatgctgcagcacagggttcgcctgaggccactttgcgtctggcccagccactccacgcgtgcctggtgcagtgctcgagagaagccgctccacaggactatgaggctgtggctcgggggtcattctccctgctttggaagggtgccgaggccttacttgaacgtcgggcagcttttgccgcgcggctgaaagctctgagttttctggttctgcttgaggatgagtccaccccttgtgaggtgcctcatttcgcgtcacccacagcctgcagggcggtggctgctcaccagctttttgacgctagcggtcacggcctgaatgaagctgatgctgatttcctggacgacctactcagtcgtcacgtcatacgcgctctggtaggcgagcggggctcttcctcgggtctgctgagtcctcagcgagctctgtgcctcctggagttgacgcttgagcattgtcggaggttctgctggtcccgccaccacgacaaggctatttccgcagtggagaaagctcactcatatctcagaaatactaacttggcaccttcgctccagttgtgccaactgggcgtgaagctcctacaagtcggtgaggaagggccccaagctgtggctaagctacttatcaaggccagcgcagtactgagcaagtctatggaggccccttccccacctctgcgggccctctatgagtcttgccagtttttcctaagcggcttggagcgagggaccaagaggaggtaccgcctcgatgctatactgtcactgtttgcctttctcggcggctattgtagtctgctgcagcagctccgggacgacggtgtgtacggagggtctagcaaacaacagcagtcattcctacagatgtattttcaggggttacacttatacaccgtggtggtgtacgattttgcacaggggtgccaaattgtggacctcgctgacttgactcagcttgtagacagctgcaagtcaacagtggtgtggatgctcgaagcactggagggattaagtggccaggaacttacggaccatatgggcatgaccgctagctacacctcgaatcttgcttacagtttttactctcacaagctgtacgccgaagcttgcgccatttctgagccgctatgtcaacaccttgggctggtaaaacctgggacctatccagaagtgcctccagaaaagctccacagatgcttccgactacaggtggagtcgctgaagaaactcgggaagcaggcacagggctgcaaaatggtgattctctggctcgccgccctgcaaccctgctcacccgagcatatggctgaacctgttacattttgggtgcgggtgaaaatggacgccgcccgagccggggacaaggaactccagttgaaaaccctgagggattctctgagcggctgggaccctgagacactcgctcttctcctcagggaagaacttcaagcatataaggccgtgcgagcagataccgggcaggaaagattcaacatcatttgtgacctgctggaattatcacctgaggaaacccccgcaggcgcgtgggctcgtgcgacacacttagttgagttggctcaggtactctgctaccatgattttacacaacagacaaactgcagtgccctggatgcaatccgggaggctctccagctgttggacagtgttcggcccgaggcccaggctcgggatcagctcctcgacgataaagcacaggcacttctgtggttatacatttgcacactggaggcaaagatgcaggagggcattgagagggaccgccgggcacaggctccaggtaacctcgaggagttcgaagtgaacgaccttaactatgaggacaagctgcaggaggacagattcttgtattcaaatatcgcattcaacttggctgcggacgccgcacagtccaagtgcttagatcaggccctcgctttatggaaggaactcctgactaagggccaggcacccgcagtgaggtgcctccagcagactgccgctagcttgcagatccttgcggcactgtatcagttggttgctaagccaatgcaggccctggaggtgcttctcctgttgcggatcgtgtccgaacggctcaaagatcatagcaaagccgccggcagctcctgccacattacccaactgcttttaactctcggatgccctagttacgcccagttacacctagaggaggcagcctcgagccttaaacacctagaccaaacaactgacacctatctgcttctctcgttaacctgcgatctactcaggagtcagctatactggacacaccagaaagtgacgaagggcgtgagtctgctactgagcgtgctgcgggacccggcgctccagaaatcttctaaagcctggtacctattacgggtccaggtcttacaactggtggcggcctatttgtccctacccagcaataacctatcccatagcttgtgggagcagctatgcgcacaggggtggcagacacctgagattgcccttatcgattcccacaaactgctgcggtctataatcctgctgctgatggggtccgatatcttaagtactcaaaaggccgctgttgagacatcctttctcgattatggggagaaccttgtccaaaagtggcaggtgctctccgaggtcttgtcctgctccgaaaagcttgtgtgccatttggggcgactgggtagcgttagtgaagccaaggcgttttgtttagaagctctgaaactgacaactaagttgcagatcccacggcagtgcgcattattcctcgtccttaagggagagctcgagctggcaaggaacgatatcgatctttgtcaatccgatctgcagcaggtgctattccttcttgagtcctgcaccgaatttggtggggtaacgcagcatttagattccgtcaagaaggtccaccttcagaaaggcaaacagcaagcccaggtaccatgtccccctcaactcccagaagaagaattgtttttgaggggaccagctctggagttggttgctactgtcgccaaggagccaggtcccattgcaccttcaactaacagctccccagtgctaaagactaagccacagcccatccccaattttctgtcccactcaccaacctgcgactgtagcctgtgtgcatcccctgtcctgaccgctgtctgcctgcgttgggtgttggtaactgctggggtgcgtcttgccatggggcaccaggcccagggtctggaccttctccaggtggtgttaaaaggctgtcctgaggccgcagaaaggttaactcaggcattacaggcgtccttaaaccacaaaacccctcctagccttgtcccctccctgctggacgagattctcgcacaggcttacactttattagcactcgaggggctgaaccagccttcaaacgagagcctacagaaagtgctgcagagcggccttaaatttgtggcagcacggatcccacacctggagccctggagagctagcttgctgctcatctgggcactcacaaaactgggcggtctttcatgttgcactacccagctgttcgcctcctcttggggctggcagccgccgctgatcaaatctgtccctgggtcagaaccctctaaaacacagggacagaaacgatccggcagggggcgacagaagttagcatccgcccccctgcggttaaataacacctcacaaaagggcctcgaaggaagagggttgccctgcaccccaaaaccccccgaccgcattagacaggccggcccccacgtgccgtttacagtgtttgaggaagtgtgtcctaccgagtctaagcctgaagtcccccaggcgcccagagttcagcaaagggtccagacccggctgaaagtaaacttctcggatgattcagatctcgaagacccggtgagcgccgaggcatggttggctgaggaaccaaagaggcgcggaaccgcatcacgcgggcgagggcgggcgaggaagggactgtccttgaaaacggacgccgttgtggcccccggctcggctcctggtaatcctgggctgaatggccggtctagacgggcaaaaaaggtggcttctcgtcactgcgaggaacgtaggccccaacgagcgtcagaccaggcccgccctggcccagagatcatgaggactattccagaggaagaactgaccgacaattggagaaagatgtcgttcgaaattctgagaggaagcgatggggaagatagcgcctccggcgggaaaactcctgctccaggacctgaggctgcgtctggcgagtgggaactgctgcggctggactcctcgaaaaaaaaattaccatccccctgtccagacaaggagtcagacaaagacttaggaccgagactgcggctacctagcgcccccgtggcaacaggtttatctactcttgactcaatctgcgattcactgtctgtagcatttagaggcattagtcactgcccccccagcggattgtacgctcatttgtgcagattcctggccctatgccttggacaccgggacccctatgctacagcattcttggtgaccgagagcgttagtataacgtgtcgtcatcagctccttactcacctgcatagacaactgtccaaagcacagaaacatcgtggatctctggagatcgcagatcagttgcaaggactgagtctacaggagatgcctggggatgttcccctggcccgcatacagagactgtttagctttagagcccttgaaagcggccactttccgcaaccggagaaggagtctttccaggaacggctggcgctgatcccctccggcgttacggtatgcgttttagcgttagcaacactccaaccggggaccgtcgggaacacgctgctactcacaagattggagaaagattctcctcctgtgagcgtgcaaatcccaactgggcaaaacaaactgcatttgagaagcgttctgaacgagtttgatgcaattcaaaaggcgcaaaaggagaactcatcctgcaccgataagcgggagtggtggacaggtagattagcgctggatcaccgaatggaggtgcttattgcttccctagaaaagtctgtgctggggtgttggaaaggccttctgctgccaagctcagaggaaccgggccctgctcaggaggcatccaggctccaggagttgttacaggattgtggctggaagtaccccgaccgcacactcctcaaaattatgctctccggtgcaggggctctgactccacaggacattcaggcattagcatatggactctgtccaactcagcccgaacgagcacaagagttgctaaacgaggctgtggggcgcctgcaaggacttactgttccatcgaacagccacttagtgctggtcctggacaaggacctccagaaactgccctgggaatcaatgcccagtctccaggcattgcccgtgacccggctccctagcttcagattccttctaagctattccattatcaaggagtatggcgccagccccgtgctgagtcagggcgtcgatcctcggtccacattctatgtgctgaatcctcacaataatctcagtagcaccgaggaacagttcagagccaactttagcagcgaggccggttggcgaggtgtggttggcgaagtgcccagacccgagcaggtgcaagaggccctgactaagcacgacctgtatatatacgctggccatggcgccggagcccgattcttggacggccaagctgtgctgcgtttaagttgccgggcggtggccctcctcttcgggtgttctagcgccgccctcgcagttcgggggaacctggaaggcgctgggatagtgctcaagtatataatggcagggtgtcccctatttctaggcaacctctgggatgtgacggatagggacatcgatcggtacactgaggccctgcttcagggatggctcggggccggacccggcgctccactcctatattatgttaaccaggctagacaggcccccagattgaagtatctcatcggagccgcaccaatagcttatggacttcccgtaagcctgcgctag

SEQ ID NO: 187266 - DNA, 5388 bp, Artificial Sequence
  Description of Artificial Sequence: Synthetic coding sequence
atggaggcccccagcccccccctgcgggccctgtacgagagctgccagttctttcttagtggccttgagagggggactaaacgaaggtaccggctggatgccattctgagtctgttcgcatttttgggtggttattgcagcctgctgcagcaactgcgggatgacggcgtttacgggggatcttcaaaacaacagcaatctttcctccaaatgtactttcagggccttcacctatatactgtggtcgtctacgatttcgcgcagggctgccagattgtcgaccttgccgacctgactcagctggttgacagttgcaagagcacggtagtgtggatgctagaggctctggaaggcctgtccggtcaggagttgacagatcacatggggatgactgcttcttatacttcgaacttagcttatagtttctactcccacaagctctatgccgaagcctgtgctatctctgaacctctgtgtcagcacctaggtctcgtgaaaccgggaacatacccagaggtgcccccagagaaattgcaccgctgttttcgacttcaggttgagagtttaaaaaagctcgggaagcaggctcagggctgtaagatggtgatactatggctagccgccctgcagccctgctctccagagcacatggccgagcctgtgaccttctgggtaagggttaagatggacgccgccagggctggagataaggaattacagttgaaaacgcttcgtgattcattgtcgggttgggaccccgagaccctagctctcctgcttcgcgaggaactccaggcctataaagccgtccgagcagacacgggccaagagcgtttcaatatcatctgtgaccttctcgagctctctccagaagagactccagccggagcttgggcccgcgccacacaccttgttgaactggcccaggtcctctgttaccacgattttactcagcaaaccaactgttcagctcttgacgcaatccgcgaagctctgcagctgctggacagcgtgcgacctgaggcccaggcacgggaccagttgctggacgataaagcacaggccttactgtggctttatatttgcactctggaggccaagatgcaagagggtattgagagggatcggcgggcacaagctccgggtaatcttgaggagttcgaagtcaacgacctaaattatgaggacaaactccaagaggaccgttttttgtactcgaacattgctttcaacttggcggccgatgccgcacaatccaaatgcctggaccaagccttagcactgtggaaggagcttctgacaaaaggtcaggcccccgcggtccgttgcctgcaacagacagccgcatccctgcaaatcctggcagctctgtaccagttggtggcaaagccgatgcaggccctggaggtcttgctgctgctgcgtatcgtgagcgagagactgaaagaccacagtaaggcagcaggcagcagctgtcacataactcagcttttactcacgctgggctgtccatcttatgcccagctccacctggaggaggcggcatcttccttgaaacatctcgatcagacaaccgatacctacctgcttttgtctctgacctgcgacctactccgctctcagctctactggactcatcaaaaggtgactaaaggggtatcgctgctgctcagcgtcctccgggatcctgctctgcagaagtcttctaaagcttggtatctcctccgggtgcaagtactccagctggttgccgcatacttgtctctaccaagcaataatttgtctcacagcctgtgggagcagctctgcgcgcaggggtggcagacaccggagattgctctgatcgatagtcacaagttgcttaggagtatcattctcctactgatgggaagtgatatcctatcgacccagaaggccgccgtagagactagtttcctggactatggagaaaacctggtccagaagtggcaggtcctgtctgaggtcctgagctgttcagaaaagctggtgtgccacctggggcgcctgggatccgttagtgaggcaaaggcattttgcttagaagctctgaagcttacaacaaaactccagatcccccgtcagtgtgccctattcctcgtgttgaagggtgaacttgagctggctcggaatgacattgatctctgtcagtcagatctgcagcaggtactgtttctactggaatcctgcaccgaattcggcggagtgacacaacacctggattccgtgaagaaggtccacttacagaaaggcaaacaacaggcccaggtgccttgtcctcctcagctaccagaggaagagctgttcctgcgcgggcccgcactggaactggttgccacagtggccaaggaacctgggcctattgccccaagcaccaactcaagtcccgttctgaagacaaagccacagcctattccaaactttttgagccactcaccaacctgcgactgttccttatgtgcttcccccgtgctgactgcggtctgtctgcgctgggtgctagtcacggcaggagtgcgcctggctatggggcaccaggctcaggggctggacctccttcaggtggtcctcaaaggctgcccagaggccgctgagaggctgacccaggctttgcaggccagtcttaaccacaagacgcctccatcgctggtgcccagcctgttagatgaaatactggcccaggcttacactttgctggcactggaggggttaaaccagccatccaacgaaagtctgcaaaaagtgctgcagtccgggctcaaattcgtggctgcacgaatcccccatcttgaaccttggcgtgcgtctttgctgctgatttgggcattgacaaagctggggggactgtcatgctgcaccacgcaattgtttgcgtcttcttggggctggcagccgcccctcatcaaaagcgtgcctgggtccgaaccttctaagacccagggccagaagaggtccggccggggccgacaaaagctggcctccgcacctctcagactgaataatacttctcagaagggtctggaaggccggggacttccttgcaccccaaagccacccgatcgaatcaggcaggcaggaccacatgtgcctttcacagttttcgaagaggtgtgcccaaccgagtcaaagcccgaggtcccgcaggcacctcgggttcagcagagggtgcagacaagactaaaggtgaattttagcgatgatagcgacctggaagatcccgtgtctgccgaggcttggctcgccgaggagcccaaacgccgtggcaccgcctcccgagggcgcggccgggctagaaaaggcctgtcactgaagaccgacgccgttgtggcaccaggcagtgctcccggaaaccctggcctgaacgggcggagtcgacgggctaagaaagtagcgagcagacactgcgaagaacgaaggcctcagagagccagcgaccaggcaaggcccggccctgagatcatgcgcactattcccgaagaagagttgactgacaattggaggaaaatgtcttttgaaattctgagaggcagcgacggtgaagattccgccagtggaggcaagacgcctgcacccgggccggaagccgcctccggcgaatgggaattactgcgccttgactctagcaagaaaaagctcccatctccatgtcccgacaaggaatccgataaggaccttgggcctcgtctgcggctaccttctgccccagttgctaccggtctgtccaccctcgacagtatttgcgattccctgtctgtggcgttccggggcatttcacattgtccccctagcggtctgtatgcccacctctgccggtttctcgccctctgtttaggtcatagggatccttacgcaactgcttttctggttacagaatcggtgagtataacttgtcggcatcaattgctgactcatctgcaccgccagctcagcaaagcccagaaacaccgcgggtctcttgagattgctgaccagctacagggattgtccttgcaggaaatgcctggcgatgtccctctggcacgaattcaaagactgttcagttttagagccctggaaagcgggcatttcccccaacccgaaaaggaaagtttccaagaacgtctcgccttgatcccttctggcgtgacagtgtgtgtactggccctggctacactgcagcccggcaccgtgggtaatacactgcttcttacaagacttgagaaagactctcctcccgttagcgtccagatcccaaccggccagaacaagctccacttgaggtcggtgctcaacgagttcgacgccatccagaaggcccagaaagagaatagttcatgtacagacaagagggaatggtggacaggccggttggcactcgatcatcgcatggaggtgctgatagcaagcctggaaaaaagcgtgcttggctgctggaaggggctgcttttaccatctagtgaggaaccaggcccagctcaggaggcatccaggctgcaggagctgcttcaggattgcgggtggaaatatccagatagaaccttgctgaagataatgctgtctggggccggcgcacttacaccccaggatatccaggctcttgcatacggcttgtgccctacacagccagagagggctcaagagctcctgaacgaagccgttggcagactgcagggccttacagtgccttctaactctcatctcgtcctggtcctcgacaaggacctgcagaagctcccctgggaatccatgccttcactgcaagctctgcctgtcacccgcttaccatcattcagattcctcctctcctatagtatcattaaggaatacggggcctcacccgtgctgtctcagggtgtggatccaagatctacattctacgtgctcaatcctcacaataatttgtcgtccaccgaggaacagtttcgtgctaatttctccagtgaggctggctggcggggcgtggttggggaagtccccagacccgaacaggtgcaggaagcccttaccaagcatgacctgtatatctatgccggccatggtgctggggcaagatttctcgatggacaggcggtcttacggctgtcctgccgggccgtagcccttctgttcggatgctctagcgcagctctggcagttcgaggaaacctcgaaggcgcaggcatagtgcttaagtacatcatggccggctgtccattgttcctgggaaatctgtgggatgtgaccgaccgagatatcgataggtacactgaagctctgctgcagggatggctgggtgctggtcccggagcacctctgctctactatgtaaatcaggccaggcaggcccctagactaaagtatctgattggtgccgcgcctatagcctacggcttacccgtgagcctgaggtag

SEQ ID NO: 187267 - DNA, 1248 bp, Artificial Sequence
  Description of Artificial Sequence: Synthetic coding sequence
atgggcaccaccgcccgggccgccctggtgctgacctacctggccgttgcttcagcagccagcgagggaggctttactgccaccggccagaggcaactccggccagagcattttcaggaggtaggatatgccgctcctcccagcccaccactgtccaggagcctacccatggaccaccccgactcaagtcaacatggccctccattcgagggccagagtcaggtgcagccccctcccagccaggaagcaacacctctgcagcaggagaaattactgccagctcagctccctgccgaaaaggaagtcggtcctcctctgccacaggaagctgtgccccttcagaaagaactgcctagtctacagcacccaaacgagcagaaagaggggactccagctccatttggtgatcagtcccacccagaacccgaatcttggaatgccgcccaacattgtcaacaggacaggtcccagggtggttggggacaccgattggatggcttcccccctgggcggccctcgccagataacttgaatcaaatttgtcttccaaaccggcagcacgtggtctacggcccctggaatttgccccagtccagttattcccacttgacccgtcaaggtgaaacactcaactttcttgagatcggctactccaggtgctgtcattgcagatcccacacaaacaggcttgagtgcgcaaagctcgtgtgggaagatactctagacaagtactgcgaccgagagtatgccgtaaaaactcaccaccatctgtgttgtcgccatccgccaagccctaccagagatgaatgttttgccagacgggctccatatcctaattacgatcgggacatcctgactattgatatcggcagagtcaccccaaatctcatgggacatctgtgcggcaaccaacgggtgctcacaaaacataaacacatccccgggctgattcacaacatgacagcacggtgttgtgacctgcctttcccggagcaagcctgttgcgcagaagaagagaagctgacttttattaatgacctctgcggccctagaaggaacatttggcgcgatcctgccctgtgttgttatctgagccccggagatgagcaggttaactgtttcaacataaattatctgaggaacgtggccctggtgtccggagacactgagaacgctaagggccagggagagcagggcagcaccggcggcactaacatctcatctacatcagagcccaaagaggaatag

SEQ ID NO: 187268 - DNA, 1623 bp, Artificial Sequence
  Description of Artificial Sequence: Synthetic coding sequence
atgggcaccaccgcccgggccgccctggtgctgacctacctggccgtggctagcgccgcgtctgaaggcggcttcacggccacaggtcaacgccaactgcgaccggagcactttcaagaagttggctatgccgcccccccttctccaccactgtctagatccttacctatggaccatccagacagctcccagcacggacctccctttgagggtcaatcccaggtccagcccccgccatcacaggaagccaccccgctgcagcaagaaaagctgctacctgcccaactgcccgccgagaaagaagtgggccctccactccctcaggaagctgttccgcttcagaaggaactgccgtccctccagcatcctaacgaacaaaaggagggcactcccgctccctttggagaccaaagtcatcccgaaccggaatcttggaacgccgctcaacattgtcagcaggatcgcagccagggggggtggggtcatcgtctcgatggattccctcctggacggcctagccctgacaaccttaaccagatttgcctgccaaacagacaacacgtggtttacggtccatggaacctgccccagagctcatattcccatctgacaaggcaaggagaaaccttgaattttctggagattggctactctaggtgctgtcactgccggtcccacactaacaggctggaatgtgctaaactggtgtgggaagaggcaatgtcgcgcttctgtgaagcggagtttagcgtgaaaacaaggccgcactggtgttgcacgcggcaaggcgaggcccgctttagctgcttccaggaggaggcaccccagcctcactatcaactccgagcgtgcccctctcatcaaccagatatctccagtgggctagagttacccttccctccaggcgttcccacactggataacatcaaaaatatctgtcacctacggcggtttagatccgtgccacgaaacctgccggcgaccgacccgcttcagcgggaattgctggcacttattcaactggagagagagttccagcgatgttgtagacaaggcaataaccacacctgtacgtggaaggcctgggaagacaccttggacaagtactgtgaccgagaatacgccgtaaaaactcatcatcacctctgttgccggcacccacccagccccacccgcgatgagtgcttcgcccggagggccccctaccctaactacgatcgggatatcttaacaattgatattgggcgagtgaccccaaatctcatgggccatttgtgcggtaaccaacgggtactgactaaacacaagcacatccccggactgatacacaacatgaccgcccgctgttgtgacctgccttttccggaacaagcttgctgtgcagaggaggagaaactgacctttataaacgacctttgcggtcctaggaggaacatatggcgagatccggctctctgttgttacctgagtcctggggatgagcaggtaaactgtttcaatatcaactatcttcgaaacgtggccctagtgagcggggacacagagaatgccaaggggcagggcgaacagggcagtacaggcgggactaatatttcatcgacaagtgagcctaaggaggagtag

SEQ ID NO: 187269 - DNA, 1704 bp, Artificial Sequence
  Description of Artificial Sequence: Synthetic coding sequence
atgggcaccaccgcccgggccgccctggtgctgacctacctggccgtcgctagcgccgcatctgaaggcggttttactgcaacagggcagcgccagttgcggcctgaacacttccaggaagtgggctatgctgctcccccgagcccacccttgtccaggagtttgccaatggaccatccggactcatctcagcatggcccccccttcgaggggcaatcagggaaggaggggcgcggtcccagaccacattctcaaccatggctgggagaaagagtcgggtgcagtcacatcccaccatccattgtgcagcctccaccctcacaggaagcaacaccactgcagcaagagaagctgctgcctgctcagctccctgccgagaaagaggtcggccccccactgccccaggaagctgttccattgcaaaaggaactccctagcctccagcacccgaacgaacagaaggagggaacccctgcgccttttggcgaccagtcccacccggagcccgagagttggaatgcagcccagcattgccagcaagaccgatcccagggggggtgggggcataggctggatggctttccaccaggccgaccttcacccgataacttgaatcagatctgcctgcctaataggcagcatgttgtgtacgggccatggaaccttccgcagtcaagttatagtcatcttacacgccagggggagaccctgaacttcttggagatcgggtattcccgctgctgtcattgcaggtcgcacactaatcgccttgaatgcgctaagctggtgtgggaagaggccatgtccagattttgtgaagcagagtttagcgtgaaaacaagaccccattggtgctgtacccgacaaggggaggctagatttagttgttttcaggaggaagccccacagccccattatcagttgcgggcgtgcccctcacaccagccagacatcagttccggcttggaactcccgtttcctcctggggtgcccacccttgataacatcaaaaacatctgccacttaagacggtttagaagcgtgccgaggaacctgcctgctactgacccactccagagggagttgctggctctgatacagttagagcgggagttccagcgctgctgtcgtcagggaaataaccatacatgtacctggaaggcgtgggaggatacacttgacaaatactgcgatcgcgagtacgccgtgaagacacatcaccatctatgctgtaggcaccctcctagccccaccagggacgaatgtttcgctagaagggcaccctatccgaactacgaccgggacattctgaccatcgacatcggccgggtcacccccaacctgatgggacatctatgtggaaaccaacgggtgctcactaagcataagcacatcccgggcctgatacataatatgacagcccgatgttgcgacctgcctttcccagagcaagcatgttgcgctgaggaggagaagctaacttttatcaatgatctctgcggccctagacgaaacatctggcgggacccagcgctgtgttgctacctctctcccggggatgagcaggtcaattgttttaacattaactatcttagaaatgtcgcattagtgagcggcgacaccgaaaacgcgaagggacaaggcgagcaggggagcaccggtggcacaaacatctcaagtacatcggagcccaaagaggagtag

SEQ ID NO: 187270 - DNA, 2100 bp, Artificial Sequence
  Description of Artificial Sequence: Synthetic coding sequence
atgaagatcgccgtgctgttctgcttcttcctgctgatcatcttccagactgacttcggaaagaatgaagagatacctcgcaaacaacggagaaaaatctaccacaggcggctcaggaaatccagcaccagtcataagcaccgatcgaaccgacagctgggtatccagcagaccacggtttttacccccgtcgcacggttgccaatcgtgaacttcgattattccatggaagaaaagttcgaatcctttagctctttccccggcgtcgaaagctcgtacaatgttctgcctgggaaaaagggccattgtctcgtcaagggcataaccatgtacaacaaggcagtctggagcccagaaccctgcaccacttgtctgtgttccgatggacgcgttttatgcgacgagactatgtgccatcctcaacgatgccctcagaccgtgataccagaaggagaatgctgccccgtctgcagcgccacagtctcttactccctcttatctggtatcgccttaaacgacagaaatgaattctcaggagactcgagcgagcaaagagaacccacaaacctgctacacaagcagttacctccacctcaggtgggtatggaccgaatcgtgcggaaagaggcacttcaaagtgaagaggacgaagaagtgaaggaggaggacacggagcagaagagggagacgcctgaatctaggaatcaagggcagctgtactcagaaggggactcccgcggtggtgacaggaagcagcggcccggagaagaaaggcggctggcccaccagcagcagagacagggaagggaggaggaggaggacgaagaggaggaaggggaggagggggaggaagatgaagaagatgaggaggacccagttcgcggagatatgtttaggatgccctcccggagtcctctgcctgcgccaccaagagggaccttgagactaccatccggctgtagcctatcttaccgaaccatcagctgcattaacgcaatgttaactcaaatccctccactaaccgcaccccaaatcactagtctggagttgacaggtaatagtatcgctagcatccctgatgaggcatttaacggcctgccaaatctggagcggctcgacctgtcaaagaataacataacctcgtctggcatcggtcctaaggctttcaagctgctgaaaaaactgatgcgcctgaatatggatggcaataatctgattcagatcccttcccagctgccttctaccttagaagaactgaaggtaaatgaaaacaatcttcaggccattgacgaggaatccttgtcggacctaaaccagctggttacccttgagttggaaggcaacaatctctctgaggccaatgtcaaccctctggcgttcaagccactgaagagcctggcatacctcagattgggcaagaataaattccggataatccctcagggcttacccggcagtatcgaagagctttacctggagaacaaccagatcgaggagattactgagatctgttttaatcacacccgaaagatcaacgtcattgtgctgcgctacaacaagatagaagagaatcggattgcgcccctggcatggattaatcaggagaacctcgaaagcatcgacctctcctacaataaactgtatcacgtgcctagctacctgccgaagtctctactgcacctggtcctgctggggaatcaaatcgagcgcatcccaggttacgtctttggacatatggagcctggcttagaatatttgtacctttccttcaacaagctcgcagatgacggcatggaccgagtgagcttttatggggcctaccatagccttagagaattattcttagatcacaatgacctcaaaagtatcccaccgggcatccaggaaatgaaagctttgcactttctccgcttgaataataacaagattcgtaatatcctgcctgaagagatatgtaatgccgaggaggatgatgattccaatctggagcatctgcatttagaaaacaattacatcaaaatccgcgagataccaagttacactttttcctgtattagatcttactctagcatagtgctgaaaccgcagaatatcaagtag

SEQ ID NO: 187271 - DNA, 495 bp, Artificial Sequence
  Description of Artificial Sequence: Synthetic coding sequence
atgaagatcgccgtgctgttctgcttcttcctgctgatcatcttccagacagatttcggtaaaaacgaagagattcctcgcaagcagaggaggaagatctatcatcgtagattacgcaagtcaagcacctcgcacaaacatcgatcaaatcggcagctgggaatccagcaaaccaccgtctttacccctgtcgcacgccttccgatcgtgaactttgactactccatggaagagaagtttgaaagcttttcttctttcccgggagttgaatcatcctacaatgtcttgccggggaaaaagggccattgtctagtcaagggtattaccatgtacaacaaggccgtgtggtcccctgaaccgtgtacaacatgtctttgcagcgacggaagagtgctatgtgacgagactatgtgccacccgcagagatgcccacagaccgtaatacccgaaggcgagtgttgtcccgtctgttcagcaactgggacagagatttag

SEQ ID NO: 187272 - DNA, 483 bp, Artificial Sequence
  Description of Artificial Sequence: Synthetic coding sequence
atgaagatcgccgtgctgttctgcttcttcctgctgatcatcttccagacagactttggaaagaacgaagaaatacccaggaaacagcggcgcaagatctaccaccgccggctgcgcaagagtagtaccagccacaagcaccggtccaacaggcagttgggaattcagcagaccaccgtgtttacaccagtggctaggctgccaatcgtgaactttgattattccatggaggagaaatttgaatcattttccagctttccaggcgttgagtcatcctacaacgtgctccctgggaagaaaggtcactgtttagtgaaaggcataacaatgtataacaaagctgtctggtcaccggagccatgcacaacttgtctttgtagtgacggcagagtgctttgtgacgagaccatgtgccaccctcaacgatgtccgcaaacggtcatccctgagggagagtgctgtccagtctgcagcgcaacctag

SEQ ID NO: 187273 - DNA, 1932 bp, Artificial Sequence
  Description of Artificial Sequence: Synthetic coding sequence
atgaagatcgccgtgctgttctgcttcttcctgctgatcatcttccagaccgattttgggaagaatgaagagataccccggaagcaacggcggaagatctaccatcgaaggctgcggaagtccagcacttcccacaaacaccggtccaacaggcagttgggtatccaacaaactaccgttttcacacccgtagctagactgcctatcgttaatttcgactactctatggaagaaaaattcgagagcttttcttccttcccgggcgtcgagagttcgtataatgttcttccgggcaaaaaagggcattgtctagtgaaaggaattaccatgtacaacaaggctgtgtggtcacctgaaccatgcacaacttgcctgtgcagcgacggccgggtcctgtgtgatgagacaatgtgccacccccaaagatgccctcagacagtcattccagagggcgaatgctgcccggtttgtagcgctaccgagcagagggaacctacaaacctgcttcacaaacagcttccccctccacaggtgggtatggatcgcatcgttagaaaggaggccctgcagtcggaggaggatgaagaagtgaaagaggaagataccgaacagaaacgtgaaacaccagaatcacgtaatcagggtcaactgtattccgagggcgactctagagggggcgataggaaacagaggccaggagaagagagacggctggcacaccagcagcagcggcagggacgcgaggaagaggaagacgaggaggaagaaggcgaggagggcgaagaagatgaagaggacgaagaggacccagttcgtggggatatgttccgcatgccatccagatctcctcttcctgctcccccacgcgggacactgcgactgcctagtggttgctctctcagctatagaacaatctcatgcattaacgccatgcttacccaaatcccccctctgacagcgccacagatcacctcccttgagctgactggtaactccattgcctccattcccgatgaggcattcaacgggcttcccaatctggaacgattagacctgtccaaaaataatatcacctccagtggcattggacccaaggcttttaagctcctaaaaaagcttatgcgacttaacatggatggtaacaatctcattcagataccctcacagctcccttcaaccttggaggagctgaaggtgaacgagaataatctgcaggcaatcgacgaagaaagcctgtctgacctcaatcagctggtaaccctggagcttgaaggaaacaacttgagcgaggctaatgtgaaccccctggcctttaaaccactgaaaagcctggcctacctcaggctgggtaaaaataagttcagaatcatcccacaggggctacccggctcaatagaggagctgtacttagaaaataatcagatagaggaaatcacagaaatttgtttcaaccacacgagaaagattaacgtgatcgtcctgcgttacaataaaattgaggaaaacaggatcgccccactggcctggatcaaccaggagaatcttgaatccattgatttgtcatataacaaactctatcatgtcccaagttacttaccaaaatccctgctgcatttggtgttactcgggaaccagatagagaggattccgggctatgtgtttggccatatggagcctggcctagaatatctctatctttcattcaacaagcttgcagacgacgggatggaccgcgtgagtttctacggagcctatcacagtctgcgcgaacttttcctggaccacaacgacctgaagtcgattccacccggaatccaagagatgaaagccctgcatttccttaggctcaacaacaataaaataaggtgcgtttcagacgccgtgctcgagactgtcaccaataggtcagacgtcgcgtttcccctctggtag

SEQ ID NO: 187274 - DNA, 1779 bp, Artificial Sequence
  Description of Artificial Sequence: Synthetic coding sequence
atggagatgcaggacctgaccagcccccacagccggctgagcggctcatccgaaagccccagcggtcctaagttaggcaatagccacatcaattccaattctatgaccccgaacggaacggaggtgaagaccgaacccatgtcatccagtgagaccgcctcaactaccgcagacgggagtcttaacaatttctccggcagtgctattggctctagtagcttctcaccgaggcctacccatcagttcagccccccccagatctacccaagcaatagaccgtacccccacatcctgcctacaccttcatctcagactatggccgcatatggtcagacccagttcaccacagggatgcagcaggcgacggcgtacgctacgtatccacagccagggcagccttatggcatctcttcatacggggcactctgggccggcatcaaaactgaaggtggtctgagccagtcccagtctccaggccagacaggattcctcagttacggcaccagctttagtaccccgcagcccgggcaggccccctactcataccagatgcagggatcttcctttactacctcctccggcatctacacaggcaacaactccttaaccaacagtagcgggttcaacagcagccagcaagactatccaagctacccttcctttggccaaggacagtatgcccagtactacaacagtagtccgtaccccgctcattacatgacgagttccaacaccagtcctaccactccaagtaccaatgcgacgtatcagttacaggagccaccttctgggattacctctcaagccgtgaccgatcccacagccgaatactccaccatacattcaccctcaacaccaattaaggactctgattctgatagattacggcgcggctccgatggtaagtcacgcgggagaggccggagaaataacaatccatcaccgccccccgactccgaccttgaacgcgtctttatctgggatctagacgagaccatcatcgtgttccattctctcctaactggaagctacgcgaatagatacggcagagatccccctacatcagtctctctggggctcagaatggaggagatgatcttcaatctcgccgatactcatttgttttttaatgacttggaagaatgtgatcaggttcacattgacgacgtctcaagcgatgacaacggccaggacctgagtacatataattttggcacagacggttttccagctgccgccacatcggctaatctgtgcctggccacgggagttcgtggaggggtggattggatgaggaagctcgcttttcgatacaggcgcgttaaggagatttataatacatacaagaacaacgtgggcgggctgctgggcccagctaaaagggaggcttggcttcagttgagggctgaaattgaggcactgaccgactcttggctgacactggccctgaaggccctgtccctgattcattcgcgcactaattgcgtgaacattctggtcacaacaactcagttgatacctgccttggccaaggttttactgtatgggctcggcatcgtgttcccaattgagaatatatatagtgccacaaaaatcgggaaggagtcctgcttcgagcgaatcattcaaaggttcggacgcaaagtggtgtacgtggtgatcggagacggtgttgaagaggaacagggcgccaagaaacacgcaatgcccttttggagaatctccagccattccgacttgatggctctgcaccatgcattggagttagagtatctgtag

SEQ ID NO: 187275 - DNA, 1680 bp, Artificial Sequence
  Description of Artificial Sequence: Synthetic coding sequence
atgctgctgttcccccaggtggccgtgaagaccgagcccatgagcagtagtgaaacagccagcaccaccgcagacggaagtctgaataacttctccgggtcagccatcggcagttcctccttttcgcctagaccaactcatcagttcagccctcctcagatttaccctagcaacagaccgtacccgcatattcttccaacaccaagcagtcagactatggctgcttatggacagactcagttcacaactggaatgcagcaggccaccgcttacgcaacctatccccagcctggtcaaccctacgggataagttcttatggggctttgtgggccgggatcaagacagaaggggggttgtcgcaatcccagtcgccaggtcagactggattcctcagctatgggacgagctttagtacaccgcagcctgggcaggccccatactcgtatcaaatgcagggcagctcttttactacctccagtggcatttataccgggaacaatagcctgacgaacagctctggtttcaattcctcacagcaggattacccatcttacccaagtttcggacaaggtcagtatgcgcagtattacaattctagcccgtatccagcccactatatgacctccagcaacacctcacctacaaccccctcaaccaacgctacatatcagctgcaggagccaccatctggtatcacatctcaggcagtgactgaccccactgcagagtactctaccattcacagcccttccacgccaattaaggatagtgattccgacaggcttcgacggggatcagacgggaaaagcagagggaggggcaggaggaacaacaaccccagtcctcctcctgattccgatctggaacgggtgtttatttgggatctggacgagaccatcatcgtgttccactccctcttaactggaagttacgcgaatcgatacggcagggatccccctaccagcgtcagtctgggactcaggatggaagagatgatattcaatttggctgatactcacctgttcttcaacgatttggaagaatgtgatcaggtgcacatcgatgatgtaagttctgatgacaatggacaggatctttctacatataactttggaacagacggatttcctgcagccgcaacctcagcaaacctctgtctcgcaacgggtgtccggggtggggtcgactggatgagaaaactcgcttttcgttaccgacgagttaaggagatttacaacacatacaagaacaacgtggggggcctcctgggccccgctaagcgtgaagcgtggctgcagttgcgtgctgagattgaggctctcaccgactcatggctaacgttggctcttaaggctctgagcctgatccatagccgcaccaactgtgtcaacattctggtcacaaccacgcagcttattcccgccttagcgaaagtacttctctacggccttggcattgtcttccccatcgagaacatctacagcgctaccaagatcggtaaagaatcatgtttcgagcgcattatacagcggtttgggaggaaagtcgtttatgtcgttattggcgatggggtggaagaagagcagggagcgaagaagcacgcaatgcccttctggagaatcagcagccacagcgatctgatggcactgcaccatgccctggaactggaatacctgtag

SEQ ID NO: 187276 - DNA, 1779 bp, Artificial Sequence
  Description of Artificial Sequence: Synthetic coding sequence
atggagatgcaggacctgaccagcccccacagccggctgagcggctcttcggaatcccccagtggacctaagttgggcaactctcacataaattctaactcgatgacccctaacggcacagaggtaaagacagagcccatgtctagttctgaaaccgcatcgaccaccgccgatggatcactgaataatttttcggggagtgcgatcggatcatcatctttcagccctaggcctactcatcagttttctcctccccagatttatccctctaaccgaccttacccacatatccttccgacacccagttctcagaccatggctgcttatggccagactcagttcactaccggaatgcagcaggcgaccgcctatgctacctacccacaaccaggacagccatatggcatttcatcatatggcgccctgtgggcaggaatcaaaaccgagggcggactcagccaatcccagtcgcctgggcagactggtttcctgagctacgggactagcttttccacgccccagcccgggcaggccccctatagctaccagatgcaaggcagcagcttcactacgagcagcggaatttacaccggcaacaattccctcaccaacagctccggtttcaattcttcccagcaggattacccctcttacccgtccttcggccaggggcagtacgcgcagtattataactccagcccctaccctgcccactacatgacatcttccaatacatctccaacgacacctagtaccaatgcgacttaccagttacaggaacctccctccggtataaccagccaagccgtgactgacccaactgccgagtactcgacaatccacagcccaagtaccccaatcaaggactcagatagtgacaggctgcgtagaggaagtgatgggaagagccgtggaagggggcgccggaataacaacccctcaccacctccagatagcgaccttgagcgggtgtttatctgggacctagatgaaactatcattgtgtttcactccttactcaccgggagttatgccaaccggtacgggagggatcctccaacgagtgtgtcactcggtctgagaatggaggagatgatttttaacctggccgatacacacctgttttttaatgacttggaggaatgtgaccaggtacacatcgacgatgtgagtagcgatgataatggtcaggatttatctacatacaatttcggaacggacggctttcccgccgctgccacatcagccaacttgtgtcttgctaccggggtgcgcgggggagttgattggatgaggaaacttgcatttcggtaccgcagagtgaaagaaatatacaatacttacaagaacaatgtcggaggcctcctggggcctgcaaagagagaggcatggctgcaactgcgagcagagattgaagctttaactgacagctggcttactctcgcacttaaggcattgtccttgatccattctaggacgaattgtgttaacattctggtgaccacaacacagctgatccccgcccttgcaaaggttctgctctatggactggggatcgtgttccctattgaaaacatctactcggccacaaaaatcggcaaggagtcgtgctttgagagaatcattcagcggtttggacgcaaggtggtttacgtggtgattggcgacggagtggaagaggaacagggagcaaaaaaacacgcaatgcccttttggcgtattagctcgcattctgacctgatggcactgcatcatgcactcgagctagaatacctttag

SEQ ID NO: 187277 - DNA, 1683 bp, Artificial Sequence
  Description of Artificial Sequence: Synthetic coding sequence
atgctgatgatctacgtgcagctggtggtgaagaccgagcccatgagctcatctgagaccgcatccacaaccgcagatggttcacttaacaacttcagcggatctgctataggaagctctagtttttcccccaggccaacccatcagttttctcctccccagatctacccgtctaaccgaccttacccgcatattcttcctaccccaagcagtcagaccatggctgcctacggccagacacagtttactacagggatgcagcaggctacagcctacgcaacttatccacagccaggccagccgtacggcatcagttcctatggcgcactgtgggcgggaatcaagaccgaaggtggtctgagccagagtcagagcccggggcaaacaggcttcctgagttatggcacttctttcagcacacctcagcctggccaagccccatactcataccagatgcaaggctctagttttacaacgtctagcggcatttatacaggaaataattcgctgactaatagtagtggctttaatagtagccagcaagactatccatcctacccttcttttgggcagggccagtacgcacagtattataacagtagcccttatccagctcactacatgactagctctaacacctcccccacaacgcccagcaccaatgctacctaccaactccaggagcctcccagtgggatcactagccaggccgtcacagaccccaccgctgaatactccacgatccacagtccttcaactcctatcaaggactcggacagcgaccgccttaggcggggatcagatggaaagtctaggggaagagggcgcaggaataacaatccctccccgcctccagactcagaccttgagagggtgtttatttgggacctcgatgaaactataatcgtgtttcatagtctgctgacaggatcctatgcaaatagatacggtcgggatccacccacatccgtttccctcggactgagaatggaagagatgatcttcaatttggccgatacccacctgttttttaacgacttggaggaatgtgatcaggtgcacatagacgacgtgagcagcgatgataacggccaggacctgtcaacctacaacttcgggaccgatggattcccggctgctgcaacttccgctaacctttgcttggctaccggagtcagggggggggtggactggatgagaaagttggccttcagataccgccgggtgaaggagatctacaatacatacaagaacaatgtggggggtctgctgggtcccgctaaaagagaagcctggcttcaattaagggccgagatcgaagcactcacagattcctggctgacattggccctgaaagccctctcactgatacattcccgcacaaattgtgtgaatatcctcgtcaccacaacgcagctaattcccgccctggctaaggtgctgctctatggactgggcatcgtgtttcctattgagaatatttatagtgccaccaaaataggcaaagagtcgtgttttgagaggattatacagcgcttcggcagaaaagttgtctacgtagtcatcggggatggggtagaggaggagcagggagccaagaaacacgccatgccattctggcggatctccagtcacagtgatctaatggctctgcaccatgccctcgagttagagtacctgtag

SEQ ID NO: 187278 - DNA, 1674 bp, Artificial Sequence
  Description of Artificial Sequence: Synthetic coding sequence
atggagatgcaggacctgaccagcccccacagccggctgagcggcagcagtgagtcaccaagtggtcctaagctcggcaacagccacatcaactccaattcaatgactcctaatggcaccgaggttaaaactgaacccatgagtagctctgaaacagccagtacgaccgccgacggcagcttgaacaactttagtgggtcagctattggatcatctagtttttcccctaggcccacacaccaatttagtccccctcagatatacccatctaacagaccttatccgcatatccttcctaccccgtcgtcacagaccatggcagcttacggccagacacagtttaccaccggaatgcagcaggctaccgcttatgcaacctatcctcagcccggccagccatatgggattagcagctatggcatcaagactgaaggtgggctgtcacagagccagtcccccggccaaactggcttccttagttatggaacatcgttctccacaccccagcctggacaggccccgtatagttatcaaatgcagggctcgagtttcaccacttcctctggcatttatacaggtaataacagtctgaccaactcatccggtttcaattccagccagcaggactaccctagctaccccagcttcggccagggacagtatgctcagtactacaatagctctccataccctgcacattacatgaccagttccaacacatctcctactacaccatctaccaacgctacatatcagctgcaagagcctccctctggcattacctcacaggcagtgacagatcccacggctgagtacagcaccatccatagtccatcaacgcctataaaggattcagattcagacaggctaaggagagggtccgacggcaagtcaagggggaggggaaggagaaataataacccttcccccccccccgactccgatttagaaagagtgtttatctgggatttagacgagactatcatcgttttccacagcctcctcacaggaagctacgccaaccgatatggacgggagtgtgatcaggtgcacattgacgacgtgagctcagacgacaacgggcaggatttgagcacatacaattttggaacagatggcttcccagccgctgccacttctgctaacttatgtctggcaaccggggtgcgcggtggagtggactggatgagaaagctagcttttcggtataggagggttaaggagatttacaatacctataagaacaacgtgggcggtcttctggggccggcaaaacgtgaagcgtggctacagctccgtgctgaaatcgaggcacttaccgattcttggttgaccctggcactaaaggcccttagcctcatccacagtcgtacaaattgtgtcaatatactcgtgacaactacacagctgatccccgctctggccaaggtgctgttatatggccttggcattgtttttccaattgaaaacatctattccgcgactaagattgggaaggagtcctgcttcgaaaggatcattcagcggttcggccgcaaagttgtttacgtcgtcattggcgatggagtcgaggaggagcaaggggcaaaaaaacatgccatgcccttctggaggatctcaagccactctgatctgatggccctccaccacgcactagagttggagtacctgtag

SEQ ID NO: 187279 - DNA, 1527 bp, Artificial Sequence
  Description of Artificial Sequence: Synthetic coding sequence
atggtggagctggtgatcagccccagcctgaccgtgaacagcgactgtttggacaagcttaaatttaaccgagcagatgccgctgtttggactcttagcgataggcaaggaattactaaatctgcccccttgcgagtgagccaactgttttcacgtagttgcccaagggtgctcccacgccaacccagcactgctatggcagcatacggccagacgcagtacagcgccggcatccagcaggccactccatacacagcgtatcctccccccgcccaagcatatggaatcccttcttatagtataaagaccgaagatagcctgaaccactccccaggacaaagcggatttctctcatacggatcttccttttctactagtccaacggggcagtctccgtacacgtatcagatgcatgggacgaccggcttctatcaaggtggcaacggattaggcaacgccgctggcttcggatcagtccaccaggattatccttcttatccgggcttccctcaatcgcagtatcctcaatactatggatctagttacaatcctccctatgtgcccgctagctccatatgtcccagtcctttgagcactagtacttacgtgcttcaggaggcctcacacaacgtacccaatcaatctagtgaaagcctggcgggcgaatataacactcataatggccctagcaccccggcaaaggaaggggacacagaccgtcctcatcgggcctccgatggcaagcttaggggtagaagcaaaagatcgagcgacccctctcccgccggggacaacgagatcgagcgcgtgttcgtgtgggatctggacgagacaattataatcttccatagtcttcttacaggaacgttcgcctcccggtatggaaaagactgcgaccaaatacacgtggatgacgtctcgagtgacgacaatggtcaagacctgagtacttataatttttctgccgacggattccacagctcagcccccggcgctaacctgtgcctcggcagcggggtgcatggaggggtggattggatgagaaagcttgcattcagatatagacgtgttaaagagatgtataacacttacaaaaataacgtgggcggcctcatcggcacacccaagagggaaacatggctgcagctgagagccgagctagaagcccttactgacctatggttgactcacagtttaaaggcgttgaacctgatcaatagtcgcccaaactgtgtgaacgtgttggtaaccacaacgcagctgatccccgcattagccaaggtcctgctgtatggactgggctccgtgttccccatcgaaaatatctactcggcaactaaaacaggcaaggaaagctgcttcgagcgcatcatgcagcgctttggccgtaaagccgtttacgtggtgattggagacggtgtagaggaggaacagggtgccaagaagcataatatgcctttttggcggatttcatgccatgcagatctggaagccctgaggcatgcattggagctggaatacctgtag

SEQ ID NO: 187280 - DNA, 1617 bp, Artificial Sequence
  Description of Artificial Sequence: Synthetic coding sequence
atggtggagctggtgatcagccccagcctgaccgtgaacagcgactgtctcgataagctgaaattcaacagggctgatgccgccgtatggactctcagtgatcgacaggggatcactaagtctgcgcccctgcgggtgtctcagttgttcagtagatcatgtccaagagtcctgccacggcagccatcaactgctatggccgcatacggccagacacaatatagcgcggggatccaacaagccaccccgtacacggcctacccaccaccagcccaggcctatgggatcccctcctacagcatcaaaaccgaggattcactcaaccacagcccaggccagtctggcttcctgagctatggatcttccttcagcacatcgcccaccgggcagtccccttatacctaccaaatgcacggaaccactggcttctatcaggggggcaacgggctaggcaatgccgctggcttcgggagtgtacaccaggattaccctagttacccggggttccctcagtcacagtatccccagtattatgggtcaagttacaaccctccatacgtccctgcctcctcgatctgtccaagtcctctgagcacctccacctacgtgctccaggaggcatcacacaacgtcccaaaccaaagttctgagtccctggctggagagtataatacacacaacggaccatccacgcccgcaaaagagggagataccgataggccccaccgcgctagtgatgggaagctgagaggcaggagcaaaagaagctctgatccctccccagcaggagacaatgagatcgaaagagttttcgtgtgggacctggatgagactatcattatattccatagcctgctgaccggaactttcgcctcccgttacggcaaagatacaaccactagcgtgagaatcggcctgatgatggaagagatgatcttcaatttggcagacacccacctgttctttaatgatcttgaagattgcgatcagatccacgtcgatgacgtaagttcagatgacaacggacaggacctgtctacatacaacttcagcgctgatggattccactctagtgcacctggagccaacctgtgccttggctcaggcgtgcacgggggtgtggattggatgcgcaagctggctttccggtatagacgcgtgaaagaaatgtacaacacttataaaaacaacgtgggaggcctgatcgggaccccaaaaagagaaacatggctacagctccgagcggaattagaggcattgaccgatctgtggctgacacactccttaaaggccctcaaccttatcaattctcggcctaattgcgttaacgtcctcgtgacgaccacgcaactgatccccgcattggctaaagtgctgttatatggcctcggaagcgtgtttccgatcgagaatatatattccgccacgaaaacgggaaaggagtcatgcttcgagcgaattatgcagcggtttggacggaaagctgtttacgttgttatcggcgacggcgtggaggaggagcaaggcgcaaaaaagcataatatgccattctggaggatctcatgccacgctgatctggaggcgctgagacatgccctcgaactggagtatctttag

SEQ ID NO: 187281 - DNA, 1380 bp, Artificial Sequence
  Description of Artificial Sequence: Synthetic coding sequence
atggtggagctggtgatcagccccagcctgaccgtgaacagcgactgtctcgataaattaaagttcaacagggcagacgctgccgtgtggacactgtctgacaggcaagggattaccaagtccgcccctctgagagtctctcagttgttcagtcgaagttgtccacgcgtacttccacggcaaccatcaactgctatggctgcctatggtcagacgcagtattccgccgggatccagcaggctacgccttatactgcataccctcccccagcgcaggcttatggcatcccatcatacagcatcaaaaccgaggactccctgaatcatagtccgggccagtccgggttcctgtcctacgggagttctttctcaaccagcccgaccggacagtcaccctatacctaccagatgcacgggacaactggcttctatcaggggggaaatgggctggggaatgcagccgggttcggctccgttcatcaggactatccgtcttatccgggcttcccgcagtcacaatacccacaatattacggtagctcttacaatcccccatacgtgccagcaagctccatttgtcccagcccgctcagtacgagtacctacgtgttgcaagaggccagccacaatgttccaaatcagtcgtcagagtctctcgcgggagagtataacacacacaatggacccagcactcctgccaaagagggcgataccgacaggccacatagggctagtgatgggaagctgagggggcgaagcaagcgttcctctgacccctcaccggctggtgataacgaaatcgagcgcgtgttcgtttgggatctagatgaaacaatcataatctttcactccctgttaacggggacattcgcttctaggtacggaaaagataccactactagcgtgaggatcggattaatgatggaagagatgatctttaatctggcagatacccacctgttctttaacgacctggaagactgtgaccagattcacgtggacgatgtatcttccgatgacaatgggcaggacctttcaacgtacaacttttcagctgacggttttcacagctctgccccaggggccaacctgtgtctcgggtccggagtacatggcggcgtggattggatgcgtaagctcgcttttcggtacagacgtgtcaaagagatgtacaatacctacaagaacaacgttggaggcaaagagtcctgtttcgagcgtattatgcagcgctttggacgcaaagccgtctacgtcgttataggggatggggtggaagaagaacagggcgccaagaaacacaacatgcccttttggagaatttcatgtcatgcagaccttgaggctctgcgccatgccctcgaactggagtacttatag

SEQ ID NO: 187282 - DNA, 1527 bp, Artificial Sequence
  Description of Artificial Sequence: Synthetic coding sequence
atggtggagctggtgatcagccccagcctgaccgtgaacagcgactgcttagataaacttaaattcaacagggctgacgcagccgtatggacactttccgatcgacaaggaatcacaaaaagtgcccctctgcgtgtgtcacaactatttagccgcagttgtccccgggtcctccctaggcagccctccaccgccatggcagcttacgggcagacacagtattccgctggcatccagcaggccactccctatactgcttatccaccccctgcacaggcctatggaatcccttcctacagtataaagacagaggattcgctcaatcacagccctgggcaaagcggattcttgtcctacggtagcagtttttcaacttcaccaactgggcaatccccttacacttaccagatgcacggaaccacagggttctatcagggggggaatgggctcgggaacgctgctgggtttggctccgtgcaccaggactatccttcctatcccggattcccgcagtcccagtacccgcagtactatggtagttcttataacccgccttatgttccggcatccagcatatgtccaagccctttgtccacctcaacgtacgtcctgcaggaagccagccacaacgtcccaaatcagtccagcgaatctctggccggcgagtacaacacccacaacggtccctcaaccccagctaaggagggagataccgataggcctcaccgcgcttcagacggcaaactgcgaggacggagcaagagaagcagcgaccctagccccgccggagataacgagattgagcgcgtctttgtttgggaccttgatgaaactattatcatctttcatagtctgctgacaggaacttttgcatcacgatatggcaaagactgcgaccaaattcacgtggatgatgtgtcctcggacgacaatggccaggatctctcaacctataacttttctgccgacggatttcattcatccgcacccggcgcaaatctctgcctgggctcaggcgtgcacggtggtgtcgattggatgcgtaagctcgcctttcgctaccgccgggttaaagaaatgtacaacacgtataagaacaacgttggaggcttgattggtacaccaaagcgggaaacatggcttcaactgcgcgcggaactagaggctctgacagacctatggttaacccattccttgaaagctcttaatctgattaacagccgacaaaactgcgttaatgtcctggtgactacaacgcagttgattcccgccttagcgaaggtactactctatggccttgggtccgtgttcccaatagaaaatatctactctgctactaagaccgggaaagagtcatgctttgaacgaattatgcagagatttgggagaaaggctgtttatgttgttataggagacggcgtcgaggaggagcagggagccaaaaagcacaatatgcccttttggcgcatttcctgtcatgctgatcttgaagccctaagacatgctctggagttagaatacctctag

SEQ ID NO: 187283 - DNA, 1611 bp, Artificial Sequence
  Description of Artificial Sequence: Synthetic coding sequence
atggaggaggagcaggacctgcccgagcagcccgtgaagaaggccaagatgcaggagagtggagagcagaccatcagtcaggtgtctaacccagatgtgtcagatcagaaacccgaaacatcgtctctggcgtctaacttgccgatgagcgaagagattatgacctgcacagactacattccccggagctcaaatgattatacaagccagatgtacagcgccaagccgtatgctcatattttgtctgtgccagtttctgagacagcctatccaggacaaacacagtaccagacactgcagcagacgcaaccctatgcggtatatccgcaagctacccaaacctacggtctgccccctttcgccagctccaccaacgctagcctcatttctacgtcgagcaccatcgcgaatatccccgccgccgctgtagccagcattagcaaccaggactatcctacttatactatcctgggacagaaccaatatcaggcctgctatccatcgtccagcttcggcgtgactggacagaccaatagcgacgccgaatccaccactctcgccgccacaacatatcagtccgagaaaccaagtgtaatggccccagcgccagcggctcagagactgagctcaggggacccctctacaagcccctcactgtcccagacaaccccaagtaaggatacagacgaccagagcaggaagaacatgacgagtaagaatagaggaaaaaggaaggctgacgctacctctagccaggatagcgagttggagagagttttcctgtgggatctagacgaaaccatcattatttttcactcactgttgacgggttcttatgcacaaaagtacgggaaagaccccaccgtggtcatcggcagcggtttgaccatggaagagatgatcttcgaagtggccgacacccacctcttttttaacgaccttgaagaatgcgatcaggtgcatgtcgaggatgtggcgtcggatgacaacggtcaagacctgagcaactactcgtttagtacggacggtttctctggatccggtggatccgggtcacacggaagcagcgtgggggtccaggggggcgtggactggatgaggaagctcgcttttcgctatcggaaagttcgggagatctacgataagcataaatctaacgtgggtgggctgctttcaccacaacgcaaggaggcactgcagcggctgcgggccgaaatagaggtcctgacggattcgtggttggggactgccctgaagagcttgctcctgatacagagtaggaaaaactgtgtcaacgtacttatcactacgacacagctggtgccagcactcgccaaggttctgttgtatggccttggcgaaatctttcctatcgaaaatatatactccgcaactaagataggaaaagaatcctgctttgagagaatcgtgtcccgatttggcaagaaggttacctacgtcgttatcggagatgggcgtgatgaggaaatagctgcgaaacaacaactctactttttagacatggaggcattgggctgtcagcttgaacccacagcactgatcctcttcatccagctctccgggaaccttagcaattacaataagctttag

SEQ ID NO: 187284 - DNA, 1251 bp, Artificial Sequence
  Description of Artificial Sequence: Synthetic coding sequence
atgatcatcccccacaagtgcatcctgcagaccagcagcaccaacgcttctttaatcagcaccagttccacaatcgccaacatcccagctgctgcagtggcctcaatttcaaatcaggattatccgacatacacaatcctgggccagaaccaataccaagcgtgttaccctagttcttcattcggggttaccggccagacgaacagcgatgcagaaagtaccaccttggcggccactacgtatcagtcggagaaaccaagtgttatggctcctgcccctgcggcccagcgcctgtcctcagacccgtccactagccccagtttgtcacaaactactcccagcaaggacacagatgatcagagtaggaagaacatgacctctaagaacagagggaaacggaaagccgatgctacttcctcacaagatagcgagctggaacgcgtgtttctttgggacctggacgagacaatcataatctttcacagcctacttaccggaagctatgctcagaaatatggcaaagatcccaccgtggtgatcgggtctgggctgacgatggaggagatgatctttgaagtggccgatactcacctgttcttcaatgatctggaagagtgtgaccaggttcacgtcgaagatgtcgcctcagacgataatgggcaggatctgagcaattatagcttttcaactgatgggttttccgggtctggtggttctggaagccacggaagttccgtgggagtgcaaggtggggtggattggatgcgaaagctggcattcagatatcgcaaggtacgtgaaatctacgataagcacaagtccaacgtgggtggattgctttcgccacagcgcaaagaggcattgcaaaggctcagggccgaaatagaagtactgacagattcctggctcggtactgcgctaaagagtctgctgctgatccagtcacggaagaactgcgtcaacgtgctgatcacaaccacccagttggtgcctgcattagccaaagtattgctgtatggactgggggaaatctttcccatagaaaatatttactctgcaacgaagattggcaaagaatcatgtttcgagagaatagtgtctcgcttcggaaagaaagtgacctatgtggtaatcggcgacgggagggacgaggagatcgcagcaaagcagcataatatgccattctggcgcattacaaaccacggggatctggtatctctgcatcaggcactagaattagacttcctgtag

SEQ ID NO: 187285 - DNA, 1722 bp, Artificial Sequence
  Description of Artificial Sequence: Synthetic coding sequence
atggaggaggagcaggacctgcccgagcagcccgtgaagaaggccaagatgcaggagagcggagagcagaccatttctcaagtatccaacccagatgtctccgaccagaagccagagactagttctctagcctccaacctgcccatgagtgaggaaataatgacatgtaccgattatatccctaggagctctaacgattatacttcacaaatgtatagcgccaagccgtatgcccacattctgagcgtccctgtcagtgaaactgcatatcccgggcagacacaataccagacattgcagcagacccagccttacgctgtctatccgcaggccacccaaacctatggtcttccaccatttggtgccctgtggcccggcatgaagccggagtcaggactgatccagacaccctctcctagccagcactcagtgctcacttgcacgactggacttacaacttctcagccctccccagctcactactcttatcctattcaagcctcgagtactaatgcaagcctaatttcgacttcctctacgatagcgaacatccccgccgctgctgtggcttctatatctaaccaggactacccgacctacacgattctggggcagaaccaataccaggcttgctacccaagtagtagcttcggcgtcaccggtcagactaatagcgacgcagaaagcaccaccctggcagctaccacttaccagagtgaaaaaccatccgtcatggcacctgctcctgcagcccagcgcctctcttctggcgatcccagcacttccccttccctatcgcagactacgccctcgaaagacacagacgatcaaagtaggaaaaacatgacgtcgaagaataggggcaaaaggaaggccgacgccacctcaagccaggattctgagctcgagcgggtcttcctgtgggatctcgatgaaactatcatcattttccatagcctgctgactggcagttatgctcagaaatacggcaaggacccgaccgtggtcattggctcagggctgacgatggaagaaatgatctttgaagtcgccgacacccatctgtttttcaatgacttagaagagtgcgaccaggtccatgtggaagacgtggcgagcgatgataacggccaagacctaagcaattactcatttagtacagacggcttcagtggatccggggggtcaggaagtcacggctcctccgtgggcgttcaggggggagttgactggatgcgtaaactcgccttccgctataggaaggtgagggaaatttacgacaaacataagagtaacgttgggggcttgttaagcccccagagaaaggaagcactacagcgcctgcgggctgaaatcgaagtgttgaccgattcttggcttggcacagcattgaagtctcttctcctgatccaatcccgcaagaattgtgttaacgtgctcattacaaccacacaattggtgcccgctctagctaaggtgctgctttatggcctaggagagatctttcccattgagaatatctattccgccaccaagatcgggaaagagagctgtttcgagcgcattgtcagcagatttggaaagaaagtgacgtatgttgtgatcggcgacggcagagacgaggagatagctgctaagcagcacaatatgcccttctggcgcattactaaccacggggatcttgtctcactgcaccaagcactggagctggactttttatag

SEQ ID NO: 187286 - DNA, 1344 bp, Artificial Sequence
  Description of Artificial Sequence: Synthetic coding sequence
atgaagcccgagagcggcctgatccagacccccagccccagccagcacagcgtgctcacttgtaccacaggtctcaccactagccaacccagccccgcgcattattcatacccgattcaggccagcagcacgaatgccagcttgattagcacctccagtaccattgctaacatccccgcagcagccgtcgcaagtatatctaaccaagactatcctacatatactatactggggcaaaatcagtaccaagcttgttaccctagttccagcttcggagtcacagggcagaccaattctgatgcagaatcaacaaccctagccgcaaccacctatcagtcagagaaacctagtgtcatggcccccgccccagcggctcaacggttgtctagtggggatcccagcacctcaccatctttgtctcagaccaccccatctaaagatacagatgaccagagccgtaaaaacatgacatcaaagaatcgcggcaaaagaaaagccgacgctacttcctcacaggactccgaactggagagagtcttcctgtgggacttggatgaaaccattataatttttcatagtcttttgactggttcctatgcacaaaagtacggtaaggatccgactgtggtgattggctccgggctaaccatggaagaaatgatcttcgaggttgctgacacacatctcttttttaacgatttggaagagtgtgatcaggttcacgttgaagatgtggcctccgatgataacgggcaagatcttagcaattattctttcagtacagatgggttcagcggctcagggggttctgggtctcatggaagctccgtgggtgtgcagggcggcgttgactggatgcgcaaacttgcattcagatacagaaaggtgcgtgagatctacgacaagcacaaatctaatgttggtggtcttttgtctcctcaacgtaaggaggccctgcaacggctgagggccgaaatcgaggtgttgacagactcttggctgggcactgcgctgaaaagtctcctgctcatccaatctcgcaagaattgtgtgaacgtcctgattactaccacccagctcgtacccgccctggccaaggtcctgttatacggactgggcgagatcttccctattgaaaacatttactctgcgacgaagatcggcaaggagtcatgttttgagcgcattgtcagtagattcggcaagaaggtgacctacgtggtgatcggtgatgggagagacgaggagatcgccgcaaaacagcacaatatgccgttttggagaatcaccaaccacggtgacctcgtaagtctccaccaggccttagaactggattttttatag

SEQ ID NO: 187287 - DNA, 1584 bp, Artificial Sequence
  Description of Artificial Sequence: Synthetic coding sequence
atggaggaggagcaggacctgcccgagcagcccgtgaagaaggccaaaatgcaggagagtggggaacagacaatctcgcaggtgagtaaccccgatgtgtcagatcagaagccagaaacgagttcactggcttctaatctgccaatgtcagaggagattatgacctgcaccgattatattccaaggagtagtaacgactatacaagccagatgtactctgccaaaccttatgctcacattttgagtgttccagtcagcgagactgcttacccagggcagactcagtaccagaccctgcagcagacgcagccctacgccgtgtatcctcaggctacccagacgtacggcctgccccctttcgctagttcaacaaacgccagcctgatctcaaccagttcaacaatagctaacattcccgcggcagccgtggcctccatttcgaatcaagattaccccacgtacactatcttgggccagaaccagtaccaggcctgctatcccagcagtagcttcggtgtaacaggccaaaccaactccgacgccgagagtactacgctcgccgccacaacgtatcagagcgagaagccttcagtcatggcgcctgctcctgctgcgcaacgcctctcttccggcgatccctccactagtcctagcctgagccagaccactcccagtaaagacacagatgatcagtcgaggaagaacatgacctctaaaaaccggggcaagcgcaaggccgatgccacgagcagccaggattcagagctcgagcgggtgttcctgtgggacttagatgagactattatcatcttccacagtctgttaactggtagttatgcacagaaatatggaaaggatccgacagtggtgattgggagcggactcaccatggaagaaatgatctttgaagttgcagacacccacctgttttttaacgatctcgaggagtgcgatcaggtgcatgtggaggacgtggcttcagacgacaacgggcaggatttatctaattactcttttagcactgacggcttttccgggtcaggagggtctggcagtcatggctccagcgtaggtgtacagggtggcgttgactggatgagaaagttagcttttcgttataggaaagttagggaaatctacgacaagcacaaatctaacgtgggaggactcctgtcaccacagagaaaagaggccctgcagcgccttagggcggaaattgaagtcctgactgattcatggctggggacagccctgaaatctctcttgttgattcagtctcggaagaattgtgtcaacgtgctcattaccacaacacaactggtaccagccctggctaaggtattattatacggactgggagagatcttccctattgaaaacatatatagcgccactaaaattggtaaggagagttgttttgaacggatcgttagccgcttcgggaaaaaagtaacttatgtcgttattggagatggaagagacgaggaaattgctgcaaaacagcataatatgcccttctggagaataactaatcatggcgaccttgtctccctacatcaagctttagaattggattttctctag

SEQ ID NO: 187288 - DNA, 1563 bp, Artificial Sequence
  Description of Artificial Sequence: Synthetic coding sequence
atgacctgcaccgactacatcccccggagcagcaacgactacacctctcagatgtattcagctaagccatacgctcacatcctgtccgtgcccgtatcagaaactgcctaccccgggcagactcagtatcaaactctacagcagacacagccctacgccgtatacccgcaggctacccaaacatacggacttccccccttcggcgcactttggcctggcatgaaacccgagagtggattgatacaaactccatctccaagtcagcattcagttctaacctgtaccacggggctaaccactagccagccatcaccggcccactattcgtaccccatccaggcctcctctacgaatgctagtctgatcagtacaagcagcacaatcgctaatataccagctgctgccgtggccagtatttcgaaccaggattaccctacatataccattttaggccagaatcagtaccaggcgtgctatcccagttcatcctttggtgtcacaggacaaacgaactctgatgcggagtcaactaccttggcggcaaccacttatcaatcggaaaagccgtctgtaatggctccagcgccagctgcacagcgattgtcttcaggggatccctccacctccccctctctatcacaaaccaccccctctaaggacacagatgatcagtccaggaagaacatgacaagcaaaaacaggggcaaaaggaaagccgacgccacctcgagccaggattctgaacttgagagagtgttcttgtgggatcttgacgagaccatcatcattttccactccctcctgacgggctcatacgctcagaagtatgggaaagatccaacagtcgtgatcggctccggcctgaccatggaggaaatgatctttgaggttgccgacactcatctattttttaatgatcttgaggagtgtgaccaggtccatgtagaggacgttgcttcagatgacaatggtcaagatctaagtaactactccttctccacggacggattcagcggcagtggtgggagtgggtctcatggttcttcagtcggtgtgcagggcggggttgattggatgcgtaaactggcttttaggtaccgtaaggttcgggagatctatgataaacataagtccaacgtcggtggcctgctgagtccacaacggaaggaagcccttcagcgactccgtgcagagatcgaagtcctaaccgactcttggctggggacggcacttaagtccctcctcttgattcagtcccggaaaaattgtgtgaacgttctgatcacgaccactcagctagtccccgccctggctaaagtgcttttgtacggattaggggagatttttcctatcgagaatatctattccgcaacaaaaataggcaaggaatcctgcttcgagagaattgtttcaaggtttgggaagaaggtgacttacgtggtgatcggcgatggtagagacgaggagatcgctgccaagcagcacaacatgcccttttggagaattaccaaccacggtgatttggtgtccctgcatcaagccctggaactggacttcctttag

SEQ ID NO: 187289 - DNA, 1920 bp, Artificial Sequence
  Description of Artificial Sequence: Synthetic coding sequence
atggaggacagccaggacctgaacgagcagagcgtgaagaagacctgcactgaatctgatgtgagccagagtcaaaactctcgctctatggagatgcaggacctagcttctccccacaccctcgtcggcgggggggatacccccggctccagcaaactcgagaaaagcaacctttcttcaacttccgtcacaactaacggaacagggggtgagaacatgaccgtgttgaataccgcagactggcttctctcatgtaatacaccctcttccgccacaatgagtctcctcgccgtgaagaccgaacccctgaattcttccgagacgaccgccacaaccggcgatggcgcgctcgatacatttaccggctccgtgatcacatcaagcggttattccccccgctcggctcaccagtactcaccgcaactgtacccaagtaaaccctatcctcatatcctgtccacccccgctgcgcaaactatgagtgcctacgctggccagactcagtatagtggcatgcagcagccagcagtctacaccgcctactctcagaccggtcagccttactccctccccacttacgatctgggagtgatgctgccggcaattaagactgagtctgggttaagtcagactcagtctcccctgcagagcggctgcctgagctattctccggggttttccaccccacaacctggacagactccatattcttaccagatgcctggctccagttttgctccgtcgagtacaatttatgccaataatagtgtctcaaacagtaccaacttttcaggctcccagcaggattatccctcttacactgcatttggacaaaaccagtacgcccaatattactcagctagtacgtatggcgcttacatgacgtcaaacaacactgctgatggcacccctagtagcactagtacctatcagctccaggaaagcttacccggactgaccaaccagcctggggagttcgacactatgcaatctccctcgacgcctattaaggacctggatgagcgcacctgtcgatcttccgggtccaagtcccgaggcagagggcgaaagaacaacccgagcccccctcccgatagcgaccttgaaagagtattcgtttgggatttggacgaaacgatcatcgtcttccactctctcctcacagggagttatgcacagaagtacggcaaggacccacctatggcagttacactaggactgcgaatggaggaaatgatttttaacctcgcggatacacatcttttttttaacgaccttgaggagtgtgaccaggtgcatattgatgacgtgagctcagatgacaatgggcaagacttgtctacttatagctttgccacagatgggtttcatgccgccgcatctagtgctaatctgtgcttgcctactggagtgaggggaggtgtcgactggatgagaaagctggccttcagatatcgccgtgtgaaagagctgtacaatacttacaaaaacaatgtaggagggttgctggggcccgcaaagagagacgcctggttgcaactgcgcgcggagatcgagggcctgacggacagttggctgactaacgcattaaagtccctgagtatcatatccacccggagtaattgcataaatgtgttggtgacaacaacgcaactgattcctgccctggccaaggtattgctctatagcctcggaggggcatttccgatagaaaacatctactctgccacaaagattggaaaggaatcctgtttcgagagaattgtgagccggttcggcacaaacatcacatacgtggtgatcggagatggcagagacgaagagcatgcagcaaaccagcataacatgccgttctggaggatcagttctcatagcgatctgttagccctgcaccaagcacttgagctcgagtacctctag

SEQ ID NO: 187290 - DNA, 1851 bp, Artificial Sequence
  Description of Artificial Sequence: Synthetic coding sequence
atggaggacagccaggacctgaacgagcagagcgtgaagaagacctgtactgaaagcgatgtgtcccagtctcagaacagcaggagcatggaaatgcaggacctggcatcccctcatactcttgttggaggaggcgacacaccgggctcttctaaactcgaaaagtccaacctgtccagcacatcagttaccaccaatgggaccggagtctcgctgttggcagtgaagactgagcccctgaactcatcagagacaactgcaactacaggggacggcgcattggacacattcacaggctccgttatcacatcttcaggctattcgccaaggtctgcgcatcagtatagtccccagctgtatccttctaagccgtacccgcacatcctttctacccctgcggcacaaactatgagtgcctatgctgggcagacccagtactccggcatgcaacagccggcagtttacacagcctacagtcagaccggacagccctactccctgccaacgtacgacttaggggtgatgctgcctgccatcaagaccgaatcaggcctgagccagacacagagccctttgcagtcaggctgtctgtcttatagccccggctttagcacacctcagccagggcaaacaccatactcttaccaaatgcccggatccagctttgctccttctagcacaatttacgctaacaacagcgtgtccaatagtactaatttctctggttcgcagcaggactatccttcttacaccgccttcggacagaaccaatatgcccagtattactctgcttctacatacggggcctacatgaccagcaacaacaccgcagacggcacccccagttcaacatcaacgtatcagctgcaagagtcactgcccgggctgacaaatcagccaggcgaatttgatactatgcaatctcccagcactcctattaaggacctggacgagagaacctgtcgcagcagcggcagcaaatcaaggggtcggggccgcaaaaacaacccgtccccgcctccagacagcgatctggagagggtgttcgtatgggatctggatgaaactataattgtattccacagcctgcttaccgggtcatacgcccaaaaatacggaaaggaccctcctatggctgtcacgctcggtctgagaatggaggagatgattttcaatctggccgacactcatctgttcttcaatgacctggaggagtgcgaccaggtgcatatagatgacgtgtcatctgacgataacggacaggacctgagcacgtactcctttgctacagacggcttccacgcagctgcatcgagcgccaacctatgtctgccgactggcgtaaggggaggtgtggattggatgcgcaagctggcctttaggtacagaagagttaaggaactgtataacacttataagaataatgtcggtggccttctggggcctgctaagagagacgcttggttacaactgcgggccgagatcgaaggtttgacagattcttggctgacaaatgctttaaagtccctgagtatcatctcaactagaagcaattgtatcaacgtgctcgtgaccaccacacagctcattccagctctggcgaaggtgcttctttattcacttggcggcgctttcccgattgaaaacatctattcggccactaagatcggcaaggaaagttgcttcgaacgtataatgcagcgcttcgggcgtaaggtggtatatgttgtcatcggggacggcgtggaagaagagcaggccgccaaaaaacacaacatgccattttggaggatcagctcacactccgatttgctcgccctccaccaggcattggaactagagtacctctag

SEQ ID NO: 187291 - DNA, 1920 bp, Artificial Sequence
  Description of Artificial Sequence: Synthetic coding sequence
atggaggacagccaggacctgaacgagcagagcgtgaagaagacctgcactgagtccgacgttagtcagagccagaattcgaggtccatggaaatgcaggacttggcaagcccgcatactctcgtggggggcggggatacgccagggtcttctaagcttgagaagtccaacctgtcttccacatcagtcacaactaatggtaccggtggagagaatatgacagtgctgaatacagcggactggctgttgtcctgcaacacacctagttccgcgacaatgtcactcctcgctgtgaagactgagccattaaattcaagtgagaccaccgctacgaccggagatggtgcccttgatacttttaccgggagcgtgattactagtagcgggtattcaccaagatccgcccaccagtatagtccccaactgtacccatctaagccctacccacacattttgagcacaccagccgcgcagacgatgtccgcctatgctgggcagacccaatattccgggatgcagcagcccgctgtctataccgcatactcacaaactggacagccatactccctgcctacttacgatctgggtgtcatgctgcctgccatcaaaaccgaatccggcctgagccagactcaatctccgcttcagagcggatgcctttcatactctcccggtttttcaacccctcagcccggtcagacgccatatagttaccaaatgccaggatctagctttgctcccagtagtacgatttacgctaataacagcgtgtctaattccacaaacttcagtggttcacagcaagattaccccagttatacagccttcggccaaaatcagtatgctcaatactactcagcctctacatacggggcttatatgacatcaaataatacagctgacggaacaccctcttctacatcgacatatcagttgcaggaatctctaccgggactgacaaaccagccaggggaattcgacaccatgcagtcccctagcacccccattaaagacttagacgaacgaacctgccgctcgagtgggagcaaaagccgcggcagaggccggaagaacaatccgtccccccctccagattcagacctcgaacgagtattcgtgtgggacctcgacgagacgatcattgtcttccattctttattgacaggctcctacgcccagaaatacggaaaggatccaccaatggcagttactctaggactgcgaatggaagaaatgatcttcaatctggccgacactcacctgttcttcaatgatctggaggagtgcgaccaagtgcatattgacgatgtgtcatccgacgataacgggcaggacttgtctacctattctttcgccactgatggattccatgctgcagcttccagcgccaatctgtgcctgcccaccggcgtgcgtggtggcgttgactggatgcgcaagctagcctttcggtataggcgggttaaggagctctacaatacctacaaaaataacgtgggagggctgctgggcccggcaaaacgcgatgcatggctgcagttgcgggcggaaatcgaagggttaaccgactcttggcttaccaatgcacttaaatccctgtccattatcagcacccgaagtaactgtattaatgttctggtgactacaactcagcttattccagcactcgccaaagtgctgctctatagtcttgggggagcctttccgattgaaaatatttactcagctactaagattggaaaagaatcttgcttcgagcggatcatgcagcgattcgggaggaaggtcgtgtacgtggtgatcggtgacggcgtggaggaggaacaggctgccaaaaagcacaacatgcctttttggaggatctcttcacactcagatctgttggccctgcatcaggctctggagttggagtatctgtag

SEQ ID NO: 187292 - DNA, 9498 bp, Artificial Sequence
  Description of Artificial Sequence: Synthetic coding sequence
atgaccgacaagagcatcgtgatcctgagcctgatggtgttccacagcagtttcatcaacggaaagacgtgccgtaggcagctggtagaagaatggcatcctcagccaagcagctatgtagtgaactggacactgacagaaaacatttgcctggacttctatcgggactgttggttccttggcgttaatacgaagatcgacacatcgggcaatcaagccgttccccagatatgcccccttcagatccagctgggcgacattctcgtgatttcctcagaaccctcactgcagttcccggaaattaacctgatgaacgtgtccgaaacaagctttgtgggatgtgtccagaataccaccaccgaggaccagctcctgttcggctgtcgattgaagggaatgcatacggttaactcaaagtggctatcagttgggacacattatttcataaccgtgatggcctccggacctagcccatgtcctctggggctccgactcaacgtgaccgttaaacagcagttttgtcaggaaagcttgagctcagagttttgttctggccatggcaagtgcttgagtgaggcctggtcaaagacctatagttgccactgccagcccccttttagtggcaagtactgccaggaactggacgcctgctcttttaaaccttgcaaaaataacggatcttgtatcaataaaagggaaaattgggacgaacaggcatacgaatgtgtgtgccaccccccatttactgggaagaattgttcagagataatcggccagtgtcagcctcatgtatgcttccacggcaactgctccaatataacatccaactcctttatttgcgagtgtgacgaacagttctctgggccattttgcgaagtaagtgcaaaaccttgtgtgagtttgttgttctggaaaaggggcatctgccctaacagcagcagcgcctatacgtacgagtgtcccaaaggatcctcttcacagaatggcgaaacagacgtgagtgagttctcactggtgccctgccagaacgggactgactgcattaagatttctaacgatgttatgtgcatttgctcccctatttttactgaccttctatgtaagtctatccagacgagctgcgagagtttccctctgagaaataatgctacttgtaaaaagtgtgagaaggactacccttgctcctgcatttcagggttcaccgaaaagaattgcgaaaaggccatcgaccactgcaaactcttgagtataaattgcctgaacgaggaatggtgctttaatattatcggccggttcaagtacgtctgtataccggggtgcaccaaaaacccttgttggtttctgaagaacgtctatctaatacatcagcatttgtgttactgcggagttacgtttcatggcatctgtcaggataaggggcctgcccagtttgaatatgtttggcagctggggtttgcagggtccgaaggcgaaaaatgtcagggtgtcatagacgcttatttctttttggctgccaattgtacggaggatgccacctatgttaatgacccagaggataacaacagctcgtgttggtttccccatgagggaactaaagagatctgcgccaacggatgctcctgcctctctgaggaagactctcaggagtatagatatctatgttttctccgttgggccggcaacatgtacctggaaaatactaccgatgaccaagagaacgaatgccaacacgaagcagtatgtaaggatgaaattaaccggcctaggtgttcttgtagtctctcttacatcgggaggctgtgcgttgttaatgtggactattgcctcggaaatcattctatctcagtacatggcctgtgtctggcgttgtcccacaactgtaactgctctggcctccagaggtacgagaggaacatctgcgagatcgacactgaagattgcaagtctgcctcgtgtaaaaacgggaccactagcacgcatctgcgcggttatttttttcggaagtgtgtgcccgggtttaaagggacccagtgcgagattgacatcgacgaatgcgcctcccatccttgcaagaacggtgctacttgcatcgaccagccgggtaactacttctgtcagtgtgtgcccccattcaaggtggtcgatggtttttcatgtctgtgcaaccctgggtacgtgggcatccgatgcgaacaggacatcgatgattgcatccttaatgcttgcgagcataactcgacttgtaaggatcttcacctgtcttaccagtgcgtgtgcctgtccgattgggagggcaacttttgtgaacaggaatcgaatgagtgtaagatgaacccatgcaaaaacaattcgacctgtactgacctgtacaagagttaccgttgcgaatgtaccagcgggtggacgggacagaactgcagcgaagaaatcaatgaatgcgactcagacccctgcatgaacggagggctctgccatgagtcaaccatcccaggccaatttgtgtgtctgtgccctcctctttacactggccagttctgccaccaaaggtacaatttatgtgacctgctgcacaatccctgccgcaacaacagcacctgcctggcccttgttgatgcaaatcaacactgcatctgtagggaggaattcgagggcaaaaactgtgaaattgatgtgaaagactgtctgtttctgtcttgccaggactacggggactgcgaggatatggtgaataatttccggtgcatatgtcgacccggattcagcggctccctctgtgagatcgagattaacgagtgctcctccgaaccgtgtaaaaataatggcacctgcgtggacctgaccaaccggtttttttgtaattgcgagcctgagtatcacggccctttttgtgagttagatgtgaacaaatgtaaaatttctccctgcctcgatgaggagaactgtgtttacaggactgatggatacaattgcctctgcgctcccggatacacaggcattaattgcgagataaatcttgacgaatgcctcagcgagccctgtctccacgatggggtgtgcatcgacggcataaaccattacacctgcgactgcaagtccggattttttggtacccactgtgaaaccaacgcaaacgactgtctgagtaacccgtgtttacatggccgctgcaccgagttaatcaacgagtacccctgctcctgcgatgcagatggcacttcaacacagtgcaagatcaagattaacgattgtacatctataccgtgcatgaatgagggattctgtcagaagagtgctcacgggttcacatgtatctgtccccggggatatactggggcgtactgcgagaagtccatcgacaactgcgcagaaccagaattgaattctgtcatctgtctaaatggagggatctgtgtagatggccccggccatacttttgactgccggtgcttgcctgggttttctggacagttctgcgagattaatataaacgaatgctcttcctcaccctgtctgcacggggctgactgcgaggaccacattaacgggtatgtgtgtaagtgccagcctgggtggtctgggcaccattgtgagaacgaactggagtgtatccccaacagctgcgttcatgagctctgtatggagaatgagcctggttcaacatgtttgtgtactccagggtttatgacttgtagcataggcctgctctgtggggatgaaatccggagaatcacttgcctgacccccattttccaacgcaccgaccccatatctactcaaacatatacaatcccaccaagcgagaccctagtgtcaagtttcccgtcaataaaagcgaccagaatacccgctatcatggatacctacccagtggaccaaggtcctaaacagacaggcattgtgaaacatgatatactccccaccactggcctcgcgacccttcggatctcaacaccattagagtcctaccttttgcaggagttaattgtcacccgcgaattgtcagccaagcactccctgctgtcatccgccgacgtctcaagtagccggttcttaaactttggaatccgggatcctgcgcagattgtgcaagacaaaaccagtgtgtcacatatgccaatccgcacaagcgccgctactttagggtttttctttccagaccgtagggcaagaacgccttttataatgtcctccttgatgtctgatttcatcttcccgacacagagtctcctatttgagaattgccaaacggtcgcgttgagcgcaacccccacaacttcggtcatacgctcgattcccggggcagacatagaattgaataggcagtctctcctttctcggggcttcctcctgatagcagccagcatctcagccacgcccgtagtctcgagaggcgcccaagaagatattgaagaatacagcgctgatagtttgatctctaggagggaacactggcgcctgttgtccccatcaatgtcacctatcttccctgcaaaagttatcattagcaaacaggtcaccatattgaactctagcgccctgcaccgtttcagcaccaaagcctttaaccccagcgagtatcaagccattactgaagccagttctaaccagagattaactaatatcaagagccaggctgcagactcccttagggagctatcacaaacatgcgcaacgtgttctatgaccgaaataaaatccagccgggagttctcagatcaggttctccatagcaagcagagccacttctacgagactttttggatgaattcggctatcctagcttcctggtacgcactaatgggggcccagacaattacatccggccattcgttttcgagtgccaccgagattacaccttctgtggcttttactgaagtgccttctttatttccgtctaagaagtctgcgaagcggaccatactgtcatcatcactcgaggagtccattactctttccagcaacctggacgttaatctgtgcttggacaaaacttgtctttccatagtaccttctcagactatttcctctgacttgatgaactccgatctcacgtccaagatgaccaccgatgagctgtccgtgagcgaaaatatccttaaactgttgaagatcaggcagtacggcattactatggggcccacagaagttctgaatcaagaatcccttcttgatatggagaagtctaaagggtcacacactctcttcaagctgcacccttccgactcatcgttggacttcgaactgaacctgcagatctaccctgacgtgactctcaagacttactcagagataactcacgcaaacgactttaagaataatctgcccccattgactggcagcgtcccagactttagcgaggtgacaaccaatgtcgcattctacaccgtcagcgcaacgccagcactgagtattcagactagctcctctatgtccgtcattagacctgactggccgtacttcactgattatatgactagtctcaagaaagaggtaaagacttcctccgagtggtctaagtgggagctgcaaccgtccgtgcagtatcaggaattccctacagcctcaaggcacctgccgtttacaaggtctctgaccctaagttctcttgaaagcattctggcacctcagaggctgatgatatctgactttagctgtgtacggtactatggcgattcttacttggagtttcagaatgtagctctcaaccctcaaaataatataagtctcgagtttcagacattttcatcctatggccttttactatacgtaaagcaggactctaatctcgtggatggtttcttcattcaactctttatcgaaaacgggacattgaagtaccacttctattgtccaggagaagctaagttcaagtctatcaataccaccgttagagtagacaatggccagaaatatacattgttgatcaggcaggaactggacccgtgtaacgcagagcttacaatcctgggtcgcaatactcagatctgcgagtcgatcaatcacgttctcggcaagcctctgcctaaaagtggatctgtgttcattggaggattcccggatctgcacggcaaaatccaaatgcccgtgcctgttaagaactttaccgggtgcatcgaggtgattgaaatcaataactggaggtcctttatcccgtccaaggcagtaaagaactaccatattaacaattgtcgaagtcaaggattcatgctctctcccacggcgtccttcgtcgatgcctccgatgtgacacagggcgttgacacaatgtggacgagcgtgagcccttccgtggctgctcctagtgtgtgccagcaggacgtgtgccacaacggaggcacttgccacgccattttccttagtagcggcattgtgagtttccaatgtgactgtcctctgcacttcaccggcagattctgcgaaaaggatgcaggtctgtttttcccatctttcaacgggaattcatatctcgaactccccttccttaaatttgtgctggagaaggagcacaaccggactgtgacaatctacctgactattaaaactaactctttgaacggaacgatattatactctaacggaaataactgcggaaaacaattcctgcacctttttctggtagaaggaaggcctagcgtgaagtacggctgcggtaactcgcaaaatatcctcactgtaagtgctaattacagcattaacactaacgcttttacccctataacaattagatacacaactcctgtgggaagtcccggggtggtgtgtatgatcgagatgaccgctgacggcaaacctcctgttcagaaaaaagatacagagatctcccacgcttcacaggcttatttcgaatctatgtttctaggtcacattcctgccaacgtgcaaatccataagaaggcagggcccgtgtatgggttcagggggtgtatcctggatctgcaggtcaataacaaagagtttttcattatcgatgaggcacgacatggcaaaaacattgaaaattgccacgtgccttggtgcgcccaccatctgtgtcgcaacaacggaacctgtatctcagacaatgagaaccttttttgtgagtgtcctcggttgtactctggcaagctttgtcaattcgcaagctgcgagaacaatccgtgcggaaatggggcaacatgtgtgcccaaatctggaacagatattgtctgtctctgcccttatggccggtcaggtcccttgtgcactgacgccatcaacattacacagccccgcttctccggcactgacgccttcggctatacatcctttcttgcatatagcagaattagcgacatctctttccactatgagttccacctaaagttccagttggcgaacaaccattctgctttgcagaacaatctgattttcttcaccggccaaaagggccacggcctcaacggtgatgatttcttggctgttggattactgaacggaagcgtggtttacagctacaaccttgggtctggcatcgcctctatcagatcggagcccctgaacctctccctgggggtccacaccgtgcacctcggcaaattcttccaagagggatggctcaaagtagatgaccataagaacaagtctataatcgccccaggccggctagtggggctgaatgtatttagtcagttctatgtcggcggctacagcgaatacactcccgacctgcttccgaatggcgccgacttcaaaaatggtttccagggatgtatctttactctgcaggtgcgtaccgaaaaagacggtcactttcgtggtctgggcaaccctgaaggccaccctaacgctggtcggtctgtaggccagtgccacgcctccccttgctcgctgatgaagtgcgggaatggagggacttgcatagagagcggcacctcagtctattgtaactgtactactgggtggaagggcagcttctgcacggagactgtgagcacttgcgatccagaacacgatcctcctcatcattgtagcagaggagccacatgtattagcttgccccacgggtacacatgcttttgcccgctcggaaccacaggcatctactgtgaacaggccttgatcctgatcgtgatcctggaaaaacctaaacccgctgagaggaaggtcaaaaaggaggctttgtcaatctcagacccctccttccgcagtaacgaactgagttggatgtcctttgcaagcttccacgtgagaaaaaagacccatattcagctgcaatttcagccgctggccgccgatgggattcttttttatgctgcccagcatctgaaggctcagagtggcgactttctgtgtattagcctcgtgaacagtagtgttcaactccgctacaatctgggagaccgcactattatccttgaaactctccagaaggtgactatcaatgggagtacatggcatattataaaagctgggcgtgtcggcgctgaaggatacctggaccttgatggcataaatgtgactgagaaggcctcaacaaagatgtcatcgcttgatactaatactgacttttatattggcggggtctcctccctgaacctcgtgaaccctatggctatagagaacgaaccagtgggatttcagggctgcattaggcaagtgatcatcaataatcaagagctacagctcacagaatttggagcgaaagggggcagcaatgttggcgactgcgatggtaccgcttgcggctacaatacttgcaggaatgggggtgaatgcaccgtgaacggcactacattcagctgcagatgcctgcccgattgggctgggaatacgtgtaaccagtcagtgagctgtctaaataacctctgcctacatcagtctttatgcattcctgaccagtcctttagctatagctgtctgtgtaccctcggctgggtgggccgctattgcgagaacaagacttcttttagcaccgcaaaatttatgggcaatagttatattaaatatatcgatcccaactatcgcatgcgaaacctgcaatttacaaccattagtcttaacttctctactactaagactgagggcttaattgtctggatggggatcgcccaaaatgaggagaacgatttcctggccatcgggctccacaaccagacccttaagatcgctgtgaacctcggtgaaaggatttctgttccgatgagctataataatgggaccttttgctgtaacaaatggcatcacgtggtcgtgatccagaatcaaacccttatcaaagcctacatcaataactccctgatacttagcgaggacatcgacccccataagaatttcgtggctctgaattacgatggtatctgctacctggggggctttgagtatggacggaaagttaatatcgtcactcaggaaatttttaagactaactttgttggcaagatcaaggatgtggttttttttcaggagcctaaaaacattgagttaatcaagttggagggatataatgtgtacgatggggatgagcagaacgaagtcacatag

SEQ ID NO: 187293 - DNA, 1785 bp, Artificial Sequence
  Description of Artificial Sequence: Synthetic coding sequence
atgaccgacaagagcatcgtgatcctgagcctgatggtgttccactctagctttattaacggaaaaacatgtcgccgccagttggtcgaagaatggcatcctcagccctccagttacgtcgtcaattggaccctcaccgagaacatctgccttgacttctaccgagactgttggtttctgggggtcaacacaaagattgacacgtcggggaaccaggccgttcctcaaatttgccctctgcaaatccagctgggggatattctagtcatcagctcggagccatctctgcagtttccagagatcaatctgatgaacgtatcagagacatcatttgtaggatgcgtacagaacaccactaccgaggatcagctcctgtttggttgccgcctgaagggcatgcacacggttaactccaagtggctgtccgttggcacacactatttcatcaccgtgatggcctctggaccaagcccgtgtcccctgggactcaggctgaatgttaccgtcaagcagcaattctgtcaagagtccctgtcatcggaattctgctccggtcacggcaagtgtttgtctgaggcctggtcgaagacgtatagttgtcactgtcagcctcccttctcgggcaagtactgccaggaactcgatgcatgcagctttaaaccctgcaaaaacaatggatcttgcatcaataagcgggagaattgggacgaacaggcttacgaatgcgtttgtcatccgccgtttaccggcaagaattgcagcgagataatcggacagtgtcagcctcatgtttgcttccacggaaattgttccaatataacttcgaattctttcatttgtgaatgcgacgagcagttcagtggaccattttgcgaggttagcgctaagccatgcgtatctctactgttctggaagagaggcatctgccctaacagttcatctgcatacacctatgaatgtcccaaaggctcctctagccaaaatggcgagacggacgtgtctgaattcagtctggtgccgtgccagaacggcaccgactgcattaaaatcagcaacgacgtaatgtgcatctgttcccccatcttcacagatctgctgtgcaaatcgattcagactagttgcgaatccttccccctgagaaataatgctacctgcaaaaagtgtgagaaggactatccgtgctcctgcatcagtggattcacagagaaaaattgcgaaaaggccatcgatcactgcaagctgctgtcaatcaattgtctcaatgaggagtggtgtttcaacattataggccgattcaagtacgtctgcatccctggctgtactaagaatccttgttggttcctgaagaatgtgtatctcatccatcagcacctttgctactgcggagtgacttttcatgggatctgccaggacaaaggccccgcacaattcgaatacgtctggcagcttggtttcgctggttcagagggagaaaagtgccagggggtgatcgatgcttatttttttttggcagccaactgtaccgaagatgccacttatgtcaacgaccctgaagacaataactcttcttgctggtttccacatgagggcacgaaagaaatctgcgccaatggatgcagttgcctctccgaggaggactctcaagagtacaggtacttatgctttctgaggtgggccgggaacatgtatctcgagaataccaccgatgaccaggagaacgagtgccagcacgaagccgtctgtaaggacgagatcaaccgtcctaggtacctctgcatcatctag

SEQ ID NO: 187294 - DNA, 9498 bp, Artificial Sequence
  Description of Artificial Sequence: Synthetic coding sequence
atgaccgacaagagcatcgtgatcctgagcctgatggtgttccactcatcatttatcaacggcaaaacttgccggcgccaactcgtggaggaatggcacccccaacccagcagttatgtggtgaactggactctaactgagaatatatgcctggatttctaccgagattgttggtttctcggcgttaatacaaaaattgatacctccggaaaccaggccgtgcctcagatttgtccactgcaaatccaactcggggacatactagtcatttcaagcgaaccgtcactccaattccccgagatcaaccttatgaacgtgtcagaaacttcctttgttggatgcgtgcagaataccactaccgaggaccagctcctgttcggatgtagactcaaagggatgcatactgttaatagtaagtggctgagtgttgggacccactacttcattactgttatggcaagcgggccttctccgtgtccgctaggcctcaggctgaacgtcacagttaagcagcaattttgccaggaatcactgtccagtgagttttgcagtggtcatggtaagtgcctgtcagaagcctggagcaagacttacagctgccattgccaacctccattctctggcaagtattgccaggagctagacgcctgctcctttaaaccttgtaagaacaacggttcctgtattaacaaacgagagaattgggacgagcaggcatatgaatgcgtttgccatcccccttttacaggcaagaattgcagtgagattatcggccaatgccagccccacgtgtgcttccatggcaattgcagtaacatcactagtaacagcttcatctgtgaatgcgacgagcagtttagcggtcccttttgtgaggtgagcgcaaagccctgcgtcagcctccttttctggaaacgaggcatttgcccgaattcctcctctgcctacacatatgagtgcccgaagggaagctcatcgcagaatggggagactgacgtttcggagttctctctcgtcccatgtcagaacggtacggattgtattaagatctcaaacgacgtgatgtgtatctgttctccaatctttactgacctgctatgtaagtctatccaaacctcttgcgaaagttttccactgcgtaacaacgcaacttgtaaaaaatgtgagaaggattatccctgttcttgcatctctggtttcaccgaaaagaattgtgagaaggctatagaccactgtaaactgctgtctatcaactgcctgaatgaggagtggtgtttcaatattattggccgttttaaatacgtgtgcatacctggatgcaccaaaaatccctgttggttcctgaaaaacgtttatcttatacatcagcacctgtgctattgtggggtgacctttcatggcatttgccaggataagggcccggcccaatttgaatatgtctggcagctggggttcgccggatctgagggcgaaaagtgccagggggtcattgacgcatatttctttctcgccgccaactgtactgaggacgccacctacgtcaacgatcccgaagataataattcctcttgttggtttcctcatgaaggtaccaaggagatctgcgcgaacgggtgctcctgtttatccgaagaggatagccaggagtacagatacctgtgttttcttcggtgggccggaaacatgtacctggagaacacaacagacgaccaggagaacgagtgccagcacgaggcagtgtgcaaagacgagattaatcgaccgagatgctcctgttcactcagttatatcggcaggttgtgcgtcgtgaatgtggactattgcttaggtaatcactctatctcagtgcatgggctctgtctcgctctatctcacaactgcaattgttctgggttacaacgatatgagcgtaacatatgcgagattgacacagaggactgtaagtcagcatcatgcaaaaacggcacaacttcgacacacctgcgtggttattttttcaggaagtgcgtacctgggtttaagggaacccagtgcgagatagacattgatgagtgtgcctcacacccatgtaagaatggggccacctgcattgaccagcctgggaactacttttgtcaatgcgtccctcccttcaaggttgtcgatgggttctcctgcctgtgtaatcctggatacgttggaatccgctgtgagcaggatattgacgattgcatactgaatgcgtgtgagcacaatagcacgtgtaaggatctgcacctctcataccagtgcgtgtgtctgtcggattgggaaggcaacttttgtgagcaggagagcaatgagtgcaaaatgaacccttgtaaaaataattcaacctgtaccgatctctataagtcttaccgctgcgaatgcaccagtgggtggacagggcaaaattgcagcgaagagatcaatgagtgtgactctgacccgtgcatgaatggcggattgtgccacgaaagcaccatccccggacagttcgtgtgcctgtgcccaccactttatacaggccaattttgccatcagaggtataatctgtgtgatctcctgcacaacccttgtcgtaataactctacgtgtctcgccctggtggatgcaaaccagcactgcatctgtagggaagaatttgaaggaaagaactgtgagatcgatgtgaaagactgcctgttcttgtcttgccaagactatggagactgcgaagacatggtcaataactttaggtgcatatgtcggcctggtttttctggctcactatgcgaaatcgagataaacgagtgtagctcagaaccatgtaagaacaatggcacatgcgtcgatctcaccaaccgcttcttttgtaactgtgagcctgagtatcatgggcccttttgtgagctcgatgtgaacaagtgcaaaatttcaccctgcctcgacgaagagaattgcgtgtaccggaccgacggatacaactgtctctgtgctcctgggtataccggaattaattgcgagatcaatctggacgagtgcttaagcgaaccatgtttacacgacggggtttgcatcgatggcatcaatcactacacttgtgactgtaagagtggattctttggcactcactgcgagacaaacgccaacgattgcctatcgaatccctgtctgcatggtagatgcacagaactcatcaatgaatacccatgctcatgtgatgccgatggcacatctactcagtgtaagattaagattaacgactgcacttccataccttgtatgaatgagggcttctgtcagaagtctgctcatggctttacctgcatctgcccccggggctacacgggagcctattgtgaaaagtcgatagacaactgtgcagagcctgaactgaattccgtgatatgcttgaacggcggaatatgtgtcgacgggcctggacacacattcgattgccgttgccttcctggattcagcggtcagttttgtgaaataaacataaatgagtgttcaagcagcccatgtctgcatggcgcggactgcgaggaccacattaacggctatgtatgcaagtgtcaaccagggtggagcgggcaccattgcgagaatgagttagaatgtatcccaaactcatgcgtgcatgaattgtgcatggagaacgaacctggctctacttgcctgtgtactcccggtttcatgacttgctccataggcctgttgtgtggggacgaaataagaaggatcacttgccttacacctatctttcaacgaaccgatcctatctccacacaaacttataccattcccccctcggagaccttggtatcttcttttcctagcatcaaagctacaagaatcccagctatcatggacacatatcccgttgatcagggaccaaagcaaactggcatcgtaaagcatgacatcctccctacaactggcttagccacattgaggatatccacccctttggagagctatctgcttcaggaactcattgttactagggagctgagcgccaagcattccctcttatctagcgcagatgtatcttcatctcggtttctgaactttggcatcagagatcctgctcaaattgttcaggacaagacatcagtctctcacatgccaataaggacctcggcagcgacgctgggatttttcttcccggaccgacgagctcgaactccctttattatgagcagccttatgagtgattttatcttcccaacccaatcccttttgtttgaaaactgccagactgttgctttatcggccacaccaacaacatctgtgattcggtctattccaggcgctgacattgaactgaaccgacagagtctcctgagtagaggcttcctgctgattgccgcaagcataagtgccaccccagttgtcagtaggggcgctcaggaggacatagaagaatactctgccgattcgttgatctctaggcgggagcactggcgtctcctgtctcctagtatgtcaccaatctttccagccaaagtgatcatttccaagcaagtgactatattgaattcttcagctctgcacagattctccacgaaggcctttaatccctctgagtatcaggccattaccgaggcctcctcaaatcaaagattaactaacataaagtcccaggctgccgattccctaagagaactcagccagacatgtgctacctgttctatgaccgagatcaaaagcagcagagagttttcagatcaggtgcttcatagtaaacagagtcacttctacgagaccttttggatgaacagcgctattctcgcctcctggtatgcactgatgggcgcacagacgattaccagtgggcactccttttccagtgcgactgaaatcacaccatcagtggcctttactgaagtgcccagcctgttcccctcaaagaaaagcgcaaaacgtaccatactttccagttcgttagaggagtctatcacgctcagtagcaatctggatgttaacctgtgcctcgataagacctgtctgagtatcgtcccctctcaaaccataagctctgacctgatgaactctgacctcacttccaagatgacgacagatgagctgtcagtctccgagaacatactgaaacttcttaagatacgtcagtacggtatcacgatgggtcctacagaagtgctgaatcaggaatctctcctagacatggagaaaagcaaagggtcacatacactttttaaactacacccgagcgattcatcattggactttgagctgaacctgcaaatttatcctgacgtcacactcaagacatactctgaaattactcacgctaatgattttaagaataacctccctccactgaccggaagcgtgcccgacttttcagaagtcaccactaatgtggccttctacacagtgtccgcaactcctgcactcagcattcagacatcaagctccatgtccgttataagaccagactggccatattttaccgactacatgactagcttgaagaaggaagtaaagaccagctccgagtggtccaagtgggagctccaaccctcggtgcagtaccaggagtttcctacggcttccagacatcttcctttcacacggtccctcaccctttcatcactagagtccattctagccccacagaggctgatgatctcagacttctcatgtgttcgttattatggtgatagctacctggaatttcagaatgtggctcttaaccctcaaaacaacatcagcctggaattccagactttcagcagttacgggttgctgctgtatgtgaaacaagattcaaatttggtggatggcttttttatccagctcttcatagagaatggcacattgaagtatcatttttattgtccaggagaggcaaaattcaagagcattaacactaccgtgcgtgttgacaatggccagaaatacaccctgctgattagacaggagttagacccttgtaatgcagagctgaccatcctggggagaaacacacaaatttgcgaaagcatcaatcacgtgctcggcaaacctctccctaagtcagggtccgtgttcatcggaggcttccccgacctgcacggcaaaattcaaatgcccgttcctgtaaaaaactttaccggctgcattgaggtgatcgaaatcaacaactggcgcagcttcatcccgtccaaggcagttaaaaattaccatatcaacaattgcagatcgcagggattcatgttgtcccccacagcttcgtttgttgatgcatcggacgtgacccagggcgtggacacgatgtggacttcagtgtccccaagcgtggcggcaccttcagtctgccagcaggacgtatgtcacaacggtggaacatgtcacgctattttcttgagctcaggcattgtatctttccagtgtgattgtcccctgcactttacaggccgcttttgcgaaaaggatgctggccttttctttcctagtttcaatggcaacagctatttagaactgccgttcctgaagttcgtacttgagaaggaacacaacaggactgtaactatttacctgaccattaagaccaactccctgaacggcacgatcttgtattccaatggcaacaactgcgggaagcagttcctgcatctcttccttgtggagggtcggccgagcgtgaagtatgggtgcgggaatagtcagaacatcctcacagtgagtgcaaattactctatcaacacaaacgccttcacccctatcaccatccgttatacgacaccagtgggatcccccggggtggtctgcatgattgagatgactgcagacggtaagcccccagtgcaaaaaaaggacaccgagataagccatgcatcccaggcctattttgagagcatgttcctgggccacattccagctaatgtgcaaattcataagaaagccgggcccgtttatggattcagaggctgtatactggaccttcaggtgaacaataaagagttctttatcatcgacgaggctagacatggaaagaatattgaaaattgtcatgtcccatggtgcgctcatcatttatgtagaaacaatggcacgtgtatttcagacaacgagaacttattttgtgagtgccccaggctttactccggaaagctctgccagttcgccagttgcgaaaacaacccttgcggcaatggcgccacgtgtgtgcctaaaagtggaactgacattgtctgtctgtgtccttacggcaggagtggacccttgtgcacagacgctatcaacataactcagccgcgcttttcaggtacagatgcctttggatacacaagctttctggcgtattcgagaattagcgatatcagtttccattacgagttccaccttaaattccagttggctaacaatcactctgccttacagaacaacctcatcttttttaccggacaaaaagggcacggtcttaatggagacgacttcctggctgtgggtcttctcaatggaagcgtggtgtatagctataatcttggctctggcattgcttcgatccggtccgaacctctcaatttgagcctgggagtccatacagtacacttaggaaagttcttccaagagggatggctcaaggttgatgatcataaaaacaaaagtatcatagcaccagggaggctggtcgggctgaacgtgttctcccagttctatgtaggcggttattccgagtacactcccgatctgctccccaatggggccgatttcaaaaacggatttcaggggtgcattttcaccctacaggtacgtactgaaaaagacgggcacttcagaggcctggggaacccagagggccaccctaatgcaggacgaagcgtcggccagtgccatgcctctccctgctctttaatgaaatgcgggaatggagggacctgcatagagagcggcacttcagtttattgcaattgtacaaccgggtggaaaggctccttctgcaccgaaaccgtgagcacatgtgacccagagcacgatcctccccaccactgttcacgcggcgctacgtgcataagtttgccgcacggatatacctgtttttgtccgttaggtaccaccggaatttactgtgagcaagcgcttatactgatcgtcatactggaaaagcctaaacccgcagagcgtaaagtcaaaaaggaagcattaagtatctcagacccctctttccgctcaaatgaactgagctggatgagcttcgcgagcttccacgtcagaaagaaaacacacatacagctgcagtttcagccgttagccgccgatgggatcttattttacgccgcacagcacctgaaggctcagtctggagatttcctgtgcatctccctcgtgaattcttcagtacaactgcgatacaacctgggcgacagaaccattatcctcgaaacactgcagaaggttaccattaacggctctacttggcacatcatcaaagctggtcgtgtgggcgcagaggggtacttagacctagatgggatcaacgtcacggagaaagcctctaccaagatgtcttctctcgatactaacacagacttttacattggtggggtgtcctcacttaacttggtgaaccctatggcaatcgaaaacgaaccggtgggattccaggggtgcatcaggcaggtgatcatcaacaaccaagaactgcaactgaccgaattcggcgccaagggcgggtccaatgtgggcgattgcgacggcacagcttgcggctacaacacatgcaggaacgggggtgagtgtaccgtgaacggtactacattcagctgtcggtgcctgccagattgggccggaaatacatgcaatcagagcgtgtcctgtctcaacaatctgtgtcttcatcagtccttgtgtatccctgaccagtcatttagttattcttgtctttgtaccctggggtgggttggtagatactgtgaaaataagacctctttcagcactgcgaagttcatgggaaattcatacatcaagtatattgatccaaactacaggatgcggaacctgcaatttactaccatatcattgaactttagtacgaccaagaccgagggactgatagtttggatgggcatagcccaaaatgaagagaatgattttttagctatcgggctccacaaccagaccttgaagattgccgtaaaccttggtgagcggatcagcgtaccaatgagttataacaacgggaccttctgctgtaataagtggcatcacgtcgtggtgatccagaaccagaccttgattaaagcatatataaataatagtctgatcctgtctgaagacatcgatccacataaaaacttcgtagccctcaactacgacggaatttgttacctaggaggattcgaatacgggcgaaaggtgaatattgtgactcaagaaatttttaaaacaaacttcgtaggcaaaattaaggacgtggtgttcttccaggagcccaagaatatcgagcttattaagctggagggatacaatgtatatgacggagacgagcagaatgaggtcacatag

SEQ ID NO: 187295 - DNA, 9435 bp, Artificial Sequence
  Description of Artificial Sequence: Synthetic coding sequence
atgaccgacaagagcatcgtgatcctgagcctgatggtgttccactcatctttcattaatggcaaaacatgtcggagacagttagtcgaggaatggcacccccagccgtctagttacgtcgtaaattggaccctgacggaaaatatctgccttgacttttatcgggattgctggtttctaggagtgaataccaagattgatacgtctggaaaccaggccgttccacaaatctgtccactgcagatccagctgggcgacatcctggtcatctccagcgaaccaagcctgcagtttcctgagattaacctgatgaatgtgtcagagacaagttttgtcgggtgtgtgcagaacaccacaacagaggaccagttgttattcggttgccggctcaagggtatgcacaccgtcaattccaaatggctgtctgttggtacgcactactttattactgtgatggcctccggacctagcccatgtccactgggcctgcggttgaatgtgaccgtcaagcagcagttttgccaggaatccctttcttcagaattttgtagcggacacggaaagtgccttagcgaggcttggtctaaaacctactcctgccattgccagcccccattctcgggaaaatattgccaggaactggatgcttgcagttttaagccatgcaagaataacggctcttgtatcaacaagcgggagaattgggacgagcaggcttacgagtgcgtttgccatccgccttttactggcaagaactgctcagaaatcatcggtcagtgtcagccccatgtgtgttttcatgggaactgttctaacatcaccagtaactcatttatttgtgaatgtgacgaacaatttagcgggcccttctgcgaggtgtccgctaaaccgtgtgtgtctttactgttctggaaacggggcatttgtcccaactccagttctgcgtacacatacgaatgccctaaaggttcatcttcccagaacggcgagacggacgtgagcgaattttcccttgtgccgtgccagaacggtacggactgcatcaaaattagtaatgacgtcatgtgcatttgctcgccaatttttaccgatcttttgtgcaagagcattcagacctcatgcgagtctttccccctccgcaataacgcaacctgtaaaaagtgtgagaaagattatccttgttcctgcatttcggggttcaccgaaaaaaattgcgaaaaggctatcgaccattgcaaattgctatctattaattgcctgaacgaagagtggtgtttcaacatcataggcaggttcaaatatgtctgcattcccggctgtactaaaaacccatgctggttcctcaagaatgtctatctcattcaccagcacctttgctattgcggggttacgttccatgggatctgtcaggataaaggtcccgcgcaattcgaatatgtatggcaactcggctttgctgggtcagagggtgaaaagtgtcagggagttattgacgcctacttttttctggccgccaactgtacagaggatgccacctacgtgaacgacccagaggacaacaatagctcctgttggttcccgcatgaaggtactaaggagatttgcgctaacggctgctcctgtctctcagaagaagattctcaggaatatagatacctgtgctttctccgttgggccggcaacatgtatctcgaaaatactaccgacgaccaggaaaacgagtgtcagcacgaggccgtttgtaaggatgagatcaaccggcctcgttgttcatgctccctgtcttatataggccgcctctgcgttgttaatgtggactactgcttgggcaaccactctatctccgtccacggtctgtgtttagccttaagccataattgcaactgttcaggtttacagcgttatgaacgtaacatatgcgaaattgataccgaagactgcaaatccgcgagttgcaagaatggcaccactagcacccatctgcgcggttatttcttccgaaaatgtgtccctggatttaaggggactcagtgtgaaattgacatagacgagtgcgcctcacacccttgcaagaacggcgctacgtgtattgaccagccaggcaactatttttgccagtgcgttcccccctttaaggtggtggacggtttttcctgcttgtgcaatcccggttacgtagggattcgttgcgaacaggacatcgacgactgtatactgaacgcttgcgagcacaactcaacttgcaaggatctgcacctctcttaccagtgcgtttgccttagtgattgggaaggcaatttctgcgagcaagagagtaatgagtgtaagatgaacccttgtaagaacaacagcacttgcactgatttgtacaagtcttacaggtgcgagtgtacttcagggtggacagggcagaattgctcagaagaaatcaacgaatgtgatagtgacccatgtatgaatggtggtttgtgccacgagtctaccatccccgggcagtttgtttgtctttgtcccccgctgtatacagggcagttctgtcaccaacgctataatctttgcgatctgctccacaacccgtgtcgaaacaactccacttgcttggctctggtggacgcgaaccaacattgcatctgcagagaggaattcgaaggcaagaactgtgagattgacgtcaaagattgtcttttcctttcttgtcaggattacggcgactgcgaggacatggtcaataatttcaggtgtatatgtcgtccgggttttagtgggtccctttgcgagatcgaaattaatgagtgttcgtctgagccctgtaagaacaatggtacgtgtgtggatttaaccaacaggtttttttgcaattgtgagcctgagtatcacggccctttctgcgagctcgacgttaataaatgtaagatctctccttgtctcgatgaagaaaactgcgtgtaccggaccgatggctataactgtctctgcgcgccgggctacacaggtatcaattgcgaaatcaatctggacgagtgcctgagtgaaccttgtttacatgacggcgtctgtattgacggtatcaatcattatacatgcgattgcaagagcggcttttttggaacccattgcgagaccaatgccaacgactgcctgtccaacccatgtctgcacgggcggtgcaccgagttgataaacgagtatccctgctcatgcgatgctgacgggactagtacacagtgcaaaatcaagattaatgattgcacctcaattccctgcatgaacgagggtttttgccagaaatctgcgcacgggttcacatgtatttgccctagagggtataccggcgcttactgtgagaagagcatcgacaattgcgcagagccagagctaaactccgttatctgcctaaacggcggtatttgcgtggacggacctggacatacctttgactgccggtgcttacccggtttcagcgggcaattctgcgagatcaacatcaatgaatgtagctcatcgccctgtttgcatggagccgactgcgaggaccatatcaacggatacgtttgtaagtgccagccaggatggtccggccatcactgcgaaaacgagcttgaatgcattccaaactcctgtgtgcacgagctctgtatggaaaacgaacccggcagcacatgcctgtgtacacccggattcatgacatgttcaatcggtctgctttgtggagatgagatcagaaggatcacctgccttacgcctattttccagcgcacggaccctatctctacacagacatacaccatccccccatccgagaccctcgtgtcctcattcccaagtattaaggctacaaggatccccgctataatggacacctatcccgtcgaccagggcccaaaacagactggaattgtcaaacacgatatactgccgacaacaggactggccaccctgagaatcagtacaccgttggaaagctaccttctgcaggaactcatcgtgacaagggagctaagtgcgaaacactccctgttaagttcggccgacgtttcttcatctcgtttcttgaacttcggcataagagatcccgcccagattgtccaggacaagacatcagtgagccatatgcctataagaacatctgccgccaccttgggcttctttttccctgacagacgcgcccgcactcccttcatcatgtcctcactgatgagcgattttattttcccaacacaatctctgttgtttgagaactgtcaaacggtcgccctgtcggccacacccacaacaagtgtgatacgtagcatcccaggggctgatatcgagcttaaccgccagtccctcctatcccgcgggttcctgcttatcgctgccagcattagcgccacaccagtggtttccaggggagctcaagaggatattgaggagtattcagccgactccctgatctcacgtagggaacactggagactccttagcccctcaatgagcccgatattcccagcaaaggtgatcatatctaaacaggtaaccatcctgaattcttctgccctgcatcggtttagtactaaggctttcaacccttccgagtatcaggcaatcacggaagccagctccaaccagcggctgacaaacatcaagagccaagccgccgatagccttagagaactatctcaaacatgcgcgacttgctcgatgactgaaattaaatctagtcgcgagttctccgaccaggtgctgcacagcaaacagagccacttctacgagacgttttggatgaacagtgccattttggcttcatggtatgctttaatgggcgcccaaaccattacaagcgggcatagtttttctagcgctacagagattacaccaagtgtggcttttactgaggttcctagcctcttcccctcgaagaagtcagctaagagaacaattctgagcagttccttggaagagtctattactttatcctccaatctggacgtgaatttgtgtttggacaagacctgcctttcgattgtaccctctcagacgatttcgtcagacctaatgaattcagatctgacgtctaagatgacgacggacgagctgtcagttagtgaaaacatcttaaaattgttgaaaattcgacagtacggaataacgatgggacccacagaggttttgaatcaggaatcactgctggacatggaaaagtccaagggatcacacacactttttaagctccatcccagcgatagcagcctggatttcgaactgaacctgcaaatataccctgacgtgacgctgaaaacatacagcgagataacccatgccaacgattttaaaaacaatcttcctcctttgaccggatcagtgccggacttttccgaggttacaacaaatgtggccttctacacagtgtcagctactcccgcattatcgatccagacatcttcctccatgtccgtgatccgacccgactggccctatttcactgactacatgaccagtctgaagaaggaggtaaaaacgtcgagcgagtggagtaaatgggagctacagcccagcgtgcagtatcaggaattcccaacagccagtagacacctgccgttcaccaggtctctgaccttgagctctctcgagtccatcctagctccgcagaggttaatgattagcgacttttcctgcgtccggtattatggcgactcttacctcgaatttcagaacgtcgcacttaatccacaaaacaatatctctctggaattccagaccttctcatcgtacgggttgctgctgtacgttaagcaggacagtaatctcgttgacggattcttcatccagctcttcatcgaaaacgggaccctcaagtaccatttctactgtccaggagaggccaagtttaaaagtattaacaccacagtgcgagtagacaatggtcagaagtatactctccttatcagacaggaattagacccttgcaacgcagaactcacgatcctgggacgcaatacccagatttgtgaaagcataaaccatgtgctcggaaaaccactgcctaaatccgggagtgtgttcatcgggggatttcccgatctgcacggcaagatacagatgcccgtgcccgttaagaattttacagggtgcatcgaagtgattgagataaacaactggagatccttcatcccctcaaaggcagtgaagaattaccacataaacaactgtagaagccagggctttatgctgtccccaaccgcgtcattcgttgatgcctctgatgttactcagggcgtggataccatgtggaccagcgttagcccaagtgtggcagctccaagtgtgtgtcagcaggacgtctgccataatggcggcacatgccatgcaatcttcttaagtagcgggattgtgagcttccagtgtgactgccctctgcatttcaccggcagattctgtgagaaagacgccggcttattttttccctcattcaatggaaactcgtatttggaactgccatttcttaaattcgtgctggagaaagagcacaaccgcaccgtgacgatctacttaaccattaagactaacagcttgaatggaacgatcctgtactcaaatggcaacaactgcgggaaacagtttttgcatctgttcctcgtcgagggaaggcctagcgtcaaatatggctgtggaaatagtcagaacattttgactgtgagtgcaaattacagcatcaatacaaacgccttcacacccattaccatccgctacaccacgcctgtcggttctcccggcgtggtgtgtatgatcgagatgactgccgacggcaagccgcccgtgcagaaaaaggatacagaaattagccacgcttcccaagcctacttcgagagtatgtttctgggtcatattcctgccaatgtgcagattcataaaaaagcaggccctgtgtacgggttccggggctgcattctagatctccaggtcaacaataaagaattcttcattatcgatgaggctcggcatggaaagaacatcgaaaactgccatgtgccctggtgtgcccaccacctgtgcaggaataatggcacttgtatctcagataacgagaatttgttctgcgaatgtccccgattgtattctggtaagttgtgccagttcgcaagttgtgagaacaatccttgtggcaatggcgcaacctgtgtcccaaaatctgggactgacatcgtgtgtctgtgcccctatggaagatccggacctctgtgtactgacgctataaacatcacgcagcctcggttctctggcacagatgcgtttgggtatacttcctttcttgcatactctcgaatctccgacataagcttccactacgaatttcaccttaagtttcagctcgctaataaccacagtgctttgcagaataacctgattttctttaccggacagaaaggacacggactcaacggtgacgatttcctggcagtagggcttctcaatggaagtgttgtatattcttacaatcttggaagcggaattgccagcattcggtcagaacccctgaatctgagcctgggggtccacactgtgcaccttgggaaattcttccaggaaggttggttgaaagtcgacgaccacaagaataagtctatcatcgcccccggcagacttgtaggcctcaatgtcttttctcaattttacgtgggcgggtactctgagtacacacccgaccttctgcctaacggcgccgactttaagaacgggtttcagggatgcattttcaccctacaggtgcgaactgaaaaggatggtcactttagagggttaggaaaccctgagggccatccaaacgccggacgctctgttggacagtgtcatgccagtccctgtagcctaatgaagtgcggcaatggcggcacctgtatcgagagtgggactagtgtatactgcaattgcaccacagggtggaagggtagcttttgcacggagaccgtgagcacatgtgatcctgaacacgaccctccccatcattgcagtcggggcgcaacctgcatcagccttccacatggctacacctgtttttgccccctggggacgaccggcatctactgcgagcaagcgctttctatctctgacccttccttccggtcaaatgagttgtcatggatgagcttcgcatcgtttcacgtgagaaaaaaaacccacatacagctgcaatttcaaccactggccgcggatggcatactattttacgctgctcagcatttaaaggcacagagcggcgatttcctctgtattagcttagttaattcctccgtccagcttcgttacaatcttggcgatcgcacaataatcctagagaccctgcagaaggtaacgataaatggctccacttggcatataataaaagcagggcgtgtgggtgccgagggatacttggaccttgatggcatcaatgtcaccgaaaaggcctcaacaaagatgtcttctttagatacaaatacagacttctatatcggaggtgtatcatctcttaaccttgtgaaccccatggctatcgagaacgagccagtgggcttccagggttgtattaggcaggtaattattaacaatcaagagttacagctcactgaatttggcgccaaaggcggatctaatgttggcgactgtgatgggactgcttgcggctacaatacttgcaggaacggaggcgaatgtacggtgaacggaactacattttcctgtcgttgtctgccagattgggcaggtaatacatgtaatcaaagcgtctcatgcctcaacaatctgtgtctccaccagagtctgtgcataccagaccagtcctttagctattcttgtttgtgcacccttggatgggttggcagatattgtgagaataagacctctttctcaacagctaagttcatgggaaacagttacattaaatatatcgaccccaactaccgaatgcggaacttacagttcacgacaatctcattgaatttttccactaccaaaacagaagggctaatagtttggatggggattgctcaaaatgaggaaaatgactttctagccatcggccttcataaccaaactttgaagatcgccgttaacctcggggaaaggatttcagtccccatgagctacaacaatggaaccttttgttgtaataaatggcatcatgtggttgtgatccagaaccaaacacttattaaagcctacattaacaattccctgatcctttcagaggacatcgaccctcacaagaactttgtggctctgaactacgacggtatttgctatttaggtggatttgagtacgggaggaaggtcaatatcgttactcaggaaatctttaagacaaactttgtcggtaagataaaagatgttgtattttttcaagaacctaagaatatcgagttaatcaaattagagggttacaatgtgtacgacggagatgagcaaaatgaagtcacatag

SEQ ID NO: 187296 - DNA, 1785 bp, Artificial Sequence
  Description of Artificial Sequence: Synthetic coding sequence
atgaccgacaagagcatcgtgatcctgagcctgatggtgttccactcaagcttcattaacggcaagacctgcagacgccaactagtggaggagtggcaccctcagcctagcagttacgtggtgaactggacattaaccgagaatatttgcttggacttctaccgagattgttggttcctgggggttaacactaagatagacacatctggaaaccaagccgttccccaaatttgcccattgcagattcagttgggcgacattctggtcatttcctctgagcccagtttgcagttcccagagatcaacctgatgaatgtgagcgagacaagtttcgttggatgtgtacagaatacaaccacggaggatcagctcctgttcggatgtcggctgaagggtatgcacacagtgaattcaaagtggctcagcgtcgggactcattacttcatcacagtgatggccagcgggccaagcccatgccccctcggattgcgactaaacgtgaccgtgaagcagcagttttgtcaggagtccctgagcagtgaattttgctccggccacgggaagtgtcttagtgaggcttggtccaaaacctatagctgccactgtcagccacctttttctggcaagtactgccaggaattggacgcttgttcattcaagccgtgcaagaacaatggtagctgtatcaacaagcgagagaactgggacgagcaggcatacgagtgtgtctgccacccgccttttactggcaagaattgctccgaaatcattggacagtgtcagcctcatgtctgttttcacgggaactgtagcaacataacgtccaattcatttatatgcgaatgtgatgagcagttttccggccccttctgtgaggtttcagctaaaccttgtgtttccctcctcttctggaagagaggaatctgcccaaattctagttctgcctacacatatgagtgtcctaaggggtcctcaagtcaaaatggtgaaacagacgtctctgaattctctttagtcccgtgccagaatggaactgactgtatcaaaatcagcaacgacgtgatgtgcatttgctcaccaattttcacagacctgctgtgtaagtctattcagacgtcttgtgagtccttccccttgcgaaataacgccacttgcaagaagtgcgagaaggactacccttgcagctgcataagtggtttcactgaaaaaaactgcgagaaagccatagatcactgtaaacttctctcaatcaattgcctgaatgaggaatggtgcttcaacatcatcggcaggttcaagtatgtgtgcattccgggctgcaccaagaacccttgctggttcctgaagaacgtgtatctcatccatcagcatctctgctactgtggtgtgacattccatggaatttgccaggacaaaggccccgcacaatttgagtacgtgtggcagctaggatttgccgggagtgagggcgaaaagtgccagggagtaattgatgcctatttctttctcgccgccaattgcacagaggatgctacatacgtaaatgatccagaagacaataatagctcttgttggttccctcatgaggggaccaaggaaatttgtgctaacggctgctcatgtttgagcgaggaagattcccaggagtacaggtatctgtgcttcctccgctgggccggcaatatgtacctagagaacactaccgacgatcaggaaaatgaatgccagcacgaggcggtatgcaaggacgagatcaataggccccgttacctctgcataatttag

SEQ ID NO: 187297 - DNA, 1860 bp, Artificial Sequence
  Description of Artificial Sequence: Synthetic coding sequence
atgaccgacaagagcatcgtgatcctgagcctgatggtgttccacagctcgtttatcaatggcaagacctgtaggaggcagttggttgaggagtggcacccccagccaagcagctatgtagtaaactggaccctcactgagaacatttgcctggatttctacagagattgctggttcttgggcgttaataccaaaattgacacttcaggcaatcaagcagtccctcagatctgtccgctgcaaatccagttgggggacattcttgtcatctcatcagagccctcactccagttcccagaaattaatctcatgaacgtctctgagacgtcttttgtaggatgcgtgcaaaacaccactaccgaggaccaactcctgttcggatgcagactgaaggggatgcacaccgtcaattcaaagtggctgtctgttggaacgcactattttatcactgttatggcgagcggaccctcaccttgcccccttgggctgcgacttaatgtcaccgttaaacagcagttctgccaggaaagcctatcaagcgagttctgcagcggacacggcaagtgtttatcggaggcgtggtcgaagacgtacagctgtcactgtcagcctcctttcagcggcaagtattgtcaggaactggatgcctgtagctttaaaccctgcaagaataatggcagctgtatcaacaagcgcgagaactgggatgaacaggcatatgagtgcgtttgtcatcccccctttacaggaaagaactgtagtgagattattggacagtgccagccacacgtgtgtttccacggcaattgttcaaacattacctcaaattccttcatctgcgagtgtgatgaacagtttagcggccccttctgtgaggtttccgctaagccctgtgtaagcctcctgttttggaagcggggtatatgcccaaatagctcctctgcatacacctacgaatgtccaaagggcagcagttcacagaacggcgaaaccgatgtgagtgaattctcactggtgccttgtcagaatggaaccgattgcatcaaaatcagcaacgatgtgatgtgcatttgttcgcctatattcactgaccttctgtgcaagtcaatccaaacctcctgcgagagttttccgcttagaaacaacgctacgtgtaaaaagtgtgagaaggactacccttgttcctgcatttctggttttacggagaagaactgtgagaaggcgatcgaccactgtaagctgttgtccatcaactgcctgaatgaggagtggtgcttcaatattatcggccgctttaaatacgtgtgtatccctgggtgcactaagaacccgtgctggtttctgaaaaatgtatatctgatccatcaacatctgtgctattgtggcgtcacctttcatgggatctgtcaggacaagggtcctgcacagtttgagtacgtctggcaactgggcttcgctggatctgaaggggaaaagtgtcagggagtcatcgacgcatactttttcctcgccgccaactgcactgaggacgctacctacgtgaatgaccccgaagataataacagtagctgttggttcccccatgaaggcactaaggagatctgcgccaatggctgcagttgcctatcagaggaggatagtcaggagtatcggtatctttgctttctaagatgggcaggtaacatgtatctcgaaaacactacagatgaccaggaaaatgagtgtcaacatgaagctgtttgcaaagatgagataaatcggccacgtcgtatcctgaacacggttattccacatcagatccagcagcatatagagcggtttatccagcacgaccaggtcggcttcattgtgagaatctag

SEQ ID NO: 187298 - DNA, 1764 bp, Artificial Sequence
  Description of Artificial Sequence: Synthetic coding sequence
atgggctgggacctgggcacccggctgttccagcggcaggagcagagatccaggctgtccagaatttggctggaaaagaccagagtgttcctggaggggagcacacggacaccggctctccctcactgtctgttctggttactgcaggttccatcaacacaggatcccctgtttcccggttatggaccacagtgtccggtggatctggccggtcctccttgcctgagacctttattcgggggccttgggggttattggagggcattacaaagaggtagggaggggcgtactatgacctcgcgcgcgtctgagttatctccaggtagatctgtaaccgccgggattattatagtgggtgatgaaatcttgaagggccatacacaggacacgaataccttttttctctgtagaactctccgttctctgggcgtgcaggtgtgccgggttagtgtggtcccggatgaggtggccacaatagcagcagaggtcacctctttctctaaccgattcacgcatgtgctgactgctggtggtatcggcccaacgcacgatgacgttaccttcgaggccgtggcccaagcatttggggacgagttgaaaccccaccctaagctggaggcggccaccaaggccctgggcggtgagggatgggaaaaactgtctcttgttccgtcgtcggctagactgcactacggaaccgacccatgcacgggccagccttttaggttccccctagttagtgtgaggaacgtatatctattcccggggattccggaactactgcgccgcgttctggaaggcatgaaaggcctgtttcagaatccagctgtacagtttcacagcaaggaactgtatgtcgctgctgatgaggcaagcattgcgcccattctggctgaagcgcaggcccacttcggacggcggcttggcctgggctcctaccccgattggggcagcaattactatcaggtgaaattgacccttgacagcgaagaagagggccccctcgaagaatgcctagcgtacttgaccgctcggttgcctcaaggtagccttgtgccatacatgccaaacgcagtcgagcaggcttccgaggccgtgtacaaactggctgagagcggcagcagcctggggaagaaggtcgctggtgccctgcaaacaatcgagacttctctggctcaatacagtctcacacaactgtgtgttgggtttaacggaggcaaggactgcacagctctattacacctgttccacgccgcagtacagcggaagctgccagacgtccccaatcctctgcagattctctacattaggtctatttctccatttccagagctggaacagttccttcaggacacaatcaaacggtataacctacagatgctagaagcggaaggctccatgaaacaagcgctcggtgagctgcaggctagacatccccaattggaagctgtgctcatggggacgcgtcgaaccgatccatattcttgtagcctctgtcctttctctcctaccgaccccggctggccagctttcatgaggataaaccctctgctggattggacatacagggatatctgggacttcctgcgtcaattattcgtgccctattgtatactctacgatagaggatataccagtctggggagcagagaaaacactgtgagaaacccggcccttaaatgtctgagccctggcggacaccccacttatcgcccggcctatctgttggagaatgaggaagaggaaagaaatagccggacttag

SEQ ID NO: 187299 - DNA, 513 bp, Artificial Sequence
  Description of Artificial Sequence: Synthetic coding sequence
atgaagggcctgttccagaaccccgccgtgcagttccacagcaaggaactctatgtggccgcagacgaagcatcgattgcgcctattctagcagaggcacaggcccattttgggaggcggctaggactgggcagctaccccgattggggttcaaattactaccaagttaaattaaccctggactccgaggaggagggtcccctggaggagtgtctggcctacctaacagcccgcctacctcaaggctctttagtgccatacatgccaaatgcggtcgaacaagccagcgaggcggtgtataaactcgcagaatcggggaattacctgatgtttcagacaccatctagaagctgcatcagtgccgcttctcctctcagcctttcctggaattccttctaccgcacgctgtctcgagagcaagccatcccggaaaaccaaattgccagccctccctctgaggccaagggcgccgaggagccatggatggggccttttccagggcagcagggttag

SEQ ID NO: 187300 - DNA, 1473 bp, Artificial Sequence
  Description of Artificial Sequence: Synthetic coding sequence
atgaccagccgggccagcgagctgagccccggccggagcgtgaccgccgggatcattatcgtgggcgacgaaattctcaaaggtcacactcaggacacaaacacattttttctctgccgaactttgagatccttaggcgtgcaggtgtgcagagtttcggtggttcctgacgaagtggccaccatcgccgcagaggtaaccagcttttccaacaggttcactcacgtgctcacagccggtggtatcggccctacgcacgacgacgtgacattcgaagccgttgctcaggcatttggagatgaactcaaacctcatcccaagctggaggccgcaactaaggcgctcggcggcgagggttgggaaaaattaagcttagtacctagttctgcacgcctgcactacgggactgacccttgcacgggccagcccttcagattccccctcgtgtctgtgcggaacgtgtacttgttccccggtattcctgagctgctgagacgcgtgctggagggaatgaaagggctctttcaaaatccagccgtccagttccacagtaaggaactctatgtggctgccgacgaggctagcattgcaccgatactagctgaggcccaagcacactttggtcgtaggctcggactcggctcatatcctgattgggggtctaattattaccaagtcaagctcacgctcgacagtgaggaggaaggccctctggaggaatgcctcgcatacctgacggcgagactgcctcagggctcccttgtcccgtacatgccaaacgctgttgaacaagcctcagaagctgtgtacaagctcgccgaatctggatctagcttggggaagaaggtggccggggccctacaaactatcgaaacttctctggctcagtacagcctcactcagctctgcgtgggcttcaacggcggcaaagattgtactgccttactgcatctgtttcatgctgcggtgcaaagaaagctccctgacgtgccaaaccccttgcagattctgtatattaggtctatctctcccttccctgaattagagcaatttctgcaggatacgataaagaggtataatctgcaaatgttggaggcggagggctccatgaaacaggccctgggagagctccaggcacgacacccccagctggaggcagtgttgatgggaacaaggagaactgatccttattcatgctcactgtgcccattttcccctacagaccccggttggcccgcttttatgagaatcaacccactgctggattggacgtatcgcgatatctgggacttcctcagacagctcttcgtgccctattgcatcctttatgacagggggtatacctccttaggcagccgggaaaataccgtgcgcaaccccgccctaaaatgcctgtctcccggggggcaccctacatatcgccccgcgtatttgttagagaacgaggaagaagagaggaactctcgtacctag

SEQ ID NO: 187301 - DNA, 387 bp, Artificial Sequence
  Description of Artificial Sequence: Synthetic coding sequence
atgctggaggccgagggcagcatgaagcaggccctgggcgagctgcaagctcggcatccccagctcgaggctgtccttatggggacccgacgaacagacccttattcttgttcactttgccctttttcgcctacagacccagggtggcccgcctttatgcggataaatcccttgttggattggacctatcgggacatttgggacttcttgagacagctttttgtgccttattgcatactatacgaccgcggctacacttctctgggttctcgagagaatactgtgagaaatcccgccctgaagtgcctctcccccggtggacatcccacatatcgtcctgcgtacttgcttgaaaacgaagaggaggaacggaactctcgcacctag

SEQ ID NO: 187302 - DNA, 885 bp, Artificial Sequence
  Description of Artificial Sequence: Synthetic coding sequence
atgcagcccagcagcagcaccccccccctgcacccctacagcaccgatggattgatatttccctttaatcctcagggccacactcaggatactaacacgtttttcttatgtcgaacactccgttcactcggcgtgcaagtttgtcgcgttagcgtcgtccctgatgaagtcgctaccatcgccgccgaggtgacttctttctccaacaggttcactcacgtccttactgcagggggcataggtcccacacacgacgacgtgactttcgaggctgtggcccaggcattcggggacgagcttaagccgcatccaaaactggaggcggccaccaaagcattggggggggaaggctgggagaagctgtcgctggttcccagtagtgctcgcctgcactatggaacggatccttgtacagggcagcccttccggttcccccttgtctctgtcaggaacgtctacttgtttcctggaattcctgagctgctccgccgggtgttggagggcatgaagggactgtttcagaatccagcagtgcagttccacagcaaagagctgtatgtcgctgccgatgaggcgtctatagcccctatcctcgcagaagcacaagctcatttcggcaggaggttgggcctggggagctatcctgactgggggtccaactattatcaggtgaagcttactctggacagcgaggaggagggtcctctggaggagtgtctcgcttacctgaccgctaggctgccccaaggctctcttgtgccatatatgccaaacgccgtggaacaggcttcagaagcggtctacaagctggcagagagtggcagagacctgatggaggaggggcactacgcccagtcccactggtggcatcccaggtcacaatag

SEQ ID NO: 187303 - DNA, 1341 bp, Artificial Sequence
  Description of Artificial Sequence: Synthetic coding sequence
atgaccagccgggccagcgagctgagccccggccggagcgtgaccgccggcatcatcattgttggggatgagattctaaaggggcacacccaggataccaacaccttttttctgtgtcgtacacttaggtctctcggcgtccaggtgtgcagagtctcagtggtgccagacgaagtcgctactatagctgcagaagtgacgagctttagtaacaggttcacccatgtgcttactgcgggcggcattggcccaacgcacgacgacgtaacgttcgaggcggtagctcaggcatttggggacgaactgaaacctcatccaaagttggaggcggccaccaaggccttgggcggagagggctgggaaaagctcagcctcgtcccaagttctgcaagactccattacgggacagatccttgtactggccagccattcaggtttcccctagtgtctgtccgtaatgtctatctattccccggaatccccgagctactgagaagagtcctcgagggcatgaagggcttgttccagaatcccgcagttcaatttcactcaaaagagctgtatgtggcagcggatgaggcgagtattgctcccattctggctgaagcccaagcgcactttggccggcgcctgggactcggcagctaccccgactggggaagcaattattaccaggtcaaactgactttagattctgaggaggaaggacctctggaagagtgccttgcgtatctaaccgcaagactgcctcagggctctctggtaccatatatgccaaatgctgtcgagcaggcttccgaagcggtgtataagctggcagaatccggttcttctctcggaaagaaagtcgctggggctctccagacaatcgaaacctctctggctcagtacagcctcacgcagctctgcgtaggctttaacgggggtaaagattgtactgccttacttcatctgtttcacgctgcagtccagagaaaactcccagatgtgcccaatcctttacagattctgtacatcagatctatttcccccttccctgaattggagcaatttctgcaggatactattaagcggtataatctgcagatgctggaggcagagggttctatgaaacaagcactaggcgagctccaagcccgacatccacagctcgaagcggtccttatggggactcgacgaactgatccatactcatgtagcctgtgtccattctcacctacagatcccggctggccagccttcatgagaattaacccactcttagactggacatatcgggacatatgggatttcttgcggcaactgttcgtgccttactgtatcctgtatgaccgaggctag

SEQ ID NO: 187304 - DNA, 1371 bp, Artificial Sequence
  Description of Artificial Sequence: Synthetic coding sequence
atgggctgggacctgggcacccggctgttccagcggcaggagcagagaagcagactctcaagaatttggctggagaaaactcgagtgttcctggagggaagcacgaggacccccgccctgccccattgcctgttttggctcctgcaggtgccctcaacccaggaccccctcttccccgggtacggacctcagtgtcccgtcgaccttgctgggccaccttgtctgaggcctctatttgggggattgggggggtactggagagcgttacagcgtgggagagagggcagaactatgacgtcccgtgcatctgagctgtcacccggcagatctgtcaccgctggcattattatcgtcggagatgaaattctaaaaggccacactcaggacacaaataccttcttcctgtgccggacactgcgctcactgggggtgcaggtctgtagagtttccgtcgtgcccgacgaagttgccaccatcgctgctgaagtgacatctttctctaaccgcttcacacatgttctgacagccgggggaattgggcctacacatgacgacgtgacgtttgaagcagtggcccaggctttcggggatgagctgaagccccatcctaagctcgaggccgccactaaagccctgggaggggagggttgggaaaagttgtcccttgtcccatcttcggccagacttcactacggcaccgacccttgtactggccagccatttcgctttcccctggttagtgtgcggaacgtatacctattccccggcatccctgagctgctgcgcagagtgctggagggcatgaagggcctgtttcaaaaccccgccgtccagtttcactccaaggaactgtatgtggcagccgatgaggctagtatcgcccctatcctcgcggaagcacaagcacacttcggtcgacggctgggcttgggctcctatccagattggggcagcaattactaccaggtgaaactgacactggactctgaagaggaaggcccactggaggaatgcttggcctatcttaccgcccgtttgccccagggtagcctcgtcccatatatgcccaacgctgtggagcaagcctcagaagccgtttataagcttgcggagtccggttcctctctagggaaaaaggtggccggggcactgcagaccatcgagacttccttggcgcagtatagtctcacccaactctgcgtcgggttcaacgggggtaaggactgcactgccttgctgcatctcttccacgccgccgtgcaaagaaaactccccgatgttccaaaccctctgcaaatcctctatattcgtagtatctcccccttccccgaactggagcaattcctgcaggatacgatcaaacgctattag

SEQ ID NO: 187305 - DNA, 1017 bp, Artificial Sequence
  Description of Artificial Sequence: Synthetic coding sequence
atgcagcccagcagcagcaccccccccctgcacccctacagcaccgacggactgatattccccttcaacccccagggtcacacccaagacaccaacacctttttcctatgtagaacgttgcggtccctgggcgtgcaggtgtgtcgagtgagtgtggtgcctgacgaagttgctactatagccgcagaggtaacgtctttctcgaatcggttcactcacgtgttgacagcaggtggcatcggccccacacacgatgatgtgacatttgaggccgttgcacaagcgttcggggacgaactgaagcctcatcccaaactcgaagcagctaccaaggcgctcgggggggaagggtgggagaagttatcattggtgccctccagcgcaaggttacattatggaactgacccttgcacgggccagcccttccgattcccacttgtgtctgttcggaatgtgtatctgttccccggcatccccgagctccttagacgggtcctcgagggaatgaagggtttgttccaaaatcctgctgttcagttccatagtaaggagctctacgtggccgctgacgaggcctcaattgctcctatcctggcagaagcccaggcccacttcgggaggcggctcggtctgggtagctacccagattgggggtccaattattatcaggtgaagctcactttagactccgaagaggagggcccactggaagaatgcctggcctacctgacggcccggttaccccaaggctctttagtgccctacatgcccaatgctgtcgaacaggccagcgaagcggtctataagctcgccgagtctggcaactatctgatgttccagacccccagcaggtcctgtatttccgccgcgagccccctaagtctgtcttggaattccttctataggacactgtccagggagcaggccatcccggagaatcaaattgcgtccccccccagcgaagctaagggggccgaggagccttggatggggcccttccccggccagcagggctag

SEQ ID NO: 187306 - DNA, 1461 bp, Artificial Sequence
  Description of Artificial Sequence: Synthetic coding sequence
atgatccggcgggtgctgccccacggcatgggccggggcctgctgacacggcggcctggcacgaggcgggggggcttctctctggactgggatggcaaagtctccgagattaaaaagaagattaaaagcattctcccgggaaggtcttgcgacctgttgcaggataccagtcatctgcctcccgagcactctgatgttgtcatagttggcgggggagtcctcggactgtccgttgcttactggctgaagaaactcgagtcgcggcgtggcgccatcagggtgttggtggtagaaagagatcatacatactctcaggcttctactggcctgtcagtcggcggaatctgtcaacaattcagtctgcccgagaacatccagctgagcctgttctcagccagctttctgcgaaacatcaacgaatatctagccgtcgtggacgcccctcccctcgacctgcgatttaatcccagcgggtatctgctgctcgcatcagaaaaggatgcagcagctatggagagtaatgtgaaggtgcagaggcaggaaggggcaaaggtctcactgatgagccctgaccagcttcggaacaagttcccatggataaataccgagggagtggccctggcctcctacggtatggaggacgaggggtggtttgacccgtggtgtctactgcagggtctccggaggaaggtacagtcgcttggcgtgttattctgtcagggcgaagtaacacggtttgtgtcctccagccaacggatgctaacaacggacgataaagccgttgtcctgaagagaatccatgaagtacatgtgaagatggaccgatcacttgagtaccaacctgttgaatgtgctatcgtaatcaatgctgctggagcttggagcgcccagattgcagctctggcaggggttggagagggccctcctggtaccctacagggcaccaaattgccggtcgagcctcggaaaaggtacgtgtacgtttggcattgtccacaaggaccagggctcgagacaccgttggtcgccgataccagcggggcttatttcagacgagagggcttaggttcgaactacctgggcgggcgctctcctacggaacaggaggaacctgaccccgctaacctggaggtggatcacgatttcttccaggacaaagtgtggcctcacctggccctgcgggtccccgcgttcgaaaccctgaaagttcaatccgcctgggctggctactacgactacaataccttcgatcagaacggtgtggttgggccacatccactcgtagtgaacatgtattttgccactggcttcagtggacacgggctgcagcaggcccccggcattggcagggcggtcgctgaaatggtgctgaaaggaaggtttcaaaccatcgatctttcacccttcctgttcacacgattctatcttggcgagaagatccaagaaaataacataatatag

SEQ ID NO: 187307 - DNA, 951 bp, Artificial Sequence
  Description of Artificial Sequence: Synthetic coding sequence
atggagagcaacgtgaaggtgcagcggcaggagggcgccaaggtgtctctgatgagccccgaccagctgcgtaataaatttccctggataaacacagagggggtggcccttgcctcctacggaatggaagatgaaggttggtttgacccgtggtgcctgctgcaggggcttagacggaaggtacagagtctgggagtactgttctgtcaaggtgaggtcaccaggtttgtgtctagctctcagcggatgcttaccaccgacgataaagccgtggttttaaagaggatacacgaagtccacgtcaaaatggataggagcttggagtaccagccagtggaatgcgccattgtgataaatgcggctggagcatggtccgcccagattgccgctctggcaggcgtgggagagggaccgccaggtaccctgcagggcactaagctgccagtcgagccgagaaaacggtacgtctatgtgtggcactgcccacagggcccaggccttgaaactccactggtcgccgatacttccggcgcatactttcgccgggaggggttgggtagcaattatctggggggacgctcccctacagagcaagaggaacccgatccagccaacctcgaggtggatcacgacttcttccaggacaaagtgtggccacaccttgctcttagagtgcccgcttttgaaaccctgaaagtgcagtcagcttgggcaggttactacgattacaacactttcgaccaaaatggggtcgttgggccacaccctctggtggttaacatgtatttcgccacaggcttcagcgggcatggtttgcagcaggctccaggtatcgggcgggccgtggctgagatggtcctcaagggccgcttccagaccatcgacctgtctccattcctgttcacgcggttctatctgggcgagaagatacaagagaataacataatttag

SEQ ID NO: 187308 - DNA, 1419 bp, Artificial Sequence
  Description of Artificial Sequence: Synthetic coding sequence
atggcccacaccggccggaccgtgggccggctgggcgagggcgactgggacggaaaagtcagcgagattaagaagaagatcaagtccatcctgccaggacgaagttgcgatctgctacaagacacatcccatctgcccccagaacactctgatgtggttatagtgggcgggggcgtcctgggtctcagcgtcgcttactggctcaagaagctcgagtcccggagaggcgccatcagggtgctcgtggtcgagcgcgaccacacatattcgcaagccagtacagggttatcggtcgggggcatttgccagcagttttctctcccagaaaacatacaattgtctctcttctcagccagcttcctacggaatatcaatgagtacttggcagttgttgacgctccccctcttgacttacggtttaacccttccggataccttctgttagcctcagaaaaagatgctgctgccatggagagtaatgtgaaggttcagcggcaggagggggctaaggtgagccttatgtcccctgatcagctccgcaacaagtttccatggattaataccgagggcgtcgcactcgccagctacggaatggaggatgaaggctggtttgacccctggtgtctgctccaagggctgcgacgaaaggtgcagtctctgggcgtgctattttgccaaggggaagtgacgcgctttgtcagtagcagtcaaaggatgcttacgaccgatgacaaagctgtcgtcctgaaacgcatccatgaagttcacgtcaaaatggacaggagcctggagtatcaaccggtcgagtgtgctatcgtcataaacgccgccggcgcctggtctgcacagatcgcagccctggcaggagtgggggaaggaccacccggcactctgcagggcacaaagcttccagtggagcctagaaaacggtacgtgtacgtgtggcactgcccacaaggacccggcttggagacccctctggtggccgatacgagtggcgcatattttagacgggaaggcctgggctcaaattatctgggaggacgtagcccaactgagcaggaggagcctgatcctgcaaatctcgaggttgaccacgatttcttccaggacaaagtgtggccacatctggctctccgggtccccgcattcgaaactctaaaggtccagagcgcatgggcgggttattatgattacaacactttcgatcagaacggggtggtgggaccacatccgctggtcgtaaatatgtactttgcgacaggattcagcgggcacggattgcagcaggcccccgggatcggtcgtgcagtggcggagatggttttaaagggacggttccaaaccatcgatctgagcccatttctcttcacccgcttttaccttggcgagaagattcaggaaaataacatcatctag

SEQ ID NO: 187309 - DNA, 501 bp, Artificial Sequence
  Description of Artificial Sequence: Synthetic coding sequence
atggcccagcggctgctgctgcggcggttcctggccagcgtgatcagccggaaaccttctcagggacagtggcctccactgaccagccgcgcattacagacaccacagtgtagccccggcggattgactgtgacaccaaatccagcccgtactatttacacaaccagaatcagcctgactacctttaacatccaagacggccccgactttcaggaccgcgtagtcaactcagaaacccctgtggttgtcgacttccacgcacagtggtgcggcccttgtaaaattctcggaccccgcctcgaaaagatggtcgctaagcagcatggaaaggttgtgatggccaaggttgatatcgacgaccatacagacctggctatcgaatatgaagtctcagccgtgcctacggtactggctatgaagaatggagatgtggtggacaaattcgtgggaatcaaggacgaagaccagcttgaagccttcctaaaaaagctgatcgggtag

SEQ ID NO: 187310 - DNA, 2055 bp, Artificial Sequence
  Description of Artificial Sequence: Synthetic coding sequence
atgggcctgagcgccgccgcccccctgtggggcccccccggcctgttacttgcgattgccctgcacccggctctgtcagtcccacctcgcagggactactgtgtgctcggtgccggccctgccgggctgcagatggcttacttcctccagcgcgcgggtagagactatgcagtgttcgaaagagccccgagacctggctcattctttactcgctacccgagacataggaagctgataagcatcaacaaacgttacaccggtaaggccaacgccgagtttaacctgcggcacgattggaatagcctgctgagccatgaccccaggctgctgtttagacactacagtcgagcgtattttcctgatgcccgggacatggtgcggtacttgggcgattttgcagataccttgggactgagggtgcagtacaatacaaccattgcacacgtgactctggacaaggatcggcaagcttggaacggccactacttcatcttgacagatcagaaagggcaggtgcatcagtgcagcgtcctttttgtagctacaggactgagcgtgcctaatcaggttgacttccccggctcggagtacgcagagggatacgagtccgtatcagtggatcctgaagattttgtggggcagaacgtgttgattttaggccgtggcaactctgccttcgaaactgccgaaaacatcctgggggtgacgaacttcattcatatgctgagccggagccgcgtgagactatcttgggcgacacactacgtaggggatctgagagctatcaataatgggctgttggatacataccagctgaagagcttagatggcttgctcgagagcgatctgacagatctggcaattctgaaggactcaaaaggtaagttccatgtcacacctaaattctttctcgaagaagccaacaccaaccagagcgctgattctattaccttgcctcaggatgacaacgacaattttgcgatgagagtgccttacgatagggttattcgttgcctcggatggaatttcgatttttccatctttaacaaatccctgcgccttaacagtgggaacgcctttgggaagaaatatcccctcatccgggcaagctatgaatccaagggctcccgaggattgttcattctgggcaccgcctcccacagcgtcgattacaggaagtctgcgggaggttttattcatggctttcgttataccgttagagccgtgcacagattgctggagcataggcatcacagtgtaacttggcctgctacagagctgccaattacgcagttgaccagctccatcgtgcggagggttaatgaggcgtctggtctgtatcaaatgttcggggtgcttgccgacgtaatcctcctgaaggaaaacagcactgccttcgaatacctggaagagtttcctattcagatgctcgcacaactcgagacacttaccggccgaaaggccaaacatggtctttttgtcatcaatatggagtacggccgcaacttctccgggcctgataaagacgtgtttttcgacgaccggtccgttggtcatactgaagacgcctggcagagcaatttcctgcacccagtgatctactactataggtacttgcctaccgagcaggaagtccggtttcgccctgcgcattggccacttccgcggccaactgcaattcatcacatcgtggaggattttctaaccgactggactgccccaatagggcacatcctaccactaagacgcttcctggagaactgcctggacaccgacttgaggagcttctatgccgagtcatgtttcctattcgccttaacaaggcaaaaattgcctcctttctgccagcagggatacctgagaatgcagggtctggtctctaccgagagcctctggcaacaccgtgtggaaagtagactgctcagagattatgcccccaccggaaggcgcctggaagattccagtcagcagctgggcgaccaggagcctctgggttctcctctggcgcccggtccactggcccagagtgtggactcgaacaaggaggagctttag

SEQ ID NO: 187311 - DNA, 2055 bp, Artificial Sequence
  Description of Artificial Sequence: Synthetic coding sequence
atgggcctgagcgccgccgcccccctgtggggcccccccggcctgctgctagcaatagcattacatcctgccctgtctgtcccgccacgtagagattactgcgtgctgggcgctgggcccgccgggctccagatggcgtacttcctgcagcgagctgggagggattacgcagtctttgagcgcgcccctaggccaggtagtttttttacccgatatcctaggcataggaagctgatctcaatcaataagagatatactggaaaggccaacgccgagttcaacctgcgccacgattggaactccctgctgtctcatgaccccaggctcctatttaggcattactccagagcttacttcccagacgcccgagacatggtccggtacctcggcgatttcgctgataccctgggccttcgggtccagtacaacaccaccattgcccacgtgacactggacaaagatcgccaagcatggaatgggcactatttcatcctaaccgatcagaaaggccaagtacaccagtgtagcgtactgttcgtcgccacagggctatccgtcccgaaccaggtagactttcccggaagcgagtacgctgagggctacgagagtgtctcagtcgatccggaagattttgtcggacagaatgttttaatcttggggaggggcaattccgccttcgagactgcggaaaatatcttgggtgtgacaaacttcatccacatgcttagtcgttccagggtccggctgagctgggccacacactacgtcggagaccttagagctataaataatgggcttctggatacttatcaactcaaaagtttggatgggcttttagagagtgatctgacagatctcgctattctaaaagatagcaagggaaaattccatgtgacacccaagttttttcttgaggaggccaacacaaatcagtcagctgactctatcacccttccacaggatgacaatgacaatttcgctatgagggttccatacgaccgggtgattagatgccttggctggaattttgatttttccattttcaataagtctctccgtctgaattccggcaatgcttttgggaagaaatacccactgatcagagcgagctatgagagcaaagggtctcgagggctgttcatcttagggactgccagccactccgtggactacaggaagagcgcaggtggcttcatccacggctttcggtataccgtgcgtgccgtgcatcgcttgctcgaacaccgccaccactccgtgacttggcctgccacggagctgcccatcacccagctaacctcatccatcgtgaggcgggtcaatgaagcaagtgggctgtaccagatgttcggggtgcttgccgacgtgatcctcctcaaagagaacagtacggcgtttgagtatctcgaagagttccctatccagatgctagcccagctggagacactgaccggccgcaaagctaagcatggactgttcgtcatcaacatggaatacgggcgcaatttctccggacctgataaggatgtcttctttgacgatcggtctgttgggcacactgaagacgcatggcagagtaatttcctgcaccccgtaatctactactaccgctatctgcccacagaacaggaggtgagatttaggcccgcacattggccattgcctcgaccaacggcaatccatcatatagttgaagatttcttgaccgactggactgctcctattgggcatatactgccactgagacggttcctggagaattgtttagacaccgaccttcgtagcttctacgccgagtcatgctttcttttcgccctcacccggcagaaacttcctcctttttgccagcaggggtatctgaggatgcagggactggtcagtacggagtccctctggcagcacagagtggagtctcggctgcttagggactatgcccccactggacggagactcgaggactcatcacagcagctgggcgaccaggaacctcttgggtcacccctggccccaggtcccctggcccagtctgtggattccaacaaggaagaactgtag

SEQ ID NO: 187312 - DNA, 261 bp, Artificial Sequence
  Description of Artificial Sequence: Synthetic coding sequence
atgggcctgagcgccgccgcccccctgtggggcccccccggcctgctgcttgccattgcgttacaccccgccctttcagtccctccgcgcagagattactgcgtgctcggggctggccctgccggattacagatggcttatttccttcagcgcgccggcagagattacgcagttttcgaacgagccccccggcctggttcctttttcacacgttatccccgtcaccggaagcttattagcatcaacaagcgttatacctag

SEQ ID NO: 187313 - DNA, 729 bp, Artificial Sequence
  Description of Artificial Sequence: Synthetic coding sequence
atgttcctgctgagcggcgacccctgcttcaagaccccccccagcacagccaagtctatttctattcccggtcaggactcatctctgcagctcacttgtaaaggaggcggaaccagcagcggcggaagctcaactaactcacttactggctcccggcctccaaaagccaggccaaccatacttagtagcggtctgcctgaggagcccgaccagaacctcagctcccccgaggaggtttttcactctgggcactctaggaattcaagttatgcgagccagcagagtaaaatcagtggatactcaaccgagcactctcgttcgtcaagtctgtccgatctgacccacagacgcaacacgtcaacttccagctcagcaagcggtggattagggatgactgttgagggacccgaaggctcggagagggagcatcgccccccagagaagccgccgagaccaccacggccgttacacctcagtgatcgctcctttcgccgcaagaaagacagcgttgagagccatcccacttgggtggatgataccaggattgatgctgacgccatagttgagaagattgttcagtcccaggacttcactgacggcagcaacacagaggactcaaacctgaggctcttcgtttctagagacgggtccgctaccttaagtggcatccagctggcgacccgtgtgagttccggggtctatgagcccgttgttatcgagtcacattag

SEQ ID NO: 187314 - DNA, 1155 bp, Artificial Sequence
  Description of Artificial Sequence: Synthetic coding sequence
atggccttcctgatgaagaagaagaagttcaagttccagaccaccttcaccttagaggaactgaccgctgtgcccttcgttaacggagtactgttctgcaaggtgaggctactcgatggtggtgattttgtgagtctgagctcaagggaggaggtgcaagagaactgcgttagatggaggaagagattcacgttcgtttgtaaaatgtcagccaaccctgcgaccgggcttctggacccttgtgtattccgcgtatcagtgcgtaaggaactgaagggcgggaaggcgtactctaagctcggctttgcagacttgaatctggccgagtttgcgggttccgggtcgactgtgaggtgctgtctgctggagggatacgacactaagaatacacgccaggataatagcatcctcaaggtcacaattggaatgttccttctgagtggagatccctgttttaagacacctccatctaccgctaagtccatatcaattcctggccaggatagtagtctccagctgacctgtaagggcggcggaaccagtagtggaggtagttctacaaacagcttgactggttcacggccgcctaaggcaaggcctacaatactgtcctcagggctgcccgaggaacccgaccagaacctttcgtcccccgaagaggtcttccacagcggacacagtcggaacagctcctacgcctctcaacaaagcaagatttccggatattctacagagcattctagatcttcaagtctgagcgacctgacgcacagaaggaatacgagcacttcttccagtgccagtggaggcctggggatgaccgttgaaggccccgagggtagcgaaagggagcataggccacctgagaagcccccccgccctccacggccgcttcatctgtcagatagaagttttcgtcgaaaaaaagatagcgtggagagccaccccacttgggtcgacgacacccgcatagatgcagatgcaattgtcgaaaaaatcgtccagagccaggacttcaccgacgggtctaatactgaggactctaatctgagactgtttgtgtccagagacggctctgccaccctttctgggattcaactggctacacgggtctcctccggcgtgtatgagcccgtcgtcatcgagagccactag

SEQ ID NO: 187315 - DNA, 435 bp, Artificial Sequence
  Description of Artificial Sequence: Synthetic coding sequence
atgtacagcgagatccagcgggagcgggccgacatcggcggcctgatggccaggccagagtacagagagtggaaccccgaacttattaagcctaagaagttattaaaccctgttaaggcgagcagatcacaccaggagttgcatcgggaattgctgatgaaccatcgcagaggcctcggagtggactcgaagccggagctgcaaagggtactggaacacaggcgccgaaatcagctgattaagaaaaaaaaggaggaactcgaggctaaacggctccagtgccctttcgaacaggagcttttacgtaggcagcagagactgaaccagttggagaagccccctgagaaggaggaggatcacgctccagaattcataaaggtcagagagaacctgcgtaggatagcaacactgacctctgaagaaagagagctgtag

SEQ ID NO: 187316 - DNA, 435 bp, Artificial Sequence
  Description of Artificial Sequence: Synthetic coding sequence
atgtacagcgagatccagcgggagcgggccgacatcggcggcctgatggcccgaccagaatatagggaatggaacccggagctgatcaagccaaagaaactcttgaaccccgtgaaagccagccggtcacatcaagaactgcatagagaattattgatgaaccaccggagggggttaggcgtcgactccaagccagagttacaaagagtactcgaacatcggaggaggaatcagttaattaaaaagaaaaaggaagagcttgaagcaaagcgactacagtgccccttcgagcaagagttactaagacgccagcagagactcaaccagttggaaaaacctcccgaaaaggaggaggaccacgcccccgagttcattaaagtgcgcgagaatttgaggcggatcgcaacactgacatctgaggaaagagaactgtag

SEQ ID NO: 187317 - DNA, 519 bp, Artificial Sequence
  Description of Artificial Sequence: Synthetic coding sequence
atggcccagcggctgggcgagtgggcccggggccccagcgacgccacagggctttacagagccgtgctcttacgatccgctgctatgtacagcgaaatccaaagagagagggctgatattggtggtctcatggcaaggcccgagtatcgggaatggaaccccgagctgataaagccaaagaagctgctgaacccagttaaggcgtctcgctctcatcaagagctgcatagagagctcctgatgaatcataggcgtggcctaggggtcgattcaaagccagagctgcagagagtcttggagcatcggagacgtaatcagctcatcaaaaagaaaaaagaggagctcgaagccaagcgcctccagtgtccctttgagcaagaattattaaggcggcagcagcgcctgaatcagcttgagaagccccccgagaaggaggaggaccacgcacctgaatttattaaagtgcgcgagaacttgcgaagaatcgcaaccttaacctccgaagagcgcgaactctag

SEQ ID NO: 187318 - DNA, 408 bp, Artificial Sequence
  Description of Artificial Sequence: Synthetic coding sequence
atgtacagcgagatccagcgggagcgggccgacatcggcggcctgatggctcggcctgagtatcgcgaatggaatcccgagctgattaagcctaaaaagctgctcaacccagttaaggccagtcgaagccaccaggagctgcaccgagagctattaatgaaccatagacgcggactgggcgtagattctaagccagagctacaacgtgtgctggagcaccgccgacgcaatcagctcataaagaaaaaaaaggaggagctggaggctaagagactccagtgtccattcgagcaggagctgttgagacgacaacaaagacttaatcaggtgggtgatgggcatcctgcggggacaacacaccccccagggctatcgagccgggaagagctttgctgtggtcattcatag

SEQ ID NO: 187319 - DNA, 318 bp, Artificial Sequence
  Description of Artificial Sequence: Synthetic coding sequence
atgtacagcgagatccagcgggagcgggccgacatcggcggcctgatggcacgacctgagtacagggaatggaatccagaattgatcaaaccgaagaagctgctcaatcctgtgaaggccagtaggagccatcaggaacttcacagggagctacttatgaaccatcgccgcggactcggcgtggactctaagcctgaactgcagcgggtgttggaacaccgaaggcggaatcagctgattaaaaagaaaaaggaggagctcgaggccaaacgactgcagtgtccatttgagcaggaactgctgaggagacagcagtag

SEQ ID NO: 187320 - DNA, 528 bp, Artificial Sequence
  Description of Artificial Sequence: Synthetic coding sequence
atgggcgccgcccagggcaagaagaagacctacagcccccaggcccgttttcactcagagaatgaaaaacagcgcagaaatggaagcgccgcaatgtactccgagatccagagagagagagcggatatcgggggcctgatggcgcgcccagaatatcgagaatggaatcctgagctaattaaacccaaaaagctgttaaaccctgtgaaagcatctcgatctcaccaggagctccatcgcgaactccttatgaatcaccgcaggggactcggggttgatagcaaacctgaactccagagggtccttgaacaccggaggcgcaatcagctgataaagaaaaagaaagaggaactggaggccaaacgattgcagtgccccttcgaacaggagttgctgcggaggcagcagagacttaaccagctcgaaaaacctccagagaaggaagaggaccatgcacctgagttcattaaggtgcgtgagaatctaaggcggatcgcaactctcacctccgaggagagagaactgtag

SEQ ID NO: 187321 - DNA, 789 bp, Artificial Sequence
  Description of Artificial Sequence: Synthetic coding sequence
atggcccccggcagcccccccggccccgccatcgccaccatgaagcttaacgaaagatccctagctttctatgcaacgtgtgatgcgcctgtagataatgcaggatttctgtacaaaaagggcggcaggcacgcagcatatcacagacgctggttcgttcttcgcgggaacatgttattctatttcgaggatgcagctagccgggaaccagtcggggtgattatcctggagggatgcaccgtggaactggtagaggctgccgaagagttcgccttcgcagtgaggttcgccggaactagagcacgcacctatgtgttggccgcagagtcccaggacgccatggagggatgggtgaaggctctgtctagggctagcttcgactatctgcggctggtcgtgcgagagctggaacagcagttagccgccgtaaggggcggcggagggatggctctgcctcagccccagccccagagtttgccgctcccaccctccctgcccagcgccttggcccctgtgccatcactgccgagtgcacctgcaccagtgccggcgttacctttacccaggcggcctagcgctctgccacccaaggagaacggttgcgccgtgtggtccacagaagccacatttcggccagggccggagccgccacctccaccccctcggaggcgggccagcgccccacatgggccattagacatggcccccttcgccagattgcacgaatgctacggccaggaaattagggcactgcgaggccagtggctgagctcgcgcgtccaaccttag

SEQ ID NO: 187322 - DNA, 750 bp, Artificial Sequence
  Description of Artificial Sequence: Synthetic coding sequence
atgaagctgaacgagcggagcctggccttctacgccacctgcgacgctccagtggacaacgctggttttttgtacaagaaaggcggcagacacgcagcgtaccatcggcgttggttcgtcctaaggggaaacatgctcttctattttgaggatgcggctagccgagagccagtgggggtgataatcctggaaggatgtactgtcgagctggttgaggcagcagaggaattcgctttcgccgtgaggtttgctggtacacgggctcgtacgtacgtcctggccgccgaatcacaggacgccatggaagggtgggtaaaggcattatcaagagcatccttcgattatttacgcctagtcgtgagggaattagagcagcagctggctgcggtaagagggggcggtgggatggctctgccccagccacagccccagagcctgcctctgccaccgtctctgccatctgctttggcccccgtgccctcgctcccaagcgccccagcccctgtccccgctcttccccttcccaggcgaccatcagcccttcctcccaaggagaatggatgtgctgtgtggtcaaccgaagctacattcaggccaggtccagagcccccgccaccccccccccggcgtcgcgccagtgccccacacggccctttggatatggcaccctttgcccggcttcatgaatgctatgggcaggagattcgggcacttagaggccagtggctgtcctcaagggtccaaccttag

SEQ ID NO: 187323 - DNA, 267 bp, Artificial Sequence
  Description of Artificial Sequence: Synthetic coding sequence
atgaagctgaacgagcggagcctggccttctacgccacctgcgacgctccggtcgataatgctggcttcctgtacaagaaaggaggtaggcacgccgcctaccatcgccggtggttcgtactccgcggcaatatgctgttttactttgaggacgcagctagccgtgaaccagtaggcgtgatcatcctggtggctgtggcactttggccacgggctctgtctgtttccccctggtggctcagccaaggttccccagacaccccttag

SEQ ID NO: 187324 - DNA, 849 bp, Artificial Sequence
  Description of Artificial Sequence: Synthetic coding sequence
atgcaggccagctgcacccggcgggtgggcggcacccggcccaccaccggcgccggttcatgctgtgccggcacctgcagcagtacatctaggaccttgcctgcagtgagcccatgggcaagttctagttggagagccgcattgtggtcatggtggagaccccccagatcctctcccagcctctgcgcactcaggggccccggaagagcccctacctgctggcccttgagagttcgaatgccctggagggctggcagccggccttgccgagttccagccagcaccacgtgcggttggtggtgcgcttcatggtcttcgagctggaggctttatgtggcaggtgtcgcatggccgtgtccatctcctagcccgtcgccatgcccatgcccacgtccatgccctttgccgtggccacagagtcatccatgtctgcttccccagcctaggtcacagccatgtccttgccccgctgggcccgtaccctcacgccccagacgaatggcagccctgagcggagcacttaggcctccaagcggcttagatccctctcctctacatcatcgcctcgccgctgggccacgccaccccactgggccatggacatggccccccagtcctggctgcacctccgccatggccaggagatctggaccttgtgtggcctctggcagcgctgccgggtctagtcctgaagccaccagggctccagtgttgggcggccataagctgtacgcactgtgggaccggcccgggcccggggaaaccgggggggcggatccggagggaaaccacggacaggggtggccccccggacccgagtggcctgggtttggtggatgccgactatag

SEQ ID NO: 187325 - DNA, 354 bp, Artificial Sequence
  Description of Artificial Sequence: Synthetic coding sequence
atgaagctgaacgagcggagcctggccttctacgccacctgcgacgctcccgtcgataatgccggtttcctgtacaagaaaggcggccggcatgcagcctaccatcggcgctggttcgtgctgcgcggaaacatgctcttttattttgaggatgcggcaagcagggaacctgtgggagtcatcattctagaaggctgcaccgtagagttagtggaagcagccgaagagttcgcattcgccgtaaggttcgcaggcacccgcgcacgaacttatgtcctggccgcagagtcacaagacgctatggagggttgggtgaaggctctgtctagagcatcttttgactacctgaggtag

SEQ ID NO: 187326 - DNA, 750 bp, Artificial Sequence
  Description of Artificial Sequence: Synthetic coding sequence
atgaagctgaacgagcggagcctggccttctacgccacctgcgacgctccggttgataacgccggttttctgtacaagaaaggaggtagacacgccgcttaccatagaagatggtttgtgcttaggggaaatatgctgttctacttcgaggacgctgcctcccgggagcccgtaggggttatcatcctggaaggctgtacagtggagttagttgaggcagctgaggagttcgcattcgcggtgcgtttcgcagggacccgtgcccgcacttacgtgcttgctgccgagtctcaggacgctatggaagggtgggttaaagcactgtcccgagctagtttcgactacttgaggctggtagtgcgagagctggagcagcagctggccgcagtgcgcggcggcggcgggatggctttgcctcagccacagccccagtcgctgcccctgcccccgtctctgccatcagctctcgcaccggtgccaagcctgccctccgccccagcaccagtgcccgcccttcccctgcctcgtcgccccagcgcactgcccccaaaggagaacggatgtgcagtgtggtcaactgaagcgacttttaggccaggccccgagcctccaccaccaccaccccgcagaagggccagcgctccgcacggacctctcgatatggctccgttcgcccgcttgcacgaatgctacgggcaggagatccgtgccttgcgaggccaatggcttagcagcagggtgcagccttag

SEQ ID NO: 187327 - DNA, 750 bp, Artificial Sequence
  Description of Artificial Sequence: Synthetic coding sequence
atgaagctgaacgagcggagcctggccttctacgccacctgcgacgcacctgtggataacgcaggcttcctgtataaaaaagggggtcgccatgcagcatatcatagacgttggttcgttctacgaggtaacatgctgttttacttcgaagacgccgcatctcgagaacctgttggcgtgattattcttgagggctgcaccgttgagttggtggaagccgcagaggagtttgccttcgcagtgagattcgctggcactcgcgcccgtacgtatgtgctagccgctgagtctcaggatgctatggaaggatgggtcaaggctctgagccgggcctctttcgattacctgcggcttgtggtcagggagctggagcagcagctggctgcagttaggggaggaggcggtatggcactgccccagccgcagccccagtcactgccacttcccccatccttgccaagcgcattagcacctgtcccctctttgcctagcgcccccgcgccggtccccgctctgcctctgccaagacggccctcagctctcccacctaaagaaaatggatgcgccgtgtggagtaccgaagctacatttcgtcccgggccagagccaccacctccaccacctaggcgccgggctagcgccccccacggacctctggacatggccccttttgcccgacttcatgaatgctacggacaggagattagagcgctgaggggccagtggcttagcagccgcgtgcaaccttag

SEQ ID NO: 187328 - DNA, 225 bp, Artificial Sequence
  Description of Artificial Sequence: Synthetic coding sequence
atgaagctgaacgagcggagcctggccttctacgccacctgcgacgcccccgtggacaatgcgggattcttatacaagaagggcggcagacatgctgcctatcatcgccgctggttcgttctcagggggaatatgcttttttactttgaagatgcagcaagccgcgagcctgtgggagtcatcattctggaggggtgtacagtggagctggtggaagccgcctag

SEQ ID NO: 187329 - DNA, 243 bp, Artificial Sequence
  Description of Artificial Sequence: Synthetic coding sequence
atgaagctgaacgagcggagcctggccttctacgccacctgcgacgctcctgtagacaatgctggttttttgtacaagaaaggaggccgccacgccgcctaccacaggcggtggttcgtcctgcgaggtaatatgttgttctacttcgaggacgccgcaagccgggaaccagtcggcgtcatcattctcgagggttgcactgtggagctagtggaagctgccgaagaattcgctttcgcttag

SEQ ID NO: 187330 - DNA, 780 bp, Artificial Sequence
  Description of Artificial Sequence: Synthetic coding sequence
atgaagctgaacgagcggagcgtggcccactacgccctgagcgacagcccagccgatcacatggggttcctgagaacctggggcggccctggaaccccacctacaccctccggaactggaagacgatgttggttcgtcctgaaagggaatcttcttttcagcttcgagtcaagagaaggacgggctcctctgtcattagtggttctcgaaggatgtaccgtggagctggccgaggcaccggtccccgaggagttcgcctttgcaatttgctttgacgcacctggcgtgagacctcatctgttggctgctgaggggcccgctgcccaggaggcatgggtgaaggtgctttctcgggccagtttcgggtacatgaggcttgtcgttcgcgagctggaatcacagctgcaggacgctcgacagtcacttgccctccagcgccggtcaagctggaagtctgttgcatcacgctgcaaaccccaggccccgaatcaccgggcagccggcctggagaacggtcactgcctgagcaaggattcctcaccagtgggcctggttgaagaggccggatcccggtctgctggttggggcctggccgaatgggagctgcagggccccgcaagccttttgctaggcaagggtcagtccccagtctccccagagacatcatgtttctcaaccctgcatgactggtatggtcaggagatcgtcgaattacgacaatgttggcaaaagagggcacagggatctcactcaaagtgcgaggagcaggacaggccatag

SEQ ID NO: 187331 - DNA, 327 bp, Artificial Sequence
  Description of Artificial Sequence: Synthetic coding sequence
atgaagctgaacgagcggagcgtggcccactacgccctgagcgacagccccgcggaccacatgggatttctgaggacctggggagggcctggtactcctcccactccctccggtacaggccgtagatgctggtttgtcttaaaagggaacctactatttagcttcgaatctcgcgagggtcgagcacccctgagcttggtggtcctagaaggctgcactgtggaactcgcagaagcccccgtgcctgaagaattcgccttcgccatttgcttcgacgcgccaggagtccggccccaccttctagccgcagaaggacccgctgcctag

SEQ ID NO: 187332 - DNA, 729 bp, Artificial Sequence
  Description of Artificial Sequence: Synthetic coding sequence
atgaccatccccggcggcacccccagcctgaagatcctgtggctgaaccaggagcctgagattcaggttaggcggttagatacgctcttagcttgtttcaatctgtcttctagtcgggaagagctgcaggcagtcgagtcccccttccaagctctgtgctgcttgctcatttatctattcgtacaagtggacaccctgtgcctggaggacctgcacgccttcattgcccaggcgttgtgtttacaagggaaaagtacttcccagctcgttaatctgcagccagattacataaacccaagagccgttcaattaggtagtctactggtgaggggactcactaccttggtgcttgttaacagcgcttgtgggttcccgtggaagactagcgacttcatgccatggaacgtgttcgacggaaagttattccaccagaagtatctgcagtcagagaaagggtatgcagtcgaagtgttgctggagcagaacagaagtagactgacgaaatttcataatctgaaggccgtggtctgcaaggcttgtatgaaggagaaccggcggattacgggtagggctcattggggttctcatcacgctggacgatggggtaggcaaggctcctcctaccatcgaaccggatctggctattccagaagcagtcaggggcaaccctggcgcgatcagggccccggtagcaggcagtacgaacacgatcagtggcgcagatactag

SEQ ID NO: 187333 - DNA, 2733 bp, Artificial Sequence
  Description of Artificial Sequence: Synthetic coding sequence
atgggcgtgcggggcctgcagggcttcgtgggcagcacctgcccccatatctgtaccgtggtcaactttaaggagctggctgaacatcaccgatcaaaatatcctgggtgcacgcccactatcgtcgtcgatgcgatgtgttgcctgcgatattggtacactcccgagtcttggatttgcggcggccagtggcgggagtacttcagcgcccttcgcgactttgtgaagaccttcaccgcagcaggaataaaactgatcttcttcttcgacggcatggtggagcaggacaagcgagatgagtgggtcaaacggaggttaaagaataaccgcgagatctcacgcatttttcattatataaaatctcataaagagcagccagggcgcaatatgtttttcattccatccggcctggccgtcttcactcgctttgctctcaaaactctcggccaagagaccctatgcagcctccaggaggctgactatgaggtggccagttatggcctgcagcacaactgcttaggcattcttggcgaagacacagactatctcatctacgacacgtgtccctacttttccatttcagagttgtgcctcgaaagcctagacactgtgatgttatgtcgggagaagctctgcgagtctctgggcctttgtgtggcagatcttccactgctcgcttgcctactcggtaatgacatcatcccggaggggatgttcgaaagcttcaggtacaaatgtttatcttcatacacctccgttaaagagaacttcgataagaaaggaaacatcatcctcgcagtctccgaccacatctccaaggttctgtacttatatcaaggtgagaagaaactggaagagatacttcctctgggacctaacaaggcactcttttataaaggcatggcctcctacttgctgcctggacaaaaaagcccctggtttttccagaagccaaaaggtgtgatcacactagacaagcaggtgatctcaacctcttctgacgctgaatcacgggaggaggtgcccatgtgcagtgatgccgagagcagacaggaagtgcccatgtgcacgggtcctgaatctcggagggaagtccccgtttacaccgactctgagccccggcaagaggtccctatgtgttcagatccagagccccgtcaagaggtgcctacctgtacggggccggaatccaggagggaggtgcctatgtgtagcgatcccgagccaagacaggaggtgcctatgtgtacaggccccgaagctcgccaggaagtgccaatgtatactgactccgagccgcgccaggaggtacctatgtacaccgacagcgaacctcggcaggaagtgcctatgtacaccgggagcgaaccccggcaagaagtgccgatgtatactggaccagagtcccgccaggaagtgccaatgtacaccggccctgagtcgaggcaggaggtgctaattcggacggatcctgaaagcagacaggaaatcatgtgcaccggccacgagtccaagcaggaggtgcctatctgtacagatccaatttctaagcaggaagattcaatgtgcacccatgcagagatcaaccagaaactaccagtggccactgacttcgagtttaagcttgaggcgctgatgtgcacgaatccggaaattaaacaagaggaccccacaaacgttggacccgaggtgaaacaacaagtgacaatggtctctgacaccgaaatccttaaagtggccagaacacaccacgtgcaggccgaatcgtatctggtctacaacatcatgtctagcggtgagatcgagtgttcaaacacgttggaagacgagctggaccaggccttgcccagtcaggcatttatctataggccaatcagacagagggtctacagcttgctgcttgaagattgccaggacgtcacctcgacatgtctggccgtcaaggaatggttcgtctatcccggaaatccattgcgccatccagacttggtccggcctctgcagatgacgattccgggggggacaccgagcctgaaaattctttggcttaatcaagaaccagagatacaggttcgcaggttagatactctgctggcatgtttcaatctgtcatcgtcacgcgaagaacttcaggctgttgagagtccgttccaggccctctgctgtcttctgatctatctcttcgtgcaagtggataccctatgcttggaagatctgcatgcatttattgcacaagctctctgtttgcagggcaagtcaacatctcagctggtaaatttgcaacctgattatattaaccccagagccgtgcagctcgggtcacttctggtgcgcgggctcacaaccctggtcctcgtcaactcggcatgtggcttcccctggaagactagtgattttatgccttggaacgtgttcgacggtaagttgttccaccaaaagtacctgcagtccgagaaagggtatgcagtggaggttttgcttgagcagaatcgaagccgactgaccaaatttcacaatctaaaggcagtggtttgcaaggcctgcatgaaggagaacagacggataaccgggagagctcactggggatcacaccatgcaggcagatggggacggcaaggatccagctaccatagaaccggttctgggtatagccgaagcagtcagggccagccctggcgcgaccagggccccggaagccgacagtacgaacatgatcagtggcgacgctattag

SEQ ID NO: 187334 - DNA, 2802 bp, Artificial Sequence
  Description of Artificial Sequence: Synthetic coding sequence
atgttcggcccccggggcagcaccagcgccggcgccggccggaaggaaatcctgagccggtcaagcgtgatgggcgtccggggtttgcaaggatttgtgggatcaacctgcccccacatctgtacagtggtgaacttcaaggagcttgccgagcaccaccgaagtaagtacccgggctgcacgccaacaatagtcgtcgatgccatgtgctgcctccgatactggtacactcctgaatcatggatctgcggcggacagtggagggaatatttcagcgctctcagggacttcgtgaagacattcactgctgccgggatcaagctgatcttcttctttgacggtatggtggaacaggataagcgggacgagtgggtgaagagaaggcttaaaaataaccgggagatctcacggatcttccattatatcaaatcgcataaagagcagccaggcaggaacatgttttttatacccagtgggctcgccgtgttcacgagattcgcgctcaaaaccctgggccaagagacactgtgttcacttcaggaggccgactacgaggtagccagttacggattgcagcataactgcctggggatccttggagaagacacagactatctgatttacgatacgtgtccatacttttcaatcagcgaactatgtcttgagtctctggatacagttatgctctgtcgcgagaagctgtgcgagagtctgggactgtgcgttgccgacctccccctgctggcctgtctgcttgggaacgatatcattccagagggaatgttcgaatcattccgctacaagtgcctgtcctcctacacctctgtgaaggaaaacttcgacaaaaagggcaatataatactggcggtttcggaccacatcagtaaggtcttgtatctgtaccaaggtgaaaagaagcttgaggaaatcctcccccttggccccaacaaggctctgttctacaaaggaatggctagttatctgttaccaggtcagaaaagcccctggtttttccagaaaccaaaaggggtaatcacgctggataaacaggtgatctccacatcatctgatgctgagtctagagaggaggttcctatgtgttcagacgcagagtctcggcaagaagtgccaatgtgtacagggcctgaatcccggcgcgaagtgcccgtatacaccgactccgagccgcgacaggaggtgccaatgtgttccgacccggaacctcgccaggaggtgcctacttgtacgggacccgagagccggcgtgaggtgcctatgtgctcagaccccgaacctcgccaggaagtccccatgtgcacaggccctgaggcccggcaggaggtgcctatgtataccgactccgaacctcggcaagaagtgcccatgtacactgactcagagccacggcaggaggttccgatgtacaccggctccgagcctagacaggaagtgccaatgtacactgggccagagtcgcggcaagaggttcccatgtacaccggccctgagtcccgacaggaggtgctcatacgcacagatcctgagtcccggcaggagatcatgtgcactgggcacgagagtaagcaggaggttcctatttgcactgatcctatttccaaacaggaagacagtatgtgcacacacgctgaaattaaccagaagttaccagtggccaccgatttcgaatttaagctcgaggccttaatgtgcacaaatcccgaaattaaacaggaagatcccaccaatgtgggccccgaggtgaaacagcaggtgacaatggtaagtgataccgagatcctcaaagtagctaggacgcatcatgtgcaggcagagtcctacctggtttataatatcatgagctccggagaaatcgaatgttcgaacacactggaagacgaactcgaccaggcacttccctcacaggctttcatctacaggcccattagacaacgggtgtactcactgcttttggaggattgccaggacgtgacttctacttgcctcgcagtaaaggaatggttcgtgtatccaggaaatccgctgaggcaccccgatttggtgcggccattgcagatgactatacccggtggcacgccctcactgaagatcttatggctgaatcaggagcccgagatccaggtgaggcgactcgatactcttctggcctgtttcaatctctcatccagccgcgaggagctgcaggccgtggagtccccgttccaggctctctgttgtctacttatttatctgtttgtccaagtggatacactctgcctggaggatttacatgccttcatcgcacaggctctttgcctccaaggcaaaagcacatcccagctcgttaatctccagcctgactatatcaacccccgagcagttcagctcggaagcctcctcgtgagaggtttaacaacgctggttttggtcaattccgcatgcggcttcccctggaagacaagtgatttcatgccttggaacgttttcgacgggaagctctttcaccagaaatacctacaaagcgagaagggttacgcagtggaggttttactcgaacaaaaccgctctaggctcaccaagtttcacaatctgaaagcagtggtctgcaaggcttgcatgaaagagaatagacgcattacaggacgcgcgcactgggggtctcaccacgccggacgctggggaagacagggatcctcctaccacagaaccggctccgggtactctaggtcttcccagggacaaccatggagggatcagggacccggctccagacagtatgaacacgatcagtggcgcaggtactag

SEQ ID NO: 187335 - DNA, 2769 bp, Artificial Sequence
  Description of Artificial Sequence: Synthetic coding sequence
atggaccggcagatgatcctgagccggagcagcgtgatgggcgtgcgaggattgcagggctttgtaggcagcacatgcccacatatatgtactgtagtgaactttaaggaactggctgagcatcacagatccaaataccctgggtgtacaccgaccatagtggtggatgctatgtgttgcctgagatattggtacactcctgaaagttggatctgcggtggccagtggagggagtactttagcgccctccgagacttcgtgaagacctttactgcagcaggaatcaagttgatcttttttttcgatggcatggtggagcaagacaaaagggatgagtgggtcaagcgccgattgaagaacaacagagaaatatcaaggattttccattacataaagagccataaagaacagccgggcagaaatatgttttttattccctctggattggcggtgttcactcgattcgctctcaagacccttggccaggaaaccctgtgttctctgcaggaggctgattacgaagtggcgtcttatggactgcagcacaattgtcttggcattttaggcgaagatacagattatctgatctacgatacgtgcccatatttttctataagtgagctctgcttagaatcactcgacaccgttatgttgtgcagggagaaactgtgcgagtccctaggcctgtgtgtagctgacctgccactactggcatgcctgctcggcaacgatattattccagaaggtatgttcgaaagctttcgctacaaatgtctctcatcatacacatccgttaaagaaaattttgacaaaaagggcaacatcattttggcggtctcggaccatatcagcaaggtcctctacctctatcaaggagagaaaaagctagaggaaatcctccccctaggacccaataaggcactgttctacaaggggatggcttcatacctgctgcctggtcagaagagcccatggttttttcagaaacctaagggagtgatcacactggacaagcaagttatctccacatcatcagacgctgagtcccgcgaggaggtgccaatgtgttctgatgccgaatccaggcaggaagttccaatgtgtaccggacctgagtctcgacgagaagtcccggtatacacagattccgagcccagacaagaagtgccaatgtgtagtgaccccgaaccacggcaagaggtacctacatgtaccggtcctgaatctcgccgggaagtgccaatgtgctcagacccggagccgcgacaagaagtccctatgtgcaccggtccagaggccaggcaggaagtgcccatgtacacggatagcgagccacgacaggaagttccaatgtatacagatagcgagccgagacaggaggttccaatgtatacagggagtgagccaagacaggaggtgccaatgtatacaggccccgaaagtaggcaagaagttcctatgtatactggccccgagtccagacaagaggtgctgattcgcactgacccggaatcacggcaagagatcatgtgtacgggccacgaatcaaaacaggaagtgccaatctgcacagatcctatttcgaaacaggaagattccatgtgtactcacgcggagatcaaccagaaactgccagtggcaaccgactttgagttcaaactcgaggcccttatgtgcactaatcctgagattaagcaagaggatccgacaaatgtaggcccagaggtgaagcaacaagtgacgatggtgagcgacactgagatcctgaaagtagcacgtactcaccacgtgcaggcggaatcttaccttgtctataatatcatgagtagcggcgagatagagtgttctaataccctggaggacgagcttgaccaagccttgccatctcaggcatttatttaccgaccaattagacagcgggtttacagtttattgttggaagattgccaggacgtcacgtcaacatgccttgctgtgaaagaatggttcgtctacccaggaaatccactcagacatccggatctggtgcggccattacagatgactatcccaggagggacaccttctctgaagatcctgtggctgaaccaggagcctgaaatccaggtccgaaggcttgatacccttcttgcatgtttcaacctcagttcctcacgcgaggagctccaggccgtggaatctccctttcaggcactgtgttgcctgcttatttacttgttcgttcaggttgataccttatgtctcgaagacctgcacgcctttattgctcaggctctctgcctgcagggcaagagtacttcccagttagtaaacctgcagccagactatattaatcctcgcgcagtgcagctcggatctctcttggtgagaggattaacaacgctcgtactagtcaacagcgcttgcgggttcccgtggaagaccagcgacttcatgccttggaatgtgttcgacgggaaactgtttcaccagaaatacctgcagtcagagaagggttatgctgtagaggtgctgctcgaacagaaccgttcaagactgacaaagttccacaaccttaaagccgtcgtttgcaaggcctgcatgaaagagaacaggcggataacaggaagggcacactggggcagccaccatgcgggccgttggggacgtcagggcagctcttaccaccggacgggatctggatattcccgatccagtcagggccagccttggagggaccagggccctggttccaggcagtacgaacatgaccagtggagaaggtactag

SEQ ID NO: 187336 - DNA, 3291 bp, Artificial Sequence
  Description of Artificial Sequence: Synthetic coding sequence
atgggcgtgcagggcttccaggagttcctggagaagcggtgccccggggcggtggtgcctgttgacctgctgaaactcgcccgaacggtgtctcgccagcagcagcaacagcatctccataggcaactgccccctacagccgctctggctcctggagcacctcgggccgccaggggatccgtccctctgcagcctcctctgccccctgcagctctgggcgcatattcaggtggggccggacccattagacaccaccaccctgctcaccacttccaccatcacggacaggctcagcccggcctgcatcctccccttccaccacctccccccccgcagctgccgggtgcccgcgttctcgtggatgccggttcagccctcccccgcctctatggcggttatcagaccgattgggtatgcggaggtcaatggaatgcgatgctgggctacttgtctgccctctgtcaggcctgcgcttatcctggcggagatggcctggagctggtggtaatgttcccaggcggactcgggaaagatagattggctgagtggggaagaaggtgccaagcagagcgacagactgctcagctgattgttggacatgtcgggaataaagggacacctccgccacgcgcttggtttctgcctcccgcatgtttgagtcactgcgtcagattggcactaataaggttccgcgtgaaagtgttccagtccctggaggaccaccacctggaggtggtcgctttcttccgcgagaatggcttccatgggttgttggcccacgattctgagtacgccctgtacaacataccgtcatactattcatcgcacgcgctcaaactgtcctggaacggcaagaatttgacaaccaatcaattcctgatgcaagaagttgcaaagcaactgggcctgaaaagaatgaattttccgatttttgcagctctgctcgggaaccacattcttcccgatgaggatctggccgcctttcactggtctctgctgggacccgagcatccccttgcttccctgaaagtccgtgctcatcaactggttctccccccctgtgatgtggtgatcaaggccgtgagcgagtatgtgtccagtataaaggacccctctaatcttgacgtggtaggcaaggacgtgtttaaacagtctcagagcaggaccgaggataagatagagaggttcaagaaagctgtagaatattacagtgtcaccaccaagcttagctcacttccagtggggccttcttttcttggcttccgcaacaataggctcgggaatccacctttgccccgaaaccaggtgggaactatcagcgccggaaaacccatgttttctcatcaggtgccccagaaggtgaaatacccacccccttttcctgtggggccaaacagcagcctcctgttctcgtcccacgccctaggagagtctcatgccttctctgaagatcccatgctgcaaaatagccctttcgcgaattgggcggtgtcttatgactctagtgcctcccagttcccaaattacctgccaagcaaggccagccccccccttggccccgatagttcacactcctccagctctgacggagatgagccgaatggggcctcttccgaccacatcacagaagccttccaccaccagccagagtggggtaaccctaaccgcgacagaggttcatgggcccaacccgtcgacacgggcgtatctgaggctagcctcggtgatggagagccacacatccccagcctactaagcatgagtactcgtaatcatatggatattacaatccccccactgccgcctgtcgccccagaggtccttagagtggccgagcacagacatagacgggggctgatgtatccctatatttatcacgtgctcaccaagggggaaatcaaaatccccgtgtgtatagaagacgagtgcaacatggagttacccccggctgccttgctcttccgatccgcacgccagtacgtttacggggttttatttagcctggcagaaacccaacggaagatggaaaggctggcaatgcggagaagactaccagtggaagtgcccagcgtcattctgaaggaatggtccgcatacaagggcaagagtcctcagacacccgagctggtgtcagccctgacattccgagagtggacatgtcctaatctgaagaagctgtggctggggaaggccgtcgaggataagaatagacgaatgcgggcatttcttgcttgtatgaagtccgacacccccagcatgctcaaccccgcgaatgttccaactcatctgctactgatgtgctgtgtgttgcgatacatggtgcagtggccaggtggaaggatactgcaccgacatgagctggacactttcttagcgcaagcagtctcaacacagctgtatgagccagataggctgcaagaacttaagattgagaagctcgatgcacggggaattcagctggcagcactgtttatgtcaggagtcgatacagcactgttcgccaatgacgcctgcggtcaacccgtcccctgggaacattgctgtccttggatttattttgacggtaagctgtttcaaagcaaacttattaaagctgggcgcgaacgggtctctcttgtggagttatgtgacggacaggctgacctagccaccaaggttgagaagatgagacagtctatactggagggggtgaacatgaaccacccgcctcccagcgctctcctcccctcaccaacattcgttccgccaatggtacccagtttgtaccccgtgtccttatactctcgagccatgggcagcatgccacttccaccccaggggcggagtaggggcttcgctggactccatccaataccgccgcagggcggtaagttggaaatcgccggaatggtggtggggcaatgggccgggtcacgctcaagcagaggccggggcagctttggcatgcaggtagtgagcgtgggtggacccgggaaaggtcacgggaaagaacaaaccggccgcgggtctaagggacacaagaaggggaataagcagggctcctcagatggggtgagcaagagtttagaactccaccagggtcgatctagatctcaggtgaacggaaactcaggagcactaattaaggaagagaagtccgaccaccgactgcccgcgccaagccagtgtgctctgagtcgcgactcaaatgagtgtaacaacggaaatcggtacttacctatgaataatagagaaaagaatcaccttcaggagcagaagctcgaaacggttgctcagaggaaagaagattag

SEQ ID NO: 187337 - DNA, 717 bp, Artificial Sequence
  Description of Artificial Sequence: Synthetic coding sequence
atgggcgtgcagggcttccaggagttcctggagaagcggtgccccggtgctgtggttccggtagatctgttaaagctcgcaaggacagtgagccgccagcagcagcagcagcacctgcacaggcagctgcctcctacagcggctctggcgcccggcgccccacgggccgcccgtggtagcgttccactgcagcctccattaccaccagctgctcttggagcttactcaggaggcgctggccctattaggcaccaccatcctgctcaccactttcaccaccacgggcaggcacaacccgggctgcaccccccgctgccacccccgcccccaccacagctaccaggggcacgggtcctggtcgatgccggatcagctttgcctagactctatggtgggtatcagaccgactgggtgtgtggggggcaatggaatgcgatgctcggctatttatccgcactctgtcaagcctgcgcctatcccggaggggacggtcttgagcttgtagtgatgtttccgggcggcctgggaaaagatcggctagccgaatggggacggaggtgtcaggcagagagacaaactgcccagctgattgtgggtcacgtcggcaacaagggcacaccgccaccccgtgcgtggtttttgcctcctgcctgcttaagccattgcgtaagactagccttgatcagattccgcgtcaaacaggccgccatgctttag

SEQ ID NO: 187338 - DNA, 3408 bp, Artificial Sequence
  Description of Artificial Sequence: Synthetic coding sequence
atggagacccagaaggacgaggccgcccaggccaagggcgccgccgcaagcgggtcaactcgggaacaaacagcagagaagggcgccaaaaataaagcagccgaggccactgagggaccgaccagcgagccctcatcctctgggccagggcggctcaaaaaaactgccatgaagctctttggtggtaagaagggaatctgtactctgccctcatttttcgggggaggccgatcaaaaggttccgggaaaggaagctcaaagaagggcctaagtaagtccaagactcacgacggattatcggaggcagcgcacgggcctgaggacgtggtcagcgagggaacagggttttccctgcctttgcccgagcttccctgtcaattcccctcatcccagtctgcacacggggccttggagacagggtctcgttgtaagacatcagtggccggtgccacagaaaaagctgtggccgagaagtttccttccatgcctaaacccaaaaagggcctgaaaggcttttttagctctatacggcgccatcgaaaaagtaaagttacaggggccgagcagagcgagcctggggccaagggtccggagcgggtgcgcgctagaccacatgaacacgtgagtagcgcgccacaggttccttgcttcgaggagacttttcaagccccaagaaaggagaatgctaacccacaagatgcacctggccccaaggtgagccctacaccggagcctagccccccggcgacagaaaaaatggcatgtaaggaccctgagaaaccaatggaagcctgcgctagcgctcacgttcagccaaagccagccccagaagcgtcttcactggaggagcctcactcacctgaaaccggcgaaaaagtggtagctggcgaagtcaacccccctaatggccctgttggggatccactgagcctcctcttcggtgacgtcacctccctgaaaagcttcgactccctaacgggctgcggcgacatcatcgccgaacaggacatggactccatgactgatagcatggcctcagggggccagcgggcaaacagggatggaacgaagagaagctcttgtctggtcacctatcagggtgggggagaggaaatggcgttacctgacgatgatgacgaagaggaagaggaggaagaggaggtagagctggaggaggaggaggaagaagttaaggaggaggaagaagacgacgaccttgagtatctttgggagaccgctcagatgtatccgcgccccaacatgaatctgggctaccatcctactacctcgcctgggcatcacggatacatgctgctggatccagttaggtcctatcctggcttggccccaggcgagctgctcacgccacagtccgatcagcaagaatccgcccccaattcggatgagggctactatgactccaccacccccggctttgaggacgattctggggaggctctgggtctagtgcggcgggactgtctgcccagggattcctactcaggggatgccctgtatgagttctacgagccagacgacagcttggaaaactcaccacctggggacgattgcctgtacgatttacacggaagatcatcagagatgttcgacccgttcctcaattttgaaccttttctgtcatctagaccgcccggcgcgatggagacagaggaggaacgtctcgtcacaattcaaaaacagctcttatattgggaactgagaagggagcagctcgaggcacaggaagcaagggctcgagaagcacatgccagggaggcccacgcccgcgaagcctacactagagaggcttacggaagggaagcttatgcccgagaggctcatacttgggaagcgcacggtagggaggctcgaacgcgggaggctcaggctagagaggtgcgatgtcgggagactcaagtccgggagacccaggcccggcaggaaaagcccgttctggagtaccaaatgcgacctctgggtccgtccgtgatgggcctggcagccggcgtttctggcactagccagatctctcataggggaataacgtcagccttccccacaacggcttccagcgaaccagactggagggacttcagaccactcgaaaaaaggtacgagggaacctgttcaaagaaggatcagagtacctgccttatgcagctgttccagagcgacgcaatgttcgaaccagacatgcaggaagccaatttcggcggaagccccagacgcgcgtaccccacttactcacctccggaggacccagaggaagaggaggttgaaaaggagggcaacgccactgtatccttctcacaggcgctagtggaattcacttctaacgggaatctcttctcttcgatgtcatgttcttcggattcagacagctcctttacgcagaatctgcctgagctcccgccaatggtgacattcgatatcgccgacgtcgaacgcgatggcgagggcaagtgcgaggaaaaccccgagtttcataatgacgaagacctcgcagcctcactggaagcatttgagctcgggtattaccacaagcatgctttcaacaattaccatagccgattttaccagggcctgccatggggggtgtcatctcttccacgctacctgggcttgccaggattgcatccccgcccccctcctgcagcaatggcccttaaccgccgaagtagatccctggacacagctgaaaccctagagatggagttgtcaaattcccatttggtgcaggggtacctggaaagcgatgagctgcaggcccagcaggaggacagcgatgaagaggacgaagaggaagaagagggggaatggtcccgcgactcacctctgtctctgtataccgaaccccccggagcgtacgattggccggcgtgggcgccatgccctctcccagtggggccaggacccgcttggatctctccaaaccagttagacagaccatcttcccagtcgccctatcgccaggccacgtgttgcatccctccgatgactatgtcaatttcactgagtgtgccggaatccagggctccgggggagagtgggccgcagcttgcaagacctagtcatttgcatctgcccatggggccctgctataatttgcagccacaagccagccagtcaatgcgggctcggcctcgtgatgtgctgctgcctgttgacgagccttcctgcagtagttcctctgggggcttcagccctagcccgctccctcaggcgaaaccggtcggcatcacccacgggattccacaactgcccagggtgcgacccgaacacccccagcctcaaccaacgcattatggtccttcttccttggacctctccaaggagagggccgagcagggcgcgagtctcgccacatcttactctagtactgccatgaatggcaacctggctaagtag

SEQ ID NO: 187339 - DNA, 2415 bp, Artificial Sequence
  Description of Artificial Sequence: Synthetic coding sequence
atggagacccagaaggacgaggccgcccaggccaagggcgccgccgcttctggcagtaccagagaacagaccgcagagaagggcgctaagaacaaagccgccgaggccacagagggacccacgagtgaacctagtagttccggccctggaagactgaagaaaaccgccatgaagctttttggtggcaaaaaaggaatctgtaccctgccatcattcttcggtggagggcgcagcaagggttcgggcaagggtagctctaagaaggggctctctaaatcaaaaacccatgacggtctgagcgaggctgcccacgggcctgaagatgtagtgtctgaaggtaccgggttttcgctcccacttcctgaactaccatgtcagtttccctcctcacagtcagcccacggtgccttggaaactggttcgagatgcaaaacatcagtggccggcgccactgaaaaggctgtggccgagaaatttcccagtatgccgaagccaaagaaaggcctgaaggggttcttctccagcattcgccgccaccgcaaaagcaaggtgaccggagccgagcagagcgagccaggtgccaaaggacctgagcgagtgagggcccggcctcacgagcatgtgagctctgcaccccaagtcccttgtttcgaggaaacctttcaggctcctcgtaaagagaacgccaatccccaggacgcaccaggacccaaagtgtcacctacgcccgagccatcgccccctgctacagaaaaaatggcctgcaaggatcctgagaaaccaatggaggcctgtgcctcagcgcacgtgcagcccaaacctgcccccgaggcctcatccctcgaggaacctcacagcccagagacgggcgagaaggtagtcgccggtgaagtgaatccccctaacggcccagtgggggatcccctgtctctactgttcggagatgtgacatctcttaagagttttgacagcctaacgggttgcggggatataatcgccgagcaggacatggacagcatgaccgacagcatggctagtggtggacagcgagctaatagggacggtactaagcgctcatcttgcctggtgacgtatcaaggcggcggcgaggaaatggctttgcctgatgatgatgatgaagaggaagaggaggaagaagaagtggagctagaagaggaggaggaggaggtcaaggaagaggaagaggatgatgatcttgagtacctgtgggagaccgcccagatgtaccccagaccaaatatgaacctgggctaccacccaacgacgtcaccaggtcatcacggatacatgctgctggaccccgtgaggtcatatcctgggctcgctcccggggagcttctcacaccccaatcagaccagcaggaatccgcccccaacagcgatgaagggtactacgattctaccacacctggattcgaggacgattcgggagaggcactaggcctggtgaggcgggactgcctccctagagatagttattccggcgacgctctatacgagttctacgagcctgatgattccctggagaactctcccccaggcgatgattgtctgtatgacctgcacgggcggtcctcagaaatgttcgaccccttcctgaactttgaaccattcttatcatctcggccacccggcgccatggaaacagaggaggaaaggctcgtgactattcagaaacagctcctgtattgggagctgaggagggagcagctagaagcccaagaagctcgagctcgggaggcccatgcccgcgaggcccatgctcgtgaagcatacacaagagaggcttacggtagagaggcatatgccagagaggcccacacctgggaggcacacggcagagaggctaggaccagagaggcccaggccagagaagtgcggtgcagggagacccaggtgcgtgaaactcaggctaggcaggaaaagcccgtcctggagtatcagatgaggccactgggaccatctgtaatggggttagctgccggcgtgtcgggtacgtcacagatcagtcacaggggcatcacctcagctttccccaccaccgcctcttctgagcctgattggagagatttccggccgctggagaagaggtacgaaggcacctgcagcaaaaaagaccaaagcacctgtctcatgcagctatttcagtccgacgctatgtttgagcctgacatgcaggaggccaactttgggggttctcctagaagggcataccccacctatagtccacctgaggaccccgaggaagaggaggtcgaaaaggaggggaatgccaccgtcagttttagccaggctttagttgaatttacaagtaacgggaatctgtttagtagcatccgttgtccggggactgaagacaagagacaggttactcaggcatgtggcacatggtag

SEQ ID NO: 187340 - DNA, 1566 bp, Artificial Sequence
  Description of Artificial Sequence: Synthetic coding sequence
atgttcaccagcgagaagggcgtggtggaggagtggctgagcgagttcaagacccttcccgagacatccctccccaactacgccaccaatttgaaggataagagctcactagtttcatcactgtacaaagtcatccaagaaccccagagcgaactgctggagccagtctgccatcagctgttcgagttctatcggagcggcgaagagcagctgctgcagttcacgttgcagtttctacctgagctgatctggtgctatctggccgtctcggccagcagaaacgttcacagtagtgggtgcatagaggccctcctgctgggagtctacaacctcgaaattgtcgataagcaagggcacaccaaagtcttgagcttcactatcccttccttgagcaagcccagcgtataccacgagccctcaagcatcggatcaatggcactgacagaatcagctttgagtcagcacggcctcagcaaagtcgtatattcaggcccacacccacagagagaaatgctgacagcccaaaaccgttttgaagtgctgacttttcttttattatgctataatgctgctctaacctacatgccatcggtttccctccagagcctgtgtcagatctgctcgcgcatttgcgtgtgcggttacccgagacagcatgtcagaaagtataagggtattagtagcaggatccctgtgagcagtggattcatggtacagatgcttaccggtatctactttgccttctacaacggcgagtgggacttagcccagaaagctctggacgatattatctaccgtgcacagctggaactataccctgaacccctgctggtcgccaatgcaatcaaagccagcctaccccacggacccatgaaatcgaataaggagggcacaaggtgcatccaggtagagatcaccccgacgtcttcacggatctctcgaaacgccgtgacctcgatgagtattcgcggtcacagatggaagaggcatggaaatactgaattgacaggacaggaggagttgatggaaattagtgaagtggacgaggggttctatagcagagccgcctcttcaacctcacagtctgggttgagtaattcctcgcacaattgttccaataaacctagcatcggaaaaaatcatcgacggtcgggaggttcaaaaaccgggggcaaggagaaggagaccacaggcgagtcctgtaaagaccatttcgcccgtaagcagacgcagagagcccagtcagagaatctggaacttttgtccctgaaaaggctcacgctaacaacaagccagtcattgcctaaaccttcatctcatggattagctaagacagcggccaccgtcttctcgaaatcgttcgaacaggtatctggggttaccgtaccgcacaacccctccagcgcggtggggtgcggagcaggcaccgatgctaatcgcttttctgcctgcagtctccaggaggaaaaactgatatatgtgtcagagcgaactgaactgccgatgaaacatcaatccgggcagcaacggccccctagcatatccataaccttatcaactgactag

SEQ ID NO: 187341 - DNA, 342 bp, Artificial Sequence
  Description of Artificial Sequence: Synthetic coding sequence
atggacggccgggtgcagctgatcaaggccctgctggccctgcccattagaccagcaacgcgtcggtggaggaacccgatccccttcccagagaccttcgatggcgataccgaccgcctccccgagtttatagtgcaaacaggaagctacatgtttgtggacgaaaatacctttagcagcgatgctttgaaagtgacttttctaattacccgccttactggccccgccctccaatgggttatcccttatatcaaaaaagagtctcctcttttgaatgactatcgtggttttctggccgagatgaaacgggtattcggatgggaagaggacgaagatttctag

SEQ ID NO: 187342 - DNA, 2241 bp, Artificial Sequence
  Description of Artificial Sequence: Synthetic coding sequence
atgggcgacgtgctgagcacccacctggacgacgcccggcggcagcatatcgcggaaaaaacagggaaaatcttgaccgaatttctacagttctacgaggaccagtacggcgtcgctttattcaactccatgcggcatgaaattgaagggacagggctgccccaagctcagctcctctggaggaaggtaccactcgacgagcgcattgtctttagcgggaatctgttccagcaccaagaagattctaaaaaatggcggaaccgcttctcactcgtgcctcacaactatggtctggtgctatatgaaaataaggcggcatatgagcgccaggtgccgccgcgggctgtgatcaactctgccggttataaaatattaacttccgtcgatcagtacctggagctgattgggaacagtctgcctggcaccactgcaaagtccgggtctgcgccaatcctaaagtgtccaacacagtttccgcttatcctgtggcacccatatgcgaggcattattacttctgtatgatgactgaagccgaacaggataagtggcaagctgtgctccaggattgtattaggcactgcaacaatggaataccagaagatagcaaggttgaagggcccgccttcaccgacgctattcgtatgtatcgccagtcaaaagaactgtatggcacctgggaaatgctctgcggtaatgaggtgcagatcctttctaacctggtcatggaagaactaggcccagaactgaaagcagaactgggcccacgcctgaaaggaaaaccccaggagcgccagcgtcagtggattcagattagcgacgcggtctaccacatggtttacgaacaggccaaggcgcgcttcgaggaagtgttaagtaaggttcaacaggttcagcctgcaatgcaagccgtgataaggacggacatggatcagatcattacatccaaggaacatctggccagcaaaatcagggcgttcattctgccaaaggccgaagtttgcgtccgaaaccacgtgcagccctatatcccctcaatcctcgaggcactgatggtgcctacctctcagggcttcacagaggtaagggacgttttttttaaggaggtcactgatatgaacctgaacgttataaatgaaggggggatcgataagctaggtgaatatatggagaagctgagcagattagcctaccatcccctcaagatgcagagctgttatgaaaagatggaatccttaagactcgacggcctgcagcagaggtttgacgtgagttcgacttctgtgtttaagcagcgtgcacagatccacatgagagaacagatggacaacgccgtatacaccttcgagaccctgctccaccaagaactgggcaaggggcccaccaaggaggagctatgtaagagcatccagagggtacttgaaagggtgttaaagaaatacgactatgattccagtagcgtgcgtaaacgattttttcgggaggccctgcttcagatttccatcccattccttctgaaaaagctggctcctacctgtaagtcggaacttccccgatttcaggagctgatttttgaagactttgccagatttattcttgttgaaaatacctacgaagaggtggtgctccaaacggtgatgaaggacattctgcaggccgttaaggaggccgctgtacagcggaaacataacctctatcgcgacagcatggtgatgcataatagcgaccccaatctgcacctcctcgcggagggggctccaatcgattggggcgaggagtactcaaactctggagggggaggcagcccctcaccatccactccagaaagcgccacactgtctgagaaaaggcgccgtgctaagcaggtagttagtgtggtccaggacgaggaggttggacttccatttgaagcctcacccgagtctcccccgccggcatcacctgatggtgttactgagattcggggactacttgcacagggcctacgacctgagtctccgccacctgccggccccctcctgaacggcgcccccgcaggcgagagcccacagccaaaagcggctccagaagctagtagccctcctgccagtccattacaacacctacttcccgggaaggccgtggacctggggccacctaaaccttcagatcaggaaaccggcgagcaggttagctccccttctagccaccccgctttgcatactaccaccgaggatagtgctggcgtgcagactgagttttag

SEQ ID NO: 187343 - DNA, 2202 bp, Artificial Sequence
  Description of Artificial Sequence: Synthetic coding sequence
atgggctggatgggcgagaagaccggcaagatcctgaccgagttccttcagttttacgaagaccaatacggcgtagccctatttaatagcatgcggcatgaaatagaggggacggggctgccacaggcccaactgctgtggaggaaagtgccgctggatgaacggatcgtgttctcagggaatctgtttcaacaccaagaggatagcaagaaatggcgcaaccgtttttctttagtaccccacaactacggcctggtactgtatgagaataaggccgcctatgaacgccaagtgccccccagggccgtgatcaacagcgctggttataaaatcctcacaagtgtcgaccagtatcttgaactgatcggtaacagcctgcctggtaccacggcgaagagcggctctgcccctatcctgaagtgccctactcagtttcctctgattctctggcacccatacgctagacattactatttctgtatgatgaccgaagcagaacaggataagtggcaagcagttctgcaagattgcatcagacactgcaataacggtatccctgaggattccaaagttgaaggccccgcctttacggatgccattcggatgtatcggcagtccaaagagctgtatggaacctgggagatgctatgcggtaacgaagttcaaatcctgtcgaatcttgtgatggaggaattggggccggaactgaaggcagagctcggcccacgattgaagggcaagccccaggagcgccagagacagtggattcagatttccgacgcagtataccatatggtgtatgagcaggccaaggcacgttttgaggaggtgctcagcaaagtacaacaagtccagccagctatgcaggccgtgatcaggactgatatggaccagatcattacctctaaggagcacctcgctagcaagatcagggctttcatcctacccaaggccgaggtctgtgtgaggaaccatgtgcaaccctatatcccgagcatcctggaagctttaatggtgccaacaagtcagggattcaccgaggtgcgggacgtgttctttaaggaagttaccgatatgaatctgaacgtgattaacgagggtggtattgacaagcttggggagtacatggaaaagttgagtcgcctcgcctaccatccattaaaaatgcaaagctgttacgagaagatggagtcactgcgcttagacgggctccagcagcggttcgacgtgtccagcacttccgtcttcaagcagcgcgcccagatccacatgcgggagcagatggacaatgcagtgtacacttttgaaacattattgcatcaagagctgggcaagggtccgacgaaagaggaactctgtaaatctatccaacgcgtactggaaagagtgcttaaaaagtatgactacgattccagctctgtgagaaagcgattcttccgcgaagctctgctacagattagcattccattcttgcttaaaaaactggcaccaacatgtaagagtgagttgccacggttccaggagctgatctttgaagacttcgctcgtttcatcctggtagaaaacacgtatgaggaagtggtgctccagaccgtgatgaaggacatccttcaggctgtgaaagaagcggctgtgcagagaaagcacaatctgtaccgggatagcatggtaatgcacaattcggatcctaatctgcaccttcttgccgaaggagcccccattgactggggagaggaatattccaatagcgggggaggtgggtctccgtctccaagtacaccggagtcagctaccctcagcgagaagcggcggcgggcgaagcaggtagtgtcagtcgtgcaggacgaagaggtgggcctgcccttcgaggcatcccccgagagtccacctcccgccagtccagacggtgtcacagagattcggggtctactagctcaggggctgagacctgagtcaccccccccggctggacctctcctgaatggagcgccggcgggggaaagccctcagccaaaggccgcccccgaagcttcgtccccacctgccagtcctctgcagcacttgctccctgggaaagccgtggacctcggtccccctaaacccagtgatcaggaaactggggaacaggtgtcctcgccctcatctcacccagcgctgcacacaaccacagaagattctgccggggtgcaaaccgagttctag

SEQ ID NO: 187344 - DNA, 1191 bp, Artificial Sequence
  Description of Artificial Sequence: Synthetic coding sequence
atggtgcccaccagccagggcttcaccgaggtgcgggacgtgttcttcaaggaggtcacagatatgaacctcaatgtaattaatgagggcgggatcgacaaattgggggagtatatggagaaacttagtcgcctggcttaccacccgctcaagatgcagtcctgctacgaaaagatggagagcctgcggctcgatggtctccagcagagattcgacgtgagtagcacaagcgtttttaagcagcgtgcacagattcatatgagggaacagatggacaacgcagtctacacatttgagaccctgttacaccaggaactggggaaaggccctaccaaagaggaactttgcaagagcatccagagggtactcgagcgcgttctcaagaagtacgactacgactcctcgagtgtgagaaagcgattttttagagaggctttgctccagatatctatcccctttctgctgaagaaactcgcccctacatgtaagtcggaactccctaggttccaggagctcatttttgaggatttcgcccggttcatccttgtagagaatacgtatgaggaggtagtgctgcagaccgtcatgaaagacatcctgcaagctgtaaaggaagccgcggtgcagagaaaacataacctttatcgagatagtatggtgatgcacaactccgatcctaacttacacctgctcgccgagggagcgccaatcgactggggagaagagtattccaattcggggggggggggatctccttctccgtccacccctgagagtgctactttgtctgagaaacgcagaagggcaaaacaggtggttagtgttgtgcaggacgaggaagttggactcccatttgaagcttccccggaaagccccccgcccgcaagccctgacggtgttactgagataaggggactgttggctcagggactccgccctgagtctcccccacccgcgggacctctccttaacggcgcacccgccggtgaaagccctcagcctaaggcagccccagaggcctcaagtcctcctgcaagccccttgcagcatctgttgcccggaaaagcggttgatcttggccctccgaaaccgagcgatcaggagacgggagagcaggttagcagcccttctagtcaccccgcgctgcacacaaccacagaagattcagctggtgtgcagaccgagttctag

SEQ ID NO: 187345 - DNA, 3072 bp, Artificial Sequence
  Description of Artificial Sequence: Synthetic coding sequence
atgggcgccggcgccctggccatctgccagagcaaggccgccgtgcgcctgaaagaagacatgaagaaaatcgttgccgtcccattaaacgaacagaaagacttcacctatcagaagttattcggcgtttctctgcaggaactagaacggcagggcctaactgagaacggtattccagctgtggtgtggaatatcgtggagtatttaacacaacatgggttaacacaggagggcttgtttcgcgtgaacggaaatgttaaggtggtggagcaactgcggttgaaatttgagtccggcgtgcccgtcgagctgggcaaagatggcgacgtgtgttcagccgcatctctcttgaagctgtttcttcgagaactgccagactctttgatcacttccgccctccagccaagatttatccagttatttcaagacgggcggaatgatgtgcaggagtcgagccttcgtgacctgatcaaagagttaccagatactcactactgtctgctgaagtatctgtgtcaatttctgacaaaggtggctaagcaccatgtgcagaatcgcatgaacgttcacaaccttgcaaccgtgtttgggcccaactgtttccacgtgccgccggggttggagggcatgaaggagcaagacctctgtaataagattatggccaagattcttgagaattataacaccctcttcgaggtcgaatatactgagaatgaccacctgaggtgtgagaaccttgcccgactcatcatcgttaaggaggtctactataaaaactccctgcctatcctgctgacacggggccttgagcgcgatatgcccaaaccacctcctaagaccaagatccccaagagcaggagcgagggatctatccaggcccatcgcgttctgcagcccgagctgtcggacggaatcccccaattgagtttgcgcctgtcatatcgcaaagcatgtctagaggacatgaactcggccgagggtgccatctctgccaaactggtcccatcctctcaggaggacgagcggccgctgagccctttctatctttcagcccatgtcccccaggtgagcaacgtctctgcaacaggagagctgctagagcggaccattcggtcagctgtggaacaacacctgtttgatgtgaacaacagcgggggacagtccagtgaggactccgaaagcggcactttgagcgcatccagtgccactagcgcacgacagcggcgtcgtcagagcaaggaacaggacgaagtgcggcatggccgcgacaagggactgataaataaggaaaacaccccttcaggatttaaccacttagacgactgtatcctcaacactcaggaggtagagaaggtccataaaaacacatttggatgtgccggggagaggagtaagcccaaaaggcagaaatcctcaaccaaattgtcagagctacacgacaaccaagacggtcttgtgaacatggagtcccttaactctacaaggtcccacgaacgaacaggccctgacgacttcgagtggatgagcgacgaaagaaaaggaaatgagaaggatggcggacacacgcaacatttcgaatcccctaccatgaagatccaggaacacccatcactcagcgacactaagcaacagcgaaatcaggacgcaggcgatcaggaggagagctttgtcagtgaggtgccccaaagcgacctcacggccttgtgcgatgaaaagaactgggaagagcctatccccgctttttcctcgtggcagcgagaaaattctgacagcgacgaggctcacctctctccacaggcagggcgactgattcgtcagttgctcgatgaggatagtgacccgatgctgagtccaaggttctacgcttacggccaatctcgacagtacctggacgatacggaggtgcctccttcaccccctaactcacacagcttcatgaggaggcggtcttcttccctggggtcatatgatgacgagcaggaggatctgactcccgcccaactgactaggaggattcagtcactcaagaagaagatcaggaagttcgaggaccgattcgaggaggaaaagaagtatcggccatcccattctgacaaggccgccaaccccgaggttcttaagtggactaacgatctggctaagttccgacgacaattgaaggagagcaaattgaagatatcggaggaggacctcactccacgcatgaggcagcgatccaataccttacccaaatctttcggcagtcagctcgagaaagaggacgagaaaaaacaagagcttgtggataaggccataaaaccctcagtagaggccactttggaatccatccagagaaaactccaggaaaaacgcgctgagtcaagtcgtccggaggacatcaaagacatgaccaaggaccaaattgccaatgaaaaggtggctctgcaaaaggcactattatactacgagtctatccatgggcggcccgtgacaaaaaacgagagacaggtgatgaaaccgctttatgataggtacagattggtgaagcaaatcctgtcacgcgctaacactatcccgatcatcggtagtccaagttcaaagcgccgttccccactcctgcagcctataatcgaaggggagaccgcttcgttcttcaaggaaattaaggaagaagaagagggcagcgaagacgattcgaacgtgaaacctgacttcatggtgaccctcaagaccgacttcagtgcccggtgcttcctcgaccagtttgaagatgacgctgatggcttcatcagtcctatggacgataaaatacctagcaaatgttctcaagacactgggctatcaaacctccacgcggcctccataccagaattactggagcacctgcaagaaatgagagaagagaagaaacgaatcagaaagaagctccgggacttcgaagacaatttctttagacagaatggcagaaatgttcagaaggaagacagaactccaatggccgaggagtactcagaatacaagcatatcaaagctaagctgagactgcttgaggtgctgatttcaaagcgtgatactgattctaaatccatgtag

SEQ ID NO: 187346 - DNA, 2010 bp, Artificial Sequence
  Description of Artificial Sequence: Synthetic coding sequence
atggcctgcgagatcatgcccctgcagagcagccaggaggacgagcggccattgtcacctttttacctttctgcccatgtgccacaggtatctaacgtgagcgcaaccggcgaactccttgaacgtactattcgtagcgcagtcgaacagcacttgttcgacgtcaataattctgggggacagtctagcgaagatagcgaatccggtactctgtcagccagtagcgccacttcagcacggcagcggcgacgccagagtaaagagcaggatgaggtccggcatggccgcgacaaggggttgatcaataaagagaatacaccaagcgggttcaatcacctggatgactgcatcctgaatacccaggaagtcgagaaggtgcacaaaaacactttcggctgtgcaggcgaaaggagcaaacccaagcgccagaagagtagtaccaagctgtcagagctccatgacaatcaggacgggctggttaacatggagagtttgaattccacaagatcccatgaacggaccggcccagatgactttgagtggatgagcgacgaacggaaggggaatgaaaaagatgggggacacactcagcattttgagagtccaactatgaaaattcaggagcaccctagtttaagtgatactaagcaacagagaaatcaagacgccggcgaccaggaagaaagctttgtgtcagaagtgccccagagcgacttgacagctttgtgtgacgagaaaaactgggaagaacccattccagccttctcgagttggcagagggagaactcagactccgacgaggcccatttgtctccccaggccggccgtttaatcaggcagctattagacgaggactcggacccgatgctgagtccaaggttttacgcttacggccagagcaggcaatatctggacgatacggaagtacccccttctccacccaactcccacagctttatgaggcgtaggagctcttcactagggtcttacgacgacgaacaggaggatctgacaccagctcagttgaccaggcgtattcagtccctgaagaaaaaaatccgcaaatttgaggaccggttcgaggaagagaagaagtacagaccgagccatagtgataaagcggcgaatcccgaggtgctgaaatggaccaacgacctcgctaagttcaggcgccagttgaaggagtccaaacttaaaatctctgaagaggacctcacaccacgcatgaggcaaaggtcgaacacgctgcctaagtcttttggtagccagctcgagaaggaggatgagaagaaacaggagctggtcgacaaagcgattaaacccagtgtggaagcgaccctggaatccatccagagaaaactgcaagaaaagagggccgaaagctccagaccagaggacatcaaggacatgacaaaagatcagatcgccaacgaaaaagtcgcactacaaaaggccctcctgtactacgagtctatccatggtaggccagtgaccaaaaacgagcgccaagttatgaaacccctctatgaccggtaccggctcgtgaagcagatcttgagcagagctaataccatcccaattatagaggaggaagaagggtcagaggacgattccaatgtgaaacctgacttcatggtgaccctgaagacagacttctccgccaggtgtttcttagatcagtttgaagatgatgctgacggatttatctctccgatggatgataaaataccaagtaaatgctctcaggacaccggcctaagcaatctgcacgcggcatccatacctgaactgctggagcatttgcaggagatgcgagaggagaaaaaacggatcagaaaaaagcttcgggattttgaggacaattttttcaggcaaaatggccggaatgtacagaaagaggatcgcactcctatggctgaagagtactcagagtacaagcacattaaggctaaattgcggctgttagaagtactcatctcaaagcgggatactgactccaagtccatgtag

SEQ ID NO: 187347 - DNA, 2094 bp, Artificial Sequence
  Description of Artificial Sequence: Synthetic coding sequence
atggcctgcgagatcatgcccctgcagagcagccaggaggacgagcggcccctttctcctttctatctcagtgcccacgttcctcaagtctccaacgttagtgccaccggggagctcttggagagaacaatccgaagcgcggtcgagcaacacttgttcgatgtaaacaacagtggcgggcaatctagcgaagactccgagtctgggacattatccgcttcatcagccacatcagcccgacagcggagacggcagagcaaggaacaggacgaagtgcgacacggccgggacaaaggcctgatcaataaggagaacacgcccagcggatttaaccacctagatgactgcattctgaatacacaggaggtagagaaagttcacaaaaacaccttcggatgtgccggagagcgaagcaagcctaaacgccaaaagtcatccacaaaattaagcgagcttcatgataatcaggacggtttagttaatatggaaagcttaaatagtacccgaagccatgagcggacagggcctgacgactttgagtggatgtccgacgagagaaaaggaaatgagaaagacggcggccacacccaacactttgaatctcccacaatgaagatacaagagcaccctagcttaagcgacaccaaacagcagagaaatcaggacgcgggtgaccaggaagaaagtttcgtctccgaggttccacagagtgaccttacagccctgtgcgacgaaaagaactgggaggagcccattcctgccttcagttcctggcagagggagaacagtgacagtgatgaggcacacttgagtccacaggccggtcggttgatccgccagttgctagatgaagactctgatcccatgttaagccccagattctatgcatacggtcagagtcggcagtacctggatgataccgaagtgccaccctccccaccaaattcccatagttttatgcgacggcgctcctccagtctcgggagctacgacgacgaacaggaagacctcacgcccgcccagctcacaagacgtatacaatctctgaaaaagaaaattagaaagttcgaggatcgcttcgaggaggaaaaaaagtaccgaccatctcacagcgacaaggccgctaatccggaggtgttgaagtggacaaatgatcttgcgaaattcagaaggcagctaaaggagtctaagctgaaaatttcagaggaagacctgaccccgcggatgaggcaacggagcaataccctcccgaaaagctttgggtcccagctggagaaggaagacgagaaaaagcaggagctcgttgacaaggccatcaaacccagcgttgaggccaccttggagtccatccagcgtaaattgcaggaaaaaagggccgagtcctcccgccctgaagacatcaaagacatgaccaaggaccaaatcgcaaacgaaaaggtcgcactgcagaaagcccttctgtactacgagagtatccatggcaggcccgtgaccaagaacgaaagacaagtgatgaaaccactctatgaccggtatcgtctggtgaaacaaattctgagccgcgctaacaccatccctattattggcagtccttccagtaaaagacggtcaccgctgctgcaacctatcatcgagggagagacagccagcttctttaaggagattaaggaagaagaggaagggagcgaggatgacagcaatgtcaagcccgatttcatggtaaccttaaaaacagatttctcagctcgttgtttcctggaccagtttgaggatgacgccgacgggttcattagtccgatggatgacaagataccgagtaagtgcagtcaggacactgggctgtcaaacctccacgctgcttccattcccgagttactcgaacacttacaagagatgagggaagaaaagaagcggatcagaaagaagttaagagatttcgaggacaactttttccgccagaacgggaggaatgtgcaaaaggaagatcggacacctatggcagaggagtattcggagtataagcacattaaggcgaaactccgactgctggaagtccttatttctaagcgcgatacagattccaaatctatgtag

SEQ ID NO: 187348 - DNA, 609 bp, Artificial Sequence
  Description of Artificial Sequence: Synthetic coding sequence
atgggcgccggcgccctggccatctgccagagcaaggccgccgtgcgcctcaaggaggatatgaaaaaaattgttgccgtgcctctgaacgagcagaaggacttcacctatcagaaactgttcggagtgagcctccaggaactggaaaggcagggactgacagagaacggtattccagctgttgtctggaatattgtagagtacctgacgcagcacggcctcactcaggaaggccttttcagggttaatggcaacgtgaaggtcgtagagcaactgagactgaagtttgagtctggtgtgccagtcgaattaggcaaagacggagacgtctgttccgctgcatcgctgctgaagttgtttttaagagagttgccagattctctcattaccagcgctctgcagccgagatttatccagctttttcaggacgggcgaaacgacgtccaggaatcctctcttagggacttgataaaagaacttcccgacacacattactgtctcttgaagtatctatgtcaattcttaacaaaggtggcaaaacatcacgtacaaaatcgtatgaatgttcacaacctcgcaacagtgtttggaccaaactgcttccagtag

SEQ ID NO: 187349 - DNA, 1494 bp, Artificial Sequence
  Description of Artificial Sequence: Synthetic coding sequence
atggccagccccgccccccccgagcacgccgaggagggctgccccgcacccgcagctgaggagcaggctcccccgagtcccccccccccccaggcctccccagcagagcgacaacagcaggaagaggaggcacaggaggctggcgctgctgagggcgctggacttcaggtagaagaagccgctggacgggcagccgccgcagtgacgtggctgctcggcgaacctgtgctctggctgggatgccgggctgatgaattactatcctggaagagaccgctacggtccctgctgggcttcgttgcagccaatctcctgttctggtttcttgccctcacgccctggcgggtctatcacctgattagcgtgatgattctggggcgcgtcataatgcagataatcaaggatatggtgctatccaggacacgcggagcccaactttggaggtccttgtccgaaagctgggaagtgattaactctaagcctgacgaacggcccaggctgagtcattgcatcgcggagagttggatgaattttagcatcttcctgcaggaaatgtccctgtttaaacagcagtcaccaggcaagttctgtttactcgtctgctctgtctgtactttctttacaatactaggatcttatatccctggggtgatcctttcctaccttctactgctctgtgcattcctttgtccactgtttaagtgcaacgacatcggccagaaaatctattctaaaataaagagtgtcctacttaagctggattttggaatcggtgaatacatcaaccagaagaagagagagcgatctgaagctgataaggaaaaatcccacaaggatgactccgagctggacttcagcgccctttgtccgaaaatatccttgactgtggcagccaaagagttgtccgtcagtgacaccgacgtttccgaagtgtcttggacagataatggaacctttaacttaagcgagggctacacccctcagacggatacatccgatgatcttgacaggcctagcgaggaagttttcagcagggacctgtcggactttccgtctctagaaaatggaatgggaacaaatgacgaggatgaactttccctgggcctgcccactgagctcaagcgaaagaaggaacagcttgactccgggcatcgcccatcgaaggaaactcagagcgccgcgggcctgacgctgccactgaattctgaccagacctttcatctaatgtctaaccttgccggcgacgtgatcaccgctgctgtgaccgccgccatcaaggaccagctggaaggcgttcagcaggccctgagccaggcagcacctatccccgaagaggacacagataccgaagagggggacgatttcgaactgcttgaccagtccgagctggatcagatcgagtcggaactgggcctgacccaggatcaagaggccgaagcacagcaaaataaaaaatcaagcggttttctatccaatctgctgggcggacattag

SEQ ID NO: 187350 - DNA, 1071 bp, Artificial Sequence
  Description of Artificial Sequence: Synthetic coding sequence
atgcccgagggcgaggacttcggccccggcaagagctgggaggtgataaactccaaaccagatgagcgaccaagactctcacattgtattgctgagagctggatgaatttcagcatattcctgcaggaaatgtctctctttaagcaacagtcccctgggaagttttgtttactcgtatgtagcgtgtgcaccttctttactattttgggaagttacatcccgggtgttattctctcctacctgctgctcctttgcgccttcctgtgtccactttttaaatgcaacgatatcggacagaagatctattcaaaaataaagtccgtccttctaaagctggatttcggcatcggggagtatataaaccaaaagaagcgggagcgctccgaagcagacaaagaaaagtctcataaggatgatagtgagctggattttagtgctctctgccctaaaatttccctcaccgtggcggccaaagaactgagcgtctcagatacggacgttagcgaagtgtcatggacagacaacgggacattcaacctgagcgagggctatacaccccaaacggatacatcagacgatttagatcgccccagtgaagaagtctttagcagagacctgagcgattttccttcactggaaaatggaatggggacaaatgatgaagacgagctttccctgggcctcccaactgaactcaaacgtaaaaaggagcagcttgatagtggacaccggccatccaaagagacgcaatccgctgccgggctgactctccccctaaactcagaccagacattccatttgatgagcaacttggcaggcgacgtgatcacggctgctgtcacagcagccatcaaggaccagctggagggcgtgcagcaggccctaagtcaggctgcgccaattccagaggaggacaccgacaccgaggaaggcgatgacttcgaattactggaccagtcagagctggatcagatcgagtccgagctcgggctgacgcaggaccaggaagccgaggcccagcaaaataaaaagtccagcgggtttctctccaacctgcttggaggacattag

SEQ ID NO: 187351 - DNA, 2151 bp, Artificial Sequence
  Description of Artificial Sequence: Synthetic coding sequence
atggccaccagccaccgggtggccaagctggtggccagcagcctgcaaactcccgtcaatccaataactggagcaagggtagcccagtatgagcgggaagatccccttaaagccttggccgcagctgaggcaatcctcgaagatgaagaagaggaaaaggtggctcagccggctggagcctccgcagatctgaacacttcattttccggagttgatgagcatgcgcccatttcttatgaggacttcgtgaattttccggatattcatcacagcaacgaggagtactttaagaaggttgaggagcttaaagctgcccacatcgaaacgatggccaaactcgaaaagatgtatcaggacaagctgcatctaaaagaggttcagcctgtcgttattcgggaagattctctctccgactcatcccggtccgtgagcgaaaagaacagttatcaccccgtgtctctgatgacctcattctcagagccggatttggggcagtcttcttccttgtacgtaagctcttctgaggaagaattaccgaacctcgagaaggaatacccccgtaagaatcggatgatgacatacgccaaggaattgatcaataatatgtggaccgacttttgtgtggaagactacatcaggtgtaaagatactggattccatgccgctgaaaagcgccgcaagaaaagaaaagagtgggtgccaacgataactgttcccgagcccttccagatgatgatcagagaacagaagaaaaaagaggaatcaatgaaatctaagtcggacatagaaatggttcataaggcactgaagaaacaagaggaggatcctgagtacaagaagaaattccgagcaaatcccgttccggcttcagtgttcctccccctctatcacgacctggtgaagcagaaggaggaacgcagacgttcactcaaagaaaagagtaaggaagcattgctggctagccaaaagccattcaagttcatagcgcgagaggagcaaaaacgcgcagcccgggaaaaacagttgagggacttcctgaaatacaaaaagaagaccaaccggtttaaagccagaccaatcccacgatcgacatatgggtcaaccacaaacgataagctgaaggaagaggagttgtaccgaaatttgcgaacccaactacgggcccaggaacatctccagaatagctcccctctgccttgccgctccgcttgcgggtgtagaaatccaagatgcccagagcaggccgtgaagctaaaatgcaagcacaaagttaggtgccccacgcccgatttcgaagatctacccgagcgctaccagaagcacctgagtgaacacaagtccccgaagctgctgacagtgtgtaagcccttcgatctgcacgcttcccctcacgcaagcattaagcgggagaagatcttagctgacatcgaagccgatgaggagaatcttaaagagacacgatggccttacctgagcccgcgtcgtaaaagtccggtgcgctgcgcgggtgtgaatccagttccatgcaactgcaaccctcccgttcctacggttagttcacgaggtagggagcaagccgtgagacgttcgctcgaggaaaagaagatgctggaggaagaacggaaccggattctgaccaagcagaaacagcgaatgaaggaactccaaaaactgctgactaccagggccaaggcctacgattcacaccagagcctcgcacagataagcaagagccgcgtgaagtgcctacgcaaatccgagaaggaacgcatgcgggagtaccagcgggaactggaggagagagaagaaaagttaaagaagaggccactgctgttcgagagagttgcacagaagaatgcccggatggctgccgaaaaacactattccaatactcttaaggctcttggaatctccgatgagttcgtctcaaagaagggccagtctggaaaggtgctggaatacttcaataaccaagagacaaaaagcgtgacagaggataaggaatccttcaatgaggaagaaaaaattgaggagagggaaaacggggaggagaattactttattgacactaactcgcaagactcatacaaagagaaagatgaggctaatgaggagtctgaagaagaaaaatcagttgaggagagccattag

SEQ ID NO: 187352 - DNA, 1983 bp, Artificial Sequence
  Description of Artificial Sequence: Synthetic coding sequence
atggccaccagccaccgggtggccaagctggtggccagcagcctgcagactccagtcaatcctatcacgggagcacgcgtggcacagtatgagagggaggacccgttgaaagctctggccgcggctgaagcaatcctggaggatgaggaggaagagaaagtcgcacaaccagccggcgcatccgccgatctgaatacgagtttctctggggtggacgagcacgctcctatctcttatgaagattttgtgaattttccagacattcaccactccaatgaagagtactttaaaaaagtagaggagctcaaggctgctcacatcgaaacgatggctaagttggaaaaaatgtatcaagacaagctccatcttaaagaagtgcagccagtggtgatcagagaggatagcctgtctgactcctctaggtccgtgtccgagaagaactcttaccatccagtgtctctgatgacatcattctccgaaccggacctggggcagagcagctcgctctacgtttcatcaagtgaggaagagctgccgaacctcgaaaaagaatatcctcggaaaaaccggatgatgacatacgcgaaggaactcataaacaatatgtggaccgacttctgcgtggaagactatatacgctgcaaggataccgggttccacgccgccgagaaaagaagaaagaagaggaaggaatgggtgcccaccatcaccgtgccggagcccttccagatgatgataagagaacagaaaaaaaaggaggagagtatgaagtcaaaaagtgatatcgagatggtccataaagctctgaagaagcaagaggaagatcctgagtataagaagaaattccgggcaaatcccgtgcccgcatcagtgtttctgccattgtatcacgacctggtgaaacagaaggaggaacgtagacgaagcctcaaagaaaaatcaaaggaggcactgctcgcctcccagaagcccttcaagttcatagcaagagaggagcaaaaacgggccgcccgtgaaaaacaactgagggactttttgaagtataaaaagaagactaatcgcttcaaggctagacccattcctagatctacatatggtagcactaccaacgataagttgaaggaagaggaactgtaccggaatctcagaactcaacttcgagcccaggaacaccttcaaaactcctcaccactgccttgtcgctcagcttgcggttgccgcaacccccgatgcccggagcaagccgtcaagttaaagtgtaagcataaggtcaggtgccctacccccgacttcgaagacctaccggaaagatatcagaagcatctgtcagaacataaaagcccgaaactgctaactgtgtgcaaaccattcgatctgcacgcctctccccacgcctccattaagagagagaagattctggcggacatcgaggcagatgaagagaacctcaaagaaacaaggtggccttatctttctcctcgaaggaaatcccctgtccgatgcgctggcgtcaaccctgtcccttgcaactgcaacccaccggtacccactgtgagcagccgaggaagggagcaggccgtgagaaaatcagagaaggagagaatgagagaatatcaaagggaactcgaagagcgagaggaaaagctaaagaaacgccccttactgtttgagagggtagcacagaagaatgcccgcatggccgccgagaagcactactctaacacactgaaggcgttggggatatcagatgagtttgtcagcaagaaggggcagtcaggaaaggtcctggaatacttcaacaatcaggagactaaatccgtgacagaagataaggagtccttcaatgaggaggaaaagatcgaggaacgcgaaaacggcgaggagaattatttcattgatacaaattcacaagatagctacaaggaaaaagatgaggcaaacgaggagtccgaggaagagaagtccgtcgaagaaagtcattag

SEQ ID NO: 187353 - DNA, 645 bp, Artificial Sequence
  Description of Artificial Sequence: Synthetic coding sequence
atgagcgtgccccagatccacgtggaggaggtgggcgccgaggagggggctggcgccgctgctcccccagacgaccacttgcgctccctgaaagctctaaccgagaagcttcggcttgaaaccaggcggccatcatacctggagtggcaagccaggcttgaagagcacacatggccattcccccgccccgccgcggagccacaggcttcactcgaagaaggcgaacgtggggggcaggagcccctgctaccacttcgggaagccggccagcatccacctagcgcaagaagcgcatcacagggcgcaagacctttgtctaccggcaagctcgaaggcttccagtctatcgacgaggccatcgcctggcttaggaaagagctgacagaaatgcggctgcaggatcagcagctggcccgacagttgatgcggcttcgcggcgacattaacaagctgaaaatcgagcatacctgccgcctccacaggaggatgcttaatgacgctacttacgagctggaagagcgggacgagctggccgatcttttctgtgacagcccactcgctagcagcttcagcctcagtacccccctcaagctgatcggtgtcacaaaaatgaatattaactctcggcggttctccctctgttag

SEQ ID NO: 187354 - DNA, 1248 bp, Artificial Sequence
  Description of Artificial Sequence: Synthetic coding sequence
atggccgccagcatcagcggctacaccttcagcgccgtgtgcttccactctgcaaactctaatgctgatcacgaaggcttcctcttgggggaagtgcggcaggaggaaaccttctctatctctgactcacagatttctaataccgaatttctccaggtaattgaaatccacaaccatcaaccatgcagtaaacttttcagtttctacgattacgcatcaaaagtgaatgaagaatccttggatcggattctgaaagaccggagaaaaaaagtgatcggttggtatcgattcaggcgcaatacccagcaacagatgagctatcgtgagcaagtcctgcataagcagctcacaaggatcttaggtgtccctgacttagtcttccttctgtttagctttatttccactgccaataatagcacacacgcccttgaatatgttttgtttcgacccaaccgacgttacaaccagagaatatctctcgcaattcccaatcttggcaacacttcccagcaggaatataaagtcagtagcgtaccaaacacctcacagagttatgccaaggtcatcaaagagcatgggactgatttctttgacaaagacggagttatgaaggacatacgtgccatctatcaggtgtataacgctttgcaggaaaaggttcaggcggtttgcgccgacgtagagaaaagcgaacgagtagtcgagtcatgccaggccgaggtaaataagcttcggaggcaaatcactcagcgtaagaatgagaaggagcaagaaagaaggctgcagcaggccgtgctgtctaggcaaatgccttcggagtcactggaccctgcctttagtccgcgaatgccatcctcgggatttgctgccgagggccggagtaccctcggcgatgctgaagcctctgatcccccccccccatacagtgatttccacccaaataatcaggaaagtaccttatcacattcccggatggaacggtcagtcttcatgccccgcccccaagccgtgggctcatctaactacgcctcaacctcagccgggctaaagtaccccggttctggggctgacctccctccaccacagagagccgcgggtgatagcggcgaagattcagatgattctgattacgaaaatcttatcgaccctacagagcctagtaacagcgaatatagtcactctaaagactcacggccaatggctcatcccgatgaggaccctcgcaacacacaaacatctcagatctag

SEQ ID NO: 187355 - DNA, 3522 bp, Artificial Sequence
  Description of Artificial Sequence: Synthetic coding sequence
atgacccggcggtgcatgcccgcccggcccggcttccccagcagccccgcacctggctctagtcccccgcgctgtcatctcagaccagggtccactgcccacgccgccgcaggaaagcgcaccgaatcaccaggcgaccggaaacaaagcataatcgattttttcaaacctgcctcgaaacaagataggcacatgctggatagtccacagaaatccaatataaaatacgggggaagccggctgagtattaccgggactgagcaatttgagcgcaagctgagtagccccaaggaatccaagccaaagcgcgtcccacctgagaagagcccaatcattgaagcattcatgaagggagttaaggagcaccacgaggatcacggcatacacgagtctcggagaccatgcctgagcttagcatctaaatacctggcaaaaggaaccaatatctatgtgccgagcagttaccaccttcccaaagaaatgaagagcctgaaaaagaagcacagatctcccgagcgacgtaagagtcttttcatccacgaaaacaatgagaagaatgacagagacagaggtaagactaatgcagatagcaaaaaacagactactgttgcagaagccgacatcttcaacaactcatctaggtctttgtctagtagaagctctctctcgagacatcatcccgaagagagccctctgggcgccaagtttcagctgtcactggcatcatattgcagggagagagaactaaaaagactcaggaaggagcagatggaacaacggatcaactctgaaaatagcttctccgaggcatcgtcgctctctctcaagagcagtatcgagcgcaaatacaagccacgccaagagcagcgcaaacagaatgatatcataccggggaaaaacaacctcagcaatgttgagaatgggcacttatctcggaagcggagctctagcgatagctgggagcccacaagtgccggttctaaacagaataagttcccagaaaagcgtaagcgaaactctgtcgattccgacctcaaatctacccgagaatccatgatccctaaggctcgcgaatcgtttctcgaaaagcggccagatgggccgcaccagaaagagaagtttataaagcacatcgcactcaaaacgcccggggacgtgctccgtttggaggatatcagcaaggagccctcggacgaaaccgatggttctagtgccggcctggcgccctcaaattccggcaattctggtcaccattccacccggaatagtgatcagatacaggtggcaggcacaaaggaaacaaagatgcaaaagccccatctccctctttcacaggagaaatcagccataaaaaaggcttccaacttgcagaagaacaaaaccgcatcctccaccaccaaggagaaagagaccaagttgcccctgctatcaagggtgccctcggcagggagcagcctcgtcccactgaacgcaaagaattgcgctctgcccgtctctaaaaaagacaaagaacgatcttcctcgaaggagtgctcaggacattccacagagagtaccaaacacaaggagcacaaagccaaaaccaacaaggctgactctaacgtttcatcaggcaagatctctggcggtcccctacggtctgaatatgggacccccactaagtctccaccagcagctctggaggttgtcccgtgcatcccctcacccgctgcccctagtgataaggccccctccgaaggcgagtctagcgggaatagtaacgcgggctctagcgccttaaagcgcaagttgcggggtgactttgacagcgacgaggagagtctgggctataacttagacagcgacgaggaagaggagacactgaagagtctggaggagatcatggctcttaatttcaaccagacccctgcggctaccggaaagccacccgctctttctaaaggactacgctcccagtcttcagattacacagggcacgtgcacccaggaacctacacaaataccttagagagactggttaaggagatggaagatacccagagattagatgaactgcagaaacaacttcaggaggacatcagacaaggaaggggaattaaatcaccaattcggatcggcgaagaggactctaccgatgacgaagacggtcttttggaggagcacaaggagttcctcaagaaattttcagtgacgatcgacgccattccggatcatcatccgggagaggagattttcaattttttaaatagtgggaaaatctttaatcagtacacactggatctgcgtgacagtgggttcatcggacagtcagcagtggaaaaactcatactaaagtccggcaagaccgatcagattttcctgaccacccagggattcctaaccagcgcgtaccactatgtccagtgtcctgtgcctgtgctcaagtggctgtttcgcatgatgtcagttcacaccgattgcattgtgtctgtacagattctgagtaccttaatggaaatcaccatccggaacgacacatttagcgactcccccgtttggccgtggatccccagtctgtctgatgtcgccgcagttttcttcaacatgggaatcgatttccgcagtctattccccttagagaacctccaacccgacttcaatgaagactatctcgtgtctgagacccaaaccacaagccgcgggaaggagagcgaagatagttcttataagcctatctttagcacacttcctgagaccaatatccttaatgtggttaagtttttggggctatgtacctccatccacccagaaggataccaggaccgggagatcatgctccttatcttaatgttattcaaaatgtctctcgaaaagcagctaaaacagattcccctcgtggacttccagtccctcctgatcaatttgatgaagaacatccgggactggaacaccaaggtgccagaactgtgcttggggatcaacgaattaagtagccatccccataatctgttgtggctggtgcagctcgtccctaattggacaagcaggggacgccagctgagacaatgccttagcctcgtgataatcagcaagctgctggatgagaagcacgaggacgtgccaaacgcgtctaacctgcaggtcagtgtgctccaccgatatctggtccagatgaaacccagcgatctgctaaaaaaaatggtgctaaagaaaaaggctgagcagccagatggaatcatcgacgactcacttcacctcgaactcgaaaagcaggcatactaccttacttatattctgcttcatctagttggcgaggttagctgttcccatagcttttcttccggacaaagaaagcactttgtccttctgtgcggcgcgttggaaaagcacgtaaaatgcgacatcagagaagacgctagattattttaccgcaccaaagtcaaagatctggttgcaagaatccatggcaagtggcaagagatcatccagaattgtaggccgactcagggtcaactgcatgacttctgggtgcccgacagctag

SEQ ID NO: 187356 - DNA, 3561 bp, Artificial Sequence
  Description of Artificial Sequence: Synthetic coding sequence
atgacccggcggtgcatgcccgcccggcccggcttccccagcagcccagcccctgggtcttctcccccacgctgccatctcaggcccggaagcaccgctcacgcggcagccgggaagcggaccgagtctcccggagaccgcaagcagtctattatagattttttcaagcctgctagtaagcaggatagacacatgctcgacagccctcagaagtctaatattaagtatggagggagcaggctgtcaatcaccgggaccgaacaatttgagagaaagctgagtagcccgaaagagagcaaacccaagcgggtgccccccgagaaatcgccgataattgaggccttcatgaagggggtaaaagaacatcacgaagatcacggcatccacgaatcacgtcggccatgcctgtcccttgcatctaaatacctggccaaaggcacaaacatctatgtgccctcaagctaccatcttccaaaggagatgaaaagcttaaaaaaaaagcataggtcaccagagagaagaaaatcgctcttcatccacgaaaataacgaaaagaatgaccgggatagagggaagaccaacgctgatagtaaaaaacaaactaccgttgccgaggcggatattttcaacaattcttctagaagtttgtccagccgatcgagcttgtcccgccatcacccagaagaatcccctctgggagcaaagttccagctctccctcgccagctactgcagagagcgtgaactgaaacgtttaagaaaagagcagatggaacagcgaattaatagtgagaactcatttagcgaagcatcaagcctctccctgaaaagtagtattgaaagaaaatacaaacctcgtcaggagcaacgtaagcagaacgatataatccctggaaaaaataatctgtctaacgtggagaatggtcacttgtcgagaaagcggagcagctcggattcctgggagccaacctctgccgggtctaagcagaataagtttcctgagaagaggaaacgcaactctgttgattccgatctgaaaagtactagagagagcatgattcctaaggcccgcgaatcttttttggaaaagagacctgatgggccacaccagaaggaaaagttcattaagcatatagctcttaaaactccaggagacgtactgcgcctggaagacataagcaaagagcctagcgacgagactgatggcagctctgctggtctggcaccatccaatagtggtaactcgggacaccactccactaggaactcagaccagatacaagtggcaggcaccaaagagactaaaatgcaaaagccccacctgccattaagccaagagaaatcagcaattaagaaagcctcgaatcttcagaaaaacaaaaccgcctccagcacaaccaaagaaaaagaaactaagctgccacttctcagcagggttccatccgctggatccagtttggtaccattaaatgcaaaaaattgtgccctcccagtgtctaaaaaggataaggaacggtcatccagcaaggaatgctctgggcacagtactgagagcaccaagcataaggagcacaaagcgaagacgaataaagccgatagcaacgttagctctggcaaaatcagcggtggaccactacggagcgagtacggaactcccacaaagtcacccccagccgccctagaagtggtgccttgcattccctcaccagcagccccttccgataaagcaccgtcagagggggagagctcaggaaactctaacgccggaagtagtgcgctgaagcgaaagctgcgaggagacttcgacagtgacgaggagtccttgggctacaatcttgatagcgatgaagaggaggaaaccctgaagtcactcgaagaaattatggccctgaacttcaatcagacacccgcagcgacagggaaaccccccgccctttccaaggggttaagatctcaatcctcagactacactgggcatgtgcaccccggaacatatactaatactctcgagcgtcttgtgaaagagatggaggacacacagcgcctggacgaactgcagaaacaactacaagaagacatccgccagggccgcggcataaaatcaccaatcaggataggtgaagaagacagcacggacgacgaagacgggttgctggaggaacacaaggaatttctgaaaaaattttccgtaacgatcgacgccattcccgatcatcaccccggagaagagatctttaactttctgaactcgggcaagattttcaaccagtacacgctggacttgagggattctgggtttatcggccagtctgcagtggaaaaactgatccttaaaagcggcaaaacagatcagatcttcctgacgacccagggctttcttaccagcgcttaccactatgtgcaatgtccggtacccgttttaaagtggctgtttcgaatgatgtccgtccatacagactgtatcgtttccgtccaaatcctttccaccttgatggaaatcaccatccggaacgacacatttagcgatagccccgtgtggccgtggatcccttccctgagtgacgtagccgccgttttctttaatatgggcatcgatttcagatctctgtttcccttggagaatctccaaccggactttaatgaggattatcttgtgagcgaaacccagacaacatccagggggaaggaatctgaagatagctcctataaaccaatcttttccaccctgcctgagacaaatatcttgaacgtggtcaagttcctcggcttgtgtacctctattcacccggaaggctaccaggaccgtgagatcatgctgctcatcctaatgctgtttaagatgtcactggaaaaacagttgaagcaaattcctttggttgacttccagtcactattgatcaatctgatgaaaaatattagagactggaatactaaggtccctgagctgtgtctcggaatcaatgaactgagctcccacccccacaatctgctctggctggtgcagcttgtgccaaattggacttcacgcggacggcagctacggcaatgtctaagtctcgtaatcatttccaagttgctcgatgagaagcatgaggatgtgccaaatgccagcaacctgcaggtgtctgtgctgcatcgatacttggttcaaatgaaacccagtgacttgctaaaaaagatggtgttaaaaaaaaaggcagagcagcccgacggaatcatcgacgactcgctgcacctggagctggaaaaacaagcatactacttgacatatatcctgctgcacctggtcggtgaggtttcttgcagtcactcattcagctctggacaaaggaagcatttcgttctcctgtgtggggccctcgaaaaacatgttaagtgtgacatcagagaggacgcccgcctgttctataggactaaggtgaaagacctggtggcccggatccacggtaaatggcaggagataatccagaactgcaggcccactcaagtcagcttctgttatacgatctcatgcattttgaacagctttgccgagtggcactcctcatactgtctcaagtag

SEQ ID NO: 187357 - DNA, 2277 bp, Artificial Sequence
  Description of Artificial Sequence: Synthetic coding sequence
atgacccggcggtgcatgcccgcccggcccggcttccccagcagccccgctccagggagcagtcctccgaggtgtcacctgcgccctgggagcacagctcacgcagctgctgggaagcggaccgaatcgcctggtgatagaaaacagtccataattgacttttttaagccagcctccaagcaggacagacacatgctggattctcctcagaaatctaatatcaaatacggcggcagtcggctgagtattacagggacggagcagtttgagcggaagctttctagccctaaggagtcgaaaccaaagagggtaccacccgagaaatcccctatcatcgaggcctttatgaagggagtcaaagaacatcacgaggaccacggaatacatgagtctcggcgaccgtgccttagcctcgcttcaaagtatctcgcaaagggaactaatatttatgtgccatcctcttaccacctgcccaaggagatgaagtctctgaagaagaagcatcggagcccagagaggaggaagagtctcttcatacatgaaaataatgaaaaaaacgatagagacaggggcaagactaatgcagatagcaagaagcagacaaccgtcgcagaggctgatatcttcaataattccagtcgatccctgtcttctaggtctagcctcagcaggcaccacccagaggaatctcctttgggcgccaaattccagctgtccctagctagctattgccgggaacgcgaactgaagaggcttaggaaagaacagatggagcaaagaatcaactctgaaaactcattttcagaagcgtccagcctgtctctgaaaagtagtatcgagagaaagtataaaccccgacaggagcagcgtaagcagaacgacataattcctggaaaaaacaacctttcaaatgtggaaaacgggcacctcagccggaagaggagctcatccgactcctgggaaccaacttccgctgggtcgaagcagaacaagtttcctgaaaaacggaaaaggaacagcgtcgactccgacttgaaatctacacgcgaatccatgatacccaaagcccgcgagtctttcctggaaaaaagacccgatggtcctcatcagaaggaaaagttcattaaacatattgctctcaaaaccccgggagacgtgctcaggcttgaagatatctcaaaagagccctccgatgagaccgacggatccagcgcaggactagctccatccaatagtggcaactctggccatcactcaacaaggaatagtgatcagattcaagtggccggaaccaaagagacgaaaatgcagaaaccgcacctaccgctgagtcaggagaaaagcgccatcaaaaaggccagcaacctgcaaaaaaataaaaccgcgtccagcaccacgaaagagaaggaaactaagctgccgctgctatctagggtgccatccgctggttcctctttagttcccctgaatgcaaaaaattgtgcacttcctgtttccaagaaggacaaggaacggtctagctctaaagagtgttcaggacacagtacagaaagcacaaagcacaaggaacacaaagcgaaaaccaacaaagcggactccaatgtgtcatctggtaaaatctccggggggcctttgagatccgaatacggaacacccaccaagtcaccgcccgccgcactcgaggtggtgccttgtatcccgtctcctgcggcaccatccgataaagccccctcggaaggagagtcatctggaaactccaatgcgggcagctccgcacttaaaagaaaactgagaggggatttcgactctgacgaagaaagtctgggttataacctggattcggacgaagaagaggagacgctcaaatcccttgaggaaattatggcgctgaactttaaccagactcccgccgcgaccggaaagccacccgctctgtccaagggactccgctcccagagctccgactatacagggcatgtccatcccgggacatacaccaacaccctagagagattggttaaagagatggaagacactcagaggttcgtttctatcaagattaacctgctgaacctgaccttttgcctttttgtctggttgacctttaacttgcctttcctcaaaaatcacgaaaagctggcatgtattctggatagcgtggtgaattgtgttaggatacgttacgtcggcaggacccaatggctgatgccagttatcacaactctgtgggaaacccaggccagactgctcgaacctaggagctcgaggctccgatag

SEQ ID NO: 187358 - DNA, 675 bp, Artificial Sequence
  Description of Artificial Sequence: Synthetic coding sequence
atgacccggatcaccgagctgtggagcagcccccagtggaaggtgggggctgaagtttgcggacggcaaatgcgcgagcagcggactgcagagcaatcggaaacacaaaggacatggttgtccatggctgctaccttacaatttttggtgtgcctggtggttgcaatctgtcttctgagcggggttaccacaacccagcctcacgccggccagcccatggacagcacaagtgtgggaggaggactgcaggagccggaagcaccagaggtgatgtttgaattgctctgggctggcctagaactggacgtgatgggacagttacatattcaggatgaagaactggccagcacccatcccggtcggcggctccgtttattactgcagcaccacgtacccagcgacttagagggaaccgaacagtggttacaacagcttcaggacctccgcaaaggccctcccttgagtacgtgggactttgaacacctcctccttacaggtctgtcatgcgtctaccgcctgcatgcggcttcagaggctgaggagagaggtcgctgggcccaggtttttgcactgctcgcacaggagacgctatgggacctctgcaaagggttctgccctcaggatagaccgccttcccttggctcctgggcgtccatattggacccttttccctag

SEQ ID NO: 187359 - DNA, 606 bp, Artificial Sequence
  Description of Artificial Sequence: Synthetic coding sequence
atgcgggagcagcggaccgccgagcagagcgagacccagcggacctggctgagcatggcagcgaccctccagtttctggtgtgcctagttgttgccatatgcttgctgtcaggcgtgacgacaacgcagccccatgccgggcagcctatggactctacctctgtagggggtggccttcaggagccagaggcccccgaagtgatgttcgaactgctctgggctgggctggaactggacgtgatgggccaactacacatccaagacgaagaactggcgagtacccatcccggccgtagactgcgtttgctcctccaacaccacgttccatctgatctggagggaactgagcagtggttgcaacaactgcaggacctccggaaagggcctcccctgtctacgtgggactttgaacaccttttactgacgggattgtcttgcgtgtacaggttgcacgctgcctcagaagcagaggaacgcggcagatgggcccaggttttcgccctgttggcacaggagaccctctgggatctgtgcaaggggttctgtccacaggatcgtcccccctcgcttggctcatgggcctcaattttggaccctttcccctag

SEQ ID NO: 187360 - DNA, 1626 bp, Artificial Sequence
  Description of Artificial Sequence: Synthetic coding sequence
atgcccggcctgcggcgggaccggctgctgaccctgctgctgctgggggccttactgagcgctgatctgtatttccacctctggccccaggtgcagcgtcagctgcgaccccgggaaaggccccggggatgcccgtgcactggacgagcctcatctctggctagagactcagctgccgccgcttctgaccctggcacaattgttcataacttttcccgaacggagccacggactgaacccgcaggtggctcacactccgggtccagcagcaaactgcaggccctctttgctcatcctctgtataatgtgcccgaggaaccacccctgctgggagccgaagattcgctcctcgcttcgcaggaagccctccggtactacaggcgcaaagtcgcacgttggaatcggcgtcacaagatgtaccgcgaacagatgaacctcacctcactcgaccctccattgcagttacgcctcgaggcaagctgggttcagttccacttgggtatcaaccgtcatggattgtactccaggagtagtcccgtcgtttcaaagcttctgcaggacatgagacatttccccactatctccgccgattattcccaggatgaaaaggccttattgggcgcctgtgactgtactcaaatagtcaagccgtccggcgtacaccttaagctggtcctgagattctctgactttgggaaagccatgtttaaaccaatgaggcagcagcgggatgaagagacaccggtggatttcttttattttattgacttccagcggcacaacgcagaaatcgccgcattccatcttgacagaattttagattttcggcgcgttccgccgacggtggggcgcatcgtgaatgtcacaaaggaaattctggaggtcaccaaaaatgagatcttacagtccgtcttcttcgttagtcctgccagcaacgtgtgtttcttcgccaagtgtccctatatgtgcaagaccgagtacgcagtctgtgggaatccacatctactggagggttctctaagcgctttcttacccagcctaaatctggctcccagactatcagtgcctaatccatggatccggagctatacattagctggcaaagaggagtgggaggtaaatcctttgtattgtgacacagtaaaacagatatatccctataacaacagtcagcgcctgctgaatgtcatcgatatggctatttttgatttcctcatcggcaatatggatcgtcatcattacgagatgttcacgaagtttggggacgatggatttctaatccatctcgataatgcccggggatttgggcgccactctcacgatgaaatctccattctaagcccactgagccagtgctgcatgatcaagaagaagactctgttgcatcttcaactgttggctcaggccgattatcgactgtcggacgtgatgagggaatcattgttggaggatcagttgagtccggtccttacggagcctcacctcctggcactggaccggaggctgcagacaatcctccgcaccgtggagggatgcatcgtagcgcacggccaacagtctgtcattgtggacggcccagttgaacagctggcccccgactccggacaggcaaatctgacctcttag

SEQ ID NO: 187361 - DNA, 1023 bp, Artificial Sequence
  Description of Artificial Sequence: Synthetic coding sequence
atgggccccccccacagcggccccggcggcgtgcgggtgggcgccctccttctcctgggagtactggggcttgtttctgggctgagcctggagccggtgtactggaactcagccaataagaggttccaggctgagggaggctacgtgttgtacccccagatcggcgaccggttagatcttctttgcccacgagctcggcctccaggacctcattcttcgcccaattacgagttctacaaattatacctcgtcggaggggcccagggcagacgatgcgaagccccccccgctcctaatttactcttaacatgtgaccggccggatctggacctgagattcacaattaaattccaggaatactcccccaacctgtggggtcacgaatttaggtcccaccacgactactacatcatcgccacttccgacggcactcgggaaggattggaaagcctccaaggtggcgtgtgtttgactcggggaatgaaggtgctcctgagggtcgggcaaagtcccagaggcggcgcagtacccaggaagccagtttctgagatgcccatggagcgtgatcgcggcgccgctcactcactggagcctggcaaggagaacctccctggagaccccacatccaacgccaccagtcgcggtgctgagggccccctcccgcccccaagcatgcccgctgttgctggggccgcaggcggcctggctttgcttctcctgggtgtggctggagctggcggcgccatgtgctggagaaggcgccgtgctaagccttctgagagccgacaccccggcccaggctctttcggacgaggaggctcacttggcctcggagggggggggggcatgggcccacgagaagctgagccgggcgagctgggaatagcgctcagagggggcggggccgccgaccccccattctgtccccactatgagaaagtgtccggcgactacggtcaccccgtgtacattgtgcaggacgggccaccccaaagccctccaaatatctactacaaagtttag

SEQ ID NO: 187362 - DNA, 438 bp, Artificial Sequence
  Description of Artificial Sequence: Synthetic coding sequence
atgttcaccagccccagcgagggcaagcccggcaacatggaccggcaccattacgagatgttcaccaagttcggtgatgatgggtttctgatccatcttgacaacgcacggggcttcggccgacatagccatgacgagatctctatcctgtcccctctttcgcagtgctgtatgatcaaaaaaaagaccctcctgcacttgcaactcctcgctcaagccgactacagactctctgacgtaatgcgggagagtctgctagaggaccagctcagcccagtccttaccgaaccacacttactagcactggatcgtcggttacagaccattctgcggaccgtggagggttgcattgtcgcccacgggcaacagtcggtgatcgtagatggaccagtggaacaactcgcccccgactccggccaagctaaccttacaagctag

SEQ ID NO: 187363 - DNA, 1230 bp, Artificial Sequence
  Description of Artificial Sequence: Synthetic coding sequence
atgaagctgaagcagcgggtggtgctgctggccatcctgctggtgattttcatctttacgaaggtgtttttgatcgacaacctagacacgtccgctgccaatcgagaggaccagcgggccttccatcggatgatgaccggtctgagagtggaactggcccccaagctcgatcacacactgcagtccccttgggagatcgccgctcaatgggtcgtgcctagggaagtgtaccccgaagagaccccagagctcggagccgtgatgcacgccatggccaccaagaagataattaaggctgacgtggggtataagggcactcagcttaaagcccttctcattttggaaggtggtcagaaggtagtcttcaaaccaaagagatatagtcgtgatcacgtggtcgagggtgagccgtatgcaggatacgatcggcacaacgccgaggtcgctgccttccatttagatcgcattctcggattccacagggcacctcttgtagtgggacggtttgtcaacctccggactgagatcaaaccagtagctactgagcagcttctgtccactttccttactgtggggaataatacgtgcttctacggcaaatgctactactgtagggagacggagcctgcctgtgcagatggcgatatcatggagggcagcgtgaccctctggctccccgatgtctggcccttgcagaagcaccgccatccatggggcaggacatatcgagagggcaaactcgccaggtgggagtacgatgagtcatattgcgatgctgtcaagaagacaagcccctacgactcaggcccccgtttgctggacatcatcgataccgccgtgttcgattacttgatcggaaatgccgatcggcatcactacgagtctttccaggacgacgaaggggcatctatgctgattttattggacaatgccaaatcatttggcaatccttccctggacgaacggagcatcttggccccactgtatcaatgctgcatcatacgagtgtctacatggaacaggcttaactaccttaaaaatggcgtactgaaatctgccctaaagtctgccatggcacatgatcctatttctccagtccttagcgaccctcacctggatgccgtagatcaaaggctgctgagcgtcctggctacagtcaaacagtgcaccgatcaatttgggatggataccgtgctggtcgaagatagaatgcccttgagccatctttag

SEQ ID NO: 187364 - DNA, 417 bp, Artificial Sequence
  Description of Artificial Sequence: Synthetic coding sequence
atgaagctgaagcagcgggtggtgctgctggccatcctgctggtgattttcattttcacaaaagtattcttgatcgacaatctcgataccagcgcagccaaccgagaggaccagagagctttccaccgaatgatgactggactccgggtggagctcgcgccaaaactggatcatacattgcagagcccctgggaaatagcagcacagtgggtggtgcctagggaagtctatccagaggagaccccagaactgggtgccgtgatgcacgccatggccaccaagaaaatcattaaggccgatgtgggctacaaaggtacacagctgaaggccctcttgatcctggaaggcggtcagaaggtcgtctttaagcctaagaggtactcacgggatcatgtggtggagggcgagccctattag

SEQ ID NO: 187365 - DNA, 1755 bp, Artificial Sequence
  Description of Artificial Sequence: Synthetic coding sequence
atgaagatgatgctggtgcggcggttccgggtgctgatcctgatggtgtttcttgtagcctgcgctttgcatattgccctcgacctgctgccgcggctggaaagacgaggagcccggccttccggtgagccgggctgcagttgtgcgcaaccagcagcggaggtagccgctccaggctgggctcaggtgagaggaaggcccggtgagccaccagctgcttccagcgccgccggcgacgccgggtggccgaacaaacatacactaaggattctccaggatttcagttctgatcccagctcgaacctgagctcccacagtcttgagaagctccctccagcagcagagccggctgaacgggcccttcggggcagagatcctggggccctgcgacctcatgaccctgctcaccggcctttactaagagatccgggaccgcgacgaagtgaaagcccgcccggtccaggtggcgatgccagtctactagctagactattcgaacatccactttatcgggtggccgttcccccactcacggaggaagatgtgctgtttaacgtgaattcagatactcggctgtcccccaaagctgcggagaacccggactggccgcatgcaggtgccgaaggtgcagagtttctcagccccggcgaggccgccgtcgacagctaccctaactggctgaagttccacattgggatcaaccggtatgaactgtatagtcgccataatccggcaatagaagcattgttacacgatctttctagccagaggattacatccgttgccatgaagagcgggggaacacagctaaagcttatcatgacattccaaaactatggacaggccctattcaagccgatgaagcaaaccagggagcaagaaacccctccagatttcttttatttttccgattatgagcgtcacaacgcagagatcgccgccttccacctcgatcgcatcctggattttagacgggtgcctccagtggctgggcgtatggttaacatgacaaaagaaataagagacgtcacacgagacaaaaaattgtggcgaactttttttattagccccgcaaataacatttgcttctacggggagtgctcctattactgctccacggaacatgccttatgcggtaagccagaccaaatcgaggggtcactcgcagccttcctccctgacctttccttggccaagaggaagacatggcggaatccttggcggcggagttatcacaagcggaagaaggccgagtgggaagttgaccctgactactgcgaagaggttaagcagacaccaccttacgattcctctcaccggattttggacgtgatggatatgaccattttcgattttctaatgggcaatatggaccgacatcattatgaaaccttcgaaaagtttggtaacgaaacatttatcatacacctcgacaatggcagagggtttggaaagtactctcatgatgagttatcgatcctcgtgccactgcagcagtgttgcaggattcgcaagtccacatatctgcgacttcagttgctagcaaaagaggaatacaaacttagcctgctgatggcggaatcccttcggggagatcaagtggcccctgtcctgtatcagccccacctagaagccttggatcgaaggctgcgtgtagtactgaaggccgtgcgggattgcgtggagaggaacggcctgcattccgtggtcgatgacgatcttgataccgaacaccgggccgcttcagcccggtag

SEQ ID NO: 187366 - DNA, 3957 bp, Artificial Sequence
  Description of Artificial Sequence: Synthetic coding sequence
atgatgaaccggaccacccccgaccaggagctggtgcccgccagcgaaccagtgtgggagcgcccatggagcgtggaagaaatccggcgcagttcccagtcatggtccttggctgcagatgcaggcctcttacagtttctgcaggagttctcgcagcagacaattagtaggacgcacgaaattaagaaacaggtcgatggcttgatacgggaaacgaaggcaacagattgtaggctccataatgtgttcaacgatttcctcatgctgtcgaatacgcagtttatagagaatcgagtgtacgacgaggaggttgaggaacccgtactgaaggccgaggccgaaaagaccgaacaggagaagacccgtgagcaaaaggaggtcgacctcatcccaaaagtgcaggaagctgtgaattatggactgcaggtcctggattcagctttcgaacagctcgacattaaggctgggaactctgactctgaagaagatgacgccaatggccgcgtggaactaatactggagcccaaggacctgtatatcgacaggcctctcccctaccttattggttctaaactgttcatggagcaggaggatgtgggacttggagagctgtcatccgaggaaggatccgtcgggagtgacagaggctcaatagtcgacacagaagaagaaaaggaagaggaggaatccgacgaagatttcgcacatcacagcgacaatgaacaaaaccaacacactacccagatgagtgatgaggaagaggatgacgacggctgcgatctatttgctgattccgaaaaagaagaggaggatatcgaggatatcgaagagaacactcgtcctaagaggtctaggccaaccagcttcgcggatgaactggctgctcgcataaagggcgacgcaatgggaagggtggatgaggaacccacaacactgccgagtggagaggctaaacctagaaagactttaaaggagaaaaaagaaagacgtaccccatcggatgatgaagaggacaacctctttgcacctccgaagctaaccgacgaagatttcagtccatttggctcaggcggcgggttatttagcggaggcaaaggcctcttcgacgatgaggatgaagagtccgatctatttactgaagccagccaagacaggcaggctggcgccagtgtgaaggaagagagttcgtcctctaagcctgggaagaagatccccgccggagcggtctccgtgttcctgggtgatacagacgtgtttggcgctgcctcagtgccctccctgaaggaacctcagaagcccgaacaaccgacgccccgaaaatcaccttatggccctccgcccaccggcctgtttgacgatgatgatggtgatgacgatgatgactttttctccgccccccactcaaagccttcgaaaactcgcaaagtgcagtctactgctgacatcttcggtgacgaggagggcgacttattcaaagagaaagctgtggcaagccccgaggcgactgtaagtcagaccgatgaaaataaggcccgagcagagaaaaaggtcacactttcatacagcaagaacttgaagccctcttctgaaacgaaaacgcaaaagggccttttcagcgatgaggaggattccgaggacctcttctcttcccagtccgcgtctaatctgaagggggccagcctcctgccaggaaaacttcctactagcgttagcctcttcgatgacgaggatgaagaggacaacctctttggcggcactgccgccaaaaagcagactctcagcctacaggcgcaacgtgaggaaaaggcaaaggcaagtgagctgagcaagaaaaaagcgtccgcactactcttttcgtccgacgaggagtggaatatccctgcatcacagacccatctggcgtctgacagtcggtccaaaggcgaacctcgggattctggcacactgcaatctcaagaagctaaggcggttaagaaaacctcactgttcgaggaggataaagaagacgatctattcgccatcgctaaggattcccagaagaagactcagcgggtgtccctccttttcgaagatgatgttgacagcggcggaagtctgttcggttcacccccaacaagcgtgccccctgcaacaaaaaaaaaggagactgtctcggaggccccgcctctgttattttccgacgaggaggaaaaagaagcccagcttggtgtaaagtctgtcgacaaaaaggttgagagtgctaaggagtcactcaagttcggcaggaccgatgtggccgagtcagagaaggagggactgttaactcgatcagctcaggagaccgtgaagcattctgacctgttcagctcctcatccccttgggataagggaaccaaacctcggaccaagaccgtgctctcactgtttgacgaggaagaagataagatggaagatcagaatatcattcaggctccgcagaaggaggtgggcaaaggatgcgacccagacgcacacccaaaatcaaccggagtgtttcaggatgaagaactcctcttttctcataaactacagaaggataatgatcccgacgttgatctcttcgcaggcactaagaagaccaaacttttggagccatcagtaggaagtctcttcggcgatgacgaagacgatgatctttttagctccgcaaagagtcaaccgcttgtccaggagaaaaagcgggtggtgaaaaaagatcactccgtaaactccttcaagaatcagaaacatccagagtccatccagggaagcaaggagaagggcatctggaagcccgagacgccgcaagctaacctggccatcaaccctgcagctttgttgccaaccgccgcctctcagatttctgaagttaaaccagtgttgccagagctggcgtttccaagttcagaacacagaagatctcacgggctagaaagcgtgcccgttcttcccggatcaggtgaagccggggtttctttcgatctgcccgcccaggcggacaccctccattctgcaaacaagagccgggtgaaaatgcgaggcaaacgaagacctcaaacacgcgctgccagaagactggccgcccaggagtccagcgaagcagaggatatgtccgtgccaaggggcccgattgcccaatgggccgacggggccatttcgcccaacggccacaggccccagctcagggccgcgagcggcgaggactctaccgaagaggctttggcagcagcagctgccccttgggaagggggtccggtgcctggagtcgatacttcaccgtttgcaaaatccctgggacactcccggggggaagccgatttgtttgacagtggcgacattttttctaccggcacagggtcccagtcagtagaacgcactaagcctaaagctaaaatcgctgaaaatcccgccaatccgcccgtgggcggaaaggcgaaatctcccatgttcccagcactgggagaagctagctcagacgatgaccttttccagagtgccaaaccaaagcctgctaagaagaccaatccattccccttgctagaagatgaggatgatttgttcactgatcagaaggtaaaaaaaaatgagaccaaatcttcaagccagcaggacgtcatcctgacaactcaagatatctttgaagacgacatattcgcgactgaagcaatcaagcccagtcagaagacacgggagaaggagaagacccttgaaagcaacctcttcgatgataatatcgatatctttgcggacttgacagttaaaccgaaagagaaaagtaagaagaaagttgaagcgaagtccatctttgatgatgacatggacgatatcttttctactggcattcaggccaagacaacaaagccaaaaagccggtctgcgcaagctgcaccagaaccaagatttgagcacaaagtgtccaacattttcgacgatcctctgaatgctttcggtggccaatag

SEQ ID NO: 187367 - DNA, 3789 bp, Artificial Sequence
  Description of Artificial Sequence: Synthetic coding sequence
atgaaccggaccacccccgaccaggagctggtgcccgccagcgagccagtatgggagcgcccttggagcgtagaagaaatccgacgatcctctcagtcatggagtctcgcagctgatgccggcagggtgtatgacgaagaagtcgaggagcctgtactgaaggctgaggccgagaaaacagagcaggagaaaaccagagagcagaaggaagtagacctcattcccaaggttcaggaggcagtgaactacggacttcaggtactcgactctgcttttgagcagctggatataaaagcaggaaattccgattccgaggaggatgacgctaacggcagagtcgaactgatcctggaacccaaagacctgtacatcgaccggcctttgccatatttgattggttccaaactgttcatggagcaggaagatgtcggcctgggtgagttgtcttctgaagagggttcagtgggttcagatagaggatctatagtggatacagaggaggaaaaggaagaggaggagtctgatgaggacttcgcacatcattcagacaacgagcagaaccagcacacaacccagatgtccgacgaggaggaggacgacgatggatgcgacctgttcgccgatagcgagaaggaagaggaggatatcgaagatattgaagagaacacacgaccaaagcggtccaggccgacctcttttgctgacgaactggcggccagaattaagggagatgcaatggggcgagttgatgaggagccaacgactttgccttcgggggaggccaagcccaggaagaccctcaaggaaaagaaagaaagaagaacgccttccgatgacgaggaggacaacctgtttgcaccccccaagttgaccgacgaggactttagcccatttggctcaggtggagggctcttttccggagggaagggactgtttgacgatgaagatgaggaaagcgatttgttcacggaggcaagtcaagatcggcaagcaggcgctagcgtgaaagaggaaagtagctcctcgaaacctggaaaaaagatccctgccggtgccgtctctgtcttccttggtgatactgacgtgtttggggccgctagcgttccctcactgaaagagccacagaaaccggagcaacccacacctcggaagtccccctatgggccaccacctactggcctctttgatgatgacgatggcgatgatgatgacgattttttttccgctccccacagtaagcctagtaaaactaggaaggtgcagagtaccgccgatattttcggtgatgaagagggcgatcttttcaaagaaaaagccgtcgctagtccagaggccacggtgagtcagaccgacgagaataaagctcgggctgaaaagaaggtgacattgtcttacagtaagaacctgaagccctcctctgagaccaaaacccaaaaagggctgttttcggatgaagaagattccgaggatttgttcagtagccaatccgcctctaatctgaaaggggcctctctgttgccggggaagctgcctacgagcgtgagtctcttcgatgacgaagacgaagaggataacctctttggcggaacagcagcaaagaagcaaaccttatcactgcaggctcaacgagaggagaaggccaaggcctcagagctcagcaaaaagaaggcttcagccctgctctttagctcagatgaggagtggaatatcccggctagtcagacacacctggcatccgactcccgcagcaaaggcgagccacgggacagcgggaccctgcagtcccaggaagccaaggccgttaagaagacatcccttttcgaggaagataaagaggatgatctgttcgccattgcgaaggattctcagaaaaaaacccagagggtcagtctgctgttcgaggacgacgttgatagcgggggctccttattcggcagcccacctacatccgtgccgcctgccacaaaaaaaaaagaaaccgtctcagaggctccaccactgctgttttcggacgaggaggagaaagaggcacaactcggagttaagtctgtggataagaaagttgagtctgcaaaagaatctttgaaattcggccgcactgacgtggccgaaagtgaaaaagagggcctgctgactaggagcgcccaagagaccgttaaacactcagatttgttctcatccagctccccatgggacaaaggtacgaagcccagaacgaaaacagttttgagcttattcgatgaggaagaagataaaatggaagaccagaatattatccaggccccgcagaaggaagttgggaagggatgcgacccggatgctcatcctaaatctactggcgtctttcaggacgaggagttactgttcagtcacaagcttcaaaaggacaacgaccctgacgttgatctctttgccggaactaaaaaaactaaactgctcgaaccatccgtggggtcactttttggtgacgatgaagacgatgacctgttcagcagcgctaagagccagcctttagttcaggagaaaaaaagggtcgtgaaaaaagaccactccgttaacagttttaaaaatcagaagcatcccgagtccatccaggggtctaaagagaaaggcatctggaaaccggaaaccccccaagctaacctggcaatcaaccccgccgcacttctgcccactgccgccagccagatttccgaggtgaaacccgtccttccagagttggcctttccaagcagcgaacatcgcagatcacacggcctcgagtccgtccctgttctccccggttctggagaggccggtgtgtctttcgacctgccggctcaggctgacacactgcactctgctaacaaatccagagtgaagatgagaggcaaaaggaggcctcagaccagagctgctaggcgcctggccgcacaggaaagctctgaagctgaagatatgtctgttcctagaggccccatcgcccagtgggcggacggagcaatctccccaaatggccataggccacagttgagggccgcgagcggcgaggattcgacagaggaggctctcgccgccgcggcagctccctgggagggcggcccagtccctggagtggatactagcccattcgctaagtccctgggacactctaggggggaggccgatctcttcgactccggcgatatctttagtactggaacaggctctcagtccgtggaaaggacaaaacctaaagccaagatcgccgagaatccagctaatccgcctgtgggtggcaaggccaagagtcctatgttcccagccttgggcgaggcctcgtctgatgacgatctgtttcagagtgcaaagcccaagcccgcgaagaagactaacccttttcccctcctagaggatgaagacgatctttttacggatcagaaagtcaaaaagaacgagaccaagagttcgtctcagcaggatgttatcctgaccacccaagatatctttgaggacgacatcttcgccactgaagcgattaaaccatctcagaagacacgggaaaaggagaaaacgctggaaagcaatttgttcgacgataatatagacatattcgcggatctgaccgtgaaacccaaagagaaaagcaagaagaaagtggaggcaaaatcaatcttcgatgatgatatggatgacattttttcaactggaatccaggccaagactactaaacccaaatcacgatctgctcaggcagcgcctgaacctaggttcgaacataaggtctccaatatcttcgatgatcccctgaacgcctttggcggccaatag

SEQ ID NO: 187368 - DNA, 399 bp, Artificial Sequence
  Description of Artificial Sequence: Synthetic coding sequence
atggaggaccagaacatcatccaggccccccagaaggaggtgggcaaaggctgcgatcctgacgcccacccgaagtccacaggagtgttccaggatgaggaattgctgttcagccacaagcttcagaaagacaacgatcccgatgtcgacctgttcgccggaacaaagaagactaaactactggagcctagcgtgggctctctgttcggggacgatgaggatgatgacctgtttagttccgctaaaagtcagcctttggtgcaggagaaaaaacgggttgttaaaaaggaccactccgtgaacagctttaaaaatcagaaacatccggagagtatccagggctctaaggaaaaggggatttggaagcctgagactccccaagtgcggaatccactgtag

SEQ ID NO: 187369 - DNA, 3963 bp, Artificial Sequence
  Description of Artificial Sequence: Synthetic coding sequence
atgatgaaccggaccacccccgaccaggagctggtgcccgccagcgaaccagtttgggaaagaccctggtctgttgaagaaattcggcgatcatcccagtcctggagtcttgcagcggatgccggtctgctgcagtttttacaggaattcagccagcagactatctctcggactcacgagattaagaaacaggtagatggactgatccgagagacgaaggcaaccgactgccgccttcataatgtttttaacgatttcctgatgctatccaatactcagtttatcgaaaatcgggtgtacgatgaagaggtggaggaacccgtattgaaggcagaggccgaaaagacggaacaggagaaaacaagagaacagaaagaggtggacctgatccctaaggtgcaagaggccgtgaactacggcctgcaggttctcgatagtgcttttgaacagctggatatcaaagccggtaactctgacagtgaagaggatgacgctaatggtcgcgtagaactgatcctagagcccaaggacctctatatagaccgcccccttccttacttgatcgggagcaagttatttatggagcaggaagacgttggacttggcgagctgtcgtccgaagaggggtcagtgggctcggatcgcggctctatagtagatacagaggaggagaaggaagaggaggagagtgatgaagatttcgcacaccattctgataatgaacagaatcagcacaccacccagatgagcgatgaggaagaagacgatgacggctgtgatctcttcgccgacagcgaaaaggaagaagaagacatagaggatattgaagaaaacacccgacccaagcgctcacgccctaccagctttgcggacgaactcgctgctcggatcaagggagacgcgatggggagagtcgatgaagaacctacgaccctgccatcaggggaggcgaagcctaggaagacactaaaagaaaagaaagaacggagaacccccagcgatgatgaagaggataatctgtttgcacctcctaagttaaccgatgaggatttcagcccctttggaagcgggggcggcctcttctctggaggcaagggattatttgatgatgaggacgaggagagcgacctgttcacggaagcctctcaggaccgccaagcaggcgcctccgtgaaggaggagtcgtcttcctcaaaaccgggtaaaaaaatcccggccggagcggtctcagtctttttgggtgacactgatgtgttcggcgcagccagtgtgccaagcctcaaggagccccagaagccagagcagccaacgccacggaaatccccgtacggccccccccccacaggtttgttcgatgacgacgacggagatgacgatgatgacttcttttctgccccacactcgaagccctctaagacacgcaaggtacaaagtactgctgacatattcggcgacgaggagggagatttattcaaggaaaaggccgtcgcttcaccagaggctacagtctcgcagactgatgagaacaaggctagggctgaaaagaaagtcactctgtcatactccaagaatctgaagcctagcagtgaaacgaaaacgcagaagggcctcttttcagacgaagaagatagcgaggatcttttctcaagccagtctgcgtccaacctcaagggggcttcattgctccccggtaagctcccaacatcggtatccctatttgacgacgaagacgaggaagataatctgttcggtgggacggcagcaaaaaagcagacactcagcctccaggcccagcgagaggagaaggcgaaagcgagtgagttgtctaagaaaaaagcttccgccttactcttctcaagtgatgaggaggatcaatggaacattcctgctagccagacccatctggctagcgattcccgcagtaaaggcgagcccagggattccggtacactacagagccaggaggccaaagcagtcaagaaaactagcttatttgaagaagacaaggaagacgatctgtttgctatcgcaaaggattctcagaaaaaaacgcagcgggtcagcctgcttttcgaggacgacgtggactctggggggtccctctttggatccccaccgacgtcagttccccccgccacaaagaaaaaagagactgtttcggaggctccacctttacttttttccgacgaagaggagaaggaagctcagctgggagtcaaatccgttgacaaaaaagtagaaagtgcaaaggaaagcctcaagtttgggcgcaccgacgttgccgaatcagaaaaggagggactattgactaggtcagcacaggaaacggtgaagcacagcgacttattttcatcctcctctccctgggacaaaggaaccaagccccgcacaaaaaccgtgctgtctctgttcgacgaagaggaggacaaaatggaagatcagaacattattcaggctcctcaaaaggaggtcggaaaaggctgtgatccagatgcacatcccaagtcaactggcgtattccaggatgaagaactgctgttttcccacaagttacagaaagataatgaccctgatgtagacctgtttgctggcaccaagaaaacaaaactcttagagccaagcgtgggcagtctgtttggggatgatgaagacgacgacctcttcagcagtgctaagtcccagcccctcgttcaagagaagaagcgggttgtcaagaaggaccattcagtgaacagctttaaaaaccagaaacatccagagagcatccaggggagcaaagagaagggaatatggaaaccggagactcctcaggcgaatcttgccatcaaccctgctgccctactccccaccgccgccagccaaatctccgaggtaaagccagtgttgcccgaattagccttcccttcctcggagcatagacgaagccacggcctcgagtcagtccccgtattacctgggtctggtgaagctggagtgtcttttgacttgcccgcacaggctgacaccctccacagcgccaataagagccgggtcaaaatgaggggaaagagacggccccaaactcgcgccgccagaaggctggctgctcaggaaagtagcgaggccgaggacatgtctgtgccccgaggtccaatcgctcagtgggccgatggtgctatctctcccaatggtcatagaccccagttacgggccgccagtggcgaagattctacagaggaagcactggccgctgcagctgcaccctgggaaggcggcccagtccccggcgtggacacgtctcctttcgccaagagcctcgggcactccaggggtgaggccgatctgtttgattccggcgatatttttagtacaggtactggttctcagagcgtcgaacggaccaaacccaaagctaaaatcgcagagaaccccgccaacccacccgtggggggaaaggccaagtcccctatgtttccagcgttgggtgaagcttctagcgatgatgacctattccaaagtgcaaagccaaaaccggccaagaaaaccaacccctttccgctgctcgaggacgaggatgacctcttcaccgatcaaaaggttaagaaaaatgagacgaaatcctccagtcagcaggacgttattctgaccacccaggacattttcgaagacgacatcttcgccacagaggccattaagcccagccaaaagacgcgcgaaaaggaaaaaacactggagtcgaacttgttcgatgataacatagacatttttgccgacctgacagtaaaacctaaggagaaaagcaaaaaaaaggtagaggctaagagcatttttgacgacgatatggacgatattttctcaacaggcatccaggctaagaccacaaagcccaaatcccggagtgcacaagccgcgccagagccgaggtttgagcataaggtctcaaacattttcgatgaccccctaaatgcgtttggaggccaatag

SEQ ID NO: 187370 - DNA, 4026 bp, Artificial Sequence
  Description of Artificial Sequence: Synthetic coding sequence
atgatgaaccggaccacccccgaccaggagctggtgcccgccagcgaaccagtgtgggagaggccttggagcgtggaagagattaggagaagctcacaaagctggagcctcgccgcagacgctgggctgttgcagttcctgcaagagttcagtcagcagactatctccaggacgcatgaaatcaaaaagcaggtggacgggctgatccgtgagacgaaggctacggactgtcgactgcacaacgtttttaacgatttcttaatgctgagcaatacacaattcattgaaaatcgagtgtatgatgaagaggtggaagagccagtgctcaaggccgaggccgaaaaaacagagcaggaaaagaccagggagcagaaagaagtggatttgattcccaaagtccaagaagcagtaaattacgggctgcaagtcctggattccgcctttgagcaactggacattaaagccggcaatagcgactctgaagaagacgacgctaacggtcgagtcgagcttatcctagaaccaaaggatctttatatcgaccgcccactgccatacctgatcggtagcaagctgttcatggaacaggaggatgtgggcctgggggaacttagcagcgaggaaggtagtgtcggcagcgatcggggatctatcgtcgatacagaggaggagaaggaggaggaggagtcagatgaggattttgcccaccacagtgacaacgagcaaaaccagcacaccacccagatgagcgatgaggaagaagatgatgacggttgtgatctattcgctgactctgaaaaggaagaagaggatatcgaggatatagaagagaacactcgccccaaacgatcgagaccaacctccttcgcagacgagctggctgctcgaatcaagggtgacgcgatggggcgcgtggacgaggagccaacaaccctgccaagtggcgaggccaaaccgcgaaagactctgaaggaaaagaaagagagacgtacgcctagtgatgacgaggaggataacttgtttgcccccccaaagctgacagacgaagacttttctcctttcggatccggcggggggctcttttccggcggaaagggtttatttgatgacgaagatgaagagtctgatctctttactgaagccagccaggacagacaagccggcgcctctgtgaaagaagagagttcgtctagtaagccgggaaaaaaaatccctgctggagccgtttctgtgtttctgggggatactgacgttttcggtgcagcgtccgtgcccagtctaaaagagcctcagaagccagaacagcctaccccccggaagtctccgtacgggccaccccctacaggcctgttcgacgacgatgatggagacgacgacgacgactttttttcagcaccacactctaaacctagcaagacgggcaaggtccagtcaactgcagatatcttcggcgacgaggaaggtgatctgtttaaggaaaaagccgtggctagcccagaagccacagtcagccagaccgatgagaataaagcaagagctgagaagaaggtaacactgtcatacagcaagaatctgaaaccgtcctctgagactaaaacacagaaggggctgttctccgacgaggaggactctgaagatttgttctctagccagagcgcctctaacctgaaaggagccagcctcctgcccggcaagctaccaacctctgtgagtctattcgacgacgaggatgaggaggataacttgtttggtggaacagctgccaagaagcagacactatcgcttcaggcacagcgcgaagaaaaagccaaagcatccgaactaagcaagaagaaagcctcagccttgctgttctctagtgacgaggaagatcaatggaacatcccagccagccaaactcacttggcttcagactctagatccaagggagaaccgagggacagtggaacgctgcagtcgcaagaggcgaaagctgtcaaaaagacatccctgttcgaagaggacaaggaggatgacctgttcgctatagccaaggactcacaaaagaaaacacagagagtgagcctgctcttcgaggacgatgttgatagcggtgggtcactcttcggttctccgccaacctcggtacccccagcaactaaaaagaaggagactgtttcggaggccccccccctgctcttcagcgatgaagaagagaaggaggctcagctcggggtgaagagcgtagacaagaaagtggagagcgcgaaggagtccctcaagttcggccggaccgacgtggcggaatccgaaaaggagggcctgctgacccgctccgcccaggaaaccgtgaagcactctgatctcttctcctcgagttctccttgggacaaagggactaagcctcggactaagaccgttctaagtctcttcgatgaggaagaagacaaaatggaagatcaaaatataattcaggctcctcagaaagaagttggtaagggctgcgaccctgacgctcacccaaaatccacaggagtgttccaggatgaggaactgctcttcagccacaaactgcagaaagataacgatcctgatgtggacctgtttgccggtacaaagaagaccaagctactcgagccatccgtgggctcactctttggggatgacgaagacgacgatctgtttagcagcgctaagagccagccactcgttcaggagaaaaaaagagtggtgaagaaggatcactcagtaaattcattcaagaaccagaagcacccagagtcaattcagggttcaaaggaaaaaggaatttggaaaccagagacaccacaggattctagcgggctggctccatttaaaaccaaggagccaagtacccgcattgggaagatacaggccaatctcgcaatcaatcccgctgcccttctacccacagcagcttcacaaatcagcgaggttaaaccagttttgccggaactggcatttccgtcctctgagcatagacgctcccatggtctagagtcggtgcccgtgctaccaggctcaggagaggctggagttagttttgatctgccagcccaagctgacacactgcattctgccaataaaagccgagtcaagatgaggggtaagagacgtcctcagacgagggctgccaggcggctcgcagctcaggagtcttccgaagccgaagacatgtcggtccctcgcggccccatcgctcagtgggcagacggcgccatctcacccaatggtcatcgaccgcagctgcgggcagcgtctggcgaagactcaactgaggaagctctagcggccgccgccgcaccttgggaaggcggtcccgtgcccggggttgatacatcccccttcgccaaatctttgggacattcaaggggggaggcagatttgttcgattccggtgacatcttcagcaccggcacaggttctcagtcagtagagagaactaaaccaaaagcgaaaatagcggagaaccccgcaaacccccctgtgggcggcaaggcaaagtctcccatgttcccagcgttgggggaggcctctagtgacgatgacttgttccagagcgcaaaacccaagcctgctaagaagacgaatccgtttcctctgctggaagatgaagacgacttatttaccgaccagaaagtcaagaagaatgagaccaagagttctagccagcaggacgtgattctgacgactcaagatatttttgaggacgatatttttgctaccgaagccatcaaaccctctcaaaaaacacgggagaaagagaaaacgctggagtctaaccttttcgacgataatatcgacatctttgcagacctaaccgtgaagcctaaggagaagtccaagaagaaggttgaggctaaatcgatcttcgacgacgacatggacgacatctttagcactggcatccaagccaagacaaccaaaccgaagtctaggtccgctcaagccgccccagaaccaagattcgaacacaaagtttccaacattttcgatgaccccctgaacgcctttggcggacagtag

SEQ ID NO: 187371 - DNA, 840 bp, Artificial Sequence
  Description of Artificial Sequence: Synthetic coding sequence
atgatgaaccggaccacccccgaccaggagctggtgcccgccagcgaacctgtctgggaacgaccctggtccgtggaggaaattagaaggagcagccagtcatggtcactagcagcagatgccggtcgggtgtacgacgaagaagtcgaggagccagtgctaaaagcagaagctgaaaagacagagcaggagaaaactagagagcaaaaggaggtcgacttgataccgaaagtccaggaggcggtgaactacgggctgcaggtattggactcagcctttgaacagctggatattaaagccgggaattcagatagtgaagaggacgatgccaacggcagagtcgagctgatactggagcctaaggatctgtacatcgaccgaccgctcccctacctaatcgggagcaagttgtttatggagcaggaagacgtaggcctgggagaactgtcaagcgaagaggggtccgttggctctgaccggggcagcatcgttgatacagaggaggaaaaggaagaggaagaatccgatgaagatttcgcgcatcacagtgataatgaacaaaatcagcacacgacacaaatgtctgacgaggaggaagatgacgacggatgcgatctgttcgcagattctgaaaaagaggaggaggatattgaggatattgaggagaacactcggccaaaaagatccaggcccacatccttcgcagacgagctcgctgcccgtattaaaggcgacgccatgggtagggttgatgaggagcctacaaccctgccatcaggtgaagctaaacctcgaaagaccctcaaagaaaagaaggagcgtagaacacctagcgattag

SEQ ID NO: 187372 - DNA, 3762 bp, Artificial Sequence
  Description of Artificial Sequence: Synthetic coding sequence
atgccccggctgagcggcaagagcgtgcgggtgtacgacgaggaggtggaggagccggtcttaaaggctgaagccgagaaaacagagcaggagaaaacaagagaacagaaggaggtcgatctgatcccaaaagtgcaggaagccgttaattatggactgcaggtattggattcagctttcgaacagctggatattaaagccggaaactcagacagcgaagaagatgacgcaaatgggagagtggagctaatcctggaaccaaaggacttgtacatcgatcgacctttaccttatctgatcggttcaaaactgttcatggagcaagaagatgtaggactgggggagctgtcgtctgaagaagggtcagtcggctcagataggggctccatagtagacacagaagaagaaaaggaggaggaggaatcagacgaggatttcgcccaccactctgacaacgagcaaaaccagcacaccacacagatgagtgacgaagaggaagatgacgatggatgtgacttgttcgccgatagtgaaaaagaggaggaggatattgaggacattgaggaaaatacacgtccgaagcgcagtagaccgacatcattcgctgacgaacttgcagcccgtattaagggagacgccatggggagggtcgatgaggagccaacaacactgccgtcaggtgaggcgaaaccgcgaaaaacactcaaggaaaaaaaggagcgtagaacccctagtgacgatgaggaggacaacctctttgcacctcccaaactgacagacgaggacttttcaccgtttggatccggcggtgggctgttctctgggggtaagggtctgttcgatgatgaagatgaggagtctgacctgttcactgaagccagccaagaccggcaagccggggccagcgtaaaggaagagtccagctcgtcaaagccaggcaagaagatacctgccggcgctgtgagcgtgttcctaggagatactgacgtatttggagccgcttccgttccttctttgaaagaaccccagaaacccgagcagccaacacctaggaagagcccatatggcccaccccctacaggtctgtttgacgatgatgacggcgacgacgacgacgattttttctctgccccccattccaagcccagcaaaactgggaaggtccagagcaccgcggatatcttcggagatgaggaaggtgacctgtttaaagagaaagccgtggcaagccccgaagccacagtgagccagacggacgaaaataaggcccgagccgagaaaaaagtgacattgtcctacagcaaaaacctgaagcccagcagtgagaccaagacacagaaggggcttttttcagatgaggaggacagtgaagatttgttcagttcccagagcgcgagcaaccttaaaggagctagccttttgcctggcaagttgccaacttctgtttccctgttcgacgatgaggacgaagaggataatttattcggcggaaccgctgctaagaagcaaacactcagtctccaagcccagagagaagaaaaagcaaaggcaagtgagctctcaaagaaaaaggcaagtgctctcctgttcagctctgacgaagaagaccaatggaatattccagcgtcgcagacgcatttggcgagtgactctaggagcaaaggagaaccgagggattccgggacgctgcagtcacaggaagcgaaggccgttaagaagacttccctgttcgaggaggataaggaagatgacctgttcgcaatagccaaggattctcaaaaaaaaacacagcgggtgtcattgctgttcgaagatgacgtggactctggcggtagtctgttcggctctcctccgacctcagtacctcctgcgaccaagaagaaagaaacagtaagcgaggccccccccctgctgttctctgatgaggaagaaaaagaggcccagctaggtgtgaaaagtgtggacaaaaaggtggagtctgcaaaggagtcccttaagtttggacgaaccgacgtcgctgagtcagagaaggaagggctcctgacaaggtccgcccaggaaacagtgaagcacagtgacctgttctcgtcctccagtccatgggataaggggacaaaaccaagaactaagacagtgttgagtctgttcgatgaagaggaggataaaatggaggatcagaacatcattcaggccccccagaaggaagtaggcaagggctgcgacccagacgcgcaccctaagtctaccggagtttttcaggacgaggaactcctatttagccacaaactgcagaaagacaacgaccctgacgtggacctttttgccgggaccaagaagactaaactcctggaaccaagcgttgggtctctatttggtgatgacgaggatgacgatctgttttcttctgctaaaagccagccgctcgtacaggagaaaaaaagggtggtgaagaaggaccattcagtaaatagctttaaaaatcagaaacatccggaatccattcaaggttcaaaggagaaagggatctggaagcccgagacacctcaggatagctctggcctggctcccttcaagaccaaggagccttcgacacgaattggtaagatccaggccaatctggctattaacccggctgctcttttgcctaccgctgcaagccagataagcgaggtaaaacccgtgctgcctgaactggccttcccaagttctgagcaccggcgaagccacggactcgaatcggtccccgtccttccgggttccggcgaagctggggtctctttcgatctccctgcacaggctgacacactgcacagcgcgaacaagtcaagagtgaagatgcgtggtaaaagaagaccccagactagagccgcccggcgactcgccgcgcaggagagctctgaggccgaggacatgtctgtgccgcgagggcctatcgctcagtgggccgatggggccatttcaccaaacggacaccgcccacagctcagggcagcctcaggcgaagacagcaccgaagaggcgctggcggctgctgctgctccttgggagggtggacctgtcccaggtgtggatacgtccccatttgccaaatctttgggccattctaggggcgaagccgacctctttgacagcggagacatcttctcaacggggacgggaagccagtcagttgagagaactaaaccgaaagccaagatagccgaaaatcccgctaatcctcccgtgggcgggaaggccaaaagtcctatgtttccagcccttggtgaggccagttctgatgacgacctgttccagagcgccaaaccgaagcccgcaaagaagacgaaccccttccccttactggaagacgaagacgatctttttacagaccagaaggtgaagaaaaatgagacgaagagctctagccagcaggacgtcattttgacgacacaggatattttcgaagatgacatttttgctactgaggctattaagcctagccagaaaaccagggagaaggagaagaccttggagtctaatctgttcgacgacaacattgatattttcgctgacctgactgtgaaaccgaaagagaaatcaaagaaaaaagttgaggccaagtctatctttgatgacgacatggacgatatattcagcaccggtattcaggctaaaacaacaaaaccaaagagtagaagtgcccaagccgcgccagagccgagatttgagcacaaagtgagcaatatcttcgacgacccactcaatgcgttcggcggtcagtag

SEQ ID NO: 187373 - DNA, 3738 bp, Artificial Sequence
  Description of Artificial Sequence: Synthetic coding sequence
atgatgaaccggaccacccccgaccaggagctggtgcccgccagcgagcccgtgtgggagcgtccctggtccgttgaagaaatccgacgatctagccagagttggtccttagccgcggatgctggcctgctgcaatttctgcaggagttctcccagcagaccattagccgcactcacgaaatcaaaaagcaggtagatgggcttatccgcgagacaaaggcaactgactgtaggctgcacaatgtattcaacgactttctcatgctaagtaacacccagttcattgagaatagggtctatgatgaggaggtggaggaaccggtattaaaggcggaggccgagaaaacagagcaagagaagactcgcgagcagaaggaggtcgatctgatccctaaggtccaggaggccgtcaattatggtctgcaggtgctggactctgccttcgagcagttggacattaaggccggaaactccgactcggaggaggacgacgctaatgggagagtggaactgattctagaacccaaagatctctatatcgacagaccactgccctatctgatcgggtcaaagttgttcatggagcaggaggatgtgggcctgggtgagctcagctctgaggagggtagcgtcggcagtgatcgcgggtctatcgttgatactgaagaggagaaggaggaggaggagtctgatgaggactttgcccatcactccgacaacgagcagaatcaacacacaacccaaatgtctgatgaagaggaggacgacgacggttgcgacctcttcgctgacagtgagaaagaggaggaagacatagaggacattgaagaaaatacccgtccaaagaggtcccgaccaacgtcttttgcagacgagctcgccgctcggataaagggcgacgctatgggcagggtagacgaggaacccaccaatgaggaggacaatctttttgctccaccaaagctgacagatgaagatttcagtcccttcggttccggcggggggctcttttcaggaggaaagggtttatttgatgacgaggacgaggaatccgatctcttcactgaggcgtctcaagaccgtcaagccggcgcaagcgtaaaagaagagtcgagctcctccaaaccaggaaagaagatcccagccggtgcagtcagtgtatttttgggagacaccgacgtatttggcgccgcttccgtgccgagcttgaaagagcctcagaagcccgagcagcctaccccacgaaagtccccatacggcccaccaccaaccggactcttcgacgacgatgatggcgatgacgatgatgacttcttttccgctccccatagcaaaccgtccaagactcggaaggttcaatcaactgccgacatattcggggatgaggaaggagacctgtttaaagagaaggccgtagccagtcctgaggctaccgtctcacagacggacgaaaataaggcacgggcggagaagaaggtgaccctgtcttactcaaagaatctcaagccttcttctgagaccaaaactcagaagggcctattctctgacgaggaagacagcgaggatctgtttagttctcagagcgccagcaatctcaagggcgccagccttctgcccgggaagttaccgacgagcgtatccctcttcgatgacgaggatgaagaggataacctctttggcgggacagccgctaagaaacagacactgtccctccaagctcagcgtgaggagaaggcaaaggcatctgaactcagtaaaaagaaggctagcgcactcctgttctcttcagatgaggaggatcagtggaatatacccgcatcccaaactcatctggcctcagattccaggtcaaagggcgagcctcgggacagcggtacattgcagtcacaggaggcgaaggcggtgaaaaaaacctcacttttcgaggaggacaaagaggatgacctttttgctatagccaaagactctcaaaaaaagactcaacgggtctcactgcttttcgaagacgatgttgactcgggtggctcattgttcggtagtccaccaacctcagtccctcctgccactaaggaaggccttcttacccgcagtgcccaggagaccgttaaacactctgaccttttcagctctagcagtccttgggataaaggcaccaagcctagaacgaaaacagtcctctcactcttcgatgaggaggaggacaagatggaggaccagaacattattcaggcaccgcagaaagaggtcgggaagggttgcgacccggatgcacatccaaagagcacaggggtgtttcaagacgaggaactgctgttctcacacaaactgcagaaggacaacgaccctgacgtcgacctgttcgccggcactaagaaaacgaaacttctggagccatcagtagggtctctttttggtgacgacgaagacgatgacctgttcagctctgccaaaagtcaacccctggtgcaggaaaaaaaacgagtcgtgaaaaaagatcacagcgtcaactcttttaagaatcagaaacatccagaatcaattcaaggttccaaagagaagggtatatggaagcctgagacaccccaggccaatttggctatcaatcccgcggctcttctaccaaccgccgccagccagatctccgaggtgaagcccgtactcccagaattagcctttccaagctccgagcaccgccgctcacacggcctggagtctgtgccagtcctgcccgggtctggagaggccggagtctctttcgatcttcccgcccaggctgacactctgcattcggcaaataagagcagagtgaaaatgagaggaaaaaggaggccccagacccgggctgcccggaggttggctgctcaagagtcctctgaggctgaagacatgtcggttccacgaggaccgattgcccagtgggcagacggcgccatcagcccgaacgggcatcggccccagctgagagccgcaagcggcgaagattccacggaggaagcccttgccgcagcagccgccccttgggagggcgggcccgtacctggcgtcgatacctccccctttgcaaagtccctgggtcactccagaggcgaagcagatctgttcgattctggtgacattttttccaccggaaccggcagtcaatccgtcgagaggaccaagccgaaagcaaaaattgcagaaaatcctgcaaatccgcctgtaggaggcaaggctaagtccccaatgttcccagccttaggagaggcctcttctgatgacgatctgttccaatccgccaaacccaagcctgccaagaagacaaacccttttccactgttggaagacgaggacgatttattcacagaccagaaggttaaaaaaaatgaaactaaaagctcaagccagcaggacgttatactcaccacacaggatattttcgaagacgacattttcgcaaccgaagccatcaagcctagccaaaaaacacgagagaaggagaaaaccctcgagtcaaatttgtttgatgacaatatagacatcttcgctgacttaacggtgaagcctaaagaaaagtccaaaaaaaaggtggaagctaaatctatttttgacgatgacatggacgacatttttagtacggggatccaggctaagacaaccaaacccaagtcccgatccgcccaggcagcccccgagcccaggtttgaacacaaggtgtccaacattttcgatgatccccttaatgcgtttggagggcagtag

SEQ ID NO: 187374 - DNA, 3840 bp, Artificial Sequence
  Description of Artificial Sequence: Synthetic coding sequence
atgatgaaccggaccacccccgaccaggagctggtgcccgccagcgagccggtttgggaacgtccctggtccgtagaagaaatcaggcgtagcagccagtcttggtcactggcggccgatgcagggctcttacaattcctgcaggaattttctcagcagaccatctcgagaacccacgagataaagaagcaggtcgacggattgatccgagagaccaaagcaactgattgcagactacacaatgtgtttaacgacttcctgatgctgagtaacacacagttcattgagaatagagtgtacgacgaagaggttgaagaaccggtactgaaagctgaagcagaaaagaccgagcaggaaaagacaagggagcagaaggaagtggacctgattccaaaagttcaggaggccgttaattacggtcttcaagtactggattctgcttttgaacagctggacattaaggccggcaattctgatagcgaggaggatgacgcaaatggcagggtcgagctgattctagaaccaaaagacctctatattgacagaccactgccttacctcatcgggagcaaactctttatggagcaggaagatgttggcctcggagaactgtctagtgaggagggatctgtgggatcagatcgtggatccattgtggacacagaagaggagaaggaggaagaagagtcagacgaagactttgctcaccattcagacaacgaacagaaccagcatacaacccagatgtcggacgaggaggaggatgatgacgggtgtgatctctttgcagattccgagaaagaagaagaagatatcgaggacatcgaggaaaataccagacctaaaaggtctagacctacctctttcgccgacgagctcgccgcaagaataaaaggcgatgcaatgggaagagtcgacgaggaaccgacaaccctgcctagtggcgaagcaaagccaaggaaaactctgaaagaaaagaaggaaagaagaacccctagcgacgatgaggaagataatctgtttgctccccccaaattgactgatgaagacttctctccctttggcagcggaggaggcctctttagtggaggcaagggactgttcgacgacgaagacgaagagtctgacctgtttacagaggcaagccaagacagacaagctggggcatctgtcaaagaggagtccagctcgtctaaacccggcaagaagatccctgccggggcggtgagcgttttcctcggcgatacagacgtttttggcgctgcctcagttccatctctgaaagaaccacagaaacccgagcaacctacgccccgtaagtccccgtacggcccccctccaaccggactgtttgacgacgacgatggcgacgatgacgatgatttcttcagcgccccacacagtaagcctagtaagacaaggaaggtacagagcacggccgatatttttggggacgaggagggagatctttttaaggaaaaggcggtcgcatcccctgaggcgactgtgtctcagaccgacgaaaacaaggcgcgggcagaaaagaaggtgaccctgtcttattcaaagaacctcaagccttccagcgagacgaaaacccaaaaaggccttttctccgatgaagaagacagcgaggatcttttctcttcccagtccgcatcaaatctaaaaggtgcctccctcctccctggcaagttgcccacatcggtcagcctgttcgacgacgaggacgaagaagataatcttttcggaggtacggccgccaagaagcagactctgtcattacaagcacaacgcgaagagaaggccaaagctagcgaacttagcaaaaaaaaggcctccgcactgctgttttcgagcgacgaagaggaccagtggaacatccctgcgtcacagacccatttggcatctgactccagaagtaaaggtgagccgcgcgatagcggtaccctccaaagccaggaagccaaagctgttaaaaagaccagccttttcgaggaggataaggaggacgatctgtttgccatcgctaaggactctcaaaagaagactcaaagagtatcactcctgtttgaggatgacgtggactctggaggatccctgtttgggagtccgccaacatccgtgccacctgcaacaaaaaaaaaggagaccgtgtctgaagctcccccccttttattttccgacgaagaagaaaaggaagctcaactcggagttaagagtgtcgataagaaggtggaatccgccaaggagtctctgaagtttggcagaaccgacgtggctgagagcgaaaaggagggcctgctgacacggtctgcccaggagacagttaagcacagtgacctgttcagcagctcctcgccatgggacaagggtacaaagcctagaacaaagacagtcctgagcctcttcgacgaggaagaggacaaaatggaggaccaaaacattattcaggcaccacagaaagaggtggggaaagggtgcgaccccgatgctcacccgaaatccaccggcgttttccaggacgaggaattactgttctctcacaagttacaaaaggacaacgatcccgacgtggatctctttgccggcacgaaaaaaacaaaactgttggagccaagtgtcggctctttgtttggagatgatgaagacgacgatctgttctcctctgctaaaagccagcctttagccaatctggctattaaccctgccgcgttgcttccgaccgccgcctcacagatctcagaggtaaaacctgtcctacctgagctggcgttcccgagttcagaacatcgccggtctcacggcctcgagtctgtgcccgtattgcctggaagtggggaggccggggtctccttcgatctgcccgcacaagccgatacgttgcactctgccaataagagtcgcgtcaaaatgaggggtaagagacgcccccagacccgagccgctcgtaggttagcagcccaggagtcctcggaggctgaggacatgtccgtcccgaggggccctatcgcccaatgggccgacggcgctatcagcccaaacggtcatcgcccgcagctccgggcagcttctggggaggatagtacagaagaggctctggccgctgccgctgccccatgggaggggggacctgtgcccggcgtagacaccagccccttcgctaagagcctgggacatagccgcggcgaggccgacctattcgactccggcgatatcttcagcacgggcaccggctcacagtcggtcgagagaacaaagcccaaggcgaagatcgcagagaatcccgctaacccaccagttggtgggaaggccaagtctcctatgttcccagcattgggtgaggcgagctccgatgacgatctgttccagtcagccaagccaaagcccgccaaaaagaccaatccttttcccctgctggaagacgaggatgacctcttcaccgaccaaaaggtgaagaagaacgaaacaaaaagcagcagtcagcaggacgtcattcttacaacacaagatatcttcgaagacgatatattcgcaacggaggccatcaagcctagtcagaagactagagagaaggaaaagaccctggagtccaatctgtttgacgacaatatcgatatttttgcagatctaacggttaaaccgaaggagaaatccaagaagaaggtcgaagccaagagtatcttcgacgacgacatggacgacattttttctacgggcatccaagcaaaaacgacaaaacccaagtcaaggtctgcacaggcagctcccgaacctcggttcgagcacaaggtcagcaatatctttgatgaccccctgaacgccttcggcggtcagtag

SEQ ID NO: 187375 - DNA, 1329 bp, Artificial Sequence
  Description of Artificial Sequence: Synthetic coding sequence
atggccgagggcgagggctacttcgccatgagcgaggacgagctggcctgctccccctatattccactcggtggtgactttggcggaggagacttcggcgggggtgatttcggtggaggggacttcggcggtggagggtcattcggaggtcactgcctggattattgtgagtcaccgacggcccactgtaacgtgcttaattgggaacaggtgcagcgactggatgggatcctgtcagagactatcccgattcatggtagaggtaattttccgacactagaactgcagccctctttaattgtgaaggtagtgcggcgaaggctcgccgagaagcgtataggtgtgcgggatgtgagactgaatggctccgcagcgagtcatgtcctgcaccaggattcagggcttgggtacaaggacctggacctgattttttgtgctgatctgcgtggcgaaggtgagttccagaccgtgaaggacgtggtgcttgactgtctcctggacttcttaccggagggagtgaataaggaaaagatcacaccgttaacactgaaagaggcctatgtccagaagatggtgaaagtgtgcaacgactcagatcgttggagtctgatctcccttagcaataattctggcaaaaacgtagagctgaaatttgtagactctctcagaagacagttcgagttctccgtcgattcctttcaaatcaagctcgattcattgctactcttttacgaatgctcagaaaatccgatgacggagacctttcaccccaccatcatcggggaatcagtgtacggtgatttccaagaagccttcgaccatctctgcaacaaaatcatcgctaccaggaaccccgaagagatcaggggcggggggctgctcaagtactgcaatctgctggtgagaggatttcgccccgcctccgatgaaattaaaaccctgcaacgctatatgtgcagccgctttttcatcgacttctctgatattggcgaacaacagaggaaacttgagagctaccttcagaatcattttgtgggattagaggaccgtaagtacgagtacctgatgacactccacggggttgtgaacgagtcaacggtctgtcttatgggacacgaaaggcgccagactctcaacctgataacaatgctggctattagagtcctggctgatcaaaatgtgattcctaacgtagccaacgtgacctgttattaccagcctgccccatacgtcgcagacgctaacttctcaaactattacatcgcccaggtgcagcccgtgttcacatgtcagcagcaaacgtacagcacatggctgccatgtaactag

SEQ ID NO: 187376 - DNA, 1176 bp, Artificial Sequence
  Description of Artificial Sequence: Synthetic coding sequence
atggccgaggagagcagctgcacccgggactgcatgagcttcagcgtgctgaactgggaccaggtgtcaagattgcacgaggtgctgaccgaagtggtccccatccatggccggggcaattttccgacacttgagatcacactgaaggatattgtccagacagtgagaagcagattggaagaggccggaattaaagttcatgatgtccggctcaatggctccgcagcaggccacgtactcgtcaaagataacggtctgggctgtaaagatctggacctcatcttccatgtcgcccttcccaccgaagcggaattccagttggtgagggacgtcgtgctgtgtagtctcctgaattttctgcccgaaggcgtgaataaactcaagatctctcctgtgaccttgaaggaggcctatgtgcagaagctggtgaaggtctgcactgatacagaccgctggtctctcatctccctctccaataaaaacgggaaaaatgtcgagctaaaattcgtagatagcatccgtcgtcagtttgaattcagcgtggatagttttcaaatcatcctggacagcctgctattcttctatgattgttccaacaacccgatttccgagcattttcatccaaccgtcatcggagagtcaatgtatggcgatttcgaggaggcattcgaccacctgcagaaccgcttgattgccacaaagaacccagaggagattcgcgggggtggactcctgaagtacagtaatcttcttgtccgcgactttagacccaccgaccaagaagagatcaagacactcgaacgctatatgtgttctagattttttatcgacttccccgatatacttgagcaacagaggaagctcgagacgtacctccagaatcattttgccgaggaggagcgctctaagtatgattacctgatgatcctccgccgggtggtgaatgaatccaccgtgtgcttgatgggccatgagcgaagacagactcttaacttgatctccttactggcgctcagagtcctcgctgaacaaaacataattccctccgccaccaatgtaacttgttattaccagccggctccctatgtgagcgatggaaatttttctaattactacgtggcccacccgcccgtgacgtattcacaaccgtaccccacctggctgccatgcaactag

SEQ ID NO: 187377 - DNA, 2340 bp, Artificial Sequence
  Description of Artificial Sequence: Synthetic coding sequence
atgcagcaggccctggagctggccctggaccgggccgagtacgtgattgagtctgcccggcagaggcctcccaaacgcaaatatctgtcatctgggaggaagtccgtttttcagaaattgtacgatctttatatagaggagtgtgaaaaggaaccggaggtgaagaagttaaggcgaaacgtcaatctcctggaaaaactggtaatgcaggagacattgtcttgtctcgtagtgaatctgtaccctggcaacgagggctattccctgatgttgcgtggcaagaatggaagtgattccgaaaccattaggctgccctacgaagaaggcgaattactagagtacctcgacgctgaagaacttcctcctatccttgtggacctcctcgagaaaagccaggtcaacatcttccattgtggttgtgttatcgccgaaattagagactacaggcagtccagcaatatgaagtctcccggctaccaatcccgtcacattctcctccggccaacaatgcagacactgatctgcgacgtgcacagtatcacctcagataatcataagtggacgcaggaggataagctccttttggaaagccagctgattttggccaccgcagaaccgttgtgcctggatccctctatagctgtgacctgtacagcaaataggctcttatacaacaagcagaagatgaacacacgccccatgaaacgctgtttcaaacggtacagcagaagttcactgaacaggcagcaggacctgtctcactgcccccccccgcctcaactccgtctcctggattttctacagaagcgtaaggaacggaaggctggacagcactatgatctcaagatctcaaaggctggtaattgtgtggacatgtggaaaagatcaccttgcaacttagccatcccctccgaggtcgacgtcgaaaagtacgcaaaggtggaaaaatcaatcaagtccgacgacagccagccaacagtctggccagcacatgatgtgaaagatgattacgtgtttgagtgcgaggccggcacacagtaccagaagaccaaactcacaatactgcagagcctgggagatcctctctattacgggaaaattcaaccttgtaaagccgatgaggaaagtgattctcagatgtcgccctcacattcaagcaccgatgatcattcaaactggtttataataggcagtaagacagacgctgaacgtgtggtgaaccagtatcaggagctggtgcagaatgaggccaagtgtcctgtgaaaatgtctcactcctcatccggaagtgcttctctgtcccaggtctcacccggtaaagaaactgaccagactgagactgtgtccgtgcagtcatccgttctcggcaagggcgttaaacatagaccacctcccataaagctaccatcatcttccggaaattccagcagcggcaattatttcactccacagcagaccagctccttcttgaaaagccctacacccccgccttctagtaagccttcctctatcccaagaaagtcctctgtcgatctgaaccaagtttccatgctcagtccagcggcccttagccccgctagcagttcacaaagaactaccgccacgcaggtgatggccaacagtgctggactgaatttcatcaacgttgttggcagtgtctgcggagcgcaggcccttatgagcggctccaatcctatgctgggctgtaacactggggcaatcacgcccgctggtattaacctgtccggcctactgccgtcgggcggactcctgcctaacgcgcttccttcggcaatgcaagcagcttcccaggctggcgtaccattcggcttaaagaatacctcctccctacgccctctgaacctgcttcaactcccgggaggcagccttattttcaacaccctccagcagcaacagcagcagcttagccagtttacaccacagcaacctcaacagccgactacctgctcccctcagcagcctggtgagcagggttcagaacaaggatcgactagccaggagcaggcgctttcggctcaacaggccgctgtaattaatctgacaggtgtcggaagtttcatgcagagccaagccgcagtactctcccagctcggcagcgctgagaacaggcccgagcagtcattgccgcagcagcggttccaattgagctccgcattccaacagcagcaacagcagatccagcagttacggtttctccagcatcaaatggccatggcagccgccgcggcccaaacagcacagttgcatcaccatcgacacaccggctctcagagcaaaagtaagatgaagagagggacaccaacaacacctaaattctag

SEQ ID NO: 187378 - DNA, 2202 bp, Artificial Sequence
  Description of Artificial Sequence: Synthetic coding sequence
atgcagcaggccctggagctggccctggaccgggccgagtacgtgatcgaatcagctcgccagcgtcccccaaaaagaaaatatttatcgtcaggccgcaagagtgtgttccaaaaactgtacgacctgtacattgaagaatgcgaaaaggaacccgaggttaagcaaaaactccgcaggaatgtaaatcttttagagaagcttgtaatgcaagagacactcagctgtttggttgttaacttgtacccaggaaatgagggttattctcttatgttgcgaggaaagaacggctctgatagtgagacgatccgactcccatatgaagagggggagttactggagtacttggatgctgaagaattgccgcctatactggttgacctactggagaagtcccaggtgaatatatttcactgtgggtgcgtaattgctgaaatccgcgactaccggcagtcctcaaacatgaagagccctggctaccagtctaggcacatcctgctacgtcccaccatgcagaccctgatatgcgacgtgcacagcattacgagtgacaaccataaatggacacaggaggataaactgctcttggaatctcagctgattcttgcaacggccgaacctttatgccttgacccttccatcgcggttacctgtactgctaataggctgctctacaacaaacaaaagatgaacacccggccaatgaaaagatgttttaagcgctactctcgaagttctcttaataggcagcaagatctcagtcattgtcctccccccccccagctacgcttactagatttcctccagaagagaaaagagcggaaagcaggccagcattacgacctcaagatatctaaggccggcaactgcgtcgacatgtggaaacgctccccctgtaaccttgcaatcccctccgaggtggacgtggagaaatatgccaaagtggagaagtctataaaatctgacgattcccagcctaccgtgtggcctgcgcatgacgtgaaggatgattacgtgttcgagtgcgaggccggtacccagtatcagaaaacaaaactcaccatcctgcaatccctgggcgatcccctctattacggcaaaatccaaccctgtaaggctgatgaagagagcgactctcagatgtcaccatctcatagcagtactgacgaccacagcaactggttcataataggttccaaaactgacgcagaacgcgtggtgaaccagtatcaggagcttgtccaaaacgaggccaaatgccccgtgaaaatgagccacagtagcagcggctcagcttctctgtcccaggtcagtccaggcaaggaaactgaccagaccgagaccgtctccgtgcagagcagtgtactgggtaaaggagtcaaacaccgtccgcccccaatcaagctgccaagctcttcaggaaactctagcagcggcaattacttcactcctcagcagacatcatctttcctgaagagccccactccgccacctagttccaagccatcttcaattccacgcaagagctctgtcgatctgaatcaggtttctatgctgagtcctgctgcattgtccccggcatcctcatctcagaggacaaccgctacccaagtgatggctaattccgccggcctcaatttcatcaatgtagtgggatcggtgtgcggcgcccaggccctaatgtccggaagcaatcctatgctcggatgcaataccggcgcaattaccccagcagggatcaatctgagcgggctcctgccttcaggaggcctcttaccaaacgctctcccctcagctatgcaagctgctagtcaggcaggcgtgccatttggactgaagaacacttccagccttcggcccttgaacctcttgcagctgcctggaggcagtcttatcttcaacacactccagcagcagcagcagcagcttagccagttcacaccacaacagccgcagcagccgaccacctgtagtccacagcaaccgggggagcagggtagtgagcagggaagcacgtctcaggaacaggcactgtcagctcaacaggccgcagttatcaacttgaccggagtcgggtcctttatgcagtcgcaggctgccgccgttgccatcttagcggcgagcaatgggtatgggagcagctcttctactaattcctccgcaacctcatctagcgcttatagacaacccgtgaaaaagtag

SEQ ID NO: 187379 - DNA, 2202 bp, Artificial Sequence
  Description of Artificial Sequence: Synthetic coding sequence
atgcagcaggccctggagctggccctggaccgggccgagtacgtgatcgagtcagcccgacagcggccacccaagcgcaagtacctcagctctggcagaaagtctgtctttcaaaagctgtatgacctgtatatcgaagaatgcgagaaggagcctgaagtgaagcaaaaacttcgtagaaacgtgaatctgctggaaaagctggtgatgcaggagacgctgtcttgcttggtggtgaatctttaccccgggaacgaaggctattccctgatgctgaggggaaagaacggcagcgatagcgagacgattcgcctcccgtatgaggagggagaactgctcgagtacctcgatgctgaagagctccctccgatcctagtggatctgctcgagaaatcacaggtgaatatttttcattgtggttgcgtaattgccgagattcgagactacagacagagctcgaacatgaaaagtccaggctaccagagccggcatatcctgctccgccctaccatgcaaactctcatttgcgatgtccactccattacatctgataaccacaagtggacacaggaggacaagctcttgctggaatctcagctgatcttggctacggctgagccgctgtgcttggacccctcaatcgctgtgacatgcactgcaaacaggttgctgtacaataaacagaaaatgaatacgcggcctatgaagaggtgtttcaaacggtacagccggagctctctcaataggcagcaggatctgtctcactgccctccacctcctcagctgagactgttggactttttgcagaaacggaaggagcgtaaagcgggacagcactatgatctcaagataagtaaggccggtaattgcgtcgacatgtggaagaggagcccctgtaatttggccatccccagtgaggttgacgtggaaaagtacgctaaagtggagaaatccattaagtctgacgactcgcagccaactgtttggcctgcccatgatgtgaaggacgattatgtctttgagtgtgaggcggggacgcagtaccagaagaccaaactgacaattcttcagtctcttggggatcccctgtactacggaaaaatacagccttgcaaggctgacgaagaatctgacagtcagatgagtccgagccactccagcactgatgaccatagcaattggtttatcataggatcaaaaaccgacgccgagcgggtggttaatcagtatcaagagctggttcagaatgaggccaaatgcccagtaaaaatgtcccactcctcttctggaagcgcctcattatctcaggtgtctccaggtaaagagaccgaccagacagagacagtcagtgtccaatcttctgttttgggaaagggagtcaaacacagaccccccccaattaaattgccgagcagctccggaaatagttcctccggcaactacttcacacctcagcaaacttcgagctttctgaagtctccaacaccccccccttccagcaaacccagctccattccacgcaaaagttccgtggacctgaaccaagtttctatgcttagtcctgctgccctatcaccagcaagctcaagccagcgcaccactgcaacccaggtcatggccaacagtgctgggttgaactttataaacgtggtgggatcggtgtgtggggcccaggctctcatgagcgggagtaatccaatgctgggctgtaataccggcgcgattacacccgcagggattaatctgtctggtctcctgcccagcggtggcctgctccctaacgcccttcccagcgcaatgcaggcagcctcacaggccggagtaccatttggcttgaagaatacttcttcattgcgccctttgaatctactccaattgccagggggatctctgatctttaatactctacaacaacaacagcaacaactgtcgcagtttacgccccaacaacctcagcagccaacaacatgctccccccagcaacccggtgaacagggcagcgagcagggatcgacaagccaggaacaagccctgtcagcacagcaggccgctgtgattaacttaacaggcgtgggtagctttatgcagtcccaggccgcagcggtggcaatcctggcagcttccaatggatacgggtcctccagctccaccaattccagtgcaacctcttcgtctgcatacaggcagcctgtcaaaaaatag

SEQ ID NO: 187380 - DNA, 2202 bp, Artificial Sequence
  Description of Artificial Sequence: Synthetic coding sequence
atgcagcaggccctggagctggccctggaccgggccgagtacgtgattgagtctgctagacagcggcccccaaagagaaagtacctaagctccggaaggaaatcagtcttccaaaaactgtacgacctttacatagaggaatgcgagaaagaaccggaagtcaagcagaagcttaggcgcaatgtgaatctcctcgaaaaactggtgatgcaggaaacactgtcctgcctcgttgtgaatctgtaccccggcaatgaggggtattcactgatgctgcgcggcaagaacggcagcgattctgagaccatacgacttccctatgaggagggagagctgctagaatacctagacgcagaagaactgcctccaatcttagttgaccttctggaaaaaagccaggtgaacatcttccattgtggctgcgttatcgctgagatcagagactataggcagagcagcaacatgaaaagcccaggctatcagtctagacacatactgctgcgccctaccatgcagacactgatttgtgacgtgcacagtataacctcagataatcataaatggacacaggaggataagttactgctcgagagccagctcattcttgcgacggccgagccactatgcctagacccgagcattgccgtgacatgcaccgctaaccggctgttatataacaaacagaagatgaatacaaggccaatgaagcgttgctttaagcggtactcacgctctagcctgaatcgccagcaggacctcagccactgcccacctccccctcagctgcggctgttggactttttgcagaagcggaaagaaagaaaagctggccagcactatgatctcaagatttccaaagctggaaattgtgtcgatatgtggaaacgttctccctgcaacctggccatcccaagtgaggttgatgtggagaagtatgcaaaggtagagaagtccatcaaatctgacgactctcaacctactgtgtggcccgcccacgacgtcaaagacgactacgtgttcgaatgtgaggccgggactcagtaccagaaaacaaaactgacaattcttcagagtctcggggatcccttatattatggaaagattcagccctgtaaggccgacgaggagtctgatagccagatgtctccttcgcattcttctactgacgaccattcgaattggttcataattggctcaaaaacggacgcagaaagagtggtaaaccagtatcaagagctggttcagaatgaggccaagtgtcccgtgaaaatgtcacattcttcttccggcagcgcttccctctcacaagtgtcgcctggtaaggaaactgatcagactgagactgtgagcgtgcaatccagcgttttaggcaagggcgtgaagcaccggcctcctcctataaaactgcctagctcgtccggtaattcctctagcggcaattacttcactcctcaacagacatcctctttcttgaaatcccccaccccgcccccctcaagcaagcccagtagcatccccaggaagagctcagtggacttgaatcaagtgagcatgttgagccctgccgctctgtcacctgctagcagcagccaaagaacaactgcaacccaggtgatggctaattccgctggactgaatttcataaacgtggtgggatctgtatgcggagctcaggcattgatgagcgggagcaatcccatgttagggtgtaatacaggagctatcaccccagcggggattaacttatccggccttctgcctagcgggggcctgctgccaaacgccctcccttcagcgatgcaagctgcaagtcaagctggagtccctttcggcctgaagaatacatcttctctgcggcccttgaatctgttgcagctcccaggcgggagtcttatttttaatacccttcagcagcaacagcaacagctgtcccaatttacacctcaacaacctcagcaacccaccacgtgcagcccacagcagccgggagagcagggatcagagcaaggctccacatcacaggaacaggccttaagcgcccagcaagcagcggtgataaacctgactggcgtgggctcgttcatgcaatcccaggccgcagccgttgctattttagctgcgagtaacggctatggaagcagttcctccacaaactcaagtgcgacctctagtagcgcatatagacaacccgtcaagaaatag

SEQ ID NO: 187381 - DNA, 2217 bp, Artificial Sequence
  Description of Artificial Sequence: Synthetic coding sequence
atgcagcaggccctggagctggccctggaccgggccgagtacgtgattgaaagtgctcgccagagaccacctaagcggaagtacctctcatcaggcaggaaaagcgtctttcaaaaactatacgacctgtacatagaagagtgcgaaaaggagcctgaagttaaaaaattaaggcgcaacgtgaacttgctggaaaaactggtgatgcaggaaacactatcatgtttggtggtcaacctgtatccagggaacgaaggctatagcttgatgcttaggggtaaaaacggttctgatagtgaaaccattcgcctcccttacgaggaaggcgagctactggagtacttggatgccgaggaattgcccccaattctggtcgacctcctcgagaaatcccaggtcaacatttttcactgcgggtgtgtgattgccgagatcagggattatagacagagcagcaatatgaagagccctggttaccaatcacggcatattctgttaaggccaaccatgcaaacccttatatgtgatgtacactcaatcacctctgataaccacaagtggacgcaggaagacaagctgctcttggaaagccagcttatccttgccacagcagagccactgtgtctggatccttccatcgctgttacctgtacagctaacaggctgctatataacaaacagaaaatgaataccaggccgatgaaaaggtgcttcaaaagatattctcgcagttccttgaaccgccagcaagatctgagtcactgcccaccgcccccccagctgaggttgctggactttttgcagaaaaggaaggagaggaaggcaggacagcactatgacctgaagatcagtaaggcgggcaattgcgtggacatgtggaaacgaagtccctgcaatctggcgatcccatcagaggtcgacgttgaaaaatacgctaaagtggaaaaaagcatcaagtccgacgacagtcaacctaccgtctggccggcccacgatgtaaaagacgattacgtcttcgagtgcgaggccggcacacaatatcaaaaaaccaaactgaccatactgcagtcactgggagaccccctctactatgggaagatccagccatgcaaggctgacgaggagtctgattctcagatgtctccctcccacagctccacagacgatcattccaattggttcattatcgggagtaaaaccgacgcggagagagtggtcaaccagtatcaggaactggtgcaaaacgaagcaaagtgtccagtgaagatgtcacacagctcgtctggatctgcttctctctctcaagtgagcccggggaaggaaacggaccagaccgaaacagtgtccgtccagtcatctgtacttggtaaaggcgtcaaacatcggcctccgccaatcaagctcccgtccagtagtgggaatagttctagcgggaattattttacacctcaacagacctctagcttcctgaaatctccgacgcctccccctagctctaaacctagctccatcccgcgtaaaagctcggttgatctgaatcaggtttcaatgttgagccccgcagcactgagccccgcatcatcgtcgcagaggaccaccgctacgcaagtaatggctaatagcgccggtctgaactttataaacgtagttggaagcgtctgtggcgcgcaggcgctaatgagcggttccaatcccatgcttggatgcaataccggtgccatcacacccgccggcattaacctctctggtctgctcccctccggcgggttactacctaacgccttgccgagcgccatgcaggctgcctcacaggccggggtccccttcggactaaagaatacttcttccctgaggcctctcaatctattacagctgccgggcgggagccttatattcaataccctgcagcagcaacagcaacagctgtctcagtttaccccccagcagccgcagcagcctaccacctgctctccccaacagccgggagagcagggcagcgaacaggggagcacgtcgcaggagcaggctctttccgcccagcaggccgccgtaattaatctgacaggagtggggtcgtttatgcaaagccaggccgctgccgtcgctatcctcgctgcctctaatggttacggatcatcatcctctacaaactcttctgcaacctccagctctgcgtacagacagccagacacgcgagctctgaatcagaagaactag

SEQ ID NO: 187382 - DNA, 1497 bp, Artificial Sequence
  Description of Artificial Sequence: Synthetic coding sequence
atgtacgtgatcgagagcgcccggcagcggccccccaagcggaagtatctcagcagtggtcgcaaaagtgtgtttcagaaactatatgacctgtatatagaggagtgtgagaaggaacccgaggtgaagaagctgcggaggaacgtgaacctcctcgaaaagttagtgatgcaagagaccctgtcgtgtctagtggtgaatctctaccccggaaatgaggggtatagccttatgctgagaggcaaaaatggctctgacagtgaaaccatccgactgccatacgaagaaggagagctcctcgagtacttggatgccgaagagcttccacctatactggtcgacttattggagaaatctcaggtgaatatcttccattgcggctgcgtgatcgccgaaatccgcgattacaggcagtcctctaacatgaaatctcccggatatcagagccggcatatattactgagacctactatgcaaactctgatctgcgatgttcatagtattacatcggataaccataagtggacccaagaagataaattgctcctagaatcccaattaattcttgccacagccgagccgctatgtctggatccaagcatagcagttacgtgcacagcaaatagattattatataacaagcaaaaaatgaatactcgcccgatgaagcgctgctttaaaagatacagccgtagctccctgaatcgacagcaggatctgtcccactgtccacctccgcctcagcttcgcctcctggactttctgcagaaacgaaaggaacgaaaagccgggcagcactacgatctgaagatatctaaagctgggaattgtgtggacatgtggaagagatccccatgtaatctcgccattccaagcgaggttgatgacgtcaaggacgattatgtatttgaatgcgaagcaggaactcagtaccaaaagactaaactgaccattctgcagagtttaggggaccctttgtactatggaaaaatccagccttgtaaggctgacgaagagtccgactcgcaaatgtccccatcacacagcagtaccgacgaccattctaactggttcatcattggttcaaagaccgatgctgagagagtcgtcaaccaatatcaggagctagtccagaacgaggccaagtgccctgtgaaaatgagccatagctcatccggatctgcaagtttgtcacaagtaagccccggcaaggaaaccgaccagaccgaaacagtgagtgttcaaagctccgtgttgggtaagggagtgaagcaccggccccccccaattaaattgccatcctccagcggcaacagctcctcaggaaactactttactccacagcaaacctctagcttcctaaagtccccaaccccaccgccatcaagcaagccttcctccatccctcggaagtcttctgtggacctgaatcaggtctcaatgctgtcccctgctgctctgtcacccgcttcatcttctcagcggcacgagagctag

SEQ ID NO: 187383 - DNA, 678 bp, Artificial Sequence
  Description of Artificial Sequence: Synthetic coding sequence
atgctgctgaccctggccggcggcgccctgttcttccccggcctgtttgccctgtgcacctgggccctacgcagaagtcagccagggtggtcgaggaccgattgcgtgatgatctcaacaaggttagtctcctcggtgcacgccgtgctcgctacaggatcaggcatcgttatcattaggtcttgcgatgacgttatcacgggacgacattggttggcccgagagtatgtgtggttcctgataccctacatgatttatgattcttacgccatgtatctctgcgagtggtgtcggactagagaccagaaccgcgccccctcactgactctacgcaactttctttctcgtaataggttgatgatcacacaccatgcagtgatcctgtttgtgcttgttcccgttgcccagcttaaacaacaacataccctcttatacaaagtcaacggcatccttacacttgctactttcttgtcatgtagaatactccttttcccttttatgtattggagctacgggcgccagcagggtctgagcctgttgcaagtgccattcagtatacctttttattgcaatgtggctaatgcttttcttgtcgccccacagatttattggttttgtctgctctgcaggaaagccgtgagactcttcgacaccccccaggctaagaaagacggttag

SEQ ID NO: 187384 - DNA, 774 bp, Artificial Sequence
  Description of Artificial Sequence: Synthetic coding sequence
atgctgctgaccctggccggcggcgccctgttcttccccggcctgttcgcgctatgtacctgggccctacgtaggtcgcaaccagggtggtcaaggacagactgcgtgatgatttctactagacttgtgtccagcgttcacgccgtgctggcaacggggtccgggatagtcattattagaagttgcgacgatgtgattactggaaggcattggctcgccagagagtatgtctggtttttgattccttacatgatctacgactcatacgctatgtacttatgtgagtggtgtagaacccgagaccaaaaccgggcaccgtccctgaccttaaggaatttcttatcacgtaatagattgatgatcacacatcacgccgttattttgttcgtcttggtgccagtcgctcagcgactgagaggcgacctcggagacttcttcgttgggtgcatcttcacagctgaacttagcacccctttcgtcagcctggggcgagtactcatccagctcaagcaacaacacacactcctgtataaggtaaacggcatcctcactttagcgaccttccttagctgccgcatcctgttgttccccttcatgtactggagctatggtaggcagcagggcctgtctctgctgcaggtgccatttagcattccattctattgtaatgttgccaatgccttcctcgtggccccacagatatattggttctgtctgttgtgtcgcaaggctgtcaggctattcgatacgccacaggccaaaaaagatggctag

SEQ ID NO: 187385 - DNA, 993 bp, Artificial Sequence
  Description of Artificial Sequence: Synthetic coding sequence
atgatcagcacccggtaccggcggcggcgggacgccccccggggccccggaaggtgccctccccatcctacacgcccccggggccctggacggaagcgcggagccgccggaagccccggagccgcgccttctgcctcccggcgcccagagttccccaagcccctacgcgttttgccttggcgagagcgggggcgtggcggtagggagtggccaatgagcctccggtctcccttgcccacatctgcctgtggttggggcgagtctggaaggcgccccgggagggcaccatgcggacccagaaccgggctgtctgctcgagcagtcctgtccgcaagggcccggctggtctcctctgtacacgccgtactggctaccggttctggcatcgtgattatccgatcttgcgatgatgtcattaccggacggcactggctggctagagaatacgtgtggtttctgattccctacatgatctacgactcttacgctatgtacctctgtgaatggtgtaggacccgggatcagaacagggccccttctttaaccctccgtaatttcctgtctcgtaaccgattaatgattacccaccatgctgtcattctctttgttctggtgccggtggcacagagattacggggggatctgggggattttttcgtgggttgcatctttacagctgagctgtccactccatttgtctcactgggacgagtcttgatccaattaaagcagcaacatacgctgctgtataaggtgaatggaatcctgaccctggccaccttcttgtcttgtcgaatactgttgttccccttcatgtactggtcctacggccggcagcaaggtctgtcactacttcaggtgcccttctctatcccattttactgtaacgtggctaatgcatttctggtggcaccacagatctactggttttgtcttttatgtagaaaagctgttagactgtttgataccccacaggccaaaaaagatggatag

SEQ ID NO: 187386 - DNA, 741 bp, Artificial Sequence
  Description of Artificial Sequence: Synthetic coding sequence
atggaggcccccgaggccgccgagggcggcctgcagcggggcgcccggcgcgcagctggcgccagatcacaaggtgcgctcccttccggtgaggtacatcacgggggtgttaagctgggcatgaggtccattcccattgccaccgcatgtacaatctaccacaagttcttctgtgaaactaatctagatgcatatgacccttatctcattgcaatgagctccatctacctggccggaaaggtcgaggaacagcacctccggacacgcgatatcatcaatgtttcgaaccgctattttaacccctccggtgagccgttggaactggatagtcggttctgggaactaagagatagcatcgttcaatgcgaattgctgatgctgcgggtccttcgctttcaagttagcttccagcacccacacaaatacctgcttcattacctcgttagtctccagaattggctgaatagacacagttggcagaggacccctgtggcggtgactgcctgggccctcttacgagactcatatcacggcgccctgtgcctccggttccaggctcagcatattgcagttgctgtgttatacctcgctttacaagtatacggcgtcgaagtgccggctgaggtagaggcagaaaaaccctggtggcaggtgttcaatgacgatctgactaagccaatcatcgacaatattgtgtctgacttaattcagatctatacaatggacactgaaataccctag

SEQ ID NO: 187387 - DNA, 585 bp, Artificial Sequence
  Description of Artificial Sequence: Synthetic coding sequence
atggaggccggcgtgaagctgggcatgcggagcatccccatcgccaccgcctgtacaatctatcataaattcttttgcgagacaaacctggatgcatatgacccatatctgattgccatgtccagtatttacctggcaggcaaggttgaagagcagcaccttcgtacacgcgacatcattaacgtgtctaatagatacttcaatccttcgggcgaacctctggaattggatagccgcttttgggagctgcgcgactccattgtgcagtgtgaactgctgatgctgagggtccttcggtttcaggtgtctttccagcacccacacaaatacctgctgcactatctcgtttcactgcaaaattggttaaataggcatagctggcagagaactcctgtggcggtgacagcttgggcgttgctcagggactcttatcacggtgcgctgtgcttaaggtttcaagctcagcacatcgccgtggcagtgctctacctggccttgcaggtgtatggcgtcgaagttcccgcagaagtcgaagccgaaaagccctggtggcagatctacacaatggataccgaaattccctag

SEQ ID NO: 187388 - DNA, 681 bp, Artificial Sequence
  Description of Artificial Sequence: Synthetic coding sequence
atggaggcccccgaggccgccgagggcggcctgcagcggggcgccagaagggccgctggcgcgagaagtcagggggcattacctagcggcgaggtccaccatggaggcgtcaagctgggaatgcggagcattccaatagctactgcatgtaccatctatcacaagttcttttgtgaaaccaatctggacgcatacgacccctacttgattgctatgagttccatctatttagcaggaaaagtggaggagcagcatcttcggactagagacattatcaacgtctccaatcgatattttaatccctcaggtgagcccctggagctcgactcacgtttttgggagctccgcgacagcattgtgcagtgtgaactgcttatgctgagggttttgcgatttcaggtaagtttccagcatcctcataagtatcttctgcactatctagtttcgctgcagaattggctgaatcgtcattcatggcagcgaacccctgtggccgtcaccgcttgggccttgctgcgagactcctaccatggtgccctgtgcctgcgcttccaagcccagcacatcgctgtcgctgtcttgtatttagcattgcaggtctacggggtcgaggttcctgctgaagtggaggccgagaagccctggtggcaaatctacaccatggataccgagataccatag

SEQ ID NO: 187389 - DNA, 645 bp, Artificial Sequence
  Description of Artificial Sequence: Synthetic coding sequence
atggaggccggcgtgaagctgggcatgcggagcatccccatcgccacagcctgtaccatctaccacaagtttttttgcgaaactaacctggacgcatacgacccatatctcattgccatgtcttccatttacctggccggaaaggtcgaagagcagcatttacgcacccgggacatcattaatgtgtctaaccggtatttcaatccgtctggggagcctctcgagctggattcgaggttttgggagctgagggattccatagtccagtgcgagcttctgatgctgcgcgttttgaggtttcaagtctctttccagcatccacacaagtatcttcttcactaccttgtgagcctccagaactggctgaacaggcattcatggcaaagaactccggtagcggtaaccgcatgggctttgctgcgcgattcataccacggcgcgctgtgtctgaggttccaggcacagcatatcgctgttgctgttctgtacctggccttacaggtgtacggggtcgaggttccggcagaggtggaggctgagaagccatggtggcaggtgtttaacgacgacctcacaaaaccaatcatcgacaatatcgtatctgatctgatccagatctacactatggataccgaaatcccttag

SEQ ID NO: 187390 - DNA, 741 bp, Artificial Sequence
  Description of Artificial Sequence: Synthetic coding sequence
atggaggcccccgagggcggcggcggccccgccgcccggggccccgagggcccagcacccgaggcccgggtgcacttcagagtagcccggttcatcatggaggctggcgtcaagcttggaatgagaagcataccaatcgccaccgcctgtacgatttaccacaaatttttttgcgagacaaacttggacgcttatgatccttatctaatcgcaatgtcttccatctacctggcaggaaaggtcgaggagcagcacctgaggaccagggatattatcaatgtgagtaacaggtactttaatccatctggagagccgctggaacttgattctcgtttctgggaactgcgcgattccatcgtccaatgtgaactgcttatgctaagagtgttgagatttcaggtgtccttccaacaccctcacaaatacttactccactacttagtgtccctgcagaattggctaaatcgacatagctggcagagaaccccagttgccgtgaccgcctgggctttgctccgcgattcctaccacggggcgctgtgtctgcgcttccaggctcagcatattgcagtggccgttttgtacctagcattgcaggtgtatggagtggaggtcccagccgaggtggaggcggaaaagccttggtggcaggtatttaacgacgatctgactaaaccgattatcgacaacatcgtgtctgacttgatacaaatatacacaatggacacagagattccatag

SEQ ID NO: 187391 - DNA, 429 bp, Artificial Sequence
  Description of Artificial Sequence: Synthetic coding sequence
atggaggccggcgtgaagctgggcatgcggagcatccccatcgccacagcatgcacgatctaccacaagttcttctgtgaaaccaatctcgacgcgtacgatccgtacttgatcgccatgagtagtatttatctcgcaggcaaagtagaagagcaacatctgcgtactcgcgacattatcaacgtgtcaaaccgatttatcccctggacacagagaagtcctaaggtgttggcacaagcatgtccaaaacggagtccagggtggtcagcggcttggggtcattgccatcacgtggccatgaccgccggccctcaccggacctcatgggaggattggctttgctgctggcgtagggcaggcgagggtaatggaatgctgcccctgtgccagtctttggaagtcgccgttcaagtgatggtgggggcatag

SEQ ID NO: 187392 - DNA, 285 bp, Artificial Sequence
  Description of Artificial Sequence: Synthetic coding sequence
tgagccggcaaggtggaggagcagcacctgcggacccgggacatcattaatgtcagcaacaggtatttcaatccatctggtgagcccctggaacttgattctaggttctgggaactgcgtgatagcatagtacaatgcgaattgttgatgttgagagtattgagatttcaggtgtcttttcagcaccctcataaagttttcaatgatgatttgaccaagccaatcatcgacaacatcgtgagcgaccttatccagatctatactatggatacagagattccctag

SEQ ID NO: 187393 - DNA, 366 bp, Artificial Sequence
  Description of Artificial Sequence: Synthetic coding sequence
tgacggtacttcaaccccagcggcgagcccctggagctggacagcaggttctgggaactgagggatagtatcgtacagtgcgagctcctaatgttgcgagtcctcagattccaagtttcattccagcatccacacaaaaattggctgaaccgtcactcatggcagagaacccccgtagctgtcaccgcctgggctctgctcagggatagttatcacggggcgctatgcctgagattccaagcacagcatatcgcggtggcggtcctgtatcttgccctgcaggtgtatggtgtggaggtcccagctgaagtggaggctgagaagccatggtggcaaatctatactatggatacggagataccgtag

SEQ ID NO: 187394 - DNA, 3207 bp, Artificial Sequence
  Description of Artificial Sequence: Synthetic coding sequence
atgctggtgggcagccagagcttcagccccggcggccccaacggcataatacgttcccagtcgtttgcaggttttagtggtttacaggagagaaggagcaggtgtaactcttttattgaaaacagttccgccctgaaaaagcctcaggccaaactcaaaaagatgcataacttaggtcacaagaataacaatccacctaaggagcctcaacccaaacgtgtggaggaagtctacagggcccttaagaatggacttgatgaatatctagaggtgcaccagactgaacttgacaagctgacggcacagctgaaggatatgaaacgaaatagccgcttgggggtactatacgacttggacaagcagattaagacgatcgagcggtatatgaggaggttggaattccacatcagcaaggtggatgagctgtacgaagcgtactgtatacagcggaggctacaggatggagcatccaagatgaaacaggccttcgccacatcccctgctagcaaagccgcccgcgagtctctcacagagatcaatcgttccttcaaagagtacacagagaacatgtgcacaattgaagtggagcttgagaacttactgggagagttctccatcaagatgaaaggcctggccggatttgcaaggctgtgccctggagaccaatacgagatttttatgaaatatggccgccaacgttggaagctgaaggggaagatcgaagttaacggaaaacaaagttgggacggcgaagagactgtctttctgcccctcatcgtgggattcatctctatcaaggtgaccgaactgaagggattggctactcacatcctggtggggagcgttacctgcgagaccaaggaactctttgccgcccggccacaggtggtcgccgtggatattaatgacctcggtactattaaactgaatttagagatcacctggtacccgttcgacgtggaagatatgacagcttcttcaggggccgggaacaaggccgcagcacttcaaagaagaatgagcatgtactctcagggaacccctgagacgcccactttcaaagatcatagtttctttcggtggctccaccctagccccgacaaaccaaggaggctgtccgtgctatcagcgctgcaggacactttcttcgcaaagctacatagatcaaggtcattttccgacctgcccagcttacgtccaagtcccaaggccgttttagaactctactcaaaccttcctgacgacatttttgagaacggcaaggcagctgaagagaagatgccactaagtctatctttctcagatctacccaatggtgattgcgccctcacatcccattctaccggctctccttctaactcaactaaccccgagatcactatcactccagctgagttcaatttatcctccctggcgtcacagaatgaaggcatggacgatacatcatcagcgtctagcaggaactccctcggtgaaggacaagaacctaagtctcacttgaaggaggaagaccccgaagagccacgtaagcctgcatccgcccccagtgaggcttgccggcgacagtccagcggggcaggagctgagcatttgttcctcgagaacgatgtggcggaggcattgcttcaggaatctgaggaggcatccgaattaaagcccgtcgaactagacaccagcgaggggaacattacaaagcagctagtaaaaaggctgacaagcgctgaggtacctatggcaaccgatcgcttgctgagcgaaggctccgtgggcggggagtcagagggctgccgctcatttctcgacggaagtctggaagacgcattcaatggtcttctgcttgctctggaaccacacaaagaacaatataaagaattccaagatctgaatcaggaggtgatgaatctggatgatatcctcaagtgtaagcctgctgtcagccgcagccggtcttcgtcattgtcgttgaccgtggagtcagcgctggaatccttcgacttcctcaacacctccgacttcgatgaggaggaggacggtgacgaggtctgtaatgttggagggggagcggactctgtgttttcagacaccgagactgagaagcatagctaccgtagcgtccaccccgaggctcgcggccacctgagtgaagctctcaccgaagatacaggtgtcggaacttctgttgcaggcagccccctgcccctgaccaccgggaacgaatctcttgacattacaatcgtaaggcacttgcagtactgcactcagttagtccagcaaatcgtcttcagctcaaagacccccttcgttgcccgctctctgctcgagaaactttcccggcaaattcaggtcatggagaagctcgctgccgtctctgatgaaaatattgggaacattagctctgtcgtggaggcgatacccgagttccataagaagctgtcactgctctccttctggaccaaatgttgttcccccgtcggcgtctaccacagcccagccgaccgggtaatgaagcaactagaggcaagttttgctagaacggtaaacaaagagtaccccggactcgccgacccggtgtttaggacgctggtctcacagattctggatcgcgctgagcctctattgtcatcttcactgagcagtgaagtggtaactgtgtttcagtactatagttatttcaccagtcacggggtgtcagatttggagtcatatctcagtcagctcgccaggcaagtgtcaatggtccaaacactacagagcctcagagatgaaaagctgttacagactatgagtgacctcgcacctagtaacttgctagcccagcaagaagtgctcaggaccttggccctgctgctgactagagaggacaacgaggtgagcgaggcggtgacattatacctggcagccgcatccaagaaccaacattttagggaaaaggcgctcctgtactattgcgaggccctgacaaaaactaatttacagctccagaaagctgcttgccttgcgctgaagattctagaagctacggaatctatcaaaatgctagtcaccttgtgtcagtcagatacagaagaaatccggaacgttgcatccgaaactcttctgtctcttggagaagacggaaggctggcctacgagcagctggataagttccctcgtgattgtgtcaaagtgggaggccggcatggcaccgaggtagcaaccgcgttctag

SEQ ID NO: 187395 - DNA, 1776 bp, Artificial Sequence
  Description of Artificial Sequence: Synthetic coding sequence
atgctggtgggcagccagagcttcagccccggcggccccaacggcatcattcggtcgcagagcttcgctggattcagcgggttacaagagagaagatcaaggtgtaactcgttcatagaaaactcttcagccctgaaaaagccgcaggcgaagcttaaaaagatgcataatctagggcacaagaataacaacccgccaaaagagccacagccgaagagagtggaggaggtataccgagcccttaagaatggcctagatgaatatcttgaagtgcaccaaaccgagctcgacaagctgactgctcagctcaaagatatgaaaagaaactccagattgggtgtcctgtacgacctggacaagcagataaaaactatcgaaaggtacatgcgcagactagagttccacatctcaaaggtggacgaattatatgaagcatactgtattcagaggcgcctgcaggacggtgccagcaagatgaaacaggcttttgccacatcacctgcaagcaaggcggccagggagagtttaaccgaaatcaatcgtagtttcaaggagtacacagaaaacatgtgcacaatcgaagttgaactggagaacctccttggtgaattttccatcaaaatgaagggcctcgccggcttcgcccggctttgccccggcgaccaatacgaaattttcatgaagtatggccgccaaagatggaaactcaaaggcaaaatcgaggtcaacggcaagcagtcatgggatggcgaagaaacagtgttcctgcctttgattgtcggcttcattagtatcaaagtgacagagttgaagggccttgccacacacattctcgtcgggtcagtgacgtgtgaaaccaaagaattatttgccgcaaggcctcaagtcgtggccgtggacattaacgatctcgggacaattaaactcaatctggaaattacctggtacccatttgatgtcgaggatatgacggcctccagtggagctggaaataaagccgccgccctgcagcggagaatgtcgatgtactcgcaaggcactcctgagacccctacctttaaagatcactctttcttttcaaatttgcccgatgacattttcgagaatggcaaagctgctgaagagaagatgcccttatcactgtcgttttccgatctcccaaatggggattgtgccctgacctcccattccacaggttctccctccaattctacgaaccctgagataacaataacgcctgcagagtttaatcttagcagcctggcatcacagaacgaagggatggatgataccagtagcgccagtagtagaaatagcctgggtgaaggccaagagccaaagtcccacctcaaagaagaagatcctgaggaacccagaaaacccgcctctgcccccagcgaggcttgtcgcaggcaatctagtggggccggggcagagcacttgtttcttgagaacgacgtagctgaggcactgctccaggagtctgaagaagcctctgagctcaaacctgtggaattggataccagtgaaggaaacatcactaagcagcttgttaagcgcctcacgagtgccgaagtgccgatggccactgacagactgttatctgaggggtcagttggtggagaaagtgaggggtgtcgctctttcctagatggaagcctcgaggacgctttcaatggcctcctgttggccctcgagcctcataaggagcagtacaaggaattccaggacctgaatcaggaagtgatgaatcttgacgatatcctgaaaaagtag

SEQ ID NO: 187396 - DNA, 1944 bp, Artificial Sequence
  Description of Artificial Sequence: Synthetic coding sequence
atggtgctgcccagccggctgcactggatccggaaccggccctggagagacagaatcagaagaagacaactgaacaggctcccaacacggctgccggaaattatgctagttggatcccagtcgttctcacctggcggaccgaacggtattattaggtcccagagctttgcaggattcagcggactgcaagaacggcggagccgctgcaattccttcattgagaattctagtgctctcaagaagccgcaggctaagctgaagaagatgcataatcttggccacaaaaataacaaccctcctaaggagccacagccaaagcgagtcgaagaggtttaccgggccctcaaaaacgggcttgatgaatacctggaggtgcaccagacggaactggataaactaaccgcccagttgaaagacatgaaacgaaactccagattgggtgtactgtatgacttggacaaacagattaagacaatagaacgctacatgagacgcctggaatttcatatcagtaaggtggacgagctttatgaggcctactgcattcagagaaggctgcaggacggagcttccaagatgaagcaagcctttgcaacttcccccgcttccaaagccgcgcgcgaatccctgactgaaataaatcgatcattcaaggagtacacagagaatatgtgtaccatcgaggttgagctggagaatcttttgggcgaatttagcatcaagatgaagggcctggcaggctttgctagattgtgtccaggtgaccaatatgaaatcttcatgaaatacgggcggcagcgctggaaactgaagggcaagattgaagtgaatgggaaacaatcatgggacggagaggaaaccgtgttcctgccactcatcgtgggattcatcagcattaaagtgactgaattaaaggggttggcaacccacatcttggtcggttccgtgacatgcgaaaccaaggagttgttcgctgcccgaccacaggtggtggctgtagatataaacgacctgggcaccatcaaactgaacttggagattacctggtatcctttcgacgtggaagacatgacagcctcttccggcgcagggaataaggcagccgcactgcagcggagaatgtccatgtattcccaggggactccggaaacgcctacctttaaggatcacagtttcttcagcaacctgcccgacgacattttcgaaaatggtaaggcggccgaagagaaaatgcctttaagtttgtccttctctgacctgcctaacggcgactgtgccctgacctcacattctactggatcaccgtctaattcaactaacccagagattaccatcacccccgcggagttcaatctttccagccttgcctcgcagaacgaaggcatggacgatacctccagcgcatcttccagaaactccctaggcgaaggccaggaacctaagagtcacctgaaggaagaggaccctgaagagccccgcaaacctgcttcagctccatccgaggcctgccgacggcagtccagcggagcgggggctgagcacctattcttggaaaatgatgtcgcggaggccctgctgcaggaatctgaagaggctagcgaactgaaacccgttgagctcgatacaagtgagggaaacattactaaacagctggtgaagagactgacgagcgctgaggtccctatggctaccgaccgcctcctatcagaaggaagcgtaggaggcgagtccgaaggctgccgctcttttcttgacgggtcactggaggacgcctttaacggactgttgctggcgctggagccacacaaggaacagtacaaggagttccaagaccttaaccaggaggtgatgaacctggacgatatcctaaaggacgctaaacacctggacgatcagaaactgaacggcgctgcaagttggactgagattactgagggagaatag

SEQ ID NO: 187397 - DNA, 3144 bp, Artificial Sequence
  Description of Artificial Sequence: Synthetic coding sequence
atgcagttcttcgacgccgaggagctgctggtggacgaggaggacgacgtgttcggggaaggacttccaacccgccttcccgagattatgcttgtcggttcccagtcctttagtcctggcgggcctaacggtattatacgtagccagtcgttcgcagggttctcaggcttacaagagcgcaggtccagatgtaatagttttattgagaactctagcgctcttaaaaagccccaggcaaagctcaaaaaaatgcataatctgggacataagaataataatccccctaaggaaccccagccaaaaagagtagaggaagtctatcgcgcactgaagaacgggttggacgaatacctcgaggttcatcagaccgaactcgataagttaacagcccagcttaaggacatgaaacgcaactccaggctgggagtgctttatgatttggacaaacagatcaaaaccattgaacgatatatgagacggctggaattccacatctccaaagtcgatgaactttatgaagcctactgcattcagcgtagattgcaggacggcgcttctaaaatgaaacaggcctttgcaacttcccctgcttccaaagcggctcgggagagtctaactgagatcaatcgatcatttaaggagtatacagaaaacatgtgcacaattgaggtggagttagagaacttattaggtgagttctccatcaaaatgaagggactggctggtttcgcaagactgtgccctggcgatcagtacgagatctttatgaaatacggaagacaaagatggaaattgaagggcaagatcgaggttaatgggaaacagagctgggatggagaggaaacagtattcctccctctgattgtcggattcatcagcattaaggtaaccgagcttaagggattggctacccacatcctggtggggtccgtaacatgtgagacaaaagaattattcgctgcccggccacaagtggtggccgtcgatattaatgatctgggtactatcaaactcaatcttgagatcacctggtatcctttcgacgtagaggatatgactgcatccagcggagctggcaataaagccgccgctctccagcgaaggatgtccatgtactcacagggaacccccgagacacccacattcaaagatcactctttcttttctaacttgccggatgacatcttcgaaaatgggaaggctgcagaagagaagatgcccctgtcattatcattctcagatcttccaaatggcgattgcgctcttaccagccactccaccggctccccttccaattcaactaatcccgaaatcaccatcacacccgccgaatttaatctttctagtctggcaagccagaacgaaggaatggacgacacctcttctgcatcttccaggaattctttgggcgagggacaagaacccaagagccacttgaaagaagaggacccagaggaaccacggaagcctgcgagtgcaccaagtgaggcttgtcgccggcaatcatcaggcgctggcgccgagcacctgttcctagagaacgacgtggccgaagcattactgcaagaaagtgaggaggcgagcgagctgaagcctgtggagctggacacctctgagggcaatatcacgaagcagctggttaagcggctgacctctgcagaagtcccgatggcgaccgaccggctactgtctgagggcagcgttggcggggaatcagaaggctgtagaagttttctcgacgggagcctagaggatgcatttaatggtctgttactcgcactggagccccataaagaacaatacaaggaattccaggatctcaaccaggaggtgatgaacctcgacgatatcctcaagtgcaagccagccgtgagtagatctaggagcagcagcctatcattaactgtggagtcagcgctcgagagttttgacttccttaatacgagcgacttcgatgaggaggaggatggggacgaggtgtgcaacgtgggtgggggggccgacagcgtgttctccgacaccgagaccgaaaagcattcttacagatctgtgcacccagaggcccgcggccacctgtctgaggcactcaccgaggataccggggtgggcacttcagttgccggcagcccactgcctcttactactggcaatgagtctttggacattacaattgtccggcacctccagtactgcacccagctggtacaacagatcgttttcagttctaagacccctttcgtggcgaggagcctcctggagaagctgtcccgccaaattcaggtcatggaaaaactggcagctgtgagcgacgaaaatattggcaacatcagcagtgtggtcgaagcaatcccggagtttcacaagaagttgtccctgctcagcttttggaccaagtgctgctcgcctgtgggcgtttaccactcccccgccgaccgagtgatgaaacaactggaggcctctttcgcacgcaccgtaaacaaagaataccctggattggcagacccagtcttccgaactttggtgagccagattctggatagggccgaacctttgctgagttcctccctctcatcagaagtcgttactgtgtttcagtactacagctattttacaagccatggtgtcagtgacttagaatcatacctgagccagctggcgcggcaggtcagtatggtgcagacactccagagtctcagagacgagaagctactgcagacaatgagtgacttggcaccctcaaatctgttggctcaacaggaagtgttgagaaccttagctctcctcctgacccgggaagataacgaggtaagcgaggccgtgaccctctacctcgcagctgcctccaaaaatcaacacttcagagaaaaagccctcctgtattactgcgaagctttaaccaaaaccaatctgcagctccagaaagcagcatgtcttgctctgaaaattctggaggccaccgagtccattaagatgctggtcactctctgccaatcagacacagaagagatacgcaatgtagcctccgagaccctcctaagtcttggggaggacggccgattggcctacgaacaactagataaattcccacgtgattgcgtaaaagttggaggtagacacggaaccgaggtggcgacggccttttag

SEQ ID NO: 187398 - DNA, 1842 bp, Artificial Sequence
  Description of Artificial Sequence: Synthetic coding sequence
atgctggtgggcagccagagcttcagccccggcggccccaacggcattattcgctcgcaatcctttgcaggctttagcggtctgcaagaaagacggtcaaggtgtaatagcttcatcgagaacagctctgcactcaagaagcctcaggctaaactcaagaagatgcataacctgggacacaagaataacaacccccccaaagaaccacagccaaaacgtgtagaggaagtttacagggccctgaaaaacgggctagacgagtatctggaagtacatcagacagagctcgataagcttactgctcagttgaaggacatgaagagaaattcaaggctgggagtgctgtatgacttagacaagcaaatcaagaccatcgaaaggtatatgcgccgccttgagttccacattagcaaggtggacgagctctatgaagcctactgtatccagcgcaggctgcaagacggcgcaagtaagatgaagcaggcgtttgctactagtcccgcctccaaagccgcccgcgaaagtctaactgagatcaaccgatcttttaaggagtacaccgaaaacatgtgtacaatcgaagttgaattggaaaatcttctgggcgagttctccattaagatgaagggcctggccggctttgcacggctctgtccaggagatcagtatgagatttttatgaaatacggtcgccaacgttggaaactgaagggcaagatcgaggtcaatggcaagcagtcgtgggacggcgaggaaacagtgttcctaccactgatcgtcggttttatctccatcaaggttacagagctgaagggacttgcaactcacatcctcgtgggatcagtaacctgtgaaacaaaagaattgttcgccgcccggccacaggttgtggccgtggatatcaacgacctggggaccatcaaactaaacctcgagataacttggtacccattcgacgtagaagacatgacagcatcaagcggtgccggcaataaggccgctgcactccaacggcgcatgagtatgtactcacagggcacacctgagacgcctacgttcaaagaccactccttcttttcgaaccttcctgatgacatctttgagaatggaaaagctgcggaggagaagatgccactctccctttctttcagtgatttgccaaatggcgactgcgctctcacgtctcactcaactgggtccccttccaactccaccaaccctgaaataaccatcacaccagccgaatttaatctgtcaagtctggcgtcccaaaatgagggcatggatgataccagctcagcctcttcccgaaattcactgggggaaggtcaggaaccgaagtctcacctcaaagaagaggatcccgaagaaccaaggaagcccgcatccgcgccctcggaggcttgccgacgacaatcatcaggagccggggcggagcatctgttcctggaaaacgatgtggccgaggccctgctgcaggaaagcgaagaggctagtgagctgaaacccgttgagcttgacacatctgaggggaatatcacaaaacagctcgtcaaacggctgacctccgccgaggtaccaatggccaccgatcggctgctcagcgagggtagtgtcgggggcgagtccgaagggtgtaggagtttcttagacggctccctggaagacgcattcaatggacttcttctggcattagagccacataaggagcagtacaaagaatttcaggatctaaatcaggaagttatgaatttggatgacatactcaaggacgccaaacaccttgacgaccaaaagctgaacggtgccgccagttggaccgagatcactgagggggagtag

SEQ ID NO: 187399 - DNA, 2673 bp, Artificial Sequence
  Description of Artificial Sequence: Synthetic coding sequence
atgagcgccaacaacagcccccccagcgcccagaagagcgtgctgcctacagctattcctgctgttttacctgcagccagcccttgcagctcccccaaaaccggactgtccgctcggctcagcaacggttcatttagtgcgccttcactcaccaattctcgcggaagcgtgcatactgtttcatttctgttacagattggcctcactcgcgagtccgttactatcgaggcacaggaactgtcactgagcgcggttaaagacttggtttgctctatcgtttaccagaagtttccggaatgcgggtttttcggcatgtacgacaaaatcctgctctttcggcatgatatgaattccgaaaatatcctgcagctgattacctccgcagatgagattcacgagggagatttagtggaagtagtcttgagcgcactggccacagtggaggacttccaaatccggccacacacattgtatgttcattcctataaagcacctacattttgcgactactgcggtgaaatgctgtggggattggtgagacaggggttgaaatgtgaggggtgcggccttaactatcacaaaagatgcgccttcaaaatcccgaacaactgctctggggtccgcaagcggcgtctctcaaacgtcagtctgcccggtcctggactgtcagtccctagacccctacagcccgagtacgttgcactgccttcagaagaaagtcacgtgcatcaggagccatcaaagagaattcctagttggtcgggtcggccaatctggatggaaaagatggtgatgtgcagggtaaaagtcccccacacttttgctgtccacagctacactcgccccacaatctgtcagtactgcaaacggctgttgaaagggcttttcaggcagggaatgcaatgtaaggattgcaaatttaattgtcacaaaagatgcgccagtaaggtgcctagagattgccttggggaggttactttcaatggcgagcctagctcccttgggacagatactgatatccccatggatatcgataacaatgacatcaatagtgattccagccgaggtctcgatgacactgaggaacccagccctcccgaggacaaaatgttctttttggatcccagtgatcttgacgtcgagcgggacgaggaggccgttaagacaattagtccaagtacatccaataatatcccacttatgagagttgtacaatctataaagcacactaaaagaaaatcgtcaacaatggtgaaggaggggtggatggtccactacacatctagagacaatctgcgtaaacgccactactggcgcttggattctaagtgtttaaccctgtttcagaatgagtccgggtctaaatattacaaggaaattccgctgagcgagatcctcagaatttctagtccacgggactttactaacatctctcaaggctcaaatccacactgtttcgaaatcatcaccgatactatggtctactttgtgggggagaacaatggagactcctcacacaacccagtgctcgccgcaacaggcgtcgggttggacgtcgctcagagctgggaaaaggcaatacgacaggccttgatgcccgtaactcctcaagcaagtgtgtgtacctctcccggccaaggtaaggatcacaaggatctgagcacctccatttctgtaagcaactgccagattcaggagaacgttgatatctccaccgtttaccagatttttgctgacgaagtcctggggtcaggccagttcgggatagtctacggcggtaaacaccgcaaaacaggccgggatgtggctataaaggtgattgacaagatgaggtttcccacaaaacaggagtcgcagcttagaaatgaagtcgccatactccagaacctacaccatcctggtattgtcaacttagagtgtatgtttgaaactcctgaacgagtgttcgtggtgatggaaaaactgcatggcgacatgttagaaatgatcctgtcttctgagaaatctagactccctgaaaggatcaccaaattcatggttacacagatcctggtggcactgcgtaatttgcacttcaaaaatatagttcattgcgacctgaagcctgaaaacgtgcttctagcttctgctgaacccttcccccaggtaaagctgtgtgactttggcttcgccaggattattggtgaaaagtcctttaggcggtccgtggtaggcaccccagcttacctggcccctgaggtgttacgttcaaagggctacaaccggagcctggacatgtggagtgtgggagtcattatttacgtttctctgagcgggacatttccttttaatgaggatgaagacattaatgaccaaattcagaatgcagcatttatgtatccccctaatccgtggcgggagatatcgggcgaagcaatcgatctgatcaacaatctgctacaggttaagatgcgtaagcgctatagtgtggataagagtctctcacacccgtggctgcaggactaccaaacatggctcgacctccgtgagttcgagaccagaatcggggaacgttacatcacccatgagagcgatgatgcaaggtgggagatacacgcttatacacataatttggtctatcccaaacacttcatcatggctcctaaccccgatgatatggaggaggacccctag

SEQ ID NO: 187400 - DNA, 1233 bp, Artificial Sequence
  Description of Artificial Sequence: Synthetic coding sequence
atgccctacagcaccaacaaggagctgatcctgggcatcatggtggggaccgctgggataagtctcttgttgctgtggtaccacaaggtgcgcaaaccaggtattgccatgaagctgcctgaatttttatccctgggaaatacttttaactctatcactctgcaagacgagattcacgatgatcaaggcacaactgtcattttccaggagcgccagctccaaatattggagaagttaaatgagctactgaccaatatggaggaattgaaggaggaaataagattcctaaaggaggcaatccctaagctggaagagtatattcaagacgaacttggtgggaagatcacagtccataaaatcagccctcagcaccgtgcacggaaacgtagactaccaaccatccagtcctccgcaacctctaactccagtgaggaggctgagtctgagggagggtacatcacggcgaacacagacacggaggaacagtcattcccagtgccaaaggcgtttaatacaagggtcgaagagttaaaccttgatgtgctgttgcagaaagttgatcatctcagaatgagcgagtccggcaaaagcgagagcttcgaacttttaagggaccacaaggaaaaatttcgcgatgagattgaattcatgtggaggtttgcaagagcctatggagatatgtacgagctgtccaccaacacccaggagaagaagcactacgctaacatagggaagacgctgagtgagagagctataaacagagctcccatgaatgggcattgccacctgtggtacgccgtcctgtgtggatatgtgtctgagttcgaagggctacagaacaagattaactacggtcacttgttcaaggaacaccttgacatcgctataaagcttctacctgaagaacctttcttgtactacttgaaaggacggtactgctacaccgtgtccaaactgtcctggatcgagaagaagatggctgcaaccttgttcgggaaaattcctagttccacagttcaggaggctctccacaattttcttaaagccgaagagctgtgcccaggctactctaatcccaactacatgtacctcgccaaatgctacacagatctggaagagaatcagaacgccttaaaattctgcaatcttgccctactgctccctaccgtgaccaaagaggacaaagaggcccaaaaggagatgcagaagataatgacgagcctgaagcgctag

SEQ ID NO: 187401 - DNA, 1233 bp, Artificial Sequence
  Description of Artificial Sequence: Synthetic coding sequence
atgccctacagcaccaacaaggagctgatcctgggcatcatggtggggactgcaggtatttcactgttgctgctttggtaccacaaggtgcggaagcccgggattgctatgaagctccctgagtttctgagcctgggaaataccttcaactctattacccttcaggatgaaattcacgacgaccaaggtactactgtgatttttcaggagagacagctccagatcctggagaagctcaacgagctgctaacgaacatggaagaactgaaggaggaaatccgattcctgaaagaggctatcccaaaactggaggaatacattcaagatgaattaggcggcaagatcacagtgcacaagatttccccccaacatagggcgcggaagcgccgcctccccactattcagagttctgccacttccaactcaagcgaagaggcagagtccgaggggggctacattaccgcgaacacagatacagaggagcagagcttccctgtacctaaggcgttcaatacccgagttgaggaactaaatctagatgtgctcttgcagaaggttgatcaccttcggatgtccgaatcaggtaagtccgagtcatttgaattgttaagagaccacaaagagaagttccgagacgaaattgagtttatgtggcgtttcgccagagcttatggcgacatgtatgagttaagcaccaacacccaggagaagaaacactacgcaaatatcggcaagacgctgtccgaaagagccataaaccgcgcccctatgaacggccactgtcatctgtggtacgctgttctctgcgggtacgtttccgaattcgagggtctgcaaaataagatcaactatggccacctcttcaaagagcatctggacatcgctatcaaactcctgccggaagaacctttcttatactacctgaagggacgatactgttacactgtcagcaaattatcttggattgaaaagaaaatggcagcaaccctgttcggcaaaatccccagttcaacagtgcaggaggcactgcataattttcttaaggccgaggaactgtgcccggggtatagcaatccaaattacatgtacctggcaaaatgctacactgacctggaagagaaccaaaacgcactgaaattctgtaatctcgcccttttgttgcccacagtgactaaggaggacaaggaggcgcagaaggaaatgcaaaaaatcatgactagtcttaagagatag

SEQ ID NO: 187402 - DNA, 528 bp, Artificial Sequence
  Description of Artificial Sequence: Synthetic coding sequence
atgccctacagcaccaacaaggagctgatcctgggcatcatggtggggacggccggaatctctctcttacttctgtggtaccacaaggtacggaagccggggattgccatgaagcttcctgaattcctgagcctgggcaatacgttcaactctatcactctccaggacgagatacacgacgaccaaggcacgacagttatatttcaggagcgccaattgcagatcctggagaagctgaatgagcttttaactaatatggaggagctcaaggaggagatcagattcctgaaggaggcaatccccaagttagaagaatacatccaagacgagctgggcgggaagattaccgtgcacaagatttctccccaacatcgagcaagaaaaagacgccttcctactatacagtccagcgctaccagcaactccagcgaggaagctgagtcggaaggcggttacattactgcaaataccgacacagaggagcagagcttccctgtcccaaaggctttcaacacacgtgtggagtag

SEQ ID NO: 187403 - DNA, 798 bp, Artificial Sequence
  Description of Artificial Sequence: Synthetic coding sequence
atgggcaagtgcctgcggtacatcaccgccaacaccgacaccgaggaacaatccttcccagtacctaaagcgtttaacacacgggtcgaagagctcaatctcgatgtcctgctccagaaagtagatcacctcaggatgagtgagtccggcaagtcagagtcctttgagcttctgcgggatcataaagagaagtttagggatgagatcgaattcatgtggcgcttcgccagggcctatggggatatgtatgaactcagtacgaacactcaagagaaaaaacattacgccaatatcggaaagaccctgagtgagcgggccattaaccgcgcacccatgaatggacactgccatctctggtatgccgtgttgtgtgggtacgtgtccgaatttgagggcttacaaaataagatcaactatggtcacctgttcaaggaacacttggatatagcaatcaagttgctgcccgaggaaccattcctatactacctcaagggtagatactgttacactgtgtcgaagctatcttggattgaaaagaagatggcagccaccctcttcgggaagatcccaagtagcacagtacaagaagccctgcataactttctaaaagccgaagaactgtgtcctggttattctaaccccaattacatgtatctggctaaatgttacacagacctggaggagaatcagaacgcactgaaattttgcaatctggcactgcttctcccgacagttaccaaggaagataaagaagcacagaaagaaatgcagaagattatgacctcgctgaaaaggtag

SEQ ID NO: 187404 - DNA, 453 bp, Artificial Sequence
  Description of Artificial Sequence: Synthetic coding sequence
tgagtgctgtgcggctacgtgagcgagttcgagggcctgcagaacaaaatcaactacggacatctgttcaaagaacacttagacatagccattaaactgctgccagaagaaccattcctctattacttgaagggacgctattgttacaccgtcagcaaactctcatggatcgagaaaaagatggcggccactctgttcggtaaaataccgtccagcacggttcaggaagccctgcacaattttctcaaagctgaagaactctgtcctggttacagcaatccaaactacatgtacctcgctaaatgttacacagacctggaggaaaaccagaatgccctgaaattttgcaatctggctttactgctccccaccgtgacaaaagaggataaagaagcccagaaggaaatgcagaagataatgacaagcttgaaacgcctccggaagactaaatag

SEQ ID NO: 187405 - DNA, 717 bp, Artificial Sequence
  Description of Artificial Sequence: Synthetic coding sequence
atgggcaagtgcctgcggtacatcaccgccaacaccgacaccgaggagcagagtttccctgtccccaaggcattcaacacccgggtagaagagctgaatctggacgtactcctgcagaaggtggaccatttaagaatgtcagaaagtggcaagtctgaatccttcgagctgctcagagatcataaggagaagttccgggacgagattgaatttatgtggagattcgctagggcctacggagatatgtatgagctgtccaccaatactcaggagaagaaacactatgcaaatatcggaaaaacactgagtgagagggctattaacagggctcctatgaacgggcattgccacctctggtacgccgtgctctgcgggtatgttagcgagttcgagggccttcaaaataagatcaattacgggcatttatttaaggagcaccttgatattgctataaagttacttcccgaagaacctttcctgtactacctcaagggaagatattgctatacagttagcaaactttcttggatcgaaaagaagatggccgcaacactgtttgggaaaattccctcgtcgacagtccaggaggcactgcacaacttcctaaaggccgaggagctgtgccctggttatagcaatcccaattatatgtatctcgccaagtgttataccgacctggaagaaaaccaaaacgcacttaagttctgcaacttatag

SEQ ID NO: 187406 - DNA, 1413 bp, Artificial Sequence
  Description of Artificial Sequence: Synthetic coding sequence
atgagccggctgggcgccctgggcggcgcccgggccggcctgggcctgctgcttggaaccgctgcaggccttggattcctttgcctgttgtactcacaacggtggaagcggacccagaggcatggacgaagtcagtctctgccaaactcactggactatactcagaccagtgaccccggaaggcatgtgatgctgctccgagccgtccccggcggcgctggggatgcctctgtactgccaagccttccccgggaggggcaggaaaaagtcctggataggttggattttgtgcttactagtctggttgctctgaggcgagaggtggaggagttgcgctctagcctccgaggcctagcaggggagatcgttggagaagttcggtgtcacatggaagagaatcagcgcgttgcaagacggcgcaggtttcctttcgtgagggagcggtcagatagcacagggtcttcttcggtctatttcacggcttcaagtggagccacctttactgacgccgagagcgagggaggctataccactgcaaacgccgaaagcgacaacgaaagagattcagataaagagtccgaagatggagaggatgaagtatcatgtgaaactgtcaagatgggtcgaaaggattcactggatcttgaggaggaggctgcgagcggggcgagttcagctttagaggctggaggtagttccgggctggaagacgtgttgccacttctgcagcaggccgacgagcttcatcggggagacgagcaaggcaaacgggagggattccaactcctgctcaacaataaattggtctacgggagccgccaggacttcctatggagactggccagagcctactcagatatgtgcgagctgactgaagaagtgagcgagaaaaagtcctatgccctagacggaaaggaggaggccgaggctgccctggagaagggggacgagagcgctgattgccacctgtggtacgcggtgctttgcggtcagctggcagagcacgagtcaatacagaggcgtatccaatctggcttctcatttaaggagcacgtagataaagccatcgcacttcagcctgagaatccaatggcccatttcctactgggtcgatggtgctaccaggtctcccacctgagctggttggagaagaaaacagccactgccctgctggagagtcccctgtccgccactgtggaggacgccctccagtccttccttaaagcagaagaattacagccaggcttctccaaagctggtagggtgtatatatcaaaatgctatcgtgagctggggaaaaattctgaggccaggtggtggatgaaactggccctggagctgcctgacgtgactaaagaagacctcgccattcaaaaggatctggaagagctggaagttattctccgcgactag

SEQ ID NO: 187407 - DNA, 1413 bp, Artificial Sequence
  Description of Artificial Sequence: Synthetic coding sequence
atgagccggctgggcgccctgggcggcgcccgggccggcctgggcttgctgcttgggacagccgcggggctaggtttcctttgccttctatatagccaacggtggaagcgcacacagcgccatggacgtagtcagtccctgcctaactctcttgactacacccagactagtgatcccggaaggcacgttatgctgctgagggccgtgccgggcggcgctggagatgccagtgtattgccctcgttaccccgggagggccaagagaaggtgctcgatcgtttggactttgtcctgaccagtctcgtggcactccgtcgggaggtggaagagctcaggagctccctgagaggcctggcaggcgagatcgtcggtgaggtgcggtgtcacatggaggagaaccagagggtggcacgcagacggagattcccattcgttagagagagatcagactcgactgggtctagtagcgtgtattttactgcttctagtggtgcgacattcaccgatgctgagtccgaaggtggatacacgacggctaacgccgagagtgataatgagagagatagtgacaaagaatccgaggatggagaggatgaggtaagctgcgagacagttaaaatgggacggaaagatagccttgacttggaagaggaggccgccagtggcgcatctagcgcgcttgaagccggagggtcttctgggcttgaggacgttctcccgctgcttcaacaggctgacgaattacaccgcggagatgagcagggaaaacgggaggggttccagctgcttttaaataacaagctggtgtacggcagccgacaggactttttgtggagactagctagggcttatagtgacatgtgcgagcttactgaggaagtgagcgagaagaagagctatgccctcgatggtaaggaggaagccgaagccgcccttgagaaaggcgatgaaagcgccgactgtcatctctggtacgcagtcctttgcggtcagctagcagagcatgagtcgatccaacgacggatccaatctggtttttcgttcaaagaacatgtggataaggccatcgccctccagccggaaaatccaatggcccacttcttattaggacggtggtgttatcaagtctcacacctgtcttggctggagaagaaaaccgcaacagcactgctggaatctcctctctcagcaactgtggaagatgctctgcagtcgttcctaaaagccgaagaattgcagcccggtttttctaaagccggccgggtgtacatatcgaaatgctatcgggaattgggcaaaaatagcgaagcacgatggtggatgaagttagcgctcgaactgcctgacgtgaccaaggaggacctggctatccagaaggaccttgaagaacttgaagtgattcttagggattag

SEQ ID NO: 187408 - DNA, 1224 bp, Artificial Sequence
  Description of Artificial Sequence: Synthetic coding sequence
atgctgctgcgggccgtgcccggcggcgccggcgacgccagcgtgctcccttccctgcccagagaaggccaggaaaaagttctggaccggctggatttcgtgctgaccagtctggtggcccttaggcgtgaggtagaagaactccgtagtagtttgcgaggattggccggcgaaatagtcggagaagttcgatgccatatggaggagaaccaacgagtggcacgcagacgaagatttcccttcgtgcgagaaaggtctgattctaccggtagctcttctgtgtattttaccgcatcctcaggcgcaacatttacggacgcggaatccgaaggaggatacactacagccaatgccgagtcagacaatgaacgggactcagataaggagtctgaagacggcgaagatgaggtcagctgcgaaacggtaaaaatgggacgcaaagactcacttgacctggaagaagaagccgcgtcgggagcttcatccgctctcgaggctggcggttccagcgggttggaagacgtattgccgttactacagcaggccgatgaactgcaccggggagatgaacagggcaagcgagaggggtttcagctcctgctgaataacaagctcgtctacggatctcggcaagacttcttgtggcggctggccagggcttacagtgatatgtgcgaactgacagaggaagtctctgaaaagaaatcctatgcactcgacggtaaggaagaagctgaggctgctctagagaaaggtgacgagtctgccgactgccacctgtggtatgccgtgctctgcggccagctagccgagcatgaatccatacagcggcggatccagagcggcttttccttcaaggagcacgttgacaaagcgatagctcttcagcctgagaatccaatggcacatttcttgctaggcaggtggtgttaccaagtcagccatctatcctggctcgaaaagaaaactgcaaccgctctgttggaatctcctctgtcagcgacggtcgaagacgccttgcaatctttcttgaaggccgaagagttgcagccaggcttctcaaaagcaggacgagtgtacatttcaaagtgttatagggagctcggcaaaaattcagaagcccggtggtggatgaagctggctttggaactgccagacgtgacgaaggaggatctcgctatccagaaggacctggaagagctggaagtgattctccgcgattag

SEQ ID NO: 187409 - DNA, 864 bp, Artificial Sequence
  Description of Artificial Sequence: Synthetic coding sequence
atgagccggctgggcgccctgggcggcgcccgggccggcctgggcctcctgttggggaccgcagcaggacttggatttctatgcctcttgtattcgcagcggtggaagagaacacagaggcacggaagaagtcagtccttacccaactctctagactatacccagacatccgaccccggaagacacgtgatgctgcttcgggcggtgccaggcggcgccggcgatgcctccgtccttccgagcctgccgcgcgaaggacaagaaaaggtgctggacagactggattttgtgctcacgtctctcgtggcattacgtcgagaagtagaggagctgaggtctagccttaggggactcgccggtgaaattgtgggcgaagttaggtgccacatggaggaaaatcagcgggtggcacgaagacggcgcttccccttcgtgagagagaggagtgatagcactggtagttcatccgtctactttacagcctctagtggagccacgtttacagacgcagagagcgaaggtggatacacaactgcaaacgcggagagcgacaacgaacgagattccgacaaagagtccgaagatggtgaagatgaagtgtcctgcgaaaccgtgaaaatgggacggaaagatagtcttgacctggaggaggaggccgcttctggcgcgagcagtgcactggaggcagggggctcaagtggtctggaagatgtgctaccacttctgcagcaggccgatgagttacacagaggtgatgaacaggggaagcgagagggatttcagttgctgctgaataataagctggtgtacgggtcccggcaggacttcctgtggcggctggcccgcgcatattcagatatgtag

SEQ ID NO: 187410 - DNA, 945 bp, Artificial Sequence
  Description of Artificial Sequence: Synthetic coding sequence
atggccctggccgcccggctgtggcggctgctgcccttccggcggggcgccgcgcctggatcacgtctgccggctgggacaagtggtagccgggggcactgtgggccatgtcggtttaggggttttgaggtcatgggaaatccaggcaccttcaaacgcgggctgctgctgagtgctctgagctacctgggctttgagacatatcaggtgatctctcaggccgctgtggttcacgccactgctaaagtagaggagatcctggaacaagccgactatctgtatgaatcaggagaaacagagaaactatatcagcttctaacccaatacaaggaaagcgaggatgctgagctgctgtggcgtctggcccgggcatcccgcgacgtggcgcagctgtcacgaaccagtgaggaagaaaaaaagctgctcgtgtacgaggcactagaatatgcgaagagagcccttgaaaaaaacgaatcctcctttgcgtctcataaatggtatgctatctgtttgtctgatgtgggcgactacgagggcataaaagcaaaaattgccaatgcttacatcatcaaggaacacttcgagaaagctattgagcttaatcccaaagacgccacctccatccatctcatgggcatctggtgttatacattcgccgagatgccctggtaccagcgcagaatcgcaaaaatgctgtttgccaccccccctagctcaacatatgagaaagccctgggctactttcatagagccgaacaggtagaccccaatttctattccaaaaaccttctccttctaggtaagacctacttgaaactgcacaataaaaaactcgccgccttctggctcatgaaagcaaaagattatcctgcccacactgaggaagacaagcaaatccagaccgaagcagcacaactcctgacatcattttctgaaaagaattag

SEQ ID NO: 187411 - DNA, 855 bp, Artificial Sequence
  Description of Artificial Sequence: Synthetic coding sequence
atggccctggccgcccggctgtggcggctgctgcccttccggcggggggcagcacccgggtcaagacttcctgcgggtacttccggctcacgaggccattgcggaccttgcagatttcgtggatttgaagtcatgggtaatcccggcaccttcaaacgcgggctattgctgtctgcattatcttaccttggcttcgagacttatcaagtcatctcccaggctgccgtggtgcacgcgactgctaaggttgaggagatcttggaacaagcagactatctatacgaaagcggagaaaccgaaaagctgtatcagctgctaacccagtataaagaatcagaagatgcggagctcctctggcggctggctcgcgcttcccgggatgtggcacagctgtcgcgcacctcggaggaagaaaaaaaactgctggtatatgaggcgctcgagtacgctaagagggctttagagaaaaatgaaagttcctttgccagccacaaaaaagccatcgaattgaaccccaaagacgccacaagcatccacctgatgggtatttggtgttatacctttgccgagatgccatggtatcaaaggaggatcgccaaaatgctgttcgccactcccccgagctcgacctacgaaaaagctctgggctactttcaccgcgctgaacaggtggacccaaatttttactccaagaacctcctgctgttggggaagacctatctgaaactgcacaataagaaactcgccgcgttctggctgatgaaggctaaggattatcccgcccacaccgaggaggataagcagatccagactgaggcagcccaattattaacatccttttcagaaaagaactag

SEQ ID NO: 187412 - DNA, 3540 bp, Artificial Sequence
  Description of Artificial Sequence: Synthetic coding sequence
atggcccggcggagccagagcagcagccagggcgacaaccccctggcgcccggatacctgccaccccactataaggagtactatcggctggctgtggatgccctcgctgaaggcggttccgaggcgtacagccgctttctggctaccgagggggcccctgactttctgtgccctgaggagctggagcacgtgagccggcacctgaggccacctcaatacgtgactcgagagccacctgagggctcactgttggacgttgatatggacggttcatcgggtacttactggcctgtgaactctgatcaggccgtgcccgagttggacctgggctggcccttaaccttcggttttcagggcacagaggtgaccactcttgtccaaccccctcctcccgattccccatctatcaaagacgaggccagaaggatgattaggtcagcacaacaggtcgtcgctgtggtgatggacatgtttacagatgttgacttactttcagaagtgctggaagccgccgcaaggcgcgtccctgtgtacatattgctcgacgaaatgaacgcccagcatttcctggacatggccgataagtgtcgagtgaaccttcagcacgtggatttcctacgggttcgcaccgtggcgggccctacatattactgcagaacgggcaaaagtttcaaaggacatgtgaaggaaaagtttctgcttgtcgactgtgctgttgttatgagcgggtcttactccttcatgtggtccttcgaaaagatacaccgcagcttagcacatgtattccagggggagctggtgtcctctttcgatgaggaattccgaattctatttgcccaatcggagcccctggtgccatccgccgcagccctggcaaggatggacgcttacgccctagccccatacgccggcgcaggacccctcgtaggtgtccctggcgtgggggcccccacaccgtttagctttcctaaacgcgcccacctgttgttccctccaccaagagaggaagggctgggattcccttccttcctggatcctgaccggcactttctgtctgccttcaggagagaggaaccgccacgaatgccaggtggtgctctggagccacacgcgggactgcgacctttgtccagacgtttggaagccgaagctggacccgctggagagctggccggagctagaggctttttccaggcccgacacttagagatggacgctttcaagcgtcactccttcgcaaccgagggcgcaggtgccgttgaaaacttcgccgctgcccgccaagtttctaggcaaacatttctgtcacatggggatgacttccgcttccagacgtcccactttcaccgcgatcagctgtaccagcagcaatatcagtgggatccccagctgacccccgcgaggcctcagggcctctttgagaaactcagaggagggagggcaggattcgcagacccggatgacttcaccttgggggccgggccaagattccccgagctaggacctgacggtcaccaaagactcgactacgtgccaagttcagccagccgcgaggtgcggcatgggagtgatcccgcgttcgcgccagggcccagaggcttggaaccttctggtgccccacggcccaacctgacacaacgatttccttgccaggcagccgcaagacctggaccagatcccgcccctgaggcagagccagaaaggcgtgggggtccagaaggtcgtgccggtctgagaaggtggcggctggccagctatctgtctggatgtcacggagaggacggtggcgacgacggtctgcccgcccccatggaggctgaggcttatgaggacgacgttcttgccccggggggcagggctccagccggagatctcctgccatccgcgtttagagtccccgccgcctttcccacaaaagtccccgtgccgggtccagggtccggcgggaatggcccagagcgggaagggcccgaagaaccaggattagctaagcaagattctttccgatcacggctcaatccgctggtgcagcgcagcagcaggctgagatcctctctgatattctcaacctcacaggccgagggagccgccggggccgccgccgctacagaaaaagtgcagctgctgcataaagagcaaacagtgagcgaaacgttgggtccaggcggagaggcagtgcggtccgctgcatcaaccaaagtcgcagagctgttggaaaagtacaaagggcccgcccgggacccaggcgggggcgctggcgcaatcaccgtggcttcacacagtaaagccgtggtgtctcaggcctggcgagaagaggtcgctgctcctggtgcagtgggtggagaacggaggagcctggagagctgcctgctcgatctacgcgactcatttgcgcagcagttgcatcaagaggcagaacggcagccaggggcagcatcactcactgccgcacagctactggatacactgggaaggagtggcagcgatagactgcctagccggttcctgagcgcacagagtcacagcacctcaccccagggacttgactctccactacctctcgaaggcagcggggcacaccaggtgctccataacgagagtaagggctctcctacatctgcatatcctgaaagaaagggctcccccactccaggcttctccactcggagaggatcacctaccactggattcattgagcagaagggaagtccaacatcggcctaccctgaacgcagagggtccccagtgcctcctgtgccagaacgcaggagttcccctgtgcccccggtaccagaaaggagggggagtctgaccctcactatcagcggagagagcccgaaggctgggcctgctgaagaggggccctcgggcccaatggaagtgcttcgcaaagggagtctgagactgcgccagcttttatcccccaagggcgagcgcaggatggaagatgagggggggttccccgtcccgcaggagaacggccagccggaaagcccacgacgtctgtcattgggccagggcgattccacggaagcggccacggaggagaggggtccgcgtgccaggctatcctctgccacagccaatgcactctactcctcgaacctgcgtgacgacactaaggccatcttagagcagatttccgcgcatggccagaagcaccgggccgttcccgcgccctctcctggtcccacacataatagtccagagctcgggcggcctcccgctgccggcgttctggctcctgatatgtcggataaagacaagtgttcagcaatcttcaggtcagactccctcgggacacagggacgcctgtcacgcactctccccgcaagcgccgaggagcgggaccgattgctccggcgaatggagtccatgcgcaaggagaagcgagtttattccagatttgaagttttctgcaagaaggaggaggcaagctctccgggcgcaggggaggggcctgcagaggaaggcactagggattccaaggttggaaagttcgttccaaaaatcctcggcaccttcaagtcaaaaaaatag

SEQ ID NO: 187413 - DNA, 933 bp, Artificial Sequence
  Description of Artificial Sequence: Synthetic coding sequence
atgggcaaccaggtggagaagctgacccacctgagctacaaggaggttccaactgcagatcctacaggggttgaccgagatgacgggccgcggattggggtatcttacattttcagcaacgatgacgaggatgtcgaaccccagcctcccccacagggacctgacggaggagggcttcctgacggcggcgacggaccgcccccaccccaaccccagccctacgaccctcggctgcacgaagtagagtgctctgtgttctaccgggatgagtgcatttaccagaagtcatttgctccagggtcagcggccctcagcacatacacaccggaaaatctcctgaacaaatgcaaacctggggacttggtagaattcgtatctcaagctcagtatccgcattgggccgtgtatgtgggtaatttccaagtggtgcacttgcatagattggaagtaatcaatagttttcttacagacgctagccaagggcggagaggcagggtggtaaacgatttataccggtacaagccacttagtagcagtgccgtggtccggaacgcactcgctcacgttggagccaaagagcgggaactttcatggcggaacagcgaatctttcgccgcatggtgtcgatatggcaagagggaattcaaaatcgggggcgaattgaggattggaaaacagccataccggctgcaaatccagctgagtgctcaacgttcgcacactttggaatttcagtctttggaggacctgattatggaaaagcgccgcaacgatcaaataggtcgcgctgccgtcttacaggagctggccacccacttgcaccccgctgaacccgaggagggagatagcaatgttgcccggactacaccgcctcctggacgccccccggccccaagttcggaggaggaagacggcgaggcagtggcccactag

SEQ ID NO: 187414 - DNA, 999 bp, Artificial Sequence
  Description of Artificial Sequence: Synthetic coding sequence
atggagcccgtgggccggaagcggagccggaaggccgccaaggcccaactggaggctcaagtaacagccgcccagggcgccactaaagaggggtccgggatcgccagcaactttcccggtcagcccacaatggagcctgtgggacgcaaacgttccagaaaggcagctaaagcccaactcgaggctcaagtgagagcagcccctgctaaaaagcacaccgggaaagaccccgtgagggatgagtgtgaggagcgcaatccgtttacggagacgagagaagaagatgtgacagacgagcatggcgagcgcgagccttttgctgaaaaggacgagcacaccgggatccacaccatgaaactggagcacattgctgccgatataaaaaagggactcgcagcaaaacgtgaaatgatcaagatagataaagccgcctatagaaagacgaagaatactattgagagggccctgaagaaaaagcagcttaagcgccagaagagagattatagacacactaggaagttgctgaatgtgttaaaggagtacatagcagagaagcagaaggatgacgaggccgaggaagcggaagcggccgcagccgccgctgaagccgcagccgcggccgaggctgcagccgcagccgctgaggtgattgttgtggaggatgaggaggaggaagagaaagaggaggaagaggagaaggaggaggaggaggaagagggagaggaagaggggggtggcgaagaaggagaggagggcggcggcgggggtgagggcgaagaaactgaagaggaggaagaggaggaggaggaggaagaagaggaggagcagatcaaggcattccaagagaagcagaagaggtggcagcagcctaccggggtgagatcttggcggcttcgggaaatgaagcccctcctggagcaactgctcaaggcagcgaaagacaccaaggacaattactgcatcataagctcctctgaggaatccgagctagacaattag

SEQ ID NO: 187415 - DNA, 999 bp, Artificial Sequence
  Description of Artificial Sequence: Synthetic coding sequence
atggagcccgtgggccggaagcggagccggaaggccgccaaggcccagcttgaggcccaggtcacagcagctcagggcgctactaaagaggggagcggtatcgcgtccaattttcccggacagccgaccatggagcccgtgggaaggaaaagatcccggaaggctgctaaggcacaattggaggctcaagtaagggcggcacccgctaaaaagcacaccggtaaagatcctgtccgggacgaatgtgaggagcggaacccattcactgaaacaagagaagaagacgttaccgatgagcatggagaacgtgagccttttgcggagaaggacgaacatacaggcattcatactatgaagttggaacatattgccgctgatatcaaaaaggggcttgccgccaagagagagatgattaagattgataaagccgcttaccggaagactaagaacacaatagagagggcactgaagaagaagcagctgaagagacagaaacgggattatagacatacaaggaaattgttgaacgtgctgaaggagtacatcgcggagaagcaaaaagatgacgaggccgaagaggcagaagccgctgctgcagctgcggaagctgccgccgccgctgaggcagcagccgctgccgcagaagttatagtcgttgaagatgaagaagaggaggagaaagaagaggaggaagaaaaggaggaggaagaggaagagggtgaggaggaaggagggggtgaggaaggggaagaaggggggggcggaggggagggtgaggaaaccgaagaggaggaagaggaagaggaagaggaagaggaagaagagcagatcaaggctttccaggaaaagcagaaaagatggcagcagcccacaggggtgaggtcttggagactcagggaaatgaagcctttgctggaacagttgcttaaggctgcgaaggacactaaagataactactgtatcatttcctctagtgaagagagcgaactcgataactag

SEQ ID NO: 187416 - DNA, 561 bp, Artificial Sequence
  Description of Artificial Sequence: Synthetic coding sequence
atggccgcctggggcaagaagcacgccggcaaggaccccgtgcgggatgagtgtgaagagcggaacagattcaccgagaccagggaagaagacgtgaccgatgaacatggtgagcgcgaacctttcgctgaaaccgatgagcatactggcgccaacactaagaaacccgaggatacagcagaggacctcacagccaaaagaaagcgcatgaaaatggacaagacttgcagtaagactaaaaacaaatccaagcacgctctcagaaaaaagcaactgaagaggcagaagagagattatatccactccctgaaattgctgaatgtgcttgaagaatacattaccgacgagcagaaggaggaagaggaagaggaaggagaagaagaagaactgataagaatcttccaagaacagcagaagaagtggcagcagtatcgctcagtgaggcgcgaaagactgaaggagatgaaactcctcagagaccaatttgtcaaggccctggaagatttcgaagacctatgcgatagggtgttttccgatgaagattctgaattggataactag

SEQ ID NO: 187417 - DNA, 681 bp, Artificial Sequence
  Description of Artificial Sequence: Synthetic coding sequence
atgcccggcttcctgagcttcctgagcgtgagcctgcggagccccgggtccggcatcgcatcatcatttccgggtcagccagccaccgatcctgttggtcggcgggccgctaaagctcagttagaggcccagttcatggccgcttggggtaagaagcacgccgggaaggatcccgtgcgtgacgaatgcgaggagcggaatcggttcacggaaacacgggaggaggatgtgacagacgagcatggtgaacgggagccatttgctgagacagatgagcacaccggcgcaaacacaaagaagccagaggacactgccgtgggtgccaataactttaaaaactacccggtacacatcggcgtgagttctgagcaacacattttattggattgctctctcagcagacagaagagagactacatccatagcttaaaactcctgaacgtcctggaggaatatataaccgacgagcagaaagaggaagaagaggaagagggagaagaggaggagctcattagaatattccaagagcagcagaagaagtggcaacagtaccgcagcgtgcggcgagaacggctaaaggagatgaagctgcttcgggaccagttcgtgaaggcccttgaggattttgaagacctgtgtgaccgggtcttcagtgacgaagacagcgaactggataactag

SEQ ID NO: 187418 - DNA, 561 bp, Artificial Sequence
  Description of Artificial Sequence: Synthetic coding sequence
atggccgcctggggcaagaagcacgccggcaaggaccccgtgcgggatgagtgtgaagaaaggaacagatttaccgagacacgcgaggaagacgtgactgacgagcacggcgagcgggagcccttcgccgaaaccgatgagcacacgggcgcgaataccaagaaaccagaggacacagcagaagacctgactgccaagcgcaagcgcatgaaaatggacaaaacctgctccaaaactaagaacaaaagcaagcacgccctgcggaagaaacagctcaaacggcagaagcgtgattacatacactctttgaagctcttgaatgttttagaagagtatattaccgatgagcaaaaggaagaggaagaggaggagggggaggaagaggaactgattcgtatttttcaggaacaacagaaaaaatggcagcagtataggagcgtgagacgggaacggctaaaggaaatgaaactcctccgtgaccagtttgtgaaggctcttgaggattttgaggatctgtgcgatcgagtcttctcagacgaggactcagaacttgacaattag

SEQ ID NO: 187419 - DNA, 501 bp, Artificial Sequence
  Description of Artificial Sequence: Synthetic coding sequence
atggccgccaaggaccagctggaggtgcaggtgatggccgcccaggaaatggagctcgcaggaaaagatcctgtcagtcacgagcatgaggaacgcaagccggtgacagagacgaaggaaggggatgtgaccgatgaacatggtgaaagaggttcattcgctgagactgacgagcacactggggtagacacaaaggaactcgaggacatcgccgcagatattaaggagcatctcgctgcaaaacgcaagcggattgaaaaaatcgcaaaagcctgtagtgagatcaagaacagaattaagaatgtactacgcactacccagctcaagcgacaaaaacgtgactataggatcagtctaaagctccccaatgtgttagaggaattcattaccgacgaacaaaaggacgaggagggcgatggcgaaaaggaagagcaaattaagattttccaggagcaacaaaagaggtggcaacaagacgggaaggggaccgaaagggactag

SEQ ID NO: 187420 - DNA, 501 bp, Artificial Sequence
  Description of Artificial Sequence: Synthetic coding sequence
atggccgccaaggaccagctggaggtgcaggtgatggccgcccaggagatggagctcgcaggcaaagacccggttagtcacgaacacgaagagcggaagcctgtgactgagacgaaagagggcgacgttactgatgagcatggcgaaaggggatcttttgccgagacagacgaacacactggggtggatacaaaggagctggaggatatagctgccgacataaaggagcacttggccgccaagaggaagcggatagagaagattgctaaagcctgctctgaaattaagaacagaataaaaaatgtcctacgtactacccaactgaagcgccagaaacgcgattaccgcatctcacttaagcttcctaacgtattggaggagtttatcacagacgagcagaaggatgaggagggggacggcgaaaaggaggagcagattaagattttccaggagcagcagaagcgctggcagcaggacggcaagggcacagaacgggactag

SEQ ID NO: 187421 - DNA, 381 bp, Artificial Sequence
  Description of Artificial Sequence: Synthetic coding sequence
tgagacgtgaccgacgagcacggcgagcggggcagcttcgccgagaccgacgagcacacaggggtcgacacaaaggagctggaagatatagccgccgatattaaggagcacctcgctgccaaacgaaagcggattgagaaaatcgccaaagcctgcagtgaaatcaaaaaccggatcaaaaatgttctgcgcacaacccaactcaaacggcagaaaagggactatcgaattagtctgaagctgccaaacgtcctggaagagtttattacagatgaacaaaaggatgaggaaggggacggggaaaaggaggagcaaataaagatttttcaggaacagcagaagaggtggcaacaggatggtaaaggcaccgagagggattag

SEQ ID NO: 187422 - DNA, 387 bp, Artificial Sequence
  Description of Artificial Sequence: Synthetic coding sequence
atggccgccaaggaccagctggaggtgcaggtgatggccgcccaggagatggagctggctgggaaggatccagtatctcacgagcatgaggaacgtaagccagtcaccgaaacaaaggagggcgatgtgaccgatgaacacggcgaaagggggtcttttgccgagacagacgaacacacaggcgtggataccaaagagctggaggatatcgctgggatgttctacgagctgtttgtcgtgtatgaaaactgcttccagccatacaatccatattcacgcttgtacgagctggtggacgataagaccgtgctaaacgcttttttttcctatatcgccttcaatgtgatctgtttaatcatattcctgacttatttttttaactgctag

SEQ ID NO: 187423 - DNA, 1395 bp, Artificial Sequence
  Description of Artificial Sequence: Synthetic coding sequence
atgatggcccggcgggaccccaagcccggcgccaagcggctggtgagggcacagactctgcagaagcaacgccgcgccccagtgggcccgcgtgcaccacctcccgacgaggaagatcctagattgaagtgcaagaactgtgaagccttcggtcacacagcacggtctacacgctgtccaatgaaatgttggaaagctgctcttgtgccgcccaacttcggcgagaaggagggcaaagagaatttgaagccctggaagccacaggtcgaagctaatcctggacccctcaacaaggataagggtgagaaggaggagaggcccaggccacaggatccacagagaaaagccctgcttcacattttctcgcgcaagccccctgagaagcccctgcccaatcagaagggcagtaccgagtcatccgattatctgagagtggcatccggacccatgcctgtgcacacaactagcaagcggccccgcgtcgaccccgttctgagtgatcgctcagccaccgagatgtcggatagaggaagcgtcctcgcaagcctgtcccctctgagaaaggcctccctgagttcctcctcctcactcgggccaaaggaacggcagaccggcgctgcggccgatataccccaaaccgctgtacgacatcaaggaccagaacctctgctagttgtgaagcccacccattccagccccgccggcggctgtagggaagtgccgcaggcagccagcaagactcatgggcttctacaagccgtgtcccctcaagcgcaggataagaggccagcagtaacatcacagccgtgccctcccgctgccactcactctttgggactgggctcaaacttgagcttcggcccaggtgcgaagcgcagcgccccagcacctatccaggcttgcttgaacttccccaagaagccaagactcggtcctttccagatacctgaatctgcgatccagggcggcgaactgggagccccggagaacttacagccccccccggcggccactgaactcggtccgaggacatctcctcaaacaggaacccggacaccagcgcaggtactcagcggtgatcggcagccccctcattctagaccgtgcctgcctacagctcaggcatgcacgatgtctcatcacccagccgcatcccatgatggtgcccagccgttgcgcgtgctctttcgccgtttggagaatggccgctggagttcgagcctgctgactgcaccatcttttcattccccggagaaacctggtgctttcttggcccagagtccgcacgtgagtgaaaaatcagagggtccttgtgtgagggtccccccctcagtgctgtacgaagatctgcaggtaccatcttcttccgaggattccgactcagatttggagtag

SEQ ID NO: 187424 - DNA, 45 bp, Artificial Sequence
  Description of Artificial Sequence: Synthetic coding sequence
atgatggcccggcgggaccccaagcccggcgccaagcggctgtag

SEQ ID NO: 187425 - DNA, 1395 bp, Artificial Sequence
  Description of Artificial Sequence: Synthetic coding sequence
atgatggcccggcgggaccccaagcccggcgccaagcggctggtgagagcccagactctgcaaaaacagcggagggccccagtcggccccagggccccacctcctgacgaggaggatccacgtctgaagtgtaaaaactgcgaggcctttggccacacagcccggtctacacgctgtccaatgaagtgttggaaggctgcattggtgccgccaaatttcggcgagaaagaggggaaggaaaatctcaagccctggaagccccaagtcgaggctaacccaggacccctcaataaggataagggggaaaaagaagaacggccacgcccccaggatccccagcgtaaagctctcctccacatctttagcaggaagccacctgaaaaacctctgccgaaccagaaaggtagtaccgaatccagcgattacttgagggtcgcttccgggccgatgcccgtgcatactacctctaaaagaccacgggtggaccctgtcctgagtgataggagcgccactgaaatgagtgacagagggtcagtgctggcctcattaagtcctctgaggaaggcctctctctcgtccagcagttctctgggccccaaggaaagacaaactggtgctgcagcggatattccgcaaacggccgtccgtcaccaggggccagagccactcctggtggtcaaaccaacgcattcttcacccgccggtggatgtcgcgaggtgccccaggcagcttctaagacacatggtctcttacaggccgtatcaccacaggcacaggataaacggcccgcagtcacatcccagccctgccctcccgcagcgacccatagtctcgggctggggtctaatctatccttcggccccggagccaaacgctccgctccagcacccattcaggcatgtctcaatttccctaaaaaaccacgcctggggccgttccagattcctgagtctgcaatccagggcggcgaactgggtgctccagaaaatctgcagcctccacctgctgccaccgaacttgggccccgcacaagtccacaaaccggcacccgcacccccgctcaggtactctcaggcgaccgacagccgccacattccaggccttgtttgcctaccgctcaggcatgtacaatgtcccaccatcccgccgccagccacgatggggcccaacccctcagagtcttatttagacgattggagaacggccgttggtcctcctctctacttacagcgcctagttttcacagtcccgaaaagccaggggcattcctggcacagtctccccatgtttctgagaaatccgaggggccgtgcgtccgagtcccccccagtgtgttgtacgaggacttgcaggtgccttcctcttctgaggacagcgattcggatctggaatag

SEQ ID NO: 187426 - DNA, 1143 bp, Artificial Sequence
  Description of Artificial Sequence: Synthetic coding sequence
atggccgtgaccgaggccagcctgctgcggcagtgccccctgctgcttccccaaaaccgctccaaaactgtctatgaggggttcatatccgcgcaggggcgcgacttccacctgcggatcgtgcttcccgaggatctgcaactaaagaacgcccggctgctgtgttcttggcagctgagaacaattctttccggatatcatcggatagtccaacagagaatgcagcacagccccgacctaatgtcgttcatgatggaactaaagatgctactggaagttgccctcaagaataggcaagagctgtacgccctgcctccccctcctcagttctactcatcactgattgaggagattggcactctggggtgggataaactggtctatgccgatacgtgtttctcaaccatcaagcttaaggccgaggacgccagcgggcgggagcatctgattacgttaaagctgaaagcaaaatatcctgccgaatcacccgactacttcgtggactttcccgtgcccttttgtgcctcctggacccctcaagtcaacagcccacagtccagcctcatcagcatctattcacagttcctggccgccattgagtctctcaaagctttttgggatgtcatggacgaaattgatgaaaaaacttgggtgctcgagccagagaagccccctcggtccgctaccgcccggagaattgccctcgggaacaacgtgagcattaatattgaagtagaccctcgccacccaacaatgttacccgagtgcttttttctgggcgccgaccacgttgtcaaacctctcggcataaaactttctaggaacatccatctttgggaccccgaaaactccgttttgcagaatctgaaggacgttttagagatcgatttcccagcacgggcaatcctggagaagtccgacttcactatggattgtggaatctgctacgcatatcaactggatggcaccattcccgaccaggtgtgcgataatagccagtgtggtcagccattccaccagatctgtctatacgaatggttacggggcctgctgacctccaggcaaagttttaatatcatctttggagagtgcccgtactgttcgaagcccattactctcaaaatgagcgggaggaagcactag

SEQ ID NO: 187427 - DNA, 2580 bp, Artificial Sequence
  Description of Artificial Sequence: Synthetic coding sequence
atgaccagcaagcaggccatgagcagcaacgagcaggagcggctgctctgctataacggcgaggtactggtgttccagctaagtaagggaaactttgccgacaaggagccgaccaagacacccatactgcacgtgcgccgcatggtgttcgataggggaacgaaggtcttcgtgcaaaagagtactgggttttttaccataaaggaggagaactcacaccttaagatcatgtgctgtaattgcgtttcagactttagaacgggcatcaatctcccatacatcgtcattgagaaaaataaaaaaaataatgtgttcgaatatttcctcctaattctgcattccactaataagtttgagatgaggctgagctttaagctcgggtatgagatgaaggatgggctccgtgtcttaaacggtccccttattctctggcgtcatgtgaaggcctttttctttattagcagtcaaaccggaaaggttgtatcagtgagtggcaatttttcttccattcagtgggccggcgaaatcgagaacctggggatggtccttcttgggctaaaagagtgctgtctgagtgaagaggaatgtacacaggagcccagcaaaagcgactacgccatctggaatacaaaattttgtgtgtacagcctggaatcacaagaagtattgagtgatatctacattattccccctgcctatagctctgtggttacatatgtgcatatctgcgccacagagatcatcaagaatcagcttcgcatcagccttattgcactcactcggaaaaaccagctgatctcattccagaacgggactccgaaaaacgtctgccagctgccatttggcgacccttgtgccgtgcaactgatggactccggcggtggaaacctgttctttgttgtgagctttatctctaacaatgcatgtgctgtgtggaaagagagtttccaagtggctgccaaatgggaaaagctatcattggtattaatcgacgacttcattggttcaggcaccgagcaggttctgctgcttttcaaggactctcttaattctgattgcctcacatccttcaagattacagatctaggaaaaatcaattactcatccgaaccctccgactgtaatgaagatgacctctttgaggataagcaggaaaatcggtacctcgtggttccacctctagaaactggtcttaaggtgtgtttctcatccttcagggaacttcggcagcatttgttgcttaaggagaagataatttcgaaaagctacaaggctctcattaacctggttcaaggaaaggacgataatacctcctccgccgaggaaaaggagtgccttgtgccactgtgcggcgaggaggaaaattcagttcacatcctagacgaaaaactgagtgacaacttccaggactctgagcagctcgtcgaaaaaatctggtatcgagtaatagatgactccctggtggtgggcgtcaaaacaacttctagcttaaaactgtcactgaacgatgtaactctgtccctcctaatggaccaagctcacgattcccgcttcagactcctgaagtgtcagaatcgggtgatcaagctgtccaccaacccttttcctgctccctatctgatgccctgtgagatcgggttggaggccaagcgagtgacattgaccccagatagcaaaaaagaagagagctttgtttgcgaacacccctccaaaaaagaatgtgtccagatcatcacagccgtgacctccctgtcacccctgctgaccttttctaagttctgttgtacagtgcttctccagattatggagcgcgaaagtggaaattgcccgaaagaccgttatgtggtgtgcggccgcgtgttcctgagcctggaggatctttcaacaggcaagtatctcctgacgtttccaaaaaagaaacccatcgaacacatggaagacctgttcgcgctgctggccgcctttcataagagctgtttccagattaccagccccggctatgcgctgaactccatgaaggtgtggctcttggagcatatgaagtgcgagatcataaaggagttcccagaggtctatttttgcgagcgacccggaagcttttacggtactctattcacttggaaacaacgcacacccttcgaggggatcttgattatctattctcgcaatcaaaccgtgatgtttcagtgtcttcacaatctgattaggatccttcccatcaattgctttctgaagaacctcaagtcgggatcggaaaacttcctgatcgataatatggcattcacgctagagaaagaattagttacactgtctagcctgagctccgccatagccaaacatgagagcaactttatgcagcggtgtgaagtgtcaaagggaaaaagctctgtggttgcggccgccctgtcagatcgaagggaaaacattcatccgtacagaaaagaactccagagggaaaagaagaaaatgctgcaaaccaatcttaaggtcagcggggctctataccgagagattacactgaaggtggccgaggtgcagctgaaatcagatttcgccgctcagaagctcagcaacctgtag

SEQ ID NO: 187428 - DNA, 2580 bp, Artificial Sequence
  Description of Artificial Sequence: Synthetic coding sequence
atgaccagcaagcaggccatgagcagcaacgagcaggagcggctgctgtgctataatggcgaggtcctggtgtttcagctgagcaaagggaatttcgccgataaggagccgactaagactcctattttacacgttagacgaatggttttcgacaggggcaccaaagtgtttgtgcagaagagcactgggttctttacaatcaaagaggaaaattcccacctgaagataatgtgctgtaattgcgtaagcgacttccgaacagggataaatctcccttacatcgttattgagaaaaacaagaagaataacgtttttgagtactttcttctgatactgcattctacgaacaaatttgaaatgcgcctaagttttaaattgggatacgaaatgaaagacggcctaagggtgttgaacggtcctctgatcctgtggagacatgtcaaggcttttttctttatttcttcgcaaactgggaaggttgtgtcagtgagtggaaatttctcttccattcagtgggctggtgagatcgagaatctgggaatggtcctcctgggactcaaagagtgctgtctcagcgaagaagaatgtacacaagagccgtccaagtctgattatgccatctggaatacaaagttctgcgtgtacagcctcgaaagtcaagaagttcttagcgatatctacattataccccctgcctacagctccgttgtgacgtacgttcacatctgtgctaccgagatcataaaaaaccaattgaggattagcttgattgcattgactaggaaaaatcagctgattagttttcaaaatggaacacctaagaacgtatgtcagttaccctttggggacccatgcgcagtgcagctcatggatagcggcgggggcaatctgtttttcgtcgtttccttcattagcaacaatgcctgcgccgtctggaaagagtccttccaggtggcagcaaagtgggagaagcttagcttggttctgattgacgattttattggttccggcaccgagcaggtccttctgctgttcaaggatagcttgaatagcgattgccttacctccttcaagattactgatctcgggaagataaactactcatctgagccgagcgattgtaacgaagacgacctgttcgaggacaagcaggagaatcgatacctggtggtcccaccactggagaccgggctgaaagtctgcttttcatcctttcgggaacttcgtcaacatctgttgctgaaggaaaagatcatcagtaagtcttacaaggcgcttatcaatctcgtgcaaggtaaggacgataatacttcttctgcagaagaaaaagaatgccttgtgcctctgtgtggggaggaggaaaatagtgtccatattctggacgaaaagctctctgacaattttcaggatagcgagcaacttgtcgaaaagatatggtacagagttatagacgatagccttgtcgtgggggtgaaaacgacaagctctttgaagctcagcctcaacgatgttacactctctctgttaatggatcaggcccacgactcaaggttcagactcctgaagtgtcagaaccgggtaattaaactgagcactaatccatttccagccccttacctcatgccctgtgaaatcgggctggaggccaagcgggtcacattaacccctgattcgaagaaggaagaaagttttgtgtgtgagcacccttctaaaaaggaatgtgtacagatcatcaccgccgtgaccagtctgtctcctctcttgacttttagcaaattctgctgtaccgtactgctgcagatcatggagcgcgagagtggcaattgtccgaaggacaggtacgtcgtgtgcggtagggttttcctgtcacttgaagatctgtctactgggaagtatctgctaacctttccgaaaaagaagcccatagagcacatggaggatctctttgccctgctggcagcttttcacaagagttgtttccagatcacaagccctgggtacgctcttaattctatgaaggtctggctgcttgagcatatgaagtgcgaaataattaaggaatttcctgaggtgtatttctgcgaaaggcccggttcattctacggcactctttttacatggaaacagaggacccctttcgagggcatcctcattatctactccaggaaccagacggtgatgttccagtgtctgcataacctgatccggatcttgcctataaattgtttcctcaagaacctgaagagcggatcagagaacttcctgattgacaatatggcattcactctggaaaaagagcttgtcaccctgtctagtctcagctccgccattgccaaacatgagtccaattttatgcagagatgcgaagtgtcaaaaggtaagtcctcagtggtcgccgctgccctaagtgacaggcgggagaatatccacccataccggaaggaactacagcgagagaagaagaaaatgctgcagacaaatctgaaagtgtccggagccctatatcgggaaataaccttaaaagtggcagaagtccagcttaagtcggatttcgccgcccagaaactttctaatctgtag

SEQ ID NO: 187429 - DNA, 2457 bp, Artificial Sequence
  Description of Artificial Sequence: Synthetic coding sequence
atgaccagcaagcaggccatgagcagcaacgagcaggagcggctgttgtgctataacggggaagtgctcgtttttcaactgtcgaaaggcaatttcgccgataaggaacccactaagactccgattctgcatgtgcgtcgtatggtatttgatagaggaacgaaagtgttcgtccaaaagtcaaccggctttttcaccataaaggaagagaacagccacctgaaaattatgtgctgtaattgcgtgtctgactttcgaactggcatcaatctgccttacatagtcatcgaaaagaacaagaaaaacaacgtcttcgagtatttcctgcttatccttcactccacaaacaaattcgaaatgcgtctatcctttaaactcggttatgagatgaaggacggactaagagtccttaatgggccgctgattctttggcgccatgtgaaagcattcttctttatctccagccaaaccggtaaagttgtatcggtctcagggaacttctcgtctatccagtgggcaggtgagattgagaatttaggcatggtattactgggtttaaaggagtgttgtttgtccgaagaggagtgcacccaagagccatctaaaagtgactacgcaatctggaacactaagttttgcgtctattccctcgagtcccaagaagttctgtccgatatttacatcattccacctgcctatagcagcgtagtgacatacgtgcacatctgcgcaacggagatcataaaaaaccagttgcggataagcctcatagctctcacacgcaagaaccaactgatttcgtttcagaacgggacacccaaaaacgtctgccagctgccttttggggatccctgcgcagtccaactgatggactcaggtggggggaaccttttctttgtggttagttttatctctaataatgcttgcgccgtgtggaaagaatccttccaggtcgccgcaaagtgggagaaactgtctttggtgctaattgatgactttattggcagcggtacagaacaggtactgctgctcttcaaagacagtctgaatagcgattgtctgacttcgttcaaaataaccgacctgggaaaaatcaattacagctcagagccttcagactgtaatgaggacgatctctttgaggacaagcaagagaaccgatacctcgtcgttccaccactcgaaaccggcttgaaagtatgtttctcgtcctttagggagctgagacagcacttactgctcaaagagaagattatatccaaatcatacaaagctctgatcaacctggtgcagggcaaggacgataacacctcttcagccgaggaaaaggaatgtctggtacctctgtgtggagaggaagagaacagtgtgcacattttggacgagaaattgtcagacaattttcaggactcagagcagctggtggaaaagatctggtacagagttattgatgactcactcgttgtgggtgtaaagacaacttcttctctgaagctgtctttgaacgacgtgacactcagcttgctaatggaccaggcccacgactcccgtttcaggctcttgaagtgccagaatagagtaattaaactttcaactaatccctttcctgccccctatctgatgccttgcgagatcggcctggaggccaaacgggtaaccctcacacccgattccaaaaaggaagagtcgtttgtttgtgagcatcccagcaaaaaggagtgcgtacaaataattacagcagtgacctccctgtctccactattgaccttctctaagttttgttgtactgtgctgctgcagatcatggaaagagagagcggcaactgtccaaaggacaggtatgtggtgtgtggcagagtgtttctgagcttagaggacctgtctaccggaaaatatctactcacttttcctaagaagaaacccatcgagcatatggaagatctgtttgctttactagccgcatttcacaaatcctgtttccagatcacaagcccgggctatgctctcaactcaatgaaagtgtggcttcttgaacacatgaagtgcgaaatcatcaaggagttcccggaggtctacttttgcgaacgtcctggatccttctacggaacgctgttcacctggaagcagcggacccccttcgaaggcattctcattatctatagccgcaatcaaaccgtgatgttccagtgcctgcacaatctgattaggattcttccaatcaattgcttcctgaagaaccttaaatctggaagcgagaattttctgattgataacatggcgtttactcttgagaaggagctcgtcacactctctagcctctcgtccgcaatcgctaagcacgagtcaaactttatgcagagatgcgaggtgagcaaagggaagtcctccgtggtggccgcggccctgtcggaccgccgcgaaaacatccatccgtaccgcaaagagctgcagaggtag

SEQ ID NO: 187430 - DNA, 1677 bp, Artificial Sequence
  Description of Artificial Sequence: Synthetic coding sequence
atggcccaggacagcgtggacctgagctgcgactaccagttctggatgcagaagttaagcgtgtgggaccaggcttcaaccctggaaacgcagcaagatacgtgtcttcacgtcgctcaattccaggagtttcttcgaaagatgtacgaggctctgaaagagatggatagcaacaccgtgattgaaagatttcccacaatcggtcagttactcgctaaggcctgctggaacccatttattttggcctacgacgaaagccaaaagattttgatttggtgcctgtgctgcctcatcaacaaagagcctcagaacagtggccagagcaagcttaattcatggatccagggggtgctgtctcacattctgtcagcacttcgtttcgataaggaagtggcgctgttcacccaggggctggggtatgcccccatcgactactatcccggtcttctgaaaaatatggtgctttcactcgcctccgagcttagggagaatcatttgaacgggttcaacacacagaggaggatggcccctgagagagtggcctccctgagccgtgtgtgtgtgcccttaatcactctgacagatgtagatcctttggtcgaagcgcttctcatctgccatggccgcgaaccgcaggagatcttgcaacctgagttctttgaggctgttaacgaggctattctacttaaaaagattagcctgccaatgtcagccgtcgtatgtctgtggctgcggcatctgccatctctggaaaaggccatgctccacctcttcgagaagcttatctcttcggagcggaactgtcttcggcggatcgaatgctttatcaaagacagcagcctccctcaagctgcctgccacccggctatcttccgagtggtggacgaaatgttccggtgcgctttgctggagacggatggagctcttgaaataatagcaactatccaggtgtttactcagtgcttcgtcgaggctttggagaaagccagcaagcaactgcgctttgccctgaaaacttactttccctatacttctcccagcttagccatggttttgcttcaagacccccaggacataccacggggacattggttacagaccctcaagcatatatccgagctgctgcgtgaggccgtggaagatcagacacatggcagctgcggcggccctttcgagtcttggttcttattcatccattttggcgggtgggccgaaatggtggctgaacaattactgatgagtgccgctgagcctccaacggccctactttggctcttggcattctactacggcccgagagatggtcgtcagcaaagggcacaaacaatggtccaggtgaaggcagttttggggcacctgttggccatgagcagaagtagcagtctctccgcccaagacttgcagacagttgccgggcagggtacagatactgatcttcgggctcccgcccagcagctcatccgccacctgctgctcaatttcctcctttgggcccctggggggcacacaattgcttgggatgttataacgctgatggctcacacagccgagattacccatgaaattattggcttccttgaccagacactgtataggtggaatcggctcggtattgagtcccccagatccgagaaactggcacgggaattgctgaaagagctgcggacccaggtgtag

SEQ ID NO: 187431 - DNA, 1677 bp, Artificial Sequence
  Description of Artificial Sequence: Synthetic coding sequence
atggcccaggacagcgtggacctgagctgcgactaccagttctggatgcagaagctctcagtgtgggaccaggcttctacactcgagacacaacaggacacatgtctgcatgtcgcccagttccaagagtttctgcggaagatgtatgaagccctgaaagaaatggacagtaacactgtgattgaaaggtttccgaccattggccagctccttgctaaggcgtgctggaatccttttatcctcgcctatgacgagtctcagaaaatactgatctggtgcctgtgctgtctaatcaataaggagcctcagaactctggacaaagcaagcttaatagctggattcagggcgtgctctcccacatcctttccgccctgcgatttgataaggaagtagccttgttcacccagggactgggctatgcccccatcgattattatcccggtttgctgaaaaatatggtgctctcattagcgagcgagctccgggaaaaccacctgaacgggttcaatacccagcgcagaatggcgcctgagcgagtagcctctctcagtagagtctgcgtccccctcatcacattaaccgatgtcgatccattggtcgaggcacttctgatctgccatgggcgggagccacaggaaattctgcagcctgagttttttgaggcggtgaacgaagctattctcctcaagaaaataagcctaccgatgtccgctgtcgtgtgcctgtggctgagacacctaccgtctctggagaaagctatgttacatctgttcgaaaaattgatcagcagtgagcgcaattgtcttcgacggatcgagtgtttcatcaaagattcgtctctgccccaagccgcctgtcaccccgccatcttccgggtggtggatgaaatgttccgatgtgccctcctcgaaactgacggcgctctggagataattgctactatccaggttttcacccagtgtttcgtggaggcccttgagaaggcttctaaacagctgcggttcgccctgaaaacctacttcccctatacttccccctcgctggccatggttctcctccaggatccccaggacatccctcgcggccactggcttcagaccctcaaacacattagcgaacttctcagagaggcagttgaagaccagacacacggcagctgtggtggaccatttgagtcttggttcctgttcattcatttcggaggctgggctgagatggtggctgagcagctcctaatgtccgctgcagagcctcccaccgcccttttatggctgctggcattttattatggcccccgggatggaagacagcagagagcccagactatggtgcaggtgaaggcggtgctggggcacctgctggcgatgtcccggagttcaagcctctctgctcaggacctgcagactgttgcgggccagggcaccgacaccgatcttcgcgcacctgctcagcagctgattaggcacctgctcttaaactttttgctgtgggcacctggcggccacacgatcgcttgggatgtcattacgctgatggctcatacagctgaaatcacacacgagattatcggctttttagaccagacactgtaccggtggaatcggctagggattgagagcccgagaagcgagaaactggctagagagcttttgaaagaattacgcactcaggtgtag

SEQ ID NO: 187432 - DNA, 453 bp, Artificial Sequence
  Description of Artificial Sequence: Synthetic coding sequence
atggcccaggacagcgtggacctgagctgcgactaccagttctggatgcagaaattgtccgtgtgggaccaggcaagcaccttggagacacagcaggacacttgcctccacgtggctcagttccaggaatttttgagaaaaatgtacgaggcgctgaaggaaatggattcgaacacagtgatcgaacgatttcccaccatagggcagctgctagcaaaggcttgttggaacccttttattctggcttacgatgagtctcaaaaaatcctaatctggtgcttgtgttgcctcattaataaggaaccccagaattcaggacaaagtaagctcaattcttggattcagggcgtgttatctcatatattgagcgctctgcgattcgacaaggaggtggccctgtttacccagggattgggatacgctccaatcgactactaccctggcttattgtag

SEQ ID NO: 187433 - DNA, 4416 bp, Artificial Sequence
  Description of Artificial Sequence: Synthetic coding sequence
atggtgagcaagcggcggctgagcaagagcgaggacaaggagagcctgaccgaggacgcttccaaaacacgaaaacaacctctcagtaagaaaacgaagaaatcgcatatagccaacgaagttgaggagaatgactccatcttcgttaaactcctcaaaatcagcgggatcatcttgaagacaggcgagagtcaaaatcagctagccgttgatcagatagcttttcagaagaaactttttcagacccttcgtaggcacccgagctatcctaagattattgaagaatttgtgtctggccttgagagctatattgaggatgaagactccttccgcaactgtctactgtcgtgtgagcggctgcaggatgaggaggcctccatgggcgctagctatagcaaatccctgataaaactcctgctgggtatagatatcctgcaacctgccataataaagacccttttcgaaaaactcccagagtattttttcgaaaataagaacagcgacgaaatcaacatcccccgacttatagtatcacagcttaaatggctggatcgcgtagtggacggtaaggatttaaccaccaaaatcatgcagctcatctctatcgcgcctgaaaacctgcagcatgacattattacttcgctccctgagatcttgggagactctcagcacgccgacgtaggaaaggagctatcagacttacttattgaaaacacttctctgacagttcctatcctcgatgtgttgagttccttacgactggaccctaatttcctcctgaaggtgagacagttggttatggacaagctcagctcgatacggttagaagatctgccggtgataattaagttcatcctgcactctgtgaccgccatggacactctggaggtcatatccgagttgagggaaaaattggacttgcagcactgtgtgttaccctcccggctccaagcctcacaggtgaagcttaaatctaaaggacgcgcctcctcctccggaaatcaggagagctccgggcagtcctgcatcatcctcctgttcgatgtgattaaaagcgcgattagatacgaaaagacaatctctgaagcctggattaaagcaatcgagaacactgcctccgtaagcgaacacaaagtgttcgatctggttatgttgtttattatctactcaaccaatactcagaccaaaaaatatattgatcgggtgttgaggaataaaataagatccgggtgcattcaggagcaactcttgcagtcaacctttagtgtccattacctggtgttgaaggatatgtgttcttccattctcagcctggcccagtccctgctacacagcctagatcaaagcattatcagtttcggcagcctgctctacaagtacgccttcaagttctttgatacctactgtcagcaggaggtggtgggtgccctggtgacccatatttgcagtgggaacgaggcagaagtggataccgcactggacgtactactcgagctcgtggtgctcaacccttccgcgatgatgatgaatgcagtctttgtaaagggtatcctagactatctcgataatatttctccacagcagattcgcaagttattctacgtcttgagtacactggcctttagtaagcagaacgaggcctcatctcatattcaggatgatatgcacttagtcatcagaaaacagctctcttccaccgtgttcaagtacaaactaattggcatcataggcgccgtcaccatggctggaataatggccgcagatcgttctgagagcccgtcactgacacaggagagagctaacttaagcgacgagcaatgtactcaggtcacctcactcctccagctggtgcactcatgttcggagcaaagcccgcaggcctcagccctatactacgacgagttcgcaaatctgatccagcatgagaagctggacccaaaagccctggaatgggtcggccatacgatatgtaacgacttccaggacgctttcgtggtggactcctgtgtggtgccggaaggcgacttccccttccccgttaaggccctgtacgggctggaggagtacgatactcaagacgggatcgccatcaacctgctgcctctgctgtttagtcaggattttgccaaggatggtggtccggttacatcgcaggaatccggacagaagttggtctcccctctttgtttagcaccttatttcaggctgctccggctctgtgtagagcgtcagcacaacggcaacctcgaggagatagatggtttgttagattgtccaatcttcctgaccgatttggaacccggcgagaagctggaatccatgagcgctaaggaacgttcctttatgtgctccctgatatttttgaccctgaattggtttcgggagatcgttaacgccttctgtcaagaaacctctccagagatgaagggcaaggtgctcactaggctgaagcacatagtggaactgcaaattatcctggagaaataccttgctgtaaccccggactatgtcccccccctgggcaacttcgacgtggaaacactcgacatcacaccacacactgtcacagccatcagcgctaagattagaaagaagggtaagattgagaggaagcagaaaactgacggatcaaaaacttcatccagtgacacactctcagaagagaagaactccgagtgcgatcctacacccagtcatcgtgggcagctcaacaaagagttcaccgggaaggaagagaaaacttcactgctcctgcacaatagccatgcctttttcagggagctggatattgaagtcttcagtattctccactgtgggctcgtcacgaagtttatcttagatacagaaatgcatactgaagcaaccgaagtggtgcagcttggcccccccgagctgttattcctgctggaagatctgagccagaagctcgagagcatgctgacgcctcctattgccagacgcgttcccttcctcaaaaacaagggttcacgtaacataggctttagccatctgcagcagaggagcgctcaggaaattgtgcactgtgtttttcagctcctgactccaatgtgcaatcatctcgagaacattcataattattttcaatgtctggccgcagagaatcacggggttgtggacgggccgggggttaaagtccaggaataccacattatgtcaagttgctatcagcgcctgcttcaaatattccacggcttgtttgcctggagtgggttcagccaacccgaaaaccagaatcttttatactctgcactgcatgttctgagcagtaggctgaaacaaggtgagcattctcagcccctagaagagctcctgtcacaatctgtccattacctgcaaaactttcatcagtcgattccctcattccagtgtgcactatacctcatacgtctgcttatggtcatactcgaaaagtccactgcaagtgcccagaacaaggagaaaattgcttcgcttgcgcgtcaatttctatgtcgagtttggccatcaggcgataaggagaaatccaacatatctaatgatcagttgcatgcactgctctgtatctacctggaacacactgagagcatcctgaaagctattgaggagatcgcaggtgtgggcgtgcctgagctgattaactcgccgaaggatgcgagctcctcaacctttcctactctgactcgacacacctttgtagttttcttcagggtgatgatggccgaactcgagaaaaccgtaaaaaaaattgagccgggaacagccgctgattctcaacagatacacgaggagaaattgctgtattggaatatggctgttcgtgatttctcaattttaatcaaccttatcaaggtattcgatagccaccccgttctgcacgtgtgtctgaagtacggcagactcttcgtggaagcctttctgaaacagtgcatgcctctgctcgatttctctttcagaaaacatcgtgaggatgtgctctcactgctggaaacattccagttagataccaggctgctgcatcacctgtgcggccattccaaaatccaccaggacactagactaacacaacatgtgccactgctcaaaaagaccctcgagcttctggtgtgcagagtgaaggcaatgctgacactaaacaattgtcgcgaggcattttggctcggtaacctgaaaaatcgggacctgcaaggtgaggaaatcaaatcacaaaattctcaggagtcaacagccgacgagtcagaagatgacatgtcatctcaagcctctaaaagtaaagccacagaggtgtccttacagaacccaccagagagcgggactgatgggtgtatcctgctgatcgtgttgtcatggtggtcccgcacactccccacctatgtgtattgccagatgctgctgtgtcctttcccgtttccaccttag

SEQ ID NO: 187434 - DNA, 3750 bp, Artificial Sequence
  Description of Artificial Sequence: Synthetic coding sequence
atggtgagcaagcggcggctgagcaagagcgaggacaaggagagcctcacagaggatgccagcaagactcgcaaacagcctttaagtaagaagactaaaaagtctcatattgccaatgaggtcgaagagaacgacagcatctttgtcaaattgctgaagatatccggaattatccttaagacgggggagagtcaaaatcagctcgcagtcgaccagatcgcctttcagaagaaattgttccaaactctgaggcggcatccatcttaccctaagattatcgaagaatttgtgtccgggctggagtcctatatcgaagacgaggactcatttaggaactgcctgctgtcttgcgagcgtctgcaggatgaagaagcctcgatgggggcaagttacagtaaaagcctgatcaagctgctgctgggcatagacatcctccagcctgctattattaaaacactgttcgaaaaactgccagagtacttctttgagaataaaaacagtgacgaaattaatatacccagactgattgtaagtcagttaaagtggctggatagagtggtggatggcaaagaccttactacaaaaataatgcaactgatctccattgcccctgagaacttgcagcacgacataatcacatccttgcccgagatactcggcgactcgcaacatgccgacgtgggcaaggaattgtctgacctgctgatcgagaacacttccctcactgtgcctatcctcgacgtgctgtccagtctcagactcgatccaaattttcttcttaaggtccgccagctggtcatggacaagttgagcagcattcggctagaagaccttcctgtgatcatcaagtttattctccattccgtcacagcaatggacactttggaggtgatatccgagttgagagagaaacttgacctgcagcactgcgtcctgccatcccggctgcaggccagtcaggtcaagttgaagagtaagggtagggcgtcttctagcggtaaccaggagagctcaggccagagctgtatcatactcctgtttgacgtaattaagagcgctattagatatgagaagaccatctccgaagcgtggattaaggccattgagaatactgccagcgtttccgagcataaggtgttcgacttggtaatgttgttcataatctactccactaatactcaaactaagaaatacatagaccgtgtgttgcgcaataagatcagatccggttgcatccaggaacagctgttgcaaagcacatttagcgtgcattacttagtgctgaaggatatgtgctcaagcatcttgtcactcgcacagagtctgttacatagcctggatcagagcatcatttcttttggttctctactgtacaagtacgcattcaaattcttcgacacctattgccagcaggaggtggtgggcgccttggttacccatatctgtagtggcaatgaagcagaagtggatacagcccttgacgtgctcctggaattggtcgtccttaacccatctgccatgatgatgaacgccgtttttgtgaaagggattcttgactacctcgataacatctccccacagcagattagaaaactgttctatgttcttagcaccctggccttctcaaagcagaacgaggcctcctcccacatccaagatgacatgcacttagtgatacgtaaacaactatccagcacagttttcaaatacaagctaatcgggataatcggcgccgtgactatggccggcatcatggccgcggaccggagcgagtctccctccctgacccaagagagggctaatctgagcgatgagcaatgcactcaagttaccagtttgctgcagctggtgcactcttgctcagagcagtcaccccaggcatctgcattatattacgatgaattcgccaacctgatacagcacgagaaactggaccccaaagctcttgagtgggtcggacatacaatttgtaatgatttccaagatgcctttgttgtggacagctgcgtggtccccgaaggtgatttcccttttcccgtgaaggctctctacggacttgaggagtatgatacgcaggacggaatagcaattaacctgttgccgctgctgttttcccaggatttcgcaaaggatggtggcccagtaacaagtcaggagtccggtcagaagctggtctcccctctttgtctcgccccctactttcgacttttgaggttgtgcgtggaacggcagcataacgggaacttagaggagatcgacgggctcctggattgtccaatcttcctcaccgatctcgaacctggagagaagctggagtcaatgtccgcgaaggagaggagctttatgtgcagtctgattttcctgactctgaattggtttcgtgaaatcgtgaacgccttctgtcaggaaacatctccggagatgaagggtaaagtgttgacccgccttaagcatatagtggaactgcaaataatccttgagaagtacttagccgtgacacccgactacgtgcctcccttgggaaatttcgacgtcgagaccttggatattaccccacatactgtgaccgctatctcagcaaagattcggaaaaaggggaaaattgaaaggaagcagaaaacggatggcagcaaaacaagcagttctgatacactgtccgaagagaaaaactccgagtgtgaccctacaccaagtcaccgaggccaactgaacaaggagttcacggggaaggaagaaaaaacttccctacttctccacaactctcacgcgttttttagagaattggatatcgaggtattttccatactgcactgcggactcgtgacaaaattcatcttggatacagagatgcacaccgaggccaccgaagtggtccaactcgggccgcctgagttgctgttcttactcgaggaccttagtcagaagctcgagagcatgctaaccccccccatcgcccgaagggtccctttcctgaagaacaaaggctccagaaatatcggctttagtcacctgcagcagcgcagcgctcaagagatcgtgcattgcgtctttcaactcctcacaccaatgtgtaaccacctagaaaacattcacaactacttccaatgcttagcagctgaaaaccatggcgtggttgatggaccaggtgtcaaggttcaagagtatcacattatgagtagttgctaccagcggttgttacagatctttcacggcctattcgcctggtctgggttttcacaacctgagaaccaaaatctgctctactcagcattgcacgttttgtctagccgactcaaacaaggtgagcactcccaacctctggaggagctgcttagccagagtgtccattaccttcagaacttccatcaatccatcccaagcttccagtgcgctctgtacctgattcgattattaatggtcatcttggagaagagtaccgcatccgcacaaaataaggagaagatcgcatctctcgcccggcaatttctgtgtagggtctggcccagtggcgacaaggagaaatccaacatatctaacgatcagctacatgctttgctgtgcatttacctagagcacaccgagagcattctcaaggctattgaggaaattgccggggtgggcgtccccgaactgataaattcaccaaaggacgctagctccagcacattcccaaccctcaccaggtttatgaaacgcaatagctctaccggaacttggctgttcgaaactagcgtgtctagtagtacatag

SEQ ID NO: 187435 - DNA, 4356 bp, Artificial Sequence
  Description of Artificial Sequence: Synthetic coding sequence
atggtgagcaagcggcggctgagcaagagcgaggacaaggagagccttaccgaagatgcgtcaaagacgaggaagcagccattatccaaaaaaaccaagaagtcccacatcgccaatgaggttgaggagaatgattccatatttgtcaaattacttaagatctccggaatcatactgaaaactggagaatcccagaaccaactggctgtggaccaaattgcatttcagaagaaactcttccagaccctgcggagacacccgtcttaccccaaaatcatagaggagtttgtgagcggcctggaatcttacatcgaggacgaggattcctttaggaattgtctactgtcatgtgaacggttgcaggacgaggaggcaagcatgggcgcatcgtacagcaaatccctgatcaaactcctgctcggcatcgatatcttgcagcccgctatcattaagacactgttcgagaagcttcccgaatactttttcgagaacaaaaactcggatgagatcaatattcctcgtcttatagtctctcagcttaaatggctggaccgcgtggtagacggcaaggacctgacaacaaagattatgcaactgatctctatcgcaccagagaaccttcagcacgatattatcacgagcctgccggagatcttgggtgactcccaacatgcagatgtgggtaaagagttaagtgatctcctgattgaaaataccagtctcacagtgcctattctggatgtactctcaagcctccggttggaccccaatttcctgttgaaggtccggcagctggtgatggacaaactgtctagcatcagactcgaagacctgccggtgatcatcaaattcatactccactcggtgacagctatggataccctggaggtcatcagcgaacttcgtgaaaagctggacctgcagcactgcgtgctgccatcacggttacaggcgtctcaggtaaagctcaaatctaaaggtagagcgtcatctagcggtaaccaagaatcatctggacagtcatgcataatactgctttttgacgtcatcaagagcgcgattcgttacgagaaaaccatttcagaagcctggataaaagccattgaaaacaccgcatctgtcagtgaacacaaggtattcgatctggtgatgttgttcatcatctactccacaaatacacagacaaagaagtacatcgatcgggtgctgaggaacaagattcgatcgggctgcatccaagagcagctgctgcaatcaaccttctctgtccattatctcgtcctgaaagatatgtgctctagcatccttagcctcgctcagagtttgctccatagtctcgaccagagtatcattagtttcggctcacttttgtacaaatatgccttcaaattctttgacacctattgccaacaagaggtcgtgggggcacttgttacacatatctgctccggaaatgaggctgaggttgacacagccctcgacgtcttgcttgaactggttgttttgaatccttccgccatgatgatgaacgccgtatttgtgaaagggatcctggattaccttgacaatatcagtccgcagcaaattcgcaagctcttctacgttctgagcaccctagccttctccaagcagaacgaggcttcatctcacattcaggatgatatgcatctcgtgattagaaagcagctcagctcaaccgtgtttaagtataaactgattggcataattggggcagtaaccatggccgggataatggcagccgaccgctccgaaagtccaagcttgacacaagagcgcgcaaacttatccgacgaacagtgcactcaggtgacatctctacttcagttggttcattcatgtagtgagcagtcccctcaagccagtgccctgtattatgacgagttcgcaaaccttattcagcatgaaaaattagatcccaaggcactcgagtgggtgggtcacacaatctgtaatgacttccaggacgccttcgtcgtcgactcttgtgtggtgccggagggagacttcccattccccgtgaaggctctgtacggactggaggagtatgatacccaggatgggatagcaattaacctgctgcccctactgttcagtcaggattttgctaaggatggaggacccgttactagtcaggaaagcggtcagaagctggtaagtcctctgtgcctggcaccgtattttagactcttgcgcttatgcgtggagcgtcagcataacggtaacttagaggaaattgatggcctcctagattgtccgatattcttaacggatttagagcctggggaaaagctcgaatctatgagtgctaaggaacgctctttcatgtgctccctgattttccttaccctcaactggtttcgcgagatcgtcaacgcattttgtcaggaaaccagccccgagatgaagggcaaggttttgacaagactcaagcatatagtcgagcttcaaatcatcctggaaaaatatctcgcagtcactccagattatgtgccaccccttgggaactttgatgtcgaaacactggatataaccccccatacggtcaccgccataagtgccaagatccggaaaaagggcaaaattgaaagaaaacagaagactgacggctccaagacttcctcatctgacactctctccgaagagaagaacagcgagtgcgacccaactccgtcccaccgcgggcagctgaacaaagagtttactgggaaggaagaaaagacctccctcctactccacaactcgcacgcttttttcagagagttagatatcgaagtcttctcaattcttcactgcggcctggtgacaaagttcatcctggacaccgagatgcacaccgaggctactgaggtggtgcaacttggtcctccagaactgctctttctcttggaggatttatctcagaaactcgaaagcatgctgaccccaccgatcgctaggagggtccccttcttaaagaataagggctctcgaaatattggtttcagccacttgcaacagcggtccgcacaggaaatcgtgcactgcgtattccagcttttgacacctatgtgcaatcaccttgagaatatccacaactatttccaatgcctggcggccgagaatcacggagtcgtggacgggcctggggtgaaagtccaggaataccacattatgagcagctgttaccagcggctcctgcagatattccatggcctttttgcttggtccggcttctcacaacccgagaaccagaacctgctgtattcagcccttcatgtgctctctagcaggctcaagcagggagagcactcacagccccttgaagagttactgtcccagtcagtgcactatctgcagaattttcaccagtccatcccgtctttccagtgtgctctctaccttataaggttgctcatggtaatactcgagaagagcaccgcctctgcacagaacaaagaaaagatagccagtctggcccgtcagtttctatgccgagtttggccctccggcgataaagagaaaagtaacatctctaatgatcagctccatgccctcctgtgcatatatctggaacatacagaaagtatcctgaaagctatagaagagatagcgggggtaggggtccccgagctaataaactcccccaaagatgcctcttcgagcacgttcccaacactgactcgccataccttcgtcgtcttctttagggtaatgatggccgaattagagaaaactgttaagaagattgagccggggactgctgccgactcacagcagattcatgaagagaaactgctgtactggaatatggccgtgcgcgatttttcaatactgatcaacctcatcaaagttttcgattctcacccggtgctgcacgtctgcctcaagtatggtaggttatttgtagaagcttttctgaagcaatgcatgccactgctcgacttctcctttcggaagcatcgagaggatgtcctgagcctgttggaaactttccagctggatactcgcttgctacatcacttatgcggccactcgaaaattcatcaagatactaggctgacccagcacgtgccactgctgaaaaaaaccctagagctcctcgtttgcagggtgaaggcgatgcttaccctgaataactgccgcgaagctttctggctgggaaacttgaagaatcgcgacctgcagggcgaggaaattaagtcacagaatagccaagagagtacagccgatgagtcagaggacgatatgagttctcaggccagcaagtccaaagccaccgaggacggtgaggaggatgaagtctctgccggagagaaggagcaagattccgacgaatcttacgatgactccgactag

SEQ ID NO: 187436 - DNA, 4356 bp, Artificial Sequence
  Description of Artificial Sequence: Synthetic coding sequence
atggtgagcaagcggcggctgagcaagagcgaggacaaggagagccttaccgaggacgcctctaagacaaggaaacagccccttagcaagaagacgaagaaatcacacatagccaatgaggtcgaggagaatgactcgatcttcgtcaagctcttgaagatttccggaatcattctgaagactggagagtctcagaatcagctggcagtggaccagatcgcctttcaaaagaaactgttccaaactttacggcgccacccaagctatcccaagatcattgaggaatttgtttcgggcctcgagtcatacatcgaagatgaggatagtttccgcaactgtctcctatcctgtgagaggcttcaggacgaggaggcttcaatgggtgcctcctatagcaaatccttgatcaaactgctgctgggaattgatatccttcagcctgcaattattaagacgctgtttgagaagctaccagagtacttcttcgagaataaaaacagcgacgagataaatatccctagacttattgttagtcagttgaaatggcttgatcgggtggttgacggcaaggacctgacaactaaaataatgcagcttatcagcatcgcccccgagaatttgcaacacgacattataacgagcctccctgagatcctcggggactcccaacatgccgatgtaggtaaggaactcagtgatctgctgattgaaaatactagcctaaccgtgcccattctcgacgtcctttcgtcacttcggcttgatccgaactttctattaaaagtgcgccaactagtgatggacaaactgagtagcatcagactggaagatcttccagtcatcattaagttcattttgcacagcgtcaccgcaatggacacgctggaagtcatctccgaactccgcgaaaagttggacctacagcattgtgtgctgcctagtagacttcaggccagccaggtgaagctgaaatccaagggtcgagctagtagctctggcaaccaggaaagttctggacagtcttgtatcattctgctgtttgatgtcataaagtctgccatcagatatgagaagactatttccgaggcctggatcaaggcaatcgaaaacacagcttcggtatccgaacacaaagtattcgatctcgttatgctctttatcatctattctaccaacacccagacaaagaaatacatcgaccgggtgctgaggaacaaaatcaggtcaggctgcattcaagaacagctgctgcagtccaccttttccgtccactacctggtccttaaggacatgtgttcttccatcttgagcttagcccagagccttcttcactccctggaccagtctatcatttcctttggtagtctcttatacaagtatgcatttaagttctttgacacgtactgccagcaggaggttgtgggcgccttggtgacccacatctgctccggcaacgaagctgaggtggacactgccctggacgtgctcctagagctagttgttctgaaccccagtgcaatgatgatgaacgcagtttttgttaaaggcatccttgattacctggataacattagcccacagcaaatccggaagttgttctatgtgttatccacccttgctttttccaaacagaatgaggcctcaagccacatccaggatgacatgcacctggtgatacggaagcaattaagtagtactgtgtttaaatataagctgatcgggattatcggggctgttactatggccggtatcatggcagccgatagatccgagtctccctctctcacccaggaaagagcaaacctttcagacgagcagtgcactcaggtgacctcccttctgcagctggttcattcttgctctgagcagtcaccccaggccagtgctttgtactacgacgaatttgcaaacttaattcagcatgaaaagttggaccctaaggccctcgagtgggtgggccacaccatctgcaacgactttcaggacgcctttgtcgtcgactcatgtgtggttccagagggagactttccgttccctgtcaaagccttgtacgggctggaagagtatgacacacaggatggcattgccattaacctcctaccacttcttttttcccaagacttcgctaaagatggcgggccagtcacaagccaagaatccgggcaaaaactggtttctcctctctgtctggccccgtatttccgcctcctccgattgtgcgtggagaggcaacacaacggcaacctggaagaaatcgacgggcttctcgattgtcctatctttttaacagacctggagcctggtgagaagcttgagtcaatgtcagccaaggagcgaagcttcatgtgttcactgatattcctgaccctaaattggttcagagagattgtgaatgccttctgccaggagacaagtcccgaaatgaaggggaaagtcctgacacgacttaagcacattgtcgaacttcagataatattagaaaagtatctggccgtcactcccgactatgtgccccccttaggcaattttgatgtggaaacactcgacattaccccccatacggtaacagcgatctccgcaaagattcggaaaaaggggaagatcgagcgcaaacagaaaacagatggtagcaagaccagttcctcagataccctgtctgaagagaagaattccgagtgcgacccaaccccatcccacagagggcaactaaataaagagttcactggcaaagaggagaagacaagcctcctgctgcataacagtcacgcgttttttcgtgagcttgatattgaagtgttttccattctgcactgtgggctggtgacgaagttcattctcgacacagagatgcatacagaagctacagaggtcgtgcagctcgggcctcctgaattgctgttccttctggaagatctaagccagaaacttgagtctatgctgacacctccaatagctcgccgtgtcccatttctcaagaataaggggtcacgaaacattggattttcccatttgcagcagcggagtgctcaggagattgtgcactgtgtgttccaactgttaacacctatgtgtaatcatcttgaaaacattcacaactatttccagtgccttgccgctgagaaccacggcgtcgttgatggccctggagtaaaggttcaagaatatcatatcatgagcagctgctaccagaggctcctccagatattccacggtttattcgcctggtcaggattctctcagcccgagaatcagaatctcctgtactcagcattacacgtgctgtcgagtagattgaaacagggagagcactcgcaaccattggaggaactgctcagccaaagcgtgcactacctgcagaattttcatcagagcattccgtcctttcagtgcgcactctacttaatacgcttgctgatggttattctggagaagtccacagccagcgcgcagaataaagagaagattgctagtcttgctcgacagtttctgtgcagggtgtggccatcaggggacaaagagaaaagcaatatctcaaacgaccagctccacgccctcttgtgtatatatctcgaacataccgagagtatccttaaggcgatcgaagagatcgctggcgtaggggtaccagaactgattaatagcccaaaggacgcaagctcttccacttttcctaccctcactagacacacgtttgtggtgtttttccgtgtaatgatggcagaacttgagaagacagtcaagaagatcgaaccaggcaccgcagctgatagccaacagatccacgaagagaagctcctgtactggaacatggccgttcgagactttagcattctgataaacctgattaaggtatttgactcccacccagtgctccatgtttgtctaaagtacggtagactctttgtggaagctttcttgaagcagtgtatgcctctgcttgacttcagtttccgtaagcatcgggaagatgtcctctctctactcgagaccttccaacttgacacacgtctgctccatcatttgtgtggccacagcaaaattcaccaggacaccagactcacccagcacgtgcccctactgaagaagaccctggagcttttagtgtgcagggttaaagccatgctgaccctcaataactgccgggaggctttctggttgggcaatctgaagaacagagatctccagggggaggaaatcaagtcccagaacagccaggagtccacagccgacgaatccgaagacgatatgagcagtcaagcatcaaaatccaaagctaccgaagacggcgaagaagacgaggtgagcgccggcgagaaggagcaagactctgatgaaagctatgatgattccgactag

SEQ ID NO: 187437 - DNA, 1341 bp, Artificial Sequence
  Description of Artificial Sequence: Synthetic coding sequence
atggacagcagcgccgcccccaccaacgccagcaactgcaccgacgccttagcatacagttcgtgctctcccgctcctagtccaggatcctgggtgaatctgtctcatctcgatggcaacctgagcgatccatgtggacccaaccgaaccgatctgggcggaagggactctttatgccccccaactggaagcccatcaatgattacagccattactatcatggccttgtactccattgtgtgcgtggtgggcctgtttgggaatttcctggtgatgtacgttattgtcaggtacactaagatgaaaacagcaaccaacatctatatctttaatctggctctggctgacgctcttgctacttcgaccctcccattccagtctgtgaactacctcatgggaacatggccattcgggaccatactctgcaagattgtgatatctatcgattactataacatgttcaccagcatcttcaccctgtgtaccatgtctgtcgacagatacatagcagtgtgtcatccagtgaaagcactggactttcgcactcccagaaatgccaagattatcaacgtgtgcaattggattctttcatctgcgattggtctccccgttatgttcatggctactaccaaataccgccagggttccatagattgtacacttactttcagccaccccacctggtactgggagaacctcctaaagatctgtgtgttcatttttgctttcattatgcctgtattaatcatcactgtctgctatggtctgatgattttgcggctgaaatcagtgcgcatgctgtcaggcagtaaagaaaaggataggaacctgagacggatcacccgcatggtcttggtggtggttgctgtgtttatcgtttgctggacccccatccatatctacgtgatcattaaggctctggtgaccattcctgagacaacctttcagactgttagctggcatttctgcattgcgctgggatatacgaacagctgcttaaatcccgttttatatgctttcttagacgagaacttcaaaaggtgtttccgcgagttttgcataccaacctctagcaacattgaacaacagaattctacacgaattagacagaacaccagggaccacccaagcacggcaaacaccgtggatcggaccaatcatcagtgtcttccgattccctcattgagttgctgggcactggagcaagggtgtctggttgtgtacccaggcccgcttcagggacctcttgtgcgatacgacctgcctgctattctgcactcctcatgtttgaggggcaataccgcccctagcccttcaggtggcgcatttctcctctcctag

SEQ ID NO: 187438 - DNA, 1125 bp, Artificial Sequence
  Description of Artificial Sequence: Synthetic coding sequence
atggagagcctgctgcagcacctggaccggttcagcgagctgctggctgtttcgagcaccacatatgtttcaacttgggatccggcaactgtgcgccgggccctgcagtgggcgcggtacctgcggcatatccaccgaagatttgggaggcacggtcctattcggacagcactggaacgacgtctacacaaccagtggagacaggagggagggttcggccgtggaccagtgccgggcctggccaacttccaggccctgggacactgcgatgtcctgctatcactccgactgctggaaaacagagcactgggcgatgcggcccggtaccatctggtccagcaattattccccgggcccggagtgcgggacgccgatgaggagacattgcaagaatcccttgctcgacttgctcgccgtcggtcagccgtgcacatgttgagatttaacggctaccgggagaaccccaatctgcaggaagattcacttatgaagacacaagccgagctgcttctcgagcgcctgcaggaggtcggcaaggctgaggctgaaagacccgccaggttcttgagttccctatgggagaggctgccccagaataacttcctcaaggttatcgcggtggccctcttgcagcctcccctctcaagacgcccacaagaggaactggagccggggattcataaaagccccggcgaaggttctcaggtcctggtccattggctgctcgggaattcggaagttttcgccgctttctgcagggccctgccggcagggttgctcaccttggtcactagcagacaccctgccttgagcccagtctacctcggcctacttactgattgggggcagcggttacattacgacctgcaaaaagggatctgggtgggaaccgagtctcaagacgttccatgggaagagctccataatcgcttccagtccctgtgccaagcacctccccctctgaaggacaaggtgctaaccgccctggaaacttgcaaagcacaagacggcgactttgaggtgccgggcctctcaatttggacggatctccttctggcgctgagatccggcgccttccggaaaagacaagtcctgggattgagtgcaggcttaagcagcgtgtag

SEQ ID NO: 187439 - DNA, 3807 bp, Artificial Sequence
  Description of Artificial Sequence: Synthetic coding sequence
atggaccagaagatcctgagcctggccgccgagaagaccgccgacaagttgcaagaattcctgcagactctgcgggaaggggaccttacaaaccttctgcagaatcaggctgttaagggaaaagtggccggggctctgctccgcgcaattttcaaaggcagtccttgtagcgaggaggctgggacccttcgcagaagaaaaatttacacatgctgtatacagctcgtagagtcaggcgatctccaaaaggagatcgcctcagagataatcggtttactcatgctggaagcccaccattttcccgggcccctgctggttgaactggcaaatgagttcatctcggctgtgagggagggatccctcgtcaacggcaaaagtttggagttgctcccaatcattcttactgctttagcaactaaaaaggagaatctggcctatgggaaaggcgttctgtcaggcgaggagtgtaaaaaacagctgatcaatacactgtgctccggtcggtgggaccagcagtacgtgattcaactcacatcgatgtttaaggatgttccacttactgccgaggaggtagaattcgtcgtggagaaggctctctctatgttcagcaaaatgaacctccaagaaatacctccactagtgtaccagctgctcgtgctatctagcaaaggatctaggaagtctgttcttgagggcattattgccttcttttctgccctggataaacagcacaatgaggaacaatctggagacgaacttttggatgtggtcaccgttcccagcggggaactgaggcacgtggagggaactattattctccacatagtgtttgctattaaattagattacgaactgggcagggaactggtgaagcaccttaaagtagggcagcagggcgacagcaacaacaacttgagcccgttttctatcgctctgctgcttagcgtgactagaatccagaggtttcaggaccaagttctggacctcctgaagacttctgtggtaaagagcttcaaggatctgcagctactccagggatcgaagttccttcagaatcttgtcccacatagatcgtacgtgagcacaatgatactcgaagtcgttaagaactctgtgcacagttgggatcacgtgactcaggggctcgtagaactgggcttcatccttatggactcatacggcccaaagaaagtgcttgacgggaagacaatcgagacatccccaagtctgtcaaggatgcccaatcagcacgcatgtaaacttggtgcgaacatactgctcgagacctttaaaattcatgaaatgatccgccaggagatcctcgaacaggtgctgaaccgcgtggtgacacgtgcctcctctcccatttcacattttctggatctgcttagtaacatagtcatgtacgcccccctcgtgctacaaagttgttcttctaaggtaactgaagctttcgactatctgtctttcctgcctttacagactgtgcagcggctgttgaaagctgtacagcctcttctgaaagtcagcatgtctatgagggactgtctgatacttgtgcttaggaaagcaatgtttgccaatcagctggacgctcgcaagagtgccgtcgccgggttcctactgctgctgaagaactttaaagtcctgggatcgttgtcgtcaagccagtgttctcagtctctgagtgttagtcaggttcatgtggatgttcattcccactacaattctgtggctaacgaaaccttttgtttagagatcatggactccctccgccgctgcctgtctcagcaagctgacgtacggctgatgttatacgaaggcttctacgacgtgctgcgacgaaattcccagctggcaaactccgtgatgcagaccctgctgtcacagctcaaacagttctatgaaccgaagccagacttgttgcccccacttaagctggaagcctgcattctcacacagggtgacaagatctccctacaagaacctctggattacttgctgtgttgcatccaacattgcctggcctggtataagaacaccgtgattcccctgcagcaaggtgaggaggaagaggaggaggaggaagctttctacgaagatctggacgacatactggaatcaattaccaatcggatgataaaaagtgagcttgaagactttgagctggataagtccgcagatttcagtcagtccacttctattgggatcaagaacaatatctgcgccttcctggtgatgggcgtgtgcgaagtcctgatcgagtacaacttctcgatcagcagctttagtaagaatcgcttcgaggacatcctgagcctgttcatgtgttacaagaagcttagcgacattctgaacgaaaaggccgggaaggccaaaactaagatggctaataaaacgagcgactctctgctgagtatgaagtttgtgtccagtttgctgaccgccctgttccgagtcctgctgtggcggtacacatccatccctacaagtgtggaagaaagcggaaagaaggaaaagggcaagtctatctcacttctgtgtctggagggccttcaaaaaattttctctgccgtgcagcaattctatcagccaaagatccagcagtttttgcgtgccctcgacgtcaccgataaggagggcgaggaaagggaggacgctgatgtttcagtaactcagagaacagcattccaaattcggcaatttcaaagatctctgctcaaccttctgtctagccaagaagaggactttaactcaaaagaagccttgctgttagtgacagtcctcaccagtctttcaaagttactggaaccctcatcaccccagttcgtgcaaatgctaagctggaccagcaagatctgcaaagaaaatagccgggaagacgccctgttttgcaaatcgctaatgaacctcctcttctcactgcatgtatcgtacaaatcacccgtaatcttgctgagagatttgtctcaagatattcatgggcatctgggagacatcgatcaagacgtggaagtagagaagacgaaccatttcgccattgtgaaccttagaaccgctgctccaaccgtttgcttgttagtgctgagccaggcagagaaagtgctggaagaggttgactggctgatcacaaaactgaagggacaggtgtcacaggaaactttatctgaggaggcgtcttcccaggcaactctgcccaaccagcctgtagaaaaggctataatcatgcaactgggtaccctcctgactttttttcacgagctggtccagacagccctgccttctggatcgtgtgtggataccttattaaaagacttgtgcaaaatgtatacaaccctgaccgcacttgtaaggtattacctccaggtatgccaatcctcgggtggcatccctaagaatatggaaaagttggtgaaactcagcggatcgcacttaaccccactgtgctactcttttatcagctatgtccaaaacaaaagtaagtcattaaactataccggagagaaaaaggaaaagcccgcggcggtcgcaacagcgatggcccgtgtcctccgggaaacgaagcccataccgaacttgatatttgctatcgagcagtatgaaaagtttttgatccatttaagcaagaagtcaaaagtgaatctgatgcagcatatgaaactgagcacttctagggatttcaagattaaagggaatattttagacatggtactgagagaggatggtgaggacgaaaatgaagaaggcacagcatctgagcacggcggtcagaataaggagcccgccaagaaaaagcgcaagaaatag

SEQ ID NO: 187440 - DNA, 3987 bp, Artificial Sequence
  Description of Artificial Sequence: Synthetic coding sequence
atggaccagaagatcctgagcctggccgccgagaagaccgccgacaagttgcaggaatttcttcagactctccgggagggggatctgacaaacctccttcaaaatcaggccgttaagggaaaggtggccggcgccctgctgagagccatcttcaagggatccccctgctccgaggaggccggcacattaagaagacgtaaaatttatacatgctgtattcaactggttgaaagcggggatctccaaaaggagatcgcaagtgagattatcggcctgcttatgctagaagcccaccactttcctgggcctctacttgtcgagcttgctaatgagtttatctccgctgtgcgcgagggttctctcgtcaatgggaagtcactggaattgttacctatcatcctgactgctcttgccaccaagaaggaaaacctcgcgtacggaaaaggtgtattgagcggagaggagtgcaagaagcagcttattaatacgttgtgttccggtcgctgggatcaacagtacgtcattcaactgacttccatgttcaaggacgtcccccttactgcagaagaggtggagtttgtcgtagagaaagccttatccatgttcagcaaaatgaacctgcaggagattccgcctctcgtctaccagctgctggttctgtcgtccaagggcagtcgaaagagtgtactagaaggaatcatcgcattcttctctgcactcgataaacaacacaatgaagaacaaagtggagatgagctcctggatgtggtcacagtgccgtctggcgagctaaggcatgttgaagggactatcattttacacattgtctttgccataaagctggactacgagttaggacgtgaactggtgaagcacctaaaggtggggcaacagggggattccaacaacaatctgtcaccattctccatcgcactcttattgagcgtgacaaggatccagaggttccaggatcaggtgctagatctccttaaaacctctgttgtgaaaagctttaaagaccttcagctgttgcaggggtctaaattcctgcagaacttagtgccccatagaagctacgtctcaaccatgatcttggaggtcgtaaaaaactccgtccactcttgggatcatgtgacgcagggattggttgaactgggctttattctgatggattcctacgggcctaagaaagtcctggatggtaagactattgagacgagcccctctctgtcccggatgccaaatcagcacgcatgcaagctgggagctaacatactgctagaaacattcaaaattcatgaaatgatccggcaagagatactcgagcaggtcctcaaccgcgtggtgactcgggcgtcctctccaatcagccacttcttagacctcctgtccaacatcgtcatgtacgccccgctcgtattacagtcatgcagctcgaaagtcactgaggcttttgactatttatcatttctgcccttacaaaccgtgcagcgtctgttaaaagcggtgcagcccctgctaaaggtaagcatgtcgatgcgggattgcctcattctcgtgttacgcaaggccatgtttgcaaatcagttggatgcaaggaagagcgcagttgcgggctttttgctactgctgaaaaacttcaaggttttagggtccctctccagttcccagtgtagccaaagtctgtccgtgtcccaagtgcacgttgacgttcacagccactataattccgtggcaaacgagactttttgtcttgagattatggatagcctgagacggtgcctgtcgcaacaggctgatgtaaggctcatgctgtacgagggtttttacgatgtgctgcggagaaatagccaactcgcaaatagtgtgatgcaaacactgctgtcacagctcaagcaattctacgagcccaaacccgacctgctacctcctctcaagttagaagcctgcattctcacccagggggataagatatcacttcaggaacccctcgactatctgctctgctgtatccagcactgtctcgcatggtacaaaaataccgtgatcccattgcagcagggtgaggaggaagaggaagaagaggaggcattctatgaggatcttgatgatattctcgaatcaataaccaaccgcatgattaagagcgaattagaggattttgaattagataagtctgcagactttagtcagagtacatcaatcggcattaaaaataatatatgtgcctttctggtcatgggagtttgtgaggtgttaatcgaatataactttagcatttcttcgtttagtaagaatcggtttgaggatattctgtccttgtttatgtgttacaagaaactcagcgacattttgaacgagaaagccggcaaagctaaaacaaagatggctaacaagacatccgatagtctgctctctatgaagttcgtcagctccctcctcaccgccttgtttcgggatagtattcagagccaccaggaatccctatctgttcttagaagctctaatgaatttatgcgttacgccgtcaacgtggcgttacagaaagtgcagcagcttaaagagactggacacgtgtccggccccgacggccagaatcctgagaagatcttccaaaatctatgcgatattacccgggtgctcttgtggagatatactagcattcccacatccgttgaagagtcaggcaaaaaagagaaagggaaaagcatcagcttactctgtctggaagggctacagaagattttttcagctgtgcagcagttctaccagcccaaaattcagcaattcctcagggctttagacgtgaccgacaaggagggtgaggagcgggaggacgcggacgttagcgtaacccagcgaacggctttccagattcggcagtttcaacggtcgctgctgaatctgctgagcagccaggaggaggacttcaactctaaagaggctctgctgctagtaacagttctgacgagcttgtcaaaactgctcgagccctcctcaccacaatttgtgcagatgttatcgtggacatccaagatttgtaaggaaaacagtagggaagatgctttgttctgtaagagtcttatgaatctcctgttcagcctgcacgtcagttacaaaagccctgtcatcctcttaagagacctctctcaggacatacacgggcacttgggcgatatagaccaggacgtggaagttgagaagactaatcattttgccattgttaacttaaggacggccgcaccgacggtgtgtctgctggtcttgagtcaggccgagaaggtacttgaggaagtggactggctgattacaaaactgaaaggccaagtcagccaagaaactctgtccgaggaggctagctcccaagccactttgccaaaccagccggtggaaaaggctattatcatgcaactgggcacactactgactttcttccacgagctggtccaaaccgcgctgcccagtggctcgtgcgtggacaccctgctgaaagacctctgtaaaatgtatacgacccttacagctttagtacggtattatctgcaggtctgtcagtcatccggagggatcccaaaaaatatggagaagttggtgaaactctccgggtctcacttaacccccctgtgctactcattcattagctatgtccaaaacaagtcgaagtccctcaattatacgggggagaagaaagagaaacccgccgccgtcgccaccgctatggcaagggtgctcagagagaccaagccgatccccaatctgatctttgcaattgaacagtatgagaagtttctcatccacctaagcaaaaaatcaaaagtgaatctgatgcagcacatgaaactcagcactagtcgagattttaaaatcaagggcaatatcctggatatggtgctgcgagaggacggagaagatgagaacgaagaggggactgccagcgaacatggcggccaaaacaaggagcccgcaaaaaaaaagaggaagaagtag

SEQ ID NO: 187441 - DNA, 3288 bp, Artificial Sequence
  Description of Artificial Sequence: Synthetic coding sequence
atggaccagaagatcctgagcctggccgccgagaagaccgccgacaagcttcaggaatttctccaaactctgagggaaggcgatttaactaacctactgcagaaccaggccgtgaaagggaaagttgccggcgctctgctccgggctatatttaaagggtcaccttgctccgaggaggctggtacactgaggcgacggaagatatatacctgttgtatccagctggtggagtctggggatcttcagaaggaaatagctagcgagatcataggtctgttgatgctggaggctcaccattttccagggccgctccttgtggagctggcgaatgaattcatctcggctgttagagagggatctctcgtgaacggcaagagcctagagctgctgcccattattttgaccgccctagcaaccaaaaaagagaacctagcatacgggaagggcgtcctcagtggagaagaatgtaagaaacaattaataaacacattgtgcagcgggagatgggatcagcagtatgtgattcagttgacatcgatgtttaaggatgtgccgctcacagcggaggaagttgaattcgttgttgaaaaggcacttagtatgttttccaaaatgaatcttcaggaaattcctccactggtgtatcagcttctcgtgctgtccagtaaaggaagcaggaaaagcgttctggaaggcatcatcgctttcttctctgccctggacaagcaacataacgaggagcagtctggcgatgagctgttagatgtggtcactgtgcccagcggagagctgagacacgtggaaggcactatcatcctgcacatcgtcttcgctattaagctggactacgagctgggaagggagctcgtgaagcatcttaaggtgggccagcaaggcgatagtaacaacaatctcagtcctttctcaatagcactcctcttgtcagtaacgcggatccagcggttccaagatcaggtcctcgacctcctcaagacatcagtggtgaagtcgttcaaagatctgcagctcctgcaaggatctaaattcctgcagaacctcgttcctcatcggagctatgtttctactatgattctggaagtagtcaagaattccgtgcatagttgggatcatgttacccagggactggtagagctgggctttatacttatggactcctacggccctaaaaaggtcctggatggtaaaacgattgaaactagtccttccttgagtaggatgccaaaccaacacgcctgcaagctgggcgctaatatcctgctggaaacgttcaagatccacgaaatgattcgccaagaaatcttagagcaggttttgaatcgagtcgtcacccgtgcttctagtcctatctctcacttcctagatctgctgtcaaacattgtgatgtacgccccactggtgttacagtcttgttccagcaaggtaaccgaagctttcgattacctctccttcctacctctacaaacggtgcagcgcctgctgaaggcagtgcaaccacttctgaaggtttctatgagtatgcgcgactgcctgatccttgttcttcgaaaagcaatgttcgccaaccagttggatgcaagaaagagtgccgtggcggggtttcttctgcttctcaaaaattttaaggtgctggggtcactgagctcaagtcaatgtagccagtctctctcggttagtcaggtgcacgtggacgtgcattctcattataactctgtcgccaatgagactttctgccttgaaatcatggattccctccggcgttgtttatctcagcaagccgatgttcggctgatgctttatgagggtttctatgatgttttgagaaggaactctcagttggcaaattccgttatgcagactctgttgtcccagcttaaacagttctacgaaccaaaaccagacctactgccgcctctcaagctggaggcctgcatcctaactcagggggataaaataagtttacaggaaccactcgactacctgctatgttgcatccagcactgtctggcttggtacaaaaatacagttattccccttcaacagggggaggaggaagaagaggaggaagaggcgttctatgaggacctagacgatatcctggagagtatcaccaacagaatgatcaagagtgagctcgaagattttgagctggataaatcggccgatttttcccagagtacatcaattggaatcaaaaataacatttgcgcgtttctggttatgggggtttgtgaagtcctgattgagtataacttttcaattagctcattttcaaaaaataggttcgaggacattctgagcctcttcatgtgctataaaaaactgtctgatattctcaacgaaaaagctgggaaagccaagacaaaaatggctaacaagacctcggacagcttgctgtcaatgaaattcgtctctagcttgctgaccgccttgtttcgtgtactgctctggagatatacaagcataccaacatccgtagaagaatcgggcaagaaagaaaaaggaaaatcgattagccttctctgtttggaaggacttcagaagattttcagtgcagtgcagcagttttatcagcctaaaatacagcagtttctgcgagcattggatgttactgacaaggaaggcgaggaaagagaagatgctgatgtgtctgttacccaacgcactgcttttcagataaggcagttccagagaagtttgttgaatctcctctcctctcaggaagaagactttaacagcaaagaggcccttctgctagtgactgtcttaacatctctgtcaaaactccttgagccgagcagcccacaattcgtgcagatgcttagttggacctcaaagatttgtaaagagaactcccgagaggatgcattgttctgcaagtctctgatgaacctgctgttcagccttcacgtttcgtacaaatctccagtgatcctgcttagagacctgagccaggatattcatggtcacctcggcgatattgaccaggatgtggaggttgagaaaaccaaccatttcgcgatagtgaaccttaggaccgccgcccctacagtttgtctgcttgtcctgagtcaggccgagaaagttctggaggaagtcgactggctcatcaccaagcttaagggacaggtgtcccaggagaccctcagcgtgtcgcccggtgtgtccgagctaagaagaaactcaaagaagtatggcaaggcaggagaggccgtatggtttagttctgacccgcccgttctattcttccactttcttcggacagagtag

SEQ ID NO: 187442 - DNA, 222 bp, Artificial Sequence
  Description of Artificial Sequence: Synthetic coding sequence
atgttcaaggacgtgcccctgaccgccgaggaggtggagttcgtggtggaaaaagcgctcagtatgttctcaaagatgaaccttcaggaaatcccccccctggtgtatcagctgttggtcctgagctctaagggctcacgcaaatctgttctggagggcatcatcgcgtttttttcagccctcgataagcagcacaatgaagaacaatctggggatgagtag

SEQ ID NO: 187443 - DNA, 501 bp, Artificial Sequence
  Description of Artificial Sequence: Synthetic coding sequence
atggcccagaccagcagctacttcatgctgatcagctgcctgatgtttctgagtcagtcccagggccaggaagcccaaactgagttgccacaggcacgaattagctgccctgaaggtactaatgcttatcggtcctactgctactattttaatgaagacagagagacctgggtggacgctgatttgtattgtcagaatatgaattccggcaatctggtctccgtactgacacaggcagaaggtgccttcgtggcctccctgattaaggagtcaggtacagacgactttaatgtatggatcgggctgcatgaccctaagaaaaatagacgatggcactggtcaagcggttccctggtcagctataagtcctggggcatcggggcccctagctccgtcaatcccggctattgtgtgtcattgaccagcagcactggcttccagaagtggaaagatgtgccctgcgaagataagttcagcttcgtgtgtaagttcaaaaactag

SEQ ID NO: 187444 - DNA, 384 bp, Artificial Sequence
  Description of Artificial Sequence: Synthetic coding sequence
atggccgtgaccgaggccagcctgctgcggcagtgccccctgctgctgcctcagaaccggagcaaaaccgtttacgagggattcatctcagcccagggtcgcgatttccacctcagaatcgttctgcccgaggacctgcagctgaagaacgctaggttactgtgcagctggcagctgcgcaccattctgtccggctaccatcggatcgtgcagcagcgaatgcagcactcccccgatctcatgagttttatgatggaactcaagatgttgctggaagtcgccctcaagaatcgccaggagctgtacgcactaccaccacctccccaattctatagttccctgattgaagagatcggtacactgggatgggacaaagcaccttag

SEQ ID NO: 187445 - DNA, 6147 bp, Artificial Sequence
  Description of Artificial Sequence: Synthetic coding sequence
atgagcggccggcagcggaccctgttccagacctggggcagcagcattagccggtctagcggcacccccggctgttcgagcgggacagagcgcccccagtctccaggaagttctaaagcccccctgcctgctgccgcggaagcccagctggagtccgatgatgacgtcctgttagtggccgcctatgaagccgaacgccagctctgccttgaaaacggcggcttttgtacttctgcaggcgcgttgtggatataccccaccaactgccccgttcgtgattaccaacttcatatcagccgtgctgcgttgttctgtaacaccctggtctgcctccccacaggcctgggcaaaacatttattgccgcagtcgtgatgtacaacttttaccgttggttcccttcaggcaaggtagtgttcatggcccccactaaaccactggtcacacaacagatcgaagcctgttatcaagtgatgggtataccacaaagccacatggctgagatgacggggagcactcaggctagtacacgaaaggaaatttggtgttccaagagggtcctgtttcttaccccacaggttatggtgaatgacctgtcccggggtgcctgccccgccgccgagattaaatgccttgttatcgatgaggctcacaaagcactcggcaactatgcatattgccaggtggtgagggagctagtaaaatacacaaatcatttccggatcctcgcattatccgcaaccccagggagcgacatcaaagcagtgcaacaggtcattacgaacctgctgattgggcagattgaacttcgaagcgaggactctccggatatccttacttactcacacgagcgtaaggttgagaaactgatcgtgcctctcggcgaggaactcgccgccattcaaaaaacctacattcagatcctggaaagcttcgcacgaagtctcatccagcggaacgtcttgatgagaagggatattcccaatctgacgaaatatcaaattatcctggcacgggaccaatttagaaagaatccgagtcccaacattgtcgggatccagcaggggatcatcgagggggaattcgccatctgcatcagtctttaccatgggtatgaactcttgcaacagatgggaatgaggagcctctacttcttcctctgtggcatcatggacggcacaaagggaatgacgcgctccaagaacgaactggggcgcaacgaagactttatgaagctctataatcacctcgaatgcatgttcgctagaactcggtccaccagcgctaatgggattagtgcaatccaacagggagataagaacaagaagttcgtctacagccatccaaaattaaagaaactcgaggaggttgtgatagagcactttaagagctggaacgcggagaatacaacagagaaaaagagggacgagacaagagtcatgatatttagttctttcagggattctgtccaggagatagcggagatgttatcacagcaccagccaattataagagtgatgactttcgtgggccatgcgtccggcaagagtacgaagggctttacccagaaagaacagctcgaggtggtcaaacagttcagagatggagggtacaacacactcgtgtcaacatgtgtgggggaagagggcctggatataggtgaggtagatctcattatctgcttcgacagccaaaaatcccctatccgattagtgcaacggatggggagaacaggccggaaacgacaggggaggatcgtgataattctctctgagggtcgcgaagaacggatctacaaccagtcacagagcaacaaacggagcatctataaagcgatcagctctaataggcaggtcctccatttctaccagagaagtccgcggatggtcccagacgggattaatcctaagttacataagatgtttattacacacggagtatatgagccagagaagccgtcgaggaacctccagagaaagagctctattttttcatatagagatggcatgcgccagagctcactcaaaaaagattggttcctatccgaagaagaattcaaactgtggaacaggctgtacagactgagagacagcgatgaaataaaggagattacgctcccacaggtacagttcagctcgctgcaaaatgaggagaacaaacccgcccaggaaagcaccaccgggatccaccagctgagtctaagcgagtggaggttgtggcaagaccacccactgcccacgcaccaagtagatcatagcgatagatgccgacatttcatcggcctgatgcagatgatagaaggcatgcgacatgaagagggggaatgttcgtacgaactagaggtagaatcttacctgcagatggaagatgtgacgtctacttttattgcccctcggaacgaatctaacaaccttgcctcggacacgtttattactcataaaaaatctagttttattaagaatatcaatcagggtagctcttccagcgtaatagagtccgacgaagagtgtgctgagattgttaaacagactcacatcaaacctaccaaaatcgtgagtctcaaaaaaaaggtgagcaaagagatcaaaaaggatcagctgaagaaggagaataaccacggcatcatcgattccgttgataacgaccgaaactccacggtggaaaacatttttcaagaggaccttcccaacgacaaacgcacttcagacacagacgagatcgccgctacctgtacaatcaacgagaacgtcataaaggagccgtgtgtactgctcactgaatgccagttcactaacaagtcaacctcgtctctggctgggaacgtgttggatagcggctacaatagtttcaatgatgagaaaagtgttagttcaaatttattcctgcctttcgaggaggagctctatattgtcaggaccgacgaccagttctataattgccactccttgactaaagaagttctggcaaatgttgagcggtttttatcatactctcccccacccctgtcaggtctctctgatctagagtacgaaattgctaaaggcacagctctcgagaatttattattccttccttgcgcagagcaccttagatctgataaatgtacttgtttgcttagccactccgccgtcaattcacaacaaaacctggagctcaattccctgaagtgtatcaactatcctagcgagaagtcatgtctgtacgacatacctaatgataatatcagcgatgaaccttccctttgcgactgcgatgtgcacaagcacaaccagaatgaaaatcttgtacctaataatagagttcagatacatcgcagcccagcacagaacttggtgggggaaaataaccatgatgtggacaacagcgatctgcccgtgctgagcacagatcaggatgagtctctgctgttattcgaagacgtcaacactgaatttgatgacgttagcctctccccactcaactcgaaaagtgagtccctgcccgtgtcagacaagacagcaatcagcgaaaccccactggtcagtcagtttcttatatctgacgagcttcttctggataataacagcgaactgcaggaccaaatcaccagggatgccaattcatttaaaagcagagaccagcgcggtgttcaagaagagaaggtgaagaaccacgaggatattttcgactgctctagagatctcttttcggtgacatttgatcttggcttctgtagtccagatagcgacgacgagatcctggaacacacttctgacagtaatcgtcctctcgatgatctgtacggaagatatctagaaatcaaagaaataagcgacgcgaactacgtcagcaatcaggccctcattccacgggaccactctaaaaattttacctcggggaccgtgattataccaagtaatgaggatatgcagaaccctaattatgtgcatctgccactgtctgcagctaagaatgaagaactgctctctccaggctatagtcaattcagcctgcccgtgcagaagaaggtgatgtcaacccctctgtctaagagcaatactctaaacagctttagcaaaatcagaaaagaaatcctgaaaaccccagatagtagcaaagagaaggtcaacttgcagaggttcaaagaggccttaaacagcaccttcgattattccgaattttccctggagaagtcaaaatcatccggccccatgtatctccacaaaagttgccacagtgtggaggacgggcagttgctgaccagtaatgagagtgaagacgacgaaatcttccggcgcaaggtgaaaagggctaaaggcaatgtcttgaatagtcctgaggatcagaagaatagcgaagtcgattctcccctccacgctgtgaagaaacggaggttcccaattaaccggtccgagctctctagtagcgacgagagtgagaatttccccaagccatgcagtcagcttgaggatttcaaagtttgcaacggtaatgcccggcggggtattaaagtgcccaagcgtcagtctcatctcaagcacgtcgctaggaagttcctggatgacgaggccgagctgtccgaggaagatgccgagtatgtgtcttccgatgaaaatgatgagagtgaaaatgagcaagactcatccctgctggattttttgaacgacgaaactcagttgtcacaggccattaatgattccgagatgcgggccatttacatgaaaagcttgcgctcaccgatgatgaacaacaaatacaaaatgattcacaagacacacaaaaacatcaacatcttctcacagatcccagagcaggacgaaacatacttagaggactcattttgtgtagatgaggaggagtcatgcaagggacaaagttcggaagaggaagtttgcgtggacttcaatctaattactgatgattgtttcgccaattctaagaaatataaaaccaggcgcgccgtgatgcttaaagagatgatggagcagaattgcgctcatagtaagaaaaagctctctcgtattattctccccgacgacagttcagaagaggaaaataacgtgaatgataagcgggaaagcaatatagctgttaatccaagcacagttaagaaaaacaagcagcaggatcactgcctgaacagcgtaccttctggctcaagcgcacagagcaaggttcgaagcactccccgggtcaatcctctcgcgaaacagagcaaacagacgtcgctcaatctgaaggatacaattagcgaggtctctgacttcaagcctcagaatcataacgaggtccaaagtaccaccccaccattcaccacagtggattcgcagaaagactgtagaaaattccccgtcccccaaaaggacggttctgccctggaggactcatccacctccggggcaagttgctctaaaagtcgcccccacctcgcaggcactcacacatccctacgcctgccccaggaaggcaaaggcacctgtattttggtgggcggccacgagattacttcagggttggaagtaattagcagcctccgagcaatacacggccttcaggtagaagtctgccccttgaacggttgcgactacattgtgagtaaccgtatggtagttgaacggcggtctcagagtgaaatgctgaactccgtgaataagaacaaattcatcgagcagattcaacacctgcagtccatgtttgagaggatttgcgtaatcgtggagaaggatcgcgaaaagacaggagacacttctagaatgttccggcgcaccaagtcatatgattcccttcttactactctaataggcgccggtattcgcattctcttcagttcctgccaggaagagacagcggacttgttgaaagagttatccctggttgagcagcgcaagaatgtggggatccacgtgcccaccgtggttaattctaataaaagtgaggctctgcagttctatctttccataccgaatatctcgtacatcaccgcattgaacatgtgtcatcagttctcatcagtgaaaagaatggcaaatagctctttacaagaaatcagcatgtatgcccaggttacccatcagaaggctgaagaaatctatagatacattcattacgtttttgacatccagatgttgcccaacgacctaaatcaggacaggctgaagtccgacatttag

SEQ ID NO: 187446 - DNA, 2010 bp, Artificial Sequence
  Description of Artificial Sequence: Synthetic coding sequence
atgagcggccggcagcggaccctgttccagacctggggcagcagcatctctcgctcttcaggcacacccggctgcagctctggcaccgagcgcccccagagtccaggcagctctaaagcacccctgcccgctgctgcggaagcccagcttgaaagcgatgatgatgtgctcctggtggcggcatacgaagccgagcggcagctgtgcctggagaatggagggttttgcacatctgctggggctctgtggatctatcccacaaactgccctgtcagggattatcagctccacatttctcgcgctgccctgttttgtaatacattagtctgcttgccaaccggcctcggcaaaaccttcattgcggctgtcgtgatgtataacttttaccggtggtttccttccggcaaagtggtttttatggcccctacaaagccactcgtgacccaacagatcgaggcgtgttaccaggtcatgggtatccctcaaagtcatatggctgaaatgacaggtagcacacaggcatccacaagaaaggagatttggtgtagcaaaagggtgctgttcctcacaccacaggtaatggtcaacgatctgtcacggggcgcttgtcccgccgcagaaattaaatgtttagtgattgacgaagctcataaagcactggggaactacgcctattgtcaggtggtacgcgaactcgtgaaatacaccaatcatttcaggatcctggctctgtccgccacccccggctctgacataaaagccgtgcagcaggttatcaccaatctgcttattggtcagattgagttgcgcagcgaggacagccctgacattcttacatactctcacgaaagaaaagtcgaaaagctgatcgtgcctctgggtgaggagcttgccgctatccagaagacgtatatccagatccttgaatccttcgctagatccctgattcagaggaacgtcttaatgaggagggacatccctaatctgactaagtatcagatcattctggcccgggatcagtttcgaaaaaatccatcccccaacattgtgggcatacaacagggaataattgaaggtgagtttgccatctgcatttccctctaccacggatacgaactgctccagcagatgggtatgagatcgctctatttttttttgtgcggaattatggatgggaccaaagggatgacgaggtccaaaaacgaactgggaaggaatgaggatttcatgaaactctacaaccacctggagtgtatgtttgccaggactcggagcaccagcgcgaacggcattagtgctatacagcagggcgataaaaataaaaagtttgtgtattctcacccaaaactcaaaaagctagaagaagtagtaattgagcattttaaatcgtggaacgccgagaataccacagaaaaaaagagggacgagacacgtgtaatgatattctcctcattcagagactctgtgcaggagatcgctgagatgctgtcccagcaccagccaatcattcgagttatgactttcgtcggccacgcctccgggaaatcaacgaagggctttacacaaaaagaacagctcgaagtggtaaagcagtttagagatgggggctataataccctggtgagcacctgtgtgggagaggagggcctcgatatcggcgaagtggatctcattatctgcttcgatagtcagaaatcacccattcgactcgtgcaaagaatgggacggaccggccgcaaacgacaaggaaggatcgttattatcctgagtgaagggcgggaagaacgcatatacaaccagtcccagtccaataaacggtctatctataaagcaataagcagcaatcggcaggtcctacacttttaccagagaagtccaagaatggtgccagacggcattaaccctaaactgcacaaaatgttcattacacatggtgtgtatgagcccgaaaaacccagtaggaacttacagcggaaaagcagtatcttctcatatcgagatggcaaatag

SEQ ID NO: 187447 - DNA, 1968 bp, Artificial Sequence
  Description of Artificial Sequence: Synthetic coding sequence
atggccgactacagcaccgtgcccccccccagcagcggcagcgccgggggcggaggggggggtggtgggggagggggtgtgaatgatgccttcaaggatgctctgcagcgggcaagacaaatagccgcaaaaattggaggcgacgctggaacgtccttaaatagtaacgattacggatacggagggcagaaaagacccctggaggacggggatcaaccagatgccaaaaaggtggcgccacagaatgactcattcggcacccagctgccccctatgcaccagcagcagagtaggtccgttatgacagaggaatacaaagttccagatggcatggtaggctttatcattggccgaggcggcgaacagatttcaagaattcagcaggaatctggctgtaagatccagattgcacccgattcaggtggtctgcctgaacggagctgtatgctcactggtacacctgaaagcgttcaaagtgctaaaaggctgttggatcagattgttgagaaaggacgacctgcccctgggttccaccacggtgacgggccaggaaacgccgttcaggagatcatgattcccgccagcaaggcaggccttgtgatcggcaaagggggggaaactatcaagcagcttcaggagcgagctggggtgaagatggttatgattcaggacggaccccagaacacaggtgcagataaacccctcagaattacgggggacccttacaaggttcagcaagctaaggaaatggtgctggagctcattcgcgatcagggaggtttccgggaggtcagaaatgagtacggctccagaattggtggcaacgagggcattgatgtgcccattcccaggttcgctgttggaatcgttatcgggagaaacggggaaatgatcaagaagattcaaaacgatgccggagtgaggatacaattcaaaccagatgacggaaccacccctgaacgcattgctcagatcactggaccgccagatcggtgccaacatgccgctgaaataatcaccgatcttctaaggtccgtccaggcaggaaacccgggaggccctgggcccggagggcgaggtcgaggccgcggccaggggaactggaatatgggaccaccggggggcttgcaagaatttaattttatcgttccaacaggaaagacagggctgatcattgggaagggcggcgaaaccataaagtcaattagccaacagagtggtgcgcggattgagcttcagagaaatccaccccctaacgccgatcctaacatgaagctttttactattaggggaacgcctcagcaaattgactacgccagacagctaatcgaggagaagatcggcggccccgtgaatcccttaggccctcctgttccacacggtccacatggtgtgcctggcccccatggtcctccaggtccaccaggccctggtacaccgatgggcccctacaatccagcgccgtataatcccggcccccctgggcctgccccacacgggccaccggctccatacgctccccaggggtggggcaatgcctatccacactggcaacagcaggcacctccagaccccgcaaaagccggaactgatcctaacagtgcagcatgggccgcgtattacgcacattattatcagcagcaggcacagcctcctcccgcggcaccagctggagcccctactacaacccagaccaatgggcagggtgatcagcagaatccagctcccgctggacaggtcgattacacaaaagcctgggaggagtattataagaagatggggcaggctgtccctgcccctaccggagctccaccagggggtcagccagactattctgctgcttgggctgaatattaccgacagcaggccgcctattatgcacagacatcacctcagggcatgccccaacacccacccgcaccccagggcttcgctaatcatgccagatcacaccatcacctgtactag

SEQ ID NO: 187448 - DNA, 1935 bp, Artificial Sequence
  Description of Artificial Sequence: Synthetic coding sequence
atggccgactacagcaccgtgcccccccccagcagcggcagcgccggcggcgggggcggaggaggaggaggtggcggtgtcaatgatgcgttcaaagatgcattacagcgcgcgaggcagatcgctgccaaaataggcggtgatgccggaacatcactgaactctaacgattatgggtatgggggtcaaaaacgacccctagaagacggggatcagcccgatgccaagaaggtggctcctcaaaatgattccttcggcactcagctgcctccgatgcaccaacagcaaagccgctcagtaatgactgaggaatacaaggtgcccgacggcatggtgggattcattatcgggagaggcggcgaacagatttcccggattcagcaagagtctggctgcaaaatacagatcgcgcccgattccggtggcctgccagagaggagttgcatgttgaccggaacgccagaatccgtgcaatccgctaagcgcctgctggatcaaatagtggaaaagggaaggccagcccccggattccatcacggagatggccctggcaacgccgtacaggagattatgattcctgcttctaaagccgggctggtaatcgggaagggaggcgagacgatcaaacaattgcaggaaagagccggcgtgaaaatggttatgatccaagatggcccgcagaatacaggagcagataagcccctgagaatcactggagatccctataaagtccagcaggcgaaagaaatggtgctggaactgatcagagaccaagggggattcagggaggttcgaaacgaatacgggtctagaataggaggcaacgaagggatagacgtgcccattccacggtttgcagttggcatcgttattggaagaaacggggagatgatcaagaagatccaaaacgacgcaggggtgagaatccagttcaagcctgatgacgggactactccggagaggattgcccaaatcactgggccccctgaccggtgtcagcacgccgccgagatcatcacagacctgttacggtcagtgcaggccggtaatccaggcgggccaggccccggtgggcgcggcagaggacggggacagggaaactggaacatgggacctccaggcgggcttcaggagtttaactttatcgtgccaacaggcaaaacagggctgattataggcaaaggaggcgaaacaatcaaatcgatctcccaacagtctggtgcgcggattgagttgcagaggaaccccccccctaacgccgatccaaacatgaaattatttacgattagaggtacaccacagcagatcgattatgcaagacagcttatcgaagagaaaattggtggccccgtgaatccactaggtccacccgtcccccacggaccccacggggtgccaggcccacatggtccacctggccccccagggccaggaactccaatgggcccctacaaccctgccccgtacaacccaggacctcccgggccagcaccgcacggtccgcctgctccatatgcccctcaggggtggggtaacgcttacccacattggcagcaacaagctccaccagaccccgccaaggcgggaactgatcccaattctgccgcctgggccgcttattacgcacattactaccagcaacaagcacagcctccccccgcagccccagccggcgctcctaccaccacccaaaccaacggccaaggggatcagcaaaaccccgccccagccggtcaggtcgattacacaaaagcttgggaggaatattacaagaagatgggccaggcggtgcccgcccccaccggcgctccacctggaggtcaacccgactattccgccgcttgggccgaatattataggcagcaggcagcttattatgcgcagacaagtccccaggggatgccgcaacacccacctgccccccaaggacaatag

SEQ ID NO: 187449 - DNA, 1965 bp, Artificial Sequence
  Description of Artificial Sequence: Synthetic coding sequence
atggccgactacagcaccgtgcccccccccagcagcggcagcgccggcggaggagggggagggggcggagggggcggggtgaacgacgcattcaaggatgccctgcaacgggcccgtcaaattgccgccaagatcggcggggacgccggcacttctctgaactctaacgactacggatatgggggccagaagcgtccactggaagacggggaccagccggatgccaagaaggtggccccacagaacgattcttttggaacacagctccctcccatgcaccaacagcagagaagcgtcatgactgaggaatacaaagttcctgacgggatggttgggtttataattgggcgggggggggaacagatcagcaggatacagcaggagtccggttgcaagatacagattgcacccgattctggtggcctgccagaacgctcatgcatgctgacgggaactcccgagagtgtgcagagcgctaagcgtctgttagaccagatcgtcgagaaaggtcgtcccgctcccggcttccatcatggcgacgggccaggcaatgctgttcaggagatcatgatccccgcatctaaagccggactggtcatcgggaagggtggcgagaccatcaaacaacttcaggaacgggccggagttaagatggtcatgatccaggatggaccccagaacacaggggccgataagcccctgcgcatcacgggagatccatataaggtgcaacaggcaaaggaaatggtactggagcttatcagggaccagggcgggtttcgcgaagttcggaatgaatatggttcccgcattggcggaaatgagggcattgatgtacctattccccgttttgccgtaggaatcgtgatcgggaggaacggagaaatgatcaaaaagattcagaacgacgcgggcgtgcgtattcagttcaaacccgacgacggtactactccggagaggattgcacagattacaggcccacctgaccgctgccaacatgccgctgaaatcatcacagatctcctccggtcagtacaggccgggaatcccggaggcccaggacctggaggaaggggcagagggagaggtcagggcaactggaatatgggcccccctggagggctgcaagagttcaacttcatcgtgcccaccgggaaaacagggctcataatcggtaagggcggagagaccatcaagtctatttcccagcagagtggggcacgaatcgagctgcagcggaacccccctcctaatgcagacccaaatatgaaattgtttactatccggggcaccccgcaacagatagactatgccagacagctaatcgaggaaaaaatcggcggtccggtgaatccgctaggtccccccgtcccccacgggccacatggggtgcctggtccacacgggcctcccgggccgccaggtccgggaacccctatgggaccttacaatccggcaccctacaaccccggaccacccgggccagcacctcatggaccgcctgccccctatgcgccccaggggtggggaaatgcatatccccattggcaacagcaagccccccctgacccagctaaggccggcacagacccaaactccgcagcttgggctgcttactacgctcattattaccagcagcaagcccaaccaccacctgctgcccccgccggcgcgcctacgacaacccagacaaatggacaggagggggaccaacaaaatccagctcctgccggccaggtggactacaccaaggcctgggaggaatactacaagaaaatgggccaggctgtccccgccccaacaggagctcccccagggggacagcccgactacagtgccgcttgggcagagtactacagacagcaggctgcttactacgcgcagacatccccccagggtatgccacagcaccctcccgctcctcaatgtcggtttgaccccgcatccattgaactggcgttgtag

SEQ ID NO: 187450 - DNA, 1890 bp, Artificial Sequence
  Description of Artificial Sequence: Synthetic coding sequence
atggccgactacagcaccgtgcccccccccagcagcggcagcgccggcggaggaggaggcggcgggggcggtggcggcgtgaacgacgcctttaaagacgccttgcagagggcaaggcaaatcgccgccaagatcggtggcgatgctggaacaagcctgaactcgaatgactacggatatggggggcaaaagcggcccctggaagacggtgatcagccagacgcgaagaaggtcgctccccaaaacgactccttcgggactcaattacccccaatgcaccagcagcagcggagtgtcatgacagaagagtacaaagttccagatggtatggtcggcttcatcatcggacgcggaggtgagcagatcagtcggattcagcaggagagcgggtgtaaaatccaaatagctccagacagcggtgggctacccgaaagatcctgcatgctgaccggcactccagagagcgtccaatcggccaagaggctgctggaccagattgtcgagaagggccgcccggcccccgggtttcaccacggcgacggaccagggaatgcggttcaggagattatgattcccgcctcgaaggccggcctagtcattggaaagggtggggaaactataaagcagcttcaagagcgggcaggagtgaagatggtcatgattcaggatggcccccagaatacgggcgctgacaagcctctcaggatcactggagacccctataaggtgcaacaggcgaaagaaatggtgctggagctgattcgggatcagggcggattccgcgaagtccgcaacgagtacggcagcagaatcgggggtaacgaggggattgatgtgccaattcccagatttgctgttgggatagtgattggaagaaatggcgagatgatcaagaagattcaaaacgacgccggggtgcgcattcagtttaaacccgatgatgggaccacccccgaacgaatcgcacagataacgggcccccccgacaggtgtcaacatgcagccgaaatcatcacggacctgttgaggtccgtccaggcaggcaacccaggcggacccggaccaggaggcaggggacggggtagaggccagggcaactggaatatggggcctcctgggggcttacaggaattcaactttatcgtgcccaccggcaagactggactaatcatcggcaagggaggcgagacgataaaaagcattagtcaacaaagcggggcacgaattgagctgcagcgtaatcccccccctaacgctgatcccaacatgaagctgttcaccatcagagggacaccacagcagattgattatgccagacagctgattgaggaaaaaattgggggccccgtaaacccactcggcccaccggtgccccatggaccgccagggactcctatgggaccttacaaccctgccccatacaatccaggacctccaggaccagcaccccatggacctcccgccccctacgctccccagggttggggtaatgcgtatccccattggcagcagcaggctccgccagaccctgccaaagctggaactgatccaaattcagcagcatgggcggcgtactatgcccattattaccaacagcaggcccagccgcctcccgctgcgcctgccggtgcgcctaccactacccagaccaacggccagggcgaccaacagaatcctgctccagctgggcaggttgattatacaaaggcctgggaggaatattataaaaaaatggggcaggctgtgccagcccctactggagcaccccccggcgggcagccggattacagtgccgcttgggcagaatactatcgccaacaggcggcctactacgctcaaacgagcccccaggggatgcctcagcacccgcctgctcctcagggacaatag

SEQ ID NO: 187451 - DNA, 699 bp, Artificial Sequence
  Description of Artificial Sequence: Synthetic coding sequence
atggccgactacagcaccgtgcccccccccagcagcggcagcgccgggggaggggggggcgggggaggtggcggcggtgtgaatgatgccttcaaggacgctctacagagggccagacagatcgccgctaagatcggaggggacgcaggtacctctctgaacagtaatgactacggatacgggggccagaagagacccctagaagacggggatgggtcttggactagtccaagcagcacaactcattgggagggcatgccaagtcctttcaaggatcaaccggatgccaaaaaggttgctccccagaatgatagtttcggaacacaactgcctccaatgcatcaacagcagaggtctgtgatgaccgaagaatataaggtgcctgacggcatggttggatttatcataggccggggaggcgagcaaatctctagaatacagcaggaaagcgggtgtaaaattcagatcgcgcctgatagcggaggcttacccgagcggtcctgtatgctgactggaacaccggaatccgtgcagagtgccaagaggctgctggatcaaatagtcgagaagggtaggcccgctccagggttccatcatggggacggccctggcaatgctgtgcaggaaatcatgatccctgcaagcaaggcagggttggtgattggcaaaggaggagagacaatcaagcaactgcagtag

SEQ ID NO: 187452 - DNA, 1998 bp, Artificial Sequence
  Description of Artificial Sequence: Synthetic coding sequence
atggccgactacagcaccgtgcccccccccagcagcggcagcgccggcggaggcggcggtggcggcggtgggggcggcgtcaacgacgcgtttaaggacgcactgcagagggcccggcaaattgctgcaaaaatcgggggcgacgcagggacttctctcaactccaatgactacggttatgggggacagaagcgacccttggaggatggcgatggcagctggacttccccaagttccacaactcactgggaagggatgccttccccctttaaggatcagcctgatgcgaagaaagtggccccacagaatgactcgttcgggactcagctgcctcctatgcatcagcagcaaagcagatctgttatgaccgaagagtataaggtgcctgacggcatggtcggcttcatcattggtcggggcggagaacagatatccaggattcagcaggagagtggatgcaagatccagatagccccagactcaggcgggctcccagagaggagctgtatgctaacgggcaccccggagtcagtgcagtctgccaaaagactgctcgatcaaatagtggagaagggccggcccgctcctggatttcaccacggggacggaccagggaacgctgttcaggagatcatgatcccagcttctaaagcaggtctggtgattggtaagggcggcgaaacaatcaaacagctccaagagagagcaggcgtaaagatggtcatgatacaggatgggccacagaatactggggccgacaagcccctaaggatcactggcgacccctataaggtgcagcaggccaaagagatggtgctggaacttattcgagaccagggcggttttcgagaggtaagaaacgagtatggttcacggattgggggcaacgagggcatcgacgtccctattccacggttcgccgtcggaatcgtgataggtcgcaatggggaaatgatcaaaaaaattcagaacgacgctggagtacggatccaatttaagccggacgatggaactaccccagagcggattgcccagatcaccggtcctccggaccgatgccaacatgcggcagagattatcacagatctgttgaggtcagtgcaagctggcaaccctggtggtccaggtcccggcggccgagggcgtgggcggggacagggtaactggaacatggggccacccggcggcctccaagaatttaacttcatagtgccgacagggaaaactggactgatcatcggaaaaggcggagagaccattaagtcaatcagccagcagagtggagcacgcatcgagctgcagaggaacccacctccgaatgcagacccaaacatgaagttattcaccataagagggaccccacagcagattgattacgcacgtcagttaattgaagagaagatagggggcccagttaatccgctggggcctccggttccacacgggcctcacggcgtgcctgggccgcacggaccaccgggaccccccggacctgggacccctatgggcccatacaatcctgccccctataaccccggtcccccaggcccagcccctcacggacctccggccccttacgccccccaggggtgggggaatgcatacccacactggcaacaacaagcaccccccgatcctgctaaggccgggacggaccctaattctgccgcctgggcagcgtattatgctcattactaccagcagcaggcgcagccgccccctgcagcacccgccggggcccccactactacacagaccaacgggcagggcgaccagcaaaaccccgccccagctgggcaagtcgactacacgaaggcttgggaggagtattacaaaaagatgggacaggccgtgccagccccaactggggcccctcccggcgggcagcctgattactctgccgcatgggccgaatactaccgccagcaggctgcttattatgcgcaaaccagtccacagggcatgcctcagcatcctccagcacctcaaggccaatag

SEQ ID NO: 187453 - DNA, 1260 bp, Artificial Sequence
  Description of Artificial Sequence: Synthetic coding sequence
atgcccctgagccggtggctgcggagcgtgggcgtgttcctgctgcctgccccctactgggccccaagggaacgttggttggggtctttacggagaccaagccttgtgcacggctatcccgtcttggcctggcactctgccaggtgttggtgccaagcctggaccgaggagccacgtgcactgtgctctagcctccgtatgaatggcgatcagaattccgatgtatacgctcaggagaagcaggattttgtgcaacacttcagccagattgtgcgggtcctgactgaggatgagatgggccaccctgaaataggagatgctatcgccagattaaaggaggtcctggagtacaatgccatcggggggaagtacaacagggggctcaccgttgtggtggcctttcgggagctggtggagccacgtaaacaggacgccgactccctacagcgtgcatggactgtgggctggtgtgttgagcttctccaggccttcttcttggtggcagatgacatcatggatagctcactgactaggcgcggacaaatctgctggtaccaaaagcccggagtgggtctggacgcaattaatgatgcaaatcttctcgaggcctgcatctataggcttctcaaactctactgccgcgaacagccctattacctgaatttgatcgagctctttctacagtcaagctaccaaacggagatagggcagacgctagacttgctaaccgccccccagggcaacgttgatttggtgcgtttcaccgaaaaacgatataaaagtattgtgaaatataaaaccgccttttactccttttacctgcctattgctgccgctatgtacatggccgggattgatggggagaaggagcatgccaatgctaagaagattttgctcgagatgggtgagttcttccagatccaagacgactacctggatctttttggtgatccatctgtgacaggcaaaatcggtaccgatattcaggacaataaatgttcatggctcgtggtgcagtgtctgcagagggcaacgcctgagcagtatcagatcctcaaggagaattatggacagaaggaggccgaaaaagtggctcgggttaaggccctctatgaagagctcgatctccctgctgtgttcttacaatacgaagaagatagctacagccatatcatggcactcatcgaacaatatgccgcccctctgcctcctgctgtattcctcgggctggcccgcaagatttataaacgccgaaagtag

SEQ ID NO: 187454 - DNA, 1260 bp, Artificial Sequence
  Description of Artificial Sequence: Synthetic coding sequence
atgcccctgagccggtggctgcggagcgtgggcgtgttcctgctgccagcaccatattgggcacctcgcgaacgatggctaggctctctcagaaggccgtcgcttgtgcacggctacccagtgttagcgtggcacagtgccaggtgctggtgtcaggcctggactgaagagcccagagctttgtgcagtagcctccgaatgaatggggatcagaactccgatgtctatgctcaggaaaagcaggatttcgtgcaacacttctctcagatagtcagagttttaacggaagatgaaatgggccatcccgagatcggtgatgctatcgcacgtttaaaagaggtcctcgagtacaacgccatcggggggaaatacaaccgcggcctgactgtagtagtcgcatttagagaattggttgaacccagaaagcaggatgcggattcattgcagagggcttggacagttggctggtgtgtcgaactcctgcaggcattctttttggttgccgatgatatcatggactcgagcttgacaagacgcgggcagatctgctggtaccagaaacccggagttggcctggacgctatcaacgacgctaatctgttagaagcgtgcatctacaggctcctgaaactctactgccgtgagcagccgtactatctgaacttgattgagctgttcctacagtcttcgtatcagactgaaatcggccagactctggaccttctgacggctccgcaggggaatgttgatctggtgcgctttaccgagaagcgctataaaagtatcgtcaaatataaaactgctttttactccttctatctaccaatcgccgccgccatgtatatggcgggcattgacggagaaaaggaacatgccaatgccaaaaaaattctcctagagatgggagagttcttccaaattcaagacgattacctcgacctcttcggggaccccagcgttaccggaaaaataggaactgatattcaggataataagtgctcgtggctggtggtgcagtgtctgcaacgcgcgacaccagagcagtaccagatcttgaaagaaaattacggccaaaaggaagcagagaaggtggccagagtgaaggcgctgtatgaagaactggatcttcccgctgtcttccttcagtacgaagaggattcttattcccacataatggccctgattgagcagtatgcagctccacttccgcctgctgtattcctgggcctagcacggaagatctataaacgcagaaagtag

SEQ ID NO: 187455 - DNA, 1062 bp, Artificial Sequence
  Description of Artificial Sequence: Synthetic coding sequence
atgaacggcgaccagaacagcgacgtgtacgcccaggagaagcaggacttcgttcagcacttctctcagatagtgagagtcctcacagaagacgagatggggcaccccgaaatcggggacgccatcgcaaggctgaaggaagtgctcgagtataacgcaataggaggcaaatacaatcgcgggctgacagtagtagtagccttcagggagctggtggagccaaggaagcaggatgcagactccctgcagcgggcttggactgtcggctggtgtgtcgaactccttcaggcctttttcctggttgctgacgatataatggatagcagcctcaccagacgaggccagatttgctggtatcagaagcctggggtgggcctagatgccataaatgacgccaacttactggaagcgtgcatttaccggctgcttaagctctactgcagagaacagccctattatttaaacttaattgagctgttcctccagtcatcctatcagactgagatcggtcagacattggatcttttgacagcgccacagggaaatgtggatctggtgagatttacagagaaacgctacaaaagtatcgtgaagtacaaaacggcattctattcattttacctgcccatcgctgccgccatgtacatggctgggatcgatggggaaaaggaacatgcaaatgccaaaaagattcttttggagatgggggaattcttccaaatccaggatgactatctcgacctgttcggggacccttctgtaacaggcaaaatcggcacggacatacaggacaataaatgctcctggctggtggtgcaatgcctgcagcgggccacccccgagcagtaccaaattctgaaagagaactacggacaaaaagaggctgaaaaggtggctagagtaaaggctttgtacgaagagctggatctcccggccgtgtttttgcagtacgaagaagacagctactcccacatcatggccctcatcgagcagtacgccgcgcctctgcccccggctgtgttcttggggcttgcccgcaaaatctacaaaaggcggaagtag

SEQ ID NO: 187456 - DNA, 2760 bp, Artificial Sequence
  Description of Artificial Sequence: Synthetic coding sequence
atgaccggctacaccatgctgcggaacggcggcgccggcaacggcgggcagacctgcatgctgcggtggtcgaataggatccggttaacctggctgagtttcacactctttgtaatcctcgtgttttttcctcttatagcacattactacttaacgacactggatgaggcagatgaggcgggaaagcggatatttggcccccgtgtgggtaacgagctctgtgaagtgaaacatgtccttgatctgtgtcggattcgagaaagtgtgagtgaagagttgcttcagctggaggccaaacgtcaggaacttaattcagaaatcgctaaactgaacctaaagatcgaggcgtgcaagaagagcattgaaaacgcaaaacaagacctgctacagctgaagaacgtgataagccagaccgaacactcctataaagagctcatggcccagaaccagccaaagttgagtcttcccattcgattgctgccggagaaggacgatgcggggctgccgccccccaaagccacacgtggctgtagactacacaactgttttgattattcccggtgccctcttaccagcggcttccctgtctatgtgtatgattcagatcagtttgtctttgggagctatctggaccctctggtgaaacaagccttccaggcaacagccagggccaacgtgtatgtgactgaaaatgcggatatagcctgcttgtacgtaattctcgttggggaaatgcaagaaccagtcgtgcttaggcctgcggagctggaaaagcagctttatagccttccacactggcggactgatggccacaaccatgtgatcatcaacttgtctagaaaatctgacacgcagaacttgctgtataatgtgagtacaggacgggccatggttgcccagagcacgttttatactgtccagtatcggcctggttttgacctcgtggtgtcgccgctagtccacgcaatgagcgagcctaactttatggaaatccctccccaggttcccgtgaaacgcaagtacctctttacattccagggcgagaagattgagtctcttcgatcctctttgcaggaagccaggtcgttcgaggaagaaatggagggagatccaccggctgattatgatgatcgcattattgctaccttgaaagcggttcaggatagcaagctggatcaagtcttagtagagtttacatgtaagaatcagcccaagccaagcctgcctacagagtgggcactttgcggcgagagagaggaccgcttggaattgttgaaacttagcacatttgcactaattattacccccggcgatcctcggctggtaatatcttctggttgcgccacccggcttttcgaggctcttgaggtcggagctgtgcctgtggtcttgggtgaacaggtccagctcccttaccaggatatgttacagtggaacgaggccgccctcgtcgtccccaaacccagagtaaccgaagtgcacttcctcttgaggagtctctctgacagcgatcttctcgctatgcgcagacagggacgttttctgtgggagacctacttctcaacagcggattcaatctttaatacagtgctcgccatgatccgcacaaggatccagatccctgcagcaccaattagggaagaggccgcggccgagattccccaccgctcaggtaaagcagccggaacagatcctaacatggctgataatggggatctcgacctgggtccggtcgagaccgagccgccgtatgctagccctcggtacctgagaaattttactcttacagttacagatttttatcgatcttggaattgcgcacctggaccattccacctatttccacacacacctttcgacccagtgcttccgagcgaggcaaagttcctgggaagcggtacgggtttccgacctatcggcggaggcgctggtggctcagggaaagagtttcaagccgctttaggaggcaacgtgccaagggagcagttcactgtcgtaatgctgacctatgagcgtgaggaggtactgatgaacagtctcgagcgtctaaacggtttaccttaccttaacaaagtggtggtcgtttggaattcgcccaagttgccttctgaagatcttttatggcctgacatcggtgtgccgatcatggtcgtgcggaccgagaaaaactccctgaataacagatttctcccatggaatgaaattgagactgaggccatcttgtctattgacgatgatgcacatctccggcacgacgaaataatgtttggatttagggtgtggcgcgaggcccgcgacagaattgtgggcttcccaggtcggtaccacgcctgggatataccgcaccagtcctggctctataactccaattattcctgcgagctctccatggtgctgacgggcgctgcctttttccacaaatactatgcgtacctgtatagttacgtgatgccccaggctatccgagatatggtggatgaatacataaattgtgaggatattgccatgaatttcctcgtgagccacatcacgagaaaacctccaataaaagtcacttctcgctggacctttcgctgcccgggttgtccccaggccctttcccatgatgactcacatttccacgaacggcacaagtgtattaatttcttcgtaaaagtgtacggttacatgccactgctctacacccagtttcgagtcgacagcgtgctgttcaaaactaggctgccgcacgataaaacgaaatgttttaaatttatttag

SEQ ID NO: 187457 - DNA, 1125 bp, Artificial Sequence
  Description of Artificial Sequence: Synthetic coding sequence
atggagttcgtgaagtgcctgggccaccccgaggagttctacaacctggtcaggtttaggattggaggcaaacgaaaggtaatgcccaaaatggaccaagacagcctgtctagcagtctcaagacttgttacaagtatctgaaccagacaagtaggtccttcgccgccgtgattcaggccctcgatggcgagatgcgaaacgccgtttgcatcttttatctggttcttagggcgctagacactctagaggatgacatgacgattagcgtggaaaagaaggtgccactcctccataactttcacagcttcctttaccagcctgattggagatttatggaatccaaagaaaaggaccggcaggtgctggaggacttccccacatactgccattatgttgccggactggtaggaattggcctgtcccgcctgttctccgcaagtgaatttgaggaccctcttgtcggtgaggacactgaaagagccaattctatgggcctgttcttacagaaaacaaacatcattcgagattatctcgaggatcaacagggtggtcgtgaattttggccacaagaggtctggagtagatatgtcaagaagctgggcgatttcgccaaacccgagaatatcgatctcgccgtgcagtgtctgaatgagcttattactaatgctcttcatcatattccagacgtcataacctatttaagtcgcttgcgcaaccagagtgttttcaacttttgtgccatccctcaggttatggccatcgccactctcgctgcatgttataataatcagcaggtctttaagggagccgtgaagatcagaaagggccaggcagtgaccctcatgatggatgctaccaacatgccggctgtgaaagctattatctatcagtatatggaagaaatctatcatcgcattcctgactcagatccctctagctcaaagactaggcagatcattagtactatcaggactcagaacttgcctaactgccagcttatctctcgatctcactattcccccatctatttgtcatttgtcatgctgcttgctgcattaagttggcaatatctcactacactttcacaggtcacagaggattatgtccaaacgggcgaacattag

SEQ ID NO: 187458 - DNA, 999 bp, Artificial Sequence
  Description of Artificial Sequence: Synthetic coding sequence
atgaccatcagcgtggagaagaaggtgcccctgctgcacaacttccactctttcctgtaccagccagactggaggtttatggaaagcaaggaaaaagaccggcaggtgctggaagactttcccactatatccctcgagtttaggaacctagccgaaaaataccagaccgttatagctgacatttgccggcggatggggatcgggatggcagaatttctcgataagcacgtcacgtcagaacaggagtgggacaaatactgtcactatgtggccggtttagttggaataggcctcagccggctcttttccgcatccgagtttgaagaccctcttgtgggagaagatacagagcgggccaattccatgggattatttctccagaagacaaacattattcgggattacttggaagatcagcaggggggcagagagttctggccgcaggaggtctggtcacgctacgtaaaaaaactgggggattttgccaaacctgaaaacatagacctcgccgttcagtgtttgaacgaactcatcactaacgcgctccaccacattcccgacgtaattacttacctttctcggctccgcaaccaaagcgtgtttaacttctgtgccattcctcaggtgatggcaatcgccactctggctgcatgctacaacaaccagcaggttttcaagggagccgtgaagatcaggaagggccaagccgtgacactcatgatggatgccactaatatgccagccgtgaaggctattatctatcagtacatggaggagatctaccaccgaatcccagatagcgaccccagtagcagcaagacccggcaaataatcagcaccatacggacgcagaatctgccaaactgccagctaatctcgaggtctcactatagcccaatttacctgtcattcgttatgttattagccgccctctcctggcagtacctcacaactctgtctcaggtcacagaggactatgtgcagaccggtgaacactag

SEQ ID NO: 187459 - DNA, 1233 bp, Artificial Sequence
  Description of Artificial Sequence: Synthetic coding sequence
atggagttcgtgaagtgcctgggccaccccgaggagttctacaacctagttagattccggatcggcgggaagagaaaggattcgctcagtagttccttaaagacatgctataagtatctgaaccagacatcgaggagcttcgcggccgttattcaggccctcgatggggaaatgaggaatgccgtgtgtattttctacctggtactgagagcgctagataccttagaggatgatatgacaatcagcgtcgagaaaaaagttccccttctgcataatttccatagcttcctttaccagcccgattggcgatttatggaatccaaagaaaaagatcggcaggtactcgaagacttcccgactatttcgctcgagtttcggaacttggctgagaagtaccaaactgtgatcgccgacatctgtcgccggatgggaatcggcatggccgagttcctggacaaacacgttacaagcgaacaggaatgggacaagtactgccactacgtcgccggcctggtggggataggcctcagtcggttattctcggccagcgagttcgaagatcctctagttggtgaggacactgaaagagctaattctatgggtctttttctgcagaagacaaacataattcgggattacctggaggaccagcaggggggtcgggaattttggccacaggaagtgtggtctcgatatgttaaaaaactgggcgatttcgctaaaccagaaaacattgacctggccgtgcagtgccttaacgagctgattaccaatgccttgcaccatattcctgacgtgatcacgtatctcagcagactgagaaatcagagcgtcttcaatttctgcgccataccgcaagtaatggccatcgcaaccctcgccgcatgctacaataaccagcaggtcttcaaaggcgccgtcaaaatccgcaaaggacaggcagtgacactcatgatggatgcgactaacatgccggccgtcaaggctatcatctaccagtatatggaggagatttaccaccggattcccgatagtgacccatctagtagcaaaactcgacaaataatttccacgatccggacgcagaatcttccgaattgtcagctgatttctcgcagtcactactctcctatttatctgagtttcgtgatgttgctcgctgctttgtcgtggcaatacctcaccacattgagccaggtgaccgaggattacgtacagacgggtgaacattag

SEQ ID NO: 187460 - DNA, 999 bp, Artificial Sequence
  Description of Artificial Sequence: Synthetic coding sequence
atgaccatcagcgtggagaagaaggtgcccctgctgcacaacttccactcctttctgtaccagcccgactggcggttcatggagtccaaggagaaggaccgacaggtgttggaggactttcctaccattagcttggagtttcggaaccttgccgagaaatatcagacggtaatagcagatatttgccggcggatgggaattggcatggccgagttcttggacaaacacgttacctccgagcaggaatgggataagtattgtcactatgtcgccggactggtcgggatcggtctgtcccgcctcttttcagcttccgagtttgaggatcctttggtcggggaggacaccgagcgagcgaacagtatgggactgtttctgcagaagactaatatcatcagggactacctggaggatcagcaggggggcagggaattctggcctcaagaagtttggtcaagatatgtaaagaagctgggtgactttgcgaagcccgagaacatagacttggcagtacagtgcctgaacgagctcatcacaaatgcactccatcacatacctgacgtgataacctacctgtcacggctgcggaaccagagcgtgttcaatttctgcgccattccccaggtgatggctatagccacacttgctgcttgttataataaccagcaagtattcaagggggcagttaaaataagaaagggccaagccgtcacactcatgatggacgcgacaaatatgcccgccgtcaaagccataatctaccaatatatggaagagatttaccaccgaattccagactcggacccttccagctccaaaactaggcagatcatcagcacgatccggacgcagaacttacccaactgccagttgatttccaggagtcactactcacctatctacttgagttttgtcatgctgctggcagctctctcttggcagtacctcaccacgctgtctcaagtgaccgaagactacgtgcagacaggggagcattag

SEQ ID NO: 187461 - DNA, 1062 bp, Artificial Sequence
  Description of Artificial Sequence: Synthetic coding sequence
atgcggaacgccgtgtgcatcttctacctggtgctgcgggccctggacacattggaagacgacatgactattagtgtggagaaaaaggttccactcctgcacaatttccacagcttcttataccagcctgattggaggttcatggagtccaaagaaaaagataggcaggtcctagaagattttcccaccatttctctcgagtttcggaatctggcggagaaataccaaaccgtcatcgccgacatctgtaggcggatggggattgggatggcagaattcctggacaaacacgtcaccagtgaacaagagtgggacaaatactgccactacgtagcaggcctggtcggtattggcctgagtcggctcttctcagcatcggagttcgaggacccactggtcggggaggatactgaacgagccaacagcatgggcctgtttctgcaaaagacaaatattatcagagattacctcgaggatcagcaaggcgggcgggagttctggccccaagaagtatggagtaggtatgttaagaaactcggcgatttcgcgaagcccgagaatatagacctcgcagtacagtgcctaaatgaattgattaccaacgctctgcatcatattccagacgttatcacctacctgagtaggcttaggaatcagtcagtttttaacttttgtgccatcccccaagtcatggctatagccactctcgctgcttgctacaataaccagcaagtgtttaagggtgctgtaaaaatacgcaaaggacaagctgtgacgttgatgatggatgctacaaacatgcctgccgtgaaggctatcatctaccagtacatggaggaaatctatcaccggataccagacagtgacccgtcctcctcaaagacacgacagataatatccaccattcgcacccagaatctccctaattgtcagctcatctctcggtcccactacagtcctatttatctaagtttcgtgatgttgctggcagctcttagctggcagtacctcaccacattgagtcaggtgaccgaagactacgttcagaccggggagcattag

SEQ ID NO: 187462 - DNA, 1062 bp, Artificial Sequence
  Description of Artificial Sequence: Synthetic coding sequence
atgcggaacgccgtgtgcatcttctacctggtgctgcgggccctggacactttggaggacgacatgaccatctccgtggagaagaaagtacccctgctgcataactttcacagcttcctgtatcaacccgactggaggtttatggaaagtaaggagaaagatcggcaggtcctggaggactttcccactatttccctggaatttcgaaatctcgcagagaaataccagaccgtgattgctgacatttgcaggcggatgggtattggaatggctgagttcttagataaacatgttacctcagaacaggagtgggataaatactgtcattacgttgctggcttggtaggcatcggcttgtcccgcctgttcagcgcctctgagtttgaagatccacttgtcggcgaggacaccgaacgggccaatagcatgggcctgttccttcagaagacaaacatcatacgcgactatctggaggaccagcagggcggccgagaattctggccccaggaggtatggagcaggtatgtgaaaaaacttggcgactttgccaaacccgagaacatcgacctagcggtacagtgcctcaacgaattaatcaccaacgcccttcatcatattccggatgtgattacctatctgtcacggctacgaaatcagtctgtttttaacttttgtgcaatcccacaggtcatggccatcgcaacactcgcagcatgctacaacaatcagcaggtctttaaaggggcggttaagatcaggaagggccaggcggttacgcttatgatggacgcaacaaacatgccagccgtaaaggcaatcatctaccagtatatggaggaaatctaccaccgtattcccgactccgatccgagctcaagtaagacaagacagataatctcaactatcagaacccagaatctcccaaattgccaacttatttccaggagtcactactcccccatttatctcagcttcgttatgctcctagccgccctgtcctggcaatatctgactaccctgtcacaggtgacagaagactatgtgcaaacgggtgagcactag

SEQ ID NO: 187463 - DNA, 921 bp, Artificial Sequence
  Description of Artificial Sequence: Synthetic coding sequence
atggagagcaaggagaaggaccggcaggtgctggaggacttccccactatctcattggagttccgcaacttggctgagaaatatcagactgtcattgcagatatctgtcgtagaatggggattgggatggctgagttcctcgacaaacacgtgacatcagagcaggagtgggataagtattgccactacgtggcagggttggtaggaatcggactgagtaggctcttttccgcatcagagtttgaagacccgctggtgggagaggatactgaacgggccaactcaatgggactctttctgcagaagactaacattattcgtgattatctagaggaccagcagggtgggagggaattctggccacaggaagtgtggagccgatatgttaaaaagcttggcgacttcgccaagcccgagaacatcgatctggcagtgcagtgtctgaatgaactaatcactaatgcccttcaccatataccagacgtaatcacatatctatccaggctgcgcaaccagagcgtcttcaatttctgtgccattccccaggtcatggccatagcgacacttgctgcttgctataacaatcagcaggtgtttaaaggcgctgtgaaaattcggaaaggacaggccgtaactctaatgatggacgctaccaacatgcccgccgtcaaagccatcatctaccagtatatggaggagatctaccacagaatcccggatagtgacccatcctcgagtaagacccggcaaatcatctccaccattcggactcagaacctacccaactgccagctcattagtcggagccactatagtcccatttacttgagttttgtgatgctgctagcggctctgagttggcaatacctgacaaccctgtcacaggtcacagaggattacgtgcagacaggggagcactag

SEQ ID NO: 187464 - DNA, 1140 bp, Artificial Sequence
  Description of Artificial Sequence: Synthetic coding sequence
atggccgccaccgagggcgtgggcgaggccgcccagggcggcgagcctggacagcccgctcagccccctcctcagcctcatccacctcctccacagcagcagcataaagaagaaatggccgcagaggccggtgaggccgtggcctctcccatggacgacggctttgtgagtctggactctccaagctatgtactgtaccgcgaccgggctgagtgggccgacatcgatccggtgccgcagaacgacgggcccaatcctgtggtgcagattatctacagtgataagtttcgtgacgtttacgattattttagggctgtgctgcagagagatgagaggagtgagagggcctttaaacttacaagagacgcaattgagctaaacgctgcaaactatacagtgtggcacttccggcgtgttctgttaaaatctctgcagaaggacctccatgaagaaatgaactatataaccgcaattattgaagagcaacccaagaattatcaagtttggcatcaccggagagtcctcgtggagtggctgagagatcccagccaggaactggaatttattgcagatatcttaaatcaggacgctaaaaactaccacgcctggcagcaccgtcagtgggtgattcaggagtttaaattatgggacaatgagcttcagtacgtggaccagttgctcaaggaggacgtgcgcaataactctgtgtggaatcagaggtacttcgtcatttcaaacaccactggatacaatgacagggcggtccttgagagggaggtgcagtatactcttgagatgattaaactcgtgccccacaatgaatctgcctggaactacctgaaaggaattctgcaggatcggggtctctccaagtatccgaatctcctgaatcaactgttggatttgcagccatctcacagcagcccctacctaatcgctttcctggtcgatatctatgaggacatgcttgagaaccagtgtgacaacaaagaagacattctgaacaaggctctcgagctatgtgaaattttggctaaagagaaggacaccataaggaaagagtattggcgatacattggccgctctcttcagagtaaacacagcacggaaaatgatagtcccacgaatgttcagcagtag

SEQ ID NO: 187465 - DNA, 939 bp, Artificial Sequence
  Description of Artificial Sequence: Synthetic coding sequence
atggccgccaccgagggcgtgggcgaggccgcccagggcggcgagccaggtcagcccgcacaacctccacctcagcctcacccgcccccgccgcagcagcagcacaaagaggaaatggcagctgaggcaggcgaggcagtggcctcaccaatggacgatggattcgtctcgctggactccccctcctatgtcctctatcgccattttagaagagtgttgcttaaatcgctacagaaagacctccatgaagaaatgaactacatcacagccatcattgaggagcagccaaagaactaccaagtttggcaccaccggagggttctagtagagtggcttagagatccctctcaagaactggaattcatcgcagacatcctgaatcaagatgcaaagaactatcacgcatggcagcaccgccagtgggtcattcaggaattcaagctgtgggacaacgaactgcagtatgtcgaccagctgcttaaggaggatgtgagaaacaattctgtgtggaatcagcgctattttgtcatttccaacaccacaggctataacgaccgcgctgtactagaacgcgaggttcagtatacacttgaaatgatcaagctcgtcccacataatgagtccgcgtggaattaccttaaagggatcctgcaagacaggggcctgtctaaataccccaatttacttaaccagttgcttgacctacagccttcccattccagcccatacctcatagctttcttagtagatatctatgaggatatgttggaaaatcagtgcgacaataaagaagacattttgaataaggctctggaactgtgtgagatactggctaaagagaaagacactatcaggaaggaatattggcgatacataggaagaagtctccagtctaagcactccacagagaacgatagtccaacgaatgtgcagcagtag

SEQ ID NO: 187466 - DNA, 1314 bp, Artificial Sequence
  Description of Artificial Sequence: Synthetic coding sequence
atggccagccccagcagcttcacctactactgcccccccagcagctccccagtgtggtctgaaccactgtattctctgaggcccgaacatgcccgtgaacgcttacaagacgactccgtcgaaactgtaacttccattgagcaggcgaaggtggaggaaaaaatccaggaagtcttctccagctacaaattcaatcacctggttcctcgcctcgtcctccaaagagaaaagcacttccactatctcaaaagaggtctcagacaactcactgatgcttatgagtgcctcgacgcatctcgaccatggctctgttactggattctgcacagtctggaacttctggacgaacctatccctcagatagtcgctacagacgtgtgccagtttctggagctgtgtcagtcccccgagggtggattcggtggagggcccggccaatacccacatttagcccccacgtatgctgctgtcaatgctttgtgcattatcggcactgaagaggcatatgacatcattaacagggagaagctcttgcagtacctgtactctttgaagcaaccagatggttctttcctaatgcatgtgggcggcgaagtagatgttagatcagcgtactgcgccgccagcgtcgcatccctgaccaatattattacccccgacctgtttgaagggacagcggaatggattgccaggtgccagaattgggaggggggtatagggggtgtgccagggatggaggcccacggaggctacaccttctgcggcctagcagctctagtcatcctgaaaagggagagaagccttaatctcaagagcctgctacagtgggttacctctcgacaaatgcgatttgaaggcggcttccaggggcgctgtaataaactggtggacggctgttattcgttctggcaggccggattgctgccactcctgcatcgcgctctgcacgctcagggcgacccagcccttagcatgtcccattggatgtttcatcagcaggcactccaggagtacattctcatgtgctgtcagtgccctgccggtgggttactggacaaaccaggaaagtctagggatttctaccacacctgttattgcctgtccggtctgtcaatagcccagcactttggttcaggcgcaatgttgcacgatgttgtgctcggggtaccagagaatgccttgcaaccgacacatcctgtctataatatcggaccggacaaggtgattcaggctactacctactttctgcagaaacctgtacctgggttcgaggaactgaaagacgagactagcgctgaaccggcaaccgactag

SEQ ID NO: 187467 - DNA, 1953 bp, Artificial Sequence
  Description of Artificial Sequence: Synthetic coding sequence
atggccagcaacatggaccgggagatgatcctggccgacttccaggcctgcacagggatcgaaaacatcgacgaggctattacactgctggagcagaacaattgggacctcgttgcagctatcaacggcgtgattccccaggagaacggcatcctccaaagcgaatacggaggcgaaactatccccggaccagctttcaacccagcgagccatcccgccagcgctcccacatcttctagctcatctgcattccgacctgtgatgcccagccgacagattgtcgagcgtcagcctcgcatgctcgatttcagggtggagtatagggatcgcaacgttgatgtggtgttggaggatacttgtaccgttggggagatcaaacagatactcgaaaacgaactccagattcctgtgagtaagatgttgctgaaaggatggaaaactggtgatgtggaggactcaaccgtgctgaaatctctccacctgccgaagaacaactctctttatgttttgacgccggatttacccccccccagctcctcctctcacgcgggagcgctccaggaaagcctgaatcaaaacttcatgctgattatcacgcaccgtgaggtccaacgagagtataaccttaacttctctggaagctctacaattcaagaggtaaaaagaaatgtttacgaccttacctctattcccgtgcgccatcaactatgggaggggtggccaacaagtgccactgatgactctatgtgcctggcggagagcggcctgagctacccatgtcatagactgacagtgggccgtcggtcttccccagcgcagaccagagaacagtctgaggaacagatcaccgacgtgcacatggtgtccgacagtgacggcgatgatttcgaagatgccacagaattcggggtggatgacggcgaggtcttcggtatggcgagcagcgctttaaggaaatctccaatgatgcctgaaaacgctgaaaatgagggggacgccctgctacagtttacagctgaattttcctctcggtatggagactgtcaccctgtattcttcatcgggtctctcgaggctgcttttcaagaagccttctatgtgaaagctcgggatcgaaaactcttggcaatttacttacaccatgatgagagcgtgttgactaatgtgttttgttcgcaaatgctgtgtgcggagtctatagtatcttacctcagccaaaatttcataacctgggcttgggatctgaccaaggatagcaaccgcgcacggtttttgaccatgtgtaatagacactttggcagtgtggtggcccagactattcgaacacagaagaccgatcaatttcctctgttcttaatcattatgggtaaacgtagttccaatgaagttttgaacgttattcaaggtaacacaactgttgacgagctcatgatgagattgatggcggcaatggagatcttcacagctcaacagcaggaggatataaaagacgaagacgagcgcgaggcccgcgagaacgtgaaacgcgagcaagacgaagcttaccgactatctttagaagccgatcgcgccaaacgtgaagcccatgagcgtgagatggcagagcagttcaggcttgagcagattaggaaggaacaggaggaggaaagggaagcgatccgcctgagtctggagcaggcacttcccccagagccaaaagaggaaaacgccgagcccgtcagcaaactccgcattcgtacaccttctggcgagtttttagagcgccgctttctcgcttcgaataaactccaaatcgtcttcgacttcgtcgcaagcaaggggttcccgtgggatgagtacaagctgctgtctactttcccacggagagacgtaacccagctcgatcccaataagtctttgctggaggtgaaactttttcctcaggagactctgtttctggaagccaaagagtag

SEQ ID NO: 187468 - DNA, 1473 bp, Artificial Sequence
  Description of Artificial Sequence: Synthetic coding sequence
atgatcctggccgacttccaggcctgcaccggcatcgagaacatcgacgaggctatcactttgctggagcagaataactgggatctggtggccgcaattaacggggtcatccctcaggagaatgggattctccaaagtgagtacggtggtgagactattcccggcccagcgtttaatccggcctcgcaccccgctagtgcacccaccagcagttcaagctcagccttccgacccgttatgccttctaggcaaatcgtggaacggcagcccaggatgctggacttccgcgtcgaataccgggatagaaacgttgacgtcgttcttgaggatacctgcacggtaggagagatcaaacagattctcgagaatgaattacaaataccagtatccaaaatgctactgaaaggctggaagacaggagatgtagaggactccacagtgctgaagtcgctgcacttacccaaaaacaactcattgtacgttctgactcccgacctccccccccctagttcctccagccacgctggggccctccaggaattcagtagtcggtacggagactgccatccagtctttttcattgggtcactcgaggccgcctttcaggaagctttctatgttaaggcgcgcgatcgtaagctactcgcgatctatctgcatcacgacgagtccgtcctgacgaatgtcttctgttctcagatgttatgcgcagaatccatcgtctcatatttgtcccagaactttatcacttgggcatgggacttgacaaaagatagtaaccgagctcggttccttacaatgtgcaacaggcattttggatccgtggttgctcagaccattcggacgcaaaagactgaccagttcccgctgtttctcatcataatgggaaagcgctcttccaatgaggtgcttaatgtaattcagggaaacactactgtagacgagcttatgatgagattgatggctgctatggaaattttcacagcccagcagcaggaggacatcaaggatgaggacgagcgggaagcccgagaaaacgtgaaacgtgagcaggacgaggcttatcgactctctcttgaggctgaccgggctaagcgtgaggcgcacgaaagagagatggctgagcagtttcgcctcgagcagatcaggaaagaacaagaagaggagagggaggcaatccggctttctctggaacaggcattgcccccagagcccaaagaggaaaatgcagaacccgtgagcaagctccgcattcgaacaccttccggagaattccttgaaagacggtttctcgcttccaacaaactgcaaattgtcttcgattttgtcgctagcaagggcttcccttgggacgagtacaagcttttgtcaacattccctcggcgcgacgttacccagcttgatccaaataaatccctactcgaagtcaagctgttcccccaggaaaccctgttcctggaagccaaagagtag

SEQ ID NO: 187469 - DNA, 1953 bp, Artificial Sequence
  Description of Artificial Sequence: Synthetic coding sequence
atggccagcaacatggaccgggagatgatcctggccgacttccaggcatgcacgggaattgagaacattgatgaggccataaccctgctggaacaaaataactgggacctagtggctgccattaacggcgtcattcctcaagaaaacggcattctgcagtccgagtacggcggcgaaacaatccccggcccagccttcaaccccgcgtcccaccccgccagcgcgcctactagcagttcttcatccgcttttcggcctgtgatgccaagtaggcaaatcgtcgagcgtcaaccacggatgcttgattttagggtcgaatatcgggataggaatgtcgatgtcgtactcgaagatacctgtactgtgggagaaattaaacagattctcgagaacgagctgcagattcccgtttcaaaaatgctgcttaaagggtggaaaactggcgatgtagaagatagcactgttctgaagtccctgcatctcccgaaaaataactccctctacgtgctgactcccgatcttcctcccccaagttctagctctcacgcgggagccctgcaagaaagcctcaatcagaatttcatgctgatcattacccaccgggaggtgcagagggagtataacctcaacttttccggttcgagtacgatccaggaggtcaaaaggaacgtgtatgatctgacgtccattcccgtgcgacaccagctctgggaagggtggccaacgagtgctacagacgattcaatgtgcctggccgagtcagggttgtcttatccatgtcaccgtctgacagttggccgcaggagttccccagcgcagacacgggaacaatctgaagaacagattactgacgttcacatggtcagtgacagcgacggagacgattttgaggacgccaccgagtttggcgttgacgacggtgaggtttttggtatggcctccagtgctctccgaaagtcaccaatgatgcctgaaaacgcggagaatgaaggggatgccctgttgcagttcactgccgagttcagtagtcggtacggcgattgccatccagtctttttcattggatccctggaggctgcattccaagaggcgttctacgtcaaagcccgggaccggaagctgctcgccatctacctgcaccacgatgaatccgtgctgaccaacgtgttttgtagccaaatgctgtgcgccgaatctattgtttcttacctctcccaaaatttcatcacatgggcatgggatctgactaaagactccaatagggctcggttcttgactatgtgtaatcgtcactttggctcagtcgtggctcagacgatacgaacccaaaagactgatcagttccctctgttcttgattattatgggcaagcggagctccaatgaggtcctcaacgtaattcaggggaatacaacggttgatgagttgatgatgagactcatggccgctatggagatctttaccgcacagcaacaggaggatattaaggacgaggacgagcgagaggccagggagaacgtcaagcgcgagcaggatgaggcctacaggctcagtctggaagccgacagagccaagcgggaggctcacgaacgggagatggccgagcagtttagactggaacagatccgaaaggagcaagaggaggagcgggaggcgatcagactaagtcttgaacaggctcttccccccgagcctaaggaagaaaacgccgaaccggtgtccaaattacggatcagaacaccatccggtgagttcctcgagaggagattcctggcctccaataagcttcagatcgtcttcgatttcgtggcaagcaagggttttccttgggacgaatataagttgctgtccacgttcccccgccgagacgttacacagcttgatcctaacaagtcactgttggaggtgaaactgtttccccaggagacattattcctggaagccaaagagtag

SEQ ID NO: 187470 - DNA, 1497 bp, Artificial Sequence
  Description of Artificial Sequence: Synthetic coding sequence
atggccagcaacatggaccgggagatgatcctggccgacttccaggcctgcacaggcatagaaaacattgatgaggctataactctgctggagcagaacaattgggatctcgttgctgccattaatggggtcatcccccaggagaatgggatcctccagagtgagtacggcggcgaaactatccccggacccgccttcaaccctgcttcgcacccagcttcggctcccacctccagctcttcttctgcttttaggcccgtaatgccttcaagacagattgtcgaacggcaaccaagaatgttggacttcagagtggagtatagggaccggaatgtcgatgtggtgcttgaagacacatgcaccgtgggagagatcaaacagatactggaaaacgaacttcagattcccgtgtcaaaaatgctcctaaaaggatggaaaacaggagatgtggaggactccaccgtgctaaagagccttcacttgcccaagaacaatagcctgtatgtgctaacaccagatcttccaccgccttcttctagcagccatgcaggcactctgcaacaattttcttaccgctacggggattgtcatcccgtgtttttcatcggctccctagaggccgccttccaagaggctttctacgtcaaagcccgggatcgcaaactactagccatctatctgcaccacgatgaatctgtcctgaccaacgtgttctgttcccagatgctgtgtgccgaatctattgtaagctatctgagccagaacttcatcacctgggcctgggacctgaccaaggatagtaacagagcgcgctttttgacgatgtgtaatcgacatttcggctcggtggtagctcagaccatcaggacccagaaaactgatcagttccctctattcttaattataatgggcaagcggagttccaacgaagtgttgaacgttattcagggcaatacgaccgtcgacgaattgatgatgcgtctgatggcagctatggaaatattcaccgcccagcaacaagaggacataaaggacgaagatgagagggaggctcgagagaacgtgaagagggaacaggacgaggcttaccgtctgagcttggaggcggaccgagcaaagcgtgaagctcatgaacgagagatggctgaacagttcaggctcgaacaaattcggaaggagcaggaggaggagagagaagctattcgcctctcactggaacaggctttaccgcccgaacccaaggaggaaaacgctgagcccgtgagtaaattgagaatacgcaccccaagtggggaattcctggaacgcagatttctggccagtaacaagttgcagattgtgttcgactttgtggcaagcaagggcttcccttgggatgagtacaaactgctgagcacatttccacgtcgtgacgttacccagctggaccctaacaagtcgctgctggaagtgaagctgttccctcaggagaccctgtttctggaggccaaagaatag

SEQ ID NO: 187471 - DNA, 1227 bp, Artificial Sequence
  Description of Artificial Sequence: Synthetic coding sequence
atgcggaacctgctggagatgtgcctggccgagagcggcctgagctatccttgccatcgccttacagtcggcaggcggagcagccccgctcaaactcgagagcaatccgaagaacagatcacagacgtccatatggtttcagactcggacggggatgatttcgaggatgccaccgagttcggggtagatgatggagaagtgtttggaatggcatcgagcgcactacgtaaaagccctatgatgcctgagaatgccgagaatgaaggcgatgccctgcttcagttcacagctgagtttagctcaagatatggcgattgccaccccgtgttctttattgggagcctggaagctgcatttcaggaagccttttacgtaaaggccagagatcgaaagctgctggccatttacctgcaccatgacgagagcgtcctgaccaacgtattttgctcacaaatgctgtgcgcagaatccatcgtaagttacctgagccagaactttatcacttgggcatgggacctgactaaggattccaatagggccaggtttctaacaatgtgtaacagacactttggcagtgtcgtagctcagaccatccgcactcagaaaaccgaccaattccctttgttcctaatcataatggggaaaagatcctcgaacgaggtcttaaatgtcatccagggcaatactaccgtggacgaactgatgatgagattaatggcagcaatggaaatttttactgcccagcagcaagaagatatcaaggacgaagatgagcgcgaagcgcgcgaaaacgtcaagagggagcaggacgaggcatatagactgagcctggaggccgatagggccaaacgtgaggcccatgaaagggagatggccgaacagtttcggctggagcaaatccgcaaggagcaagaagaggagagagaagctatcaggctgtcactggagcaggctctccctccggagccaaaagaagaaaacgccgagcctgtgtcgaaactgcggattcgcacccctagtggagaattcctggaacggaggtttctcgccagcaataaactccagatagtctttgactttgtggctagcaagggctttccctgggatgaatacaagctgctgagcacatttcctcgccgggatgtgacgcaactcgacccaaacaagtcccttcttgaggtgaagctcttcccccaggagactctatttctggaagctaaagaatag

SEQ ID NO: 187472 - DNA, 951 bp, Artificial Sequence
  Description of Artificial Sequence: Synthetic coding sequence
atgacccagggcaagctgagcgtggccaacaaggcccccggcaccgaagggcagcagcaggtccacggagagaagaaggaggcgccagcagtgccttccgctcctccatcttatgaggaggcaacatcaggggaggggatgaaggctggcgccttccctcccgcccccactgcggtgccgctgcaccccagctgggcgtatgtggacccatctagctcaagttcttacgacaatgggtttccaacaggcgaccatgagctcttcactaccttcagttgggacgatcagaaggtgcgacgagtattcgtgaggaaggtttacactatcctgctgattcaactcttggtgacccttgcggttgtggccctttttacattttgtgatcctgtgaaggactatgttcaggctaatcccgggtggtattgggcaagttatgccgttttctttgccacatacctgacactcgcatgttgtagcggaccgcgccgacacttcccatggaatctaattctgcttacagtgttcactttgtcaatggcctacctcaccggcatgttatcatcatattacaacaccactagtgtcttattatgtctgggaatcaccgcactcgtctgcttgtccgtaactgtgttcagctttcagactaagttcgactttactagctgtcagggcgtgctctttgttcttctgatgacactttttttcagtggactaatactggccatcctgctccccttccagtacgtgccctggctgcatgctgtctacgcagcgctgggggcaggggtctttacccttttcctcgcgcttgatactcagttgcttatggggaatcgccgacatagtctgagtcctgaggaatacatcttcggtgccctgaatatctacctcgatattatatatatttttacgttttttctgcaattgtttggaactaacagggaatag

SEQ ID NO: 187473 - DNA, 951 bp, Artificial Sequence
  Description of Artificial Sequence: Synthetic coding sequence
atgacccagggcaagctgagcgtggccaacaaggcccccggcaccgagggacagcaacaggttcatggagaaaaaaaggaagcccctgccgtgccctctgcccccccgagctatgaggaggccacttccggcgaaggaatgaaagctggcgcttttccacctgcacccaccgctgtacccctccacccctcgtgggcctatgtggacccatcttcctctagctcttatgacaatggctttcctaccggcgatcacgagctgtttacaacattttcctgggatgatcaaaaagtgaggcgagtgtttgtgcgcaaggtctatactattctcctgatccagttgctcgtcaccctggccgtggtcgctctgtttaccttctgcgaccccgttaaggactatgtccaagccaaccccgggtggtattgggcgagctatgctgtgttttttgccacctacctgacactcgcttgctgctccgggccgcggcgacacttcccgtggaacctgatccttctcacagtcttcacactcagtatggcgtacctgaccggtatgctcagcagttattataacactacatcagttttgctttgtctcggcattaccgctttggtctgcctcagcgttaccgtgtttagcttccaaacaaaatttgacttcacctcctgtcaaggcgtgctgttcgttctgcttatgacccttttcttctctgggttaattcttgctattctgcttcctttccagtatgtgccctggttgcatgctgtctatgcagcattgggggccggcgtgtttacccttttcctcgctctggacacccagcttctgatgggaaaccggagacattcactgagccccgaggaatatatctttggcgctttaaatatatacttggatattatttatattttcactttcttcctccaactcttcggcaccaaccgcgaatag

SEQ ID NO: 187474 - DNA, 813 bp, Artificial Sequence
  Description of Artificial Sequence: Synthetic coding sequence
atgaaggccggcgccttcccccccgcccccaccgccgtgcccctgcatccatcctgggcctacgtagacccttcttcctcaagttcatacgacaatggcttccccaccggggaccacgaactctttacaacatttagctgggatgaccagaaggttcgccgcgtgttcgtgcgaaaagtgtacacaatccttcttattcagcttctggtcactcttgccgtcgtggccctgtttacattctgcgaccctgttaaagactatgtacaggcaaatcccggatggtattgggcgtcctatgccgtgttcttcgcaacatatcttactttagcatgctgttccggtcccagacggcactttccttggaatctcattctgctcaccgttttcaccctatccatggcatacctaaccggtatgttgagctcttattacaacacaacctccgtgctgctgtgtctggggatcacggctctcgtttgcctgtcggtgaccgtattctcttttcagaccaaatttgattttacttcatgccaaggcgtgcttttcgtgttgctgatgactctgtttttctccggcttaatcctggctatcctcttgccgtttcaatatgtgccttggctccatgccgtctacgccgcactaggggcaggcgttttcacactgttcctcgccctcgatacacagctgctcatgggcaatcgaaggcattctctgtcacccgaggaatatatcttcggcgccttgaatatttacctggacattatttacatttttacattcttcttgcagcttttcgggaccaaccgcgaatag

SEQ ID NO: 187475 - DNA, 1173 bp, Artificial Sequence
  Description of Artificial Sequence: Synthetic coding sequence
atggacttctggctgtggcccctgtacttcctgcccgtgagcggcgctttaagaattctgcctgaggtaaaggtggagggggagctgggaggtagcgtcacgataaagtgcccactcccagagatgcatgtccgtatctatctgtgcagagagatggctggatcagggacctgcggtaccgtggtgagcaccacaaacttcataaaagctgagtacaaaggtcgcgtgaccttgaagcagtaccctaggaaaaatctcttcctcgtggaagtgactcagctgacggaaagcgacagcggcgtatatgcctgtggcgccggtatgaacacagatagggggaagacacagaaagtcaccctcaacgtgcattcagaatatgaacccagctgggaggagcagcccatgccagagacgcctaagtggttccacctaccctacctctttcagatgccagcgtatgcctcttcttcaaagtttgtgacacgtgtgactacgcctgcacagagggggaaagtgcctcctgtgcaccactcttctcctacgacccagatcacgcaccggccaagagtgagcagagcttcctccgtggctggagacaaacctagaacctttttacctagtaccactgcctcaaaaatttccgctctcgagggcctgctaaagcctcagacacccagctataatcaccatacacgcctacacagacaacgggccctggattacgggtctcaatccggccgcgagggccagggtttccacatactgattccgaccatactaggtcttttcctcctcgccctgctggggttggtggtaaaacgagccgttgagcggcggaaagccctctccagaagagctcggcgactcgcagttagaatgcgggccctcgaaagttcccagaggccaagggggagcccacggccgaggtcccagaataacatttattctgcctgtccccgaagggcgagaggagccgatgccgccggcaccggggaggcaccggtacctggccccggcgctccccttccgcctgcccccctgcaggtgagcgagtcaccttggcttcacgccccctccctcaaaacctcgtgtgaatacgtgtctctgtaccaccagcctgccgccatgatggaagacagtgacagtgatgactacattaatgtgcccgcatag

SEQ ID NO: 187476 - DNA, 921 bp, Artificial Sequence
  Description of Artificial Sequence: Synthetic coding sequence
atggacttctggctgtggcccctgtacttcctgcccgtgagcggcgcgctgagaattctgcctgaggtgaaggtcgagggtgagcttggaggtagcgttactatcaagtgtcctctgccagaaatgcatgtgcgcatctatttgtgtagggaaatggccggcagcggtacttgtgggacagtcgtgagcaccacaaactttattaaagcggagtacaagggccgggtaaccctgaaacagtaccctagaaagaacctcttcctggttgaggtcacccaactgacagaatccgactccggagtctatgcctgcggcgccggcatgaatactgatcgcggaaagacccagaaggttaccttaaacgtgcactccgaatatgagcccagctgggaagagcagcccatgccggagacaccaaaatggttccacctgccctacctgtttcagatgccagcctacgcgtcttccagcaagttcgtaactagagttacaacccccgcccagaggggcaaggtgccgccagtgcatcactccagcccaaccacccagataacgcatcgcccacgggtgagcagagcgtcaagcgttgctggagacaagcctagaacctttctgccaagcactaccgcctccaagattagcgccctggaaggtctgcttaagcctcagacaccctcctataaccatcacaccaggttgcatcggcagagtcctctccaggctggacctcccactggccgcgaggacgcacgccccggcgaacttcccgaggccccccgcgtggcagctaccgcccttcccaaacagcatttacagcggctaccggccgctcggagctggtcaggaaggtgccgccaccgggggggccccagaagtcgaccaaggagcgccgttgcaccacgcccggccgcaggcgtgtag

SEQ ID NO: 187477 - DNA, 837 bp, Artificial Sequence
  Description of Artificial Sequence: Synthetic coding sequence
atggacttctggctgtggcccctgtacttcctgcccgagtacgagccatcatgggaggagcagcctatgcccgagactcctaaatggttccatcttccctatttatttcagatgcccgcctacgcgtccagctccaagtttgttacccgcgtgaccactccagctcagaggggcaaggtccctcccgtgcaccatagttccccgaccacacagataacccataggccgcgggtgagcagggcaagctcagtggcgggcgataagccccggaccttcctccccagtactacggcttccaagatctcagcccttgaagggctcctcaagcctcaaactccttcatataaccatcatactaggctgcaccgtcagcgcgccttagactatggaagtcagtcaggtagagagggacagggctttcacatccttattcctaccatccttggactgttcttactggcccttctggggttggtggttaaacgggcagtagaacgcaggaaggctttaagtagacgggctagaaggttggcagtgaggatgagggcacttgagtcctcccagcggccaagaggtagtccaagaccgagatcacaaaataatatttattcagcatgcccacggagggctcgcggagcagacgcagccggaaccggcgaggcacccgtgcccggccctggcgctcctctaccacctgctccacttcaagtgtctgagtctccttggctacatgctcccagcctcaaaactagctgtgagtatgtcagtctgtaccatcagcctgccgccatgatggaagattcagattcagacgattacatcaacgttcctgcctag

SEQ ID NO: 187478 - DNA, 456 bp, Artificial Sequence
  Description of Artificial Sequence: Synthetic coding sequence
atggacttctggctgtggcccctgtacttcctgcccgtgagcggcgctttgaggattttgccagaggtaaaggtggaaggggagttaggcggctctgtcactatcaagtgccctctgccggagatgcacgttaggatttatctttgtagagaaatggcgggctctgggacctgcggtactgtggtgagcacgaccaattttatcaaagccgagtataaaggtcgggttaccctgaagcaatatcctagaaaaaatctctttctggtggaagtcactcagctgactgagtcggattccggcgtatatgcttgcggagctggaatgaacactgacagagggaaaactcagaaggtgacgctaaatgtgcattctgagtacgaacccagctgggaagaacagccaatgcctgaaacccctaagtggttccatcttccatacctgtttcagatgccttag

SEQ ID NO: 187479 - DNA, 444 bp, Artificial Sequence
  Description of Artificial Sequence: Synthetic coding sequence
atggacttctggctgtggcccctgtacttcctgcccgtgagcggcgcactgcgcatactgcctgaggtgaaagtcgaaggtgagctgggggggagcgtgacaatcaaatgtccccttcctgaaatgcatgttaggatatatctgtgtcgggagatggccggtagcggcacttgcggaaccgtcgtaagtacaaccaactttattaaagccgagtacaaaggaagagtgacccttaagcagtatccaagaaaaaatctgttcctagtggaagtgactcagcttacagagagtgattctggagtttatgcttgcggcgctgggatgaataccgacaggggcaagacccagaaggtcacactaaatgtgcactccgaatatgagcccagttgggaagagcagcctatgcctgagaccccaaaatggtttcatctgccgtatctttag

SEQ ID NO: 187480 - DNA, 426 bp, Artificial Sequence
  Description of Artificial Sequence: Synthetic coding sequence
atggacttctggctgtggcccctgtacttcctgcccgagatggagagctgttgtgtcgcgcaggacgggctcgaactggtggcactgagcgaccccccagggtcggcttctcagagcgccggaatcacagtgtctggtgccctgaggatcttgccagaagtaaaagtggaaggggaattaggaggatccgtgactattaaatgtcccctgcctgagatgcacgtgcggatatacctctgccgtgagatggcgggcagcgggacctgcggtaccgtcgtgagcaccaccaacttcatcaaagccgagtataaggggcgcgtgacgctgaagcagtatccacggaagaaccttttcctagtggaagtgacgcagctcactgagagcgacagcggagtatacgcatgtggcgcaggaatgaatacttag

SEQ ID NO: 187481 - DNA, 1398 bp, Artificial Sequence
  Description of Artificial Sequence: Synthetic coding sequence
atgcggcggccccggggcgagcccggcccccgggccccccggcccactgagggtgccacgtgtgctggtccgggtgagtcttggtctccatccccgaattctatgttacgcgtgcttttaagcgcccagacttcgccagcacggctgtccggactgctgttgattcctccagtacagccatgctgcctgggcccctcaaagtggggcgatcggccggtagggggcggtccttccgcaggccctgtgcaaggcctccaaagattgctagagcaggcgaagtcccctggagagttactgaggtggctgggccagaacccatctaaggtccgagctcatcactatagcgtggccttgcggagattggggcagctactggggagtcggccaaggccaccccctgtagagcaggtcacactgcaggatctgtcgcagctgattatcagaaactgcccaagtttcgatattcatacaattcatgtgtgtttgcacttggcagttctgctcggattcccaagcgatggccctctggtgtgcgcattggagcaggaaagaagactcagacttccccctaaacccccacctcctctccagcctcttcttcgcggtggacaaggactggaggcagctttaagctgtccacggttcctgcgctaccctaggcagcaccttataagttcgctcgctgaggctcggcccgaggagctcacacctcatgtcatggtgctgcttgctcagcacttggctcgacaccgactccgggaacctcagttgctcgaagctatagctcatttcttagtagtacaggaaacccaactctcatctaaggtcgtacagaagctagttcttccatttggacggttaaactacctcccgctggaacagcagtttatgccctgcctggagaggatcctcgcccgagaagcaggagtggcacctttggcaaccgtgaatatactgatgtctctttgtcagctccgttgtcttccgttccgggctcttcactttgtctttagcccgggctttataaactacatcagcggtactccccacgccctcattgtacggagatatttatccctcttagacacagccgtggagctggagctccctgggtaccggggcccaaggctccctcggagacagcaggttccgatattcccacagccactgatcaccgatcgtgccagatgcaagtactcgcacaaggatatcgtagcagagggcctgcgacaacttctgggtgaagagaagtataggcaggatctcactgtaccaccaggttattgtactgatttcctgctttgcgcgagttctagtggcgctgtgttgccggtgcgcactcaggatccttttctgccctaccctcccagggcctgcccttccagccgggctacgtag

SEQ ID NO: 187482 - DNA, 1650 bp, Artificial Sequence
  Description of Artificial Sequence: Synthetic coding sequence
atgcggcggccccggggcgagcccggcccccgggccccccggcccaccgaaggcgctacatgcgctggtccaggggagtcatggtctccatctccaaacagcatgcttagagtgctgctatccgcacagacaagccctgcccgtctgtccggactgctacttattccccccgtgcagccctgttgtctgggaccgagcaagtggggcgatagaccagtggggggagggccctcagcaggtcctgtgcagggtctccagagactactggaacaggccaaaagcccgggggagctactccgctggctgggtcagaacccatctaaggtaagggcacaccactactccgtggcgctacgccgactcggacaactgctaggcagcaggcctcgcccaccccccgtagaacaggtaaccctgcaggacctcagtcagctgattatccggaactgtccatcctttgatatccacacaattcatgtttgtctgcacctcgctgtgctgctgggtttcccatccgacggacctctcgtttgtgcactggagcaggaaaggcgcttgagactccccccaaagcctccaccccccttacagccacttcttcgggggggtcagggactcgaggccgccctcagttgccctcggtttctgcgctatcctcgccagcacctgatttcctccttggccgaggctcggccggaagaactgacaccacacgttatggtgctcttagcccagcaccttgcccggcatagactgcgagagcctcagctgctcgaggccattgcgcatttcctggtggttcaggagactcagctgtccagcaaggtggtgcaaaagctggtgctgccttttggaagactgaactacctgcctcttgagcagcaattcatgccatgtctggagcgcatcttagccagagaggccggcgtcgcacccctcgccaccgtgaatatactaatgtccctttgccaattgcggtgcctgccctttcgggctcttcactttgtgtttagccccggcttcatcaattacattagcggaactccccatgctcttatcgtacgccggtatttaagcctcctggatacggctgtggagctggagcttcctggataccgaggtccccgtctcccacggagacagcaagtcccgatcttccctcagcccttgatcacggaccgcgcacgctgtaagtacagccataaggatattgtggctgaaggtctgaggcaactcctgggcgaagagaagtatcgacaggatctgacagtccctccaggatactgtactgattttctactgtgcgcttcctctagcggcgctgtgctgccagtcaggacgcaggaccctttcttaccctacccaccccgaagttgtccacaagggcaggccgcgagtagcgcaaccactcgggatcccgctcagagagttgttctggtcttgcgggagcgctggcacttctgccgcgatggacgtgtcttgctcggctcgagggcactgagggagagacaccttggactgatgggttaccagctcttacctttgccgttcgaagaacttgaatcccagagagggcttccccaacttaaaagctaccttcggcagaagctgcaggcactgggccttcggtggggacccgaagggggttag

SEQ ID NO: 187483 - DNA, 1227 bp, Artificial Sequence
  Description of Artificial Sequence: Synthetic coding sequence
atgcggcggccccggggcgagcccggcccccgggccccccggcccaccgaaggtgccacgtgcgccggcccaggagagtcctgctttccaagtgatggcccattggtttgtgctctagagcaggagcgtcgcctgcgacttcctcccaagcccccgccaccactacagcctctgctacggggtggacaggggctggaggccgcactgagttgccctaggtttttacgctatccccggcagcatcttatcagctcccttgcggaagctaggcctgaagagctaacgccgcacgtcatggtgcttttggcacagcacctcgcgagacataggctccgcgaaccgcaactcctagaagccatcgctcatttcctcgtggtgcaggagacacagctctcatcaaaggtcgtgcagaaattggtactacccttcggcagacttaattatcttcctcttgagcagcaatttatgccttgtctagaacgtatcctagcgcgcgaagcgggcgtcgccccgctggcgacagtgaacattttaatgtcgctgtgccagttaaggtgtctgcccttccgagcattacattttgttttttcaccaggttttattaactatatctccgggaccccccacgcgctgatagtgagacgatatctctctctcctcgacaccgcagtggagctggaactcccaggatacaggggacctcggctgccaaggagacaacaggtgcccatcttcccacagcctctgatcacggaccgggctagatgcaaatattcacataaggacattgtggccgagggcctgcgacaacttttgggcgaagaaaaatacagacaggacttgacagttccccctggttactgtactgacttcttgctttgcgcttccagttccggcgccgtgcttcctgtgcgtacacaggacccttttctgccgtacccacccaggtcctgccctcaaggccaggccgcgtctagcgcgaccaccagagaccctgcccagagggtcgtgctggtgctcagagaacgatggcatttctgccgcgacggaagggtactgctgggatctagggcgttgagagagcgacacttgggcttaatgggctatcagctgcttcccctgccctttgaggagttggagtcccagcgcggcctccctcagttaaagagctatctccgacaaaaactgcaggccctcggcctgcggtgggggccggagggagggtag

SEQ ID NO: 187484 - DNA, 480 bp, Artificial Sequence
  Description of Artificial Sequence: Synthetic coding sequence
atgctgcgggtgctgctgagcgcccagaccagccccgcccggctgtctggcctgctgctaatcccacctgtacagccttgctgcctcgggccgtccaaatggggtgacagaccagtcgggggggggcctagcgcaggccccgtgcaaggccttcagcgcctgctggagcaggctaaatctcctggcgaattgttgcgctggctcggacagaacccaagtaaggtgagagcccaccactattctgtagctctgcggaggctagggcaacttctgggctcgcgaccccggccccctcctgtggaacaagtaactctccaggatctgtcccaattaattatccgcaactgtccgtccttcgatatccacacaatacacgtatgtctccacctggccgtcttactcggaggcacggaagtcggccccgctctgtgggccactgaacttcccgctcctggaacagccgtttatgctctcccctag

SEQ ID NO: 187485 - DNA, 1569 bp, Artificial Sequence
  Description of Artificial Sequence: Synthetic coding sequence
atgcggcggccccggggcgagcccggcccccgggccccccggcccacagagggagctacttgcgctggacctggcgagtcgtggtcaccctccccaaacagcatgttaagagttctgctgtccgcccagacaagtccggctcgtctatctggactcctgctgatcccacccgtacaaccatgctgcctcggcccttccaaatggggggataggccagtgggtggcggacctagcgctggacccgtgcagggacttcagcggctccttgagcaggccaaatctcccggggaactcttgcggtggctggggcagaacccatccaaggtaagagcccatcactactcagttgcgctgcgccggctggggcagcttctcggcagccgacctaggcccccaccagtggagcaagtcactctgcaggacctgtcacagctgattatcagaaattgtccaagtttcgacatccataccattcatgtctgtcttcatctcgccgttctgctgggctttccttcggacggccccttggtatgcgcgctcgagcaagaacgcaggttacgactcccaccaaagcccccacccccactccagcccctgctgcgggaagcccgcccggaggagctcaccccccacgtcatggtgcttctggctcagcatctcgctcggcatagactgagagaaccccagctgctggaagctattgcccactttctggtggtgcaggagacccaactcagctcaaaggtcgtgcagaaactggtgctaccgttcggccgtctcaactatctcccattggaacagcagtttatgccctgcttggagcggatcttggctcgcgaggctggcgtcgctccccttgcgaccgttaacatattaatgagtctctgccagctgaggtgtctaccgttcagagcactgcactttgtgttctcacctggcttcatcaattacatcagcggcacaccgcacgccctcattgtgagaagatacctctctctactggatactgcggtggaacttgaattgccaggatatcgggggccccggcttcccaggaggcagcaagttcccatcttccctcaaccactgattaccgacagggcccggtgcaagtacagccacaaagacatcgtcgctgaggggctgcgccagctgctaggagaagagaagtaccggcaggatttgaccgtacccccagggtattgcacagacttccttctgtgcgcatcgtcctcaggcgctgtgctccctgtgagaacacaggaccctttcctgccctaccctcctcggagttgtccacagggacaggccgcgtcctctgctactactcgggatccagctcaacgcgtggtgctcgtcctgagagagcgctggcatttctgccgtgacgggagagtgttgttgggctctcgcgcattgcgggagcgccatctgggcctgatgggttaccaactgctgccgctgccgttcgaggagctggagtcgcagagaggtttaccccaactcaaatcatacctgcgccagaaattacaggcgttgggtctccggtggggtccagaaggagggtag

SEQ ID NO: 187486 - DNA, 1179 bp, Artificial Sequence
  Description of Artificial Sequence: Synthetic coding sequence
atggaggcccccctggtgagcctggacgaggagttcgaggacctgcggccaagctgctccgaagatcctgaggaaaaaccacagtgtttttatggcagcagcccccaccaccttgaggatccttctcttagcgagctcgagaattttagctccgaaatcatttctttcaagtctatggaggacctagtcaacgaattcgacgagaaattgaacgtatgcttccgcaactacaacgctaagacggagaacctagcacccgttaaaaaccagctgcagatacaggaggaggaggagactttgcaggacgaggaagtgtgggacgcgttgacagataattacattccgtccctcagcgaagattggcgagacccgaatattgaagccctgaatggaaattgtagcgatactgagattcatgaaaaggaggaagaggaattcaacgaaaaaagtgaaaatgactctggcatcaatgaggagccgcttcttaccgccgatcaggtcattgaggagattgaggaaatgatgcagaattcacctgacccagaagaggaggaggaggtgctggaggaggaggacggcggcgagaccagctcccaggctgactccgtcctcctgcaggagatgcaggccctaacacagacatttaataacaactggagttatgaggggctgcgacacatgtcaggatctgagttgaccgaattgctcgaccaagtggagggggccatcagggacttttctgaagaactggttcagcagctcgccagacgcgacgaattggaattcgaaaaggaggtgaaaaacagtttcattacagttttgattgaggtgcaaaacaagcaaaaagagcagcgggaactgatgaaaaagcgtaggaaagaaaagggactgagcttacagtccagccggatcgaaaagggcaatcagatgcctctgaagcggttttccatggaggggataagtaacatcctccagagtggtattcggcaaaccttcggctcttctggcaccgataagcaatacctgaacactgtaatcccctatgaaaaaaaggcatcgcccccatcagtggaggatttacagatgctgaccaacatcctcttcgctatgaaagaggataacgagaaggtaccaaccttgctaacggactacattcttaaagtgctttgcccaacctag

SEQ ID NO: 187487 - DNA, 315 bp, Artificial Sequence
  Description of Artificial Sequence: Synthetic coding sequence
atggaggcccccctggtgagcctggacgaggagttcgaggacctgaggccatcctgctccgaagatccagaggaaaagccacagtgcttttacggctctagtccccatcatctggaggatccgtcgctgagtgaactagaaaatttctcaagcgaaattatcagtttcaagtctatggaggacctggtgaacgagtttgacgagaagctcaatgtatgttttcgcaactacaatgcaaagactgagaacctggcacctgttaagaaccagttgcagatccaggaggaggaggaaacgctccaggacgaggagtag

SEQ ID NO: 187488 - DNA, 315 bp, Artificial Sequence
  Description of Artificial Sequence: Synthetic coding sequence
atggaggcccccctggtgagcctggacgaggagttcgaggacctgcgcccctcttgctctgaagatccagaggagaagccgcaatgcttctacggatcctctccccaccacctcgaggacccaagcctgagtgaactggaaaactttagttctgaaattatttctttcaaaagtatggaggatctggtcaacgagttcgatgaaaagctcaacgtatgcttcaggaactacaacgctaaaacagagaacctagctcccgtaaagaatcagctgcagattcaagaggaagaggagaccctgcaggacgaggaatag

SEQ ID NO: 187489 - DNA, 1419 bp, Artificial Sequence
  Description of Artificial Sequence: Synthetic coding sequence
atgaccgccaacggcaccgccgaggccgtgcagatccagttcggccttataaattgtgggaacaaatacctgacagccgaagcattcggtttcaaagtgaacgcctccgcctcctctttgaaaaagaatcatctgggcaggtacctggccgccgacaaagacggcaacgtcacttgcgagcgcgaggttccgggccctgactgccgatttctcatcgtagctcatgacgatggcagatggtctcttcagagcgaagctcaccgaaggtacttcggagggacagaggatcgccttagttgtttcgcacagacagtgtctccagccgaaaaatggtccgtgcacatagcgatgcatccgcaggtgaatatctacagcgtcactcggaaaaggtatgcacacctttcagcccggcctgctgacgagatcgctgtggaccgggacgtgccctggggggttgacagtttgattacccttgccttccaggatcaacgctattccgtgcagacggcagatcatcgcttcctgcggcatgacgggcggctcgttgcccgccctgagcctgccactggctacactctcgaattcaggagcgggaaagtggcctttcgggactgcgagggccggtatttagctccaagcgggcctagcggaactctgaaagctggaaaagcaacaaaagtcggaaaagacgagctattcgcgctcgagcagagctgtgctcaagtggtcctccaggccgccaacgagcgcaacgtctcaaccaggcaggggatggacctctctgccaaccaggacgaagaaaccgatcaggagacattccaacttgagatcgacagagatacaaaaaagtgcgcgttcaggactcataccggcaagtattggactctcaccgcaacaggcggggtgcagtcaacggctagcagcaaaaatgcatcatgctacttcgatattgagtggcgcgacagacggattacccttagagcttccaacggtaagttcgtcacctcaaagaagaacggacagcttgccgcttctgttgagaccgctggcgactcagagctgttcttaatgaagcttattaaccgtcccatcattgtctttcgcggcgaacatggatttatagggtgtcggaaggttaccggcacactggacgccaaccgttcctcctacgatgtttttcagctggaattcaacgacggagcctacaatatcaaggacagcaccggcaaatactggactgttggatcagattctgctgtcacaagctccggcgatacccccgtggatttcttttttgaattctgcgactataacaaggtcgccattaaggtcggtggcagatatcttaagggggatcatgctggagttctcaaagcctccgccgaaacagttgaccctgcgagcctgtgggagtattag

SEQ ID NO: 187490 - DNA, 1482 bp, Artificial Sequence
  Description of Artificial Sequence: Synthetic coding sequence
atgaccgccaacggcaccgccgaggccgtgcagatccagttcggcctgataaattgcgggaacaaatatttgactgcagaggcgttcggattcaaggttaacgcttccgcctcgtcgctgaaaaagaaacagatctggactctcgagcagccgccagacgaagccggttccgccgcagtttgtctgcggtctcacctgggtagatacctggccgccgataaggatggaaatgtgacgtgcgaaagagaggtgccaggaccggactgccgtttcctaatagtggctcacgatgacgggcgatggtctctccagagcgaggcccataggcggtactttggagggaccgaggaccggctgtcttgctttgcacagacagtttctcccgctgaaaagtggtcagtgcatatcgccatgcacccccaggtgaacatctactccgtgacacgaaagaggtacgcacatctaagcgctagacccgctgatgagatagccgtcgaccgagatgtcccgtggggagtggactctctgattactctcgcatttcaggatcagcgctactccgtgcagactgccgatcatcggtttctgcgacacgacggccggcttgtggcaagaccagagccagcaactggctatacgctcgaattccgctccggaaaggtggcgttcagggactgtgaaggcagatatttggcccctagcggtccctcgggtacactcaaggcaggaaaggcaacaaaggtcggtaaggatgaactattcgccctggaacagtcctgtgctcaggttgtgctccaggcggctaatgagcgcaatgtctccacgcgacaaggcatggatttaagcgccaatcaggacgaagagaccgaccaggaaaccttccagcttgaaatagaccgtgacactaaaaagtgtgcctttaggacccacactggcaagtactggacactgaccgctacaggtggagttcagagcaccgcaagctctaagaacgcatcttgctacttcgacatcgaatggagagaccggcggatcactctgagggccagcaatggtaaatttgttacatctaagaagaacggacagctcgccgcgagcgtggagacggccggcgactcggagctctttcttatgaaactgataaaccggcctatcatcgtctttaggggagaacacgggttcatcggatgtcggaaagtgaccggaaccctggatgctaaccgttcgtcttacgacgtgtttcagctggaatttaacgacggcgcctataacatcaaagactctaccggcaaatactggaccgtagggtcagactccgcagtcactagctctggtgatacgccagtggatttcttctttgagttctgcgattacaacaaggtggcaattaaggtgggcgggcgatatctgaaaggtgatcacgccggcgtgctgaaggcctccgccgaaaccgtggacccagcctccttgtgggagtactag

SEQ ID NO: 187491 - DNA, 648 bp, Artificial Sequence
  Description of Artificial Sequence: Synthetic coding sequence
atggacctgagcgccaaccaggacgaggagaccgaccaggagaccttccagctggagatcgatcgggacaccaagaagtgtgccttccggacacacaccggcaaatactggaccctcacagccacagggggcgtccagagtaccgccagtagcaaaaacgcatcctgctattttgatattgagtggcgggatcggcggatcacattgcgggcctcaaatgggaaattcgtgaccagtaagaaaaacggacaactggcagccagtgtcgagactgccggggattcggaattgtttttaatgaaactcatcaatagaccgattatagtctttcgaggcgaacatggcttcatcggctgtcggaaggtgaccggaacgttggatgctaacagatccagttatgatgtgttccagctggaattcaatgacggagcatataacataaaggatagtaccggaaaatattggacagtgggaagtgactcagcagtgacctcctcaggagacactcccgtggacttcttcttcgagttctgcgactataacaaagtcgccatcaaagtgggcggccggtatttgaaaggggatcacgccggagttctgaaggcctccgccgagaccgtggatccagcaagcttgtgggagtactag

SEQ ID NO: 187492 - DNA, 1551 bp, Artificial Sequence
  Description of Artificial Sequence: Synthetic coding sequence
atgcccaccaacggcctgcaccaggtgctgaagatccagttcggcctggtgaacgacaccgacagatatctcacagccgagagctttggatttaaggtaaatgctagtgccccttcactgaagcggaaacagacctgggtcctggaaccggaccccggccaagggactgcagtgcttctccgaagtagccatctggggcgttacttgtcggccgaagaagacgggagggtggcttgtgaggcagaacaacccggccgggattgtcggttccttgtgctgccccagcctgacggccgctgggtgctccggtctgagcctcatggccggttcttcggtggaacagaggaccagctgtcatgcttcgctacggctgtgtctcctgccgagctttggactgtgcatctcgccatccatcctcaagcccatctgctgagtgtgagccgcaggcggtatgtgcacctgtgcccaagagaggatgagatggctgccgatggagataaaccctggggcgtggacgcacttctgacactcatcttcaggtcacggcgatattgtcttaaaagctgtgactcccggtacttgagatccgacggaagactggtctgggagcccgagccgagagcgtgctacaccctggagtttaaggcaggtaagttagcatttaaggattgtgacggacattatctggcgcccgttgggcccgcaggtacgcttaaagccggccgcaacacgcggcctggaaaggacgaacttttcgacctggaagagtcccatcctcaggttgtgctcgtggctgccaatcatagatatgtgagtgtgcggcagggggtgaacgtatccgcaaaccaagacgatgaacttgatcacgaaactttcctgatgcaaattgatcaggagaccaagaagtgcactttttattcgtcgaccggcggttactggacccttgttactcacggcgggattcatgcaacagcgactcaagtgtccgccaataccatgttcgaaatggaatggcgagggcgtcgcgtcgccctgaaagcgtctaatgggcgttatgtgtgcatgaagaagaatggtcagttggctgctatttccgattttgtgggtcccccaccccggcccgcttggaccggcaaagtcgccggaggtgccgcccagcaaaccttgagtcctccaggcaaagacgaagagttcactctcaaactcataaaccgtcccatactggtattgcgcgggctggatgggtttgtatgccatcaccgagggagcaaccagctagacactaatagatcggtgtacgacgtctttcacttatctttttctgatggggcctaccggatacgtggcagagacggggggttctggtatacggggtcacacggatcagtgtgtagcgacggggagcgagcggaggacttcgtgttcgagttcagggagcgggggaggctcgcaatccgggccaggtccggcaaatatctgagaggcggagcttccggcctactgcgtgccgacgctgacgcgcccgccggcactgctctctgggaatattag

SEQ ID NO: 187493 - DNA, 1479 bp, Artificial Sequence
  Description of Artificial Sequence: Synthetic coding sequence
atgcccaccaacggcctgcaccaggtgctgaagatccagttcggcctggtcaacgacactgatagataccttaccgccgagtctttcggctttaaggtgaacgcatctgcgccatcccttaaaagaaaacagacctgggtgctagagcctgatcctggacaggggacagcagtgttgttgcggtcttctcatctcgggcgctaccttagcgcggaggaggacgggagagtggcttgtgaggccgaacagcccgggagggactgccgcttcttggtactgcctcagccggacgggcgttgggtgctaagatccgaaccccacgggcggttttttggtgggactgaagaccaactttcttgctttgccaccgccgtctccccggcagagctgtggactgtccatctcgcaatacacccacaggctcatcttctaagcgtatcccggagaaggtacgtccacctttgtccccgggaggatgagatggcggccgatggtgataagccatggggtgtcgacgccctgctcacattaatatttagatcccggaggtattgtctgaaaagttgtgattcgcgttacctgagaagcgacgggcgtttggtgtgggagcctgagcctcgggcgtgctacactttagaatttaaggctggcaagctggcgttcaaagactgcgatggacactacttagctccagttggtcccgcaggcactctaaaggccgggcggaacactaggcctgggaaagatgagctcttcgacctcgaggagtcgcatccccaggtggttttggtggcagccaatcacagatatgtgtcagtaagacagggggttaacgtatcggccaaccaagatgacgagctggaccatgaaacctttctgatgcagatcgaccaggagaccaaaaaatgtacgttttactcctccactgggggatattggactctcgttactcacggcggcattcatgctacggccacacaggtaagtgctaacaccatgttcgagatggaatggcgtggccgcagggtcgctctgaaggcttccaatggaagatatgtgtgcatgaagaagaacggacagttggctgcgatatctgacttcgtgggcaaggacgaagaatttacccttaaattgattaaccggcctatcctggtcctgagaggtctcgatgggtttgtgtgccatcatagaggaagtaaccagctggatacaaatcggtctgtctacgatgtttttcatctgtcctttagcgacggtgcgtaccggatacgcggccgcgacggcggcttctggtatacagggagccacgggtctgtttgctcagacggagaaagggcagaagatttcgtatttgagtttagggaaagaggacgattggcaatccgggctagaagtggcaagtacctgcgcggtggagcttctggccttcttcgggctgacgcggacgctcctgctggcaccgctttatgggagtattag

SEQ ID NO: 187494 - DNA, 2133 bp, Artificial Sequence
  Description of Artificial Sequence: Synthetic coding sequence
atgctgaccaccctgaagcccttcggcagcgtgagcgtggagagcaaaatgaacaataaagccggtagtttcttctggaacctgcggcaattctcaactctcgtaagcaccagcaggactatgagactgtgttgcctgggtctgtgtaaaccgaagattgttcactccaattggaacatcttaaacaacttccataaccggatgcagtccaccgacatcattcgctacctgtttcaggatgcttttatctttaaatctgacgtggggttccagactaagggtatttctacgttgactgccctccggattgagaggctgctgtacgcaaaaagattatttttcgacagcaagcagagcctggtgcccgtagacaagagcgacgacgagctgaaaaaagttaatttgaatcatgaagtgtctaatgaagacgtcctgacaaaggaaacaaagccaaaccggatctcatcccggaagttatcagaagaatgtaacagccttagcgatgtcctggacgcattctctaaagcacctacattcccatcgtctaactactttactgctatgtggacgatagcaaagcgactttcggacgaccagaagaggttcgagaaacggttgatgttttctcacccggcctttaaccagttatgtgagcacatgatgcgggaggccaaaattatgcagtataaataccttctgttcagcctccacgctatagtaaaactggggattccccaaaatacaatactggtgcagactctcctgagggttactcaggagcgtataaatgagtgcgacgagatctgtctgagcgtcctgtccactgtgctggaggctatggagccatgcaaaaatgtgcacgtgctgcggacgggctttcgcatcctggtcgatcaacaggtatggaagatagaggatgtgtttactctgcaggttgtgatgaaatgtattggcaaggacgcgcctatcgcccttaaaaggaaactggaaatgaaggcgctgcgcgagctggatagatttagtgtactgaattctcagcacatgtttgaagtcctagcggcgatgaaccatcgttcacttattctgctggacgagtgtagcaaggtcgtgctcgataatatacatggatgccctctacggatcatgatcaatattctacaatcttgtaaggatctacagtaccataacttggacctctttaagggattagcggattatgtggcagcaacattcgacatctggaagtttcgaaaggtgctcttcattttaattttgttcgagaatctcggttttaggcccgtgggcctgatggacctgttcatgaagaggatcgtggaagaccccgagagcctcaacatgaaaaatatcctgagcatacttcacacctactctagtctcaatcacgtatataaatgtcagaataaagaacagttcgtagaggttatggccagtgcattaacgggctacctccacacaatttccagtgagaacctccttgatgcagtgtattccttttgcctcatgaactactttcccctcgctccattcaaccagttactgcagaaggatattatctccgagctgctgacctccgatgacatgaaaaacgcatataagttgcatacacttgacacctgtcttaagttggatgatacagtttacttgcgcgacattgccctttctctcccgcagctccctcgcgagctcccctcgagtcatacaaacgcgaaagtggccgaggtgctctcaagcttattgggtggggaaggacacttctcgaaggacgtgcatcttccccacaactaccacattgattttgagatacggatggacacaaatcgaaaccaggtcctgcccttatcagacgtggatacaacatccgccaccgatatccaaagagtggccgtgttgtgtgtctctcgttctgcgtattgcctcggcagttcccacccacggggcttccttgccatgaagatgagacatctgaacgctatgggatttcacgtgattctggttaataattgggagatggataagcttgagatggaggacgcggtgacattccttaaaactaagatttattccgtggaggctctgccagttgccgccgtcaatgttcaaagtacccagtag

SEQ ID NO: 187495 - DNA, 2133 bp, Artificial Sequence
  Description of Artificial Sequence: Synthetic coding sequence
atgctgaccaccctgaagcccttcggcagcgtgagcgtggagagcaagatgaataacaaagctggtagttttttctggaatctccggcagtttagtacactggtcagcacttctcgtacaatgcgcctctgctgtcttggcctatgcaagcctaaaatcgtgcactcaaactggaatatcctgaacaattttcacaacagaatgcagtccaccgacataatcagatacctgttccaagacgcctttatatttaagagcgacgtcgggttccagaccaaaggcatctctaccctcaccgccctgcggatcgaacgactactttacgcgaaacgtctgtttttcgacagtaagcagtccctagttccagtggataagtcagacgacgagttgaagaaagttaacctgaatcacgaagtctccaatgaagacgtgctcacaaaggaaactaagccgaaccgcatctcgtccagaaaattatccgaggaatgtaactctctgtcggatgtgctggacgcgttctcaaaagcgcctacatttccttcaagtaattactttacagccatgtggaccatagctaaacggttatcagatgaccaaaagcggtttgagaaacgcctaatgttctcccaccctgccttcaaccagctgtgcgaacacatgatgcgcgaagccaagatcatgcagtataagtatctgctgttcagcctgcacgccatcgtgaaactcggcatcccgcaaaacaccatccttgttcaaacactgttgcgagtgacacaagaaagaataaatgagtgtgacgaaatctgcctcagcgttttgtctacggtactcgaagccatggaaccgtgcaaaaatgttcacgtgctcagaactggatttcgaatcctggtagaccaacaagtttggaagatcgaagacgtctttacactccaggtggtcatgaaatgtatcggaaaggatgcacctatcgcgctgaaaagaaaactggaaatgaaggctcttcgcgagctcgacaggttttctgtgttgaattcacagcatatgttcgaagtacttgccgctatgaaccacaggagcctaatactactcgatgagtgttccaaggtggtcttagacaatattcacgggtgcccgctccgaatcatgataaatattctccagagttgtaaggaccttcagtatcataatctggatctctttaaggggctcgcagattacgtcgccgctacctttgacatttggaagttcaggaaggtcctctttatactcatcctttttgaaaaccttgggttcagaccagtcggccttatggacttgttcatgaagagaattgttgaagatcccgagagccttaacatgaagaatatcctctccatcctccacacttattcatctcttaaccacgtgtacaagtgtcaaaataaagagcagttcgtggaagttatggccagcgccttgaccgggtacctgcacaccatcagcagcgagaacctgctggatgctgtgtattccttttgtttgatgaactacttccccctggcaccatttaatcagcttctgcagaaagacattatctccgagctgttaaccagcgacgacatgaaaaatgcgtacaaattgcatactttggatacctgtttgaaattagacgacacagtgtacctcagggacattgccctgtctctcccccagctgcctcgggagcttccatctagtcacacgaacgccaaggttgccgaagtcttgtcctccctcctcggaggggagggccatttcagcaaagatgtgcatttaccacataactatcacatcgacttcgaaatccgcatggacaccaaccggaatcaggtgcttccgctgagtgacgtcgataccacatcagccacagacattcagagagtggctgtgctgtgtgtgagcaggtcagcttattgtctgggcagctcacaccccagaggcttccttgcgatgaagatgcgccatctcaacgctatggggttccatgttatccttgttaataactgggaaatggacaaactcgaaatggaggatgctgtcacgttcctaaagaccaaaatctactctgttgaggcgctgcctgtggccgctgtcaacgtccaatctacccaatag

SEQ ID NO: 187496 - DNA, 2133 bp, Artificial Sequence
  Description of Artificial Sequence: Synthetic coding sequence
atgctgaccaccctgaagcccttcggcagcgtgagcgtggagagcaagatgaacaacaaagctggctcttttttctggaatttgagacagttttcaacactggtcagtactagcaggaccatgaggctgtgttgcctcggcctttgtaaacccaagatcgtgcacagcaattggaatattctgaataatttccacaatcgtatgcagagcactgacattatccgctatctctttcaagacgcctttatctttaaatcagacgtggggtttcagacaaagggaatctccaccctaactgccttgaggatcgagagactgttgtatgctaaaagactgttttttgattctaagcaaagcctggtgcccgttgacaagagtgatgacgagctgaaaaaggttaacctgaatcacgaggtgagcaacgaagacgtacttacgaaagagacaaaacccaatcgcatctcttctagaaagctttctgaggagtgtaattctctctctgacgtgctggatgccttctccaaagcgcccacttttccctcatccaactactttacagcgatgtggacaatcgccaaacgcctgagcgacgatcagaaacgcttcgagaagcgattaatgttcagccatcccgcgttcaatcagctatgcgaacatatgatgcgcgaagcgaaaatcatgcagtataaatatctgctcttctccctgcacgctattgttaaactgggaattcctcagaacacaatcctcgtccaaacgctcctacgagttacacaagaacgcatcaatgagtgtgacgaaatctgcctgtcagtgctctccaccgtcctcgaggcgatggaaccatgtaagaacgtccacgtgcttcgtactggcttcaggatcctagtggatcagcaagtctggaagatcgaagacgttttcacactacaggtggtcatgaaatgtataggtaaagacgcccctattgcattaaagcgcaaactggaaatgaaagcactgagagaattggataggttttcagtgctgaatagccagcatatgtttgaggtactggcagccatgaatcacagatccctgatcctgctggatgagtgctccaaagtcgtcctggataatatccatgggtgtcccctcaggatcatgatcaatatattacagtcctgcaaagacttgcaataccacaatctagatctgttcaagggattggccgattacgttgctgctacatttgacatctggaagttccgaaaggtgttgttcatactaatcctgttcgagaacctggggttccgacctgttgggctaatggatctgttcatgaagcgtatcgttgaggacccagaatctctaaatatgaaaaatatactctctatcctacacacatatagcagcctgaatcatgtttacaagtgtcaaaataaagaacagtttgtggaagtgatggccagcgccctcactggctatttgcacaccatcagctccgagaacctgcttgacgccgtgtactcgttctgcctcatgaactactttcccctggcccctttcaatcagctactgcagaaagatattatttccgaactcctgacctcagacgacatgaaaaatgcctacaaactccatacattagacacttgtctcaaactagacgatacagtctacctccgggatattgccctttctctgccgcaattaccacgcgaactcccatccagccatacaaacgcgaaagttgccgaggttctaagctcactgttgggcggcgagggacacttttctaaagacgtgcacctgccacacaactatcacattgattttgagatccgtatggacacaaatcggaatcaggttctaccattgtcggacgttgacacaaccagtgccactgacatccagagggttgctgtactttgcgtgtcccggtctgcgtattgccttggttcttctcaccctcgaggttttcttgcaatgaaaatgaggcacctgaatgctatgggcttccatgtaatactggttaataactgggaaatggataaacttgaaatggaggacgctgtgacgttcctgaagaccaaaatttatagcgtcgaagctctccccgtcgccgccgtgaacgtccagagtacccagtag

SEQ ID NO: 187497 - DNA, 375 bp, Artificial Sequence
  Description of Artificial Sequence: Synthetic coding sequence
atgctgaccaccctgaagcccttcggcagcgtgagcgtggagagcaagatgaacaataaagcgggtagtttcttttggaatttgaggcagttttctaccctggtgtccaccagtcgaacgatgcggctatgttgtctgggactgtgtaagcctaagatcgtgcactccaattggaacatactgaataactttcataataggatgcaatcaaccgatataatccgctacctgtttcaggacgcattcatattcaaatctgatgtgggattccagacaaagggcatttcaactctgacagctctaagaatcgaacgccttctgtacgctaaaagactattttttgactccaagcagtccctcgtgcccgtcgactag

SEQ ID NO: 187498 - DNA, 2295 bp, Artificial Sequence
  Description of Artificial Sequence: Synthetic coding sequence
atggccgccaccctgaagagcctgaagctggtgcggtaccgggccttctgtagtccttctgctttcggagcggtgcggtcggtcagctactggaatgtaagtagtactcagcatgggggacaagacccgcctgaacatatctctctctgccacagtgcgaaaaaggttaagaacatttgttcaactttctcctccaggagaatcctgaccacgtcaagtgcccaccccggtttggaattttctaaaaccagctcttcaaaggcctctacactgcagttgggcagtcctcgagcaacaggtgtggacgaagaagatgtcgaagtattcgattcttttgagaatatgagggtcttcctgcagttgcgccctgagtaccgagttcacagctataacgcgagcgagacaagtcaactgttgagtgtaagtgaaggtgagctaatactccacaaggtgcgcgtcaaccagaataatctgcaggcgcaggtgattgtcgactacctatgcaaattgagctcactaccagccgaacagcatcctgttttgctgggcagcaccagctttgctctactgtgccaactgtcagtgaaaaagatccagctgttcgatacacaggacttgattaatgttctgaaggcattcgtcatcttgggaatccctcactcccacagcatgctcgatgtatatgagacaaagtgctgtcaccaagtgtgggaaatgaatatggaccagttactgctggtcgccgacctctggcggtacctgggtaggaaagtgccccgtttcctgaatattttttccagctacctcaaccttcactggaaagacctttctctgagccagttggtccacctgatatacgtgatcggtgaaaacagacaggtgtcccaggacctgatgcagaagctggagagcttaatcctcaagtatatcgatctgattaaccttgaagaggtggggactatttgcttgggtttctttaagtccagtaccaatctgtctgaatttgtgatgcgaaaaataggcgatttggcctgcgcaaatatccagcacctgagcagcagatccctggtcaacattgtgaagatgttcaggttcacacacgtggatcacattaacttcatgaaacagatcggcgagatcgccccacagaggattccttcactcggagtacagggcgttatgcatctcacactgtattgttcagccctccgctttcttaacgaaggggtaatgaatgctgtggctgctagtctgccccctagagtggcccactgccgcagtaaggatgttgctaagattctctggtccttcggcacgctgaactacaaaccgccaaatgctgaggagttctactcatctttgattagtgagatccatcggaaaatgcctgagttcaaccagtaccccgagcatctcccaacctgccttctcggcctggcctttcttgagtattttccagttgagcttatagactttgccctctcacccggattcgtaaggctggcccaggagaggactaaatttgacctcctgaaagagctctatacattggacggcactgtcggcatagagtgccctgactatagaggtaatagattgtctactcacttgcagcaggaagggtcggaactgctgtggtatcttgccgagaaagatatgaactcaaagcctgagttcctggagaccgtgtttttactggagacaatgttgggtggacctcagtacgtgaaacaccacatgatcctgcctcataccaggagctcagatcttgaggtgcagctggatgtgaatttaaagcccttgccttttaatcgtgaagccactccggccgaaaacgtggccaagctacggctcgaacacgtaggggtgagtttgacggacgatctgatgaacaaattactgaagggtaaggccagaggacacttccaaggaaaaaccgagtcagaaccggggcagcaacccatggagcttgaaaacaaagcagcagtcccgctgggagggtttctttgcaatgtcgcagataaatccggagccatggaaatggcagggctctgcccagcagcttgtatgcagactccccgcatgaagctggccgttcagttcaccaaccgcaaccaatactgttacggcagccgggacttactgggccttcacaacatgaaacgacgccaactggctcgcctggggtaccgcgtcgtggagttgtcttattgggaatggttgcccctgctgaagcgcacaagactagagaagttggcctttctgcatgaaaaagtgttcacttccgctctctag

SEQ ID NO: 187499 - DNA, 183 bp, Artificial Sequence
  Description of Artificial Sequence: Synthetic coding sequence
atggcctgccagggccgggaggagtgctggtgccagagccggatcgcacgcacattgcctgctgatcaaaagcctgaatgccggccctattgggaaaaggacgacgcttctatgccactccctttcgatttgacagacattgtcagtgaattgagagggcaactgctggaggccaaaccttag

SEQ ID NO: 187500 - DNA, 630 bp, Artificial Sequence
  Description of Artificial Sequence: Synthetic coding sequence
atgctggacgacctgaacgccacccaccagcactgcgtgctggccggctctcagcctcgattctcaagcacccaccgcgtcgcagaatgttccaccggcaccctggactacatcctgcagaggtgtcaactggccctccagaacgtgtgtgacgatgtcgataacgatgacgtaagcctgaagtcttttgagcccgccgtgctgaagcagggcgaagaaatccacaatgaagttgaatttgagtggctgaggcagttctggtttcagggcaaccggtaccgaaagtgtaccgactggtggtgccagcctatggcccagctcgaggccctttggaagaagatggagggggttaccaacgcggtgttgcatgaagtcaagagggagggcttgccggttgaacaaaggaatgagattttgaccgcaatactggcctcccttacggcccggcagaaccttcggagagaatggcacgcaaggtgccagtcccgaattgcaaggacactgccagctgaccagaagccagaatgcaggccgtattgggagaaagacgatgcctcaatgccgttgcctttcgatctgaccgacatcgtgagcgaattacgggggcaactgctcgaggcaaagccttag

SEQ ID NO: 187501 - DNA, 321 bp, Artificial Sequence
  Description of Artificial Sequence: Synthetic coding sequence
atggcccagctggaggccctgtggaagaagatggagggcgtgaccaatgctgtcctgcatgaggttaaaagggaaggcttaccagtggaacagcgtaacgagattctaaccgccatcctggcttcccttaccgctcggcagaatctgagacgcgagtggcatgctaggtgccagtcaaggattgctcgtacgctgccagctgatcagaagcctgaatgccgcccatattgggaaaaggacgacgccagcatgcccctcccttttgatctgacagatattgtatctgagcttagaggtcagctgctggaagccaagccttag

SEQ ID NO: 187502 - DNA, 321 bp, Artificial Sequence
  Description of Artificial Sequence: Synthetic coding sequence
atggcccagctggaggccctgtggaagaagatggagggcgtgaccaacgcagtcctccacgaagtaaagagagaaggattacctgtcgagcaacgaaatgagattttgaccgcgattctcgcctctctgaccgcacgccagaacctccggcgagaatggcatgcccgatgtcaatcaagaatcgctcggacacttcctgccgaccagaagcccgagtgccgcccttattgggagaaggatgatgctagtatgcctctgccctttgacctaacggacatcgtatctgaactgcggggtcagctgttagaggcaaagccttag

SEQ ID NO: 187503 - DNA, 384 bp, Artificial Sequence
  Description of Artificial Sequence: Synthetic coding sequence
atggagtggcggaaggtgagcgagtgcaacagcgtggagccctgccgtgaggttaaaaagtggccttaccgatgtatccatcatggcaagaacttcagtagaatgactaacgcggtgttgcatgaagtcaagcgcgaaggattgcccgtggagcagaggaacgaaattctgaccgctatacttgcttcccttacagctcgccagaatctacgtcgggagtggcacgcaaggtgccaatcccggattgcacgcacccttcctgcagaccagaaacctgagtgccggccatactgggagaaagatgacgccagtatgccactgccttttgaccttacagatattgtgagcgaattgcgaggacagttgctagaagccaagccttag

SEQ ID NO: 187504 - DNA, 1518 bp, Artificial Sequence
  Description of Artificial Sequence: Synthetic coding sequence
atgaagcggacccccaccgccgaggagcgggagcgggaggccaagaagttgagactcctggaggaactagaagatacatggctgccctatcttacacccaaagatgacgagttttatcagcagtggcagctcaagtaccccaagcttattttgcgcgaggcatcatccgtgtcagaggagctgcacaaggaggtgcaggaggcctttctgaccctgcacaagcacgggtgtttgtttagagatctagtccgaatccaagggaaagatctgctgactccagtgtccagaattctcattggcaatcccggctgtacctacaagtatctaaatacaaggttgttcaccgtgccatggcctgtaaaggggagcaacattaagcatacggaagctgagattgcggcggcttgcgaaacattcctaaagctgaatgactacctgcagatagagaccatccaggctttggaggaattggctgccaaagagaaggctaacgaagatgccgttcccctgtgtatgtctgcagattttcccagagtggggatgggatcttcctacaacgggcaagacgaagttgacattaaaagtcgagcagcttacaatgtaaccctgctcaactttatggatccgcagaagatgccctatctgaaagaagagccttactttggcatgggcaaaatggcagtgtcatggcatcacgacgaaaacctcgtcgataggagcgctgtggctgtgtattcctactcctgcgaaggcccggaggaggaaagtgaagacgactcccacctagaaggtagggacccagatatttggcacgttggcttcaagataagttgggacattgagacaccagggctcgccatacccctgcaccagggggactgctactttatgctagacgatctgaatgccactcaccaacactgtgtcctcgccggctcccaacctcgattttcatctacccacagggtcgccgaatgttctacaggaactctggactatattctgcaacgatgtcaattggccctccagaacgtatgtgatgatgtggataacgacgacgtgtcactgaagtccttcgaacccgcagtgcttaagcaaggtgaagaaattcataacgaggtggagttcgagtggctgcgacaattctggttccaaggaaatcggtacaggaaatgtaccgattggtggtgtcaaccgatggcccaactcgaggcgctctggaaaaagatggaaggcgtcacaaatgcggtgctgcacgaagtgaaaagagaggggctccccgttgaacagcggaatgagattttgacagccattcttgcttccctgactgctcgccagaatttgcggagggaatggcatgcaaggtgccagtccagaatagcacggacacttcctgccgaccagaagcctgaatgccgaccgtattgggagaaggacgacgcctccatgccattgccattcgaccttaccgacattgtgagcgaattgagaggccagcttttggaagcaaagccctag

SEQ ID NO: 187505 - DNA, 321 bp, Artificial Sequence
  Description of Artificial Sequence: Synthetic coding sequence
atggcccagctggaggccctgtggaagaagatggagggcgtgaccaatgccgtactccacgaagtgaagagagagggcctacctgtcgagcagcgtaatgagattctgactgccatattagcttcccttaccgctcgacagaacctgagaagggagtggcatgcaagatgccaaagccgtattgcccggacgttgccggccgaccagaaacctgagtgtcgcccctactgggaaaaggacgatgctagtatgccgcttccctttgatctcacggatatcgtttcggaacttcgcgggcaattactagaggcgaaaccttag

SEQ ID NO: 187506 - DNA, 13050 bp, Artificial Sequence
  Description of Artificial Sequence: Synthetic coding sequence
atgaccatcgccctgctgggcttcgccatcttcctgctgcactgcgccacctgcgagaaaccacttgagggaatcctgagctctagcgcctggcacttcactcactcacactacaatgcaactatttacgaaaattcgtcgcctaagacctatgtggagtccttcgaaaagatgggtatatacctggctgagccgcagtgggccgttcgctacaggatcatatcaggcgatgtcgccaacgtctttaaaaccgaggagtatgttgttggaaacttctgttttcttcggattcgaacaaaaagcagcaacaccgcccttttgaatagggaagtgagagacagttatactctaattatacaggctactgagaagaccttggaattggaagcactcacccgagtcgtggtacatatcttggaccagaatgatcttaagccactcttttctccgccatcttacagggtaaccatcagcgaggacatgccactgaagtcccccatttgtaaggttacagccactgatgcggacctgggtcagaacgccgagttttattatgcctttaacacccgctccgagatgtttgctatacaccccacttctggagttgtcaccgtagccggtaaactgaacgtgacctggaggggtaagcacgaacttcaggtgctggcagtggataggatgagaaaaatctccgaagggaatggattcggcagtctggccgcactcgttgttcacgtagaacctgcactccggaaacccccagctatcgcgtctgtagtagtcacgcctcccgactcaaacgacggcacgacttatgccacggtgctggttgatgccaattcatcgggggccgaagtcgagagcgtcgaggttgtaggcggagatccaggcaagcattttaaggccattaagagctacgctcgtagcaatgaattttctcttgtgagcgtcaaggacattaattggatggagtatctgcacgggttcaacctctctctgcaggctcgcagcgggagtggcccttacttctatagccagattcggggtttccatctcccacccagtaagttaagctctctaaagttcgagaaggccgtgtaccgggtccagctgtccgaattttctccacccggatcccgggtcgtgatggtgcgcgtgaccccagccttcccaaacttgcagtacgtcctgaaaccttcttcggagaacgtaggctttaagctgaacgcacggacaggactgatcacaaccacgaagctgatggatttccacgaccgagcacactatcaattacatattcgcactagtcctggccaggcgtcaacagtcgttgtaatcgatattgtggattgcaacaatcacgcacccctgttcaacagatcctcctatgacgggacactggacgaaaacatccctcccggaaccagcgtactggcggttacagcaacagaccgcgatcacggtgagaatggatacgtgacctacagcatagctggccctaaagcactgccattttctatcgacccatacctgggaataatttccacaagtaagcccatggactacgaactcatgaaaagaatatatacatttagagtgcgggctagtgattgggggagcccgttcagacgggagaaggaggtctctatcttcctgcagttacggaatctcaacgataatcagccaatgttcgaagaggtgaattgtaccggctctatccggcaggactggcctgtcggcaagtccatcatgaccatgagcgccatcgatgtggatgagctgcagaacttgaagtatgagatagtgtctgggaacgaactggagtatttcgacctgaaccacttttccggcgtgatatccctaaagcggccttttattaacctgacggccgggcagcctacgtcttacagcctcaaaattacagccagtgacggaaagaattatgcctctcccacaacattaaatatcaccgtagtaaaggatccacacttcgaggtgcctgttacatgtgataagacaggggtgttgacccagttcactaaaacaatattacatttcatcggtctgcagaaccaggagagctctgacgaggagttcaccagtctcagcacataccagatcaatcattacactcctcagttcgaagaccactttccgcagagcatcgatgtcctggagtctgtcccaatcaacacgcccctcgccaggctagctgcgacagatcctgatgcaggcttcaatgggaagctggtgtacgtaattgccgatggaaatgaagaagggtgcttcgatatcgaactcgagacagggctgctgacagttgccgctccattggattatgaggccacaaacttctatattctgaatgtgacagtctatgatcttgggacgccccaaaagtctagctggaagctcctgactgtgaatgtcaaggattggaatgataacgcccccaggttcccacccggcggctaccagcttacaattagtgaagacactgaagttggcacaaccattgccgaactcactactaaagacgcggacagtgaagataacggaagggtgcgttacactctcttgtcacccaccgaaaagttctccctgcacccgctgacaggggaattggtcgtgactggccacctcgatagggagagcgagccgcgctatattcttaaagtggaagcgcgcgaccaacccagcaaaggccaccaactcttttcagtgaccgacctgatcattacattggaggatgtgaatgacaattcccctcagtgtataactgagcataataggctgaaggtaccagaagacctgcctccgggcaccgtcctcacgttcttggatgcctccgatccagacctgggaccggctggtgaggtgaggtacgtgctgatggatggggctcatgggactttccgcgttgatctgatgactggagcactcatcttagagcgagagctcgatttcgagcggcgcgccgggtacaatctctcactctgggcaagcgatggcggaagacccttagctcggcgtacgctatgtcatgtggaggtgatcgtcctggatgtcaacgagaacctacacccaccacacttcgctagctttgtccatcaggggcaggtgcaggaaaacagccctagtggcacacaagtgatcgttgtggccgcgcaggatgatgatagcggtttagatggagaattgcagtattttctgcgggcagggactgggctcgctgcattctcaatcaatcaggacactggaatgatccagaccctcgcaccactcgaccgcgaatttgcatcctactactggctgacggtgctcgccgtggatcgcgggtccgtgccgctttctagcgttaccgaggtgtatattgaggtcaccgacgccaacgacaaccctccccagatgtctcaggctgtcttttatccatctattcaggaagatgcacctgtaggaacctcagtgctgcagctcgacgcatgggatcctgattcttccagcaagggaaaactgacctttaacatcacatctggaaattatatgggcttctttatgatccatccagttaccggactattgagcacagctcagcaactggacagggaaaacaaagatgagcacattctggaggtgacagtcctcgacaatggggagccctccttgaaaagtacatctagggtggtggtggggattctggacgtgaatgacaaccctccgatattctctcacaagctctttaatgtgaggctaccagagcggctgtcccccgtgagcccaggccctgtttatcgccttgtggctagtgatcttgacgaagggctcaacggccgggtgacttacagcatcgaggactctgatgaggaggccttctcaatagacctagtcacgggtgtggtgtccagctccagcacctttactgctggtgaatataatattttaaccatcaaggcgacagactcggggcagcccccgctctcagcatctgtgaggcttcacattgaatggatcccatggccccgtcccagttctatccccttggcattcgacgagacctactatagtttcacggtcatggagaccgaccctgtgaatcacatggtgggagtcatctccgtcgaggggagacctgggctcttttggtttaatatctcaggtggtgataaagacatggattttgacatagaaaaaaccaccgggagcattgttatcgcgcgccccctcgataccagaagaagatccaactataacctcaccgttgaagtcacagacggaagtcggaccatcgcaacccaggttcacatcttcatgatagcaaatataaaccaccaccgcccacagttcctcgaaacccgctatgaggtcagagtgccccaagacactgtcccaggagtggagctcctcagagtccaagctattgatcaggacaagggtaaatctcttatttatacaatacatggttcacaagacccagggagtgcctcactgtttcagttagatccttctagtggggtgcttgtgacggtggggaaactcgatctagggtcaggacctagtcagcatacgctgacagtcatggtgcgagaccaggagattccgattaagcgcaacttcgtttgggtgacaattcacgtcgaggatggcaatctgcatccacccagattcacccagttgcattatgaggctagtgtcccagacaccatcgcacctggcacggaacttctgcaggtacgcgccatggatgcggataggggagtgaacgctgaagtccactacagcctcctaaaaggcaattcggagggcttcttcaacattaacgcattgctgggcatcatcaccctggctcaaaagcttgaccaggcaaaccatgctcctcataccctgaccgtgaaggcagaagatcagggttctccccagtggcatgacctggctacagtgattattcacgtatacccctccgatcgatctgccccaatcttctcaaagagcgaatacttcgtggaaatacccgaatcaatacccgtaggaagtcccatcttactggttagcgctatgtccccaagtgaggtgacatacgagcttcgtgaaggaaacaaggatggagtcttcagtatgaactcctactccggactgatctcaacacagaaaaagctggatcatgaaaagatcagctcttaccaactcaagattcggggtagcaatatggcgggtgcctttaccgacgtgatggttgtggtggatattatcgacgaaaacgataacgcccccatgtttctcaagtccacttttgtcggacagatcagtgaggctgccccactgtattcgatgatcatggataaaaataacaatccatttgtgatccacgccagtgattcggacaaagaggccaactccctcctggtgtacaaaatactcgagcctgaggccttgaagtttttcaagatcgatccttccatgggcactctcactattgtcagcgagatggattacgaaagcatgccaagctttcagttttgcgtctacgtccacgatcaaggaagcccggtattattcgctcctcggcccgcccaggtgattattcacgtgcgggatgtgaacgacagtcctccccggtttagcgagcagatatacgaagtggcaatcgtgggaccaattcacccaggcatggagcttttgatggttcgcgcatcagatgaagactcggaagtcaactacagcatcaaaacggggaacgctgatgaggctgtgactatccacccagttacaggtagtatctctgtcttaaatcctgcttttttggggctttccagaaaactgacgatcagagccagtgacggactctatcaggatacagcacttgtcaagatctctctgacccaagtgctggacaagagcctccaattcgaccaggatgtatattgggccgccgtcaaggaaaaccttcaagaccgcaaggccctggtgattttgggcgcccaaggaaaccacctcaacgacacactgtcctatttcttgttaaacggaacagacatgttccatatggtccaaagcgccggagtcctgcagacgagaggcgtcgcctttgatagagagcagcaggacacacatgagctagcagttgaagtgcgagacaatcgaacgccgcagagagtcgcgcagggattggtgcgtgtatccatcgaggatgtaaacgacaaccctcctaagtttaagcacctcccgtattatactatcatccaagacggtacggagcctggagacgtcctttttcaagtgagtgccactgacgaagacctggggactaacggagccgttacttacgaattcgccgaggattacacttattttaggattgacccatacctgggggacatctctttgaagaaacccttcgactaccaggctttaaacaaataccacctaaaagtaatcgctcgcgatgggggtaccccttctctgcagtccgaagaggaagttttggtgaccgtgagaaacaaatctaatcctcttttccagtcgccatactataaagtgcgcgtccccgagaatatcaccctctacacgcctatcctccacactcaagcgagatcaccggaagggctgcgactgatatacaacatagtggaagaagagcctctgatgctgtttaccaccgactttaaaacaggcgtgttgaccgtgaccggcccactggattatgagagcaaaaccaaacacgtatttacagtaagagccaccgatacagctctgggctctttcagtgaagctaccgtggaagtcctggtggaggatgtgaatgataatcccccaactttctcacagttggtatacaccacatccattagtgaggggctccccgctcagacccccgtgatacagctcctcgcctcggaccaggacagcggccgaaaccgggacgtgtcttaccagatcgtggaggacggttcagatgtcagcaagtttttccagattaacggaagcaccggggagatgtctaccgtgcaggaattggactacgaagcccagcagcatttccacgtgaaagttcgtgcaatggacaaaggagaccccccactgaccggggagacgctggttgtagttaatgtttccgacatcaatgataatccccccgaattcaggcaacctcagtacgaggctaacgtgtcagagctggctacgtgtggccacctggtgttgaaagtgcaggcaattgatcccgattcccgggacacctcccgcctggagtacctgattctcagtggcaatcaggaccgacacttcttcattaactctagttcaggaattatttcaatgttcaacctttgcaagaagcaccttgattcctcatataatctcagagtgggggcttcagatggcgtgtttcgggccacagtaccggtctatataaacacaactaacgcgaacaagtactctcccgagtttcagcagcacctgtacgaagctgaacttgcagagaacgcaatggtgggaaccaaagtgattgatcttttggcaatagacaaggattccggtccttacggcacaatcgattatactattatcaacaagctggccagtgagaaattcagtatcaatccaaacggtcagattgcgaccctacaaaaactggatagggaaaatagcactgagcgtgtgatagctattaaggtgatggcacgggacggcggcggaagggtcgccttctgtaccgtaaaaattatattgacggacgagaacgacaaccctcctcaattcaaagcctcagagtacaccgtgtcaattcaatctaacgtgtccaaagatagcccggtgatccaagtactggcgtacgacgccgacgaggggcagaatgctgacgttacatatagtgtgaatcccgaggatctggttaaagatgtcatcgagataaaccctgtcacgggagtcgtcaaggtaaaagacagcctcgtcggcctggagaatcagaccctggattttttcataaaagctcaagatggtggcccacctcattggaattccttagtgcctgtgcgtctgcaggtggttccaaagaaggtgtcactgcctaaattctccgagccactgtatacctttagtgcaccagaggacctgcccgaaggtagcgagattggcattgtgaaagccgtcgccgctcaggatcccgttatttactctttagttcgcggcaccacaccagagtctaataaggatggggtgttttcactggacccagacacaggggtcatcaaagtgagaaaacccatggaccacgagtcgactaagctataccagatcgatgttatggctcattgtcttcagaacaccgacgtagtgagcctagtctccgtgaacattcaggtgggagacgttaacgataatagaccagtcttcgaggcagacccttataaggcagtgttgacggagaatatgcctgtcggaacctcggtgattcaggtgaccgccattgacaaggacacagggcgcgacggccaggtgtcctaccgtctctcagcagaccctggaagcaacgtacacgagcttttcgcaattgacagtgaaagtggctggattactaccctccaggagctagactgcgaaacttgccaaacttatcacttccacgtggtggcttatgaccacggccagacgatccagctatcttcgcaggcgctcgtccaggtctcgataaccgacgagaatgacaacgctcctaggttcgcaagtgaggagtaccgtggctcggtcgtagagaatagcgaacctggagaattagtggccacactcaaaactctcgacgctgatatttccgagcagaaccgacaggtgacttgctacatcacagagggagaccccctcggacagtttggcatctcacaagtgggggatgagtggcgcatttcttccaggaagacccttgatcgggaacatacggcaaagtacttgcttcgcgtgactgctagcgacgggaagtttcaggcctctgtgacagttgagatcttcgtgctagatgtcaatgacaattctccacagtgttcgcagctgctgtatacggggaaggtccatgaggatgtctttccaggccacttcatactcaaagtttccgctaccgacctagacactgataccaatgcccagatcacctattccctgcatggccccggagcacacgagtttaagctcgatccacacaccggtgagctgactaccctaactgccctggacagggagcggaaggacgtgtttaacctcgtcgcgaaagcgacagacggaggcgggagatcttgccaagctgatatcacgctgcatgtcgaggacgtcaacgacaacgcgccacgttttttcccctcccactgtgccgtcgcggtgtttgacaacaccaccgttaaaaccccagtcgcggtggtctttgcacgagacccagatcaaggtgccaacgcccaggtggtgtattctttaccagattcagcagagggccatttctcaatcgacgccacaactggggtgattcggcttgaaaagcctctgcaggtccgaccacaagcaccactggagctgaccgtgcgggccagcgatctcggcacccccatccctctctcaacactgggaacagtgactgtatctgtggtaggactcgaggactatttacctgtgtttctcaacacagagcacagtgtccaggtgcctgaggatgcaccacctggaaccgaagttctacagctggctaccctgacaaggcctggggctgagaaaacaggctacagagtggtctctggaaatgagcagggtcgcttccgactggacgccaggactggaattctctatgtgaacgcctcactggatttcgaaacctctcccaagtatttcctgagcatagaatgctccagaaaaagcagcagcagcctgtcggatgtgaccacagtgatggtaaacatcacagacgttaacgagcaccggccacagttccctcaagacccgtactcgaccagagtcttagagaacgccctggtgggtgatgtcatcctgacagtgagcgcgaccgacgaagatggacccctgaattccgatatcacctatagcttgatcgggggcaaccagctgggacactttaccatccatcccaagaagggggaactccaggtggcgaaggctctggacagagaacaggcaagcagttatagcctcaagctccgggccactgattctggtcaacctcctctgcacgaggataccgatattgctattcaagtggccgacgtgaacgataacccaccacgtttctttcagttaaattactctaccacggttcaggagaacagccccatagggtcgaaagtgctccagttgatactgagtgacccagactcacctgaaaacgggccgccatacagcttcaggattaccaaggggaacaatggcagcgcatttcgcgtcacgcctgacggatggctagtgacagctgagggattgagtcggcgggcgcaggaatggtaccagctgcagattcaggccagcgatagcggtattcctcctctcagttcactaacgtctgtgagggtacacgtcactgaacagagccactatgctcctagcgcactgccactcgagattttcattacggtgggcgaagatgaatttcagggcgggatggtgggtaaaattcacgctacggacagggatccccaggacacacttacttattcattggccgaagaggagactctggggagacacttcagcgtgggagcccctgatggtaagattatagctgcacagggcctgcctagaggacattattccttcaacgttacagtgtcggatggtacttttacaacaacagccggggtccacgtgtatgtatggcacgtaggccaggaggccttgcaacaagccatgtggatgggattttatcaactgacccccgaagagttggtgtctgatcactggagaaatctacagcggtttctgtcacataaattggatatcaagcgcgctaacatccatttagcctccttgcagcccgcagaggccgttgctggagtagatgtgttactggtgtttgaaggacacagcggaacattctatgagttccaggagctggcgtccataatcacacatagtgctaaagaaatggagcacagtgtgggagtgcagatgagaagcgccatgcccatggtgccctgccagggccctacttgccaagggcagatctgccataatacagtgcatctggaccctaaggtcggcccaacgtacagcacggcccgactgagcattctcacgccacgccaccacctccagcgcagttgcagttgtaacgggacagctacgcggttcagcggccagagttacgtccgttaccgggcccctgctgcgagaaattggcacatccatttctatttaaagaccctgcagccacaggctatcttactgttcactaatgagactgcctcggtcagccttaaactggcaagcggcgtcccccaactggaataccactgcctggggggattttacggcaacctttcttcccagaggcacgttaacgaccatgaatggcactctatcctcgttgaggaaatggacgcaagcatacggcttatggtggacagtatgggaaatacgagtcttgtggttcccgagaattgccgtggccttcgcccggagagacatctgctccttggcggcctgattttactccattctagtagcaacgtgagccagggttttgagggttgtctcgatgctgtcgtagtcaacgaagaagctttggacctcctggcgccaggcaaaactgttgctggcctgttagagacccaggccctgacacagtgctgcctccattcagactactgtagccaaaacacttgtctgaatggcggcaagtgtagctggactcacggcgccggatacgtgtgcaaatgtcctcctcaatttagcggaaaacattgtgagcagggccgagagaattgcacctttgccccctgtctcgagggtggtacatgcattttatcacctaagggggcttcctgcaattgtccacacccctacacaggcgaccggtgcgagatggaagctcgggggtgtagtgagggccattgtctggttactcccgagatacagagaggggactggggtcagcaggagctgctgatcatcaccgtggctgtagcattcatcattatcagcacagtggggctacttttttactgccgccggtgtaaaagccataagccagtcgccatggaagatcccgatttacttgctcgtagtgtgggcgtggatacacaggccatgccagcaattgaactgaatccactgtctgcttcttcctgcaataatctcaaccagcccgaaccgtctaaagccagtgtgccaaatgagttagtaacgttcggtcctaattccaaacagagacctgtggtttgctctgtcccaccaagactcccccccgcagctgttccctcgcattcagacaacgagcccgtgataaagcgaacatggagttccgaggagatggtttaccctgggggtgccatggtgtggcctccaacctactcacggaatgaaaggtgggaatatcctcacagcgaggtgacacagggccctctgccaccatctgcccaccggcacagtactcctgttgtgatgcctgagcctaatggtctgtacggaggtttcccttttccactggagatggagaataagagagcacccttaccaccgcggtatagcaatcagaacctagaagatctcatgccttccaggccaccatctcctagagaacgactcgtggctccctgtctgaatgaatatacagcaatctcttattaccactcccaatttagacaggggggcgggggtccctgtctggccgatggtgggtacaagggtgtcggcatgagactctcacgagccggtcctagttatgcagtgtgtgaagtggagggtgcacccctggccggccaaggacagcccagagtgccccccaattacgaaggatccgatatggtcgagagcgattacggttcatgcgaggaagtcatgttctag

SEQ ID NO: 187507 - DNA, 13770 bp, Artificial Sequence
  Description of Artificial Sequence: Synthetic coding sequence
atggacatcatcatgggccactgcgtgggcacccggccccccgcctgttgtcttatcctgctactgttcaagctgcttgccacagtaagtcagggactgcctggtacggggccactcggcttccacttcacacactcgatctataacgcgaccgtatacgagaattccgctgcgagaacatacgtgaatagccagtctagaatgggaatcaccctcatcgacctgtcttgggatatcaaataccgcatcgtctcaggcgacgaggaaggcttttttaaggctgaggaagtcatcattgctgatttttgcttcctccggattcggactaagggaggcaacagcgcaatactcaatagagagatccaggacaactatttacttatcgttaagggcagcgtgcgaggagaagacctcgaagcctggaccaaggtgaacatacaggttttggatatgaacgacctgcgtcccctgttttcacccaccacttattccgtaacgatcgccgagagcaccccgcttagaacttctgtggcccaagtgacagcaaccgatgctgacattggatctaatggggagttctattactattttaagaataaggtggacctgttctctgtgcacccgacatcaggcgttatttcgctgtcgggcagattgaactacgacgagaagaatcgctacgacctggagatcctggctgttgaccgggggatgaagctgtacggcaacaatggtgtctcttctaccgctaaactttacgtccatatcgagaggataaacgagcacgcccctactattcatgttgtgacccacgttccgttttccctggaaaaggaaccaacctacgccgtggtgacagtagatgatttagatgacggggccaacggtgagatcgaaagtgtgagtatcgtggccggcgaccccctagatcagttcttcctggcgaaggaaggcaaatggctaaacgagtacaagattaaggagaggaagcagatcgactgggagtcgtttccctacgggtataatttgactctgcaagcaaaggataaaggaagtcctcagaagtgcagtgccttgaaagctgtctacatcgggaaccctacacgggacaccgtcccaataaggtttgagaaagaggtgtatgatgtatctatctcagagttcagccctcctggcgtagtcgtggctatcgtcaagctctcccctgagccaatcgacgtggagtacaagttgtccccaggggaggacgctgtatattttaaaatcaatcctcggtccggccttatcgtaaccgcccgccccctgaatacagtgaaaaaggaagtatacaagctcgaggtcaccaacaaggaaggggacttaaaagcgcaggtgaccatctctatcgaagatgcaaatgatcacacacctgagttccaacagccgctttacgacgcatatgtaaacgagtccgtgcccgtaggcacctcagtgctaaccgtgtccgcctccgataaggacaagggagaaaacggttacattacatattccattgcctcactgaaccttctgccctttgtcattaaccagtttacgggcgtgatttctactaccgaggagctggacttcgagagctcacctgaaatctatcgctttatcgtccgtgcctcggattggggtagcccataccggcacgaaagcgaggtcaacgtcacaatccgcataggaaatgttaatgacaattccccattgtttgaaaaagttgcttgtcagggcgtcatttcctatgacttccccgtgggcggacatatcaccgccgtgagcgccattgatatagatgagcttgaactggttaagtacaagataattagtggcaatgaactgggttttttttacctgaatcccgactctggggtgttgcaactgaaaaagagcctgactaactctgggataaaaaatggtaactttgcactcaggattactgcaaccgacggtgagaatctggcggatcccatgtcgatcaacataagtgtgttgcatggtaaggtcagctccaagagtttttcctgtcgagaaacccgcgtggcacagaagttggccgagaagctgctgatcaaagccaaagcaaatggaaaactgaacctggaggatggcttcctggacttttacagcatcaacagacagggcccctactttgacaaatccttcccatccgatgtcgcagtgaaggaggacctgcccgtgggagccaacattctcaaaattaaggcttatgacgcggatagtggtttcaacggtaaagtgttgttcaccatcagcgacgggaataccgactcttgctttaacatagacatggagaccggacagctgaaagtgctgatgcctatggaccgggaacatacagatctctatctgttgaatatcaccatttacgatctcggaaacccccagaagagcagttggcgattattaacgatcaacgtggaagatgcgaatgataattcccccgtattcatacaggatagctattcagtcaatatcttggagagtagcggtattggaacagaaatcattcaggtcgaagcacgcgacaaggatcttggctcgaacggagaagtcacctacagcgttctgactgacactcaacagttcgctataaattcttccactggaattgtatacgtcgctgaccagctggacagagaaagtaaggcaaattactctctgaagattgaagcccgcgacaaggcagaatctggacagcaactgttttctgtggtgaccttgaaagtctttctagatgacgtgaacgactgttcccccgccttcatccctagttcctattccgtgaaagtccttgaagatctgcctgtggggactgtgatagcatggctggagacgcacgatccagatctcggtctgggaggacaggtcaggtactctctcgtgaacgactacaatggacggtttgaaatcgataaggcgagtggcgctatcaggctgtccaaagagttggattacgaaaagcaacagttctataatctcacggtgagggcgaaagataagggccgacctgtctcccttagcagcgtgagcttcgtcgaggtagaggttgtcgatgtgaatgagaacctgcataccccctatttccccgattttgcagttgttggttctgtgaaagaaaattcccggataggcactagcgtcttacaggtgacagcccgtgatgaagactcaggccgggacggtgaaattcagtactccatcagggacggatctgggctaggccgtttctcaattgacgacgaatccggagtgattacggctgcagacatactggatcgcgaaactatgggtagttattggctgacagtctacgctacggataggggtgtagtcccactgtactctaccatcgaggtgtatatagaagttgaggatgtgaatgacaacgcgccactgacttctgagcctatctactaccctgttgtgatggaaaacagccctaaggatgtctcggtcatccagatccaggctgaggatccagatagcagctcaaatgaaaagttgacctacaggatcacatcaggtaatcctcagaacttctttgcgattaatatcaagactggcctcattaccactacttcccgtaagctagacagagaacagcaagccgaacatttcctggaggtcaccgtgaccgatggggggccaagccctaagcagtccacaatttgggtcgtcgtgcaggttctcgacgagaacgataataagccacagttcccggaaaaggtgtaccagataaagctccccgaacgcgaccgaaaaaagcgaggtgagccaatctatagggcatttgcttttgatagagacgagggcccgaatgccgaaataagttattccatagtcgatggtaacgatgatggcaaattcttcattgatccaaagactgggatggtgagctctcgaaagcagttcactgcaggaagctacgatattcttaccattaaagctgtggacaacggcaggcctcagaaatcctcgactgctaggcttcacatcgagtggatcaagaagcctcccccttcccctatacctctgacgttcgatgaaccgttctacaacttcaccgttatggaatctgacagagtgacagaaattgtgggagtcgtctctgttcagccagctaatacccccctatggttcgacattgtcggtggcaattttgatagcgccttcgacgcagaaaaaggggtcggtacaatcgtgattgccaaacctctggatgctgaacagcggtctatttataacatgagcgtggaagtgactgatgggactaatgtcgccgtgacccaggtgttcatcaaagttctggataacaacgacaatggtcctgagttcagtcagccgaattatgatgtgactatctcagaggacgtgctgccagacactgagatcctgcaaatcgaagccactgatcgggacgagaaacataagttgagctacaccgttcattcctccatcgatagcatcagtatgcgcaaatttcgaattgatccatccacaggtgtgctgtataccgccgagaggctggatcacgaggcacaagacaaacacattctcaacattatggtgcgggatcaggaattcccttatagaaggaacctggcccgagttatagtcaacgtcgaggacgccaatgatcattccccatattttacaaaccccctctacgaagctagtgtatttgagtccgcagctctggggagcgccgtgctgcaggtgacagctttggataaggacaaaggcgagaacgcagaactaatctacacgatcgaagctggaaacacagggaacatgtttaaaattgagccggtgttaggtattatcaccatctgcaaagagcctgacatgacgactatgggccagtttgtgctgagtattaaagtcactgaccaaggttctcccccgatgagcgcaacagctatcgttcgaatctcagtgacaatgagtgataatagccacccaaaatttatccacaaggactaccaagccgaggttaacgaaaatgttgatattggcacgagcgttatactgatttccgcaatatctcaatcgacactgatctatgaagtgaaggacggcgacatcaatgggatcttcacaattaacccttacagtggggtcattaccactcagaaagccctggattatgaaaggacatcaagctatcaattgataatccaggcaaccaatatggcaggaatggcttcaaacgccacagtcaatattcaaatcgttgacgagaatgataatgcccctgtgtttctgttcagtcagtattcaggtagcctcagtgaggcagcaccaataaactccatcgtcaggtctttagacaacagtcctcttgtgatcagagcgacagacgcggattcaaaccgtaatgctctcttagtgtatcagatcgtagagagcacagccaaaaaattcttcaccgtggatagcagcacaggcgctattcgaactattgcgaatctcgaccatgagaccattgcgcacttccatttccatgttcacgtgagagacagcgggagcccgcagttgactgccgagtctcctgttgaggtgaacatcgaggtgacggacgttaatgacaaccctcctgtgtttacacaggccgtgttcgaaacaatcctgctgctgccaacctatgtcggtgtggaagttctgaaagtcagtgctactgaccccgattcggaggtgccacccgaactcacctactccctgatggaaggctcgctcgaccactttcttatcgattcaaatagcggagtcctcaccattaaaaataataatctttctaaggatcactatatgctcatcgttaaggtgtccgatgggaagttttactccacgtctatggttaccatcatggtgaaggaggccatggactcaggcctacacttcactcagagcttctactctacgtccatctctgagaataataccaatatcacaaaggttgcaatcgtgaacgccgtcgggaatcggctcaatgagcctctcaagtattcgattctcaaccccggtaataagttcaaaataaagagtacaagtggcgtcatccaaacaactggagttccctttgaccgggaggagcaagagctatacgagcttgtggtggaggcatcaagggagctggatcatctgagagtggcccgcgtcgtggttagagtcaatattgaggatattaatgataactcccctgttttcgtcggccttccctactatgcagctgtacaggtagatgcagaacccggaacacttatatatcaagtcactgctattgacaaggataaaggtcctaatggcgaagtgacatatgtgctgcaggacgattatgggcatttcgaaattaacccgaattccggtaatgtgattctgaaggaagcatttaactccgatctgtctaacatcgagtatggagtgacaatcctggcaaaagatggcggcaaaccttcactgtctactagtgtggaactgccgatcactatcgtcaataaagcaatgccagtatttgacaagcctttctacactgccagcgtaaacgaggacattcgcatgaacactccaatcctctccatcaatgccactagccccgaagggcaggggattatttatattatcatcgacggggacccctttaaacaattcaacatcgacttcgataccggggtccttaaagtggtgtccccactggactacgaagttactagcgcttataaactgactattcgcgcctcggacgccctgactggagcccgggcagaggtgaccgtggatttgcttgtgaatgatgtcaatgacaatccgcctatcttcgatcagcctacttacaatactacactgagtgaggctagtctcatcggaaccccagtgctgcaggtggtaagtattgacgctgactccgaaaacaataagatggtgcactatcaaatcgtacaggatacctacaactctaccgattattttcacattgacagttcctctggcttaatcttgaccgcaagaatgctggatcacgagctagttcaacattgcacactcaaagtgaggagcatcgattccggctttccctctttaagtagtgaagtcctggttcacatctatatttccgatgtgaacgataatccacctgtgttcaatcagctgatttatgagtcttatgtgagcgagcttgcgccgagagggcactttgttacatgcgtccaggcctctgatgctgactccagtgattttgaccgattagagtatagcatcctttctggaaacgacaggacctcatttctgatggatagcaagtctggggtaataacactgtcaaatcatcggaagcaaagaatggagccgctgtactctctgaatgtgagcgtgtctgacgggctgtttacatccacggctcaggttcatattagggtgctgggggcaaatctgtattcacctgccttcagccagagcacctacgtggccgaggtcagggaaaatgtggctgcaggaactaaggtcatacatgttagggccaccgatggtgatcccggtacatatggccagattagctatgccataattaatgatttcgccaaggatcgttttctaatagactcgaatggtcaagtaattactacagagaggcttgacagagaaaatcccttggagggagatgtgagcattttcgtaagagcactggatggcggcggacggaccacattctgcacagtgcgagtgattgttgtggatgagaatgacaacgcgccccagttcatgactgtcgagtaccgggcatcagtacgagccgacgtcggtagaggccatctggttacccaggtacaggctatagatccggatgacggggccaacagtagaatcacttattccctgtattcagaagccagcgtttctgtcgctgatctcctcgagatcgaccctgataatggttggatggtaaccaaggggaacttcaatcagctgaaaaacacagtgctgagtttctttgtgaaagccgtcgacggcggaattccggtgaaacatagcttaatcccagtgtacatacatgtccttccaccagaaactttcctgccttccttcactcagagtcagtactcctttaccattgcagaggatactgccattggatccacagtcgacacactgcgcatcctgccgagtcagaacgtatggttttcaacagttaacggggagcgcccagagaacaacaagggtgggattttcgtgattgagcaggagacaggcactataaaattagataagaggctggacagggaaaccagtcctgctttccatttcaaagtggccgctactatccctctcgacaaggtagatatcgtgtttacggtagacgtagatatcaaagtgctggatttgaacgataataagccagtctttgaaacctcctcttacgatacaatcattatggagggcatgcctgtgggaacaaagctgacgcaggttagggccatcgatatggattggggggccaacggccaggtcacttattctctccactccgactcacagcccgaaaaggttatggaggcattcaatattgatagcaatacgggctggatttcaaccttaaaggacttagatcacgagactgacccaaccttcacattcagcgtagtggccagcgatctgggtgaggcctttagcctctcatcaacagcactagttagcgtgagggttactgacattaacgacaatgctccggtgttcgcccaggaagtctatcgcggcaacgtgaaggaatcagacccacctggcgaggtagttgcagtactatctacatgggatagagatacctctgacgtgaaccgtcaggtaagctaccacataacaggcggtaatcctcgcggacgtttcgccttaggactcgtccagtctgagtggaaggtttatgtcaagaggcctctggatagagaggagcaggacatctactttctcaatatcacagcgactgacggcctgttcgtcacacaggcgatggtggaggtcagtgtgagcgacgttaatgataacagtcctgtgtgtgaccaggtcgcctacaccgccctcctcccggaggatattccatctaacaaaatcatcctgaaagtctctgctaaagacgctgacattggctccaacggatatatccgatactctttgtacggatcaggtaattcagagtttttcttagacccagagtcaggcgaactcaagactcttgcattgctggatcgggagcgcatcccagtgtactcactgatggcaaaggccacagacgggggaggtagattttgccagagcaacatacatttgattctggaagacgttaacgacaacccgccagtcttcagcagcgaccattataacacttgtgtgtacgagaatactgccacaaaggccctgctgactagggtgcaagccgttgatcctgacatcggcatcaataggaaggtggtctactctctggccgactctgctggcggcgtgttcagtatcgactccagcagcggcattatcatcctggaacagccactcgacagggagcaacagagcagttacaacattagcgtgcgggcaaccgatcagtcccccggccagtctctgtctagcctgacaaccgtgacaatcacggttctggacatcaatgataacccgcccgtctttgagagaagggactacctggttaccgttcctgaggacacaagcccagggactcaggtgctggcggtgtttgcaacctcaaaggatattgggacaaatgccgagattacctatcttattcgcagtggcaatgagcaaggcaaattcaaaatcaacccaaagacggggggcatcagcgttagtgaagttcttgactatgagctgtgcaagagattctatcttgtggtggaagccaaggacggcggtaccccagcactgtccgctgttgctaccgttaatatcaatctcaccgatgttaacgacaacccgcccaaatttagtcaggacgtgtactcagccgtaatctcggaagacgctctcgtgggagatagtgtgatactcttgattgccgaagatgttgattcacagcctaatgggcagatacacttcagcatcgtgaacggcgacagagataacgagttcactgttgaccccgtcctaggcctggtgaaagtgaagaaaaaattggatagagagcgcgttagcggctatagtctcctggtacaggcggttgattctgggatccccgcaatgtcttctaccgctacagtgaacattgatatctcggacgtgaatgacaacagtcccgtgttcacacctgctaattatacggcggtgatccaagaaaataaacccgttggaacatctattctgcagttggtcgtaaccgacagagactccttccacaatggacctccattttcttttagtatcctgtccggaaatgaggaggaagagtttgttctggatccccatggcattctgcggagcgcagttgtgtttcagcacacagagagcctcgaatacgtgttgtgcgtgcaggccaaggattctgggaagccacagcaagtttcccacacctatattagggtccgcgtgatcgaagaaagtacccacaaacccactgcaattcccctggaaattttcatcgtgacaatggaggacgactttcctggcggcgtaataggaaaaatccacgccacagatcaggatatgtacgacgtgctgaccttcgctctaaagtcggagcaaaaatccctttttaaagtcaattcccacgacggaaaaatcatcgcccttggcggcctggattccggaaagtatgtgctgaatgtgtccgtcagcgacgggcgcttccaggtacctattgacgtggttgttcacgtggagcagctggtgcatgagatgttgcaaaacactgtgacaattagatttgaaaatgttagccccgaggatttcgtcgggttgcatatgcacgggtttcgccggactctccgtaacgccgtgttgacgcagaagcaagatagcctccgcatcatttccatccagccagtcgctgggacgaatcagctcgacatgttgttcgcagtggagatgcattctagcgaattctacaaaccagcctacttaatccagaagctatccaatgctcggcgccacctggaaaacataatgaggatatcagccatcctggagaaaaactgctctggactggattgccaggaacaacattgtgagcagggactgagcctcgactcccacgccctgatgacctacagtactgcccgaatttctttcgtgtgccctagattttaccgtaatgtccggtgcacctgtaacggaggcttgtgcccggggagcaacgatccatgcgtggaaaaaccgtgtccaggcgatatgcagtgtgtctcttacgaagcatctcgacggccctttttgtgccaatgcccacccggcaagctgggtgaatgcagcggccatacttccttgtccttcgcaggcaattcctatatcaagtacagattgtccgagaactctaaagaggaggatttcaagttagcgctccggttgcgaaccctgcagtccaacgggattattatgtacacacgcgccaacccatgcattatacttaagattgtggatgggaagttgtggttccagttggattgcggttccgggccaggcatcttgggcataagcggacgggctgtgaatgacggttcctggcactcagtgtttctggaactaaataggaacttcaccagtctgagtttagatgactcttatgtcgagagaagacgggcccctctgtattttcaaacgcttagcaccgagagttctatctacttcggagcactcgtgcaggctgacaacattagatcgctgactgacactcgagtcactcaggtgctgagcggcttccaaggatgcttggactcagtaattctcaacaacaacgaactccctctacagaacaaacgttcatcttttgcggaggtggttggcctgactgagttgaagctaggctgtgtactttacccagacgcctgcaaacgatccccatgtcaacatggtggatcctgcactggtctgccttctgggggataccagtgcacctgtcttagtcagttcacgggcagaaactgcgagtccgagataacagcttgtttccccaacccttgcaggaacggcggaagctgcgacccgattggcaacacgttcatttgcaattgcaaggctggcctgactggggtcacttgtgaagaggacattaatgagtgcgagagagaggagtgcgagaacggtgggagctgtgtgaacgtattcggtagcttcctgtgcaactgtactccgggctacgtggggcagtattgcggactgaggcctgtggtggtgcccaatattcaggccgggcactcgtacgtaggaaaggaagagcttattgggatcgcagtggtactgtttgtgattttcatcctcgtcgtgttatttatcgtcttcaggaagaaagtattccgcaaaaattattctagaaataatattactctggtgcaagacccggccaccgcggcgctgctcaacaagagcaatggcattcccttccgaaacctgagaggcagcggcgacggacggaacgtctaccaggaagtcggacccccacaggttccggtgaggcctatggcctatactccttgtttccaatctgatagcaggtccaacctggacaaaatcgtagacggattgggcggagaacatcaagagatgaccacctttcatcccgaaagtccccggattctcactgcaaggcggggcgtcgttgtttgttcggtggccccaaacctacccgccgtctctccttgtcgttcggactgcgattctattcggaagaacggttgggacgcgggaaccgagaacaaaggtgtcgatgatccgggcgaagttacatgtttcgcaggaagcaataagggatctaacagtgaggtgcagagcctgtccagctttcaaagcgattccggggatgacaacgcttctatcgtgacggtcatccagcttgtcaacaacgtggtcgacacaatcgaaaacgaagtcagtgtaatggaccaaggacagaactataacagggcttaccactgggatacaagcgattggatgcctggtgcaagactgagcgatattgaagaggtgccaaactatgagaatcaggacggcggctctgcacatcaaggatccacccgggagttagaatctgattattacttagggggttacgacatcgattccgagtatccccctccccatgaggaggaatttctcagccaagatcagctcccaccccctcttccagaagatttcccagaccagtatgaggcgctgccaccttcccagccggtttccctggcaagtaccctgtctccagactgtcgtagacggccccagttccatcctagccagtatctgcctccccacccatttccaaacgaaactgacctcgttggaccaccggcaagctgtgagttttcaactttcgccgtttccatgaaccagggcaccgaacccactggacctgccgattcggtgtcactgtccttgcacaattcccgcggcacttcctcttctgacgtgagcgcgaattgcggctttgacgacagcgaggtagcgatgtctgactacgagtcagtcggcgagctgtctctggcatcactgcacatcccatttgttgagacccaacatcagacacaagtgtag

SEQ ID NO: 187508 - DNA, 13674 bp, Artificial Sequence
  Description of Artificial Sequence: Synthetic coding sequence
atggacatcatcatgggccactgcgtgggcacccggccccccgcctgctgtcttatcctgcttctgttcaaattactcgctaccgtttcgcagggcctcccaggaacaggacccttgggcttccactttacccattcaatttataatgccaccgtgtacgagaactctgccgcccgcacttatgttaactcgcaaagtagaatgggaataactttaatagacctgtcttgggacattaagtatagaatagtctccggagatgaggagggtttctttaaggcagaggaggtgatcatagctgacttctgctttctccggatcaggacgaaaggggggaattctgcgatcctgaacagggagattcaagataattacctgttgatcgtcaagggatctgtcagaggggaggatttggaagcgtggacaaaagtaaatatccaggtgctcgatatgaatgatctacggcccctgttctctcccacaacatactctgtgaccattgcagagtccacacccctgcgcacatccgtagctcaagtgaccgcaactgatgccgatatcggttcaaatggtgaattttactactacttcaaaaataaagtggatcttttttccgtccatccaacctcaggggtaatcagcctgtcaggccgcctgaactatgatgagaagaatcgctacgatctcgaaatcttagctgtggatagaggaatgaaattatacggcaacaatggggtgtctagcaccgcaaagttgtacgtgcacatcgaacgcataaacgagcacgcccccactatccacgtggtgactcacgttcctttttccctagagaaggaacctacctacgccgtggtcaccgtagatgacttagacgacggcgcaaacggagagatcgaatctgttagcatagtggccggcgaccccctcgaccagttcttccttgccaaagagggaaagtggcttaacgaatacaagatcaaagaaaggaagcagatcgactgggaatccttcccctacggctacaatctgactctccaggcgaaggataaaggtagcccacagaagtgcagtgcccttaaagctgtttacatcgggaaccctaccagggacacagttcctatcagattcgaaaaagaagtttacgatgtgtcgattagcgagttttctcctccgggtgtcgtcgtggcgatcgttaaactgtctcccgaacccatcgacgtggagtataagctatcccccggagaagacgcagtttactttaaaatcaatccaaggtcaggactgatcgtcacagcccggccattaaatactgtgaaaaaggaggtctataaactcgaagtgacaaacaaggaaggagacctgaaagctcaggttacaatttcaattgaagacgcaaacgaccatacccccgaatttcagcagccactttatgacgcatacgtgaacgaatctgttcccgtgggaacctccgttctcactgtgtccgcatcagacaaagacaagggagaaaatggctacattacctatagcattgcttcactgaacctgcttccctttgtaattaatcagttcacaggcgtgatcagtacaacagaggaactcgatttcgaatcctcccctgaaatatacaggtttattgtccgggcctcggactggggatctccctaccggcatgagagcgaggtgaacgttactattagaattggcaacgtcaacgacaattcacctctgttcgaaaaggtggcatgtcagggcgtgatcagctacgatttccctgtcggggggcacattaccgcagtttccgccattgatatcgacgaactcgagcttgtgaaatacaagatcatcagcggtaatgagcttggattcttctatctgaatcctgattcaggagttttgcagctgaaaaagagtctgactaacagtgggataaagaatggcaactttgccctgcgcataactgcaaccgacggggagaacctcgctgaccccatgtcaatcaatattagcgtcctgcacggaaaggtgtcgagtaaaagtttctcatgtcgggagactagggtggctcaaaagctggccgaaaagctccttatcaaagcaaaggcaaacggcaaactcaacctggaggacgggttccttgacttttactccatcaaccgtcagggcccgtattttgacaagtccttcccctcagatgtggccgtaaaagaagatctccctgtgggagctaatatccttaaaatcaaagcttatgatgcggactcaggcttcaatgggaaagttctgtttaccatctcggacggaaataccgattcttgcttcaacatcgatatggagactggtcagttgaaagtgctgatgcccatggatagagagcataccgatctgtacctgctcaatatcactatttatgatttagggaaccctcagaaaagcagttggcgactattgacaattaatgtggaagacgctaacgacaactcgcccgtttttatacaggatagctactcagtcaatattctggagtctagcgggatcggcacagagatcatacaagtggaggccagagacaaagatctcgggtctaatggggaagttacttattccgtgctaaccgatacccagcaattcgctattaatagcagtacaggtatcgtgtacgtggcagaccaactcgatcgcgaatctaaagccaactactccctcaagattgaagctcgggacaaggccgagtccgggcaacagctgttctcggtggtcaccctgaaggtcttccttgatgacgtgaacgattgcagccccgccttcattcccagctcctatagtgtgaaggtgctggaagacttgccagtcggcacagtgatcgcatggctggagactcacgatccggatctcggacttggcgggcaagtgcggtactcattagtgaacgactataatgggaggtttgaaattgacaaggctagtggcgccatacgcctgagcaaggagcttgattacgaaaagcagcagttttacaatctcaccgtccgggctaaagacaaaggccgtccagtatcactcagtagcgtaagttttgttgaagtggaagttgtcgatgtgaacgaaaacctgcataccccatacttccccgactttgccgtcgtggggagtgttaaggaaaactcccgaatcggaacaagcgtgctacaggttaccgccagagatgaggatagcggacgtgacggcgaaatccagtatagcattagagacggcagcggactgggccgattctctatcgacgacgaatcaggagtgatcacagcagccgatatcctggacagagaaaccatgggttcttattggctgacggtgtacgcgaccgaccgcggagtggtccctctctatagcactatcgaggtgtatattgaggtagaggacgtcaacgacaacgctccccttacctccgaacccatatactacccagtcgtgatggagaactcgcccaaagatgttagtgtgatccagatccaagctgaggatcccgactcgagttccaatgaaaaattgacgtatagaattacgtccggcaaccctcagaacttttttgccatcaacatcaagacaggcctgatcacgaccacttcccgtaaacttgacagggaacagcaggcagaacactttctggaggtgactgttactgatggaggcccatctccaaaacaatccacaatctgggtggtcgtgcaggttctggacgagaatgataataagcctcagtttcctgaaaaggtatatcaaataaagttacctgagcgtgataggaagaaaaggggggagcccatctatcgggccttcgcattcgacagagatgagggcccaaatgcggagatctcatacagcatcgtcgacggcaatgacgatggaaagttctttatcgaccctaagactgggatggtttcctcacgaaaacagttcacagcaggatcatacgatattttgactattaaggccgttgacaatggccggccccagaaaagctctacagcgcggctgcacatcgagtggataaagaaacctccaccatctcccattcccctgactttcgatgagccgttctacaattttacagtgatggaatcagacagggtgacagagatagtaggcgtcgtttcagttcaaccagccaatacgccactctggttcgatatcgtcgggggtaacttcgattcggcttttgacgcggaaaagggtgttggaaccatcgtcatcgcgaagcctctagatgccgaacagcggagtatatacaatatgtctgttgaggtgaccgatgggacgaatgtagctgtgacacaggtctttatcaaagtgttagacaacaacgataatggccctgaattttcccaacctaactacgatgtcaccatctctgaagatgtgctaccagatacagaaattctgcaaatcgaagcaactgaccgagacgagaaacacaaattgtcatatacggttcacagtagcattgactccatatcaatgcgcaagtttcggatcgacccgtctactggggtgttgtacactgctgagcgacttgaccacgaagcacaggataagcatatcctcaacatcatggtacgggatcaggagtttccatacagacgcaatttggctagggtgattgtcaacgttgaggatgctaacgaccattccccatacttcaccaatcctttatatgaggccagcgtgtttgagagcgccgcccttggcagtgcggtgctgcaggtcaccgccctggataaagataagggagaaaacgcagagctcatttacacgatcgaggccggaaacaccggcaacatgttcaaaatcgaacccgtgctaggtattatcacaatctgtaaggagcctgacatgactaccatgggccagtttgtgctgtccattaaagtgaccgaccagggcagccccccaatgtctgcgacggcaatagtgcgcatctcagttacaatgtcagacaacagtcacccgaaattcattcataaggactaccaggccgaggtcaatgaaaatgtggacatcggaacatcagtgatcttgatctccgccatatcccagtccactctgatctacgaagtcaaagatggtgatatcaatggcatttttacaattaatccctattccggggtgatcaccacccagaaagctctggattatgaaagaacttccagctatcagctcatcatccaagctaccaatatggctgggatggcatccaacgctaccgtaaacatccaaattgtggacgaaaatgataacgcccccgtttttctatttagtcaatatagcgggtcactatccgaggccgccccaatcaattctattgttcggagccttgataactctcctctggttatccgcgcaactgacgcggactccaatcgtaacgcattactggtgtaccagatcgtggagagcaccgcaaagaaattcttcacagttgattctagcactggcgcgatcaggactattgcaaatctggaccacgagaccattgcgcattttcactttcacgtgcacgttagagacagtggaagtccgcagttgacagccgagtccccggtggaagtcaatatcgaggtgaccgatgtcaacgacaatcccccagtctttacacaggcggtgtttgaaacgatcttacttttacccacctatgtgggagtggaagtgctgaaggtcagcgcaaccgacccggattccgaggtccctccagagctgacttatagccttatggaagggtcccttgatcacttcctgatcgatagtaacagcggcgtgctaacaatcaaaaacaataatctgagcaaagaccattatatgctgatcgttaaggtgagtgacggaaagttttactccaccagcatggttactatcatggtgaaagaggcgatggattccgggctgcactttacacagtctttctacagtacaagcatttcagaaaacaacactaatatcacgaaggttgccatcgtgaacgctgtgggcaacagactcaatgagcccctgaaatatagcatccttaacccaggcaataagttcaaaatcaagtccacgtccggagtaattcagaccactggggtgccgtttgatcgggaagagcaggagttatacgaactcgtcgtagaggcttcccgcgagttggaccacttaagggtcgcaagggtcgtcgtacgcgtaaacatagaggacattaacgataattcgccagttttcgtgggactcccctactacgcggccgtgcaggtggacgccgagcccggaaccctgatctaccaggtgactgccatcgataaggacaagggtccaaatggcgaagtgacatatgtgctccaggatgattatggtcacttcgaaatcaatcctaatagcggcaacgtgattcttaaagaggccttcaatagtgatctctccaacatagaatacggcgtgactattctggccaaagacggtggcaagcctagccttagcacaagcgtagagctaccgataaccatcgtcaataaagccatgccagtttttgataagcctttctataccgccagcgtgaacgaggacatccgcatgaacacacccatattatctataaacgccacgtcccccgaaggccagggaattatatacatcatcattgacggggacccattcaaacaattcaatattgacttcgacaccggggtgctgaaggtggtgtcccccctggactacgaggttacttcggcctacaaactaacaatcagggctagtgacgccctgacaggagccagggctgaggtgactgtcgatctcctcgtcaatgatgtcaacgacaatccacctattttcgatcagcccacctataacacaactctgagcgaggcttccctcatagggacccctgtcctgcaggtcgtgtcaatcgacgccgattcagagaacaataagatggttcactaccagatcgtgcaggatacttacaactccacagactatttccacatcgatagtagctccggtctcattctcacagccagaatgctcgaccatgaattagtgcagcattgtaccctgaaagtgaggagtatcgactcaggcttcccctctctgtcttctgaagtgttggttcatatctacatatccgacgttaatgacaatcccccagttttcaaccagctaatctacgagtcctacgtatccgagctggctcccagagggcacttcgttacttgtgtacaagcatccgacgcagattcctcagattttgatagattggagtactccatcctgagtggcaacgaccggacttcctttcttatggactccaaatcaggcgtcataactctgagcaaccatcgaaagcaacgtatggagcccctgtactcccttaacgtgtcagtgtcggatggcttgtttactagcacagcacaggtacacatcagagtgctgggagcaaacctctatagccccgcctttagccagtctacttatgtggccgaagtgagggagaacgttgcagcagggacaaaagtgatacatgttcgcgccaccgatggggaccccgggacctacggccagatttcctacgcaataataaatgattttgctaaggatcgctttctcatcgactccaatgggcaggtgattaccaccgaaagactagacagagaaaacccgctggagggagacgtttccatctttgtgagggctctggacggcggcggtaggacgacgttctgtacagttcgtgtcatcgttgtcgacgaaaacgataacgccccacagttcatgacagttgagtacagagcctcagttcgcgcagacgtgggacggggacatctagtgacacaggtacaagcaatcgatccagacgacggggcaaactcaagaattacatatagtctctactctgaagcctctgtatctgtggccgacttgctggaaatcgatcctgataatggctggatggtgaccaaagggaattttaatcaattaaaaaatactgtgctctcattcttcgtgaaggccgtcgacggcggcattccagtgaaacactcactgatacccgtatatatacacgtgctcccgcctgagacattcctcccctccttcacacagagccagtactctttcacaattgctgaagataccgcgatcggcagtacagtggacaccctgaggattcttccgtcccaaaatgtctggttctcaaccgtcaacggcgagagaccagaaaataataaagggggaatttttgtgattgagcaggaaaccgggaccattaaattggataaacgcttggacagagagacaagcccagctttccacttcaaggtggccgcaactattccactcgataaggtcgatattgtcttcacagtggacgtggacatcaaggtcctagatctcaatgacaacaagcctgtcttcgagacttcaagttacgatacgattatcatggagggaatgccagtgggtacaaagttgacccaggttcgagctattgatatggattggggcgcgaatgggcaggtgacatacagcctgcactccgacagtcaaccagagaaggtcatggaggctttcaacatagactcgaacaccggctggatcagtaccttgaaggatctggaccatgaaaccgaccccacgtttacattttctgtggtggcaagcgatcttggcgaggccttcagcctgtcaagcactgccctcgtgagcgtacgcgtgacagacattaacgataatgcccccgtattcgctcaggaagtctatcgaggcaatgtgaaggagtctgaccccccaggagaagtggtagcagtgctgtccacttgggatcgggatacctccgacgtgaaccggcaggtctcctatcacatcactggagggaatccgcgtgggcgtttcgctctgggactggtccagtcggagtggaaggtgtatgtgaagcggccacttgaccgggaggaacaagacatctactttctgaatatcactgctacggatggcctgttcgtgacccaggccatggtggaggtatccgtctcggacgtgaacgataattctccagtctgcgaccaagtggcatacactgcactcctaccggaagacatcccatcaaacaagattatcctcaaggtctccgccaaggacgcagacataggatctaatgggtatatcagatactcgctctatggtagcggaaactccgaattttttttagatcctgagtccggcgagctgaagaccctggcactccttgatagggagagaatcccagtatactccctcatggctaaggcaacagatggcggcggacgtttctgccagagcaatattcatctaattctggaagatgtgaacgacaaccctcctgtgtttagctccgaccactataatacctgcgtatatgagaacaccgcaactaaagcactgctgactcgtgtgcaggctgtcgatcccgatataggcatcaaccggaaggtggtgtatagtctggccgactccgcagggggcgttttttctatcgattcgtcctcgggtatcattattctcgaacaacccctggatcgcgagcaacagagtagctataatattagtgtgcgggcgacagatcagagcccaggccaatcactgtccagcctgaccacagtgaccatcactgtgctggatattaacgataaccctcctgtttttgaacggagggactatctggtcacagtcccggaggacacctcccctggcacgcaggtgcttgccgtgtttgcgacctcgaaggacataggtaccaatgccgagatcacttacctcatccggtctggaaatgaacagggaaaatttaagataaacccaaagaccggaggtattagtgtgagcgaagttctggattacgaactgtgcaaacggttctaccttgtggtggaggcaaaagatggcggaacaccagctcttagcgcggtggctaccgttaatattaatttgacggacgtgaacgacaacccccctaagttcagccaggacgtgtacagtgctgttatctcagaggacgccttagtgggagatagtgtgatcttgttaatagccgaggacgtggactcccagcccaatggccagattcattttagtatcgtgaacggcgatagagataatgaattcacagtggatcctgtgctgggcttggtaaaggtcaagaagaagctcgatcgcgagagagtctccggatatagcctgctcgtgcaggccgtcgatagcggcatccctgctatgagttcaactgctaccgtgaatatagatatcagcgatgtcaacgacaattcaccagtttttactccagccaactacaccgctgtcatacaggagaacaagccagtcgggactagcatattgcagctggtagtcaccgaccgcgatagctttcataacggcccccctttcagcttcagcattctgtcaggcaatgaggaggaagagttcgtgctggacccacacggcatccttcgatccgctgtggtctttcagcacaccgagtcactggaatacgttctgtgtgtgcaggccaaggactccggcaaaccacaacaagtatcccatacctatatccgggttagagtaatcgaagagtccactcacaagcctacggccattccgctcgaaattttcattgtcaccatggaggacgatttccctggcggcgttattggtaagatccacgcaacagatcaggacatgtacgacgtgttaacttttgctctcaagagcgagcaaaagagtctatttaaagtcaacagtcacgatggtaagataattgcactgggtggcttagacagcggcaaatatgtacttaacgtgtccgtatccgacggccgattccaggttcctattgatgttgttgtgcacgtcgagcagctggtgcatgaaatgttgcagaatacagtcaccatcagatttgaaaacgtttcacctgaagacttcgtgggactgcatatgcatggatttcggaggaccctacgaaacgcagtattgacacaaaagcaggactcgctcaggatcataagcattcagcctgtcgctgggaccaatcaactggatatgctcttcgccgtggaaatgcacagctcggaattctacaaaccagcctatctgatccagaagttatctaatgcccggcggcacctagaaaatatcatgcggataagcgcaatccttgaaaaaaattgctcgggcctagactgccaagagcagcactgcgagcagggacttagcctggattcccacgctcttatgacttactctaccgccaggatatcattcgtatgtcctcggttctatcggaatgtccgatgcacctgcaacggcggactctgccccggcagcaacgacccttgcgtggagaaaccctgtccaggtgacatgcaatgcgtgtcttacgaggccagcaggcggcccttcctctgccaatgtccccctggtaaactcggcgaatgctctggacatacttcgctgagtttcgcaggaaacagttacattaagtaccggctctccgaaaattccaaggaggaagattttaaactggctctgcgactgagaacccttcagagcaatggcataattatgtatacccgcgccaatccgtgcattatcctgaagattgtggatgggaagttatggttccagctggactgtggttctgggcctgggattttaggaatctcaggccgtgctgtaaacgacggctcatggcatagcgtcttcttggaactgaatcgcaacttcacctcactgtccctagacgactcctacgtagaacgaaggcgcgctccactgtactttcagacattaagtacggagtctagcatctatttcggcgccttggtccaggccgacaacatcagatcactaacagacactagagttactcaggtcctgtctggttttcaagggtgtctggactcggtcatccttaataataacgaactccctttacagaataagaggagctccttcgcagaagtcgtgggcttgactgagctaaagcttggttgcgttctttaccctgatgcttgtaagcggtcaccttgccagcacggaggttcctgtaccggtctgccatccggggggtaccagtgtacctgtttgagtcagtttaccggcaggaattgtgagtctgagattaccgcgtgctttcctaacccatgccgcaatgggggttcctgcgatccaatcggaaacaccttcatttgcaactgtaaggctggcctcaccggcgtcacttgcgaggaggacataaacgagtgtgaaagggaggagtgcgaaaacggcgggagttgcgtcaacgtgtttggctctttcctgtgcaattgcacccctgggtatgtggggcagtattgtggcttaagacccgtggtcgtgccaaacattcaggcgggtcactcttatgtcggtaaggaagagctgattggcatagctgtggtgctgtttgtaatcttcatcctcgtagtgctgttcattgtttttcggaagaaggtgtttcgcaaaaactatagccggaacaacatcactttggttcaggatccagccaccgctgctttgctgaacaagtctaacggaataccattccgcaatctgcgtgggtcaggtgacgggaggaatgtgtatcaggaagtcggccccccacaggtgcctgtgagacctatggcctatacaccctgttttcagagtgactctcggtctaacctggacaaaatcgtcgacggcctgggtggcgagcaccaggagatgaccaccttccacccggagtctcctcggatcctgaccgcccggcggggcgttgtggtgtgcagtgtggctcctaaccttccagccgtgagtccctgtcgctctgactgcgacagcatacgtaaaaacggctgggacgcaggaaccgagaacaaaggggtggatgatccaggggaagtaacttgttttgctgggtcaaacaaaggatcgaacagtgaggtgcaatccctgtccagtttccagagcgatagcggcgacgacaatgcctatcactgggacacctcagactggatgcctggcgcgcggctgagtgacatagaggaggtccctaactacgagaatcaggatggtggctccgcccaccagggttccactagggagctggagtctgactactacttgggcggttacgacatcgattcagagtaccctccaccacacgaagaggaattcctttcacaggaccagctccctccacctttgccagaagacttccccgatcaatatgaggcccttccgcctagccagcctgtgtcattggcctccaccctttccccggactgcagacggcggcctcagtttcaccctagccaatatctgcccccacacccctttccaaatgagaccgaccttgtgggtccacctgcgtcatgcgaattttccactttcgctgtgtcaatgaatcagggcacagagcctaccggacctgctgactctgtgtcactctctctgcacaacagccgcgggacgagcagtagtgatgtgtctgctaattgtgggttcgacgatagcgaagtggccatgtcagactacgagtccgtgggggaactcagccttgcctcactgcacatccctttcgtggagacccagcaccagacgcaggtttag

SEQ ID NO: 187509 - DNA, 3765 bp, Artificial Sequence
  Description of Artificial Sequence: Synthetic coding sequence
atggacatcatcatgggccactgcgtgggcacccggccccccgcctgctgcctgatcttacttctgttcaaactcctggctaccgtgtcgcaggggctccccggcacaggacccctgggcttccattttacccactcaatatacaacgcaacagtttacgaaaactctgcggccagaacgtatgttaacagccaatcaaggatggggatcaccctgattgatctgagctgggatatcaagtatcgcattgtatctggcgatgaggaaggcttctttaaggcagaagaagtgatcatagctgacttctgtttcctgagaattagaacaaaggggggaaacagcgctatcctgaatcgcgagattcaggacaactacctcctgattgtaaagggctccgtccgcggcgaggacctcgaagcatggacgaaggtgaatatacaggtgctggatatgaatgatctgcgccctctgtttagccccaccacatatagtgtaacgattgctgagagtacacccctgagaactagcgtcgcacaggtgaccgccaccgacgcggacatcggttcaaacggggagttttattactacttcaaaaacaaggttgatttgtttagcgtccatcctacatcaggagtgatctccctttccggaaggctgaattacgacgaaaagaacaggtatgatctagagatccttgccgtcgaccgaggaatgaaactgtacggaaataacggcgtttccagcaccgccaagctgtatgtacacatcgagcgtataaacgaacacgctcccactatccatgtggtgacacatgtgccatttagcctggagaaagaacccacctatgctgtggtgaccgtggacgatttggatgacggcgcaaatggggaaattgaaagtgtatcaatcgttgcaggggatcccctcgaccagttttttcttgccaaagagggtaaatggttgaatgagtacaagatcaaggaaaggaagcagattgattgggagtcttttccttatggttataatctgaccctgcaggccaaagataagggttccccgcagaagtgttcagccctgaaagccgtgtacattgggaaccccactcgagataccgtacccatcaggtttgagaaagaggtgtacgatgtatcaatctccgaatttagtccacctggggttgtggtcgcaatcgtgaaactgagccctgagccaatagatgtcgagtacaaactgagccccggagaagacgcagtgtactttaagatcaaccccagaagcggactgatcgtaacagcccgcccccttaatacagttaagaaggaggtctacaagcttgaggtcaccaataaggagggcgatcttaaagctcaagtcacaatttctatagaggacgcgaacgaccatacccccgaatttcagcagccattgtatgacgcatacgtgaacgaaagtgtgcctgtaggtacatcagtgctgacagtgtcggcttcggacaaggacaaaggcgagaacggttatataacctacagtattgccagcctgaacttgctgcctttcgtcatcaatcagttcaccggggtgattagtacgaccgaagaattggattttgagtcctctcctgaaatttatagattcatcgtccgcgcaagcgactggggttccccctacagacacgagagtgaggtgaatgtcacgatcaggattggcaacgtgaacgacaactcaccactttttgagaaagtggcatgccagggcgtaatatcctacgatttccctgtgggtggccatatcaccgcagtgagcgccatcgacatcgacgagctcgagttggtgaagtacaaaatcatctctggaaacgagcttgggttcttctacttaaatcctgactctggcgtgcttcagctgaagaagagcttaactaacagcggaatcaagaacggaaacttcgcactccgaatcaccgcaaccgacggcgaaaacctggcagaccccatgtcaatcaatatctctgtgctgcatggcaaggtgtccagcaagagtttctcatgccgggagactcgtgtcgcacagaagctggccgaaaaactcttgatcaaggcgaaagcgaacggcaaactgaatctggaggatggctttcttgacttctatagcataaatcgccagggtccctattttgacaagagctttccctctgacgtagcagtgaaagaagacctgcctgtcggtgcgaacattctgaagatcaaggcatacgacgcagactccggatttaacgggaaggtgctgttcaccatctctgatggcaacaccgactcctgtttcaatatagacatggagacaggccagctcaaagtgttgatgccaatggatagggagcataccgatctgtatctactcaacatcaccatctacgatctaggaaaccctcagaaatcctcctggcgactgctgaccattaatgtcgaagatgcaaatgacaactcaccagtctttatccaggattcttattcagtaaatatcctggagtctagcggaataggcacggagatcattcaggtagaggctcgcgacaaagatcttgggtctaatggggaggtgacatactctgtgttgacagatacccagcagttcgccataaattcctccacgggcatcgtctacgtggcagaccaacttgaccgtgagagcaaggcaaactactctcttaagatcgaggcaagagataaggctgagtccgggcagcagctattctcagttgtgacccttaaggtgtttctggacgatgtcaacgactgctcccccgccttcattccatcaagttacagtgtcaaggtcttagaggacctacctgtgggcactgtgatcgcctggctggagacgcacgaccccgatctgggcctggggggccaggttcggtactccctcgtcaatgattacaacggtcgttttgagattgacaaagcgtccggagccattcgcctatccaaagagcttgactatgagaaacaacagttctacaatttgactgttagggccaaggataagggccggcccgtcagcttgagcagtgtctccttcgtcgaggtggaagtcgtcgatgtgaacgagaatctgcacaccccatactttcctgactttgcagtcgtgggctccgtgaaggagaattcccggatcgggacctccgtgctgcaggtgactgccagggatgaggactccggcagagacggagaaattcagtacagcattagggatggttctggactagggcgcttttcaattgacgacgaaagcggggtgatcactgcggctgatattctggaccgggagactatgggtagctactggttaaccgtgtatgctacggaccgaggggtggtcccattgtacagcaccattgaggtgtacattgaggtggaggacgttaacgacaatgcccctctgacaagcgagcccatatattaccccgttgtgatggagaatagccctaaagacgtgtccgttatccagattcaggccgaggatcccgattctagctccaacgagaagctgacttatcgcataaccagcggcaacccgcagaatttcttcgctatcaatataaagactgggtcttgttctgtggctcaagccggcatgcagtggcacgaccactcttcccttcagagccggactcctggatttaaggggtatccatgtctgtctcttctttcttcatgggactatcgccatgctcctccctgtccggcgaccttcctcaattcttag

SEQ ID NO: 187510 - DNA, 9669 bp, Artificial Sequence
  Description of Artificial Sequence: Synthetic coding sequence
atggtgaccaccgtggtggccgtgggcgacaccctggcccagcccttagccgccgctgaggttttcatagtggaaattacccttcaagatataaatgacaaccctcctgtgtttcccacagacatgttggatctgacagtggaggaaaatatcggagacggaagcaaaatcatgcagttgaccgccatggatgccgacgagggcgcaaacgcacttgtcacttatacaatcatcagcggcgcagacgattctttccgcatcgaccccgaatccggagacctcatcgccactagacggctagaccgggaacgacggagcaaatatagcttactggtgagagccgatgacggactgcagagctccgatatgcgcattaacatcactgtttctgacgttaacgatcatactcctaagtttagccggcctgtttattcctttgacatccccgaagatacgatccccgggtcactggtggccgccatactggctacagacgacgactctggcgttaatggagaaattacttacatcgtcaatgaggatgacgaggacggaatcttcttcctgaatcctattacaggcgtatttaatctaaccaggctgctggattatgaggtgcagcagtactatattcttacagtccgcgcagaggatggggggggtcagttcacaacaatacgggtgtatttcaacatattggatgtgaacgacaaccctccaatattcagcttaaacagttacagtacgtccttgatggagaatctccctgtcgggtccaccgtacttgtcttcaacgtgactgacgcagacgatgggatcaattcccagctgacatactccatagcgtcaggggattctttaggccagttcacggttgacaagaatggtgtgctgaaggttctaaaggctctggaccgggaatcccagtctttctacaacttggtcgtacaagtgcatgatctgcctcagatccctgccagtcggtttaccagcacggcgcaagtcagtattatccttctggatgtcaacgacaaccctcctacttttctttcccctaagctgacatatattccagaaaatacccctattgacactgtggtctttaaggcgcaagccacagaccccgatagcggccccaatagctatattgaatacaccctcctgaacccactcggtaacaagtttagcatcggcaccatagatggggaagtgagactgaccggagaactggaccgggaggaagtgagtaattacaccctcaccgtggtggcaactgataagggacaaccctccctctccagctctaccgaggtggtcgtcatggtgctggacatcaacgacaataatcccattttcgcccaggccttatacaaagttgagataaacgagaatacgctaaccgggacagacatcattcaggtgttcgctgcggacggcgacgagggaacaaacgggcaggtccgctatggaatagtgaacgggaacactaatcaagagtttagaatcgactctgtgacaggcgcaatcaccgtcgcaaagcctctggatcgcgagaaaacccctacctatcatctcaccgtgcaggccacagaccgcggatctacaccaaggaccgacacttctacggtgtccatcgtactgctggacatcaatgattttgtgcctgtttttgagctctcaccttactccgttaacgtgccagagaatcttggaacacttccccgaacaattttgcaggttgtggctcgtgatgacgatcggggaagtaacagcaagctgtcttacgtgctgttcggggggaacgaggataacgcattcacactctccgcctcaggcgaactgggagtgacccagagcttggatcgcgaaacaaaggagaggtttgttttgatgatcacagcgaccgattctgggagtccagccttgaccggaacaggcacaatcaatgtgatcgtggatgacgtaaacgataacgtccccactttcgctagtaaggcctatttcacaacgattccagaagatgctcccacgggtacggatgttttgctggtcaacgctagcgacgctgacgcctccaagaatgccgtcatcaggatcatcggggggaactcacagtttacaataaaccccagcaccggacagatcatcaccagcgcgctgctggacagggaaactaaggacaattataccctggtcgttgtctgtagcgacgccggcagtccagagcccctctctagcagtacatccgtcttggttacggttacggatgttaacgacaaccctccccggtttcaacaccatccctacgtgacacacatcccgagccctaccctgcctggcagcttcgtgttcgctgtgaccgtgacggacgccgacatcggccctaactctgagctacactatagtctgtctggtaggaactctgagaagtttcacattgatcctctccgtggtgcaattatggccgccggcccccttaacggagcaagcgaagtgacgttctcagtgcacgttaaagatgggggctcgttccccaagactgacagtacaaccgtgaccgtgaggttcgtgaataaggccgacttccctaaagtgagagccaaggagcagacattcatgtttccagaaaatcaaccggtgtctagccttgtgaccacaatcacgggcagcagcctgcgcggcgagcccatgagctattatatcgcgtccgggaatctgggtaacacattccagatcgatcagctcaccggacaggtctccatctcccaacccttggattttgaaaaaatccagaagtatgtggtttggattgaagcacgtgatggcggatttccccccttctccagctacgaaaagctagatatcacagtgttggatgtgaacgacaatgcccctatcttcaaggaagatccgtttatctcagagattctggagaacttgtccccgcgcaagattctcacggtatctgctatggacaaagatagtggaccaaatggccagctagattatgaaattgtgaacggcaacatggagaactcattctcaatcaaccatgccactggagagataaggagtgttcggccacttgatcgagaaaaagtgagtcactacgtgctcactataaaatcaagtgataaagggagtccatcccaaagcacaagcgtgaaggtcatgattaatatcctggacgagaacgacaatgctcccaggttttcccagatcttttccgcacatgtccctgagaacagcccactggggtacacagtgacccgagtcacgactagcgacgaagacattggcatcaacgccatttcaagatattcaatcatggacgcctcgctgcctttcacaatcaacccatcaaccggagatatcgtcatctctcgtccgctgaatagggaggacaccgacaggtaccgcatccgggtttcagcgcacgactcggggtggactgtgagtaccgacgttaccatctttgtgacagatatcaacgataatgccccacggttctccaggacgtcctactacttggactgtccagagctcacagaaattggcagcaaggtgactcaggtgttcgccaccgacccagacgagggctctaatggacaggtgttctattttattaaatcgcaatccgagtatttcaggattaacgccacgaccggggaaatcttcaataagcagattcttaaataccagaacgttactggcttctcaaacgtgaacattaatcgtcactccttcatagtgacctcatctgaccgagggaagcccagcctcatctctgagaccaccgtgaccatcaatatcgtcgactccaacgataatgctcctcagtttctgaaaagcaaatactttacaccagtgactaaaaacgtgaaggtgggcacgaagctcatcagggtgactgcgatcgatgacaaggattttggcttgaacagcgaagtagaatactttatctccaacgataaccacctgggaaaatttaaattggacaacgacactggttggatcagcgtagcgtcatccttgattagcgacctgaaccagaatttctttataaccgtgacagctaaggataagggtaaccctcccctgtcaagccaggctacagtgcatatcactgtgaccgaagagaactaccatactcccgagtttagtcaaagccatatgtccgctacgatccccgagtctcactcaatcggttccatagtacgcacagttagtgcacgggacagggatgctgccatgaatggcctgatcaaatattccatctcatctggcaacgaggaaggcatttttgccatcaacagttctacaggcatcttgacacttgcaaaggcattggactacgagttatgccagaagcacgaaatgacaatttcagctatcgacggaggttgggtggcacgcactgggtattgctcagtgaccgtgaatgtgatcgacgtcaatgacaactcgccagtcttcctgagtgacgattacttccctaccgttttggaaaatgcaccatcaggcacaaccgtgattcatctcaacgctacagacgcagacagcggtaccaacgccgtgatcgcatatactgtccagtcaagcgatagtgacctgttcgtgatagatccgaatacaggtgtgatcacgactcaaggctttttggatttcgagactaagcaatcatatcatctgacagtcaaggcttttaatgtccctgacgaggagagatgttccttcgctacagtgaacattcagctgaaaggcaccaatgagtacgtgcctaggttcgtcagcaagctgtattattttgaaattagcgaggcagcacccaaaggaaccatagtcggggaagtgtttgcgagtgaccgagatctgggtaccgacggggaagtgcactacctcatctttggcaactctcggaaaaagggctttcaaataaacaagaagaccgggcaaatctacgtctctgggatactggatcgggaaaaggaggagcgggtctctttgaaggtgcttgccaaaaattttgggagtattcggggcgctgatattgacgaagtaactgtgaatgtgacagttctagatgctaacgatcctcccatcttcacactgaacatttacagtgttcagatctcagagggtgtgcctatcgggacgcacgtgacctttgtctccgccttcgactccgatagcattccttcttggtctcgcttctcctacttcattgggtccggaaacgagaacggagccttctccatcaacccccaaaccggacaaatcactgtgactgccgagctggaccgcgaaactcttcccatctataacttgagcgtgctagccgtggacagcggcacacctagcgccaccggttccgcaagtctgctcgttactctcgaggatataaacgacaatggccctatgctgaccgtatctgagggagaggttatggaaaacaaacgccctggtacactcgtaatgacacttcagtccaccgatcccgacttaccgccaaaccaggggcccttcacctactatctgctttccacaggtccagcgacctcatatttcagcttatccacagctggcgtgctgagtacaacgagggagatcgaccgggagcagatcgcagatttttacttgagcgtcgtcaccaaagactccggtgtgcctcaaatgagctctaccggcacagtgcatattacggtcatcgaccagaacgataacccaagtcaatcccggaccgtggaaattttcgttaattactatgggaatttatttcctggaggaatcctgggctctgtgaagccacaggaccccgacgtactggacagttttcattgttccttgaccagcggcgttacctcccttttcagcattcccggcggtacgtgtgatttgaacagccagcctcgttctactgatggtacattcgacctcacagtgctcagcaacgatggcgtacatagcaccgtcacttcgaatatcagagtgttctttgcagggttttcaaacgcaactgtggataattcaatcttgcttcggctgggagtcccaaccgtgaaggactttttaactaaccattacttacatttcctccgaatcgcctcttcacagcttacaggcctggggacggcagtacagctgtactcggcttatgaggaaaacaataggacctttctcttggcagcagtgaaacggaaccataaccagtacgttaatcctagtggtgtggctactttcttcgagagcatcaaggaaattctccttcggcagtctggggtgaaagttgaatctgttgaccatgactcatgtgtccacggcccatgccagaacggaggttcttgcctgagacggctggccgtttcctcagtgctgaaatcccgcgagagtttacctgtcatcatcgtagcgaatgagcccctgcaaccatttttgtgcaaatgtctgcctggatacgcaggcagctggtgcgagatcgacatcgatgagtgccttccttcgccctgccattccggtggaacctgtcataatctcgtagggggtttctcatgtagctgcccagatggctttacaggccgagcctgcgagagggacattaatgagtgtcttcagtccccgtgtaaaaatggggccatctgtcagaacttcccaggatctttcaattgtgtctgtaaaacagggtatactggcgtctttggcaaacattgcgagttaaacagctatgggtttgaagaactgtcttatatggagttcccctctcttgaccctaataacaactacatctacgtgaaattcgctactatcaagtcccatgctctccttctctacaattacgataaccagaccggtgatcgcgctgagttcctggccctcgagattgcggaggagaggctgagattctcctacaacctcggaagcgggacgtacaagctaacaacaatgaagaaagtttccgatggacacttccacacagtcatcgccagacgagcgggaatggccgcttcccttacagtggattcgtgctctgaaaaccaggaaccggggtattgcacagtgtccaacgtggctgtgagtgacgactggaccctggatgttcagcccaaccgtgtgactgtaggcggaatcaggagtttggagcctatactccagaggcggggtcacgtggagtctcacgattttgtgggatgcatcatggaatttgccgtaaacggacgaccgctggaacccagccaggccttagcagcacaggggatcctcgatcagtatggagatttcatcagctactgctttaaggaaaagaaatgcaagaaagtctgtttcaccgtgaccccagacacagctctatccctggaaggcaagggcagactggactaccacatgtcccagaacgagaaacgggagtacctgcttaggcagtcccttcgcggggccatgctggagccattcggggtaaattcactagaagtgaaatttcgaacccggagcgaaaacggtgtcctcattcacattcaggaatcttcaaactacacaacagtgaagattaagaatggaaaggtgtactttacaagtgatgccggaattgcgggcaaggtggaaagaaatattcctgaagtgtatgtggccgatggacattggcacactttcttgatcggaaaaaatggaactgccactgtactgtctgtggaccgcatatacaatagagacatcattcaccctacacaagactttggtgggctggatgtgttgacgatctctctaggaggaattccacctaatcaggcacacagagacgcccagactgccgggtttgacggctgtatcgcgtcaatgtggtacggcggagagtcactccccttcagtggaaagcacagcctggcctccatctccaagacggatcctagcgtgaagatcggttgcagggggcctaacatttgtgcctcaaacccctgctggggcgaccttctgtgtattaaccagtggtacgcttatcgctgtgtaccaccaggggactgtgctagccatccttgccagaatgggggaagctgcgaaccagggctgcactctggattcacctgctcatgtcccgacagccatacgggtcggacatgtgagatggtcgtggcgtgtcttggggtgctctgtccccaggggaaggtctgtaaggctgggtctccggccggccatgtgtgtgtgctatcacagggtccagaagagatttccctccccctgtgggctgtgccagcaattgtagggtcttgcgctacagtgttggcactgctcgtgctgtctcttatcctgtgcaatcagtgtcgggggaaaaaagcgaaaaaccccaaagaggagaagaagccaaaagaaaagaagaagaaaggatcggagaatgttgctttcgacgaccctgacaatatcccgccttacggtgatgacatgaccgtgcgtaagcagcccgagggaaaccctaaacctgatatcatcgagcgcgagaatccttatctaatttacgatgagactgacatcccacacaactccgagactatacccagcgcaccgctggctagccccgagcaggagatcgaacactatgacatcgataatgcatcaagtatcgctccatctgatgctgacattatccagcattacaagcagtttagatcgcacacaccaaaatttagcatccagcgccactcaccgctgggcttcgcaagacagtcacccatgcccctcggcgccagtagtttaacttatcaaccctcttacggccagggcctcaggacttcgtcgctcagtcactctgcctgtccaaccccaaaccccttaagtcggcacagtcccgcccccttctctaagtccagcacattttatcggaattcgccagctcgggagctgcacttacccatcagagacgggaataccctggagatgcatggagacacttgccagccaggaatcttcaattatgcgacacgcttgggacgcaggtctaagagcccccaggccatggcaagccatgggtcaagaccaggctctcggcttaaacagccaattggtcagattcccctggagtcaagtccccccgtgggcctatcgatcgaggaggttgagaggctgaacacccctcgcccccgtaatccttcaatctgcagcgccgatcacggcaggagctcttcagaggaggactgcaggcggccactttctcgaacacggaaccccgcagacgggatccctgcaccagagtcctcttcagacagtgatagccacgagagtttcacctgcagtgaaatggagtacgaccgggagaaacctatggtatacacttcacgaatgcccaagctgagtcaagttaatgaatcagacgctgacgatgaagataattatggggctaggttgaagcctagaaggtaccacggaagaagggccgaaggtggccctgttggcacccaggccgctgctcccggaacagcagacaacacactaccaatgaagctcggacagcaagcaggcacctttaactgggataatcttctcaattggggcccaggattcggccactacgttgacgtgttcaaggatctcgctagcctgcccgagaaagccgccgcaaacgaggaaggtaaggcagggactactaagccagtgcccaaggatggggaagccgaacagtatgtgtag

SEQ ID NO: 187511 - DNA, 14946 bp, Artificial Sequence
  Description of Artificial Sequence: Synthetic coding sequence
atggacctggcccccgaccgggccaccggccggccctggctgcccctgcacacattaagtgtgtctcagctgctccgggtgttctggctactatccctgctacccgggcaggcttgggtgcacggcgcggaaccaagacaagtctttcaggtgctggaggaacagccacccgggacgcttgtaggcactatccagacacgcccgggattcacctaccgtctcagcgagtcacatgcccttttcgccatcaacagttccactggcgcactgtatacaaccagcactatagaccgcgaatctcttccctccgatgtgatcaatctcgtcgttttgagcagcgctccgacctatcctactgaggtccgggtgctcgtaagggatcttaatgacaacgctccagtcttccctgatcccagcatcgttgtgacatttaaggaagattcaagttcagggcggcaagtgatactggacacagccactgactcagacatcggcagtaacggcgtggatcaccgcagttaccgcatcatccgaggaaatgaggctgggcgctttaggcttgacataacacttaatcccagtggagagggcgcctttctgcacctggtctccaaggggggccttgatcgcgaagttacaccgcagtatcagctgctggttgaggtggaagacaagggcgaaccgaagcgacggggttatctccaggtcaacgtgacagtacaggacatcaacgataacccccccgttttcgggtcaagtcactaccaggcaggcgttcccgaggatgccgtcgtggggtcctccgtgcttcaggtcgctgcagccgatgcagacgaaggtacgaacgcggacatccgatatcgtcttcaagacgagggcacccccttccaaatggaccccgagactggactgattacagtgcgcgaacccctggatttcgaagccagacgccaatatagtctgaccgtgcaggctatggacagaggagttcctagcctgactggtcgggctgaggcattgatccaacttctcgatgttaatgacaacgatccagtcgtgaagttcaggtatttccccgcaaccagtcgttacgcatccgttgatgagaatgctcaggtgggcactgtcgtcgccctgctgaccgtaaccgatgccgactctcctgctgctaatggcaatatctccgtccagattctaggcggtaatgagcagcgccatttcgaagtccagagttctaaggtcccaaacctcagtctcatcaaagttgcatctgctctggaccgcgagcgcatcccatcctataatctcacggtgagcgtgtcagacaactacggcgccccgcctggtgcggctgtccaggccaggagctccgtggcatcactcgttatcttcgttaatgacattaacgaccaccctcctgtgttttctcaacaggtatatcgggtgaacctgtctgaagaggccccaccgggatcatacgtttcaggaatatcagccacagatggagattccggtttgaatgccaatcttcgatattccatcgtgagtggcaacggattgggctggtttcacatttcagaacacagcgggcttgtcactactggcagttcagggggactggatagggagcttgcctcgcagattgtcctgaacatctctgccagggaccaaggggtgcatccaaaggtttcatacgcgcaacttgtcgtcaccctgcttgatgtgaacgacgagaaaccggtttttagtcagcccgaagggtatgacgtttccgttgtagaaaatgctccaactggtacagagttgctgatgctcagggccaccgacggcgacttgggcgataacgggactgtcaggttctccttgcaggaagccgagaccgatagacgttcatttagactggacccagtctcgggccggctgtccaccatctcctccctggatcgcgaagagcaagccttttactccttactggtcctggccaccgatctgggttcgcctcctcagtcgagcatggctagaattaacgtctctttgctcgatataaacgacaattccccggtgttttatcccgttcaatacttcgcccatataaaggaaaatgagcccggcggaagctacatcactaccgtgtccgccaccgatcccgatttaggtaccaatggcacagtgaagtacagcatcagcgccggagaccggtcacgcttccaagttaatgcccagtctggcgtgatcagtacacgcatggcactagacagagaagagaaaaccgcgtatcagctacagatagtggccaccgacggcggcaacctccaaagccccaaccaggctatcgtgacaatcactgtcctcgacacccaggacaatccacccgttttcagtcaagtggcctattccttcgtcgtgttcgaaaacgttgcgttaggataccacgtggggtctgtgagtgcaagcactatggatctgaattcaaacatctcttatctcattacaactggtgatcaaaagggaatgtttgctatcaaccaggtgaccggtcagttgaccacggcaaatgtgatcgacagggaggagcagagtttctaccagctcaaagtggtagcatcaggtgggaccgtgacaggggatacaatggtcaatataacagtaaaggacttaaatgataactcgccacacttcctccaggccatcgaaagcgtgaacgtggtggaaaattggcaggccggtcactccatctttcaggccaaagcagttgatccagacgagggtgttaacggcatggtcctgtactcgctgaaacagaaccccaaaaacctattcgctatcaatgagaaaaatggaaccatctcccttctaggccccctcgacgtgcacgctggtagctatcaaatcgagattctggcaagtgatatgggggtgccccagctgtcatcttccgtcattctgaccgtgtatgtgcatgatgtcaacgacaatagccctgtgttcgatcagctgagctacgaggtgaccctatctgagagtgagccagtcaactcccggtttttcaaagtgcaagcatccgacaaagattcgggagcaaatggagagattgcctacaccattgccgaaggaaatacaggcgatgcttttggaatctttcccgacgggcagctgtacataaaaagcgagttggaccgagaactccaggacagatatgtgttgatggtggttgcttcagaccgcgcagtggagccactgagcgccactgtgaatgtcaccgttatccttgaagatgtaaatgacaatcgccctctcttcaattctaccaattataccttctacttcgaagaggaacaaagggccggatcctttgtcggcaaggtgtccgccgtcgacaaagacttcggacccaacggcgaggtgcgatacagtttcgaaatggtgcaacccgatttcgagcttcacgccataagcggggaaataacaaacacacaccagtttgacagggaaagcctcatgaggcgcagaggaactgccgtctttagctttacagtcattgccaccgaccagggtattcctcagcctctgaaggatcaggccaccgtccatgtatacatgaaggatatcaacgataacgcaccaaaatttctgaaggatttctatcaagccactatcagtgaatccgcagctaatctgacacaggtgctgagagtttccgcatccgacgtggatgaaggcaacaatggcttaatccattattccatcatcaaggggaacgaggaaagacagttcgctattgattcaacaagtggacaggtgacactgattggcaagctggactacgaggcgacgcctgcctactcactagtcattcaggccgtggactctggaacaatccctctgaacagtacatgtactctgaacatagacatcttagatgagaacgataacacccccagttttccaaaatccacgctctttgtggacgtcctggaaaacatgcgaattggagaattggtgtcttctgtgacagccaccgactctgacagtggagataatgccgatctctattacagtattaccggcaccaataaccatggcaccttcagtataagtccaaataccgggtccatctttctggctaaaaaacttgactttgaaacacagagcctatacaagttgaacattaccgcaaaggaccaaggccggccgcccaggtcatccacaatgtccgtggtcatccatgttcgcgatttcaacgacaaccctccttctttcccaccgggggacatttttaagagtattgtggagaacattcctatcggaacttccgttattagcgtaactgcccacgaccccgacgctgatataaatggccagttgtcttacaccatcatacagcaaatgcctcgggggaatcacttcaccatcgatgaggtgaaaggcacaatctacaccaatgctgagatcgatcgggagttcgccaatcttttcgaactgaccgttaaggcaaatgaccaggctgttcctatcgagaccaggaggtatgcattgaaaaatgtaaccatcctcgtgacagatctaaatgacaacgtccccatgttcatctcacagaatgcacttgccgctgatccctccgctgtgatcggctcagtgctgacaaccattatggcggctgatccagacgagggcgcaaacggggaaattgaatatgagatcatcaatggcgataccgacacttttattgtcgatcgctattctggagacctgagggtggcgtccgcactggtcccatcccagttaatctacaatttgatcgtgtctgctaccgatctcggaccagagcgtagaaaaagcaccaccgaactgaccatcatattgcagggactggacggtccagtttttacccagcccaaatacattacgattctgaaagaaggagagcccatcggaacgaacgtgatcagtattgaagcggcttctccacgggggagcgaggccccagtggagtattacatagtctccgttcgttgtgaagagaagactgtggggcgcctgtttacaatcggccgacatacaggtattattcaaactgccgcaatcctagaccgcgagcaaggcgcgtgtctgtacctcgtggatgtttatgccatcgaaaagtctacagccttcccaagaacgcaacgggccgaagtggagataaccctgcaggacataaatgacaacccgcccgtcttccccacggacatgcttgacctgacagtagaagagaacattggcgatgggagtaaaatcatgcaactaacagctatggacgctgacgagggcgcaaacgccttggtcacctatacaatcatctcaggagcagatgactcatttaggatcgaccccgagtcaggtgacctgatcgcgacccgcaggttggatcgcgagaggcggagcaagtacagtctcctggtccgggcggatgacggccttcagtcatccgatatgagaataaatattactgtgagtgatgtaaacgaccacacacctaaattcagccggcctgtttacagcttcgacatacctgaggacacaatccccgggtcattagtcgcagctattctggcaactgacgacgactctggagtcaacggagaaatcacctacatagtgaacgaggacgatgaggacggaatcttcttcctcaaccctattacaggcgtctttaaccttactcgcctcctcgactatgaagtccaacagtactacatccttactgtcagagcggaggatgggggaggccagttcactaccattcgtgtctattttaacatattggacgtgaatgacaaccccccaattttctcacttaacagctattctactagcctgatggaaaatctccctgtcggttcaactgtgctggtattcaacgtgaccgatgccgatgatggcatcaatagtcagctcacatactcaatcgcttcaggggactcgctcggacagtttacggtggataagaatggagtgttgaaagtgctcaaagcactcgaccgagaatctcaaagcttttataacctcgtagttcaggtacacgaccttccacaaattcccgcatccaggtttacatctacagcccaggtgtcaatcatcctgttggacgtgaatgacaaccctccaacatttctttctcctaagctaacatacattcccgaaaatacgcctatcgatacagttgtctttaaagctcaagccacagatccagacagcggaccgaactcttacatcgaatatactctgctgaatcctctagggaataaattctccattggcacgatcgatggtgaagtccgtttgacgggggaactggatcgtgaggaagtcagcaactatacactgaccgtagttgccaccgacaaaggacagccctcattatcttcaagcactgaagttgttgtaatggtgctggatatcaatgacaacaatcctatctttgctcaggcactgtacaaggtggagatcaatgagaacacattgaccggcaccgatatcatacaggtgtttgccgctgacggcgatgaagggaccaacggtcaggtgcggtacggcattgtgaacgggaacacaaaccaggagtttaggattgacagtgtgacaggtgccattacggttgccaagccactggacagagagaaaaccccaacataccacttgacagtgcaggcgactgatagaggctcaaccccacgcacggacacctccactgttagcatcgttctgctggacatcaatgactttgtaccggtgtttgagctctcaccatatagcgtgaacgtgcccgaaaatcttgggactctacctaggacaatcctgcaggtggtggctagggatgatgatagaggatctaattcaaagctctcctacgtgctgttcggcggcaacgaggataatgcctttacgctgtctgcatccggagagctgggtgtgacccagagcctggacagggagactaaagagcggttcgtgcttatgattacagcgacagacagcggcagcccggcccttaccggcaccggcaccattaacgtaatagtcgacgatgttaacgacaacgtcccaacattcgcatcgaaggcgtactttacaacaattcccgaggacgcccccacgggaaccgacgttctactggtgaacgccagcgacgccgatgcatctaagaacgccgtcatcaggatcatcggaggaaacagtcaattcacgattaatcctagcactgggcagatcatcacttccgcgctgctggatagagaaacaaaggataactataccttggtggtcgtatgttcagacgccggctctccggagcccctcagttcctcaacaagtgtcctggttaccgtcacagacgtcaacgacaatcctcctagatttcagcaccatccatacgtaactcacataccttcaccaacactgcccggatcctttgtgtttgccgtcactgtaacggatgcagacattggccccaatagtgaactgcactactccctctccgggcggaattcagagaaatttcatatagacccgctgagaggagctattatggcggctgggccgctgaatggtgcttcggaggtaaccttctccgtgcatgtaaaggacggtggaagttttccgaagacggattccaccacagtgaccgtgcgattcgtgaataaggcagacttccctaaagtgagggctaaagagcagacattcatgtttccagagaaccagccggtcagctctctggtcacaaccattaccggcagctctctgcgaggtgaacccatgtcgtactatatcgcttccggcaacctgggtaatacttttcaaattgatcagttaacaggccaggtctccatttctcaacctctggatttcgagaagattcagaaatatgtggtatggatcgaagcaagagatggaggcttccctcccttcagctcatacgaaaagcttgacataacggtgctggacgtaaatgacaacgcccccatttttaaggaagaccccttcattagtgaaattctcgaaaacctttcccctaggaagatcctgaccgtttctgcaatggacaaagactctgggccaaacgggcagctcgactacgagatagtgaacggcaatatggagaactctttctccatcaatcatgccactggagagatccgcagcgttcggcctctggacagagagaaagtgtctcactatgtcctgaccataaaaagctctgataaaggtagtccttcccagagcaccagtgtgaaagttatgatcaatattttagatgagaacgacaatgctccacgcttttctcaaatcttttctgcgcacgtgccagagaattcccctcttggctatactgtcacccgggtcacgaccagcgacgaggatatcggcattaacgcaattagcaggtactctatcatggatgccagccttccatttaccatcaacccatccaccggcgacatcgtgatatctagaccattaaacagagaggatacggaccgttacagaattcgggtttctgctcatgacagcggctggaccgtttcaaccgacgtaacgatatttgtgacagatattaacgataacgcgccgcggttcagtcgcacttcatactatctagattgcccggagttaaccgagatcggctccaaggtgactcaggtatttgccacagaccctgatgagggcagtaacggccaggttttttatttcatcaagagccagagtgagtacttcagaattaacgcaaccactggagagatcttcaataaacagattctcaaatatcaaaatgtcactggcttctccaatgtaaatatcaacaggcatagttttattgtaactagctctgacagaggaaaaccaagtctaatttctgagacaacggttaccatcaacatcgtggatagcaacgacaacgccccacaatttctgaagtcaaaatactttacacctgtaaccaaaaacgtgaaagtgggcaccaaactgatccgggttacagctattgatgataaggacttcggcctcaactcagaggtcgagtactttatctctaacgataatcacttggggaaattcaagctagacaacgacactgggtggatttcagtagccagctctctgatctctgacctgaatcagaactttttcatcaccgtgaccgccaaggacaaaggaaatcctcctctgtcttcacaggctactgtccatatcacagtcactgaggagaattatcacacacccgaatttagccaaagccatatgtccgcaactattccagagtcacacagcattggatccatagttagaacagtttcagccagagatcgggacgccgctatgaatggtctcatcaaatacagcatctcttctggcaacgaggaaggcattttcgccataaactcctccacaggaattctcactctcgcaaaagccctggactatgaactgtgccagaagcatgagatgaccatttctgccatagatggtggttgggtagctcgcaccggctactgcagcgtgacagtaaatgtgatcgacgtaaatgataattcccctgtgttcttgagcgacgactacttccctactgtgcttgagaacgcccccagtggtactaccgtgattcacttgaatgcaacagacgccgattcgggaaccaacgcagtgatcgcttacacagtacagtcatccgacagcgacttattcgtcattgaccccaacacgggcgtgatcacgacccaaggcttcctagattttgagacaaagcagtcttaccacttgacggtaaaggcgtttaatgttccagacgaagaacgatgttctttcgctactgtcaacatccagcttaagggaaccaacgagtacgttccccgctttgttagtaagctttactactttgagattagtgaggcggcacccaaggggaccattgtcggggaggttttcgcatctgacagagatttggggaccgatggcgaagtgcactatctgatattcggtaattcacgcaagaagggatttcagattaacaagaaaacaggccagatttacgtcagcgggattctcgacagagagaaagaggaaagagtgtctctgaaagtcctcgccaaaaacttcggatccatccggggcgccgacatcgatgaggtgacagttaatgtgactgtcctcgacgctaatgacccacctatatttacactgaacatatacagcgtgcagatatcagagggtgtgcctataggcactcatgtgacatttgtgtccgccttcgattccgatagtattccctcttggagtagatttagctactttatcggaagtgggaacgaaaacggagccttcagcattaacccccagactggccagatcactgtcactgccgagctcgatcgtgagactcttccaatctataatctgagcgtcctggctgtggactccggaaccccctccgcaacaggcagcgcaagccttctcgtgactttagaggacataaacgataatggcccaatgttaaccgtgtcagaaggagaggttatggaaaacaaacgtcccggcacactcgtgatgactctgcagtccaccgaccccgaccttcccccgaaccaagggccgtttacatactaccttctttccacagggcccgccacaagctattttagcttgtcaactgccggcgtgctgtcaacaaccagagagattgatcgagagcagattgcagacttttatctatctgtggtgaccaaggatagtggcgtcccgcaaatgagctccaccggtactgtgcatattaccgttatagatcagaatgataatccctcccagtcgaggactgttgaaattttcgttaactattatggaaatctgtttcctggtggcattctgggctctgttaaaccgcaggatcctgacgtgttagactcattccactgttctcttacatcaggggtaacatccctgtttagtattccaggcggcacctgcgatctgaacagccaaccaagaagtacagacggaaccttcgatctcactgtccttagcaatgatggtgtccacagcaccgtgacttcgaatatcagggttttctttgcaggattcagtaatgcaacagtggataactcaatccttttgagactgggcgtgcctaccgttaaggattttttgacaaaccactacttacatttcctccgaattgccagttcacagctgacaggccttggcacagcagtacagctatacagtgcatatgaggagaacaatcgcacctttctgctggccgctgtaaagaggaaccacaatcagtatgtcaacccatccggcgtggccacattctttgagagcatcaaagaaatcctgctccgacaaagcggtgtaaaggtcgaaagcgtcgatcatgacagctgtgtccatgggccatgccaaaatgggggctcctgccttcgcaggctcgccgtgtctagtgtcttaaaatcacgggagagtctgcctgtgattatagtcgctaacgagcccttacagcccttcctttgcaagtgtctgcctggctatgcagggtcttggtgcgagattgatatagatgaatgtctgccttcaccctgccactctggagggacgtgtcacaatctagttgggggtttcagctgtagttgtcctgacgggtttacaggcagggcctgcgaacgcgacattaatgagtgtctccagtcgccgtgcaagaatggagcaatctgtcagaacttccccggatctttcaactgcgtttgcaaaaccggatatacgggaaagatgtgcgagagctctgtcaattattgcgaatgtaatccctgttttaacggaggctcctgtcagtcaggcgtcgactcctactactgccattgcccctttggagtgttcggcaagcattgcgagcttaattcatacggttttgaagagctctcttacatggaatttccatccctggatcccaataacaactatatctacgtgaagtttgctacgatcaaatcccatgcccttttgctgtataactacgacaatcaaacaggggatagagccgagtttcttgccctagagatcgccgaggaacgattgcgtttctcctacaatctgggttcgggtacctataagttaacaactatgaaaaaagtgagtgatggccacttccatacagtcatcgcccgacgcgctggcatggcggcctccttaaccgtggattcctgttccgagaatcaggaacccggatactgtaccgtgtccaatgtggctgtaagtgatgactggactctcgatgtccaaccaaacagggttaccgtcgggggtataaggtcgctggaacctatactccagagaaggggccatgtcgagagccatgacttcgtagggtgcatcatggagtttgccgttaatggcaggcccctggaaccttcacaagcattagccgcccaggggatcttggaccagtgtcctaggctggagggggcgtgtactaggagtccctgccagcatggtggaacgtgcatggactattggtcctggcagcaatgccactgtaaagaagggcttaccggtaaatattgcgaaaaaagtgtcacacccgatacagcactgtcgttggagggtaaaggaagactggattaccatatgagccaaaacgagaagagagaatatttgctacggcagagcctgcgcggggctatgctggagcccttcggcgttaattcactcgaggtgaagttccgcaccaggtcagagaacggagtgctcatccacatacaggagtcctcaaattacactactgtgaagattaaaaatggaaaagtttactttactagcgatgccgggattgccggaaaggtggaacgtaatatcccggaagtctatgttgcagacgggcattggcacacgttccttattgggaagaatggaactgccactgtgctgtcagtcgacagaatctacaatcgggacataattcaccctacacaagacttcgggggtctagatgtgctcaccatctcgcttggcggcatcccacccaaccaagcacatcgggacgctcaaaccgcaggctttgatgggtgcatcgcttccatgtggtacggcggcgagagtctaccttttagcggtaaacactcgctggcaagtatttctaagacggacccatctgtgaagataggttgtcggggccccaacatttgcgctagcaatccatgctggggtgatctgctctgtataaatcagtggtatgcctaccggtgtgttccccctggggactgcgcgtcacacccatgtcagaatgggggctcgtgcgagcctgggctgcacagtggtttcacttgttcttgcccggactcacacacaggaaggacatgcgaaatggtcgtcgcttgcctgggtgtgttatgccctcaggggaaggtgtgtaaggccggtagccccgcgggacacgtctgtgtgctctcccagggacccgaagagatttctctgccgttgtgggctgtccccgcaatagttggctcttgtgccaccgtcctcgccttgcttgtcctctccctgattctgtgcaaccagtgcagaggtaagaaggcaaaaaatcccaaggaggagaaaaagcctaaggaaaagaagaaaaaaggttctgagaatgtggcctttgacgatccagacaatatacccccatacggcgacgacatgacagttcgaaagcagcccgaagggaatcccaagcccgacataatcgaacgcgaaaacccttatctgatctacgacgagacagacatcccgcacaactccgaaaccattccgtcagcacctttagcgagccctgagcaggaaatcgaacattacgatatcgataacgctagttcaatcgccccgagtgacgctgatataatccagcactacaagcagtttagatctcacactcccaagttttctatccagcggcacagccctctggggtttgcgcgccagtccccaatgcccctaggggcaagctctctgacgtatcagccctcatacgggcagggtctgcgcacctcttccctctctcatagtgcctgcccgactccaaacccgctctcgaggcactcacctgccccctttagcaaaagtagtacgttctatcgaaacagccctgctcgggaactccatcttcccatcagggatggcaacacgcttgagatgcacggcgatacatgtcagcctggaattttcaactatgccactcgtctcggccgaagaagtaaatcccctcaagctatggccagccatgggagccggccgggtagcagattgaagcagcccataggacaaatccctctcgagagctcccctcctgtgggcctttctatagaggaggtggaacgcctcaataccccaagacctcgcaatccctccatttgttctgccgatcacggccgatcaagctccgaagaagattgtcggcgtccactcagcagaactaggaatcctgctgatggtatccccgcacctgagagctcctccgattcggattctcatgagtcatttacctgctcggagatggaatatgacagagagaaaccaatggtatacacctctcgaatgccaaaactaagtcaagtgaatgaaagcgatgcggacgacgaggacaattatggagcgcggctcaaacctaggcgatatcatggtaggagggctgagggaggccctgttggaacgcaggccgccgcgcccggcaccgctgacaacactttacctatgaagttaggccagcaggccggaactttcaattgggacaatctactcaactggggacccggatttggtcactacgtggacgtgtttaaggacctggcgagccttccagaaaaagccgccgccaacgaggaagggaaggcgggcaccaccaagccggtcccaaaagatggcgaagctgaacagtacgtttag

SEQ ID NO: 187512 - DNA, 1239 bp, Artificial Sequence
  Description of Artificial Sequence: Synthetic coding sequence
atgggcctgcacctgcggccctaccgggtgggcctgctgcccgacgggctactctttctccttctcctgctgatgctgttagctgacccagccttacctgcaggacgccacccaccggttgtcttagtccctggagacctgggaaatcagttggaagcgaagttggataaacccaccgtagttcactatctctgtagcaagaagaccgaaagctatttcaccatctggctgaatctcgaactcctgctgcccgtgatcattgactgctggattgataatattaggttggtgtacaataagacatccagagccacccagttcccggacggggtggacgtgcgtgtgcccgggtttggaaaaaccttctcactggagtttctcgacccctctaaatctagtgtgggatcctacttccacacgatggtcgaatccctggttgggtggggatacaccaggggcgaggatgttcgtggggccccttacgactggagaagagcccctaatgagaatggtccttacttcctggctctgcgcgaaatgattgaggaaatgtaccagttatacggcggtcctgttgttctggtggctcacagtatgggcaacatgtatactctgtattttctgcagagacagcctcaggcctggaaggacaagtacatacgcgcgtttgtcagcttgggcgcaccatggggcggcgttgctaaaacgctccgtgtgcttgccagtggggataacaatagaatccctgtgattgggcccctgaaaatccgtgagcagcagcgctccgccgtgtcaacttcatggctcctgccttacaactatacatggtccccggaaaaggtattcgttcaaacgcccaccatcaattacacactgcgcgactaccgaaagttcttccaggatataggtttcgaggacggctggcttatgcgacaggacaccgagggcttggtcgaggccactatgccaccaggcgtccagctccactgtctgtacggtaccggagtgccgactcccgattctttttactacgagtcgttcccagatcgggatcctaagatctgtttcggagacggcgatggcaccgtgaatttaaagtcagcactgcagtgccaagcgtggcagtcaagacaagaacatcaggtgctgctgcaggagctgccaggctccgagcacatcgagatgttagcgaatgcgacgacacttgcatatttgaaacgtgtcctgctggggccatag

SEQ ID NO: 187513 - DNA, 480 bp, Artificial Sequence
  Description of Artificial Sequence: Synthetic coding sequence
atgttccccggcctgttcatgctgggcaccttcctgtggagcctgatcgagtatctgattcataggtttcttttccacatgaaaccgccaagcgactcctactacctgataatgctccacttcgtgatgcatggccagcatcataaagcgccattcgatgggtcacgtctagtcttccctcctgttccagcctcactcgttatcggcgtattttacttatgtatgcaactgattctgcccgaggcagtaggtggcacggtattcgcaggcggcctcctgggatatgtcctgtacgacatgacccactattatctacactttggtagtccgcataagggctcctacctgtacagtctgaaggcacaccacgtgaaacaccactttgctcaccagaagagcggctttggtatttctacaaaactctgggattattgcttccacaccctgaccccagaaaagccacacctcaaaactcagtag

SEQ ID NO: 187514 - DNA, 1740 bp, Artificial Sequence
  Description of Artificial Sequence: Synthetic coding sequence
atggtgcagtacgagctgtgggccgccctgcccggcgccagcggcgtggccctggcttgttgtttcgttgctgctgccgttgccctgagatggagtggaagaagaaccgcgcgaggggcagttgttcgagccaggcagcgtcagcgtgcgggccttgaaaacatggatagggccgcccagcgctttcggttgcaaaatccagatctcgactcggaagcactgctggccttacctctacctcagctggtgcagaaacttcattcaagggaactggcacctgaggcagtgctgttcacctatgtcggcaaggcttgggaggtgaacaagggcaccaattgcgtaacctcctacctggccgactgtgaaactcagctaagtcaggctccacgacaggggctgctgtatggcgtgccagtcagcttgaaggaatgcttcacttataagggacaagattcgaccttagggctatcgcttaacgagggggttccggctgagtgtgattcggtggtggttcacgtgttgaagctccagggagccgttccatttgtccatacaaacgtaccccaatcgatgttctcatatgattgctcaaaccccttatttggccagacggtgaatccctggaagtcctctaagagtcctggggggagtagtggtggagaaggggccctgatcggatccggcggcagtcctcttggcttgggaacagacatcggcgggtccatccgatttccatcctccttttgtgggatttgcgggctgaaaccaaccggaaaccgtcttagcaagtcgggcctcaaaggctgtgtgtacggccaggaggctgtccggttgagtgtgggccccatggcccgggacgtggagagcctcgccctttgcctgagagcgctcctttgcgaggacatgtttaggcttgatccaacagtgccacccctgccatttcgggaagaagtgtatacttccagccagcctctcagggtggggtactacgagactgacaattatacgatgccaagtcctgccatgaggagggcagtcctagaaactaaacagtccctggaggccgctggtcatactctcgtcccctttttgccctctaacatcccccacgcactcgagaccctcagcaccgggggcctgttttccgatggcggacacacatttctacaaaatttcaaaggggatttcgtggatccatgtctgggcgacctagtcagtatcctgaagcttccccagtggcttaagggtctcctggcgtttctggtaaaacccttgctgccgaggctttctgcttttctctcaaacatgaaatccaggtcagccggcaaactttgggagctccaacacgaaatcgaagtctacaggaagacggtgatcgctcagtggagagcactggacctcgacgtggtgctcacgcctatgttagcacctgctctcgacttgaacgcacctggtcgagccaccggagcggtgagttatacaatgttatacaattgccttgactttcctgccggcgtggtacccgtgactactgtcaccgccgaagacgaggcacagatggaacattaccgcgggtactttggggatatttgggacaagatgctgcagaaggggatgaaaaaaagcgtgggcttgcctgtagccgtgcaatgcgtagcactcccttggcaggaagagttgtgtcttcggtttatgagagaggtagagcgactgatgacacccgagaagcaatccagttag

SEQ ID NO: 187515 - DNA, 456 bp, Artificial Sequence
  Description of Artificial Sequence: Synthetic coding sequence
cggcggcagcaccccctgcccctgctgctgctgcggcacctgcggcctcaggcccaccgggagcctcctcaggtgtatacttcatcccaacctctccgcgtcggatactatgagaccgataattacactatgccatctcccgccatgaggagggctgtgttagaaacaaaacagtctctcgaggctgctgggcatacgctcgtgccttttctcccctcaaatataccacacgcccttgagactctgtctacaggcggcttgttttctgacggagggcacacatttctacagaatttcaaaggcgacttcgtggatccatgtctcggagaccttgtgtccatattgaaactgccccaatggttaaaaggactcctggcgtttctggtaaaaccgctcttgcctagactgtccgcctttctgtcaaacatgaagtcacgttgccgcccactgccatag

SEQ ID NO: 187516 - DNA, 1599 bp, Artificial Sequence
  Description of Artificial Sequence: Synthetic coding sequence
atggcccccagcttcaccgcccggatccagctgttcctgctgcgggctttgggctttctcatcgggctcgtaggccgagctgccctggtactcggtggccctaaattcgctagtaaaacccctaggcctgtaaccgagcctctgctactgctcagtggaatgcagctggccaagctgatccgccagagaaaggtgaaatgtatagacgtggttcaggcatacattaaccggataaaagacgttaaccctatgataaacgggatcgtaaagtatcgctttgaggaggcgatgaaggaagctcatgcagtcgatcaaaagcttgctgaaaaacaagaggatgaagccaccctcgagaataagtggcccttcctaggcgttcccctaaccgtgaaggaggcatttcagctgcaggggatgcccaattctagcggccttatgaaccggagagacgctattgccaagaccgacgctacagtagtcgcgctcctcaagggtgcaggggccatacctctgggaataaccaattgctccgaactgtgcatgtggtacgagtctagcaacaaaatttacgggaggagcaacaacccctatgacctacaacatattgttggaggttcctcaggaggagaagggtgcacccttgctgccgcgtgttctgtaattggtgtcggaagtgacatcggaggcagcatcaggatgcctgccttctttaatggcattttcggccacaaaccttcccctggtgtcgtcccaaacaagggccagttccccctggcagtgggcgcccaggaactgttcctgtgcacgggacctatgtgccggtatgccgaggatctagccccgatgctgaaggtcatggccgggccaggaattaagcgcctgaagcttgatacaaaagttcatttgaaggacttgaaattctattggatggagcacgacgggggtagctttctaatgagcaaagtcgaccaggatttaatcatgacacagaagaaggtcgtcgtgcacctggaaaccatccttggcgcaagcgtacagcacgtaaaactcaagaagatgaaatactctttccagctgtggatcgcaatgatgagcgccaagggccacgatgggaaagagcccgtcaaattcgtggacctgctgggcgatcacggcaagcatgtatctcccctctgggagttgataaagtggtgccttgggctgagtgtctacaccatcccgagcatagggctggccctgctcgaagagaaattaaggtacagtaatgaaaagtatcagaaatttaaagctgtcgaggaaagcttaaggaaggagctcgtcgatatgctgggagatgatggcgtgtttctgtacccatcccatcctaccgtggcccccaaacaccacgtgcctctgaccaggccctttaatttcgcctacactggagtcttcagtgcgcttggattaccagtcacccaatgccccctgggcctgaacgccaagggtctccccttgggtattcaggtggttgccggccccttcaatgatcatctcaccctggccgtggcccagtatttggagaagacatttggcggctgggtgtgcccaggcaagttttag

SEQ ID NO: 187517 - DNA, 384 bp, Artificial Sequence
  Description of Artificial Sequence: Synthetic coding sequence
atgagcttcagcggcaagtaccagctgcagagccaggagaacttcgaggcttttatgaaagcaatcggtctccctgaggagctcatacagaagggtaaagacattaaaggggtcagcgaaatcgtgcagaatggtaaacacttcaagtttaccatcaccgctgggagcaaggtgattcaaaatgaatttaccgttggcgaagagtgtgaactggagaccatgaccggtgaaaaagtgaagaccgtggtgcagctggagggcgacaataaactcgtgacaaccttcaagaacatcaagagtgtgactgaacttaacggggacatcatcactaacactatgacactgggggacatagtctttaaaaggattagcaaacgcatctag

SEQ ID NO: 187518 - DNA, 399 bp, Artificial Sequence
  Description of Artificial Sequence: Synthetic coding sequence
atggccttcgacagcacctggaaggtggaccggagcgagaactacgataagtttatggaaaaaatgggcgtgaacatagtcaagagaaagctggccgctcacgataacctgaagctcacaatcacccaagagggaaataagtttactgtcaaggaatcctccactttccggaatattgaggtggtcttcgaactgggcgttaccttcaactataacctagccgacgggacagagttgcgcgggacatggagtctggaagggaataaacttataggtaagtttaagcgcacagataatggtaacgaactgaataccgtgagggagatcataggcgatgaattagtccaaacctacgtgtatgaaggtgtagaagccaagcggattttcaaaaaagattag

SEQ ID NO: 187519 - DNA, 402 bp, Artificial Sequence
  Description of Artificial Sequence: Synthetic coding sequence
atggtggacgccttcctgggcacctggaagctggtggacagcaagaacttcgatgactatatgaagtccctgggcgtgggcttcgccacccgccaagtggccagtatgaccaagccaacaacgatcatcgagaagaatggggatattctgactcttaagactcactccacatttaagaataccgaaatttctttcaaactgggggttgaatttgatgagaccacagcggacgataggaaagtgaagtcgatcgtgacactcgatggtggaaagctggtccacctgcagaaatgggacggacaggaaacaaccctggttagagagcttatcgacggaaaactgattctgactttgactcacgggaccgccgtatgtacacgcacctatgaaaaggaggcttag

SEQ ID NO: 187520 - DNA, 408 bp, Artificial Sequence
  Description of Artificial Sequence: Synthetic coding sequence
atggccaccgtgcagcagctggagggccggtggcggctggtggactctaagggtttcgacgaatatatgaaggagctgggggtcggtattgcccttaggaaaatgggggctatggccaagccggattgcatcataacttgcgatggcaagaatctgacaattaagactgagtctacattgaaaactacccagttttcttgtaccctgggggagaaatttgaagaaaccacagccgacgggaggaagacccagacagtctgtaatttcacagatggagcgctggtccagcaccaggaatgggacggtaaagaatctaccattactagaaaactgaaggacggaaaactcgtcgttgaatgtgttatgaacaatgtgacctgcacccgcatttacgaaaaggttgagtag

SEQ ID NO: 187521 - DNA, 534 bp, Artificial Sequence
  Description of Artificial Sequence: Synthetic coding sequence
atgaagaccgtgaccatgatgatggtggtggagatgcaggccctgacacaggtcttacgggctgtattgtcagcctgcacctgggtgtcccgaaagggtgatctccagcgcatgaagcagactcataaggggaagcctcctagttccatggcattcaccggaaaattcgagatggaatctgaaaagaactatgacgaattcatgaagcttctggggatcagcagcgatgtgatcgagaaagcgcggaatttcaaaatcgtgaccgaggttcagcaagacgggcaagattttacttggtctcagcactactcaggcggccatacaatgacaaacaagttcactgtgggcaaagaatccaatattcagaccatgggaggaaaaacttttaaagcaaccgtgcaaatggaaggagggaagctggttgtgaattttcctaactatcaccagacctctgagattgttggggacaagttggtggaggtcagcacaatcggcggggtgacgtacgaacgcgtctctaagagattagcctag

SEQ ID NO: 187522 - DNA, 534 bp, Artificial Sequence
  Description of Artificial Sequence: Synthetic coding sequence
atgaagaccgtgaccatgatgatggtggtggagatgcaggccctgacacaggtgctgagggcggttctgtccgcctgtacatgggtcagcaggaagggcgacctgcagcgcatgaagcaaacacacaaaggcaaacctccgagtagcatggcgttcaccggcaagtttgaaatggagtccgaaaaaaactacgatgagttcatgaagctactgggaatttcttcagacgtcatcgagaaggcccgcaacttcaaaatagttacggaggtgcaacaggatgggcaagattttacctggagtcaacactatagcggcgggcacactatgaccaacaaattcaccgtcgggaaagaatccaacattcagactatgggcgggaagacttttaaggcaactgttcagatggagggggggaaacttgttgtgaactttcccaactaccaccagacatctgagatagtaggcgataaattggtagaggtgtcaaccattggaggggtgacttatgaacgcgtgtcaaagaggcttgcctag

SEQ ID NO: 187523 - DNA, 387 bp, Artificial Sequence
  Description of Artificial Sequence: Synthetic coding sequence
atggccttcaccggcaagttcgagatggagagcgagaagaactacgacgagtttatgaagctgctggggattagcagtgacgtaattgagaaggctcgcaatttcaagatcgtcaccgaagttcaacaggacgggcaagacttcacctggagtcaacactacagcggaggtcatactatgacgaacaagttcacagtgggtaaggagagcaacatacagacaatgggcggtaaaacattcaaagcaaccgtgcaaatggaaggcggcaagctggttgtcaactttccgaattaccaccaaacatctgagatcgtgggtgataagcttgtcgaagtgtccactattgggggcgttacctatgagagagtgagcaaacgcctggcttag

SEQ ID NO: 187524 - DNA, 501 bp, Artificial Sequence
  Description of Artificial Sequence: Synthetic coding sequence
atggtggaggccttctgcgccacctggaagctgaccaacagccagaactttgatgagtatatgaaggccttgggcgtcggattcgccacacgacaggttgggaatgtgactaaaccaaccgtcataatcagccaggaaggagataaagtcgttattcgtaccctgagcacctttaagaacacagagattagctttcaactgggcgaagaatttgacgagacgacagccgatgataggaattgcaagagcgtcgtgtctttggatggcgacaagctggtgcatattcaaaagtgggatggtaaggagactaattttgtgagggaaattaaagatgggaaaatggtaatggtgagcaatgacaactcccccttcttcttggtgttcttcagcagccctcacacgagccatttgctgccatccagttcactgctcctcccattttttctgttaccttcatttttcaataatacttctctggcccgcttttttaattatatgtag

SEQ ID NO: 187525 - DNA, 399 bp, Artificial Sequence
  Description of Artificial Sequence: Synthetic coding sequence
atggtggaggccttctgcgccacctggaagctgaccaacagccagaacttcgacgagtatatgaaggctttgggagtcggcttcgcgacccgacaggtgggcaacgtcaccaagcccacagtcataatttcacaggaaggtgataaggttgtcatccgtactttgtccaccttcaaaaacactgaaataagcttccagctcggggaagagttcgacgagacgacggccgatgataggaattgcaaaagtgttgtgagcctagacggagataagctggtacatatccagaagtgggacggcaaggaaacgaacttcgtcagagagatcaaggatggcaaaatggtcatgacattaacctttggagatgtggtggcagtacggcactacgagaaagcgtag

SEQ ID NO: 187526 - DNA, 1506 bp, Artificial Sequence
  Description of Artificial Sequence: Synthetic coding sequence
atgggcacccgggccgcccggcccgccggcctgccctgcggcgccgagaacccagcgaggcgcaggcttgcactcggcgctcgacaacagatccactcttggtcccccaggacgccttccactaggctcacagcccccgcaggccccgctcggggagtggccaggcccgcgatggctcccgaccctgtggccgctgagaccgccgcacaggggccaacacctaggtattttacatgggacgaggtcgctcaaaggagcggttgtgaagaacggtggctcgtgattgatcgaaaggtctacaatatatctgagttcacccgcagacaccccggaggtagtcgggtgatcagtcactacgctgggcaggatgccacagaccccttcgtggcatttcacatcaacaagggattagtaaaaaaatacatgaactccttgctgatcggagagttgagtcctgaacagccctcctttgaacccaccaagaacaaagagcttactgacgagtttcgcgagcttcgcgctaccgtggaaaggatgggcttgatgaaagccaatcacgtgttcttcttactctatctgctgcacatattgttgttggacggggccgcatggctgacactttgggtcttcgggactagttttctgcccttccttctctgtgcggtcttgctgtcagccgtgcaagctcaagccggatggctccagcacgacttcggccacctaagtgtgttctctacctccaaatggaaccatctgctccaccactttgtcattggccacctcaagggcgcccctgccagttggtggaaccatatgcactttcaacatcatgccaagccaaactgtttccgcaaagacccagatatcaacatgcatcctttctttttcgctctcggtaagatcctaagcgttgagctcgggaagcagaaaaaaaagtacatgccttacaatcaccaacacaagtatttttttctgattgggccccctgccctcctgccattgtacttccagtggtatattttctactttgtgatccagagaaagaaatgggtggatttggcctggatgatcactttctacgtccggttcttcctgacatatgtgcctctcttaggtttgaaagcattcctcgggttgttttttatcgtgcgcttcctggagagtaactggtttgtctgggtcactcagatgaaccacattcccatgcacatcgaccatgaccgtaatatggattgggtaagtacacaattgcaggccacctgtaatgtccataagagcgcattcaacgactggttctctggtcatcttaacttccagatcgagcaccacctcttccccaccatgcccaggcacaactaccacaaggtggcacctttggtgcaaagcctctgcgccaagcacgggatcgagtaccagtctaaacccctgctatctgcctttgccgacatcatccattccctgaaggagagcggtcagctttggttggatgcctacctgcaccagtag

SEQ ID NO: 187527 - DNA, 1083 bp, Artificial Sequence
  Description of Artificial Sequence: Synthetic coding sequence
atgaacagcctgctgatcggcgagctgagccccgagcagcccagcttcgaacccacaaagaacaaggaattaacggatgaattcagagagttgcgcgcaactgtggagcggatggggctgatgaaggccaatcacgtgttcttcctgctttatctgctccatattctcctgcttgatggtgcagcttggctgacactgtgggtgttcggcacttccttccttcccttccttctctgtgccgtcttactgtctgccgtccaggctcaggctgggtggttgcaacatgacttcggccatctttctgtcttctccactagtaaatggaaccacctcttgcatcactttgtgatcgggcacctcaaaggcgcccccgcatcttggtggaatcatatgcacttccagcaccacgcgaagccaaactgctttaggaaggaccccgatatcaatatgcacccattctttttcgcactcggtaagatcttgtccgttgagcttgggaagcagaagaagaaatacatgccatataaccatcagcataaatactttttcttaattggtccacccgcactccttcctctgtatttccaatggtatatcttttattttgtgatccaaagaaagaaatgggtagatcttgcctggatgattactttttatgtgagattcttcctcacatatgtccctctgctagggttgaaagcctttctgggccttttctttatcgtgagatttctggaatcaaattggttcgtctgggtgacacagatgaatcatatccccatgcatatcgaccacgacagaaatatggattgggttagtactcagctacaggctacctgtaatgttcacaagagcgcgttcaacgactggttttccggacacttgaatttccagatcgaacaccatttgttccctacgatgccacgtcacaactatcacaaagttgcacctctggtgcagagcctctgtgcgaagcatggaatagagtaccagagtaagcctctcctcagtgcctttgccgatattatccactctctgaaagaaagtggtcagctgtggcttgatgcttatttgcaccagtag

SEQ ID NO: 187528 - DNA, 1083 bp, Artificial Sequence
  Description of Artificial Sequence: Synthetic coding sequence
atgaacagcctgctgatcggcgagctgagccccgagcagcccagctttgagcccacaaaaaacaaggaactgacagatgaattccgggagttgagagccaccgtggaacgtatgggcttaatgaaggctaaccacgtgtttttcctcctgtatctcctccacatcctgctcttggatggtgctgcttggcttaccctctgggtatttggaaccagtttccttccttttcttctatgtgccgtcctactttctgcagtacaggcccaggcaggctggctgcaacacgacttcggccatttgtccgttttctcaacgtccaagtggaatcacctgttgcatcacttcgtaatcgggcatctgaagggcgctcctgcttcgtggtggaaccatatgcattttcagcatcacgcgaaaccaaactgctttcgcaaggatcctgatataaatatgcacccttttttcttcgctctcggcaaaattcttagcgtcgagttaggaaaacaaaaaaagaaatatatgccatacaatcaccagcataaatactttttcttgatagggcccccagctctgctgcctctgtattttcagtggtacatcttctattttgttattcagcggaaaaaatgggtggacctggcatggatgataaccttttatgtgcgctttttcctcacgtacgtgcccttacttggactgaaggcctttcttgggctcttcttcatcgtgcgcttcttagaaagtaattggtttgtgtgggtgacacagatgaaccatatccctatgcacatcgaccatgatagaaacatggattgggtctccacgcaactgcaggccacatgtaacgtgcataaatctgccttcaacgattggttttcaggacatctgaactttcaaatcgaacaccatctgttccccacaatgccgcgacacaactatcacaaggtggcccccttggttcagtccttatgcgccaagcacggaattgagtaccagtcaaaacctctgttgtctgcatttgccgatatcattcatagcctgaaagagtctggccagttgtggctggacgcctacctgcaccagtag

SEQ ID NO: 187529 - DNA, 1083 bp, Artificial Sequence
  Description of Artificial Sequence: Synthetic coding sequence
atgaacagcctgctgatcggcgagctgagccccgagcagcccagctttgaaccgaccaaaaataaagagttgactgatgagtttagggaactcagagctactgtcgagaggatgggtctcatgaaagccaaccacgtgttcttcctcttgtatctgctccatattctgttattagatggggccgcatggctgactctgtgggtttttgggacgagctttctcccctttcttctgtgtgctgtgcttctatctgctgtccaggctcaggctgggtggctgcagcatgatttcggccatttaagcgttttcagcacttctaaatggaaccacctgctgcatcacttcgttataggacatctcaagggggcacccgcctcctggtggaatcatatgcacttccagcatcacgcaaagccaaactgctttaggaaagatccagatatcaatatgcatccctttttctttgctttaggaaagatcttatcagtggaacttggaaagcagaagaagaaatacatgccttataatcaccagcataaatatttctttctgattgggccccccgccctcctgccactctacttccaatggtacatcttttactttgtgattcagcgtaaaaaatgggtagatctggcctggatgatcactttctatgtgcggttcttcctcacctatgtacccctcttagggctcaaagccttcctggggctcttcttcattgtgcgtttcctcgagagcaattggtttgtctgggtgacacagatgaaccatatcccaatgcatatcgaccacgacagaaacatggactgggttagtacacagctgcaggcaacttgtaatgttcacaaatcagcttttaatgactggttcagtggccatctgaactttcagatcgagcaccatctattccccacgatgcccaggcacaattaccacaaagtggctcccctggttcagagcctctgtgcaaaacacgggatagaataccagagtaagcccttgctgagtgcttttgccgatatcatacactctctaaaggagagcgggcagctctggctcgatgcctacctgcaccagtag

SEQ ID NO: 187530 - DNA, 1131 bp, Artificial Sequence
  Description of Artificial Sequence: Synthetic coding sequence
caggacgccttccgggccttccaccaggacctgaacttcgtgcggaagttcctccagcctctgctgataggcgagcttgctcctgaggaacctagccaggacggcccattgaacgcccagctcgtcgaggatttcagagccctgcaccaggcagcagaggacatgaagctgttcgacgcctcacctactttttttgcttttctgctgggtcacatcctcgccatggaggtcctggcatggctgcttatctatttactcggacccggctgggtgccaagtgcattggccgctttcattctggccataagccaagcccaggccggatggctacagcatgacttcgggcatttatctgtgtttagtacctcaaagtggaatcatttattgcaccactttgttattggccatctgaagggggccccagcgtcatggtggaaccacatgcacttccaacatcatgctaagccaaactgctttcggaaagatcctgatattaatatgcacccattcttttttgcattgggcaagatactgagcgtcgaactgggaaagcaaaagaagaagtacatgccttataatcatcaacacaaatacttttttttaattggtcctcccgctttattgccactgtacttccagtggtatatcttctatttcgtcattcaacgcaaaaagtgggttgacctcgcttggatgattaccttctatgtacggttcttcttgacctatgtcccactgttaggtctcaaggcgttcctcggtctgtttttcatccgcttccttgaaagcaattggttcgtctgggttacccagatgaaccacattccgatgcatattgaccatgatcggaacatggactgggtaagcacacagctccaggctacctgcaatgtccacaagtctgcttttaacgactggttcagcggccacctaaacttccaaattgagcaccatctgttcccaacgatgccaaggcataattaccacaaggtggcacccctggtacagagtctctgtgctaaacacggcatcgagtaccagtccaagcctctcctgagcgccttcgcggatatcatccacagtctcaaagaaagcggacaactgtggctggatgcttacttgcaccagtag

SEQ ID NO: 187531 - DNA, 1269 bp, Artificial Sequence
  Description of Artificial Sequence: Synthetic coding sequence
atgcacggccgggaggccggccccttcgtgtgcgtgtgcgtgctgctggcatcgatccccactccccaaactccgctcttacaggcctcactgcccccctttcaccccgcttcggcaggccatcccatcacggggcagcaggacgcctttcgcgccttccacccagatcttgagtttgtagggaagtttctcaagcctttattgattggcgaactggctcccgaggagccctcacaggatcatgggaaaaattccaaaataacagaggatttccgcgccctgagaaagacggccgaggacatgaatttatttaagacaaatcacgtcttttttctgctgctgctggcgcacattattgctctggagtccattgcttggttcacagtgttctactttggaaacggctggatcccaactcttattactgccttcgtattagccacaagccaggcacaggcaggatggttacagcacgactatggacacctgtctgtttatcggaagccaaagtggaatcaccttgttcacaaattcgtcataggccacctgaagggcgcatcagcaaattggtggaatcacaggcacttccaacatcatgccaagccaaacatattccataaggaccctgacgttaacatgttacatgtatttgtacttggagaatggcagccaatagagtacgggaaaaaaaaacttaagtatttgccctacaaccaccagcacgagtatttctttctgatcggtcccccactccttatccctatgtactttcagtaccagatcattatgactatgatcgtccacaagaactgggtggatctggcctgggctgtttcctactacatcaggttctttattacatatatcccattctatggcattcttggagctctgctttttctgaattttattcgattcttagagagtcactggttcgtgtgggttacacaaatgaatcacatcgtgatggagatagaccaggaggcatacagagattggttttcatcacaactcactgctacttgcaacgtcgagcagtcatttttcaatgattggttttctggccacctgaattttcagatcgagcatcatctgtttccaacaatgcccaggcataacctgcacaaaatcgcccctctcgtgaagtctctttgtgccaagcatgggattgagtatcaggaaaagccacttctgcgcgctcttctggacatcataagaagcttgaaaaagagtggaaaactctggctcgacgcctatctccacaaatag

SEQ ID NO: 187532 - DNA, 1335 bp, Artificial Sequence
  Description of Artificial Sequence: Synthetic coding sequence
atgggcaagggcggcaaccagggcgagggcgccgccgagcgggaggtgtctgttcccacattcagctgggaggagattcaaaagcataacctgcggacagatcggtggctggtgattgataggaaagtgtataatatcacaaagtggtccatccagcatccgggcggacagcgagtcatcggacattacgcaggagaagacgccaccgacgcatttcgggcgtttcatccagacttggagtttgtaggcaagttccttaagccacttctcatcggtgagctggccccagaagagccttctcaggatcacggcaaaaatagcaaaataacagaagatttcagggcccttcggaagactgctgaggatatgaacctgtttaagactaaccacgtcttctttctgctgctgctagcgcacattatcgcactggaatccatcgcatggttcacagtcttttacttcggcaacggatggatccctactcttattacagcctttgtacttgctacgtcacaggcccaagctggctggctccagcatgattatggccacttaagcgtgtatcgaaagcccaagtggaatcacctggtccataaatttgtgattggacacctgaaaggtgctagcgcaaattggtggaaccatcgccacttccagcaccatgctaagcctaacattttccacaaggatcccgacgtaaatatgctccatgtatttgtgctcggtgaatggcagccaatcgagtacggtaaaaagaagctaaagtacctgccttacaaccatcagcacgagtacttcttcctaataggaccaccattgctgattcctatgtattttcagtatcagattatcatgacaatgatcgtgcacaaaaattgggtggacttggcctgggcggtgtcctactatatccgttttttcattacgtatattccattctatgggattcttggggcccttctgtttctgaattttatacgcttcctagaaagccactggtttgtctgggtgacacaaatgaaccacatcgtgatggagatcgatcaggaagcatacagagactggttctcaagccagctaactgccacgtgtaacgttgaacagtcattttttaacgactggttctcaggccacctgaacttccagattgagcatcacttatttccaacgatgccaaggcataatcttcacaagatagctcccttagttaaaagcctctgcgctaagcatggcatcgaatatcaagagaaacctttgcttagggcactgttggatattattcgcagtctcaagaaatccggcaagctttggctggacgcatatctccataaatag

SEQ ID NO: 187533 - DNA, 1161 bp, Artificial Sequence
  Description of Artificial Sequence: Synthetic coding sequence
atgggcaagggcggcaaccagggcgagggcgccgccgagcgggaggttagcgtgccaaccttcagctgggaggagattcagaagcacaacctgcggacagatagatggctggtcatagacaggaaagtctataacatcaccaagtggtcaatccagcatcctggtggtcagcgggttataggccactatgcaggagaggacgctactgatgctttccgggccttccatcctgaccttgagtttgttggcaagttcctgaagccccttctcatcggcgagcttgcgcccgaggagccatcacaggaccacgggaaaaactctaaaatcactgaagacttccgcgccttacgcaaaacagcagaagacatgaacctgttcaagaccaatcatgtattttttctgttactgctggcacacatcattgccctcgagagtatagcctggttcaccgtgttttattttgggaacggttggatcccgacattaattaccgcttttgtgctggcgacgtctcaggcacaagccggctggctgcagcacgactacggccatctgtcagtgtacagaaagcccaagtggaaccaccttgtccataaattcgttattggtcatctaaagggagcatccgcgaactggtggaaccataggcacttccagcatcacgctaaacctaacatattccataaagatccggatgtgaacatgttacatgtgttcgtgctcggggagtggcagccaatcgaatacggcaagaaaaagctgaaatacctcccctataatcatcagcacgaatatttctttcttatcgggccccccctcttgatccccatgtatttccaataccagatcattatgaccatgatcgtccataagaattgggtggatctggcatgggctgtgagttactatatccggttttttatcacctatatacccttctatggcattttgggcgcactattgtttctcaatttcatccgatttcttgagagccactggtttgtatgggtaactcagatgaatcacatagtcatggagatcgaccaagaagcctatcgggactggtttagctcacagctgaccgccacctgtaacgtagagcagtcctttttcaacgactggttttcgggacatctcaatttccagattgagcaccagtag

SEQ ID NO: 187534 - DNA, 1338 bp, Artificial Sequence
  Description of Artificial Sequence: Synthetic coding sequence
atgggcggcgtgggcgagcccggcccccgggagggccccgcccagcccggggccccactgcctaccttctgctgggagcaaattagagctcacgatcagcccggcgacaagtggttggtgattgagaggcgtgtatacgacatatctagatgggctcagaggcacccagggggttctaggctcatcggccatcacggcgccgaggacgcaaccgatgcctttcgagctttccaccaggacctgaactttgtccgcaagttcctgcagcccctacttatcggagaattggcaccagaagaaccatctcaggacggccccttaaacgcacagctggtggaggactttcgggctttgcatcaagccgctgaggacatgaaactgtttgacgcttccccaacattcttcgcattcttactcggccacatcttggccatggaggtgctggcatggctgttgatttatttactgggccctggttgggtgccatccgccttggccgccttcatcctcgccatctcacaggctcagagctggtgccttcagcacgatttgggacacgccagtatatttaaaaaaagttggtggaatcacgttgcccagaaatttgttatgggacagttgaagggcttttctgctcactggtggaactttagacactttcaacatcacgccaagcctaatatctttcacaaggacccggatgtcacagttgcccccgtgtttctactgggcgaaagtagcgtggaatacggaaaaaaaaagcggcgctatctaccatacaaccagcagcacctgtacttcttcctgatcggacccccccttctgaccttggtcaattttgaagtggagaatcttgcttacatgctcgtctgcatgcaatgggccgatctattgtgggccgcgtctttctatgcccgtttcttcttgtcctatctcccattttatggcgttcctggagtcttgctcttttttgtggctgtaagagtgctagagagccattggtttgtctggatcactcagatgaaccacatccccaaggagattggacacgagaaacacagggattgggtgtcatcgcagctcgccgccacctgcaatgtcgagccatctttattcaccaactggttttctggacatctcaacttccagatcgaacaccacctgttcccccggatgccgcgccacaattactcacgagttgcccccttggtgaagtccctgtgtgccaaacacggtctctcttatgaggttaagccctttctgactgctctggtggacatcgtaaggagcctgaaaaaatcaggcgacatttggctggacgcttacctccatcagtag

SEQ ID NO: 187535 - DNA, 1158 bp, Artificial Sequence
  Description of Artificial Sequence: Synthetic coding sequence
atgggcggcgtgggcgagcccggcccccgggagggccccgcccagccgggggctccactccctacattttgctgggagcagatcagagcccacgaccaacccggggacaagtggttagtgattgaacggcgagtgtatgacatatctcggtgggcccaacgtcacccaggtgggtctagattgattggacaccacggcgcagaggacgcaaccgacgccttcagggcgtttcaccaagatctcaatttcgtgcgaaagtttcttcagcctctattgatcggtgagctggccccggaagagccgtcccaagacggccccttgaatgcccaactcgttgaagatttccgggcgcttcaccaggctgctgaggacatgaagttgtttgatgcgtcccctacgttcttcgcattccttcttgggcatatcttagctatggaggtgctggcctggttgctaatttatttgttggggcccgggtgggttcccagcgctttggccgcattcattctcgccataagtcaggcgcagtcttggtgtcttcaacacgacttgggtcacgccagtatcttcaaaaaatcatggtggaaccatgtggcacagaagtttgtgatgggacagcttaaaggattctccgcgcactggtggaactttaggcatttccagcatcacgctaagcccaatattttccacaaagacccagacgtgacggtcgccccagtttttctgctgggtgagagcagcgtagagtacggaaagaaaaagagacggtacctgccctacaatcagcagcacctgtacttctttctgatcggtccgccgttgctcactttagtgaactttgaggtagaaaacctggcttacatgcttgtctgcatgcagtgggccgatcttctctgggcagcatcattctacgcccgatttttcctctcatacttgcctttttatggtgtgcctggagtgctcctttttttcgttgctgtgcgctacgggcgtgagtggcgggggcatacccaagcaactggagatccgcactgcagcccccctcccgagttaccattttctagactccagaatggcgcaagcgggaccgcttcccttgcgtgctggtggaaccatattaacactagcgtggcaggcgctcaggggagatgggtgtag

SEQ ID NO: 187536 - DNA, 1017 bp, Artificial Sequence
  Description of Artificial Sequence: Synthetic coding sequence
atgttccaggccttccccggcgactacgacagcggcagccggtgcagctcttcacccagcgcagagtcacagtacctgagcagcgtggactcttttggatctcctcctacagcggctgcctcacaagaatgtgctggactgggagaaatgcccggcagtttcgtcccaaccgtaactgcaataacgactagccaggacttacagtggctggtgcagcctaccctcattagctccatggcccagtcccagggacagcctctggcatctcagccccccgtagtggacccatacgacatgccaggcaccagctactccacccccgggatgtcaggatatagttctggcggagcgtctggaagcggaggcccgtcaacctccgggacaacaagcggtcccgggcccgcccggccggccagagcacgtcctagacgaccgagagaagaaacccttacaccagaagaggaagaaaaaaggagggtgcgccgagaacgcaataaactggctgccgccaaatgccgcaataggagaagggagctgaccgatcgtttacaagctgagaccgatcagctggaggaagagaaggcagagctggagtctgaaatagccgagctgcagaaggagaaagagcggctggagttcgtactggtggcccacaagccagggtgcaaaatcccatatgaggagggacctggaccgggaccactggccgaggtgcgggatttaccagggtccgcaccagccaaggaggatggttttagctggcttctcccccctccccccccacccccattaccgttccagactagccaggatgcaccaccaaatctcacggctagtctatttacacactctgaggttcaagtgcttggggacccattcccagttgttaacccctcatatacctcgagctttgtcctcacatgccccgaggtctcagccttcgcgggagcccagcgaacttcgggctctgaccagccatctgacccactgaacagcccatctctgctggcgctgtag

SEQ ID NO: 187537 - DNA, 909 bp, Artificial Sequence
  Description of Artificial Sequence: Synthetic coding sequence
atgttccaggccttccccggcgactacgacagcggcagccggtgcagttcgagtccatccgccgagtctcaatacctgtcctccgtggattctttcggatcaccccccactgcagcagcttcccaggagtgtgccggtctaggggagatgcccggttcgttcgtccctacggtgactgccattaccacaagccaggatctgcagtggctggtgcagcctacgctcatatcgtccatggcacaaagccagggccagcccctagccagccagccaccggtggtcgatccgtatgacatgccaggtacatcctactcaacgccagggatgtcaggatattcctctggaggggcgtccgggtccggagggcccagtacatccggaacaactagcgggccagggccagccagacccgcccgggcacggccaaggagaccccgggaggaaaccgaaaccgaccagctcgaagaagagaaggctgaactggagtccgaaatcgctgaattgcaaaaggaaaaggagcgcctggaattcgttctagtggctcacaagcctggctgcaagattccctacgaggagggaccggggcccgggccactcgctgaagtccgggatctgcctggtagtgctccggccaaggaggacggcttctcctggttgcttccgcctcccccaccaccaccactgccatttcagacgtcgcaggatgctcctcctaacctgaccgcaagcctttttacgcacagcgaggtccaagtcctcggggaccccttcccggtagtgaacccctcctacacaagctcgttcgtgctgacctgccctgaggtgagcgctttcgccggggcccagcgaacaagcggctctgaccagccatctgacccccttaacagcccctccctgctggctctgtag

SEQ ID NO: 187538 - DNA, 588 bp, Artificial Sequence
  Description of Artificial Sequence: Synthetic coding sequence
atgttccaggccttccccggcgactacgacagcggcagccggtgctcttcaagcccttcagctgaatcacaatacctgagctcggtcgacagcttcggaagcccgccgacggcagccgcctctcaggagaccgatcagcttgaagaagagaaagccgagcttgagtccgaaatcgctgagcttcagaaggagaaggaaagactggaatttgtgttggttgcccataagcccggatgcaagataccttatgaagagggacctggcccaggtccattagctgaggtccgtgatctacccggttcagctcccgccaaggaggacggatttagctggctgctccctccaccacccccaccacccctccccttccagacttctcaggacgcgcctcctaatctgacagctagtctgtttacccattcagaggtgcaagtgttaggcgatccctttcctgttgtcaacccgagctacacctcatcctttgtgctcacttgccccgaggtgtctgcgtttgcaggcgctcaacgcacctcaggatccgaccagcctagcgatcctctcaacagcccctctctgctagcactctag

SEQ ID NO: 187539 - DNA, 876 bp, Artificial Sequence
  Description of Artificial Sequence: Synthetic coding sequence
atgttccaggccttccccggcgactacgacagcggcagccggtgcagttctagtccatctgcagagtcacagtacttatccagtgtagactccttcggcagcccacccactgcagcagcctcccaggagtgcgccggtcttggcgaaatgcccgggtcgtttgtgcctacggtaacggctattacaaccagccaggatctccagtggctggtccaaccaacgctaatatcatccatggcacagtctcagggccagccactggcatctcaaccaccggtggtggacccatacgacatgccgggtacctcctattctacccccggaatgtcaggttattcatcagggggggcgagtggatccggtggtccctctacgagcggtacgacctcaggacccgggcccgcacggcccgccagggctaggccaaggcgcccgcgcgaggagactttgacacctgaggaggaggagaagcgccgtgtgaggagggagagaaataagctggctgccgccaagtgccgcaatcggaggcgcgaactgaccgacaggcttcaggcagagacggaccagctggaggaggaaaaggcagagttagagagcgaaatcgcagaactccagaaggaaaaggagcgacttgaattcgtgttggtagcccataagccaggctgcaagatcccatacgaagaagggcccgggcccgggcctctcgccgaggaggtgcaggtgctgggggacccattcccagtggtaaacccaagttacacttcaagttttgtcctgacgtgtccggaagtctccgcgttcgccggcgcccagaggaccagtggatccgaccagcctagcgatcccctgaactctccctcattactcgccctctag

SEQ ID NO: 187540 - DNA, 912 bp, Artificial Sequence
  Description of Artificial Sequence: Synthetic coding sequence
atgagcgacaacggcgtgtgcgtgctggccttcaagtgccccggcctcctgcgctatactgcctatagatgtaagcagctgtcggatacatctataatcgcagttgcctcccactgtccgctgttacagaaggtgcacgtcggcaaccaggataaactgactgacgaaggtcttaagcagttgggtagtaagtgtagagaactgaaggatattcatttcggccagtgctacaagatctccgatgaagggatgatagtgatcgccaaaggctgtctaaagctacagcgtatctacatgcaggaaaataaactggtaactgatcagagtgtcaaagcctttgccgaacactgccccgaattgcaatacgtagggttcatgggatgttccgtgaccagcaagggcgtgatacacctgactaaactcagaaacctgtcatctcttgatctcaggcacatcacagagctggataatgagaccgtcatggaaatcgtgaaacggtgcaaaaacctgagcagcctcaacctgtgcctcaactggattatcaatgaccgatgcgttgaggtgattgcaaaggaagggcagaacttgaaggagctttacctggtgtcctgtaaaatcaccgactacgccctgatcgccattggtagatacagcatgaccatcgagactgtggacgtggggtggtgcaaagagatcactgatcagggagctaccttgatagcccagagcagcaaatccctccggtatttggggctcatgcggtgcgacaaagtcaacgaggtaaccgttgaacaacttgtacagcaatatcctcacattaccttttctaccgtcttgcaggactgcaaaaggacacttgagcgggcttaccaaatgggctggactcccaacatgtcagccgcaagcagctag

SEQ ID NO: 187541 - DNA, 945 bp, Artificial Sequence
  Description of Artificial Sequence: Synthetic coding sequence
atgagcgacaacggcgtgtgcgtgctggccttcaagtgccccggcttgcttcgctacactgcttaccgctgcaagcaactctccgatacgtcaatcattgctgtggcatcacattgccccctgctgcagaaagtgcatgtgggtaaccaggataagctgaccgacgaggggctcaagcagttaggctctaaatgccgcgagcttaaggacatacatttcggccaatgttacaagatatccgacgagggaatgatagtgatcgctaagggttgtctcaaattacagagaatctacatgcaggagaataaactggtcacagaccaatctgttaaggctttcgctgagcactgtcctgaactccagtatgttgggttcatgggctgtagcgtgacaagcaagggggttatccatcttaccaaactgagaaatctgagtagtctcgatctgaggcacattaccgagctcgacaatgagactgtaatggaaattgtgaagcggtgcaaaaacctgtcatctctaaatctgtgcctgaattggattatcaatgatcgctgcgtcgaagttattgccaaagaggggcagaatcttaaagagctgtatctggtctcctgcaaaatcaccgactacgcactcattgctattgggcgatattctatgactatcgaaactgtggatgtgggctggtgcaaggagataaccgaccagggagcaactctgattgcccagtcgagcaagtccctccgatatttgggacttatgcgctgcgacaaagtgagggtagactatcaagtagtctgctttctgcatatatcgatcgtgaattctctgatgtcctatcctttgagcttcagtatctccacaccagtgtactacatcctttatattcactttatctgtatctacgccatcatcgcgatgcactgcttacccgccttcgtaaactag

SEQ ID NO: 187542 - DNA, 2106 bp, Artificial Sequence
  Description of Artificial Sequence: Synthetic coding sequence
atgggccacctgctgagcaaggagccccggaaccggcccagccagaagaggccaagatgttgctcctggtgtcggcgccgaagacctttgttgagactcccccggagaacacccgcaaaggtgcccccccaaccggcggcccctagaagcagggactgcttttttagaggcccatgtatgctgtgctttatcgtccactccccaggggcgcccgccccggccggaccagaagaggagccacctctttcaccaccgcccagggatggcgcttatgccgccgctagtagctcgcaacaccttgcgcggaggtatgctgccctagctgccgaggactgtgcagccgccgccagaagattcctgctctcaagtgccgctgcagctgctgcggctgctgcttcagcatcgtctccagcgtcctgttgtaaggagttgggactggcggccgctgctgcatgggagcagcagggccgctccctcttcctcgcctcactgggacccgtgagattccttgggcccccagcagcagttcaattattccgcgggcctaccccttccccagcagaattgccaactccccccgaaatggtctgtaaacgtaagggggcaggagtcccggcttgcacaccttgcaagcaaccgcgctgcggcggcggcggttgcgggggaggtggcggcggcgggggggggggcggcccagccggtgggggggcttctccaccacgaccacctgatgcagggtgctgtcaggcccctgagcagcctccccaaccactgtgtccaccaccgtcatcacccacctctgagggagcccccactgaggccggaggcgacgcagtgcgggccgggggaacagcacctctttcagcccaacagcaacacgagtgtggtgatgctgattgccgagaatcacccgaaaatccatgtgactgtcacagggagccacctcccgagacccctgatataaatcaactccccccaagcattctgttgaaaatcttctcaaacttgtcactggatgaacgctgtctgtctgcttcccttgtgtgcaaatactggagagatctatgtttagactttcaattctggaagcaactcgacctgagttcccggcaacaagtgacagatgagttgctcgaaaagattgcctcacgctctcaaaacatcattgaaatcaacatttccgactgtcggagtatgtcagacaatggcgtgtgcgtgctggcttttaagtgccctggcctgctgcggtacaccgcgtatcgctgtaagcagctgtccgacacatccattatagcggtcgcctcccactgtcctcttcttcagaaagtgcatgttggtaaccaagacaaattaaccgacgaggggcttaaacagctcggttccaagtgtcgagagctgaaagatatccatttcgggcaatgctataagatcagtgacgagggcatgatcgtaattgccaagggttgtcttaagctccagagaatttacatgcaagaaaacaagctcgtaaccgatcagtccgtgaaggcttttgcagaacactgtcccgaattgcagtacgtgggctttatgggctgttctgtcacctccaagggagtgattcacctaaccaaactgcgcaatttgtccagcctggatctgaggcatataactgagctagataacgaaaccgtgatggagattgtgaagagatgcaagaatctctcaagtctaaacctctgcctgaattggatcattaatgaccggtgtgtggaagtcattgcaaaggaggggcagaatctaaaagagctgtacctggttagctgtaagatcaccgattatgcactgatagctattggcagatactccatgacaattgaaacagtggacgtaggttggtgcaaggagatcaccgaccaaggcgcaactttgatcgcccagtcatccaagagtctaaggtatctcggactgatgcgatgtgacaaagttaatgaagtgactgttgagcagttggtacagcagtaccctcacattaccttcagcacagtgttgcaagattgtaagcgcactttggagcgagcctaccagatgggctggactccaaacatgtctgcggcgtccagctag

SEQ ID NO: 187543 - DNA, 2025 bp, Artificial Sequence
  Description of Artificial Sequence: Synthetic coding sequence
atgagcagcagcagccggggccccggcgccggcgcccggcggcggagaactaggtgcaggcgctgtagggcttgtgtgagaacagaatgcggggactgtcatttttgccgggatatgaagaagtttggggggccgggtcgcatgaaacagagttgtctcctacgtcagtgcaccgctcccgtcctcccccataccgcggtgtgcttactttgcggggaggccggcaaggaagatacagtggaaggcgaagaagaaaagtttggcctctctctaatggaatgcactatctgtaatgaaatcgtccaccccggatgtcttaaaatgggcaaagcagagggagtgataaatgcagagatccctaattgttgggagtgtccacgatgtacccaggaagggagaacatccaaggatagtggggaaggacctgggcggcgacgagctgacaacggtgaagaaggagctagtttgggctctggttggaaactgaccgaagaaccccctctcccgccaccgcccccccgacgcaagggcccattaccagctggccccccccctgaagatgtgccaggtcccccaaaacgcaaggagagggaggccgggaacgagcctccaaccccccgcaaaaaagtgaaaggtggccgcgagcggcatctaaaaaaagtcggtggcgatgcgtgcctcttacggggttcagatcccggcggtcccggactcttacctccaagagtgcttaacccgtctcaggcattcagttcctgccatcccggccttcctcccgagaattgggagaagcctaaaccccctcttgccagcgctgagggaccggccgtgccctccccgtctccccagcgcgagaaactcgaacgctttaaacgaatgtgtcagcttctggagagagtaccagacaccagtagtagctctagcgacagcgactccgacagcgattcgtccggtactagtctctcggaggatgaggcaccgggggaagcccggaacggcaggcggcccgctcgcggctccagtggcgaaaaagagaatcgcggagggcgcagagccgtgcggccaggctcaggaggccctctcctgtcatggcccctgggtccggcccctcctccccgcccgccacagctagagcgccatgttgtaagaccgcctccacgcagcccggagcccgataccctgcccctcgccgcaggatccgaccatcccctccctcgcgcagcgtggctcagagttttccaacacctgggcccaagggagttatgcatatgcatgcgggtatgtcgcacatggtcacgctggtgttacgataaacggctctggccccgtatggatctgtccaggaggaaaagtcttaccccgcctatgctctccggcgtggttcgccgccagccacgggccctcgatctgtcttggactggggtgagtaagaagcagctgatgtggcttctgaatagactccaggggctccaggaactggtactgtccggctgttcctggctcagcgtttccgccttgggctccgcccccctacctgcactgaggctgctcgacctcaggtggattgaggatgtcaaggattcccaattgagggagttacttcttccaccgccagatactaagcctggccagaccgaaagtcgcggcagactacagggcgtggcagaactgcgcctggcaggccttgagctgaccgatgcatccctgcggctgctgctcagacacgcacctcaactctctgcattggatctcagtcattgtgctcatgtcggagatcctagtgtgcacctgctcaccgcacctacttctcccctccgtgagacccttgtgcacttgaatcttgccgggtgtcatcgtttaactgaccactgtctgcctctattccggcgctgtccccggctgaggaggctagatttaaggagctgccgacagttgagcccggaggcatgtgcacggttagctgccgcagggccccccgggcccttccgatgtcccgaggagaagctgctgctcaaggacagttag

SEQ ID NO: 187544 - DNA, 2085 bp, Artificial Sequence
  Description of Artificial Sequence: Synthetic coding sequence
atgggcatgaaggtgcccggcaagggcgagagcggccccagcgccctgctcacccctcctatgagtagttcaagtcgcggccctggcgccggcgcaagacgacgacgcactagatgcagacggtgcagggcttgtgtaaggaccgagtgtggcgactgtcatttttgcagagacatgaaaaagttcggtggccccgggaggatgaagcaatcttgtctgctgagacagtgtacggctccggtactgcctcacacagccgtgtgcctgctatgcggggaagcaggcaaagaagacacagtggagggggaggaggaaaagttcggactgtctcttatggagtgtaccatctgtaatgagatcgtgcacccagggtgcctgaagatgggaaaggcagagggggtgattaacgccgagatacccaattgctgggaatgcccccgatgcactcaggagggacggactagtaaagactcaggagaaggtccaggccggagacgggctgacaacggagaggagggcgcttcgctcggcagcggctggaagctcactgaggagccccccctgccgccgcccccccccaggaggaaaggacccctgccggcaggcccgccacctgaagacgtgcccggaccgcctaagcggaaagagagagaagcaggtaatgaacctcctactccaaggaagaaagtaaagggtggacgcgaacgccaccttaaaaaggtgggtggggatgcatgcttgctgagggggagcgaccctggcggaccgggacttctgccaccacgtgtgctgaatccctcgcaagccttttcctcatgtcaccccggcttaccccccgagaattgggagaagcctaaacctcccctggcatcagccgagggacccgctgtgccatccccgtctccccagcgggaaaaactggaaaggttcaaacgcatgtgccagttgctcgagcgtgtgcctgatacctcgtcctccagctctgattctgatagtgatagcgacagcagcggcactagcctgtccgaagatgaggcaccaggtgaggctcgtaacggacggaggccagccaggggatcgtctggcgagaaggagaaccgtggaggccgcagggccgttcggccaggtagcgggggtccactgttgagctggcccctaggtccagcaccacctcccagaccacctcaacttgaacgccatgtggtgaggccccccccccggtcaccagaacccgatacattgccgctggcggctgggagtgatcaccccctgccacgggccgcgtggctgcgtgttttccaacatctgggcccgcgggagctgtgcatctgtatgagggtctgcagaacatggagcagatggtgttatgacaagcgtctttggccccggatggacctgtctagaaggaaaagtctcaccccccctatgctgtctggggtggtcaggcggcagccgcgcgctctggatctaagttggaccggtgtgagcaagaaacagttgatgtggctcctgaatcgcctgcagggcctgcaagaattggtactgagtggttgctcttggctgagcgtgagtgccctcggcagcgcgcctctgcctgccctgagactgctcgacttgcggtggatcgaagatgtcaaggattctcagttacgggaactattgttacctcctcccgacactaagcccggtcagaccgagtcgcggggcaggttgcagggcgttgctgaactccgacttgccgggctggagctcaccgatgcatctctcaggctcctgctcagacacgcgccacaactgtcagccttagatctgtcacactgtgcccacgtgggggatcctagcgtgcacctgcttaccgctccaacttcgcccctccgcgaaacgttggtccatctcaatctggctgggtgccaccggctcacggaccactgccttcctctcttccgaagatgcccgagattgcgccgcctggatcttcgaagctgtcgccagctttcacccgaggcctgcgctcggttggccgctgccgggccgcccggtcccttccgatgccctgaggagaagctcctgctcaaagacagctag

SEQ ID NO: 187545 - DNA, 1761 bp, Artificial Sequence
  Description of Artificial Sequence: Synthetic coding sequence
tgacggatgaagcagagctgcctgctgcggcagtgcaccgcccccgtgctgcctcacacagccgtctgtttgctctgcggggaggccgggaaagaagatactgtcgagggagaagaagaaaagtttggactctctcttatggaatgtactatctgcaacgaaattgtccacccaggatgcctcaagatgggaaaggccgagggcgtaatcaacgccgagatccctaactgttgggaatgccctagatgcacgcaggaagggcggacatctaaagacagtggggaagggccaggtcgtcgtcgtgccgataacggcgaggaaggcgcttccctgggatccgggtggaaactaactgaagagcctcccttaccgcccccccctccacggagaaaaggacctctcccagctgggccacctcccgaagacgtcccaggacctccaaagcgaaaggagagagaagcaggcaatgaacctcccacgccgcgtaagaaagtgaagggcggtcgcgagcggcatttgaagaaaaagccgaaacctcccctggcctcagcagaaggccctgccgtgcccagtccatcacctcaaagagagaaactggaaaggtttaagagaatgtgccagctcctggagcgcgttcctgacacttcttcaagttccagcgacagtgattccgacagcgattcatcaggaacttctttatcagaggatgaggctcccggggaggcaagaaatggtagaagacccgcacgaggctcatcaggagagaaggagaacaggggaggacggagggcagtgagaccgggctctggcggacctctgctgagttggcctctgggccccgccccccccccaaggccgcctcagctggagcgacatgttgtcaggccacccccccggtcgccggagccggacactctgccattagctgccggctcagaccaccctctgcctcgagccgcatggcttagagtgttccagcacctaggacccagagaactttgcatttgcatgagagtgtgtcgaacttggtcccggtggtgttatgacaaacggttgtggccaaggatggacctgagtcgccggaagtcattgacccctcccatgttatccggagttgttcggaggcagccacgagccctcgatttgtcttggaccggtgtttccaagaagcaacttatgtggcttttgaatcgactccagggacttcaggagttggtcctgagcggctgtagctggctttccgttagcgcgctagggtccgcccctctgcccgctttaagactcctcgacctgcgttggattgaggacgtgaaagattcacagttgcgggaactgctgctgcctccacccgataccaaacccggtcaaacggagtcccggggccgactccagggggtggcggaactgcgcctggcagggcttgagcttactgacgcctccttgcgcctactactcaggcacgcccctcagctcagtgcacttgatctcagtcactgcgcccacgtcggggatccatcagttcatctgctcacagccccgactagccctctgagggaaaccctggtgcacctgaacttggcaggatgtcatcgtcttactgaccattgcctgccgctatttcgaagatgcccaaggctcagaaggctggacctaaggtcatgccgccagttaagtccagaggcctgtgcacggctcgcagctgccggcccccccggcccttttcgttgccctgaggagaagttattactgaaagactcatag

SEQ ID NO: 187546 - DNA, 495 bp, Artificial Sequence
  Description of Artificial Sequence: Synthetic coding sequence
atggacctggaggagtgcatcctgatcaccgacagcaccctgatccagctgtctatacactgcccaaagctgcaggcgctagtcagcctgagcttcagtgatatcattcacctccttaagatgaaggaaccgagccaccataataaaaagctgttcgggttctctttttgtaaatccttgagccattgtgagctaatcaccgatgacggaatcttgcatttgtctaattctacctgcggccatgaaaggttgcgggttctggagctcgacaattgcctgctgatcacagatgtcgccctcgagcaccttgagaattgccgcgggcttgagagactggagttgtacgattgtcaacaggtgaccagggccgggattaaacggatgagagctcagctcccacacgtaaaggttcatgcctactttgctccggtgactccgcctaccgccgtcgctggatccgggcagcggttatgccgttgctgcgtcatcctctag

SEQ ID NO: 187547 - DNA, 1272 bp, Artificial Sequence
  Description of Artificial Sequence: Synthetic coding sequence
atggtgttcagcaacaacgacgagggcctgatcaacaagaagctgccaaaagaacttctgctccgtatcttcagttttctggacattgtgactctttgtaggtgtgcccagattagtaaggcgtggaatatccttgctctggacgggtccaactggcagcgtattgatctgttcaacttccaaaccgatgtcgagggccgagtagtcgaaaacatctcaaaacggtgcggaggatttctccggaagttatcattacgcgggtgcatcggggtcggcgactcgtcgctcaagacctttgcccagaactgcagaaacattgagcatctcaacctgaacggatgtacaaagataaccgattccacatgttactcactctccaggttttgcagcaaattgaaacatttggacttgacctcgtgtgtatcaatcaccaattcttctctgaaggggatatcagagggctgccggaacctagagtacctgaacctgagttggtgcgaccaaatcaccaaagatggaatcgaagctttggttcgtggctgccgcgggctgaaagctctcttgctgcgcgggtgtacacaactggaggacgaagccctgaagcatatccagaattactgccacgagctggtgtctttgaacctccagtcatgctcccggataaccgatgaaggtgtggtgcagatctgcagaggctgccatagactgcaggccctgtgtctgtccggttgtagcaacctgactgatgcgagtctcacagctctcgggttgaactgcccaaggctgcagatcctggaagcggctagatgtagccatctgacggacgcaggctttacccttctagcaaggaactgtcatgagctggagaaaatggacctcgaagagtgtattttaatcaccgattccactctgatacaactcagtatccactgccctaaactgcaagcactcagtctgagccactgtgagttaattactgatgacggtatcttgcacctgagtaattctacgtgcggtcacgagaggctgcgcgtacttgagcttgataactgtctgctgatcacagacgttgccctggaacatttggagaactgcaggggcctagagcggctggagctgtacgattgccagcaagtgacaagagcggggattaagcgcatgcgcgcccagctgccccacgtgaaagttcacgcatactttgcgccagtaactccaccgaccgccgtggccggaagcggccaacggctgtgtcggtgttgtgtcattctctag

SEQ ID NO: 187548 - DNA, 1020 bp, Artificial Sequence
  Description of Artificial Sequence: Synthetic coding sequence
atgtacatcgccctggtgtggatcctgttcgtgatgtggaccttcgcacaaaactgcagaaatatcgaacacttgaacctcaatggctgtacaaaaattacggactcaacctgttactcattgagccgcttctgcagcaagttgaaacatctagatttaacatcctgcgtttcaattacaaacagcagcctcaagggaatctctgaagggtgtcgaaatttggagtacctgaacctgagctggtgcgaccagatcacgaaggacggtattgaagccctcgtgagagggtgcagaggactcaaggccctgttgttgcggggctgcacacaacttgaggatgaggccttaaaacacattcagaactattgtcacgagctggtcagcctcaatcttcaatcctgctccagaatcactgatgagggcgtggttcaaatctgcagaggctgtcacaggttgcaggcgttgtgcctctcaggttgtagcaatttaacagatgcgagcctgactgcactgggccttaactgccctcgacttcagatccttgaagcagccaggtgctcccacttgacagatgcaggattcactcttctcgccagaaattgccatgagctagagaagatggacctggaagagtgtattctcatcaccgacagcaccctgattcagctgagcatacactgtccaaaattgcaggctctgagtctttcccactgtgaactcattacggatgacggtatactgcacctgagtaactcaacatgtggccacgagagacttagggtgctggaattagacaactgccttctcatcaccgatgtggctctcgagcatctagaaaattgtaggggactggaaagactcgagctttacgattgccagcaggtcacgagggccggtataaaaaggatgagggctcagctgccccatgtgaaggtccacgcatactttgcaccggtgactcctcccactgcggtagccggcagtggccagagactttgtcggtgctgcgttatcttgtag

SEQ ID NO: 187549 - DNA, 1068 bp, Artificial Sequence
  Description of Artificial Sequence: Synthetic coding sequence
atggtgttcagcaacaacgacgagggcctgatcaacaagaagctgccaaaggagctgctactcagaatcttctcatttctggacatcgtaacgctgtgtcgatgtgcccagatatccaaggcttggaatattctcgcattggatggaagtaactggcagaggatagatctgttcaatttccaaacggacgttgagggacgggtcgtggagaatatctccaagcggtgcgggggctttctgcggaaattgtccctacgcggctgcatcggagtgggagactctagcttgaaaactttcgcccaaaactgccggaatatagagcatctcaatctcaacggctgtactaagatcactgacagcacttgctattctctctcaagattttgctcaaaactcaagcacatccagaattactgtcacgaactggtgagtttgaacttacaatcctgttccaggatcactgacgaaggggtcgtgcagatttgccgcggttgccatcggctgcaagcgctgtgtctgtcaggctgcagtaatctgactgacgcttcactgacagccctaggcctcaattgcccgcgacttcagatcctcgaagccgcacggtgtagtcatttgaccgacgctggcttcaccttactggcgcggaactgtcatgagctcgagaagatggacttggaagagtgcatccttattacggacagcacattgattcagctgtccattcattgccctaagcttcaagctctgagcctcagtcactgcgaactgattacggacgatggtatcctgcacctgtcaaacagcacctgtgggcacgagcggctcagagttctggagcttgataactgtctcctcatcaccgacgttgcacttgagcacctggagaactgccgcggcctcgagcggctggagctgtacgactgtcagcaggtaacacgcgccggcataaagagaatgagagcacagctcccacatgtcaaggtgcacgcatatttcgcccctgtgacaccgcccaccgctgttgcgggctcggggcagagactctgtcgatgctgcgtgattctgtag

SEQ ID NO: 187550 - DNA, 402 bp, Artificial Sequence
  Description of Artificial Sequence: Synthetic coding sequence
atggacctggaggagtgcatcctgatcaccgacagcaccctgatccaacttagtattcactgccctaagcttcaggcattgagcctcagtcactgcgagttgattacagacgacgggattctacacttgtctaattctacttgtggtcacgagcgactccgtgtcttggagctggataattgtctgctcattactgacgtagccttggagcacctcgagaactgccgtggcctcgagagactggaactgtatgattgccagcaggtgacaagggccgggataaagcgcatgcgtgcgcagctccctcatgttaaggtacacgcctacttcgctcccgttacgcctcctacggccgttgcgggttctggacaacggctgtgcagatgctgcgttattttatag

SEQ ID NO: 187551 - DNA, 1068 bp, Artificial Sequence
  Description of Artificial Sequence: Synthetic coding sequence
atggtgttcagcaacaacgacgagggcctgatcaacaagaagctgcccaaggaactcctgttgaggattttttctttcctagacatcgttactctttgccgctgtgctcaaataagcaaggcttggaacatcctggcccttgatggctccaactggcagagaattgacctgtttaactttcaaactgatgtcgagggtagggtagtggaaaatatctccaagaggtgcggtggttttctgaggaagctaagcttacgcggctgtattggggtcggagattcttctctcaagacatttgcccagaactgtcgtaatatcgagcatctgaatctgaacgggtgtaccaagatcacagatagcacctgttactccctctcgcggttctgctcaaagctgaagcacatccagaactattgccacgagctggtatcccttaacctgcagtcttgctcacgaatcaccgatgaaggcgtggtgcaaatatgccggggatgtcaccgcttgcaggcgctttgcctgtccggatgtagtaacctaaccgacgccagccttacagccttaggcctcaactgccctcgcctccaaatcctggaagccgctagatgctcacacctgacagacgccgggttcaccctcctggccaggaattgccatgagcttgaaaaaatggacctggaggaatgcatattgataactgacagcactctgatccagttgtcaatacactgcccgaaattgcaggccctctcattatctcactgcgaactgatcaccgacgatgggatcctacacttgagcaacagtacttgcggccacgagcggttgcgggtgttggagcttgacaactgtctgctgatcactgatgtggcactggagcacctggaaaactgccgagggttggaacgtctggaactatacgactgccaacaagtgacccgagcgggaatcaagcgtatgagagcccaactgcctcatgtgaaggtccatgcctacttcgcaccagttactccgcccacagctgtcgcaggttccggtcagaggttatgtaggtgctgcgtaattttatag

SEQ ID NO: 187552 - DNA, 1260 bp, Artificial Sequence
  Description of Artificial Sequence: Synthetic coding sequence
atggtgttcagcgccgtgctgaccgccttccacaccggcaccagcaataccacatttgtggtatacgagaacacttacatgaatattacccttccccccccctttcagcatcccgacttgagcccgctgttaaggtactccttcgagactatggcccccacggggctcagctctctgaccgtgaattcaacggctgtgccgacgacccccgcagctttcaaatcattgaatttacctctgcagattactctctcagccatcatgatcttcatcttattcgtaagcttcctgggaaatctcgttgtatgcttgatggtgtaccagaaagccgcaatgcgctcagccatcaacatcctgctggcctcccttgccttcgccgatatgctgttggcagtgttgaatatgcccttcgccctagtcaccatcctgaccacacgatggatctttggcaaattcttctgccgagtaagcgccatgtttttctggcttttcgtgatagaaggggtggctatcctgcttattattagcattgatcggtttctcatcattgtccaaagacaggacaagctaaacccttaccgagcaaaagtgctgatcgctgtgtcctgggccacctccttctgtgttgcatttccactcgcggtcggtaaccctgatctgcagatcccttctcgggcccctcaatgcgtcttcggctacaccaccaatccgggctaccaggcttacgttatcctgatctcactcatcagcttttttatcccttttcttgttattctgtattcctttatggggattcttaacacccttcgacacaacgccctgcggatccatagctaccctgaaggaatttgcctttcccaggcaagtaagctgggtctgatgtcgctgcagaggccgttccagatgtcaatcgatatgggcttcaagacccgagcatttaccaccatcctgatcctatttgcagtgttcatcgtgtgttgggcaccattcaccacctatagtcttgtcgccactttttcaaagcacttctactaccaacacaatttctttgagattagcacctggttgctgtggctgtgttacctgaagtctgctttgaatccacttatctattactggagaattaagaagttccacgacgcatgcttggatatgatgccaaagtccttcaagttcctcccccaactccccggtcacacgaagcgacggatacgcccatccgccgtctatgtgtgcggcgaacacaggaccgtcgtttag

SEQ ID NO: 187553 - DNA, 1866 bp, Artificial Sequence
  Description of Artificial Sequence: Synthetic coding sequence
atgagccccgtgttccccatgctgaccgtgctgaccatgttctactatatatgtctgaggcgccgagccaggaccgcgacaaggggcgaaatgatgaatacacacagagccatcgaaagtaacagccagacgagtcctctgaacgcagaggttgtgcaatacgctaaagaagttgtggactttagtagccactacggatccgaaaactctatgtcctacaccatgtggaatcttgctggtgtgcccaatgtgtttccttcgagcggcgattttacacaaacagccgtgtttagaacatatggcacatggtgggatcagtgtcctagtgccagtctgccttttaagaggacgccaccgaacttccagtctcaggattacgttgagctcacattcgagcagcaggtttaccccactgctgtgcacgtactggagacctaccatcccggcgccgtgattcgcatcctagcctgctctgccaatccatactctccaaaccctccagctgaagtgagatgggagatcctatggagcgaaaggcccactaaggttaacgcatcccaggctagacaatttaagccatgcatcaagcaaataaattttcccacaaacttgatccggctggaggtgaattcatctctgttagaatactatacagagttggacgccgtggtgttgcacggcgtgaaggataaaccagtgctgtctctgaaaacgtcgcttatagatatgaatgacatcgaggacgatgcctacgcagaaaaagatggctgcggaatggatagcttgaataagaagttcagttctgccgtcctgggggagggccctaataacggttacttcgacaagctgccctacgagctgattcagttgatcctcaatcacctcaccctccctgacctctgcagactcgcccagacctgcaagctgcttagccagcactgttgtgaccctctgcaatatattcacctcaatcttcagccctattgggccaagctggatgatacctctctggaattccttcaatccaggtgcaccctcgtgcagtggcttaatctcagctggactggaaatcgaggattcatctctgtggccggattttcccggtttctgaaagtatgtggtagtgagctcgtgcggctggagctcagctgcagccactttcttaatgagacctgtctggaggtaatatccgagatgtgtccgaatctacaggccctcaatctgtcatcatgcgacaaactgcccccccaggccttcaatcacatcgccaaactttgtagtttaaagagattggtgctttaccggaccaaagtggagcagaccgcgctgctgtccattctcaacttttgtagtgaactgcaacatctatcgttaggcagctgcgttatgatagaagactatgacgtgatagccagcatgataggggctaaatgcaaaaaactgcgtacccttgatctctggcggtgcaaaaatattaccgaaaacggaatcgccgagttggccagcggatgccctctactggaggagctcgacctaggctggtgccctaccctacaaagcagcactggttgtttcacaaggctggcacatcaactccctaatcttcagaaactgttcttaaccgcgaacagaagtgtgtgcgacactgatattgatgagctggcctgcaactgtaccagactccagcagctcgatattctcgggacccggatggtgagtccagctagtctacggaagttgctggaaagctgcaaggatctatctctgctcgatgtgagcttctgctcgcagatcgacaatcgcgccgtattggagctgaacgcctccttccctaaggtcttcattaaaaaatctttcacccagtag

SEQ ID NO: 187554 - DNA, 2076 bp, Artificial Sequence
  Description of Artificial Sequence: Synthetic coding sequence
atggcccccttccccgaggaggtggacgtgttcaccgccccccactggcggatgaagcaactcgtcggcctgtattgcgataaactcagtaaaacgaatttctctaataacaacgacttcagagcactgctgcagtccctttacgcaacattcaaagagttcaagatgcacgagcagatagagaatgaatatattattgggctgctgcagcagcggagccaaacgatctacaacgtacacagtgacaacaagctcagcgagatgctgtccctcttcgaaaaaggcctgaagaacgttaagaatgaatacgagcagctgaattatgctaagcaactgaaggaaagactcgaagcatttacgagagattttctccctcacatgaaggaggaggaggaggtattccaaccaatgctgatggaatacttcacatacgaggagctcaaggatatcaaaaaaaaagtgattgcgcagcactgcagtcaaaaggacactgcagagttgctacggggcctgtcgctgtggaatcacgccgaggaaagacagaagttcttcaagtatagtgttgacgaaaagtctgataaggaagccgaggtgagtgagcacagtactggcattacacacttgccccctgaggtcatgctgtctatcttctcgtacctgaatccccaggagctgtgtagatgttctcaggtctcaatgaagtggtcccaactgacgaagaccggttctttgtggaaacacttatacccggtgcactgggcccgtggcgattggtattccggacctgcaactgagttggacaccgagccagacgatgagtgggtgaagaacaggaaggatgagtccagagccttccacgagtgggatgaagacgccgacattgacgagtcagaagaaagtgccgaggagagcattgctatcagtatcgcacagatggagaagaggctgcttcacggcctaatccacaatgtactgccatacgtgggtacaagcgtgaaaacattggtcctagcctatagttctgctgtgtcttccaaaatggtgaggcagatactggaactgtgccccaacctcgaacatctggacctgacacagacagacatatcggattctgccttcgacagttggtcctggttgggatgctgccagagcctgcggcaccttgatttgagcgggtgcgaaaagattaccgacgtcgccctcgagaagatcagcagggccctcggtatcttaacctcccatcagagcgggttcctgaaaacatcgaccagcaagatcacaagcaccgcttggaagaataaggacattaccatgcagagcacaaagcagtatgcttgtctccacgaccttactaacaaagggattggggaggaaatcgacaacgaacacccttggactaaacctgtcagttctgaaaacttcaccagcccctatgtgtggatgttggacgccgaagacctagccgatatcgaagataccgtcgaatggcggcacaggaatgtggagtctctgtgtgttatggagacagccagcaatttctcttgctctacttccggctgtttttcaaaagacatcgtgggtctgcgtactagcgtgtgctggcagcaacactgtgccagccctgctttcgcttattgcggtcattcattttgctgtactgggacagccctccggacaatgagctctctgccggagtccagcgccatgtgccgcaaagccgcacggaccaggcttccccgaggcaaagacctcatttacttcggtagcgaaaaatccgatcaagagacgggaagagtcctgctgttcttgtccctcagcggctgctaccagatcacagaccatggacttcgggtcctcacgctcggcggcggtctgccatatctcgaacacctgaacctatccggctgcctgacaatcacaggcgccggactgcaggatctggtgtccgcctgccctagtctcaatgacgaatatttctactattgtgacaatatcaacggaccccacgccgataccgcatcaggctgccaaaatctgcagtgtgggtttcgcgcgtgctgtcgctcaggggagtag

SEQ ID NO: 187555 - DNA, 1698 bp, Artificial Sequence
  Description of Artificial Sequence: Synthetic coding sequence
atgaaggaggaggaggaggtgttccagcccatgctgatggagtacttcacatatgaggaactgaaggatatcaagaaaaaggttatcgctcagcattgctctcagaaagacacagcagaattactccgtggcctgtctttatggaatcacgccgaggagaggcagaagttctttaagtattcagtcgacgaaaagtctgacaaggaggccgaagtgagtgaacacagcacaggcatcacgcatctgcccccagaggtgatgctgagcatcttttcctacctgaacccccaggagttgtgccgctgctcacaggttagcatgaagtggtcgcagttgacgaaaaccggctccttgtggaagcacctgtatcctgtccactgggcccgcggcgactggtactctggccccgcgaccgagctggatacagagccagatgacgagtgggtgaagaatcgtaaggacgaaagccgcgctttccacgaatgggatgaggatgctgatatagacgagtccgaggaaagcgccgaagagagtatcgccattagcattgcccagatggagaaacggctgctgcatggtcttatacataacgttctcccttatgtcggcaccagtgtcaaaacactggttcttgcgtatagtagtgctgtctcttcgaaaatggttcggcaaatcctggaactatgcccgaatttggaacatctagacttgacacagactgatataagcgactccgcctttgactcatggagctggttgggctgctgccaatcattaaggcacctggacctttcaggctgcgaaaaaattactgatgtggcactggaaaaaatctcaagagccctgggcattttgacctcccaccaatccggcttcttgaagacatccacctcgaaaattacaagcactgcttggaaaaacaaagacataaccatgcagagcactaaacagtatgcttgtctgcatgacttgaccaataagggtattggggaagagatcgataatgaacacccttggaccaagcccgtctcctctgagaacttcacatccccctacgtctggatgttggatgccgaagacctcgcagacatcgaggataccgtggaatggagacacagaaatgttgaatcattatgtgttatggaaactgcttctaatttcagttgttcaactagcgggtgcttcagcaaggacattgtgggactgcgaacctcagtgtgttggcagcaacactgcgcgtcccccgcattcgcgtactgtggccattcattttgctgtaccggcacagccttgaggacaatgtctagtctgcccgaatccagcgctatgtgcaggaaggctgcacgcacgaggctgccaagaggtaaggacctgatatattttggatcagagaagtctgatcaggagacaggccgcgttctgctgtttctttcactttctgggtgttatcaaataaccgatcatgggctgagggtcctcaccctgggcggtgggctcccctacctggaacatctgaatctcagcggttgtctgacaatcaccggggccgggttgcaagacctggtatcagcatgtccttcactgaatgatgaatatttctactattgtgataacattaacggtcctcacgcagacactgcatccggttgtcaaaacttgcaatgcggctttcgcgcttgctgccgctccggcgaatag

SEQ ID NO: 187556 - DNA, 2025 bp, Artificial Sequence
  Description of Artificial Sequence: Synthetic coding sequence
atggcccccttccccgaggaggtggacgtgttcaccgccccccactggaggatgaaacagctggtaggattatattgtgataagtccttgtacgccacattcaaagaatttaagatgcacgaacagattgagaacgaatacataatagggctgctgcagcagagaagccaaaccatctataatgtacactcagacaataagttaagtgaaatgctctctctgtttgagaaaggcctgaagaatgttaagaatgagtacgagcagttgaattacgccaagcaactcaaggagcgcctcgaggcttttactcgcgattttctcccccacatgaaggaggaggaagaagtctttcaacccatgctcatggagtacttcacatacgaggaactcaaagatattaagaagaaagtcatcgcacagcactgctcccagaaagatacagccgagctacttcgagggctaagcctgtggaatcacgctgaggagcggcagaaattttttaagtatagtgttgatgaaaaatcggataaggaagctgaggtgtctgaacactcaactggtatcactcacctccctccagaggtaatgctgagcatcttcagttacctcaacccccaggaattgtgcaggtgctcacaggtgtccatgaagtggagccaactcactaagacaggcagcctgtggaaacacctgtatccagtgcactgggcccgcggcgactggtactccgggcctgctaccgaattggataccgagccagatgatgaatgggtcaaaaatcggaaggacgagtcacgagcttttcatgagtgggacgaggatgcggacattgacgagagcgaggaatccgcagaggagtcaatcgcgatctctattgcacagatggagaagcggctgctgcatggcctgattcataatgtgcttccctacgtaggcacatccgtgaagaccctggtattagcgtattcctcagccgtgtccagtaagatggtgcgacaaatcctggaattgtgcccgaatctggaacacttggacttgacacaaaccgatattagtgactcagcatttgactcctggagctggcttggctgttgccagtccctccggcacctggatctgagcggatgcgaaaaaatcactgacgtggctctcgagaagatttccagagctctgggaatcctcacctcacaccagagcggctttctgaaaacaagcacctctaaaatcaccagtaccgcctggaagaataaagacatcacaatgcagtccacaaagcagtatgcctgtctgcatgacctcacgaataagggaatcggagaagaaatcgataatgagcatccctggacaaaacccgtctcttcagaaaactttaccagcccttatgtatggatgctcgatgctgaggacctggccgatattgaagatacagtggagtggcgccatcgcaatgtggagagtctgtgtgtgatggagaccgcatctaatttctcctgctcaacttccgggtgcttttctaaagatatcgtaggtctgcgaacctctgtgtgctggcagcagcactgcgcttcaccagctttcgcctactgcgggcattcattctgttgcactggaaccgccctgcgaactatgtcttccctgcctgaatctagcgcaatgtgcagaaaggccgccagaacacggctgccccgcgggaaggacctcatttatttcggctccgaaaagagtgatcaggaaactggtcgggtgctgttgttcttaagtctgtcgggctgctaccagattacggaccatggcctgcgcgtgcttactctgggggggggactaccgtacttagagcacctgaacctcagcggatgccttaccattaccggtgccggcctacaagacttagtgtcggcctgtccctccctaaacgacgagtacttctattactgcgataacatcaatggacctcatgcagataccgcttctgggtgtcagaatttacagtgcggcttccgagcctgctgcaggtcgggagaatag

SEQ ID NO: 187557 - DNA, 1440 bp, Artificial Sequence
  Description of Artificial Sequence: Synthetic coding sequence
ggcaagggcagcagcagcatcagcagcgacgtgagcagcagcaccgaccacacgcccaccaaggcacagaaaaatgtggccactagcgaggacagcgatctttctatgaggacattgtccactccgagtccagcgctcatctgtcctcccaatcttcccggatttcagaacggccgaggatcctctaccagtagctccagcattacgggcgagaccgtggccatggtacacagtccaccacccacacggctgacacaccctttgattcggttagcctcaagaccccagaaggagcaggcctccattgacagattgcccgaccactctatggtccagatcttctcctttcttcctacaaaccaattatgccggtgcgcccgcgtttgtcggcggtggtacaacttagcttgggatccccgactgtggcgcactattcggctgacaggggagacgattaacgttgaccgagctttaaaggtccttacgcgaagactctgccaagacacacccaatgtctgtctcatgcttgagactgttactgtgtctgggtgccgaaggctgactgaccgcggtctgtatacaatagcccagtgctgtccagagctgaggagactagaggtatctggttgctacaacatcagcaacgaagccgtctttgatgtagttagcctctgtcctaacctggagcacctagatgtttcagggtgctcaaaagtgacctgtatttcactgacacgggaagcatcaatcaagctttcccccctacacggtaagcagatctcgataaggtacctcgatatgacggattgttttgtgttagaagatgaaggcctgcacactatcgctgctcactgtacccaactgacccatctctacttgcgtcgttgcgtgaggttaactgatgagggcctgagataccttgtgatctattgcgcatctatcaaggagctgtccgtttcggactgccggtttgtgagcgactttggactgagggagatcgccaagctggagtctcgcctccggtatctgtccatagcccactgcggcagggtaacggacgtgggcatccgctacgtggccaaatattgcagtaaactccgatacttgaatgcccgcggttgtgagggaattaccgatcatggggtcgaatacctggccaagaattgtactaaactgaagtcattagacatcggaaagtgcccacttgtgtctgatacaggcttagagtgtttagctctcaattgttttaacctcaagcggctctcgctgaaatcatgtgaatcgataaccggacagggactgcagattgtggccgcgaactgctttgacctgcaaacattaaatgtgcaggattgcgaggtgtccgtggaggccttacgctttgtgaaacggcactgcaaaaggtgtgtaatcgaacatacaaatcccgcctttttttag

SEQ ID NO: 187558 - DNA, 1476 bp, Artificial Sequence
  Description of Artificial Sequence: Synthetic coding sequence
atgggcgccaacaacggcaagcagtacggcagcgagggcaagggctccagcagcatttcctctgacgtctcgtcctccactgaccatacaccgactaaggcccagaaaaacgttgcaacctccgaggattccgatttgagcatgcggacgctctccaccccatcccctgctctgatttgccctcctaatctacctggctttcaaaatggtcggggctcatccaccagctcgtcttccattactggagagaccgtggcaatggtacatagcccaccccctactagactcactcaccccctaattagactcgcttcccgccctcaaaaagagcaggcttctatagacaggctccctgaccacagcatggtccaaatcttctctttcctaccgacaaaccagctgtgccggtgtgccagagtttgccgtaggtggtacaacttagcatgggaccccagactctggcgcacaatccgcctaaccggtgagactataaacgttgaccgagctctcaaggtcctaacacgccgtctttgccaggacacccccaacgtgtgccttatgctagagacagtgaccgtgtccggatgccggagacttacagacaggggtctgtatacaattgcccagtgctgtcctgagctgagaaggcttgaggtctctggctgctacaacatcagtaacgaagctgtatttgacgttgtgtccctttgtccgaatctggaacatctggatgtttctgggtgtagtaaagtgacctgcatcagccttactcgggaggcttccatcaaactgagtccactccacggaaagcaaatctccatccggtatctggatatgactgattgctttgttctggaggacgaaggcctccacacaatcgccgcccactgtacccagctaactcatctgtacctgagacgatgcgttagactgactgatgaaggattgcggtacctggtcatttattgcgcctccatcaaagagctctctgtgtctgattgcagattcgtgagtgatttcggcctgagggaaattgccaagcttgagtcaaggctgcgctacctatccattgctcactgcggccgcgttaccgatgtgggcatccggtatgtcgccaagtactgctccaagttgcggtacctcaacgcgagggggtgtgaggggattacagatcacggcgtggagtaccttgcaaagaactgcacaaagctgaagtcattagacatcggcaagtgccctcttgtttctgacacagggctggagtgcctggctctgaactgttttaaccttaagagactgagcctgaagtcctgcgaaagcatcaccggacaaggcctgcagatcgttgctgccaattgctttgacctccagacccttaatgtacaggattgtgaagtgagcgtggaggccttgaggtttgttaagcgacactgtaaaaggtgtgtaatcgaacacaccaacccagcgtttttttag

SEQ ID NO: 187559 - DNA, 3000 bp, Artificial Sequence
  Description of Artificial Sequence: Synthetic coding sequence
atggagaacctggagagccggctgaagaacgccccctacttccggtgcgagaagggaactgattctattccactgtgcagaaagtgtgagacctgtgtgctcgcttggaagatcttctcgaccaaggagtggttctgtcgcattaacgatattagtcagcgcagattccttgtgggcattttaaagcagctcaactctctatatctgttgcactactttcagaatattctccagacaacacaggggaaagacttcatctacaacagaagtcgtataaatttatcaaagaaggaaggaaaggtcgtgaagtccagcttgaaccagatgctggataaaaccgtggaacagaaaatgaaagagatcctctactggtttgccaactccacacagtggacaaaagctaattacactttgctacttctccagatgtgcaatcccaagctattgctaacagcagcgaatgtgatccgggtcttatttcttagggaggagaataacatcagcggcctcaatcaagatatcactgatgtgtgcttttcgcccgaaaaggatcactctagtaagagcgccacaagccaggtctattggactgctaagacacaacatacctccctgcccttatcaaaggctccagagaacgagcatctgttgggagccgcctccaatccggaagagccatggagaaattccctgcggtgtattagcgaaatgaataggttgttctctggtaagggagatataactaagcccggttacgacccctgcaatctgctggttgatttggacgacatccgcgacctgtctagtggtttttcaaagtatagggattttatccgttacctgcccatccacctgtccaagtacatcctccgaatgctggaccgacacactcttaataaatgtgccagtgtgtcacagcattgggccgcgatggcccaacaggtaaagatggacctgagcgcccacggcttcatccagaaccagattacattcctgcagggcagttatacgcgagggattgatccgaattacgcgaataaagttagcattccggtacccaagatggtcgacgacggcaaaagcatgcgagtgaagcacccaaagtggaagttacggacaaagaatgagtacaacctgtggaccgcctatcagaacgaagaaacgcagcaggttcttattgaggaaaggaatgttttctgtggcacatacaacgtgcgaatcctctctgatacctgggaccagaacagagtgattcactacagcggtggagaccttatcgcggtatccagcaaccgaaaaatccatttgctggatatcattcaggtcaaagccattcccgtggaattccgtgggcatgccgggagcgttagagcccttttcttgtgtgaagaagagaattttctgctgtccggatcctacgatctgtccataaggtattgggacttgaaaagcggcgtgtgtacacgcatcttcggcggacaccaggggaccatcacatgtatggacctgtgcaagaaccgactcgtctccggcggaagagattgtcaggtaaaagtatgggatgtcgacactgggaagtgcctgaagactttccggcataaagaccccatcctagccaccaggatcaacgacacctatatcgtaagtagttgcgagagggggttagtcaaagtatggcacattgccatggcacagctcgtaaaaaccctgtccggccacgagggcgccgtgaagtgtctgttcttcgatcagtggcacctgctatcaggctcaacagacggattggtcatggcatggagtatggttggcaagtacgaaaggtgcctgatggctttcaagcacccaaagatggttgtcaataccgaatcaaatgtactcatgttccagttcgaacacatcaagtggcagtatgccgtggagaagaccaaacagaaaaaaaacaaggagaaagaagaggagaaggaagaaaatagcttaatggagattctttcgaagtgtaacatccaagtgcacagtcccagagagtcagtgtcttctaagcaaaccgtgattcaggagcttctccctgggaagccgcctaagtccagggtcttgctgaagcctgccaagttcagtagcgctgttctgatcgaagagctgcagtcccagggtaagtcaaagtcaccacgcagagacgctgacgatgtggagaaggcccagaaacagggacagctggagactcctggaaagcttccttcacatcctaaaaagaagagctggaaaatacctatgtctccagaccaattcctgctgaccgtctctgctctgcagcatgcccacaattcaggtgagtttgcttacccgtgcaggccccagaccgagatcacagatgtgtggggcccaagcatttcttacccgcggaaggtgctgaatttcaaaggcaagagcattcaaagggccgtggacagactgcgcctcagtaatccacccatcgatgtgaagcggacaagtatcccactggaaatacaaaaattgcagccaaatctgaagatctcccttcatagcccccgggtccaaagtaccatcccccagccaatgatcatcaggtccaggtttagcggctcactcaaaggcggagatcaagtgaccagttctatcgaacgcgccgtctgcagcactggtcccctcacatctatgcaggtgatcaagccgaatcgtatgctggctccacaagtcggtaccgctacgcttagcctgaaaaaagagagaccaagaatttacactgccctggatccgttccgagtgaacactgaatttgtgcttctcactgtcaaagaggagaaggagcatcaggaggctaaaatgaaagaataccaggcgagagagtcgactggagtcgtcgaccccgggaaggtttccaaggcagcctggatccggaagatcaagggactgcccattgacaatttcaccaaacagggtaaaaccgcggcccctgagctggggcagaatgtatttatctag

SEQ ID NO: 187560 - DNA, 3186 bp, Artificial Sequence
  Description of Artificial Sequence: Synthetic coding sequence
atggagaacctggagagccggctgaagaacgccccctacttccggtgtgaaaagggaactgattccatccctctatgtcgtaagtgtgagacctgtgtgttggcttggaaaatcttcagcaccaaggagtggttttgtcgcattaacgacatctcacaacggcgttttttagtgggcatactgaaacagctgaacagtctgtatctgctccactactttcagaacatcttacagactacacaaggcaaagactttatctacaaccggtcccgtatcaacttatctaagaaggaaggaaaggtggtgaagtcatccttaaatcagatgttggacaagaccgtcgaacagaagatgaaagaaatactctattggtttgccaacagtacccagtggacaaaggccaactacaccctgttgttactgcaaatgtgcaacccaaaattgctgctaacagccgccaacgttatcagggtactgttcctgcgggaggaaaacaatattagtgggctcaaccaggatatcactgatgtgtgtttttcgcccgagaaagatcattctagtaaaagtgccaccagccaggtatactggaccgcaaaaacacagcataccagccttccgctgtctaaggccccagaaaatgagcatctacttggagccgcaagcaaccccgaggaaccctggcgtaattcactcagatgcatttcagagatgaacaggctcttcagtgggaagggcgatatcacaaaacctggctacgacccttgcaaccttttagttgacttggacgacattagggacctctcttctggattttcaaaatacagggactttatacgatacttaccaatccacttgagtaagtacattctcagcatgctcgggtgtatgcggggttttcctaggcacctgcccagttggccatcctcaggagtgtctggtagcatctttttctttcctgggatgctggaccggcatacactgaataaatgcgccagcgtctcccagcactgggcagcaatggcccaacaggttaaaatggatctgagtgcgcatggatttatccaaaatcaaattactttcctccagggctcttataccaggggaattgatcctaattacgcaaacaaagtgtctataccggtgccgaaaatggtcgacgacggcaaaagtatgcgtgtcaagcatcccaagtggaagctccgcacaaaaaatgagtataatctgtggaccgcgtaccagaacgaggaaacccagcaggtgctaattgaagaaagaaacgtcttctgtgggacctataacgttagaatcctgtctgacacatgggaccaaaatcgggtcattcactactccggtggtgacctgatcgccgtctccagcaaccggaagattcacctgctggacatcatccaagttaaagctattcctgtggagtttagaggccacgcgggtagcgtcagagctttgttcctctgcgaagaagaaaactttctgttgagtgggagctatgacctgagcataaggtactgggacctgaagagcggagtgtgcaccagaatcttcgggggacatcagggaacaatcacgtgtatggacttgtgtaaaaacagacttgtgtctggcgggcgtgactgtcaggtgaaagtgtgggatgttgacacaggcaagtgtttaaagactttcagacacaaggatcccatcttagccaccaggattaacgatacctatattgtctcatcatgcgagcggggactggtaaaagtttggcacatcgctatggcccaactggttaagacgctgtcaggtcatgagggcgcagtcaagtgcctcttttttgatcagtggcacctgctcagcggatcgacagacggtctggttatggcctggtccatggtgggaaaatacgaacggtgcctaatggcatttaagcacccaaaggaagtcctggatgtgtctcttctatttctccgggtaatctcagcttgtgcggatggcaaaataagaatttacaattttttgaatggcaattgtatgaaggtcctgaaggcaaacggtcgcggcgatcctgtgctgtccttcttcatccagggaaatcggatggtggtgaataccgaaagcaatgtcctgatgtttcagttcgagcacatcaaatggcaatacgccgtggagaagactaagcagaagaagaataaggagaaggaagaagagaaagaggaaaactccctaatggagattctgagcaagtgtaatattcaagtgcacagtccaagggaaagcgtttcatctaaacaaactgtaattcaggagctcctgccgggcaagcctccaaagagcagagtgctgttgaagccagcgaaattctccagcgatgatgtagagaaggcccagaagcaagggcagttggaaaccccaggaaagctacccagccacccaaagaagaaaagctggaagattcctatgtcccctgatcaattcctgctgacagtctcggctcttcaacacgcgcataattccggtgaatttgcctatccatgcagacctcagaccgagatcaccgacgtctgggggccctccatttcatatccccgaaaagtcctaaacttcaaaggcaaatccattcagagagccgtcgaccgactacgactgtctaatcccccgatcgacgtcaaacggacgtccatcccactcgaaatccagaaactccagcctaacctcaagatcagcctccatagcccccgtgtgcagtccactattccccaacctatgataataaggtcaaggtttagcggaagtctaaaggggggggatcaggttaccagcagtatagaacgagccgtctgctccaccggcccgctgacaagcatgcaggtaattaaacctaatcgaatgctcgcgcctcaagttggaaccgccaccttgagcctgaagaaagaacggccccgaatctatacggcactggacccgtttagggtaaacacagagtttgtcctacttacagtaaaagaggagaaggagcatcaagaagcaaagatgaaagagtaccaggccagagaaagcacaggcgtggtcgacccaggaaaggttagcaaggcagcttggatccggaagatcaagggtctccctatcgataactttacaaaacaaggcaaaacagccgcgcccgagctgggccagaacgtattcatttag

SEQ ID NO: 187561 - DNA, 3159 bp, Artificial Sequence
  Description of Artificial Sequence: Synthetic coding sequence
atggagaacctggagagccggctgaagaacgccccctacttccggtgtgagaaggggactgacagtatcccattatgcaggaaatgcgagacttgcgtgttagcttggaagatcttttcaaccaaggaatggttctgccgcataaacgacatatcacaaaggcgctttttggtgggaatattgaagcaactgaattctttatatctgttgcactacttccagaatatcttacagaccacacagggcaaggattttatttataatcgctcgcgtataaatctcagcaagaaggaaggtaaagtcgtgaagtcatcgttaaatcagatgctggacaaaacagttgagcagaagatgaaagaaatactgtactggttcgctaactcaactcagtggacgaaggcaaactataccctgctgctgctccagatgtgcaacccgaagctgctcttgaccgctgccaatgtgattcgagtgctgttcctccgcgaggagaataacatatccggcctgaaccaagacatcactgatgtctgcttttctccagaaaaggaccattcatccaaatctgccacctcacaggtatactggaccgccaagacccagcatacatcactgcctctatcaaaggcacctgaaaatgagcaccttctcggcgccgcctcaaaccccgaggagccttggcgtaatagcctgaggtgtatctcagaaatgaatagactgttctctggtaagggagacatcacaaagcccggatatgacccctgtaacttgttggttgatttagacgatatacgtgacttgtcctctggctttagtaaatatagagatttcatccgctatcttcccatccatctgtccaagtacattctgagaatgctcgaccgccatactctgaacaaatgtgccagcgtatcacagcactgggctgctatggcccagcaggtaaagatggatcttagtgcccacggttttatacagaatcagatcacattcttgcagggcagctatactcgaggaatcgaccccaattacgccaataaagtaagtatccccgtgcctaagatggtggatgatggcaaatctatgagggttaagcaccctaaatggaaactgcgcacaaaaaatgagtataatctttggaccgcctaccagaacgaagagactcagcaggtattgattgaagagcgcaatgttttttgcggaacttataacgtccgaatactgtctgatacctgggatcagaaccgggtgatccactacagcgggggcgacctgatcgccgtttccagtaataggaagattcatcttttagatattattcaggtaaaggccattccagtggaattccgggggcacgccggctcagttagagcgctgttcttgtgcgaagaagagaattttctactttccggaagttatgacctgtcaattcgatattgggatctgaagagtggggtgtgcacccgaattttcgggggccaccagggcaccatcacttgtatggacttgtgcaaaaatagactcgtgtccggaggacgagattgtcaggttaaagtatgggacgtcgataccggaaagtgccttaagacctttcgacacaaggaccctattttggcaacacgcattaacgatacatacattgtgagctcttgcgagcgaggcctcgtgaaagtttggcatatagccatggcccaactggtgaaaaccttgtcaggtcatgagggtgccgtcaaatgcctgttttttgatcagtggcatttgctgtctggctccactgacgggttggtgatggcctggagtatggtgggaaagtacgaacgttgcctaatggcatttaagcatcccaaggaggtgctggatgtctctttactgttcttgagggtgatatcagcctgtgccgacggcaaaatcagaatctacaactttctgaacggtaattgcatgaaggttttgaaggccaatggacgtggtgaccccgtactgtcgttctttatacagggtaacagaatggtggttaacactgagtccaacgttctgatgttccaatttgagcatataaagtggcagtatgcagtcgagaaaactaaacaaaaaaaaaacaaagagaaggaggaggaaaaggaagagaactctcttatggagatcctgtcaaaatgtaacatccaggtacattcacctcgcgaatcggtgagtagtaagcagacggtcatccaggaactgttgcctggtaaaccccccaaatctagggtgctgctaaagcccgccaaattctcgagtgcagtcctgattgaggaacttcaatcccaaggcaagagcaagagccccaggcgcgatgccgacgatgtggagaaggctcaaaagcagggccagctggaaacacctggtaaacttcctagccatcctaagaagaaatcgtggaagatcccaatgtctcccgaccagttcctgttgacggtgtcagctctgcagcatgcccacaatagcggcgagttcgcttatccatgcagaccccaaacagagattactgatgtctggggcccgagtatttcttacccacgcaaggtgttgaactttaaggggaagagcatccagcgagcggtggatcgattgagactctccaacccgcccattgatgtgaaaaggactagtattcccttagagatccagaagctccagcctaacctcaagattagcctccacagtccgcgcgtgcaaagtacgattccccagcccatgatcattcgatcaagattctccggcagcctcaaaggcggtgaccaggtgacatcctctattgaacgcgcagtgtgtagcaccggaccccttacatctatgcaagttatcaagcccaataggatgcttgctcctcaggtaggaactgccacactgtccctgaaaaaggagagaccaagaatctacactgccctcgatccatttcgggtaaataccgagttcgttcttctgacagttaaggaggagaaggagcatcaggaggctaaaatgaaggaatatcaggcccgagagtcaaccggtgtggttgaccccggaaaggtgtctaaggccgcctggatcagaaaaattaagggactcccgatcgacaactttactaagcaaggcaaaaccgctgctcccgagttagggcagaacgtgtttatttag

SEQ ID NO: 187562 - DNA, 3156 bp, Artificial Sequence
  Description of Artificial Sequence: Synthetic coding sequence
atggagaacctggagagccggctgaagaacgccccctacttccggtgcgaaaaaggcaccgacagcattcccctgtgtaggaagtgcgaaacttgcgttctcgcatggaagattttttctactaaggaatggttttgccggattaacgacatatcccagcgcaggtttctggtggggatccttaaacaattaaacagcctgtaccttttgcactattttcagaacatccttcagaccacgcaagggaaagattttatttataacagaagtagaatcaacctgtctaaaaaagagggcaaggtggtcaagtccagccttaaccagatgctagacaaaacagtcgaacagaagatgaaagagattctctactggttcgcaaacagcacacagtggacaaaagctaattatacactgcttttgttacaaatgtgcaatcccaaactgttacttactgcagccaacgtcattcgagtgctatttctcagggaggagaacaacatttcaggtttaaaccaggatatcactgatgtgtgtttcagtcccgagaaggaccatagttccaaatccgcaacaagtcaggtctattggacggctaagacacagcatacgtcgttgcccttatcgaaggcaccagagaacgagcatctgctgggcgccgctagcaaccccgaggaaccgtggagaaatagcctgcgttgtatatccgagatgaaccgcttgttctcgggcaagggggacatcacaaaacccggatacgacccttgcaacctgctggtggaccttgacgatatcagagacctgagctccggattcagcaagtatcgcgatttcatccggtacctgccaatccacttgtctaaatatatacttagaatgctggacaggcacacattaaacaagtgcgcttccgtgtctcaacattgggccgccatggcgcagcaggttaaaatggacttatctgcacacggattcattcagaatcagattacttttctccagggcagctataccagagggatcgaccccaactacgccaataaagtgtccattcctgtgcctaaaatggtggacgatggcaaaagtatgagggtgaaacatcctaagtggaagctccgcaccaagaatgagtacaacctatggacagcatatcaaaatgaggagacacagcaggtgctgatagaagagcgcaatgtcttttgcggaacatataacgtccgcatccttagtgacacttgggaccagaatcgggtgatccattacagcggcggcgatcttatagctgtttcttctaacagaaagatccacctgctcgacataatccaggttaaggcaatcccagtggagtttcgcggacatgcaggctctgtgcgggccctctttttgtgtgaagaagaaaactttctcctgtcagggtcatacgaccttagcatcaggtactgggatctgaaatctggggtgtgtacccggatctttggcgggcaccaggggacaataacgtgcatggacctgtgcaagaaccggttagtcagcggcgggcgggactgccaggtgaaggtttgggatgtagataccggcaaatgcctaaaaacattccgacacaaagacccgattctggcaacccgaattaacgacacgtatatcgtatcgtcctgtgaaagggggctcgtgaaggtatggcacatcgccatggcacagctggtaaaaacccttagcggccatgagggtgcggtgaaatgcttgttcttcgatcagtggcacctccttagtggctcaacagacggactcgtgatggcgtggagtatggtggggaagtacgagcgctgtctaatggccttcaaacacccaaaagaggtgctggatgtctcgctgctgttcctccgggtgataagcgcctgtgccgatggcaagataaggatctataacttcctaaatggcaactgtatgaaggtgttgaaggcaaacggaagaggtgatccagtgcttagcttttttatccaaggcaatcggatggtggtgaacacagagtcgaacgttcttatgtttcagtttgagcatatcaaatggcagtatgccgtggagaaaacaaagcagaaaaagaataaggaaaaggaggaggagaaagaggaaaactctttgatggaaattctctccaagtgcaatatccaggttcacagccctcgggaatccgtgtcatctaagcagaccgtcatccaggaactcctccctggaaagccacccaagtcccgagtgttgctgaagccagctaagtttagtagtgcagtgcttatcgaagaacttcagtctcagggcaaaagtaaatctccccgaagggacgacgacgttgaaaaggcgcagaagcaaggccagctggaaacccctgggaagctcccatcacatcctaaaaagaagtcttggaagattcccatgagcccagaccagtttttgctgactgtctcagccttacagcacgcccataattctggggagttcgcttatccctgcaggcctcaaaccgagatcacggatgtgtggggaccatccatcagttacccgagaaaagtgctcaacttcaagggcaaaagcatccagcgggctgtcgaccggctaaggctttctaacccgcccattgacgtgaaaagaacctctattccgctagaaatacagaaactacagcccaatctgaaaatctccctgcacagcccacgggtccaatctacaattccccagccgatgatcattaggagcagattcagtggctcacttaaaggcggagatcaggtgactagttccatcgaacgcgctgtgtgttctacggggcccctcacttcaatgcaagttattaagcctaataggatgcttgcaccccaggtgggcaccgcgacgctgtcactcaagaaagagcgaccccgaatttacactgccctcgacccctttagagtgaacaccgagtttgtcctccttacagtgaaggaggaaaaagaacaccaggaagccaaaatgaaggagtatcaggccagggaatctactggagtggtcgaccctgggaaagtatccaaagccgcttggatcaggaagataaaggggctgcccatcgataatttcaccaaacaggggaagacagcagcaccagagttggggcagaacgtgtttatatag

SEQ ID NO: 187563 - DNA, 1629 bp, Artificial Sequence
  Description of Artificial Sequence: Synthetic coding sequence
atggagcccgacagcgtgatcgaggacaagaccatcgagctgatgtgcagcgtgccaagatccctttggctcggatgcgccaatttggtggagagcatgtgcgccctgtcttgcctgcagtccatgccctcagtgagatgcttgcaaataagcaatggtaccagctccgtcatcgtaagtcggaaaagacctagcgagggcaactatcagaaggagaaagatctgtgtataaagtactttgaccaatggagcgaatccgatcaagtagaatttgtggagcatttaatttccagaatgtgtcactaccagcacggacacatcaattcctaccttaaaccaatgcttcagcgcgatttcataacggccctccccgagcaaggactagaccatattgccgagaatatactctcttacctggatgctcgctcactctgtgccgccgagctggtctgtaaggagtggcaacgagtcatctcggaagggatgttatggaaaaagctcatcgaacgcatggttagaaccgatccgttatggaaaggcctgagtgagcggcgaggttgggaccagtatctgtttaagaaccggccgaccgatgggccaccaaattctttttatcgcagcctctatcccaagatcattcaggatattgagacgatagagtccaattggaggtgcggcaggcataaccttcagagaattcagtgccggagcgagaacagcaagggagtgtattgtctgcagtacgacgacgagaaaattatatctggccttagagataacagtataaagatatgggacaaaacctcacttgagtgtctaaaggtgctgactgggcacaccggctcagtgctgtgtttacagtatgacgaaagagtcatcgtgaccggaagctctgacagcaccgttagagtttgggatgtaaatacaggggaagttctgaacaccctgatacaccacaacgaggccgttttgcacctgcgattcagcaacggccttatggtcacatgttctaaagatcgaagcattgctgtttgggatatggcaagcgcgactgacatcacattgaggcgcgtcctcgttggacacagagccgccgtgaatgtagtggacttcgatgataagtatattgtctccgcatccggcgataggacaatcaaagtttggtctacttccacgtgtgagtttgttcgcaccctgaacggccataagagaggaatcgcctgtctacagtacagggaccggttggtcgttagtggcagctccgataacactattcgcctttgggacatcgagtgcggtgcctgcctccgtgtactggaaggccacgaggaactggtccggtgtatccgttttgacaataagaggattgtttcaggggcgtacgacggaaaaatcaaggtttgggatctgcaggccgctctggacccacgggctccggctagcactctctgcctgcggacccttgttgaacactccgggcgagtgtttcgcctccaatttgatgagtttcagataatttcctcgagccacgacgatacaattctgatttgggattttctcaatgtgcctccaagtgctcagaacgaaacccgcagcccatctcgcacctatacttacatcagtcgctag

SEQ ID NO: 187564 - DNA, 1590 bp, Artificial Sequence
  Description of Artificial Sequence: Synthetic coding sequence
atggagcccgacagcgtgatcgaggacaagaccatcgagctgatgaacacctctgtaatggaggatcagaacgaagacgagtcacctaagaagaataccctttggcaaattagtaatgggacatcgagtgtcattgtttctcgaaaacggcccagtgagggaaattaccaaaaagagaaggacctctgtattaaatattttgatcagtggagcgagagcgatcaggtcgaatttgtcgagcacctgatcagtaggatgtgccattatcaacacgggcacataaacagctacctcaaaccaatgcttcagcgtgattttatcacagctttgcctgagcagggccttgatcacattgcggagaatattctatcctatctggatgctcgttccctgtgcgctgccgaactggtctgtaaagaatggcagagggttatttcggagggcatgctgtggaaaaaactaattgaacggatggtccgaactgatcctctgtggaaagggctcagtgagagaagggggtgggaccagtacctgttcaaaaatcgccccaccgacgggccccccaactcattttataggtccttgtaccccaagatcattcaggatatcgagaccatcgaatccaattggcggtgcggaaggcataatctacaaagaattcagtgccgctccgagaacagcaaaggtgtgtattgcctgcagtacgatgatgagaagattatctccggacttcgtgacaattcaatcaaaatttgggataagacctcactggaatgccttaaggtactaacaggtcatacgggcagcgttctgtgtctacagtatgacgaaagggtgattgtgacgggcagttctgattcaaccgtgcgtgtgtgggatgtgaacacgggtgaggtcctgaacaccctgattcaccacaacgaggcagttctgcacctgcgtttctcaaatggacttatggtgacatgctctaaagaccgaagtatcgccgtgtgggatatggcgtccgcaaccgatatcaccttaagacgcgttctcgttgggcatagggctgctgtcaatgttgtggattttgatgataagtacatagtcagtgcctctggagacaggactattaaggtgtggtctacttcgacttgcgagttcgtcagaacgctgaacggccataagcgggggatcgcatgtttacagtatcgcgaccggctcgtggtttctgggtcctcggataacaccataaggctttgggatatcgagtgtggcgcttgcctccgggtgctggagggccatgaagagttggtccgatgtattcgcttcgacaataagaggatagtttccggagcgtacgatggtaagataaaggtgtgggacctacaggcagcgttggacccccgcgcgccggcttccaccctgtgcctcagaaccctcgtggagcactcgggaagggtctttcggttgcagtttgatgagttccagattatctcgtcctcccatgacgacactattctaatctgggacttcctcaatgtgccccctagcgcgcagaacgagactcgcagtccatctcgaacttacacctacatctctcgatag

SEQ ID NO: 187565 - DNA, 1527 bp, Artificial Sequence
  Description of Artificial Sequence: Synthetic coding sequence
atggagcccgacagcgtgatcgaggacaagaccatcgagctgatgatctcgaatggtacctcctctgtaattgtatctcgaaaaagaccttcagagggtaactatcagaaagagaaggatctgtgtatcaagtatttcgaccaatggagtgaaagtgaccaggtggagtttgtcgagcacctcatttcaaggatgtgtcactaccagcacggtcatataaactcatatctcaaacccatgcttcaaagagacttcatcacagctctgccagagcaaggcttagaccatattgccgaaaatattctgtcataccttgatgctcggtcgctctgcgccgccgagcttgtgtgtaaagagtggcagagagtgatctcagagggaatgctgtggaagaagctcattgaaaggatggttaggacggatccactgtggaaagggctctctgagaggaggggttgggatcagtatcttttcaagaatagacctacagatggcccgcccaactcattttatagaagcctgtatcccaaaatcattcaggacatagaaactatcgagagcaattggcgatgcggaagacacaacctacaacgcatacagtgccgctcagaaaatagcaaaggagtctactgtctgcagtacgacgatgagaaaatcatcagcggcctgcgggacaactctattaagatctgggataaaacatccctcgaatgcctcaaagtgctgaccggacacaccgggtcagttctgtgcctgcagtacgatgagagagtaattgtgactggctccagtgactccactgtccgagtttgggacgtcaatacgggggaggtgctgaacacactcattcaccataacgaggccgtgttgcacctcaggttcagcaacggtctcatggtgacgtgtagtaaggacaggagtatagcagtctgggatatggcgtcagcaaccgacatcacgctccgccgggtactggtagggcacagggctgctgtgaatgtggtggattttgacgacaaatatattgtgtccgccagcggagaccgtaccatcaaagtgtggtccaccagcacttgcgaattcgttcggactcttaacggacacaagagagggatagcttgcttacagtatcgcgatcgcctggtagtgagcggaagttctgacaatacgatacgactgtgggacatcgagtgcggagcctgtctgcgagttctcgagggtcacgaagagttggttcggtgcatccgatttgataacaaaaggatcgtttcaggggcttacgacggcaagatcaaggtctgggacctccaggcagcactggaccccagagctcccgcttcaacactgtgcctccgcaccctcgtagaacatagcggccgggtgttcagactgcagttcgacgaatttcagataatctctagttcccacgacgacaccattctcatatgggattttttaaacgtccctccgtctgcccagaacgaaacccgctcaccctctcgcacctacacttacataagcaggtag

SEQ ID NO: 187566 - DNA, 1533 bp, Artificial Sequence
  Description of Artificial Sequence: Synthetic coding sequence
atggaggaccagaacgaggacgagagccccaagaagaacaccctgtggcagatcagcaacgggacgtcgtcggtcatcgtgtctagaaagcgcccatctgaggggaattaccagaaagagaaagacctctgcatcaaatactttgatcagtggtccgaatctgatcaagttgaatttgtcgaacatctcatttctagaatgtgccattaccagcatggtcatattaactcatacctgaagccaatgctgcagagagactttatcaccgctctaccagaacaaggcctcgaccacatcgctgagaacattctatcctatctggacgctcggtccctgtgtgcggcagagcttgtgtgcaaggagtggcaacgggtgatttccgaagggatgttatggaaaaaacttatcgaaagaatggttaggacagacccactgtggaagggcttaagcgagcgtcgaggatgggaccagtacctttttaagaatcgtcctacagacggcccccctaacagcttttataggagcctgtaccctaaaatcatccaggatattgagaccatcgaatccaactggaggtgtggaagacacaatctgcagagaattcagtgccggagtgaaaactccaaaggcgtgtactgtctgcagtacgacgacgagaaaatcataagtggcctgagggacaattcaatcaagatctgggacaagacatctctggaatgtttgaaggtgctaacagggcacaccggatctgttctgtgcttgcagtacgacgagcgagtcatcgtgacaggaagctcagattccacggtgagggtctgggacgtcaatactggggaggtgttaaacactctgattcaccataatgaggcggtactacacctccgtttctcaaatgggctgatggttacgtgctcgaaagatcggtcgatcgcagtgtgggatatggcttccgctaccgatatcactctgaggagagtactggtgggccacagagcagcagtgaacgtcgtggacttcgacgacaagtacattgtctctgcatctggcgataggaccatcaaggtttggtccacgtccacatgcgagttcgttcggacattgaatggccacaagcgcggcattgcctgcctgcaatatcgcgataggcttgtggtgagtggatcttcagacaatacaatccgtttatgggatattgagtgtggggcctgtcttcgcgtgttagagggccacgaagaactcgtacggtgcattagatttgacaacaagaggatcgttagcggtgcctatgacggaaagatcaaggtttgggatctccaggccgctctggatcccagggcgccggcctccactctgtgcttgcgaactctcgtggaacacagcgggagagtattcaggctgcagttcgacgaatttcaaatcatctcttctagtcacgacgacactatcttaatatgggatttcctgaacgtgccaccctctgcacagaacgaaacacggtcacctagtcggacctatacctacatttccagatag

SEQ ID NO: 187567 - DNA, 1395 bp, Artificial Sequence
  Description of Artificial Sequence: Synthetic coding sequence
atggagatccggctgcccgacctggccctgaagcggatcttcagcttcttagacctcttcggactgctgcaggtctcccaggtcaataaacactggaatagaatagccgactccgattatctctggcgcagcctctcgttacagaggtgggattgctccaattttacgaatcaacatctagggacacacacatggaagcagttttttcttcaccagaggaggaaggagttgagactagcactggcacagcctcacaacttcatttataaggtgacaaaaaatattgccttcgaaactgagctggcttatctgtctggcaaccggctcaccgtggacgaacaggagaaatcgatcatctgtagcgtgtctcccaagcaagaactgtgtgcatgggatgtgcaagagggcaccatgatttggagcagcccagtgcaggagttccactttagtaacctcgtgacactgccccagatgcatctcgcgattaccatggaccgtaaaaagactatcaaagtctggaactgtcaggaccgggacgccctcgctgtgctcccaatgccgcaaccgtgctactgcatggaggcatacctgacaaaagacggcccattcttaatggtgggggatgctgcgggggacatctacactttcacgcttccagggttaagagacgtcagtaaagtgactgcatttcagtacgggatcgtcctcctgcactgttcacctgacaaaaagtgggtgttcgcatgtggcacatactctagaacacttccccaggtctttctcaccgaatctctgttgagaccaagtgagggatcagtgcctctgtcgacttttctgccacacaagctgtgtgccagcgcctgctggacccctaaagtgaagaaccgcattactctgatgtcacagtccagcactggcaaaaagacagagttcattaccttcgatctgaccactaagaaaactgggggccaaaccgtcattcaggcatacgagatcgccagcttccaggtggccgcccacttgaagtgtcctatctggatgggcgccagtgacggatatatgatagtgtttaccagcggtccttatctgctgcttttttccattaccgggttcttgctgcagcgttttgaggaccatcaagccgcgattaataacttttgggtagatccatgctatgttctcaccacaagtgagaatagcgttcatgtctacatgtgggaagagggaggcagacacccttacttgcggtcttgttgccatctggagaatacctggcacgatcatactactgactcttgcatatcttctgtgatgtgcgataacgcctcaatcgtgctcagggtcaggaaagtaagtgacagttcaatcctagttatgtactcccttaatacttag

SEQ ID NO: 187568 - DNA, 1092 bp, Artificial Sequence
  Description of Artificial Sequence: Synthetic coding sequence
atgctggccctgcgggacgagccccacagccccgacagccggagccaggcttttgaaacagaactcgcatatctgtctggtaataggttaactgtcgatgagcaggagaagagcatcatttgttctgtcagccccaagcaggagctttgcgcttgggatgttcaagagatgcatctagcgattaccatggatcgaaagaagactattaaggtgtggaattgccaggaccgagatgctttagccgtgctgcccatgccccagccttgctactgtatggaggcttatcttaccaaggacggtccatttctcatggtaggcgacgctgccggtgacatttataccttcacactgcccggattgagagacgtgtccaaggtcacagcatttcagtacggcatcgtgctgctccattgctcaccagataagaagtgggtgttcgcttgtggcacatactccagaacgttaccccaggtgttcctgacagaatccctgcttcgccctagtgagggctcggtgcccctgagcacctttttgccacacaagctgtgcgcctccgcatgctggacgccaaaagttaaaaatcgtatcaccctgatgtcccagtcttccacgggaaaaaaaaccgagtttatcaccttcgatctgacaactaagaagaccgggggccagaccgtcatccaggcatacgaaatcgcgtcattccaggtagcagcgcatttgaagtgtccaatctggatgggcgcatccgacggctacatgatcgtgtttacctccggaccatacctccttctgttctccatcaccggtttcctcctacagcgtttcgaagaccaccaggcagcgattaataacttctgggtggacccatgctacgttctgactacatccgagaactcggtgcacgtatacatgtgggaagaggggggcagacacccttacttaagatcctgttgtcatcttgagaacacatggcacgatcacactaccgactcgtgcattagcagcgtcatgtgtgataatgccagcattgtcctccgggtgcggaaggtgtcagacagctcaatcttagtgatgtattcactcaatacatag

SEQ ID NO: 187569 - DNA, 1185 bp, Artificial Sequence
  Description of Artificial Sequence: Synthetic coding sequence
atggagatccggctgcccgacctggccctgaagcggatcttcagctttcttgacctgttcggactgttgcaggttagtcaagtgaataaacattggaacagaatagcggattcagattatctttggcggtccctttctttacaacgctgggattgctctaatttcacaaatcaacatctggggacccacacatggaaacagttctttctccatcagcgacgcaaggagcttaggctagcactcgcccaaccacacaacttcatttataaggtgacaaagaatatcgcctttgagaccgagctggcttatcttagcggcaaccgcctgaccgttgatgagcaagagaaatccattatttgctccgtgtctcctaagcaggagctttgcgcttgggacgttcaggaagtcggagacgccgcgggagacatctacaccttcactctcccggggcttagggacgtcagcaaagtcacagcattccagtatggaatcgtactccttcactgttcccccgacaagaagtgggtgttcgcctgcggcacctattctcgtaccctgccccaggtgttcttgactgaaagcctactacgcccaagcgagggctccgtgcctttaagcacgttcctgccacataaactctgtgccagtgcatgttggactcccaaagtcaagaataggatcaccttgatgtcacagtcctcgaccgggaaaaagactgagttcatcaccttcgatctgacaacgaaaaaaaccggcggacaaactgtcattcaagcgtacgaaatcgcctcttttcaagtggcagctcacttgaaatgtccaatctggatgggtgccagcgatgggtacatgatcgtgtttacgtccggcccctatctgctgctattttcaataacaggatttttgctccagcggttcgaggaccatcaggctgctattaataatttttgggtggacccctgctatgtgctgacaacttctgagaactccgtgcatgtatatatgtgggaggaggggggccggcatccttatctgcgaagctgttgtcatctggagaacacttggcacgatcataccaccgattcctgtataagcagtgtgatgtgtgacaatgccagcattgtgctgcgggtgcgcaaagtgtcagattcatcaatcttggtcatgtacagcctgaacacatag

SEQ ID NO: 187570 - DNA, 1338 bp, Artificial Sequence
  Description of Artificial Sequence: Synthetic coding sequence
atgagccccacccaccagatccaggaccccaagcactggaaccggatcgccgattctgactacctttggcggagcctgtctcttcagcggtgggactgttccaactttactaatcagcatctcggaacccacacttggaagcagttttttctgcatcagcgcaggaaagagctaaggcttgccttggctcagccacacaacttcatttacaaagtgactaaaaatattgcattcgaaaccgaactcgcctatctgtctggcaaccggctgactgtggatgagcaagagaagagtatcatctgctcagtcagtcccaagcaggagctgtgtgcttgggatgtacaggagggcactatgatttggtcctcgccggtgcaagagttccactttagcaacctagttaccctcccccagatgcacctggcaataaccatggaccggaagaagaccatcaaggtgtggaactgccaagaccgcgatgccctggccgtcctcccaatgccacagccttgttattgtatggaagcatatctcaccaaagacggcccattcctgatggtcggtgacgctgccggagatatttatacattcactcttccaggtttgcgagacgtctccaaggtgacggctttccagtatgggattgtgctgttgcactgctctccagacaaaaagtgggtgtttgcatgcggaacctattcccgcacactgcctcaggtgtttctgaccgaatccctgctcaggcccagcgagggcagtgtgccactgagcacattcctgccacacaagttgtgcgcctcagcgtgctggacaccaaaagtgaaaaacaggatcactctcatgagtcagtcttctacaggtaaaaagacagagtttatcacatttgaccttactacgaaaaagactggcggacagaccgtcatccaggcttatgaaatcgcttcctttcaggtggcagctcacctgaagtgtcccatctggatgggggcgagcgacggctacatgatcgtgtttacgtctggcccctatctgttgctttttagtattacagggttccttctgcagcggtttgaagaccatcaggctgcaatcaataacttctgggtcgatccatgctacgtcctcaccacttcagaaaactctgtccatgtctacatgtgggaggaaggtgggcgacatccctatctccggtcctgctgccacctggagaacacatggcacgatcataccactgattcatgcatctcatccgtgatgtgtgataatgctagtattgtgctgagagtacgaaaagtgagtgactcctccatcctcgttatgtattcgctgaacacttag

SEQ ID NO: 187571 - DNA, 1239 bp, Artificial Sequence
  Description of Artificial Sequence: Synthetic coding sequence
atggccgccgccgccggcgaggaggaggaggaggaggaggccgccagagagtctgcagcacgcccagcggcaggtcctgcactgtggcggctccccgaagaattacttctcctgatctgctcctacctcgatatgagggctctgggtagacttgcacaagtgtgccgctggctcaggaggtttacatcatgtgatctcctatggcgaagaatagcccgagcatcactaaatagcggctttactagattgggtaccgaccttatgaccagcgtcccagtcaaagaaagggtgaaggtgtcacaaaactggagattggggagatgtcgcgaagggatactgctcaaatggcggtgccggcagatgccctggatgcagcttgaggatgactccctgtatataagccaggccaactttatactggcctatcagttcaggccagatggagcttcactgaaccgccgaccactgggggtgttcgcaggtcatgacgaggatgtgtgccactttgtactcgccaactcgcacatagtctccgccgggggtgacggtaaaattggcattcacaagattcacagtactttcaccgttaaatactccgcccacgaacaggaagtaaactgcgtggattgcaagggtggaattattgtatctgggtctcgtgaccgcacggcaaaggtgtggccccttgcatctggacgcttggggcagtgtttgcatacgatccagactgaggacagggtgtggtccatcgccattagtccgttgctcagctctttcgtcactgggacggcgtgttgcggtcatttctcaccactgcgaatatgggacctaaactcgggccagctgatgacccatctcggttctgacttcccaccaggggccggtgtgttggacgttatgtatgaaagcccctttacactcctgagctgcgggtatgacacttacgtaaggtattgggacttgcggacaagtgtcagaaagtgtgtgatggagtgggaggaacctcatgatagcacactctattgtctacaaacagacgggaaccacctgcttgccaccggatcctcatattatggcgtagtgcgactctgggatcgccgtcagcgtgcctgtctgcatgctttcccgctgacctcgacaccacttagtagtccagtctactgtctcaggctcacgaccaaacacttgtatgctgcactgagttataatctgcatgtgttggactttcaaaatccgtag

SEQ ID NO: 187572 - DNA, 1239 bp, Artificial Sequence
  Description of Artificial Sequence: Synthetic coding sequence
atggccgccgccgccggcgaggaggaggaggaggaggaggccgcccgagaatccgccgcacgccctgctgccggtcccgccctttggcggctgccggaagaactgttgctgctaatctgcagctacctggacatgagagccttgggtcgtctggcccaggtatgtcgatggctgcgccgattcacatcctgtgatctgctgtggcgcagaatagctagagcttcactgaacagcggcttcactcgtctaggcaccgacctaatgacttctgtgcctgtcaaggaacgagtcaaagtctcgcagaattggagacttgggcgctgtagggaaggcatactgctgaaatggaggtgttcccagatgccctggatgcagctcgaggatgacagcctgtatatctcacaggccaactttattctcgcatatcagtttcgccctgatggggcaagccttaacaggagacctcttggcgtgtttgccggccacgatgaggatgtgtgccacttcgttctggcgaatagtcatatcgtcagcgccggtggcgacggaaagattggaatccataaaatccactctacatttaccgttaaatattcagcacatgagcaagaggtgaattgcgtagattgcaagggcggaatcattgtgtccggctccagggaccgaacagcaaaagtgtggcctcttgccagcggacggctgggtcagtgcctccacactatacaaaccgaagatcgggtgtggagtatagctatttctcccctgctctcatcattcgtgaccggcacagcatgttgcgggcatttctctcctttgcggatttgggatctgaacagcggccaattaatgacacacttgggaagtgacttcccgccaggagccggagtgctcgatgtcatgtatgagagcccttttaccctgctctcctgcggatacgacacatacgttaggtattgggacttacggaccagcgtacgtaaatgcgttatggagtgggaggaaccccacgatagcaccctttactgcctccaaacagacggaaaccacctactagcaaccggctccagctactacggcgtggtgcggctctgggatagaagacagcgggcgtgcttgcatgcgttccccttgacttctactcccctcagttcccctgtctactgcctgagattaaccactaagcacctatatgccgcattgtcatacaatttgcatgttctggactttcaaaacccctag

SEQ ID NO: 187573 - DNA, 639 bp, Artificial Sequence
  Description of Artificial Sequence: Synthetic coding sequence
atgcgggccctgggccggctggcccaggtgtgccggtggctgcggcgttttactagttgcgacctgctgtggcgcagaattgcacgggcctctttgaactccggctttacacgcctggggacagacttaatgacctccgtgccagtgaaagagagggttaaggtttcacaaaactggcggcttggcaggtgtagagaaggaatattgctcaagtggaggtgcagacagatgccgtggatgcagctggaagatgattctttatacattagtcaggccaattttatactggcctaccagttccgacctgatggagccagtctcaatcgcaggccgctgggagtgttcgcaggccatgatgaagacgtctgccattttgtgctggcgaacagtcatatcgtttcggctgggggagacgggaaaatcgggatacacaagatacactctacctttaccgttaagtactccgctcacgagcaggaggttaactgtgtggattgtaagggaggaattattgtctccggctctcgggacagaacagcaaaggtgtggcctctggcttccggcagactcggccagtgcctgcacactattcagaccgaggatagagtgtggtcgatcgctataagccccctcctctag

SEQ ID NO: 187574 - DNA, 576 bp, Artificial Sequence
  Description of Artificial Sequence: Synthetic coding sequence
atgaccagcgtgcccgtgaaggagcgggtgaaggtgagccagaactggcgtctgggcagatgtcgagagggtatacttctgaagtggcgttgccgtcaaatgccctggatgcagctagaggacgattctctctacatctcacaggctaacttcatcctggcctaccagttcaggcccgacggtgctagcctgaacagacggccacttggagtgtttgcaggacatgacgaggacgtttgccatttcgtgctggcgaattcccacatcgtgtctgcgggcggggacggtaagataggtattcacaagatccatagtaccttcactgttaagtacagtgcccatgagcaggaagtcaactgcgtcgattgtaaaggcggaattattgttagcggcagtagggacaggacagctaaggtttggcctctggcttcaggtagacttggccagtgcttacatactattcagacagaagatcgagtgtggtcgattgccatcagccctctgctgagcagctttgtgaccggtactgcctgctgtgggcatttttccccattgagaatctgggacctgaactag

SEQ ID NO: 187575 - DNA, 1884 bp, Artificial Sequence
  Description of Artificial Sequence: Synthetic coding sequence
atgtgcgtgccccggagcggcctgatcctgagctgcatctgcctgtactgcggcgtgctcctacctgttttgttgccaaatctcccttttctgacatgcttgtctatgtccacgcttgaaagcgtaacatacctgccagagaagggtctgtactgtcagagactccccagctcacggacgcacggtggaactgagtccctgaagggaaaaaacacggaaaacatggggttctacggaactctcaagatgatcttctacaagatgaagcgtaagctggatcatggcagcgaggttcggagctttagcctagggaagaagccatgtaaagtctccgaatacacttcaaccactggcctggttccatgctcggcaacacctactacttttggggacctccgagcagcaaacggccaaggtcaacagaggcgaagaataacctctgtgcagccaccgactggcctgcaggagtggctgaagatgttccagagttggagtggcccagaaaagcttttggccctagacgaattaattgatagctgtgagcctacgcaggtgaagcacatgatgcaggtcatcgaaccacagttccaacgcgactttattagccttttacctaaagagttggcattgtacgtgttatcttttctagaaccaaaggacttgttgcaagctgcccagacctgcaggtattggaggatcttagccgaggataacttgctgtggcgcgagaagtgcaaggaggagggcattgacgaacctcttcacattaaaagaaggaaagttatcaaaccgggcttcatccattcgccctggaagtctgcatatattcggcaacaccggatcgacacaaattggaggcgaggcgagctgaagagccctaaggtcctgaagggccatgacgaccatgtgatcacttgcctacaattttgcgggaatagaatcgtttctggtagtgacgataacaccctgaaggtgtggtccgccgttacagggaagtgtttacgaaccttggtgggccacaccggaggtgtgtggagctcacagatgcgggataatatcattatatcgggctccaccgatcgaacgctgaaagtctggaatgccgagactggcgagtgcattcatacattgtatggccatactagcaccgtgcggtgtatgcatctacacgagaagagggtggtcagcggcagtcgtgacgccaccttgcgcgtgtgggacatcgaaaccgggcagtgcctgcacgtcctcatgggccacgtcgccgccgtgcgatgcgtgcagtacgacgggcgtcgtgtggtgtccggagcatatgactttatggtgaaagtttgggacccggaaacagaaacatgcttgcatacccttcagggacatactaatagagtgtattcattacagttcgatgggattcatgtcgtgtcgggctccctggatacttccatcagagtgtgggacgtagagacgggaaactgtattcacacacttaccggacatcagagcctgacatccggcatggaactcaaggataatatcctagtgtctggcaacgccgatagcaccgtaaagatctgggatatcaaaacagggcagtgcttgcaaactctgcaggggccaaacaagcaccaatcagcagtcacatgcctgcagttcaacaagaatttcgttatcacctcgtcagatgacgggactgtgaaactatgggatttgaagacgggcgagtttattagaaacttagtgactttggaaagtggcggcagtgggggagtcgtctggcgcatcagggcaagtaatacaaagctggtctgcgccgtcggttcaagaaacggtacagaagagacaaagctcctcgttctagacttcgacgtggacatgaaatag

SEQ ID NO: 187576 - DNA, 2124 bp, Artificial Sequence
  Description of Artificial Sequence: Synthetic coding sequence
atgaaccaggagctgctgagcgtgggcagcaagcggcggcggaccggcggctcacttagaggcaacccatcttccagccaggtcgacgaggaacagatgaatcgggtggtcgaagaggagcaacaacagcagcttcggcagcaagaagaggaacacactgctcggaatggtgaggtggttggagtggagccacgacctggaggtcaaaacgactcacagcaggggcagcttgaagagaataacaacaggttcatatcagtcgacgaggattcttccgggaatcaggaagagcaggaggaagatgaggagcacgccggcgaacaggacgaggaggatgaggaggaggaggagatggatcaggagagtgatgacttcgatcagagcgacgattccagtcgtgaagacgaacatacgcacacaaatagcgtgacaaactcatcctctatcgttgacctacctgtccaccagctgtccagtcccttctatactaagactactaaaatgaaacgtaaactggatcatggctccgaagtgaggtcattctcccttggcaagaaaccatgtaaggtaagtgaatatacctccacaactgggttggttccctgttccgctactccaacaacctttggggacctgcgcgcggcaaacggccagggccagcagaggcgcaggatcacatccgtgcagccccctacaggactgcaggagtggttaaagatgttccagtcctggtctggtcctgagaagcttctggctctcgatgaactcattgattcttgtgagccaacccaggtaaagcacatgatgcaagtgatagagccacagttccaaagggacttcataagtctcctacccaaggagcttgcactctacgtgctgagctttctggaacctaaggatctgttacaggccgcccaaacatgccgttactggcgcattctggctgaagataaccttctgtggcgagagaaatgcaaggaagaagggattgacgaacccctgcacatcaagaggcgcaaggtgataaagccaggattcatacacagcccatggaagagcgcatatatcagacagcaccgcattgacaccaattggcggcggggagagctgaagagccccaaagtcctcaaaggccatgacgatcacgttatcacgtgcttacagttttgtggcaatcggatagtgtccggctcagacgataacaccttgaaagtgtggtctgcagtgacagggaaatgtcttcggaccctggtcgggcataccggcggagtctggtcctctcagatgcgggataatatcataatctcggggagtaccgaccggaccctgaaagtctggaacgcggaaactggcgagtgcatccatacattgtacgggcatacttcgaccgttagatgcatgcacctacacgagaaaagggtcgtatctgggagccgcgacgccacgctgagggtttgggacatcgagaccggccaatgtctccacgtccttatgggacatgtggcagccgtgcgctgtgtgcaatatgacgggcgccgcgtagtgagtggagcatacgactttatggtcaaagtctgggaccccgagaccgagacttgtttacatactttgcagggccacactaatcgggtgtattcccttcagtttgatgggatacacgtagtgtccggtagcctggacacttccatccgcgtttgggacgtggaaacagggaactgcattcacaccctaacagggcatcagagtttaacgtctgggatggagctcaaagacaatattctggtgtctgggaacgccgacagtacagtgaaaatttgggacattaagacgggccagtgcctccagacattgcagggcccgaacaaacaccagtcagctgttacatgtctgcagttcaataaaaatttcgtgatcacctcttcagacgacggcactgtgaaactttgggacttaaaaaccggtgagttcattcgaaatctcgttacactggagtcgggtgggtccggcggtgtggtctggaggatccgggcatctaatacaaaactggtgtgtgcagtcgggagcaggaatggcaccgaggaaacgaaactcctcgtcctggattttgacgtcgacatgaaatag

SEQ ID NO: 187577 - DNA, 1770 bp, Artificial Sequence
  Description of Artificial Sequence: Synthetic coding sequence
atgagcaagcccggcaagcccaccctgaaccacggcctggtgcccgtggatctgaaatccgctaaagagcccctgcctcaccaaacagtgatgaagatcttcagcatttcaataatagcacaggggctcccattctgcaggaggcgtatgaaaagaaaacttgaccatggctccgaggtgcgttccttcagtctcggaaagaagccctgtaaagtgtcagaatatacttctacaactggcctggtgccctgcagtgccacacctaccacattcggtgatctgcgagcagccaatggacagggccaacaaagacggcggataacctcagttcagccaccgacaggcctccaggagtggttaaaaatgttccagtcttggtctggaccagaaaagcttctggcactcgatgagctgatcgatagctgcgagcccacccaagtgaagcatatgatgcaggtcattgagccacagtttcaacgtgactttattagcctactccccaaggagctggcactatatgtgttgagctttctggaacctaaggatcttctgcaggccgctcagacttgtcgatattggcgcatccttgccgaagacaacttgctatggcgggaaaagtgcaaggaagaaggaattgatgaacccctccacattaaaagaaggaaggttattaagcctggatttatccattctccatggaagtccgcatatatcagacagcaccgtatcgacacgaattggcgacgcggtgagctcaaaagcccaaaggtactgaagggtcacgatgatcatgtgatcacttgtcttcagttctgtggcaatagaatcgtcagtggctcagacgacaacaccttaaaggtctggtcggctgtgacaggtaagtgtcttcgaacacttgtgggccacaccgggggggtttggagtagccagatgagggataatattatcataagcgggagtaccgatcggaccctaaaagtctggaacgccgagacaggggaatgtatccacaccctctacgggcacacaagtactgtaaggtgtatgcacttgcacgagaaaagagttgttagtggttcaagagacgctacgctccgggtctgggatatcgaaaccgggcagtgcctccacgtgctcatgggccacgtagccgccgtccggtgtgttcaatatgacggcagaagggtggtcagcggtgcctatgactttatggttaaagtgtgggatcccgaaaccgaaacatgtctgcatacattgcaagggcacacaaaccgtgtctacagcctgcaattcgacgggatacatgtggtatccggttcccttgacaccagtattagggtgtgggacgtggagaccggaaactgtattcacaccttgaccggacatcagtcgctgacatcaggcatggaattaaaggacaatattctcgtctccgggaacgcagattcgaccgtgaaaatatgggatatcaagactggccagtgcctacagaccttacaagggccgaataaacaccagtccgcagtcacttgtctacagtttaataagaatttcgtcatcacgtccagcgacgacggcactgtgaagttatgggacctgaaaaccggtgagttcatcagaaacctcgttaccctagaaagtggcggctctggcggcgttgtctggagaatccgggcttctaatacgaaacttgtctgcgcggttggctcccgaaacggtaccgaggaaacaaaacttctggttcttgacttcgacgtcgatatgaagtag

SEQ ID NO: 187578 - DNA, 1596 bp, Artificial Sequence
  Description of Artificial Sequence: Synthetic coding sequence
atgctgttcttcaagtgcatcagcctgctgctgatctggctgatcccagggcagtccactacaggacttgttccttgcagtgctacgccgactaccttcggagatctgcgcgccgccaacggtcagggtcagcagagaaggaggattacatcggtgcagccccccacaggcctgcaggagtggttgaaaatgttccagagctggagcggcccggaaaaacttttggccctcgatgagcttattgatagctgtgagccgacccaggtgaaacatatgatgcaagtcatcgagccccaatttcagcgggatttcatctctctgcttcccaaggagcttgcgctgtatgtgctgtcattcctggagcctaaggatcttctgcaggccgcgcagacatgccgttattggcggatactcgccgaagacaacttactgtggcgtgagaaatgtaaagaggaggggattgacgaacccttgcatattaaacgcaggaaggtcatcaagccaggttttattcatagcccctggaaaagcgcttatatccgccaacatcgcattgataccaattggcggagaggcgaacttaagtcacccaaggtgctcaagggccacgacgaccacgtgattacgtgcctgcagttttgtggaaaccgaattgtctcggggtccgacgataacactctcaaggtgtggtcagccgtcacaggcaaatgtctgcgcactctggtgggccatactggaggcgtctggtcttcgcaaatgcgagataatataatcatttcggggtctactgacagaaccctcaaagtatggaacgccgaaacaggggaatgtattcacactctgtacggtcatacctccacagttcggtgcatgcacctgcacgaaaagagagtggtgtcaggctcacgagacgctaccctgcgcgtatgggatatagagactgggcagtgtctgcatgtactcatgggccacgtcgccgcggtgcgttgcgttcaatatgacgggaggcgggtggtgtcaggcgcttatgacttcatggttaaggtgtgggatcctgaaaccgagacatgtctgcacacgctgcagggccacacgaatagggtgtacagtttacaattcgatggaatacacgtggtgtccggcagccttgatactagcattagggtgtgggatgtggagacaggcaattgtatccacaccttaacaggtcatcagtcacttacgagtggaatggagttgaaagataatatcctggtcagcggtaacgcagattcgaccgtcaagatctgggacataaagacaggacagtgcctacaaactctgcaaggaccaaataagcaccaaagcgccgttacttgtctgcagtttaataaaaacttcgttattaccagttctgatgatggaacggtcaagttgtgggacctgaagacaggggaatttattaggaatttggtgacacttgaatctggtggcagcggcggcgtcgtttggcgaattagggcaagcaataccaagctggtatgtgccgttgggtcccggaacgggacggaggagactaaattgctggtgctagactttgatgtggatatgaagtag

SEQ ID NO: 187579 - DNA, 1797 bp, Artificial Sequence
  Description of Artificial Sequence: Synthetic coding sequence
atggacgactacagcctggacgagttccggcggcggtggcaggaggagttggcacaagcacaggctcctaaaaaaagacgccgtccagaggcagccgagcgtagagctaggcgcccagaggtgggctctggtaggggggaacaagcctccggagatcccgcgctggctcaacgcttactggagggtgccggcagaccccccgccgccagggccacacgagcagaaggtcaggacgtcgccagcagaagtcgctcccccttggcgagagagggagccggtggaggcgagcagctggtcgaccagctcattagggacctgaacgaaatgaatgatgtacccttctttgatattcagcttccatacgagctagctatcaatatttttcagtaccttgacagaaaggagctgggcaggtgcgcccaggtgtctaaaacttggaaggtgatcgctgaggacgaggtgctttggtaccgcttgtgtcagcaagaagggcacctgcccgactcgagcatctccgactacagctgctggaagttaatctttcaggaatgcagggcaaaggaacatatgctgaggacaaattggaagaataggaaaggagccgtcagcgagttagaacatgtgcccgataccgtcctgtgcgacgtacattctcacgatggcgtggtaattgctggctacacctctggagacgtccgtgtatgggatacacggacatgggactacgtcgcccctttcctcgagtccgaagatgaagaggacgagcctggcatgcagccgaacgtgagcttcgtacgcataaattcgagcctggccgtggccgcctacgaagacgggttccttaatatctgggatcttcggaccggtaaatatcctgtgcataggtttgaacatgacgcccggatccaggccctcgctctttcacaggatgatgcgaccgtggcgacggcctctgcctttgatgtggtcatgttgtctccaaacgaagaggggtactggcagatcgctgctgaatttgaggttcctaagttggtccagtacctcgagattgtgcctgagactcgcagatacccagttgccgttgcggcggccggagacctgatgtacttgctcaaggcagaagattctgctagaactctgttgtatgcgcacggacctcctgtgacctgcctggatgtgtccgctaaccaggttgcatttggcgttcaaggcctgggatgggtctacgaggggagcaaaatccttgtgtatagcctggaggcagggcgaaggctgttaaaactgggaaatgtcctcagagactttacctgcgtgaatctgtctgattctccccccaacctgatggtgtctggaaacatggatggcagagtgaggatccatgatctacgctccgggaatatcgcccttagtctcagtgcccaccagcttagagtctccgcagtgcaaatggatgattggaagatcgtatctggcggggaggaaggcttggtttccgtctgggactaccgaatgaaccaaaaactctgggaggtgtactcgggtcacccagtccaacatatcagtttctccagtcactcccttattaccgcgaacgtaccgtaccagacggttatgcgtaacgccgacttagattcatttacaactcataggaggcacagaggactgattagagcctacgagtttgcagtggaccaacttgcattccagtcacccctgccagtgtgccggtcttcctgtgacgccatggcgactcattattacgatttagcactggcgtttccctataaccacgtctag

SEQ ID NO: 187580 - DNA, 1599 bp, Artificial Sequence
  Description of Artificial Sequence: Synthetic coding sequence
atggacgactacagcctggacgagttccggcggcggtggcaggaggaacttgcccaggcccaggccccgaaaaaacgccgcagaccggaagccgctgaaagacgagcacgccggccggagaatgagatgaacgacgtgccctttttcgatattcaactgccttacgaactggccatcaacatttttcagtatctcgatcgcaaagaactgggacggtgtgcccaggtatctaaaacctggaaagtgattgccgaggatgaggtgctgtggtataggctatgtcagcaagagggtcacctacccgactcctccatcagcgactacagctgctggaagttgatcttccaggagtgccgcgcgaaagaacacatgcttcgcactaattggaagaataggaagggcgccgtgagcgagttagaacatgttcccgataccgtgctctgcgacgtgcattctcacgacggagttgttatcgccgggtatacctcgggcgacgttagggtgtgggacacacgcacgtgggattacgtcgcaccttttttagaatccgaagatgaagaggatgaacccgggatgcagcctaatgtatcttttgtgaggatcaattcgagtctcgcagtggcagcctatgaggatgggtttctgaacatctgggatttaaggacggggaaatatccagtgcatagatttgaacacgatgcaagaatacaggctttggcactcagccaagacgatgctacagtagcaacagccagcgcctttgatgtggtcatgctgtcacccaatgaggagggatattggcagatcgccgcagaatttgaggtaccaaagcttgtccagtatctagaaatagtgccagaaacaagacgctatcccgtcgcagttgccgctgccggagacctcatgtacttgttgaaagctgaggactctgcaagaactcttttatacgcacatggacctcccgttacttgtctagacgtgtctgccaatcaggtggcttttggcgtgcagggactagggtgggtgtatgaggggtccaagattttggtgtactcattagaagctggacgccgccttctgaagcttggcaatgtgctgagagattttacctgcgtgaatctgtctgatagtccccccaacctgatggtcagcggaaacatggatggccgcgtgaggattcatgatctgaggtcggggaacattgctctttctttgagtgctcaccagctgcgagtcagcgcagtccaaatggacgactggaaaattgtgtctggaggtgaagaggggctggtctctgtgtgggactacaggatgaaccagaaactctgggaggtttattctgggcatccagtacagcacatatccttctccagtcacagcctgatcaccgcaaacgtgccttaccagaccgtcatgcgcaatgccgatttggacagtttcactacccaccgcagacacaggggcctgatacgtgcctacgaatttgcagtcgatcagctcgcttttcaaagtcccttacctgtgtgcaggtcttcatgcgatgctatggcgactcactactacgacctagcgctggcctttccttataatcatgtgtag

SEQ ID NO: 187581 - DNA, 1599 bp, Artificial Sequence
  Description of Artificial Sequence: Synthetic coding sequence
atggacgactacagcctggacgagttccggcggcggtggcaggaggaactcgcccaagcgcaagccccaaaaaagagacgacgaccggaggccgcggaacgacgggcccggaggccggaaaacgaaatgaatgacgtgcctttctttgatatccaactcccatacgagttagctatcaatatctttcaatacctggaccgcaaagaactggggagatgcgcccaggtcagcaaaacctggaaagtgattgccgaggacgaggttctctggtataggctttgccagcaagagggtcacttgcccgacagctcaatctccgactattcatgctggaagctgattttccaagagtgcagagcgaaagagcacatgctccggacaaactggaagaacaggaagggcgctgtgagcgagctcgagcatgtgcccgatactgtgctttgtgacgtgcacagccatgatggggtggtgatagcaggatacacaagcggtgacgtgcgtgtttgggacacgaggacttgggattatgtggcacctttcctggagagcgaggacgaggaagatgagcctggaatgcagccaaatgtgagctttgtcaggataaactcctccctagctgtagccgcatacgaagatggatttctcaatatatgggatttacgcaccgggaaatacccggtgcatcgcttcgagcacgacgcgaggattcaggcacttgctttgagtcaagacgacgcgacggtggcaaccgctagcgccttcgatgtggttatgctgagtccaaacgaagagggatactggcagattgcggccgaattcgaggttcccaaattggttcagtacctggagatcgtccctgaaactcggcgctaccctgttgccgtggctgcagctggggacttgatgtacttgctgaaggcagaggatagcgcaagaacgctgctgtatgcacatggcccacccgttacatgtctggacgtgagcgctaatcaggtggctttcggtgtccagggactcggctgggtttatgaggggtctaagatcctggtatactccctggaagcagggagaagactgttaaagctaggcaacgtcctacgggactttacatgcgtcaatttaagcgattccccaccaaacctaatggtgtcagggaacatggatgggcgcgttcgcatccacgatctcaggagcggcaacatcgctctctccctgtccgcccatcagctccgagtatccgcagttcagatggatgactggaagatcgtgtcagggggtgaggaaggcttggtctctgtctgggattaccgcatgaatcagaagctgtgggaagtatattctggacatcccgtacaacacattagtttctcctctcatagcttgatcaccgcaaacgtgccttatcagacagtgatgcggaacgctgacctagattccttcacaacccatcgtcgccatcgcggcctgattcgcgcctatgagtttgctgtggatcagctcgcctttcagagccctctgccagtctgcagatcaagctgcgatgcaatggccacacactattacgacttggccctggcgtttccttacaatcacgtctag

SEQ ID NO: 187582 - DNA, 2871 bp, Artificial Sequence
  Description of Artificial Sequence: Synthetic coding sequence
atggaggccggcggcctgcccctggagctgtggcggatgatcctggcctatcttcatctgccagatctgggccgttgcagcctcgtgtgcagagcttggtatgagttgattctgtcccttgacagtaccaggtggcggcagctgtgtcttggctgcactgagtgtagacaccccaattggcccaaccagcctgacgtggaacccgagagttggagggaagccttcaaacagcactacctcgcctcgaagacctggaccaagaacgctttggacctagagtcctcaatttgtttctccctgttccgccgccgaagagagagacgtaccctgagcgtaggtcccggacgagaattcgatagtttgggaagtgcgctggccatggcttctttgtatgaccgcatcgtcttgttcccgggcgtctacgaagagcagggagaaatcattttgaaggtgcccgtggagattgttggccaaggaaagctgggcgaggtggccttactggcatctatagatcaacactgtagcactactagactttgtaatctggtgtttacgccagcctggttctctcctattatgtacaagaccacctcaggacacgtgcagtttgacaactgtaactttgaaaacggtcacattcaagttcatggacctggcacctgccaggtcaaattttgtaccttcaaaaatacacacatcttcctccataatgtccctctgtgcgtccttgagaactgtgagttcgtgggaagcgagaataacagcgtgacggttgagggacaccctagtgctgacaagaactgggcctacaagtacctgctcggcctcatcaaatctagtcctacattccttcctactgaggactcagactttctaatgagcctggacctcgaatcaagagatcaggcatggtcaccaaagacctgtgatatcgtcatcgagggatcccagtctccaacaagtccagctagctccagccctaagcctgggagcaaggctgggtctcaggaagcagaagtgggcagtgatggggagcgtgtcgcccaaacaccagactcctcagatggcggcctgtctccctcaggcgaagacgaggatgaggaccagctgatgtaccggttgtcctaccaagtccagggtcctagacctgttctcggaggctcgttcctcggcccacccctgccaggtgcctcaatacaattaccgtcctgtctcgtgctgaacagtctgcaacaagagttgcagaaggacaaggaagcaatggctctggccaacagtgtgcagggctgtctgatacggaaatgtctcttccgcgatggcaaggggggggtttttgtctgtagtcatggcagagccaaaatggaggggaacatttttcggaatcttacatacgctgttcgctgtatacacaacagtaagattataatgcttaggaatgatatttacaggtgcagggcctccggcatattcctgcgactggagggcggcggcctcatagccgggaacaatatatatcacaatgccgaagcaggtgtggatattcggaagaaatcaaacccactgatcttgtgcaatcagattcaccacgggttgcgctccgggatcgttgtgcttggtaatggcaaagggattatcagaaataaccaaattttctcgaataaagaggctggcatctatatcctttatcacggaaacccggttgtaagcggtaatcacatctttaaaggtagggccgctggcatcgcggttaatgagaatgggaaagggttaatcaccgaaaacgtgatccgcgagaaccagtggggcggggtggacatccgcaggggcggtatccctgtcctgaggtctaacctgatctgtttcggctactctgatggggtagtcgtgggcgatgagggtaagggacttatcgagggaaatacaatctacgcgaacaagggatgtggcgtgtggatgatgtcatcctcccttccacacgttactagcaatcacgtgtcctataatgggctgtatggggtcgctgttttctctcagaaggatggcagtagtgaactaccgagaggtcatagagctcaggagaatttcagcgaggacggcgatgcaatcctctgggaaacagagctggagaaggaggacgatcccctacgccggcctattacgatagctctagttgaatccaatagtatcaaccacaacggtgcctcgggcctgtacgtccagagcagcgaggcactccacgtgatcaccaacgtgatccacgctaacggcgatcgcggtattaccgtggcccagagtagccagccaaccagggttgcaaataacagcatatcttgtaaccgccagtccggcgtcaaagtagaagcccaatgcaaggttgaactgcgtggaaatggcatctacgacaaccgggggcacgggatcattaccaaaggtgactccactatagtaatcgaaaatgacattattggtaatcgtggatctggtttgcaactgttgcctcgcagcgatactaaagtgattaagaaccgcatccactcgtttagggcctatggtatcgctgtccgcggcagagctaaagccctcgtgcaggaaaacattatatttcaaggcaagaccagtaagaccatttttcagcaaatttctaacaacagagaatgtataatgcaaaataacaagttcctcgtgttcaaaaaaaagtctgatacttggagactggtgaaccctccagctcgcccccacctggagaactccctgagaaggccttctgctgcgcataacggccagaaagtcacggcaatggcaacgagaataacggctagagtggagggcggataccacagtaatagatccgtgttttgcactattctctag

SEQ ID NO: 187583 - DNA, 216 bp, Artificial Sequence
  Description of Artificial Sequence: Synthetic coding sequence
atggaggccggcggcctgcccctggagctgtggcggatgatcctggcctacctgcacctgcccgaccttggtaggtgttctctagtgtgccgtgcctggtatgaattgatactgtctctagacagcaccagatggcggcaactctgtctcggctgtacggagtgccgccacccaaattggccaaaccagcctgatgtggaacccgagtcctggtag

SEQ ID NO: 187584 - DNA, 1446 bp, Artificial Sequence
  Description of Artificial Sequence: Synthetic coding sequence
atgctgcggaacgacatctaccggtgccgggccagcggcatcttcctcagactggaaggaggcgggctaatcgctggcaacaatatttaccataacgccgaggctggggttgatatcagaaaaaagagtaaccccctcatcctctgcaatcagattcaccatgggctgaggagcggtatagtggtgttgggaaatggaaagggaatcatccgaaataaccagatcttttctaataaggaagccggaatttacatcctctaccatgggaatcctgtggtctccggaaaccatatcttcaaagggagggccgccgggattgccgtcaacgagaatggcaaggggttgataaccgagaatgtgatcagggagaatcagtggggtggagtcgacattcgacggggtggaatcccagtactgaggagcaatttgatctgctttggatactcggacggtgtcgttgtcggggacgaaggcaaaggccttatcgagggaaacacaatctacgcgaataaaggatgcggggtctggatgatgtcatccagcctgccccacgttacgtccaatcacgtgtcctacaatggcctgtacggcgtagccgttttttcccagaaagacggcagttctgaacttcctagaggacaccgggcccaggagaattttagtgaggacggggacgccatcttatgggagaccgaacttgagaaggaggatgatccgctgaggaggccgattacgatagcactggtggaatccaacagcataaatcacaacggtgcgtcaggactgtacgtgcaatccagcgaggctctccatgtcatcacgaatgttatacatgccaatggcgaccgaggaatcacagttgcccagtcctctcaaccaaccagggtcgctaataattctatctcttgtaacagacagagcggtgtgaaggtggaagcccagtgtaaagtcgaactccggggtaacggtatttacgataatcgcggccatggcattattactaagggtgattcaaccatagtgatagagaacgacattatcggtaaccgtggaagcgggcttcagcttcttcccaggagcgatacaaaggtgattaagaaccgaatacacagcttccgggcatacggtattgcagtgcgcggccgtgctaaagccctggtgcaggagaacataatattccaaggaaaaaccagtaagacaatctttcagcagatatctaacaatagggagtgcatcatgcaaaataataaatttttagtcttcaaaaagaaaagcgacacttggcgactcgttaacccacctgccaggccccatctcgaaaacagcttacgccgcccaagtgcagctcacaacggacagaaggtcactgccatggccacaagaattaccgcccgggtcgaaggcggctaccattccaataggagtgtattctgcactatactctag

SEQ ID NO: 187585 - DNA, 2532 bp, Artificial Sequence
  Description of Artificial Sequence: Synthetic coding sequence
atggtggccgaggagagcggccccggcgcccagaacagcccctaccagctgagaagaaaaaccctcctgccgaagagaaccgcctgtccgacgaagaactctatggaaggggccagcacatcaactacagagaatttcggacacagagccaagcgcgcacgagtgtcaggcaagtcccaggaccttagtgccgcccctgcagaacagtatttgcaggagaagctacctgacgaggtcgtgctcaagatctttagctaccttctcgagcaggacctatgtcgagccgcatgcgtttgcaagcgtttttcagagttagcgaatgacccaatcctgtggaagcgcctctatatggaagtttttgagtataccagaccaatgatgcaccccgaacctgggaaattttaccagataaatcccgaagagtacgagcaccccaatccatggaaagagtcttttcagcagttatataagggtgcacatgtcaagcctggattcgccgaacacttttactccaatccagcgcggtataaaggcagggaaaacatgctgtactatgatacgatagaagacgctttgggcggcgtccaggaggcccactttgatgggctgattttcgtacactccggaatttacacggacgaatggatctatatcgagtcaccaatcacaatgattggggcagccccaggaaaggtggcagacaaagtaatcattgagaatacacgagattctactttcgtgtttatggaaggcagtgaggatgcatatgtcgggtatatgacaatccgcttcaatcctgatgataaatcagcccagcatcataacgcccaccactgtctggagattactgtgaactgttcccccatcattgatcactgcataatccggtcaacatgcactgttggaagtgctgtgtgcgtctctgggcagggagcatgcccaaccataaagcattgcaatatcagcgattgcgaaaacgttgggttgtatatcacagaccacgcccaggggatctatgaagacaatgagatatctaataacgcattagccggcatatgggtaaaaaaccacggcaatcccattattcgtagaaaccacatccaccacggccgagacgtcggcgtctttacgtttgatcacggtatggggtactttgagtcttgtaatatccaccggaaccggattgctggcttcgaggtgaaggcatatgcaaacccgaccgtggtgcgttgcgagatccaccatggacagaccggaggaatctatgtccacgagaagggcagaggtcagtttattgaaaataagatctacgcaaacaatttcgctggggtgtggattacgtcgaactccgacccaacaattagggggaactcgatattcaatggtaaccagggcggggtttacatttttggggatggaagaggtctgatcgagggtaacgatatttatggaaatgccttggccggcatccagatccggacaaattcctgcccaatagtgaggcacaacaaaattcacgatggccagcacgggggcatttacgtacacgaaaaaggtcagggcgtgatcgaggaaaatgaggtttattcaaacactctggctggtgtgtgggtaacgacagggtccacccccgttctgaggcggaacaggattcacagtgggaaacaagttggtgtttacttttatgacaacggccacggtgtcctcgaagataatgatatttataaccatatgtacagcggcgtccagatcaggacgggttccaaccctaagattcgtcgaaataaaatctggggtggccaaaatggcggaattctggtgtacaattcaggactgggctgtattgaggataacgagatcttcgacaatgcgatggccggggtgtggattaagacagattcaaaccctacacttcggaggaataagattcacgacgggcgggacggcggaatttgcatcttcaatgggggcagaggcctcctggaagaaaacgacatctttcggaacgcccaggccggcgtcttgatcagcaccaactcacatcccattctacgcaaaaatcggatattcgacgggttcgcagccggaatcgagattaccaaccacgcaaccgctacacttgagggcaaccagatattcaacaacaggtttgggggtttgttcttggcgtctggagttaatgttactatgaaagacaataaaatcatgaataaccaggacgccatagagaaggctgtgtctcgagggcagtgtctgtacaagataagttcttacaccagctatccaatgcatgacttttaccgctgccacacctgcaacaccaccgaccggaatgctatttgtgtgaactgcattaaaaagtgccaccaggggcacgatgtcgagttcattaggcacgataggtttttctgcgattgcggcgccggcaccttgtctaatccttgtaccttagctggagagcccacccacgatactgatacactgtatgattcagctcctccaattgaatcaaatacgctgcagcataactag

SEQ ID NO: 187586 - DNA, 282 bp, Artificial Sequence
  Description of Artificial Sequence: Synthetic coding sequence
atggagggcgccagcaccagcaccaccgagaacttcggccaccgggcaaaaagagccagagtatcagggaaatcacaggacctatccgcggcacctgctgaacagtaccttcaggagaagctccccgacgaggtggtcctgaagattttctcatacctactggaacaggatctgtgtcgtgccgcttgcgtctgcaagaggttctccgagttagccaatgaccctattctgtggttaggggaggtggctcacgcgtacaatccctcgacactcgggggctag

SEQ ID NO: 187587 - DNA, 2532 bp, Artificial Sequence
  Description of Artificial Sequence: Synthetic coding sequence
atggtggccgaggagagcggccccggcgcccagaacagcccctaccagctcaggcgcaagaccttactgcccaaacggacagcctgtcccaccaaaaacagtatggagggggctagcacaagcactacagagaactttggccacagggccaaaagagcccgggtcagcggtaaaagccaggacctgagtgccgcgcccgcagaacagtacctccaggagaaattacctgacgaggtagtcctaaagatattttcctaccttctggagcaagatctttgccgggcggcttgtgtgtgcaagcgcttttctgagcttgcaaatgatccaattctgtggaaaaggctgtatatggaggtgtttgaatatacacgccctatgatgcatcctgagcctgggaagttttaccagattaacccggaagagtacgaacaccctaacccttggaaggaatccttccagcagctgtacaaaggtgcccacgtgaagccgggcttcgctgagcacttttatagtaatcccgcccggtataagggtcgtgaaaacatgctctattacgataccatcgaggacgccctgggtggcgtgcaagaagctcactttgatgggcttatttttgtacattcagggatttacactgacgaatggatctatatcgagtccccaatcactatgattggggctgccccgggcaaagtagccgataaggtaatcatagagaatactcgcgacagcaccttcgtcttcatggagggatctgaggacgcttatgttggatacatgaccatacgcttcaaccccgatgacaagagcgcacagcatcacaacgcacaccattgcctggagatcaccgtcaattgtagtcctattatcgatcactgcatcatacgatctacatgcactgtaggatcggccgtttgtgtgtctggacagggcgcctgccctacgatcaaacactgcaacatctcagactgtgagaatgtaggcttgtatattaccgatcacgcgcaggggatctatgaggataacgagattagcaacaatgctctggccgggatttgggtgaagaaccacgggaacccaatcatcagacggaatcatattcaccatggccgggatgtgggagtgtttacattcgatcacggcatggggtactttgagagttgcaatatccacagaaatcggattgccggctttgaggtcaaagcgtatgctaatcctacagtggtccggtgtgagattcaccacggtcagaccgggggcatttatgtccacgagaagggaaggggacaatttatcgaaaacaagatttatgctaataacttcgctggcgtatggataacttccaactccgaccctacaattcgagggaactcaatctttaatggcaaccaaggcggcgtatatatctttggcgacggacggggactcatcgaaggcaatgatatctatggcaatgccctcgccgggatacaaattaggaccaattcatgcccaattgtgaggcacaataagattcatgacggacagcacggcggcatttacgtccacgaaaaaggccagggcgtcattgaagagaacgaagtctatagcaacacactcgccggtgtgtgggtgactacaggctcaactcccgtgctgcgccgcaacaggatacacagcgggaaacaggttggcgtgtatttttacgacaatggccacggggtcctggaggacaatgatatctataaccatatgtactctggagtgcagatccgaactggctccaacccgaagattagacgcaacaagatttgggggggccagaacggaggtattctggtgtacaactcaggccttggatgtattgaagataacgagatctttgacaatgccatggcaggcgtctggataaaaacggattcaaacccaacactgcggagaaacaaaattcacgatgggcgtgacggcgggatctgcatcttcaatggcggtaggggcctcttagaagagaatgacatttttaggaacgcccaggccggggttcttattagtaccaactcccacccaatcctgagaaaaaatagaatttttgacggtttcgctgccgggatagaaatcacaaatcacgctaccgcgacactggagggcaaccagattttcaacaaccggtttgggggactttttctcgcctccggtgttaatgttactatgaaggacaacaaaatcatgaacaatcaagatgcaatcgaaaaggccgtctcaaggggacagtgtctctacaagatatcaagctatacgtcatacccaatgcacgacttctacaggtgtcacacctgtaatacaactgaccgaaatgcaatctgcgtaaactgcatcaagaagtgccaccagggccatgacgttgaattcatccggcacgaccggttcttttgtgactgtggggcaggcaccctttccaacccctgcaccttagccggagaacctactcatgacaccgataccttgtacgactccgcgccacctatcgagagtaacacccttcagcataactag

SEQ ID NO: 187588 - DNA, 2784 bp, Artificial Sequence
  Description of Artificial Sequence: Synthetic coding sequence
atgaacagcgtgcgggccgccaaccggcggccccggcgggtgagccggcctaggcctgtccagcagcaacagcagcagcccccccaacagcctcctccccagcccccccagcagcagcccccccagcagcagcctcctccaccaccccagcaacaacagcagcagcagcctcctcctcctcctcccccccccccacccttaccccaagaacggaacaatgtcggagagcgagatgatgatgtgcctgccgacatggtcgcggaggaatccgggccaggagcgcaaaattcaccatatcaattacgcagaaaaacgctgctcccaaaacggacagcttgcccaactaaaaactcaatggagggcgcgagtacctctaccactgagaactttggccatagagcaaagagggcccgcgtgagtggcaaatctcaggacctgtcagcagcaccggctgagcagtatttgcaggaaaagttaccggatgaagtggtattgaagattttctcatacttgctagaacaggatctttgtcgcgcagcttgtgtctgtaagcgattttctgagctggctaacgaccctatcctctggaaacgcctgtacatggaggtttttgagtacacgaggcccatgatgcatcccgagccaggcaaattctaccaaattaatccagaagagtacgagcaccccaatccctggaaggagagtttccagcaactctacaagggcgcacatgtcaagcctggatttgccgagcacttttatagcaaccctgcacggtacaagggtcgcgagaacatgttgtattatgacacaatcgaggacgccctgggcggcgtccaggaagcccactttgacggattaatcttcgttcactcagggatctatactgacgagtggatttacattgagagccccattaccatgataggggcagcaccaggaaaagtggcggacaaagtgatcatcgaaaacacaagggactcaacatttgtcttcatggaaggttccgaagatgcatatgtggggtatatgactatcaggttcaaccccgatgacaaaagtgcgcagcaccacaatgctcatcactgtcttgagatcaccgttaattgtagcccaatcatcgatcactgcatcatccgctcgacatgtacggtgggatctgccgtctgtgtgtccggccagggcgcctgtccaactatcaagcactgtaatatttcagactgcgaaaatgtaggcctatatattaccgaccacgctcagggaatctatgaggataacgaaatctcaaacaatgcgctggcaggaatttgggtgaagaaccatgggaatcccatcatcaggaggaaccacatccaccacgggcgggacgtcggtgtgtttacctttgatcatgggatggggtatttcgaatcctgcaacatccacagaaaccgcatcgctggattcgaggtcaaagcgtatgccaaccctacagttgtgaggtgcgaaatccatcatgggcagaccggcgggatctacgtccacgagaaggggagggggcagttcattgaaaataaaatttacgccaataactttgccggtgtctggatcactagcaacagtgacccaactatcagaggcaattccatttttaacggtaaccaaggcggagtatacatcttcggtgatgggcggggtctcattgaaggtaacgacatttacggtaacgcacttgcggggatccagattcgaacgaattcttgcccgatcgtgcgacacaacaagatccacgatggacaacacgggggcatttatgtgcacgaaaaggggcagggcgtaatcgaagagaacgaggtttattccaacacgcttgccggcgtgtgggtcacaactgggagtactcccgtacttcggaggaataggattcactcgggcaaacaggtgggcgtctacttctatgataacgggcacggcgtgttggaggacaacgacatctataaccatatgtacagtggtgtgcagatcagaacaggatctaatcccaagatccgacgcaacaaaatctggggcggtcagaacggggggatcctcgtttacaattcagggctcggctgtatcgaggacaatgagattttcgacaacgccatggccggggtgtggatcaaaacagatagcaatcctacacttcggcgcaacaagattcacgacggccgagacggaggaatttgtatcttcaatggcggcaggggactcttggaagagaacgatatcttccgcaatgcacaggcaggggtgctgatctcgactaatagtcatcccattttacgaaaaaatagaatcttcgacggttttgctgccggtatagaaatcactaatcacgctactgctacattggaaggtaatcaaatttttaacaaccggttcggcggtctctttctggcctccggtgtcaatgttacgatgaaggacaataagatcatgaacaatcaggacgcaatcgagaaagctgtgtctcggggacaatgcctctacaaaatatctagctataccagctacccaatgcatgatttctatcgttgtcatacttgtaatacaactgatcggaatgctatatgtgtaaactgcattaaaaagtgccatcagggacatgatgtcgagtttattcggcatgatcgttttttctgtgactgcggggctggaaccctgtccaatccgtgtaccttagctggagaaccaacacacgataccgatacactctacgacagcgcacccccaatcgaatccaacaccctgcagcataactag

SEQ ID NO: 187589 - DNA, 1056 bp, Artificial Sequence
  Description of Artificial Sequence: Synthetic coding sequence
atggagatcaaggaggagttcaccagcctggtgatggacgaggccctccttaaggagatgacattcatgcatgagaaaggtcagggggtgatcgaagaaaatgaggtgtattctaacaccttagccggagtctgggttaccacgggctccacgccagtgctgcggagaaaccggatccattccggaaagcaggtcggagtgtacttttacgataatgggcacggcgtactggaggacaatgacatctataaccacatgtattcaggagttcagatccgcactggaagtaaccccaagataaggcggaacaagatctggggtgggcagaatgggggtatcctggtctataactctgggttggggtgtatcgaagacaacgagatatttgacaatgccatggcgggagtctggatcaagactgattctaatccaactctgcgtcgaaataaaatccacgatggacgagacggcggtatttgtatatttaacgggggacgtggactactagaggaaaatgatatcttccgcaacgcccaggctggtgtcctcatcagcacgaattctcaccccatcctcagaaaaaacaggatcttcgatggcttcgcagctggcattgagatcacaaatcatgcaacagccacactcgaggggaatcagatctttaataaccgattcggaggactctttttagcaagcggcgttaatgtgaccatgaaggataacaagattatgaataaccaggacgccattgagaaagcggtctccagagggcagtgtctgtacaaaattagttcttacacaagctaccctatgcacgacttctaccgctgtcatacatgtaatacaacagacaggaacgcaatctgtgtcaactgcattaaaaaatgccatcagggacacgacgtggagttcatccggcacgacaggtttttttgcgattgtggggccggaaccttgtcaaatccctgcaccctcgccggtgaaccaactcatgacacggacacactgtacgactctgccccaccaattgaatctaacacactacaacataactag

SEQ ID NO: 187590 - DNA, 1305 bp, Artificial Sequence
  Description of Artificial Sequence: Synthetic coding sequence
atgcccagcgagatcctgctgaagatcttcagctacctggacgccgttagtttactttgtaccggatgcgtgtctcgcagattctaccatctggctaatgacaacttcatctggatcggcatctactcaactgccttctcccccgccagaagcaattggaagttcaactccgtggaaaaaatagccatgagcatgagtttcctctccgtccaggacaaagaagctggatactggaagaaagaatatattacaaaacaaatcgcaagtgtaaaggccgctctcgcggacattctcaaaccagtgaacccctacaccggactcccagtcaagacaaaggaggccctgaggatcttcggtctcgggtgggccataattctgaaggagaaagggggcaaggaatacattatggagcatgtggacttgagcataaatgatacgtccgtgacagttatatggtacggtaagaagtggccctgtctggcctcactgtctacattggacctgtgtggcatgacccctgtcttcacagattggtacaagactcctaccaaacatcgtctgagatggcacagcttaatcgcaaagtacaatctttcccacctgacgatctccactatgatcggttgcgaccgactcattaggattttttgcctgcacccgggcctgctggtgggcgtttggaagaaggaggaagagctggcctttgttatggccaacctgcacttccaccacttagtggagcgcagcacgcttggttccgccacgatcccatacgaactccctccccacagtccattcctcgacgattcaccagaatacggccttcatggctatcaattacacgtggatcttcactccgggggcgtattttatctgtgcggcacattccgcaacctcttcacaaaaagggggaatatcgagaacgggcacgtgaaattgatcgttatccacttaaaaaataatcgtgaacatcttccgctgatcggaaaagtgggactctcctggaaaaccgatatctttgacggctgtatcaagtcctgcagtatgatggatgttaccctgctggatgagcatgggaagcccttctggtgtttttcttcaccagtttgtttgcgaagtcccgccacaccctctgattcttctagctttctcggacaaacttataatgtggactatgtagatgcggaagggagagtgcatgtagaacttgtctggatccgcgagaccgaagagtacctgattgtgaatctcgtgctgtacctgtctatagccaagattaaccattggtttggcaccgagtattag

SEQ ID NO: 187591 - DNA, 1533 bp, Artificial Sequence
  Description of Artificial Sequence: Synthetic coding sequence
atggccaccggccggggccggatcctgcagcagcactggctgggcttacaaactcttcgcggcccctcacggggtgggggggccgccagaggcagagcccgggcttttggctgcagaaaaggccccggagttaaactgagcgccggcagcgctgcgctgcgctgtcacgccgggggcggtcagcactgggagagcagtttcagttgttgttccgggttcttggatggcatgcctagcgaaatactcctcaaaatcttcagctacctggatgccgtttctctgctgtgtacaggttgtgtttccaggcggttttatcatctggctaatgataattttatatggataggtatttattcgacggcctttagccccgcaagatcaaactggaaatttaacagtgtcgaaaaaatcgccatgtcaatgagctttctgagtgtgcaggataaggaagctgggtactggaagaaggaatatatcactaagcaaatagcctcagtgaaggcagccctagcagatatcctcaagcccgttaatccgtacaccgggctgcccgtcaagactaaagaggcgctaagaatctttggcctggggtgggccataatactcaaagagaaaggtggaaaggagtatattatggagcacgtggatctgagcatcaacgacacttcagtcacggtaatctggtacggaaagaaatggccctgtcttgctagcctgtctacactcgatttatgcggaatgacaccggtgtttacagactggtacaagacacccaccaaacatagacttagatggcattccctgattgcgaaatacaacctgagtcacctgacaatctcaacaatgatcgggtgtgatagactgatcagaatcttctgcctacatcctgggttgcttgtgggagtctggaaaaaagaggaggagctggcatttgtaatggctaatcttcacttccatcaccttgttgaacggtcaacactgggttctgctacaatcccatatgaacttccgccccattcaccctttctcgatgattcccctgaatatgggcttcacggctatcagttacacgtcgacttgcacagcggcggcgtgttttacttatgtggtacgtttcgcaatctgttcaccaaaaggggaaatattgagaatggccatgtgaaactgattgtcatacatctcaagaataacagagagcacctccctctgatcggcaaggtagggctcagctggaaaacggatatttttgatggctgcatcaagtcttgttccatgatggatgtgacgcttcttgatgaacatggaaagcctttttggtgcttctcctcccctgtgtgtcttaggtcacccgccacaccatctgactcaagctcatttctgggtcagacttacaacgtcgattacgttgatgctgaaggcagggtccacgtggaattggtatggattcgcgaaacggaagaatatctgatagttaacctggtactgtacctaagcattgctaagattaatcattggttcgggaccgagtactag

SEQ ID NO: 187592 - DNA, 879 bp, Artificial Sequence
  Description of Artificial Sequence: Synthetic coding sequence
atgatggccttcgccccccccaagaacaccgacggccccaagatgcaaaccaaaatgtcaacttggacacctctcaatcatcaactgctcaatgatcgggtgttcgaggaaaggagagcattgcttgggaaatggttcgacaagtggacggacagtcagcgccgccgaatcctgactggccttttggaacgatgttccctgagccagcagaagttctgttgccggaagctgcaagaaaagatccccgccgaggctcttgacttcactaccaagctgcctcgggtgctgagcttatatattttttcattcttggacccaagaagtctttgtcgctgtgcgcaggtatgctggcattggaaaaatcttgctgagctcgaccagctgtggatgctgaaatgcctccgttttaactggtacattaatttcagtccaactcctttcgagcaggggatatggaagaaacactatattcagatggtgaaggaactacacatcactaaaccaaaaactccacccaaggacgggttcgtcattgccgacgttcaactggttacctctaactccccggaggagaaacaatctccactttcagcgttccgcagctctagttcgttgagaaagaagaacaactccggtgagaaagcactgccgccttggagatcaagtgataaacacccaacagacataataaggttcaactatctggataatcgggaccctatggaaacagtccaacaaggaaggcgaaagcggaaccagatgacccctgacttctcccgccagtcacatgataaaaagaataagctgcaggataggactcgtctgcggaaggctcagtccatgatgtccagaagaaatccctttcccctttgtccttag

SEQ ID NO: 187593 - DNA, 891 bp, Artificial Sequence
  Description of Artificial Sequence: Synthetic coding sequence
atggacggcgacggcgaccccgagagcgtgggccagcccgaggaggcctccccggaagagcagccagaagaagcaagcgctgaggaggagcgccctgaagaccaacaggaagaagaagcagccgcagccgcagcctacctggacgaactcccggagcctttgttgttgcgggtcctggcagccctgcctgcagctgaactggtgcaagcttgccgactggtctgcctaaggtggaaagagctggtcgacggagcaccattgtggttgctgaagtgtcagcaggaaggcctggtccccgaggggggcgttgaagaagagagggaccactggcagcagttttatttcctgagtaagagacggagaaatctcctacgaaacccttgcggcgaagaggacctcgaaggctggtgcgatgtggagcacgggggggacgggtggcgagtggaagaactgcccggagactcaggcgtggagttcacccatgacgagagtgtcaagaagtattttgcctcctcctttgaatggtgcaggaaggcccaggtgatcgacctgcaagccgagggatattgggaagaactgttagacactacacagcctgcgatcgtggtgaaggactggtacagcggtagatctgatgccggttgtttgtacgagctcaccgtgaaactcttgagtgagcatgagaatgttcttgccgaattctcctccgggcaggtggctgttccccaggatagtgatggaggcggatggatggagatcagccacacttttactgactatggtccaggtgtgagattcgtaaggttcgaacatggcgggcaggacagcgtgtattggaaggggtggttcggcgccagagtcactaattcatccgtatgggtggagccttag

SEQ ID NO: 187594 - DNA, 594 bp, Artificial Sequence
  Description of Artificial Sequence: Synthetic coding sequence
atggacggcgacggcgaccccgagagcgtgggccagcccgaggaggcgtctccagaggaacagcccgaagaggccagcgccgaggaggagaggcccgaggatcagcaggaagaggaagccgcagccgccgctgcttacctggatgagctgccagagcctctcttattgagagttctggctgctctcccagctgcagagctagttcaggcctgtaggttggtatgtctccggtggaaggaactagtagacggggccccactttggctactgaagtgccagcaggaagggttagtacccgagggtggagtcgaggaggagagggaccattggcagcagttttattttctgtctaagagaaggcgtaacctcctgcggaacccgtgcggagaagaggacctggaaggttggtgtgacgttgagcacggaggggatggatggcgagtggaagagcttccaggtgattcaggggtggaatttacccatgatgagagtgcccctgtattgccagggggagtcgcaaaacaccgtggcttactgggcggcgctgcggggcatgacagcgctggacaccgcggggagggcctggttagatag

SEQ ID NO: 187595 - DNA, 1614 bp, Artificial Sequence
  Description of Artificial Sequence: Synthetic coding sequence
atgaagcactacagccccaccgactacgtgaactggctggaggagtataaagtgaggcagaaagcgggcctggaagcgcgtaagatcgttgcttccttctctaaaagatttttctccgagcatgtgccttgcaacggcttctccgatattgagaacctggagggaccagagattttttttgaggatgagcttgtgtgcatccttaacatggaaggcagaaaagctctaacttggaaatactacgccaagaagattctgtactacctgaggcaacagaagatcttgaataatctgaaggcattcctgcagcagcccgacgactacgaatcctacctcgagggtgcagtatacattgaccaatactgcaaccctctctcagacatcagcctgaaggatatacaagcgcaaatagattcgattgtagaactagtctgcaagaccttacgggggattaactcacggcacccgtctctagcattcaaggccggtgagtctagcatgattatggaaattgaactccagtctcaggtcttagatgctatgaactacgttctgtacgaccaactgaaatttaaagggaaccgcatggactactacaatgctttgaacctatacatgcaccaggttctcattcgccggactggcatcccaatctccatgagcctactctaccttaccattgcacgccagctcggagtacctctggagcctgtcaattttccaagccattttcttctgagatggtgccagggtgctgagggcgctaccctggacatttttgactacatctatatcgacgcctttggcaagggaaagcagctgactgtcaaggagtgcgagtacctgatcggtcagcacgtaacagcggccttatacggtgtagtgaatgtcaaaaaagtgctgcagagaatggtgggcaacctgctgtccctgggcaaacgggagggaatcgaccagagttatcagttgctgagggacagcctggatttatacctcgctatgtaccccgatcaggtgcaattgcttctgcttcaggccaggctgtattttcacctgggaatttggcccgagaaggtcctggatatcctgcagcatattcagaccctggaccctgggcaacatggcgccgtgggctatctcgtgcagcacactctcgagcatattgaaaggaaaaaggaagaggtgggagttgaggtcaaacttcgttcagacgagaaacatagagatgtgtgctactctatcggactgatcatgaagcacaaacggtatggctacaattgcgtgatttatggatgggaccccacctgtatgatgggacatgaatggattcgtaacatgaacgtgcactccctgcctcatggtcaccatcagccgttctataacgtcctcgtggaagacggtagttgcaggtatgcagcacaagagaatctggagtacaatgttgaaccccaggaaatatcgcatccagatgtgggccggtacttcagcgagttcaccggtacccactatatcccaaacgccgaacttgaaatcaggtatccagaagatttagagtttgtgtacgagacggttcagaatatctactctgccaaaaaagaaaatatcgatgagtag

SEQ ID NO: 187596 - DNA, 1887 bp, Artificial Sequence
  Description of Artificial Sequence: Synthetic coding sequence
atggccgccgccgccgtggacagcgccatggaggtggtgcccgccttggccgaagaggccgccccagaggtggccggattaagctgcctggtgaatcttcctggcgaggtattggaatacatcttatgttgcgggagcctgaccgccgcggacataggacgcgtgtcttcgacctgtaggcgactgcgagagctgtgtcagtcctccggcaaagtgtggaaggaacagttcagagtcagatggccgtcactcatgaagcattacagtccaaccgactatgttaattggcttgaagaatacaaagtgcggcagaaggctgggctagaagcccgcaagatcgtagcttcctttagcaagaggttttttagcgaacacgtgccatgcaacggtttctcagacatcgagaatctggaaggccctgaaattttctttgaggacgaattggtttgcattctcaatatggaaggtcggaaggccttaacatggaagtattacgccaaaaagatcctctactatcttagacagcaaaaaatcctcaataatcttaaagcatttctccagcaacccgacgattacgaatcctacctggaaggagcagtgtatatcgatcaatattgtaacccattgagcgatatctccctgaaggacattcaagcacagatcgattccattgtcgagttagtttgtaaaactctcaggggcatcaacagcaggcatccaagcttggcgttcaaggccggggaatcctctatgatcatggaaatcgagttgcagtctcaggttctggacgccatgaattacgtactgtatgaccagttgaaattcaaaggcaacagaatggactattacaacgcgctgaacctgtacatgcatcaggttctgatcaggaggacaggtattccaatctcgatgagtctgctctaccttacaatagctagacaactgggagtccccttagagccagtaaacttcccgtctcacttcctgttgcggtggtgccagggagcagaaggggccactctagatatctttgactatatttatatcgacgcgtttggaaaagggaagcagctgacagtgaaggagtgtgaatacctcatagggcagcacgtgacagccgctctgtacggcgtagtgaacgttaagaaagtcctgcaacgcatggtaggaaatctactctccctgggcaagcgggagggtattgaccaatcttatcagcttctcagagactcattggatctttaccttgctatgtaccccgatcaggttcagttactgcttctccaggcaagactctatttccatcttggcatttggcctgagaagtcattttgcctggttctcaaagttctcgacatcctccagcacatacaaaccctcgaccccggtcagcacggagccgtcggctatctggtgcaacacactctcgagcatatcgaacgaaagaaggaggaagtgggcgtcgaggtgaagctaagaagtgacgaaaagcatagggatgtgtgttatagtataggcttgattatgaaacacaaacgatacgggtacaattgcgtgatttatggatgggacccaacctgtatgatgggtcacgaatggatccggaatatgaatgtgcattctttgccccacggacaccaccaacctttttataacgtgctggtggaggatggaagctgtcgctatgctgcacaggagaacttagaatacaacgtggagccacaggaaatcagccatcctgatgtaggcaggtatttcagtgaatttacaggtacccattacatcccgaatgcagaactggaaattagataccctgaggatctcgagttcgtatacgaaacggtgcagaatatctattccgccaagaaagagaacattgacgagtag

SEQ ID NO: 187597 - DNA, 1866 bp, Artificial Sequence
  Description of Artificial Sequence: Synthetic coding sequence
atggccgccgccgccgtggacagcgccatggaggtggtgcccgccttagctgaagaagccgctcccgaagtggcagggctgtcatgcctggtgaatctgcccggtgaagtcttggaatatattttgtgctgcggatctctcacagctgccgacatcgggcgagtctcatccacgtgcagacgcctgcgagagctatgccagagtagtggaaaagtgtggaaggagcagttcagggtgcgttggccctcattgatgaagcactactccccaacagactacgtgaactggcttgaggagtataaggtccggcaaaaggcaggacttgaagccaggaagattgttgcctcttttagcaagaggttctttagcgaacatgttccatgtaatggctttagtgacattgagaatctggagggaccagaaatcttctttgaagacgaactggtctgtattctgaacatggaaggtcggaaggctttgacctggaaatattacgcgaaaaaaattctgtattacctccgtcagcagaagatcctaaacaacctgaaggccttcctgcagcaacctgacgattatgagtcatatctggagggcgcagtgtacatagatcagtactgcaatcctctcagcgatatttctctcaaggatattcaggcccaaattgactcaattgtagagttagtatgtaaaactctgcggggaataaacagcagacacccctcactggcttttaaggcgggcgagagtagcatgatcatggagattgagctgcagagtcaggtgctagacgcaatgaattacgttctgtatgatcagctgaagtttaagggaaatcgcatggactactacaacgcgctcaacctgtatatgcaccaggtgttgatccgtcgaaccgggatccctatcagcatgtcccttctgtaccttaccattgcccgccagttgggggtgccactcgagccagtgaactttccttcacacttcttattgaggtggtgtcagggcgctgaaggagctaccctcgatatttttgattatatttatatagacgcctttggtaaaggcaaacagttgaccgtgaaagaatgcgagtatctcatcggtcagcacgtcaccgcagcgctgtacggagtggtgaacgtgaagaaggtgctgcagcgcatggtgggtaaccttctcagcctcggaaagcgggaggggattgatcagagctatcaacttctgagggactctctggacttgtacctggctatgtaccctgaccaggtccagctcctgctgctgcaagcccgcctgtactttcacctcgggatatggcccgaaaaggtacttgacatcctgcagcacatccagactctggacccgggccagcatggggccgtcggctacttggtccagcacacccttgagcacatcgaaaggaaaaaggaggaggtgggtgtcgaggtgaaattgcgctccgatgagaaacatcgagacgtgtgttatagcatcgggctcatcatgaaacataaacggtatggctataactgcgtcatttatgggtgggatcccacctgtatgatgggccacgagtggattcggaatatgaatgtgcactctctacctcacgggcaccaccagcccttttacaacgtgttggtggaagatgggtcttgccgatacgctgctcaagagaatttggagtacaacgtggagccccaagagattagccaccccgacgtgggacgctatttttctgaatttactggcacccactatattcctaacgccgaattggagattcgttaccctgaggacctggaattcgtatatgagacagttcaaaacatttattccgctaagaaagaaaacattgatgaatag

SEQ ID NO: 187598 - DNA, 1434 bp, Artificial Sequence
  Description of Artificial Sequence: Synthetic coding sequence
atgaagcactacagccccaccgactacgtgaactggctggaggagtacaaagtacgacaaaaagcaggtctcgaggcgcgtaaaattgtagcttctttcagcaagagattctttagtgagcacgtgccgtgtaacggcttcagcgatattgagaatctggaaggtcctgagatattcttcgaagacgagctagtgtgcattctgaacatggagggaagaaaggccctgacatggaagtattacgcaaaaaagatcttatactacttgcgacaacagaagattctgaataaccttaaggcgttcttgcaacagccagacgactatgagagctacctggagggtgccgtgtatatagaccagtattgcaatcccctgtccgatatatccttgaaggatattcaggcgcaaatcgactccatagtggagctcgtgtgtaagaccctaagaggtattaattctaggcacccaagcttggcctttaaggccggagagagttccatgatcatggagattgaactgcaaagccaggtgttggatgccatgaattacgtgctgtacgaccagttgaagttcaaaggcaacaggatggactactacaacgccctgaacctctatatgcaccaggtgctgatccggcgaaccggaatacccattagtatgtccctcctctacctcacaattgccaggcagctgggagtgccattggagcccgtcaatttcccgtcccatttccttctgagatggtgccagggcgctgagggtgaaggcatcgatcaaagctaccagctgttgagagattccctggatctgtacctggcgatgtatcctgaccaggtgcagctgctgctcttgcaggctcgtctgtatttccacttgggcatctggcctgaaaaggtgctggatatcctgcagcacattcaaacactggaccccggtcaacatggggcggtcgggtacctggtacagcatacactggagcatatcgagcgcaaaaaggaagaagtgggtgtggaggttaagctccgctcagacgagaaacatagggacgtgtgctatagtataggattaatcatgaaacacaagaggtatggctataactgcgttatctatgggtgggacccaacctgcatgatggggcacgagtggattcgaaatatgaatgttcactccctcccgcacggccaccatcagccgttctataacgtcttggtggaagatggatcttgcaggtatgctgcccaggaaaacttagagtacaatgtcgaaccccaggagatctcccatcctgacgtcgggcgatacttcagcgagttcacaggcacacattatattcctaacgctgagctagagatcaggtatcctgaggacctggagtttgtgtacgagacagtgcagaacatttacagtgcgaagaaggagaatattgacgagtag

SEQ ID NO: 187599 - DNA, 1212 bp, Artificial Sequence
  Description of Artificial Sequence: Synthetic coding sequence
atggagcccgtgggctgctgcggcgagtgccggggcagcagcgtggaccctcggtcaacatttgtcctgtctaatctcgcggaagtcgttgagagagtattgaccttcttgcccgccaaagcgctcctgcgcgtcgcatgtgtgtgtagactgtggagagaatgcgtgcgtcgagttctgcgtacacatagatccgttacttggattagcgctggactcgctgaagctggccacctggaaggacactgtttggtccgggttgtcgctgaggagctcgaaaatgtgcgtatcttacctcataccgtgttatacatggcagactccgagacattcatctcccttgaagaatgccgcgggcacaagagagcccgcaaacgtactagcatggagaccgcgttggctctggagaaactgttccctaagcaatgccaggtgctgggcatcgttacaccaggcattgtggtgacacccatggggagcggatccaataggccgcaggaaatagaaatcggagaatccggattcgctcttctttttcctcaaatcgagggaatcaagatccagcctttccactttatcaaagaccccaagaacctcaccctggagaggcaccagctgacggaagtggggttgctggacaacccagagctcagggttgttttggtctttgggtacaattgctgcaaagttggggcctccaactacttgcaacaggtggtgtccactttctctgacatgaatattatcctggcgggtggacaagttgataacttaagctcactcacgagtgaaaagaatccacttgacatagacgccagcggtgtggttggcctgtccttctctggacacagaattcagagcgcaacagtgttgctgaacgaggacgtttcagatgagaaaacagcagaggccgcaatgcagcgcctgaaagcagctaacatcccggaacataatacgatcgggttcatgttcgcctgtgttgggcggggatttcagtactacagggcaaaaggaaatgtagaggccgatgccttccgcaaatttttcccgagtgtgcctttatttggatttttcggtaacggagagatcgggtgcgatagaattgtcacaggcaatttcatcttacgcaagtgtaatgaagtcaaagacgatgatttgttccactcctacaccacaattatggcactaatccatttaggatcttccaagtag

SEQ ID NO: 187600 - DNA, 831 bp, Artificial Sequence
  Description of Artificial Sequence: Synthetic coding sequence
atggagcccgtgggctgctgcggcgagtgccggggcagcagcgtggatccccggtctaccttcgtgttgtccaatttggcagaggtcgtggaaagggttcttaccttccttccagccaaggcattgctccgagttgcctgcgtctgtcgcctctggcgggaatgcgtgcggagggtgttgcggactcaccggagcgttacatggatttccgccgggctggctgaagccgggcacctcgaaggccactgtctggtgagggtggttgccgaggaactggaaaatgttcgcattctgccacacaccgtgttatacatggctgattcggagacctttatttccctcgaagagtgccgggggcataagcgcgcgcgaaagagaacctccatggagacagccttggctttggaaaagctctttccaaaacagtgccaggtattggggattgtgacacccggaatcgtggtgacgccaatgggttctggctccaacagaccccaggagatcgaaatcggggaaagtggtttcgcactgctcttccctcagattgaggggatcaagatccagccatttcacttcattaaagatcccaagaacctcacgctggagagacaccagctcactgaagttggcctcttggacaacccagagctaagagtcgtgctggtcttcgggtacaattgctgcaaggtaggtgcctccaactatttacagcaggtcgtcagcacattttccgacatgaatatcattttagcgggcggccaagtcgataatctgtcctctcttacgtcagaaaagtatgtattgtgcgcctcagacttcgtttgtgaatag

SEQ ID NO: 187601 - DNA, 900 bp, Artificial Sequence
  Description of Artificial Sequence: Synthetic coding sequence
atggccgacagcgagaccttcatcagcctggaggagtgccggggccacaaaagagctagaaaacggacttcaatggagactgcactggctctggaaaagcttttccccaaacaatgccaggttctgggaatcgtgacacccggaatcgtcgtaactcctatgggcagcgggtccaacagaccccaggagattgagattggagagtccgggtttgctcttcttttcccccagattgaaggaataaaaatacagcccttccatttcataaaggacccaaagaatcttacgttggagaggcaccagctgaccgaagtaggcctgctggataaccccgagctgagggtggtgcttgtgttcggttataattgctgcaaagttggggcctctaactacttgcagcaggtggtgagcacattctcagatatgaacataatccttgcaggggggcaagtagataacctgagtagtttgacctccgaaaagaatcctctggacatcgacgccagcggcgtggtgggcctcagctttagcggccaccgaatacagtcggccacagttctattaaacgaggatgtgtccgacgagaagaccgcggaggccgctatgcaacgactgaaagcagctaatatccccgagcacaatactattggcttcatgttcgcatgcgttgggagggggttccagtactacagagcaaagggcaacgtggaggccgatgcgtttcgcaagtttttccccagtgtgccactttttggattttttggaaatggcgagattggctgcgatcgaatagttactgggaacttcattctgagaaagtgcaatgaagtcaaggacgacgatctgtttcatagctacacaacaattatggcacttatccatctgggaagcagcaaatag

SEQ ID NO: 187602 - DNA, 1743 bp, Artificial Sequence
  Description of Artificial Sequence: Synthetic coding sequence
atgggcgagaaggccgtgcccctgctgcggcggcggcgggtgaagagatcttgtccttcgtgcggaagcgaactcggagtggaagagaagagggggaagggcaaccctatcagcatccagctgtttcctcctgagctggtggaacacatcatcagctttctgcctgtgagagacctagtggcccttgggcagacttgcagatacttccacgaggtatgtgacggtgagggagtctggaggcgaatttgtagaaggctgtcaccccggctgcaggatcagggttcgggtgtacgcccctggaagagggctgcaatcctgaactatactaagggcttatactttcaggcgtttgggggtagaaggcgatgcttaagcaaaagcgtcgctcccctgctcgcacatggttacagacggtttctgcccaccaaggaccacgttttcatcctggattacgtgggaaccctgttcttcctgaagaacgcactcgtctccacactgggacagatgcagtggaaacgcgcatgtagatatgtggtactttgcagaggcgcgaaagatttcgctagcgatccacgttgcgatactgtttaccggaaatatctctacgttctggctactcgggagccacaagaagtcgttggaactacatctagtcgcgcatgtgattgtgtcgaagtctatctacagtcttctggccaacgggtcttcaagatgaccttccatcattctatgaccttcaagcagatcgtgctggttggccaggagacccagcgtgccctgctcctactcaccgaggagggaaagatttactcacttgtggtaaatgagacccagctcgaccagccccgaagctacactgtccagttagcactccgcaaagtatctcactatctccctcatctccgcgtggcctgtatgacgagtaatcagtcttctacactgtacgtgaccgaccaggggggggtttactttgaagtacatacccccggggtgtaccgggacctattcggcaccctacaggcctttgacccccttgaccagcagatgcccctggccctgtctctgcccgccaaaatactgttctgtgcgctgggatacaaccatcttggactggttgacgaattcgggcggatttttatgcagggcaataacaggtatgggcagttaggcactggcgataaaatggacaggggcgaacccacccaggtgtgctacctccaacggccaatcactctctggtgcggcctgaaccatagtttggtgctctctcagtccagcgaatttagcaaagagttgctgggctgtgggtgtggcgcagggggcagactccctggatggccaaaaggctctgcttcttttgtcaaacttcaggtgaaggttccactctgcgcatgcgccttatgcgcaactagagagtgcctgtatattctcagcagtcacgatattgagcagcatgccccatatcgccaccttcctgctagccgagtagttgggacacccgaaccctcactgggggcacgagctccacaagatccaggcggcatggcacaggcatgtgaagaatacctctctcagatccactcctgtcagacgctgcaggatcgcaccgagaagatgaaagaaattgtcggatggatgccactgatggcagcacagaaggattttttctgggaagctttggacatgctgcaaagggcagaagggggtggcggcggtgtgggtcctcccgcccccgagacttag

SEQ ID NO: 187603 - DNA, 957 bp, Artificial Sequence
  Description of Artificial Sequence: Synthetic coding sequence
atgggcgagaaggccgtgcccctgctgcggcggcggcgggtgaagcgctcatgtccatcctgcggctccgaattgggagtggaggagaaacgaggcaagggaaatccaattagtattcaactgtttcctcctgagctggtggagcacattatcagttttcttcccgtgcgagacctagtagcgctcggtcaaacgtgtcggtatttccatgaggtctgtgatggcgagggcgtgtggcggcgtatatgtcgacgactctcaccccgcttacaggatcaggacaccaagggcctttatttccaggcatttggaggccggaggcggtgcctgagtaagtcagtggcccccctgctcgcccatggatatagaagatttttacccactaaggatcatgtgttcattctcgattacgtgggcacgttgttcttcttaaagaatgccctggtgagcacgttaggacagatgcaatggaaaagagcctgcagatacgtggtgctgtgtcgcggtgccaaagacttcgccagcgaccccaggtgcgataccgtctaccgaaaatacctttacgtgttggccacaagagagccacaggaggttgtcggcaccacatccagccgggcttgtgattgcgtcgaggtttacttgcagagcagcggccagcgggtttttaaaatgacttttcatcactcaatgactttcaaacagatcgttctcgtcggccaggaaacccagcgtgcactcctactgctgaccgaagagggaaaaatttactccctcgtggtgaacgaaacccagctcgatcagcctcgttcatataccgtgcagctggccctcaggaaggtatcacactaccttccccatctccgggtcgcttgcatgaccagtaaccagtcatctactttgtatgttacggatcctatcctctgcagttggctgcagccaccatggcccgggggatag

SEQ ID NO: 187604 - DNA, 1857 bp, Artificial Sequence
  Description of Artificial Sequence: Synthetic coding sequence
atggtgtgggagagccagcaggagcggggcggccagggcccccggcggcaggaaggccgcagcagagaaggagccatccgaatggtgagggggagccaaagaaggaagttgcagaaatttacccgtttatgtgggagagaagaggggttgcgggtcaagagatcctgtccaagttgcggctctgagcttggcgtggaggagaagagaggtaaggggaacccaatctcaatccagcttttcccccctgagctggtggagcatattatttccttcctcccagtccgcgacctagtagctttgggacaaacctgtcgatacttccacgaagtctgcgatggggagggagtttggcgccgtatctgccgacgtcttagcccacgtttacaggaccagggaagtggcgtaaggccatggaagagggctgctattctgaactacacaaagggtctctactttcaggccttcggaggcaggcggcgttgtctaagcaaaagtgtggcccctctgctcgcccacggctaccggaggtttttgccgacgaaggaccatgtcttcattcttgactatgtaggaactctctttttcctcaagaacgctcttgtttccaccttaggtcaaatgcagtggaagcgagcttgtagatacgtcgtgctctgccgtggcgccaaggatttcgcctccgacccccggtgcgacaccgtataccggaagtatctgtacgtgctggctacacgcgaacctcaagaggtcgtgggcaccacctcatccagagcttgcgactgtgtggaagtatacttgcagtcctctggccagcgggtgttcaaaatgacattccatcacagtatgacatttaaacagatagtgttggtagggcaggagacccagcgtgctctgctgttgcttactgaagaaggcaaaatctactctcttgtagttaacgagactcagttggaccagccgcgctcatataccgtacagctggctctccgcaaagtgtcacactacctcccacatcttagggtagcctgtatgacgtccaatcagtcatcgaccttgtacgtgactgatcagggaggcgtgtatttcgaggtgcatacgccaggcgtgtaccgcgatctctttgggacccttcaggctttcgatccacttgatcagcaaatgcccctggcattgtcattgccagcaaaaattctgttttgcgctctggggtataaccatctggggctggtcgatgaattcggccggatatttatgcaagggaacaaccgatatggtcaattgggcaccggagacaagatggataggggcgaaccaacacaggtctgctacctgcagcgacccatcacactgtggtgcgggctgaatcactcactggtgttgtcccagtcatccgagttctccaaagaattactcggttgcgggtgtggcgccggaggaagactacctggctggccaaaagggtccgcttcattcgttaagctgcaggtgaaggtccctctttgtgcatgtgccttgtgtgcgacacgcgaatgcctctacattttgagctcacacgacattgaacagcacgcgccctatcggcacctgccagcgtccagggtggtcgggactccagagccgtctctgggagcgagagcccctcaggaccctggtgggatggcccaggcttgtgaggaatatttgtctcagattcattcctgccagacgttgcaggacaggacagagaagatgaaggaaatcgtgggctggatgcctctgatggcagcgcagaaagatttcttctgggaagcactggacatgttgcagcgtgcagaaggcggcggagggggagtcgggccaccagcccctgagacttag

SEQ ID NO: 187605 - DNA, 957 bp, Artificial Sequence
  Description of Artificial Sequence: Synthetic coding sequence
atgggcgagaaggccgtgcccctgctgcggcggcggcgggtgaagcgaagctgtccttcgtgcggatctgaactaggagttgaggagaagcgggggaaaggcaatcccatatccatacaattgtttccgccagagctcgtggagcacatcatatccttcttgcccgtgagggatttggtcgctctgggacagacctgtcggtacttccacgaggtctgtgacggggagggggtgtggcggcgcatctgtcgcaggctttctccccgtttacaagaccaggacacaaagggcctgtacttccaagctttcggcgggcgccggagatgcctctcgaaaagcgtcgcccctttgctggcccacggttataggcgcttccttcccacaaaagaccacgtgtttatcctggactatgttggaactctgttttttctcaaaaacgccttggtgtctaccctgggccagatgcaatggaagcgggcatgccgctatgttgtgctgtgcaggggtgccaaggattttgccagcgatccccgttgcgacactgtatacaggaagtacctctatgttctggccacgcgtgaacctcaagaggtcgtgggaaccacgtcctccagagcctgtgactgtgtggaagtatacctacagtcctccgggcagcgagtgtttaagatgacttttcatcatagcatgacattcaagcagatcgtcctagtgggacaggaaacccagagagcgctcctgcttctgaccgaggaaggaaaaatttactcacttgtagttaatgaaactcagctggatcagccgcgcagttataccgtacagctggccctaagaaaggtgtctcactatctgccccatctgcgggttgcatgcatgacaagcaatcagagcagtacactgtatgtaacggaccccatcctgtgtagttggctgcagcccccgtggcccggcggctag

SEQ ID NO: 187606 - DNA, 1707 bp, Artificial Sequence
  Description of Artificial Sequence: Synthetic coding sequence
atggtgaagcggagctgccccagctgcggcagcgagctgggcgtggaggaaaagcgtggtaaggggaatcccattagcattcaactctttcccccagaactcgtggagcacattatctcattcctgcctgtacgcgatttggtcgccctgggacagacatgtcgctatttccacgaggtgtgcgacggcgagggcgtttggaggagaatttgtaggaggttatctccccggctacaggatcaagggagtggcgtgaggccatggaagcgggctgcgattctgaactacaccaagggcctgtactttcaggctttcggtggtcggagacggtgcctctcgaagtctgttgcacctcttctcgcacacggctatcgtaggttcctgccaacaaaagatcatgttttcatactggactatgtgggtaccctctttttcctgaaaaatgcgctggtgtctactctggggcaaatgcagtggaagcgggcttgtagatatgttgtcctgtgcaggggggctaaagacttcgcctcagatcctagatgcgacactgtgtatcgcaaatatctgtacgtgctggctactagggagcctcaggaagtggtggggactacttcaagccgcgcctgcgattgtgttgaagtgtatcttcagagcagtgggcaacgagtgtttaagatgacctttcaccattctatgacgtttaaacagattgtgctggtcggacaagagactcagagggccctgctcttattgaccgaagagggaaaaatctacagtctcgtggtgaatgaaacacagctcgaccaaccccgcagctacactgtccagcttgcattgcgcaaggtgtcccactacctgccccacctgagggtggcctgtatgacctcaaatcaatctagcacactctatgtgacagaccagggtggcgtgtacttcgaggtccacacaccaggcgtgtatcgagatctgttcggtaccctgcaagccttcgatcctctagaccagcagatgccacttgctctcagcttacctgccaaaattctgttttgcgctctcggctacaaccatcttggcctggtcgatgaattcggccgcattttcatgcagggcaacaatcggtatggccagcttgggacaggggacaaaatggaccgcggcgaacccactcaggtgtgctaccttcagcggccaataacactctggtgtggccttaatcattctttagtcctgtctcagtcgagcgagttctctaaagagttgctgggttgtggttgtggtgcaggcggcagacttcccgggtggccgaagggttctgcatcttttgttaaattgcaggtaaaagtaccgctgtgcgcgtgcgctctgtgcgccacccgggaatgtctgtatatcctttcctcacatgacatcgagcaacacgcaccataccgccacttgcccgcctcccgcgtggtggggacacccgaacccagcctcggagccagggcacctcaggaccccgggggaatggcccaggcctgcgaggaatatctgtcacagatacacagctgccagacactgcaggacagaacggagaagatgaaagagattgtgggttggatgcccttgatggccgcccaaaaggactttttctgggaagctctggatatgttacagcgtgctgagggtggcggaggaggggtgggaccccctgctcccgaaacctag

SEQ ID NO: 187607 - DNA, 1104 bp, Artificial Sequence
  Description of Artificial Sequence: Synthetic coding sequence
atgcccttcctgggccaggactggcggagccccggctggagctggattaagaccgaggacggatggaaacgatgtgagtcatgcagtcaaaagctcgaacgggagaacaaccgatgcaatatctctcattccatcattctgaattcagaggacggagaaatcttcaacaacgaggagcacgagtacgcttccaagaaaagaaaaaaagaccactttcgcaatgacaccaatactcagtctttctacagggaaaaatggatctacgtccacaaggagtccactaaggagagacacggatattgtacactaggagaggcctttaatcgcctggactttagcagcgcaattcaggacatcagaagatttaattatgttgtaaagctgctgcaactgattgctaaatcgcaactgaccagcttatccggagtagcccagaagaactacttcaatatcctggacaagattgtgcagaaagtgctcgacgatcaccataatcccagattaataaaagatctgctccaggacttgagttcgacactgtgcatcctaattaggggagtaggcaagagcgtactggtcggcaacattaatatctggatttgtaggctggaaacaattttggcatggcagcagcaattgcaggacctacagatgactaaacaggtgaacaatgggctgactctgagtgatcttccgctccacatgctgaacaatattttgtatcggttttccgatgggtgggacatcatcaccctgggccaagtaacacccactctttacatgctgtcggaggatagacagctgtggaagaaactatgtcagtatcactttgccgagaaacagttttgcaggcacttaatcctcagcgaaaagggccatattgagtggaagctgatgtacttcgcactgcagaagcactaccccgctaaagagcagtacggagacacactgcatttttgccgccactgctccattctgttctggaaggattatcacttagcgctgctgtttaaggactccggacacccatgcactgcagcagatcccgatagctgcttcacccctgtgtctcctcagcattttattgaccttttcaaattctag

SEQ ID NO: 187608 - DNA, 1077 bp, Artificial Sequence
  Description of Artificial Sequence: Synthetic coding sequence
atgcccttcctgggccaggactggcggagccccggctggagctggatcaagactgaagatggctggaagaggtgtgagtcatgcagtcagaagctcgagcgggagaataatcgctgcaacatcagccattccatcatcctgaatagcgaggatggcgagatctttaataacgaggaacacgaatatgctagcaagaagcggaaaaaagaccacttcaggaatgatacaaatacccagtcgttctatcgcgaaaagtggatttatgttcataaagaaagcaccaaggaacggcacggatactgtaccctaggtgaggcctttaaccggctagacttctctagcgcaatccaagatataagaaggtttaactatgtggtcaaactccttcagttgattgcaaagagccagcttacctccttatccggagtcgcacagaagaactatttcaacattctagacaagattgtccagaaagtgcttgacgatcaccacaacccaaggctgatcaaagatctcctccaggacctgagctccacactttgcattctcattcggggtgtcggaaaatcagtgcttgtgggcaatataaacatatggatttgtcgcctcgagaccattctcgcgtggcagcagcagctgcaggacctccagatgaccaagcaggtcaataatgggctgactcttagcgacctgccccttcacatgcttaataacatcctgtatcgattttcagacggatgggatataatcactctgggacaggtgactcccacgctgtacatgctgtcagaggacaggcagctatggaagaagctgtgtcagtatcacttcgccgaaaagcaattttgtaggcacctgatcctgtccgagaaggggcacattgagtggaaactcatgtattttgccctgcagaagcattacccagctaaggagcaatacggcgacacactgcacttctgccgccactgctctattctgttctggaaggactccggacatccctgtacggcagccgatcccgatagttgctttactcccgtatccccccagcatttcatagacctcttcaaattttag

SEQ ID NO: 187609 - DNA, 876 bp, Artificial Sequence
  Description of Artificial Sequence: Synthetic coding sequence
atggagaagtacagcatcatgaagagcatgaacatgcaccggaagaaggggaaaagaactattctagaaatgacccagattctcaaaagacacggatattgtacgctgggagaggcatttaatcgcctagactttagctctgcgattcaagacatacgccgctttaactatgtggttaagcttttgcagcttatcgccaagtcgcagctaacatcgctttcgggagtggctcagaagaattattttaacatactagacaaaatagtccagaaggtgctcgacgatcaccataacccacgcctgataaaagatctgttgcaggacctttccagtacgctctgtattttaatacgaggagtcggaaagagtgtgctcgtcggcaatattaacatctggatatgtaggctagaaaccattcttgcatggcaacagcaactccaggatctccagatgaccaagcaggtgaataacggattgactcttagcgacctgcccctacacatgcttaataatatcctttaccggttctccgatggatgggacatcatcacactgggtcaggttaccccaacgctgtacatgctgtcagaagataggcagctttggaagaagctctgtcaataccacttcgccgagaagcagttctgccgacacttaatcctgtctgagaagggccatattgagtggaagttaatgtacttcgcactacagaaacattaccctgccaaggaacagtacggggatactctacatttttgtcggcactgttcaattctgttctggaaagatagcggtcatccttgcaccgctgccgaccccgattcgtgcttcacccccgtgagtcctcagcatttcatcgatcttttcaaattctag

SEQ ID NO: 187610 - DNA, 876 bp, Artificial Sequence
  Description of Artificial Sequence: Synthetic coding sequence
atggagaagtacagcatcatgaagagcatgaacatgcaccggaagaaaggaaagcgaaccattctggagatgacacagattctgaaaagacatggctattgtactttgggcgaagccttcaatagacttgacttttcatccgctatccaggacattcggagatttaattatgtcgtgaaactactccagctgattgcaaagagtcagttaacatcactgtccggggtggcccagaaaaattactttaatatacttgataagatcgtgcagaaggttttggacgatcatcacaacccccggctgattaaggatctgctgcaagacttgagctctaccttgtgtatcctgatccggggtgttgggaaatccgtgcttgtaggaaatatcaacatctggatttgtaggctggaaacaatcctcgcctggcagcagcagttacaggatctacagatgacaaaacaggtgaacaacggacttacgctgagtgatctgccactccatatgttaaacaacatcctttaccggttttcagatggttgggatatcattacactgggtcaggtcactcccacactctacatgctgagtgaggaccggcagctgtggaagaagctctgccagtaccacttcgccgagaaacagttctgtaggcacctcatcctgtctgaaaaaggtcacatcgaatggaagctaatgtactttgcgctgcagaaacattaccctgccaaggaacagtatggagacacgctccacttttgcaggcactgttccatccttttctggaaagacagcggtcacccatgcactgccgccgatcctgatagttgttttacaccggttagcccccaacactttatagacctgtttaaattctag

SEQ ID NO: 187611 - DNA, 993 bp, Artificial Sequence
  Description of Artificial Sequence: Synthetic coding sequence
atgcccttcctgggccaggactggcggagccccggctggagctggattaagactgaagacggatggaaacgatgtgagagctgctcgcaaaaactggaaagagaaaataatcgttgtaatatcagccattctattattttgaatagcgaagacggagagatcttcaataacgaagagcacgagtatgcatccaaaaagagaaagaaggatcacttccgcaacgacaccaatactcagtcgttctatagagagaaatggatttatgtccataaggagagcaccaaagagcgtcacggttactgtaccctcggagaagcctttaaccgtctcgacttcagttctgccatacaggacattcggagatttaactacgtcgttaaacttcttcagctgatcgccaaatctcagctgacaagtctctcaggagtcgcccagaaaaactatttcaatatactagataaaatcgttcagaaggtactcgatgatcatcacaaccctcgtctgatcaaggacttactccaggatttatcttcaactctgtgcatcttaatcaggggcgtggggaaatccgtcctcgtcgggaacataaacatttggatttgccgattggaaacaattctggcctggcagcagcagctgcaagacctccaaatgacaaaacaggtgaacaatgggctcactctgtccgaccttcctctgctgtcagaggaccgtcagctctggaaaaaactgtgccagtatcatttcgcagaaaaacagttttgccggcatctcatcctgagcgaaaagggccacattgagtggaagcttatgtatttcgcactacagaagcactacccagctaaggaacagtatggagataccttgcatttctgtagacactgctccatcttgttttggaaggacagcgggcatccctgtacagctgccgaccccgatagctgcttcacacccgtcagccctcagcatttcatagacctgtttaagttctag

SEQ ID NO: 187612 - DNA, 378 bp, Artificial Sequence
  Description of Artificial Sequence: Synthetic coding sequence
atgcccttcctgggccaggactggcggagccccggctggagctggatcaaaacagaggacggctggaaacgctgcgaaagttgttctcaaaagctcgagagggagaacaatcggtgcaatatttcacactccatcatcctcaactccgaagacggagagattttcaataatgaggagcatgaatatgcaagtaagaaaaggaaaaaggatcactttaggaatgacactaatacccagtctttttaccgcgagaaatggatttacgtccataaagaaagcacaaaagaaagacacggttattgcacgttaggggaggcatttaataggctggatttcagttcggccatccaggacatccggcgtttcaattatgtctag

SEQ ID NO: 187613 - DNA, 852 bp, Artificial Sequence
  Description of Artificial Sequence: Synthetic coding sequence
atgggcgccagcgtgagccggggccgggccgcccgggtgcccgccccggaacccgagcctgaagaggccctagatctctcccagctgccccctgagttactgttagtggtgctatcacacgtacctccaaggacgttgctgggtcggtgccggcaggtttgtcggggatggcgcgcactggtcgatggccaagccctgtggctgctcattctggcccgggatcatggcgcaactggaagggctctactgcacttagcacgctcgtgtcagtctcccgcgcgtaatgccagaccctgtcctcttggccgcttctgtgcccgaagacccattgggcggaacctgattcgtaatccctgtggacaagagggtcttcggaaatggatggtgcagcatggaggcgatggctgggtcgtcgaggagaatcgcacgaccgtgcccggtgcgccatcccagacttgcttcgtcacatctttcagctggtgctgcaaaaagcaggtcctcgacttagaagaggaggggctctggcccgaattgctggacagtggccgcattgaaatctgtgttagcgactggtggggagctcgccacgatagcgggtgcatgtaccgtctgctcgtgcagctgctggacgcgaatcagacagttttagataagttttcagctgttcctgacccaattccccagtggaacaacaatgcgtgcttacatgtgacacacgtgttcagtaatatcaagatgggcgtccgattcgtttcatttgagcataggggacaggacactcagttctgggctggtcactacggggcccgcgtcacgaatagttctgtgatagttagagtcagactatcatag

SEQ ID NO: 187614 - DNA, 852 bp, Artificial Sequence
  Description of Artificial Sequence: Synthetic coding sequence
atgggcgccagcgtgagccggggccgggccgcccgggtgcccgcccccgaacccgaaccagaggaggccctcgatctcagtcaactgcctccggaactacttctcgtcgtgctttctcatgtacccccacgaacacttttgggacgctgccgccaggtttgcagggggtggcgggcattagtcgacgggcaagccctgtggttacttattctggcaagagatcacggggccacagggagagctctattgcacctagctcgcagctgtcagagccccgcacggaatgcgaggccgtgtcccctgggaagattctgtgccagacgccctatcggcaggaacctgatccgaaacccctgcggacaagaaggcctgaggaaatggatggtccaacatggaggcgacgggtgggtggtcgaggagaaccgcacaacagtgccaggtgctccaagccagacgtgtttcgttacgtcattctcctggtgttgcaagaagcaagtgctagatctggaggaagaggggttgtggcctgagctgctggatagcggtcggatcgagatctgcgtgtctgattggtggggcgccagacatgacagcggctgcatgtaccgcctgctggttcagctgctagacgctaatcaaaccgtgcttgataaatttagtgccgtcccagaccccatacctcagtggaataataacgcttgtctgcatgtaacacatgtgttttctaatattaagatgggggtgagattcgtgtcattcgaacataggggacaagacacccagttctgggccgggcactacggtgccagggtaactaactcctctgtgatagtacgggttcgcctctcttag

SEQ ID NO: 187615 - DNA, 1107 bp, Artificial Sequence
  Description of Artificial Sequence: Synthetic coding sequence
atggccgccgccgccgaggagcggatggccgaggagggcggcggcgggcagggcgatggcggcagctccctggccagtggttcaacccagcgccagccacccccacctgcaccccaacaccctcagcctgggagtcaggcccttcctgccccagccctggctcctgaccagctgccccaaaataacactttggttgccctgcctattgtcgctatcgaaaacatattgtccttcatgtcttatgatgaaataagccagctgaggctggtgtgcaagagaatggatctggtgtgccaaaggatgctcaaccagggatttcttaaggtggaacggtaccacaacctttgtcagaagcaggttaaagcacagctccctcggcgcgaatccgagagacgaaaccactcactcgctcggcacgctgacatcctggcagcggtcgagactcgcctgtctctgttgaatatgaccttcatgaagtacgttgatagtaatctgtgttgttttattccagggaaggttatcgatgaaatttatcgggtgctacggtatgtcaattccacacgagctccccagcgtgcccatgaagtgttgcaggagctcagggatataagctctatggcaatggagtactttgacgaaaagattgttccaattctcaaacgtaaactgcctgggtccgatgtttctgggcgtttgatggggagtccacctgtgcctgggccaagtgccgcccttaccacaatgcagctattcagcaagcagaatcctagtcgccaggaagtgactaagctgcaacagcaagtgaaaactaatggcgccggcgtcacggttctgcgccgggagatcagcgagttacgcacgaaggtgcaggagcagcagaagcaactacaggaccaggatcagaagctgctggagcagacacagatcataggcgagcagaacgcacgattggccgagttagaaaggaaactgagggaagtcatggagtctgccgtgggcaatagctcagggtctggtcaaaatgaggaatcaccgaggaagagaaaaaaggcaactgaagcaatcgacagtctgcgcaagagcaagagactccgtaatcggaagtag

SEQ ID NO: 187616 - DNA, 540 bp, Artificial Sequence
  Description of Artificial Sequence: Synthetic coding sequence
atggccgccgccgccgaggagcggatggccgaggagggcggcggcgggcaaggggatggagggagttccctcgcctccggctcaacccagcgacaaccacccccgcccgcccctcaacatccccagcccgggtcgcaggctctgccggctccggcgttagcacccgatcaattgccgcaaaataatactctggtggctcttcctatagtggcaatcgagaatattctctcctttatgagctacgatgaaatctcccagctgaggttggtatgcaaaagaatggacctcgtctgccagcgaatgctcaatcagggttttcttaaagttgaaaggtaccacaatctttgtcagaagcaagtcaaagcccagttgccacggagagaatcagagcgacgcaaccactcactcgcccggcatgcggatatcctggcagctgtggaaacccgtctgtccctcctgaatatgactttcatgaagtatgttgattctaacttgtgttgcttcatccccggcaagttccaagatcgtctccagccttag

SEQ ID NO: 187617 - DNA, 1416 bp, Artificial Sequence
  Description of Artificial Sequence: Synthetic coding sequence
atggccgccatggagaccgagaccgcccccctgaccctggagagcctgcctacagatccactgcttctgatactgtccttcttggattatagagatctgatcaactgttgttacgtgagtagacgcctgtctcagctctcctcccacgatcccctatggaggcgacattgtaagaaatattggttgatttccgaggaagagaaaacccagaagaatcagtgctggaaatccctcttcatcgatacatacagcgatgtcggcagatatatcgaccactatgccgccatcaagaaggcctgggacgatcttaagaaatatctggagcctcggtgtcctcgcatggttctcagtctgaaagagggagcacgagaggaagacctagatgctgtagaagcccagatagggtgcaagctgcctgatgactatcggtgctcataccgcatccataatggacagaagctggttgttcctggattgcttgggagcatggcactcagcaaccactatcgcagcgaagacttacttgatgtggatacagccgccgggggcttccagcagcgccagggcctgaaatactgtcttcccttaaccttctgtatccacaccggactatcccagtacattgctgtggaggcggctgaaggcagaaacaagaacgaggtgttctaccagtgccctgaccagatggcccggaatccagctgcgattgatatgtttatcattggagccaccttcaccgattggttcacgagctatgtcaaaaatgtggttagtggcggctttccaattatccgggatcagattttccgatatgtgcacgacccagaatgcgtcgctacaaccggcgatatcactgtcagcgtgtccacctccttcctgccagagctcagtagtgttcacccacctcattacttcttcacatatcgaattcgcattgagatgagcaaagacgctctgcctgagaaggcctgccagctggacagccgttactggagaattacaaacgcgaagggagacgtggaagaagttcagggccctggggttgtgggggagttccccattatctcaccaggccgcgtctacgagtataccagttgcaccactttctcgacaacttccggctatatggaaggttattacacatttcactttctttatttcaaagacaagatcttcaacgtagctattcctagattccatatggcttgccctacatttagagttagtattgcccggctcgaaatgggccccgacgaatacgaggaaatggaggaagaagaggaggaggaagaagaggaggacgaggacgatgacagtgccgatatggatgaatctgatgaagacgacgaagaggaacgccgcagacgcgtgtttgatgttcctattcggcgtagacggtgttctcgtcttttctag

SEQ ID NO: 187618 - DNA, 519 bp, Artificial Sequence
  Description of Artificial Sequence: Synthetic coding sequence
atggagaccgagaccgcccccctgaccctggagagcctgcccaccgaccccctgcttctcattttatcatttctggactaccgggatctgatcaactgctgttatgtgagccggaggctctcacagctttcatcacatgacccactgtggcgccggcattgcaaaaaatattggttgatttctgaggaggagaaaacccagaagaaccaatgctggaaaagtctgttcatcgacacttactcggacgtgggccgttacattgaccactatgctgctataaagaaggccggcatgatatcaagaaacatctggagccctggcgtcctcggctggttcgtgtccattaaccgaggttgctccaggggtcggccaagatgctgcggaagcgcagattggtgcaaattacctgatgactatcgatgcagttaccggatccataacggtcaaaaactggtggtccccgggagctactgggaggcatggcattgcctgatcaccattgtgctgaagatatgttag

SEQ ID NO: 187619 - DNA, 1248 bp, Artificial Sequence
  Description of Artificial Sequence: Synthetic coding sequence
atggccgccatggagaccgagaccgcccccctgaccctggagagcctgccaaccgaccctttactgctcattcttagtttcctcgattacagggatctgataaattgctgttacgtgagccggagacttagccagttgtctagtcacgacccgctttggcgcagacactgtaaaaaatattggttaatctccgaggaggagaagacacagaaaaatcaatgttggaagtcacttttcatcgatacgtacagcgacgttgggagatatatcgatcactatgccgccatcaagaaagcttgggatgatctaaagaaatatcttgaacctcggtgcccacgcatggtcctatcgttgaaggagggcgctcgagaagaggacctggatgctgtggaagcacagatcgggtgcaagttacccgatgattaccggtgctcttatcgcatacacaatggccagaaactcgtcgtgcccgggttgctcgggtctatggctctgtcgaaccactacagatcggaggacctgctagacgtggatacagctgcggggggtttccagcaacgccagggcctaaagtactgtctaccactgaccttttgcatacacactggtttaagtcagtatattgccgtggaggcggcagagggccgaaataaaaacgaagttttttatcagtgcccagatcagatggcgcgtaaccctgctgccatcgatatgtttattattggcgcaactttcaccgactggttcacctcctatgttaaaaatgtggtgagcggcggctttcccataattcgggaccaaatatttcgttacgtgcacgacccggagtgcgtcgcgaccactggtgacattacggtcagcgtgagcaccagcttcctcccggagctcagctcggtacatcctccacactacttttttacctacaggattaggatcgaaatgagcaaagatgccctgccagaaaaggcctgtcagctggacagcagatattggcgcatcaccaatgccaagggggatgtggaggaagtacaggggcctggtgtggtgggcgagtttcccattataagtcctggccgggtgtacgaatacacctcatgcacaacgttctccacaacttcaggatacatggaggggtattatacctttcactttttgtacttcaaggataagatcttcaacgtggccattccccgttttcatatggcttgccccacctttagagtttcaatagcacggctggtttcctag

SEQ ID NO: 187620 - DNA, 2238 bp, Artificial Sequence
  Description of Artificial Sequence: Synthetic coding sequence
atggaggaggagctgcagcacagccactgcgtgaactgcgtgagccggcgctgtatgacaaggcctgagccagggatatcctgcgatctcatcggctgccctctggtctgtggcgccgtcttccatagctgtaaggctgacgagcaccgcctcctgtgtccatttgaacgggttccctgtctcaatagcgatttcggttgtcccttcactatggccagaaataaagtggccgagcatctagagatgtgccctgcttctgttgtttgttgtaccatggaatggaacaggtggccggtttcttatgcagatcgcaaaagctacgaaaacctctcaagggacgtggacgaggttgcccagctagatatggctctggcactgcaggatcagcgtatgctactagaaagcctaaaggtcgccacaatgatgagcaaggcaacagacaaggtttccaagccccgcgaacagataagcgttaaatccagtgtgcccgagataccgcacgccaatgggctcgtgagtgtcgatgaggaatcctacggggctttgtatcaagcgacagtcgaaactacacggtcactggcagccgctctcgacatactaaacaccgcaaccagagacataggaatgttaaatacatccgttcctaacgacatggatgaacagcagaatgcacgagaatctcttgaagaccagaacttgaaagaccaggaccatctctacgaggaggaaattggagcagtgggcggaatagactacaatgatacgaaccagaatgcgcaaagcgaacaaaatggaagtagcgacctgctgtgtgatctgaatacgtcctcttacgacaccagcgctctgtgcaacggttttcctttggaaaatatctgcacccaagtgattgaccagaaccagaatcttcatggggattctaagcagtcgaatctgacaaacggggattgcgtggcctcgagcgatgggacctccaagccctccagctccctagccgtggctgcgcagttgcgtgaaattatcccttcgtctgcattaccgaacgggacggtgcagcatattctgatgccagacgatgaaggcgaaggtgagctgtgttggaagaaagtagatctgggagacgtcaagaacgtggacgtactgtcatttagtcacgcaccaagctttaatttcttgtcaaactcatgttggtctaagccgaaggaagataaagccgtggacacctctgacctcgaggtggcggaggatcccatgggacttcagggaatcgatcttattacagccgctttacttttctgcctgggcgacagccctggtggtcggggaatatccgacagtcggatggcagatatataccacattgatgtgggaacacaaactttttctttgccaagtgctattctcgctacatcaactatggttggtgagattgctagtgcatccgcgtgcgaccatgccaacccacagctctcaaacccgtcgccgtttcagacactggggctggaccttgttctggagtgcgttgcccggtatcagcctaagcagaggtccatgttcacgtttgtgtgcggtcagctgttcaggcgcaaggagttctcgagtcacttcaagaatgtgcacggggatatacacgcaggacttaatggatggatggaacagcggtgcccactcgcttattatggctgtacatacagtcagaggcgcttttgtcccagcattcagggggccaagataatccacgaccgtcatctgagatccttcggcgttcagccctgcgtgtccactgtgttggtcgagcctgccagaaactgcgttctgggcctccacaacgatcatttgtcatctttgccttttgaggtgctccagcacattgcgggctttctggatggattttctctgtgtcagctgagctgcgtgtcaaaattgatgcgggacgtttgtggttcactgctgcagagtagggggatggtgatcctgcagtggggaaagagaaagtaccccgagggaaatagtagctggcagatcaaggagaaagtctggagattctccacagccttttgcagtgtgaatgagtggaaatttgccgacattctgtccatggccgaccacctaaagaagtgctcttataacgtggtggaaaagagagaggaggctatcccactgccctgcatgtgtgtgactagagagctgaccaaggagggaagaagcctgcgctccgtgcttaagcctgttctttag

SEQ ID NO: 187621 - DNA, 1620 bp, Artificial Sequence
  Description of Artificial Sequence: Synthetic coding sequence
atggccgtgtgcgcccggctgtgcggcgtgggccccagccggggctgccgtaggaggcagcaacgcagaggacccgccgagaccgccgccgccgatagtgaacctgacacagacccagaggaggagagaattgaggcatctgctggagtcggtggaggtctgtgtgcgggaccaagccccccccctcctcggtgcagtcttctggagcttcccccagagctccttgtagagattttcgcctccttaccaggaacagatttgccttccttagcccaggtgtgcactaaatttagaaggatccttcacactgatacaatttggagaagaagatgtagggaagaatacggagtgtgtgaaaacctgcgcaagctggagattaccggagtatcttgtcgtgatgtttatgcgaaactgctgcacaggtatcgccacatcttaggactgtggcaacccgacatcgggccctatggaggcctgctgaatgtggtagttgatggcctctttatcattggctggatgtatttgcccccacacgaccctcatgttgacgaccctatgcggttcaagcccctgttccgtatccacctcatggaacggaaagcagccaccgtggaatgcatgtatggacataagggcccacaccatggccacattcaaatcgttaagaaagatgagtttagtactaagtgtaatcagactgaccatcaccgcatgtccggcggcaggcaggaagagtttcggacctggctacgagaggagtggggcaggacgttagaggacatattccacgagcacatgcaggaactcattctcatgaagtttatttacacttcccagtatgataattgtttgacttacaggaggatatacttgcctccaagcaggcctgacgatctgattaagccaggattgtttaaaggcacttacgggtcacacgggctcgaaattgtcatgctgtccttccacggtaggcgcgccaggggaactaaaataaccggcgatcccaatattcccgctggccaacagactgtggagatcgacttacggcatcggatccagctgccagacctcgaaaatcagagaaactttaatgagttgtctcgcattgtccttgaagtcagagagcgcgtgcggcaggagcagcaggagggaggacacgaggccggggaaggccgcgggaggcagggcccccgcgagagccagccatcccccgcccaacctcgggccgaggcaccatcaaaaggaccagatggtaccccaggcgaagacggcggagagccgggagacgcagtcgcagccgctgagcagcctgctcaatgcgggcagggccagccctttgttctgccagtcggggtgtcctcacggaatgaggattacccacgaacttgtcggatgtgtttttatggcaccggactgatcgctggtcatgggttcacatctcccgagcgcacccctggcgtctttatcctgttcgacgaggatagattcggtttcgtctggttagagcttaagtctttttcactatacagtcgcgtgcaggcgactttcagaaatgccgatgctcccagcccacaggctttcgacgagatgctcaagaacatccagtcattgacatcctag

SEQ ID NO: 187622 - DNA, 1068 bp, Artificial Sequence
  Description of Artificial Sequence: Synthetic coding sequence
atgcccttcctgggccaggactggcggagccccggccagaactgggtgaagactgcagatgggtggaagcgttttctggacgagaagagcgggagctttgtgagcgacctcagctcgtactgtaataaggaagtttataacaaagagaaccttttcaactctctgaattacgatgtcgctgcgaaaaagaggaagaaagatatgctcaatagtaagacaaagacacagtacttccatcaggaaaaatggatctacgtgcataagggttccacaaaagaaagacacgggtactgtaccctcggcgaagcttttaataggctggacttcagcacagcgatcctcgatagccgccgatttaactacgtggttaggcttttggaactcatcgctaagagccaactgacctccctttcaggcatcgcacagaagaatttcatgaacattcttgagaaagtggtgttgaaagtactagaagatcagcagaacattaggttaatccgtgagcttctgcagacgctgtacacaagcttatgtacccttgtgcagcgcgtcgggaagtcagttctcgtgggcaacatcaatatgtgggtgtacagaatggaaacaatcctccactggcagcagcaactaaacaatatccagattacacgacccgcctttaagggtcttacattcacagacttacccttatgcctccagctgaatataatgcaaaggctgtctgatggacgagatctggtttcgttgggccaggccgctcccgatttgcacgtgctttcggaggaccgcttattatggaagaaactgtgccagtaccacttttccgagcgccagattaggaagcgtcttatcttaagcgacaagggccagctggattggaaaaagatgtacttcaagctcgtgcgttgctatcctaggaaggaacagtacggcgataccctgcaactgtgcaaacactgtcacatcttatcatggaagggaactgaccatccttgcacagcaaacaacccagagagttgctcggtttccctgtcaccgcaggattttatcaacctcttcaaattctag

SEQ ID NO: 187623 - DNA, 789 bp, Artificial Sequence
  Description of Artificial Sequence: Synthetic coding sequence
atgcccttcctgggccaggactggcggagccccggccagaactgggtgaaaaccgccgacgggtggaaacgatttctggatgagaagtctggctcatttgtgagcgacttgtccagctactgcaataaggaggtgtacaataaggagaatctcttcaattcacttaattatgacgtggccgctaagaaaaggaaaaaagatatgctaaactccaaaacaaaaacccagtatttccaccaggaaaaatggatctacgttcacaaagggagtaccaaagaacgccatggttactgtaccctcggcgaggcatttaataggctcgacttttctacagcaattctcgacagtaggaggtttaactatgtagtgagaccggcgtttaagggccttaccttcacagatcttccactgtgcctccagctgaacatcatgcagagactctctgacggacgggacctggtctccctgggacaagcagcgccagatctgcatgttttgtcagaggatagactgctgtggaaaaaactctgccaatatcatttttcagagaggcagattcgcaagcgcctcatcctctcagacaaaggacagctagattggaaaaagatgtacttcaaactcgtcagatgttatccgaggaaggagcagtatggggatacattacagctgtgtaagcactgtcacattctgtcttggaaagggactgaccatccttgcacagccaataatcccgagagttgttcagtttctctgtcgcctcaagattttataaacctatttaaattttag

SEQ ID NO: 187624 - DNA, 1668 bp, Artificial Sequence
  Description of Artificial Sequence: Synthetic coding sequence
atgctgctgttcctgagcgtgccccagccccggccccccggcgccaggacacgagctggagcagcccgcgtagctcggtggcgacggctgaggctccagcagcttcgcaggctacgcggattgctgcgcgtgcttcgcgggcgcccaggggctgggtccaggaggcggggtcggatggcactctgtggtcaggccgccggtgctgcttcactcccctctgaactgatcgtgcatatcttctctttcctgccagcaccagacaggttgagagcttctgcgtcctgttctcattggagggaatgtctcttttatcctgccctgtggcctcagctgcgcatctgcctcagggtgtctccggcagaacagccccgacttgagttcctaatgcgaaaatgcggctggttcgtccgggaattgcgggttgagtttgcggccgagaattacctctccggagggggtcctggtgatggaggaggtgcagatacaggtacgggcggagaggaggtggaggcccttcagctgtcggcccggtggttggaggtgctccgcacttatttagaactcgtgttgtgcgtgctcgtcagcattcgcaacaatcgcaacctgcagaagttttctctgttcggagatatttctgtgctgcagcagcagggaagccttagtaacacatatctatccaaagtcgatcccgacggaaagaagataaaacaaatacagcagctgtttgaggagattctgtccaatagccgacagctgaaatggctttcgtgtggattcatgctggagatcgtgacgcccacatccctgtcgtccctttcaaacgccgtggctaatactatggagcaccttagtctcctcgataacaacatacctggcaacagtacgctaatcacagccgttgagcttgagagattcgtcaacctccactcactggccttagacttttgcgacttcactgcggagatggcgcgggtgctcacagacagcaaccacgttccattgcagcggctctcactgcttgtccataatgtcagcgtaatgcacaagagcctggataatatgcctaatgacgagcattggaaggccctctctcgtaaatcaacaagtttcagagtgtacattatggcctttgacataaagagcgaggacatgctcaaaatcttaaagcccagtatccccttagagcgcatacatttcgattcctacattacctgcgtgagcggggccatagtggacctgatctcgagacagtatgacaaattcctcacgcactttatcctcatgaatgatgtgatcgatacaagtggattcccagacctcagtgataatcggaacgaagatccactggtccttctggcatggaggtgcaccaaacttagcctcctagctatccatggctataccgtttgggcgcacaatctgatcgccattgcccgactacggggcagcgatctcaaagtgttggaagtgaccgaggagtcaatcgatttcgatcagggggaactcgcggatcaggatgtggacccggttcacaacctgattgaacaagtatcactggggttgggccagccatggcatgcagtgatggacattgagtcactgtccgtgtttacagagccaaacagacacttttatcgggagatgcagtcttttagcgaggatatctag

SEQ ID NO: 187625 - DNA, 9 bp, Artificial Sequence
  Description of Artificial Sequence: Synthetic coding sequence
atgcggtag

SEQ ID NO: 187626 - DNA, 2136 bp, Artificial Sequence
  Description of Artificial Sequence: Synthetic coding sequence
atgcacctgaagccctactggaagctgcagaagaaggagcaccccccagaagtctccagggagacccagcgcacccccatgaaccaccagaaggctgtgaatgatgagacctgcaaagccagccacatcaccagttccgtttttccaagcgcctctctcggaaaggcatctagcagaaaacctttcggtatcctgtcccctaatgtgctgtgttctatgtccgggaaatcaccagtggagagctccttgaacgtgaagacaaagaagaatgctccctctgctaccattcatcaaggcgaggaagagggtcccctggatatctgggccgtggtgaaaccgggcaacacgaaggaaaagattgctttctttgcttctcaccagtgttccaaccgcatcggttcaatgaaaataaagagctcgtgggacattgatggaagagctactaaacggagaaaaaaaagcggggacctcaagaaggctaaggtgcaagtcgagcgtatgagggaggttaactcccggtgttatcagcctgaaccatttgcctgtggcatcgagcactgtagcgtgcactacgtgtctgacagtggggacggggtgtacgccgggcgccccttgagtgttatccagatggttgcatttctcgagcagagagcttccgccttactggctagttgttcaaagaactgtacgaacagcccagctatcgtaaggttcagtgggcagtcccgtggggtaccagcagtcagcgagtcatactcagcccccggcgcttgcgaagaacctaccgagagaggcaatctcgaggtaggcgagccacaatcggaaccagtcagggtactggacatggtcgcaaaattagagtccgagtgcctgaagcggcagggccagagagaacctgggagcctgtcacggaacaactccttccgacgtaacgtcggaagggttctgttagcaaattctactcaggcagacgagggcaaaactaagaaaggtgtcctcgaggcacctgacacccaggttaatcctgttgggtccgtgtccgtcgactgtggcccgtctcgagctgatcgctgcagtccaaaggaggaccaggcatgggacggcgcgagccaggactgtccacccctgccagctggtgtgtcgtttcatatcgattctgccgagctcgagcctggcagtcagaccgcggtgaaaaatagcaatagatacgacgtggagatgacagacgaactcgtgggactgccattctcctcccacacttacagtcaagcttcagaactcccgacagacgcagtggactgtatgtcacgagaattggtgagtttgacttctagaaatcctgaccagcgcaaagaatctctttgcatttccattaccgtatctaaagtagacaaggaccagccttcgattctcaattcttgcgaagatcccgtgcctggtatgttgtttttcctgccgcccggacagcacctgtcggattactcccagctgaacgagtctaccacgaaagagagtagcgaagcaagtcagctggaggatgcagctggaggtgattctgcctctgaggaaaaaagcggttccgcggagcctttcgtgcttcctgcatcctccgtggagagcacactcccagtgctggaggcgtccagttggaaaaaacaggtgagccatgatttcctagagactaggttcaaaatccagcagttactcgaacctcagcaatatatggcttttctcccccaccatataatggttaaaatcttcaggctgctccctaccaagtcccttgtggcgttaaagtgcacttgctgttatttcaagtttatcatcgagtattataatattcgcccagccgattcgcgctgggtgagggatccgaggtatcgagaagatccttgcaaacaatgtaagaaaaaatatgtgaagggggatgtgtcactctgcagatggcatccgaagccgtactgtcaagccttaccctatgggcctggttactggatgtgttgtcaccggagtcagaaaggtttcccgggctgcaaactggggctgcacgacaaccattgggttcccgcgtgtcacagtttcaatagagccatccacaaaaaggccaaggggactgaggcagaggaagaatattag

SEQ ID NO: 187627 - DNA, 2136 bp, Artificial Sequence
  Description of Artificial Sequence: Synthetic coding sequence
atgcacctgaagccctactggaagctgcagaagaaggagcaccccccagaagtctctcgtgagacccaacgcacacccatgaatcatcagaaggccgtgaacgatgaaacatgtaaggcgtcccacattacctcatcagttttccccagcgcttcacttgggaaagcgagctcacgcaagccgtttgggatcctctctcctaacgtgctctgctcaatgtcagggaaatctcctgtcgagtcctccctcaacgtgaagactaagaaaaatgcaccttcagctactatccatcagggggaggaggaagggccactggacatttgggctgtcgtgaagcctgggaatacgaaggaaaagattgctttcttcgcctcccaccagtgtagcaacaggataggctctatgaaaattaagtctagttgggacatagatggaagagctacgaaacgcagaaagaagagcggagatcttaagaaggcgaaggttcaggttgagagaatgagagaggtcaacagccggtgttatcagcctgagcctttcgcatgtggaattgagcactgctctgttcattacgtgagtgactcaggtgatggggtctacgccggccggcccctctcagtcattcaaatggttgcattcttggaacaacgggcctcagcattgctcgcatcctgctcaaagaactgcaccaattctcctgcaattgtcagatttagtggccaatctcgcggggtgcccgccgtctccgagtcctactccgctcccggagcatgcgaagaaccaaccgaacgcggcaatctggaagtgggcgagccacaaagcgagcccgtgcgggtattggatatggttgcaaagttggaaagcgaatgcctgaagcgtcagggccaaagggagccaggcagtctttctcgcaacaattcctttaggcggaacgttgggcgtgtgttgttggctaattctacgcaagccgatgagggcaagaccaaaaagggggttttggaggccccagatacccaggttaaccccgtgggcagtgtcagtgtagactgcggccctagcagagcagaccgctgtagccctaaggaggaccaagcttgggacggcgccagtcaggactgtcctcctctccctgccggcgtctctttccatatcgatagcgcggagctagagcccggatctcagaccgctgtgaagaacagcaacaggtatgatgtcgagatgaccgatgagctcgtaggattgccgttttccagccacacatactcgcaggcctcagagctgcccacagacgctgtggactgtatgtctcgggaactagtctctctgacctcccgaaacccggaccaacgaaaggaatctctctgcatttccatcaccgtttccaaggtggataaggatcaacccagcatcttgaacagctgcgaggatccagttcccgggatgctgtttttcctacccccgggccagcacctgtctgactattcccagctgaatgaatccactaccaaggaaagcagtgaagccagccagctagaagacgccgcaggtggcgactccgcttctgaggagaaatctggcagcgctgagcctttcgtgctaccagcaagctccgtggagtctacactcccggtgctcgaagcctccagctggaaaaaacaggtaagtcatgacttcctagagacacgcttcaaaatccaacaattgttggagcctcagcaatatatggccttcctgcctcaccacatcatggtgaagatttttagactgttgccgacaaagtcactcgttgcgcttaagtgtacctgctgttacttcaaattcattattgaatattacaatatcagaccagcagattcccgttgggttcgtgatcccagatacagggaggatccttgtaaacagtgcaaaaaaaaatacgtgaaaggagacgtctcactgtgcagatggcaccctaaaccctattgtcaggcgcttccgtatggtcccggttattggatgtgctgccacaggagccagaaagggttccctggctgtaaactggggctgcatgataaccactgggtgcctgcctgccatagttttaacagggcaattcacaaaaaggctaagggaaccgaagcagaggaagagtactag

SEQ ID NO: 187628 - DNA, 567 bp, Artificial Sequence
  Description of Artificial Sequence: Synthetic coding sequence
atggccagctggctgcccgagaccctgttcgagaccgtgggccaggggccacctcctagtaaggattactaccagctgttggtgactaggagccaagtgatcttccgatggtggaagatctccctccgctcagagtaccggtccacaaaaccaggagaggcaaaggagacgcacgaagacttcctcgaaaatagtcacttacaggggcagaccgcgctgattttcggtgctcgcatcctagattatgtcattaacttatgtaagggtaagttcgatttcttagaacgactgagtgacgacttgctcttgaccatcatctcttatctcgatttggaggatatcgctcgactgtgtcaaactagccacagatttgcgaagctttgcatgtcggataaattatgggagcagattgtacaaagcacctgtgacacaataacccctgatgtcagggcattggctgaggacactggctggcgccaactttttttcacaaacaaattgcaactgcagaggcagttgcgtaagcgtaagcagaaatatggaaacctccgcgaaaaacagccttag

SEQ ID NO: 187629 - DNA, 2832 bp, Artificial Sequence
  Description of Artificial Sequence: Synthetic coding sequence
atgggcccccggaagaagagcgtgaagacctgcatcatgaacaacgaaattcccgaggaaatgactgcagacgaaacaaaagactacatgaaccaactgtcgcacgaggtgctgtgtcatatcttcagatacctgcccctacaggatatcatgtgtatggaatgtctgtcacgcaaactgaaagaggctgtgactctctatttgcgcgtagtgcgcgtggtggacctgtgtgccggacggtggtgggagtacatgccttcaggctttaccgatgccagctttctgactttgctcaaaaagatgcctgatgttgagcagttatatggtctgcacccgcgctacttggagcgtcggagagtgaggggacacgaggccttttctatccccggagtacttgaagcccttcaagcctgtcccaatctagtgggagtagagacgtcccacctcgagctggtggagtcgatctggacatacatgcctcacgtacatatacttggtaaatttaggaacaggaacggcgctttccccattccccctgagaacaaactcaagatcccgattggcgcaaagattcagacactccaccttgtgggcgtgaacgtccccgagattccatgcatacccatgctccgccatctgtacatgaaatgggttcgcctgactaagcctcagccatttaaagactttctgtgtatttcactgcgaacatttgtgatgcggaactgtgcaggccccacaaactcactcaagtacgtccctctcgtgactggcctggcctcggcacgtaaccttgagcatctggaaatggttcgtgtgccgtttttgggcggtctgatccaacacgttgtcgaggactcatggaggagtggaggcttcagaaacctccacaccatcgtactgggagcttgcaaaaatgccctggaagtggacttgggatatctcataatcaccgctgccagacggctccatgaggtgagaatacagccatctctgactaaggacggggtgttttcggctcttaagatggccgagttggagttcccacagtttgaaaccttacaccttggatatgtggatgaatttcttctgcagtcgcgaatggccaacgcagacctggtcaaatacgggcttgcagatgtcgttgagaacccagggatcatcaccgatattggcatgaaggcagtgaatgaagtgttttcatgcattaaatatcttgccatctacaattgtcctcaccttcataacccttataattggatttccgaccattcaaggtggactcggctggtggacataaatcttgtccgttgtcatgccctcaagcttgactcctttggccagtttatcgagctccttcccagcctggaatttatctctctggaccagatgttccgcgagccacccaagggctgtgctcgagtgggcctttccgccggaacagggataggggtgtcatctgcgctggtttctaaccaaaactcaaataacgacgacaataacgcacagaacaacaacgcaaacatccacgacaacaaccaccatcacccggatgatagcgacgaggagaacgatttccggcaggacctgcagcctggagagcagcagttcgctgcagacgctttaaacgaaatggaagacattgttcaagaggacggagaggtcgtggcagaatctgggaacaatacgcccgcccattcgcaagccattattcctgtggacgtggacgaggagcaggcaggaccatctggactgcagagggtagtaaaaccaaccagtatcactgtgcatgattcagaatctgatgacgaggaagattctcttgaactgcaagaggtatggattcccaagaatggcactcggcggtactcggagcgggaagaaaagactggcgaatctgttcaatctagggaactgagcgaagtggccaagacaaaacctcggcatgcaatgaagaggaagagaaccgcagataaatccacctctacctctgatcctgtgatcgaggatgatcacgtacaggtgcttgttctcaagagcaaaaacctggtaggagttaccatgacaaattgtggcatcaccgacctagtccttaaggactgccccaagatgatgttcatccatgctacaagatgcagggtcctcaaacatctgaaggtggaaaatgcacctatcgttaaccgcttcgactacgcccaatgtaagaaactcaatatggaccaagtgctggaccagatacttcgcatgccgcccgagcggaatcgaatcatctatctgagacccatgcagcaggtagatacactaacactggagcagaagctgttttcagggccctacccctaccacatctgcattatccacgagttcagtaatcctcctaatgttcggaacaaagtccggattcgtagttggatggataccatagccaacataaatcaggaattgataaaatacgaattcttccctgaagcgacgaggagcgaagaagacctgaagaagtaccctaagtacccctggggccgagaaatctatacgttggaaggtgtggtagacggtgccccatacagtatgatctcagatttcccatggttgaggtccctccgtgccgcggaacccaattccttcgccaggtacgactttgaggacgatgaggaatccacgatctacgccccccggaggaagggtcagctgagcgcagacatctgtatggaaaccatcggtgaagaaatcagcgagatgcggcaaatgaaaaagggggtctttcaacgagttgtagccatatttatacattactgcgacgtgaacggcgaacccgttgaggacgactatatatag

SEQ ID NO: 187630 - DNA, 3567 bp, Artificial Sequence
  Description of Artificial Sequence: Synthetic coding sequence
atgggcccccggaagaagagcgtgaagacctgcatcatgaacaacgagattcctgaagaaatgaccgcggatgaaacaaaggattacatgaatcagctgtctcatgaggtgctatgccatatttttcgctacctccctctgcaagacatcatgtgcatggagtgcctgtcaaggaagctgaaggaggctgtgaccctctatctgcgtgtcgtgagggttgtggatctctgtgcagggcgttggtgggagtatatgccttctggctttactgatgcctcctttcttaccctgttaaaaaaaatgcccgacgtggagcaactatacggcctccatccccggtaccttgagcgccgacgggtccgggggcacgaggccttctccatccccggagtgcttgaggcactccaggcatgcccgaaccttgtgggcgttgagacctcacacttagagttggttgagagcatatggacctacatgcctcatgtccatatcctggggaagtttaggaacaggaatggggctttccccatccccccagagaacaagctgaaaatacctataggcgcaaagatccagactcttcatttagtgggagtgaacgttccagaaataccctgtatcccaatgttgagacatctctatatgaaatgggtcagactgacgaagcctcaaccttttaaagatttcctttgcatctctctgaggactttcgtgatgcgaaactgtgcgggcccaacaaactctttgaaatacgtcccactcgtgactggcttagctagtgccagaaacttagaacacctcgaaatggtgcgtgtaccatttctgggcggtcttattcagcacgtggtggaggattcttggcgtagcggcggcttcaggaatcttcatacaatcgttctgggagcctgcaaaaacgctctagaggtcgatcttggttacttgatcattaccgccgcccgtcgcttacatgaagtgcggatccagccaagcctcaccaaagacggcgtgttttctgcattgaagatggccgagcttgaatttccacagtttgagaccttgcatctgggttacgtggacgagttcttgttgcagagtcgaatggctaatgccgacctggtgaagtacggactcgccgatgtggtggagaatccaggaatcataacagacatcgggatgaaagcagttaatgaagtgttcagctgcataaagtacctggctatttataattgcccccacctccacaacccgtacaactggattagtgatcacagtaggtggactcggttggttgatataaatttggttaggtgtcatgccttgaaacttgatagctttggccagttcatcgagcttctaccctcgctggagttcatctccctggaccagatgtttcgcgaacctcccaaggggtgtgcgagagtggggctctctgcgggaaccggtattggagtcagctccgcattggtgtctaatcagaatagcaacaatgacgacaataacgcgcagaacaataatgccaacattcacgacaataaccaccatcaccccgacgatagtgacgaagagaacgatttccggcaggatctacagccaggagaacagcaatttgcagcagacgccctgaacgagatggaggatattgtccaagaggatggggaggtggtggcggagtcagggaacaatactccagcacatagccaggccataatccctgttgatgtggacgaagaacaggccggtccctctggcctgcagcgggtggtgaagccgacatccattaccgtgcacgacagcgaaagtgatgacgaggaggacagtctggaactgcaggaagtgtggattccaaaaaatggaaccaggagatacagcgagcgggaggagaagacgggtgaatccgtccagagtcgggagcttagcgtttcaggcaagggaaaaacaccccttcggaaacgctataacagtcatcagatggggcagagtaaacaatttcctttggaagaatcaagctgtgagaaggggtgtcaggttacttctgaacaaattaaggccgatatgaaagcagcccgcgacattcccgaaaagaagaagaacaaggacgtatatccctcctgctcatccactacagccagcaccgtcggcaattcctcttcacataacacagcctctcaatccccagattttgttcggacagtgaatagtggtggtagcagcgagccaagccccacagaggtggatgtctctcgtcaatgtgcgtgctctccagggggatccgaggattctgaggccatggaagaaggagacgctgagtccagcgtgtgtccgcgctgctgttgccatagaccgcaagagtcacaacgtcgaacctcgcggtgttcagacgaagagaggccatcaacttcgagggcatgtgtagtaaacgggccagacgggaccagatccgccttcagttttcgaacgcttccacagggcggcagtagcgggccagcgcacgatgagaggaccaatggaagcggttccggtgctaccggcgaggatcgccgcggctcttcacagcctgagagttgcgacgttcagagtaatgaggattatccgcggagaccactgacccgggcaaggtctagactgtctcacgtactgctggtgagtgagagcgaagtagctaaaacaaagccccgacatgcaatgaagaggaagaggaccgcagataaaagtacaagcacatctgatccggtgatcgaggatgatcatgtccaagttcttgtattgaagtcaaaaaatttggttggggtcaccatgactaattgtgggatcactgacctggtcctcaaggactgccccaagatgatgtttattcacgctacaaggtgtcgagtacttaaacacctgaaagtagaaaacgctcccattgtgaatagattcgactatgcccagtgcaaaaagcttaacatggaccaggtgttggatcaaattctgcgcatgcctcctgagaggaatcggataatctacctgcggcctatgcagcaggtggatactctgaccctggaacagaaactcttttctggcccctatccataccacatctgcatcatacatgagtttagtaacccacccaatgtcagaaacaaagtcagaataaggtcctggatggacaccatcgccaatattaaccaggagctgatcaagtatgagttctttcccgaggcaacccgttcagaagaggacctgaagaagtacccaaagtatccgtggggtagggaaatttacaccctggaaggagtcgttgacggcgccccatactcgatgatctcagactttccttggctgagaagcctcagagcagccgagcctaatagctttgctcggtacgattttgaagacgacgaggaatcaaccatttacgcccctaggagaaagggccagctatcagcagatatctgtatggaaactattggagaagagatatccgagatgcgccagatgaaaaaaggcgtgttccagcgcgtagtggccatattcatccactattgtgatgtcaatggtgaacccgtggaagacgactacatctag

SEQ ID NO: 187631 - DNA, 3342 bp, Artificial Sequence
  Description of Artificial Sequence: Synthetic coding sequence
atgggcccccggaagaagagcgtgaagacctgcatcatgaacaacgagattcccgaggaaatgactgcagatgaaaccaaagactatatgaatcagctctcccatgaggtcttgtgtcacatctttcgctacctgcccctgcaagacataatgtgcatggaatgtttgagtaggaagttgaaggaagccgtaactctgtacctcagggtcgtgcgtgtggtcgatctgtgcgccggtcgctggtgggaatacatgccttccggtttcacggatgcctcctttcttacccttcttaagaaaatgcctgacgtcgagcaactgtacggtcttcacccccggtatctcgagagaaggagggtcagaggacacgaagcctttagcatccctggtgtcctagaggccctgcaggcttgccctaacttggtgggcgtggagacgagtcacttagagctggtcgaaagcatttggacttacatgccccacgttcatatcctcggaaagtttcgtaaccggaatggcgcttttcccatccctcctgagaataaacttaagatcccaattggcgcaaagattcaaacactgcacctcgtcggcgtgaatgtgcccgagattccttgtatcccgatgttgcgacacctgtacatgaaatgggtgagattaacaaaacctcagccatttaaagatttcttgtgtattagtctgagaacttttgtgatgcgaaattgcgccgggccaaccaatagtcttaagtacgtacctctcgtcactgggttggctagcgccagaaacctggagcaccttgagatggtgagagtgccctttctggggggactcatccagcacgtggtcgaagattcatggcgtagcggcgggttcaggaacctgcatacaatcgttcttggagcatgtaagaatgccctggaggtggatttaggctatctcattatcaccgctgctcggcgtctacacgaagtcagaatccaaccaagcttaaccaaggacggtgtcttttcagccttgaagatggcagagctggagttcccgcagttcgagacccttcacctgggatacgtggacgaattcctacttcagtccagaatggcaaacgcggaccttgtgaagtacggcttggcagatgtggttgaaaaccctgggatcattactgatataggtatgaaggctgtgaatgaagtgttctcctgtattaagtacctggcgatctacaattgtccccatttgcataacccgtataattggatctcagaccacagtcgttggaccaggctggttgatatcaatctcgttcgttgccatgccctgaaactggactcatttggacaatttatagagctgctccctagcctggaattcatctcacttgaccagatgtttcgggaacctcccaagggatgcgctcgcgttggattgtctgcaggtacaggcattggcgtgtcatcagcgcttgtgagcaaccagaattccaataacgatgacaacaacgcgcagaacaataatgcaaacatccatgacaataatcatcaccaccctgacgatagcgacgaggagaacgattttagacaggacttgcagccaggggaacagcagttcgccgcagacgctttgaatgagatggaggacatagtgcaggaggatggcgaggtggtggctgaatccggcaataacaccccagctcactctcaagcaatcataccagttgacgtcgatgaagagcaggccggcccgagcggtctacagcgggtggtgaagccaacttcgattacagtgcatgactcggaaagcgacgacgaagaagattccctggagctccaagaggtgtggattcctaagaacggcactagaaggtacagcgagagagaggagaaaactggggaatcagtccagagcagagagttgagcgtctccggcaaggggaagacccccttaaggaaaaggtataactcacaccaaatggggcagtccaaacagtttccgctggaggagtcctcctgtgagaaaggttgccaagtcacgtccgaacagattaaggctgatatgaaagctgctagggacattccagagaagaaaaaaaacaaggatgtctacccatcatgtagcagcacaactgctagtacggtgggaaactcatcctcccataacacagcctcacagtctcccgactttgtccgcacagtaaattcggggggctcatccgagccaagccccactgaggtcgatgtgtccagacagtgcgcctgttcccccggcggaagcgaggatagtgaggcaatggaggaaggagacgcagagtcctctgtttgtcccaggtgctgctgtcaccgccctcaggagtcccagcgccggacctcgcggtgttccgatgaggaaaggccgagtacatccagggcatgcgttgtgaatggccctgacgaggtggcaaagactaagccaaggcacgcgatgaagcgaaagcgcacggcagataagagcacatcgacatccgatcccgtgatcgaggatgatcatgttcaagttcttgtcctgaagtccaaaaaccttgtgggtgttacaatgacaaattgtggtataacggatcttgtccttaaagactgtccgaaaatgatgtttatccatgcaacgcggtgccgggtgctcaaacaccttaaagtcgaaaatgcccctattgtcaatagatttgactacgcccaatgcaagaaacttaatatggaccaggtgcttgatcagatattgcgcatgcctcccgagaggaatcgcattatctacttgcggcctatgcagcaggtggatactctgacactcgagcagaagctgttctccggaccgtacccatatcacatctgcatcattcatgagttcagcaatcctcccaatgtccggaataaggtgcgaattagatcctggatggacacaattgccaacataaaccaggaactgatcaaatatgagttctttcctgaagccacccggtccgaagaagacctgaagaagtatcctaaatacccatggggtcgcgagatctatacactggaaggtgtggtggatggcgcgccatactcaatgattagcgattttccatggttaaggtcccttcgagccgcagagccaaactcatttgctcggtacgactttgaggacgatgaggagtcaactatatacgctccaagaaggaagggccaactgagcgcggacatatgcatggagactataggcgaggagatttctgaaatgaggcagatgaagaaaggcgtattccagcgcgtggtggctatttttattcattattgcgacgtgaatggcgagccagtggaggacgactacatctag

SEQ ID NO: 187632 - DNA, 2832 bp, Artificial Sequence
  Description of Artificial Sequence: Synthetic coding sequence
atgggcccccggaagaagagcgtgaagacctgcatcatgaacaacgaaattcccgaagagatgactgcagatgagacaaaggactacatgaaccagttgagccacgaggtcctctgccacatttttagatacttgccgttgcaagatattatgtgcatggagtgtctgtctaggaagctcaaagaggccgtaacactgtaccttagggtggtgcgcgttgtggatttatgcgcaggtcgttggtgggagtacatgcccagcggtttcaccgatgcctcctttctaaccctgctaaaaaagatgcctgatgtggagcagttatacggcctccatccacggtacctcgaaagaagaagagtccggggccacgaggccttttctattccaggcgtgctcgaggccctgcaggcatgtcctaacctggttggggtggagaccagccatctagagctcgtggaatccatttggacctacatgccacacgtgcacatcctcggtaaatttcgcaaccggaatggagctttccctattcccccggagaacaaacttaaaattcccataggggctaaaatacagacacttcatttagtgggagttaacgtcccagaaatcccctgtattcccatgttgcgccacctgtacatgaaatgggttaggcttaccaagccgcagcctttcaaagattttctgtgcattagccttcgcaccttcgttatgcgcaattgcgctgggcctaccaacagcttgaagtacgttcctctggttactggactggcaagtgcacgcaacctcgaacacctcgagatggtgcgcgtacctttcctggggggtctcattcaacacgtggtcgaagattcctggcgatccggtgggttccgtaatctccatactatcgttctgggagcctgcaaaaacgcactcgaagtggacctgggatacctcataatcacggcagctaggcggttgcacgaagtgaggattcagccttctctcacaaaggacggcgtgttttccgcactgaagatggccgagctagagtttccacagttcgagactctacacttaggatacgtggacgagttcttgctccagtcacgtatggctaatgcagatttggtgaagtacggcctcgccgacgttgtggaaaatccaggcatcatcaccgacataggcatgaaagctgtcaatgaggttttctcttgcatcaagtatcttgccatctacaattgcccccacctgcataatccatataattggatctctgaccattccaggtggaccagactggtagacatcaacctggtgcgctgtcacgcgcttaagctcgattcctttggtcaatttattgagctacttccaagcctcgaattcatatctctcgaccaaatgtttcgggaaccccctaagggctgcgcccgtgtcggcctgtctgccggaaccggtattggtgtttcctccgctttggtgtcgaatcagaactccaacaatgacgacaataacgcccagaataacaatgctaatattcacgataacaaccaccaccaccctgacgactctgatgaagagaatgacttccgacaagacctccaacccggcgagcagcaattcgccgcggacgcattgaatgaaatggaggatatcgttcaggaggatggggaagtggtcgccgagtctggaaataacactccagcacattctcaggcaattatccccgttgacgttgacgaagagcaagccggccccagcggactccagagagtagtgaagccaacgtccatcacagtgcatgacagcgaatctgatgatgaagaagacagcctggagctgcaggaagtgtggattccaaagaatggtacaaggcggtatagcgaacgggaggaaaaaactggagaatctgtgcagtctcgcgagctaagcgaggtcgcaaagacgaagccacggcatgcgatgaagcgcaaacgcaccgccgacaagtccacgtcgacgtctgacccggtgatcgaagacgatcacgtgcaggtcctcgtgctaaaatccaaaaatctggtgggagtcacgatgacaaactgtgggatcacagatctggtattgaaggactgcccaaaaatgatgttcattcatgcaacccgctgcagggtgctaaaacatctgaaggtcgagaacgcacctattgtaaaccgcttcgattatgcccagtgtaagaagctgaacatggaccaggtgctggaccagatccttaggatgcccccggaaaggaatcggatcatctatctgaggccaatgcaacaggtggatacactaaccctcgaacagaaattattctcaggtccatatccttaccatatatgtatcatccacgagttctccaatccacccaacgtgcgaaacaaagtgaggatacgcagctggatggacactatagctaacataaatcaagaattaataaagtatgaatttttcccagaggcgacgcgctcggaggaggacttgaagaaatatccaaaatatccctggggacgcgaaatttacactctcgaaggcgtagtcgatggtgccccatactcaatgatttccgattttccttggctgaggtctcttcgagccgccgaaccgaacagcttcgcacggtatgatttcgaggatgatgaggaatccaccatttacgcccccagaaggaagggtcagctgagtgctgacatttgtatggaaaccataggggaggagatatccgaaatgcgccagatgaaaaaaggtgtcttccagcgcgtcgtcgcgatctttatccactactgtgatgtgaacggggagcccgtggaggacgattacatttag

SEQ ID NO: 187633 - DNA, 1329 bp, Artificial Sequence
  Description of Artificial Sequence: Synthetic coding sequence
atggacgaggagagcgagctgatccagccccaggaccagagctgctgggctttcctgccagacctgtgcttgtgtcgagtgttctggtggctgggcgatagggaccggtctcgagcagccttagtgtgccggaaatggaaccagatgatgtacagtgccgagctgtggcgctatagaacgatcacattcagtgggcgccctagccgggttcacgcatccgaggtggagtccgccgtgtggtatgttaagaaattcggacgctacttggaacatctggaagtcaagttcatgaatccatacaacgccgtgctgactaaaaagttccaggtgacaatgaggggactcctgtcgtgtttaagcaaaagcaataataggttaaagtcactctccatacagtacttggagctcgacagactcgtctggcggaactctatacgcagctcatttatctcgagcctctcattcttcttaaaaaaaatgggaaagagactggactacctcaacctgaaaggagcgcgtcttaccgtggaacagggatgtcagatcttagacagcttaagctatatgcggaatgagaatgtaatcagtgaactgaacatcgaagactacttctctcaccaccttgctgtatataatagtcctcagtttaagaaaacaatgtcaacattccacaatttggtgtctctgaacctcaattataattgcatatctgatgaactcctagagaatttgtgtgaaaacgcttcaacattgcgtaccattaacatcaaatgtcacgtccacgacccccatgggcaagtcatctggggcatgtcatgggccaagttggctaggcaggccaccaacttgaaggtcaacttttttttcgagcggattatgaaatatgaaaggctcgcacggatcctattacaggagatccctatcagatccatctccctgcgatcatgttacttttcagacccggattgcagcatgcggcctacacttatcgacctgctgccaacgttcagacatactcttcagaagctaacatgcgagtttaataacaatcacgagtcgctggacgaggagctgcaccttctaatcattagttgtaggaagctgttttacttcaagatctgggcgtttctcgatgtcagctttgtggaacgcattcttaaaagccagaaagaaagacagtgcgccctacgggtcttcaaggcacgcatttacacgaaccgttacgaaactaatgaggaagataaaacacttcaggagatttaccgaaagtacagaaaattgattgagtccgagctgtcctattttgttatagtgtatagcgtgatgtag

SEQ ID NO: 187634 - DNA, 1164 bp, Artificial Sequence
  Description of Artificial Sequence: Synthetic coding sequence
atggccggcagcgagccccggagcggcaccaacagccccccccccccattttctgattgggggagacttgaggccgcaattctctctgggtggaagaccttctggcaatctgtcagcaaagaacgtgtagctaggactaccagccgggaagaagtcgacgaagccgccagtacattaacaagactccctatcgatgtgcagctatacatactctcattcctttctccgcatgacctctgtcagctcggaagtaccaaccactactggaatgagaccgtacgagacccaattctgtggcgatactttctgctcagggacctaccatcctggtcctctgtggactggaaaagtctgcccgacctcgaaatcctgaaaaagccaatttccgaggtcaccgatggagcattctttgattatatggcagtgtataggatgtgctgtccttacacccggcgcgctagcaaaagctctagacccatgtacggtgcagtcacatccttcctgcatagtcttatcatccagaacgaacctcggttcgctatgtttgggccaggtctcgaggaactcaatacctctcttgtgctctcccttatgagtagcgaggagctctgcccaaccgcggggttgccccaaagacagatcgatggtatcgggtcgggtgtgaatttccaactcaacaatcagcacaaattcaatattcttatcctgtattctacgacccggaaggagcgcgatcgggctagggaagaacacacttccgctgtgaacaagatgttttcaaggcacaatgaaggggatgaccagcagggcagtcggtattccgtcatcccgcagatccagaaagtgtgcgaagtggtggacggatttatctacgttgccaatgccgaagctcataagagacatgaatggcaggatgaattctcacacattatggcaatgactgatccagctttcggatccagtgggcggcctctgctggtgctgagctgtatctcgcaaggggatgtgaaacgtatgccgtgtttttacttagcccatgagctgcacctgaacctactgaaccatccatggctcgtgcaggatacagaggccgagaccctcaccgggttcctgaatggcatcgagtggatccttgaagaggtggaaagcaaaagagcgcggtag

SEQ ID NO: 187635 - DNA, 924 bp, Artificial Sequence
  Description of Artificial Sequence: Synthetic coding sequence
atggccggcagcgagccccggagcggcaccaacagcccccccccccccttttccgactggggccggctggaagcagccatactatctggctggaagactttctggcaatcagtgtcaaaggagcgcgttgctcggactacttcccgggaagaagtcgacgaagcagcctccactctgactaggctccccattgatgtgcagctgtatattctgtcctttttgtccccacacgacctgtgtcaactcggatctacaaatcattactggaacgagactgtaagagaccccatcttgtggaggtatttcctccttcgagatctcccatcatggtcttcagtggattggaagtcactgcctgacctggaaattctgaaaaaaccaattagcgaggtaacagacggcgcattctttgattacatggccgtctataggatgtgctgcccctacacaagacgggccagtaagagtagtaggcccatgtacggtgctgtgactagcttcttacattcactgattatccagaacgaaccccgctttgccatgtttggaccaggattggaagagcttaatacgagcttagtactgtcccttatgagcagcgaagaactctgtcctaccgccggcctccctcagcggcagatagatggtattggtagcggagtcaacttccagctaaataaccaacacaaatttaatatcctgattctgtactccaccacgagaaaagagcgggaccgggccagggaagagcacaccagcgctgtcaacaaaatgttttctcggcacaatgaaggagacgatcagcagggatctcgatattccgttattcctcagattcagaaggtttgtgaagttgtcgacggcttcatctatgtggccaacgccgaggcgcacaagtctaaatattcatacgttcatttctag

SEQ ID NO: 187636 - DNA, 2130 bp, Artificial Sequence
  Description of Artificial Sequence: Synthetic coding sequence
atgggcaaggcccggcggagcccccccggccaccaccggcactgcgaaggatgctttaatcggcattgccacatccccgtagaacctaatacctcttgtctggtaatcagctgtcacctcctgtgcggtgccacctttcacatgtgtaaagaggccgagcaccagctgttgtgccctctggagcaggttccttgcctgaacagcgaatacggctgccccctttccatgagccggcacaagctggccaaacatctgcaagtttgcccagcaagtgtggtatgctgctccatggagtggaaccgatggcctaacgtcgactctgagacaaccttgcatgagaacataatgaaggaaaccccctctgaggagtgcctcgataccgctctggcactgcaggatcagaaggtcctgtttcgttcactgaagatggtcgaactgttcccagagaccagagaagctaccgaagaagaaccgactatgaatggcgaaacttccgtagaagagatgggcggcgccgtgggaggggtggatattgggctggtgcctcacggactgtccgccactaatggggaaatggccgaactatcacaggaggaacgggaagtacttgccaaaactaaggagggaatggatttggtgaagtttggtcagtgggaaaatatcttctccaaagagcatgcagctagcgctttaacaaatagcagtgctagctgtgagagcaaaaacaaaaacgatagtgagaaggagcagataagtagcggtcataacatggtggagggagaaggtgctcctaagaaaaaggagccacaggagaaccagaagcagcaggacgtgagaacggctatggaaactactggcctggccccgtggcaggacggggttctggagaggctgaaaacagcagtggacgccaaggactataacatgtacctagttcataacgggcgcatgctcatccacttcggacaaatgcccgcgtgcacgcctaaggagcgtgacttcgtgtatggtaagctcgaagcacaggaagtcaaaactgtttatacattcaaggtgcctgtgtcctactgcggcaagagggcacgccttggggatgccatgttgtcttgtaagcccagcgagcacaaggctgtggataccagcgatctgggcatcacagttgaggatcttcccaagagcgatctgatcaaaaccaccctgcaatgcgctctggagcgtgaactcaaaggccatgtgatatccgagtcaagatcaatcgatggcttgttcatggactttgcaacacagacctacaattttgaacctgagcagttctcttcagggactgtgctggccgacctgacagccgcaacacccggtgggcttcatgttgagctccacagcgagtgcgtaacacggcgtcataataagtcaagttctgcatttacgtttacgtgtaataaatttttcagacgcgatgaattcccactgcattttaaaaacgtgcatactgacatacagagctgcctcaacggatggtttcagcataggtgtccgcttgcatatttggggtgcacgtttgtccagaaccactttagacctcctggccagaaggcaaaagtgatctacagtcaggagctcaagaccttcgcaatcaagccagaggtcgctccagagctttcagaaggccggaagaataatcaccttctggggcatggcggcaagtcccagaatagcttgacctccctccctcttgaaatcttaaaatacattgcgggatttctcgacagtgtgtctctcgcacagctgtcacaagtgtctgtgctgatgcgcaatatctgtgctaccttgctccaagagaggggtatggtgttgctccagtggaagaagaaaagatattcacacggaggaacctcctggcgagttcacagggagatctggcagtttagttctctgtttagtaaaatcaaatcatgggaattcaacgaagtcacgtccatgagtgagcacttgaagagctgtcccttcaatattgttgaacacaagacagatcctatactattgacttccatgtgccaacctagagagcaggcccgcgaatcactcgtcagtactttccgcatcaggccacgaggacgctatgtaagttag

SEQ ID NO: 187637 - DNA, 2811 bp, Artificial Sequence
  Description of Artificial Sequence: Synthetic coding sequence
atgaccaccggcctgagcgaccagcaggtggtgtgcgacctggaccaccgagctgtggaagccctgttacaggctgttcggaaaaggatggctggcgcatccccagcagttccacatgaaagagccaggctcactgggggagcggccgctgttgaacctgcttgcagaggaggcggaggagcaatggcatcattggatttaccctaccgatgcccccgttgtggcgagcacaagaggtttcggtcactgtcgtctctgcgggcgcacctggaatattcccacacctacgaaaccctttatattctgtctaagaccaattctatctgcgatggagccgctgccgcggctgcagctgctgccgccgcgtccggcttccctctggcgccagagccggccgctctacttgcagtgccaggcgccaggcgagaggtattcgagtccacttccttccagggaaaggagcaagccgccgggccatcgcctgcagccccccatttgttgcaccatcaccaccatcatgcccccttagctcactttccaggagatttggtcccagctagtttaccctgtgaagaattggccgaacccggattggtgcctgcagccgcagccagatacgcccttcgggagatcgagattcctctgggagagctgttcgcaagaaagtcggtggcttcatctgcctgcagcacgccccccccgggcccgggccccggcccttgcccagggcctgccagcgcttctcccgcctcgccttctccagccgatgtcgcctacgaagaagggctggctagactgaaaattagggctctagagaagctggaagtggacaggcggctagaacggctgagcgaagaggtggaacaaaagatcgctggccaggtggggaggctacaggccgagctggaaagaaaggccgccgagctggagacggctcggcaggagagcgcgcggctgggtagggaaaaggaagaactggaggagagggcctccgagctgagcagacaagtcgacgttagcgtggagctcttggccagcctgaaacaagacttagtccacaaagagcaggaactgtcaagaaagcagcaggaagtggtccagattgatcagtttctgaaggagacagccgctcgggaagcaagcgcgaaacttcgattgcagcaatttattgaagagttactggaacgcgccgaccgcgctgagaggcaattgcaagtgatttcctcttcttgtggctccactccctccgcgtctctaggacgcggcggcggtgggggaggcgccggccctaacgctcgcggtccgggacgcatgagagagcaccacgtgggacctgccgtgcctaacacctacgctgtgtcacgacacggaagttcgccaagcacgggtgcatctagtcgagtccctgctgcctctcaaagtagcgggtgctacgactccgactcacttgaactcccaagaccagaggaaggtgcccccgaagatagtgggccaggcggactcggtacgagggcccaggccgccaatggaggatccgaaagatcccagccaccccggtcaagcggcctgcgaagacaggccatccaaaactggcaacgaaggccacgacggcattcaacagagggggaggaaggggacgtttccgacgtcgggtcgaggacaacggagagcgaagctgagggtcctctggacgcgccccggccgggacctgccatggcaggcccgctctcttcatgtaggcttagcgccagacctgaaggaggatcgggccggggtaggagggccgagagagtgtccccaagccgatctaacgaggtgatctcgccagagatattaaaaatgcgtgccgctttattctgtatcttcacataccttgacacgcgaacactgctgcatgctgccgaagtgtgccgagattggcggtttgtcgctagacaccctgcagtgtggacgagagttctcctggagaacgctagagtgtgctccaaatttctggcaatgctggcgcagtggtgtacccaagctcattctctgaccctccagaatctgaagccccgccagcgaggcaaaaaagagagcaaagaggagtacgctcgcagtactcgcggatgtctggaagcggggctggaaagccttttgaaggcagctgggggcaatcttctcattctgagaatctcacactgtccaaatatactgaccgataggtctctctggctggcatcttgttattgccgggctctgcaggccgttacttatcgctccgcgacagaccctgtgggccacgaggtaatttgggccctcggcgcaggttgtagagagatcgtctctttgcaggtcgcacctctgcacccttgccagcaacctacccgattctcaaaccgatgtctgcaaatgatcggcaggtgttggccacatttgagggctctgggggtgggcggcgccgggtgcggtgttcaaggcctcgcctcacttgcacgtaattgtatgcgcctacaggtactcgaacttgaccatgtctccgaaataacacaggaagtggccgctgaggtgtgccgagaggggttgaaaggtttggagatgctggtgttaaccgcgacgcccgttactcctaaagcacttctgcatttcaattccatctgccggaacttgaaatccatagtcgtgcagatcggcatagccgactattttaaagagccgtcttcccccgaggcacagaagttgttcgaagacatggtcactaaactccaggctctgcgcagacgccccgggttctcgaaaatcctgcatattaaagtagagggcgggtgttag

SEQ ID NO: 187638 - DNA, 2628 bp, Artificial Sequence
  Description of Artificial Sequence: Synthetic coding sequence
atggccagcctggacctgccctaccggtgcccccggtgcggcgagcacaagcgctttcgaagcctgagttctctgcgcgcccacctggagtatagccatacatatgagaccttgtacattctatccaagaccaacagcatctgcgatggagccgccgccgcagccgcagccgctgcagccgcgtctggtttcccactcgctcccgagcctgccgctctgctggccgtacctggtgcccggagagaagttttcgagagtacctctttccagggaaaggagcaggctgcaggaccatccccagcagccccccatctcctgcatcatcaccaccatcacgcacccctggcccactttcctggcgaccttgtaccagcgtcactcccgtgtgaagaactggccgagcccgggctagtgcccgctgcggcagccagatacgccctgagggagatcgagatccctctgggagaactgttcgctaggaaatccgtggctagtagtgcgtgttcgactccgccccctggaccgggtcccggaccgtgtcccggccctgcttctgccagcccagcctctccatctccagctgatgttgcatacgaggaagggttggccagattgaaaattcgagccctggaaaagcttgaagtcgatagacggcttgagcgcctttccgaagaggtggagcagaaaattgccggacaggtgggccggctacaggccgagcttgaacgaaaggcagcggaacttgaaacggctagacaggagtctgctcggctgggacgggagaaagaggaattagaggaacgcgcatccgaattatcccgccaagtggatgttagcgtagagcttcttgctagtctgaagcaagacctcgtccacaaggagcaagagttgagccgaaagcagcaggaggtggtgcagatcgatcaattcctgaaggagactgccgctagagaggcctcagctaagttgcgactacagcagtttatcgaggagttgctggagcgggccgaccgggccgaacggcagctccaggtcatatcaagctcatgcggttccaccccatccgcatcactagggagaggcggtggcggtggcggcgcaggtccgaatgcccgaggccccggaaggatgagagagcaccacgtgggccccgccgttcccaatacctatgctgttagccgccacggctcaagcccaagcacaggggccagctctcgcgtccctgccgcatcacaatccagtggctgttacgactctgactctctcgaactgcctaggccagaggagggggctcctgaagactctggccctggggggctgggcacaagggcacaggccgcaaatggggggtccgaacggtcccagccaccacggtccagtggcttgagacgacaagccattcaaaactggcagcgtcgaccccggagacatagcacggagggggaggagggcgatgtctcggatgtgggaagtagaaccaccgagtccgaggccgaaggacccctcgacgcccccaggcccggtcctgcgatggctggccccctcagctcatgccgactgtccgctagacctgaggggggatctggcagaggtagacgcgctgagcgggtcagccccagcagaagcaacgaagtgatctctcccgagattctcaagatgagagctgcgctgttctgcatcttcacatatctcgacacacgtactctgctgcacgcggctgaagtctgtagggattggaggttcgtcgccagacaccccgctgtgtggacacgggtcctgctggagaacgcgcgtgtgtgttcgaagtttctggccatgctggcacagtggtgcacccaagcccactccctgacactgcagaacctcaaacctagacagcgggggaaaaaggaaagtaaagaggagtacgcgcggtcaacaagaggatgtttggaagctgggctagaatccctcctgaaagctgcgggcgggaatttgttaatcctgcggattagccactgcccgaacatactcactgataggtctttatggctcgcctcatgttattgccgagctctgcaagcggtgacttatcggtcggccactgatccagtgggccatgaggtaatctgggccctgggagccggttgtcgcgaaatcgtcagcttgcaggttgcccccctgcacccatgtcagcagccgacacgcttcagtaacaggtgtcttcaaatgatcgggagatgctggccccacttgcgggccctgggcgtgggaggagccggatgcggggttcaaggtttagcgagcctggccagaaactgcatgaggctgcaggtcttggaacttgaccacgttagtgagattacccaggaggtggccgctgaggtatgccgagagggcctgaaaggtctggagatgcttgtgctcacagctactcccgtgacacccaaggcgttgttgcatttcaattccatctgtcgaaacctcaagtccatcgtcgttcagatcggcatcgctgactattttaaggaaccttcctcaccagaagcacaaaaacttttcgaggacatggtgaccaaactgcaggccttaaggcgccgtcccggcttttctaagattctccatataaaagttgaaggtggctgttag

SEQ ID NO: 187639 - DNA, 2154 bp, Artificial Sequence
  Description of Artificial Sequence: Synthetic coding sequence
atggccagcagcagcgacagcgaggacgacagcttcatggccgtggaccaggaagagacggtcctcgaaggaacaatggaccaggatgaggagcctcaccccgtgctggaggcagaggagacaaggcacaatcgcagtatgtctgagctgccggaagaggtattggagtacatcctatcgttcctgtccccataccaggagcataagaccgcggctctggtgtgtaaacagtggtatagattaatcaaaggtgttgctcaccagtgttatcatggctttatgaaagctgtccaagaaggtaacatccaatgggagtctcggacctacccttatccggggaccccaatcacccagagattttcccacagcgcgtgctactacgatgctaatcagagtatgtacgtgtttggcgggtgcacgcagagttcttgtaatgctgcattcaacgatctttggcggttggacctcaattctaaggagtggatacgccctctggctagcgggtcgtatccatctccaaaagccggggccaccctggtggtgtataaggatctgctcgtactctttgggggctggactaggccttccccgtaccccctccatcagccggagaggtttttcgacgagattcacacatactctccaagcaagaattggtggaactgtatcgttaccacacatggaccaccacctatggcaggacattcgtcctgcgtcatcgacgataagatgattgtgtttggcggttctctgggcagccgtcaaatgtcgaatgacgtttgggtacttgatctggagcaatgggcctggtcaaaaccaaacatttcaggacctagccctcaccctcggggggggcagtcccaaattgtaatcgatgatgccaccatcctgatactcggaggttgtgggggtcctaacgctctgttcaaggacgcatggctcctacacatgcatagcggtccgtgggcctggcaaccgctcaaagtagagaacgaagaacacggtgcccctgaactgtggtgccaccccgcttgtcgggtggggcagtgcgtcgttgtgttttcccaggccccatccggaagagcacctctttctccatcattgaacagtcgcccatcacccataagcgccaccccccctgcgctggtgcccgagaccagagagtatcgttctcagtctcctgtccgaagcatggatgaggccccctgtgtaaatggacggtggggaactcttcgcccaagggcacagcgccaaactccctccgggtctagagaaggctcactatcccccgcccgaggggacggcagcccgatcctaaatggaggctctctgagcccaggaaccgccgctgtgggtggttcctcattggactctcccgtgcaggccatctcgccctcaacccctagtgcccctgaaggatatgacctgaagattggactctcactggctcctcgaaggggcagtctcccagaccagaaagatcttcgcttaggcagcattgacctgaactgggacctgaagcctgcaagcagctcaaacccaatggacggcatggacaatcggaccgtgggcgggtccatgcgtcatccaccggaacagacaaatggcgttcacaccccgccacacgttgcctccgctctcgccggagcagtgagcccaggcgctcttagaagatctctggaggctatcaaggcaatgagtagtaagggtcccagtgcttccgccgcactgtcgccgcctttgggatcttctcctggttctccaggcagccagagtttaagctcaggcgagaccgtgcccatcccacgcccgggccccgcgcagggagatggtcactcattacccccgatagcccgaaggctggggcaccatcctcctcagagtctgaacgttggaaaacccctctatcaatcaatgaactgtaaaccaatgcaaatgtatgtgttggacatcaaggataccaaagaaaagggacgtgtcaagtggaaggtgttcaatagcagcagtgtcgtaggaccaccagaaactagccttcatacagtagtacaggggcggggagaactcatcatcttcggggggctcatggacaagaagcagaatgtcaaatactaccccaagaccaatgcactttacttcgtcagggccaagcgatag

SEQ ID NO: 187640 - DNA, 900 bp, Artificial Sequence
  Description of Artificial Sequence: Synthetic coding sequence
atgagcagccccccccagatcgtgatcgacgacgccaccatcctgatcctgggcggctgtgggggcccaaacgcgctctttaaagatgcgtggttgctccacatgcactctggaccatgggcttggcagcccttgaaggtggagaacgaggagcatggcgcaccagagctgtggtgtcacccagcatgtcgggtgggccagtgtgtggtggtgttctcccaggccccatccggtcgagcaccactgtcaccgtccctcaatagtaggccatcccccattagtgcaacaccccccgctctggtcccagaaacgcgcgaataccgcagccagtctcccgttagatctatggacgaggcaccttgtgtcaatgggcgctggggaacccttcgacctagggcacagagacagacgccatcagggtcccgggaaggtagtctgagtcctgctcgcggcgacggatcaccaatcctgaatggaggctctctgagcccaggcacagccgctgtgggcgggagttccctcgactcccctgttcaggctattagcccgtctaccccatctgcccctgaggggtacgacctcaaaataggcctgagtctggcaccccgccggggcagtctgccagatcagaaggatcttcggctgggaagcattgatttgaattgggatttgaaaccagctagcagttccaatccaatggatgggatggataatcgcactgttggcggtagcatgcggcatcctccggaacaaacaaacggcgtacatacccccccccacgtcgcatctgcactggcgggtgccgtgtccccaggtgcattgcggaggtccttggaggcaatcaaggcgatgagcagtaagggcccatccgccagtgcagcactgtcccctcccttgtag

SEQ ID NO: 187641 - DNA, 900 bp, Artificial Sequence
  Description of Artificial Sequence: Synthetic coding sequence
atgagcagccccccccagatcgtgatcgacgacgccaccatcctgattcttggagggtgcggcggtccaaatgctttgttcaaggacgcttggttgcttcacatgcattctgggccctgggcatggcaacctttaaaggtggagaatgaggagcatggagcgcctgagttgtggtgccatccagcctgcagagtggggcagtgtgtagtggtgttcagtcaagcgccctccggccgggctcccctgtctccttctctaaacagccgcccttcgcccatttcagcgaccccgcccgccctggtaccagagacccgggagtacaggagccagtcacctgtccgctccatggatgaggctccctgcgttaacggccgatggggcactctgcgccctagagctcaaagacaaactccttcaggcagtagagagggttctctatcaccagcacggggagatggttcaccaattctgaacggaggtagtctttctccgggtactgccgccgttggtgggagttcactagattctcccgttcaggccatttccccaagtacaccatcagcacccgaaggatacgatttaaaaatcggcctaagccttgcaccacggcgtggctccttacccgatcagaaagacctcaggttaggatctatagaccttaattgggatctgaagcccgcaagttcatcaaaccccatggacggcatggacaataggacagtcggaggctccatgagacatcctcccgaacaaacgaatggcgttcatactccaccccacgtcgcctcagcactcgctggtgcagtgagcccaggcgcattgcgccggagcctggaagcaattaaggcaatgtcatccaaagggcctagtgccagtgctgctctcagtcccccattgtag

SEQ ID NO: 187642 - DNA, 2127 bp, Artificial Sequence
  Description of Artificial Sequence: Synthetic coding sequence
atgagcttcaaggacaaggacgagcggatcagctgcctggaggcctatgtcaccttgacctcgaagtcttccaggtttactgacgaaaccgaaatactcaaaatgagccagcgtcattcaggtcaagccggcacagaagccggcaacggcgccgacagtccacctattgtgaattccaagtacagtacctttagagatttctgttctacttctagcttccaagacagcggatacaatgaactgaagtcttgttcgttcgataacattgacaaagaatacctggggaagaaagagaaagggccgacccttctctacgaacaccccgagacttctgggcttggacttacacatcctctggagtctcccacacagaagaagaagtgcattctgccccgcaaggaaaaagataagactcctgagctctgtgaaactcctaagatctcaggaaagaagtgcctgcctcgccgcagactcaacgtctcatttgctctgctgaagggggactttgagagtcagaacagctcactggaaagctccatatcccaagtcattaacctcgagaagaatattcccagctccgcctcgggtttctcaagggctaataattttagtccgctcgtgacaagcacactgaaaactgaagaagttacttcctgtagccaaaagctgaggctcaatttcagccagcagaagacttcaaccatcgacgacagcaaggacgattgctctctgttcgaggttgaatgcatcagtcccatccaaggtaacaattttaaggacagcattacgcacgacttctctgactcctctctttgtattaatgacgagaacgcatgtccagaactcttaggatcttccgtcagcggaaccacttgtggcactgatgaggacatcttcgtcacccccatctccaacctagtcgctaatatccgattcaacgcatctcagattctttctccttcccctgaggtgcggggctctatcagtacacctgaggattccggctttaactcgctcagcctcgagaagagcgaggacagcctgtcagatcaggaagggtccttccaggaattattgcaaaagcacaaaggaaccccaaaggttggcgataccattcgcaagactcggcacctgggcaggagccgccgactcagtaccctacgggaacagtcaagtcagagcgaaacagaggaagaaaaacagatcgtacatccagactcagaaaagagagccgccgcagccagcgccatttcagaggggcagctgtcaagtgatgaatcaggcgacctgacattctctctgaaaaatctgagcaaaacaccagccttacaacttgtccacgaactgtttatgaagagtaagagaaagagattacaggagaacagcgggcatgaatttttggagcagggtgacggagaaaagatagccgtgctgcagtgtatcttggccggcctgatcgggaagaaaatgggcatcgaaaagttggacatacttactgagcttaagtacagaaacctgaaacacatactggctatggtgcttgaaagtctgacagcagaatctttatgcagtgtttggaaagtctctcgcaactggcgggagatcgtggtacaagataaaaatgccaatcgccgtcgcaagttttacataacccagcttaaaaccgatagcgagggtgctgttcttaacgtggaagacgccgccaccaggctgcagcttctgaatcgcagcgcgttgcgctcggtgcaggcacaggccaggatcccgggctctcaaagggaacaaggttcgaccttgagcccgtggggggaggtgctgactccgctcgccagttcatctgtaacccacttatcctcaaaacaagaggagtatgtgaaggtggccaaaaccctgtttacagacgaggcactcaaaccctgtccaagatgccaatcgccagccaaatatcaaccctacaagaagagaggcctgtgtagccggaccgcctgcgggttcgacttttgcgtcctctgtctgtgcgcatatcacgggagcgaggaatgtagccgcggcgctgcaaaaccacgcaatagaaaagacgccctcccgggttcggcgcagagcaagcggaacttaaagcggctgtag

SEQ ID NO: 187643 - DNA, 675 bp, Artificial Sequence
  Description of Artificial Sequence: Synthetic coding sequence
atggccgtgggcaacatcaacgagctgcccgagaacatcctgctggaactgttcactcacgtgccagcacggcagttactgctcaactgcaggctcgtatgctcactgtggagggacctgatagacctcgttacgctgtggaaaaggaagtgcctgagagaagggtttatcactgaggactgggatcaaccagtggctgactggaaaattttctacttccttcgctccctgcaccggaaccttctgcacaacccttgcgccgaggaggggttcgagttttggtccttggatgttaatgggggggacgaatggaaggttgaggacttgtccagagatcagaggaaggaatttcctaacgatcaggtgcggtcccaggcccgcctgcgggtccaggtgccagcagtgagatccgcaccagtcgtgcgtgcccgcgccagtggcgatctgcccgccaggcccggggatcaccctgctgaagagagatgccaggtcgagggcgggctgccccacatactccagctcccggcacgcagacccctgcacttagtctcagcacggcgaaggggacattcattgctcgggcgactcgtcaggccagagggtcatcaacagcagcatcaccatagggctcccgcggccctcactccacccgagcctccaagtgccgagccatag

SEQ ID NO: 187644 - DNA, 768 bp, Artificial Sequence
  Description of Artificial Sequence: Synthetic coding sequence
atggccgtgggcaacatcaacgagctgcccgagaacatcctgctggagctttttacccacgtccccgcgcgacagttgctgctcaactgtcgtctcgtatgcagtctctggcgagatctgattgacctggtgaccctttggaagcggaagtgtctgagagaggggttcataacagaagattgggaccagccagtcgcggactggaaaattttttattttttaagatccctccacagaaatctgcttcacaacccatgcgccgaggaaggatttgaattttggagcctggatgttaacggaggagacgagtggaaggtggaagatctgtctcgggaccagcggaaggagttcccaaatgatcaggtcaaaaagtacttcgtgacgtcttactacacctgcctcaaatcccaggtagtcgatttgaaagctgaaggatattgggaggaactgatggacaccacacgcccagacattgaggtgaaggactggttcgcggctaggcccgattgcgggtcaaagtatcaactgtgtgttcagctcctgagttctgcacacgcgcccctgggcaccttccaacccgaccctgctacgatccagcagaagtcggacgccaagtggagagaagtttcccatactttttccaactacccacctggcgttcgatatatttggttccagcatggcggcgtcgatacgcattactgggcggggtggtacggaccgagagtaaccaacagctccattacaattggacctcctctgccatag

SEQ ID NO: 187645 - DNA, 675 bp, Artificial Sequence
  Description of Artificial Sequence: Synthetic coding sequence
atggccgtgggcaacatcaacgagctgcccgagaacatcctgctggagttgttcacccacgttccggcgagacagcttctgctgaactgtcgactggtatgtagtctttggagggaccttatcgacctggtgacactgtggaaacgaaagtgccttagggagggctttattacggaagattgggatcagccggttgctgactggaagatcttttattttctccgatcgctacaccgcaacctcctgcacaatccctgcgcagaagaaggctttgaattctggagcctcgacgtgaacggtggggacgaatggaaggtagaagacctgtctcgagaccagcggaaggaatttcctaatgaccaggtcagatcacaggctcgattgagagtccaagtgccggccgtgagatccgctccagtggtcagggccagagctagtggtgacctccccgcccggccgggtgaccatccagcggaggaaagatgccaggtggaaggcggactgccccacatcctgcagctaccagcccgacgtccgctacaccttgtgtcagcgagacggcgcggacacagcctcctgggtagattggtcaggccagagggtcaccaacaacagcatcaccacagggccccagctgccctcaccccccctgagcctccttctgcggagccctag

SEQ ID NO: 187646 - DNA, 675 bp, Artificial Sequence
  Description of Artificial Sequence: Synthetic coding sequence
atggccgtgggcaacatcaacgagctgcccgagaacatcctgctggagctttttacgcacgtgccggcgcgacagctgctgcttaactgtcgactggtctgctccctctggcgagatcttatcgatcttgtgacactatggaagagaaaatgcctgcgagagggcttcatcacagaagattgggaccagccagtcgccgattggaaaatattttatttccttaggtctttacaccgcaacttattacataacccatgtgctgaagagggattcgagttttggtccctcgacgtaaatggcggagacgagtggaaggtggaagacctctctcgggatcaaaggaaggagttcccgaacgatcaggtccgctcccaggctcgcttgagggttcaggtgcccgcagtacggagcgccccagtggtacgggcccgggcttcgggcgatctgcccgccagaccaggagatcatcccgccgaagagcgctgtcaggtcgagggcggactacctcacatcttgcaactacccgctcgtagacctcttcatctggtgtcagccaggaggagagggcatagcctgctgggccgcctcgtgcggccagaagggcaccagcagcagcatcaccatcgcgcgcccgctgccctcaccccccccgagcctccgagcgccgagccttag

SEQ ID NO: 187647 - DNA, 771 bp, Artificial Sequence
  Description of Artificial Sequence: Synthetic coding sequence
atggccgtgggcaacatcaacgagctgcccgagaacatcctgctggagctctttactcatgtgccagccagacagcttctcctgaattgcaggctggtgtgctcgctgtggcgggatttgattgatctggtgacgttgtggaaacggaaatgcctccgcgagggatttatcaccgaggattgggaccaacccgtggctgactggaaaattttctacttccttcgatctcttcacagaaatcttctgcacaacccctgcgcagaggaaggtttcgagttctggagcttagacgtgaacggaggtgacgagtggaaagtggaagacctgtctagagatcagcgcaaggaattccccaacgaccagcacctcccgcaggtaccaggaggcggtcctcagggtcgacgcgttttaggcggtgccgacggctatcataccgctggacatcgggggcaggggctggttcggtcccaggcgcgcttgcgggtgcaggtacctgcagtgcgaagcgcacccgtggtgcgcgccagggcgagcggagacctgccagctcggccgggggaccatcctgctgaggagcgctgtcaggtggagggaggtctgccacatattttacagctgccagcgaggagacccttgcatcttgttagtgccaggcgacgaggacactccctccttgggcggttggtgagaccagaagggcaccagcagcagcatcaccatagggcacctgctgcactaactccccccgagcctccctctgctgagccctag

SEQ ID NO: 187648 - DNA, 768 bp, Artificial Sequence
  Description of Artificial Sequence: Synthetic coding sequence
atggccgtgggcaacatcaacgagctgcccgagaacatcctgctggaactcttcacacacgtccctgctagacaacttcttttaaattgtcgactggtctgttcactgtggagagatctgattgatctcgtcactctctggaaacgtaaatgcctgcgagaaggcttcatcactgaggactgggaccagcctgtagccgactggaagatattttattttcttaggtctttgcaccgaaatctcctgcacaatccctgcgctgaggaagggttcgaattctggtcattggatgtgaacggaggggatgaatggaaagtggaagatttgtccagagaccaacgaaaggaatttcctaacgaccaggtgaaaaagtactttgtcaccagctattacacatgccttaagtcacaagtggtcgaccttaaggcagaaggctactgggaagagctcatggatacgacaaggcctgacattgaggtcaaggactggttcgctgctagaccggactgcggcagcaaatatcaactgtgcgtacagctactgtcatctgcccacgcacccctggggactttccagccggacccagcaaccatacagcaaaagtctgatgccaaatggcgcgaggtgagtcataccttctccaattacccaccaggcgtgaggtatatttggttccagcatggcggcgttgacacccactactgggccggatggtacgggcccagggtgaccaattccagtatcactattggccctccgcttccctag

SEQ ID NO: 187649 - DNA, 498 bp, Artificial Sequence
  Description of Artificial Sequence: Synthetic coding sequence
atggccgtgggcaacatcaacgagctgcccgagaacatcctgctggaactttttacacatgttccagcgagacagctgctacttaattgccgcttggtgtgtagtctgtggagggatctgatagacctcgtcaccctgtggaaaagaaaatgcctgagagaaggatttatcacggaggattgggaccagccagttgccgattggaagatcttttatttcctgaggagcctccacaggaacctgctgcataatccttgcgctgaagaagggtttgaattctggtcgttggacgtcaatggaggagacgaatggaaggtcgaagacttgtcccgcgatcagaggaaagagtttcctaacgatcaggtaagatctcaggcccgtctccgcgtgcaagtgccagccgttagatccgcacctgtggtgcgcgctagagccagcggtgacctccctgcaaggccaggagatcatcctgcggaagagcggtgccaggtggaatag

SEQ ID NO: 187650 - DNA, 861 bp, Artificial Sequence
  Description of Artificial Sequence: Synthetic coding sequence
atggccgcccccgcccccggcgccggcgccgccagcggcggcgccgggtgtagcggcggaggcgcaggcgcgggggctggtagcggcagtggcgccgccggcgccggcggtcggctgccgtctcgggtgctagagttagtgttcagctaccttgaactcagcgaactgagatcctgcgctctggtgtgcaagcactggtatcgctgcctgcacggggatgagaatagtgaggtgtggaggagtctctgtgcaagaagcctcgcggaagaagcactgcggaccgacatcctgtgcaacttaccttcctacaaagccaagattagagcctttcagcacgccttcagcaccaacgactgttcaagaaacgtgtatatcaagaaaaacgggttcaccctgcatcggaacccaattgcacagtcaacagacggagcaagaactaagattggttttagcgagggaagacacgcctgggaagtctggtgggagggtcccctgggaaccgtggctgtcatcggtattgccacaaagcgcgccccaatgcagtgccagggttacgtagctctgttagggtccgacgatcagtcctggggttggaatctggtggacaataacctgctccacaatggagaagtgaacggaagtttccctcagtgtaataacgcccccaaatatcagattggcgaaagaatcagggtcatcctcgacatggaagataagactctggcattcgagcgggggtacgaatttctcggcgtcgcttttcggggtctgcccaaggtctgcctgtatcccgccgtgagtgcagtatacggcaataccgaagtcaccttagtttatctcggcaagcctcttgacggttag

SEQ ID NO: 187651 - DNA, 1812 bp, Artificial Sequence
  Description of Artificial Sequence: Synthetic coding sequence
atggaccggggcagcctgctgcccttccagctgtggtgcccccggccatttggtacctattcacagaaccagcctcgccccccatcggccgccctgaagcccagcgcctgccctgaaccaggaggcggcgccgaaccagatcatggacctgcccatagcgaaaacacacctcctgcactagccacagaagtgccagcaagtcagcccgctccgttgctgagtgctgcggcagccggggacgagggtcgcgtcctgctagatacgtggtacgttataaaaccgggaaacaccaaagagaaagttgcttttttcgtagcgcaccagtgtggtggaggaagtcgggcgtctagtatgaaggtcaagggacattggggctccgattcatccaaagcgaaaagacggcgacgttgcctggatcccactaaagcccctcccgaccccgggggcagggaggggccgcccgccgccgaagaaggtccagccagtgcgggcgaggatgtggatctgctgagcgttgcggagatggtcgccctggtcgaacagagggcggcacttgccctccagagttacccaagaccaaccacgccagctcctgtagtcttcgtgagcgcggaacagggtgggcccgcgaaaggagtagggtcagagagacgttctggagggggagattgctcacgtgtggctgaggctgttgcgcactttgaagcacagcgggacagtccgcctacgaagggactccggaaggaggagagaccgggcccaggacccggagaggtccgaattgcctttaggataagcaacggacgggagcccagagctccagattcaggccttcctagcgggggcggggggcgcccaggatgtgcctatcctggtagccctggacctggggcacgggctaaggacaaaataacatgcgacctctatcagctgatatcaccctccagggatgcgttaccctcaaacgtagagttcctgctcgcgcgggctgacgaggctagtgagggcgactccccagcccctgcccgtcccgaagatacaccaccagcaccacctcccccccccgcccgtgactgtggtgcctctggcttccatgtggacgtggttgtcacaggggtcgtagacgagtgcatcttctttggaaaagacggtacaaagaacgtgaaagaggagaccgtttgtcttactgtctccccagaagagcctccccccccagggcaactgttctttttacagaaccgcgggcctgacgggccgcccgaacctccccctgccgacagccctgctactgctccgggacctgatgacgccgaagggacagccgacacttccctatgtcgtctctaccgccacgtgtcccatgactttttagagattcgattcaaaatccagcgcttgctggagccacgtcagtacatgctgcttcttcctgaacacgtgttggtgaagattttttccttcctccctacccgagcattggctgctttgaaatgcacatgtcaccacttcaagggaatcatcgaggcgttcggagtgcgagcaaccgatagccggtggtcccgagaccccctatatagagatgatccttgtaagcagtgtcgaaaaagatacgaaaagggcgatgtctccctttgccgctggcacccaaagccttatcaccatgacctgccttacggcagatcttactggatgtgttgccggagagccgacagagagacgcccgggtgccggctggggctgcacgacaataattgggtgctgccttgcaatggcccaggcggaggcagagctgggagagaagagggtagatag

SEQ ID NO: 187652 - DNA, 609 bp, Artificial Sequence
  Description of Artificial Sequence: Synthetic coding sequence
atgacctgcctgaccgacgtgcccaccggctgcgccgccgtggagcctaccgcccgccttccagctgcagcatgggcctctaccatcaccacggggtgttgtcctgctatgggccaggccggagccggcccagccggcagaaggggcggcgaggccggcggtggggaagggcgggctcaccacgcgcaccccagtccactgccgcgagagccacgcgtacggactgggcccccagcccattctcccacccctgggtccatcgatccttcacctgaactgtcgtgggggtccgcaggcgtcacgcaagaatctcccctgttggacccagtggatttccttttatttcgtaccagggccgtggaccctctccggagggtgttttttttcttctaccagcacctgacatttttctctattcagccccaacccccaccctgccatgctttccatcccaaggaccctcctgcgggttctcggagacagctcattctggtaccattgaagggcccacctatcctcgcacccattctgtccctcacgcctatcctttcccggtggtcgtgttactttccaagaagtagaatcgctcaaggatggcacctcagctag

SEQ ID NO: 187653 - DNA, 1359 bp, Artificial Sequence
  Description of Artificial Sequence: Synthetic coding sequence
atggccagccggatcaacaccaacttcaccctgatccccaaccagaaacttcgtaggagcaatcgccagacctcatgctattctaagacactagggtccggatttcaaccaatcagcacattcggaaactttaaagcgctccctcttgaaatcttccaaataattctaaagtatttgagcgtgaaggacattagcatgctgtccatggtgtctaaaactgtttctcagcacataatcaactacatctccacctctagcggaagtaagcgcttgcttctgcaggatttccacaaccttgaactccctgaccggcggcaggattcagccatccttgagcactaccggagcctcggtctcctgtttaagcgctgcaccctactgcttcctactaaagaacggttgaagtacatccacaagatacttaccgaagtctcttgtttcaagttcaatggttgcgctgctcccatgcagtgtttgggtctgacatgctatggtatgtttctacagactctcacggccgggtgggatgagctcgagtgccacagggtgtacaattttctgtgcgagcttactaacctctgccggaagatacaaatggctgtctgttctaaacctggaagcgcacagaagctcgagctgagaatcagactgttttgcaggaacgttctccttgatcactggacccacaggtccgattctgctttctggttaactcgcattttaaagccgtggcccatggtgaatcaggcccggttattatacattatttttggccctatcagtccccaggacgggcaggtggtttggcaggaaatgatcgaagagcccaccgacgagttcagtctcaagggtctggccgatgccatcaaactcttgtacgatgcatctaccaaagagtggaccgccgatgacgtcatttctttggttgacgaactgagcgttgtacctagggagtggttgctggagaacaatgcaaggcttctgatgctatcaggcaataacatctgcttctctttcatggcgtctaaggcagtcaacggcagaaccatcgagctggcacgactagtggtcttcctcgcactggtgtgtgagaaggagctttattgtatggactggacagttaaaatgatgcagaaggtatgcaaagtgttcagtacccccgtggagcgcaaaaattttctgcaaaatgtggccaacgcctttgcatgcgtaattatggaaatgctacagtctatcatgtcaggggatagggacgaggacgatcgcagctttctaaacctcttccatcttgtccatgcccaagcaaattttcataaggaagtgctgtatctaaccatgaatacccctctctccacgtag

SEQ ID NO: 187654 - DNA, 2133 bp, Artificial Sequence
  Description of Artificial Sequence: Synthetic coding sequence
atgggcggcaagcagcgggacgaggacgacgaggcctacggcaagccagtgaagtacgatccctcctttagaggacccataaagaaccggtcatgtacagacgtcatctgttgcgtcctgttcctccttttcattctcggatatatcgtagtcggtatagtcgcctggttgtacggggatccaaggcaggttctgtatccccggaatagcacgggcgcatattgcggcatgggagaaaacaaagacaaaccctatctgctttactttaatatcttttcttgtattctgtcatcaaatattatttcagtggccgagaacggcctccagtgtcccaccccccaagtctgtgtcagttcgtgtcctgaggacccctggaccgttgggaagaatgagttttctcagaccgtgggagaagttttttatacaaagaaccgaaacttctgtttgcctggtgttccttggaacatgactgtaatcacatcactgcaacaagagttgtgtccgagctttttgctcccgtcagcgccagccctaggccgctgtttcccctggacaaacgtgacaccacccgctttgcctgggatcaccaatgataccacaatacaacaagggattagcggtctcattgattctctgaatgcacgcgatatcagtgtgaaaattttcgaggacttcgctcagtcttggtactggatcctggtggccctgggagtggccctagttctctcccttctattcatactccttctgaggcttgtggctggaccgctggtgctggtgcttattctgggcgtcctgggtgtactggcttatggaatttactactgttgggaggaatatagggttctgagagataaaggcgcttccatctcacaactgggattcacgacaaatttgagcgcataccagtctgttcaggaaacttggctcgctgccctgattgttttggccgtgctcgaggcgatccttcttctgatgctgattttcctccgccaacgtattcggatagccatcgccttgctcaaggaggcaagcaaggccgtggggcagatgatgtcgactatgttttatccccttgtgaccttcgtcctcctgttaatatgcatcgcgtattgggctatgaccgccctatacttggccaccagtggacagccacagtacgtcctctgggcatcaaatattagcagccccggatgtgagaaagtgccaatcaatacttcatgcaaccctacagcgcacttggtaaactcatcatgcccaggcctgatgtgcgtcttccagggctacagtagtaaaggactgatccagaggagcgtattcaatctgcaaatttatggagtcttggggcttttctggactctgaattgggtcctggctctgggacagtgcgtcctggcgggggcattcgcgagcttctactgggccttccacaaaccacaggacatcccaacctttcccctgatcagcgcttttattcgcacactgcgctaccacaccggctcactggcatttggcgccctcattctgacattggtccagattgcgcgagtgattctggagtacattgaccataagctgcggggagtacagaatcctgtcgcccgatgcattatgtgctgctttaagtgttgcctttggtgcctggagaagtttataaaattccttaaccgcaacgcctatatcatgattgcaatatatggcaagaacttctgtgtcagcgccaagaacgcgttcatgctgctgatgcgtaatattgttcgagtggtggtgctggacaaggtgacagatctccttctcttcttcggaaaactgttagtggtgggcggagttggtgttctgtcattcttctttttctctggtcgaattcctgggttgggtaaggactttaaatctccacaccttaactactactggttacctattatgacgtcaattctgggggcttatgtgatagccagcggattcttttccgtgtttgggatgtgcgtggatacccttttcttatgtttcctcgaggaccttgagcggaacaacggctcactggacagaccttattacatgtctaaatccctgttgaaaattctagggaagaagaatgaggcaccaccagataacaagaagaggaaaaagtag

SEQ ID NO: 187655 - DNA, 1206 bp, Artificial Sequence
  Description of Artificial Sequence: Synthetic coding sequence
atgaagtgcgacttcaactgcaaccacgtgcacagcggcctgaagctcgtgaaacccgacgacataggccggctggtgtcctacacaccagcgtacctggaaggcagctgcaaggactgtataaaggactatgagcggctgtcttgcataggctctcccatcgtgagcccgcgaatcgtccagctcgaaaccgagagcaagaggttgcacaacaaggagaatcagcatgtccagcagactctgaactccaccaatgagattgaagccttggagacatcaaggctgtatgaagactcgggctattcatccttttccctgcaatccggactgtccgagcatgaagaaggaagtcttctcgaggaaaacttcggcgactctcttcagagctgcctgctccagattcagtcacctgatcaatatccaaacaaaaatctgttgcccgttctgcactttgagaaagtcgtctgtagcacactcaaaaagaacgctaaacgaaaccctaaagtggacagagaaatgcttaaagagattatcgcaagagggaactttaggctgcaaaatattattggacgaaaaatgggccttgagtgcgttgacatcctatccgagctctttaggagggggctgcggcacgtactggccaccatcttagcacagctgagtgacatggatctcattaatgtgtccaaagtgtccacaacatggaaaaaaattttagaggacgacaagggtgctttccaactgtactccaaggcgattcagcgagtgaccgaaaataataacaagttttcccctcatgcatctacacgcgagtatgtcatgtttagaacccccctcgcgtctgtccagaaatctgctgctcagacaagcctcaagaaagacgcccagaccaaactctccaatcagggcgaccagaaaggttcaacatactctcgacataatgagtttagcgaagtggccaagacactcaagaagaacgagtcactaaaagcctgtatcagatgcaactcacctgcgaagtacgactgctacctgcagcgagccacatgcaagcgcgaagggtgtggtttcgattactgtaccaagtgcctatgcaactaccataccactaaggactgttctgatgggaaactgttgaaggcttcatgcaagattggaccattgccgggcactaaaaagagtaaaaagaacctgcgtagactctag

SEQ ID NO: 187656 - DNA, 882 bp, Artificial Sequence
  Description of Artificial Sequence: Synthetic coding sequence
atggacgccccccacagcaaggccgccctggacagcatcaacgagctgcctgaaaacatcctgctggagctgtttacccacgttccggcaagacagctgcttctgaactgtagactggtgtgttcactttggagagaccttatcgatctgatgaccctatggaagagaaagtgtttgagagaaggatttataacaaaagattgggaccagcccgttgccgactggaagatattctacttcttaagatccctgcacagaaacctcctaagaaatccgtgcgctgaggaggatatgttcgcatggcaaatcgatttcaatggcggcgatcggtggaaggtggaaagcctccccggcgcacacggtactgattttcccgatccaaaagtgaagaagtatttcgtgacaagctatgagatgtgtctgaaatcacagctggtggatctggtggcggaggggtactgggaggaactgctcgacactttccgcccagatatcgtcgtcaaggactggtttgcagcccgggccgattgcggctgtacttatcagcttaaggtccagctcgcgagtgctgactacttcgtgctggcttcttttgagcctcccccggtaaccatccagcagtggaacaatgccacttggacggaggtgtcttatacatttagcgattacccaagaggtgtgcgttacatcctttttcagcatggcgggagggacacacagtactgggccggatggtatggaccaagagtaaccaattcctcaattgtcgtgagtcctaaaatgacccggaaccaggcgtccagtgaggcccagcccggtcagaaacatggacaggaggaggcggctcaatcaccttatagggccgtcgtgcagattttctag

SEQ ID NO: 187657 - DNA, 750 bp, Artificial Sequence
  Description of Artificial Sequence: Synthetic coding sequence
tgaaacgagctgcccgagaacatcctgctggagctgttcacccacgtcccagccaggcagttgctgcttaattgccggctggtctgctccttgtggagggatctgatcgatctaatgacattgtggaagcggaaatgcctcagagaaggtttcatcacaaaggactgggaccagcctgtcgcggattggaaaattttttacttcttaaggagtttacaccggaatcttctgcgcaatccatgtgccgaggaggacatgttcgcatggcagattgactttaacggcggcgatcgttggaaagtggagtcccttcctggagcccacggaactgatttcccggatccaaaggtgaaaaaatatttcgtcacctcttacgaatttgccgctcgtgccgattgcgggtgcacatatcaactgaaagtccagctggctagtgctgactacttcgtgctggcatcatttgagcccccccccgttactatccagcagtggaataacgcgacctggacggaagtatcatatactttctcagattacccaaggggcgtgcgctacattctgtttcagcacggagggcgagatactcagtattgggcagggtggtatggccctagggtgactaattcttcaatagtcgtgtccccaaagatgacacgtaatcaggccagctccgaagctcagcctggtcagaagcatggtcaggaggaagcggctcagagtccatacagggccgtcgttcagatcttttag

SEQ ID NO: 187658 - DNA, 1569 bp, Artificial Sequence
  Description of Artificial Sequence: Synthetic coding sequence
atgcggctgcgggtgcggctgctgaagcggacctggcccctggaggttcccgagacagagcctacgcttggccacctcagatcccaccttcggcagagcctcctatgcacatgggggtatagcagtaacaccaggtttaccatcacattgaattacaaggatcctcttacgggagacgaggagacactcgcttcttacggaatagtctcaggcgatctgatctgtttaattcttcaagatgacatccccgccccaaatataccgtcgtcaacggacagtgaacacagctccctccagaacaatgagcagccctctctggctacctcttccaaccagacctcaatgcaggacgaacagccgagtgattcctttcagggacaggccgctcaaagcggcgtgtggaacgacgattctatgctcggtccatcccagaattttgaagctgagtccattcaggacaacgcccacatggccgaaggtaccgggttctacccaagtgaaccgatgctgtgtagtgaatccgtggagggtcaagtccctcactctctggagactttgtatcagagtgctgattgtagtgacgccaatgatgccctgatcgtgctcattcatctcttaatgctggaatcagggtatatcccacagggcacggaagctaaagccctcagcatgccagagaaatggaagctttcaggagtgtacaagctccaatacatgcatccactctgtgagggctcttccgctaccctgacctgcgtgcccctcggaaacctgattgtcgtcaacgcaactctgaaaataaataatgagatccgcagcgtaaagcgcctgcagctgctgcccgagagcttcatttgcaaagagaagttaggtgaaaatgtggcgaacatctacaaggatctccagaaactgtctaggttatttaaggaccagttggtatatcccctgctcgccttcacccggcaggccttaaatttgccagacgtttttggactggtggtcctcccattagaacttaagctccgtattttccgtttgctggatgtgaggagcgtcttatccctgtctgcggtgtgcagggatctgttcacagcatccaatgaccctctgctttggagatttctctatcttcgcgacttccgggacaataccgtgagggttcaggatacagattggaaggagctgtaccggaagaggcacatccagcggaaagagagcccgaaagggaggttcgttatgctgctaccatcaagcacccataccatccccttttaccctaatcctctacaccctcgccccttccctagctcccgcttgccacccggcataataggtggtgagtatgaccagcggcccacactcccatacgtcggcgatcccatcagttctctcatcccaggaccgggtgagacacctagtcagtttccgcccttgaggcctcgcttcgaccctgtgggaccactgccaggccccaaccccatcctacccggcaggggggggcctaatgaccgttttcctttccgacctagcagagggcggcccactgacggaagactcagtttcatgtag

SEQ ID NO: 187659 - DNA, 1332 bp, Artificial Sequence
  Description of Artificial Sequence: Synthetic coding sequence
atggcccggccccccggcggcagcggccccctgctggacagcgagcattcctctcttcagaacaacgaacagccaagcctcgcgacctcgtcaaaccaaactagcatgcaggatgaacagccgtctgacagttttcaggggcaggcagcccaatctggagtctggaatgatgactcaatgctgggtccgagtcagaactttgaggctgagtccattcaggataacgcccatatggcagagggaacgggcttttacccttctgaaccgatgttatgttcagaatcagtggagggtcaggtgccacactccctcgaaactctctatcaatccgcagattgttctgatgccaacgatgccctcattgttctcattcacctgctgatgttggagagcgggtacatcccccaaggcacagaggccaaagcactgagcatgcctgagaagtggaaattgtcgggagtgtacaaactacaatatatgcacccactgtgcgagggcagtagtgccacgctgacgtgcgttccattgggaaaccttatagtggtgaacgccacgctcaaaattaataacgaaataaggtctgtcaagcgactccaattgctacctgagtcattcatttgtaaagagaaactaggcgagaatgtcgcaaatatctataaggacctacagaagttgagcaggctctttaaggaccaactcgtgtatccactgctagcctttaccaggcaagctctcaacctgcctgatgtcttcgggctcgtcgtgctcccattggagctgaagttgagaattttcagactgctggatgtgcgctctgtgctgtctctgtctgccgtttgtcgcgatttgtttacggccagtaatgatccgctgctgtggcgcttcctgtatctgcgagactttagggacaacactgtccgggtccaggatactgactggaaggaactgtaccgaaagcgccatatccagagaaaggagtcccctaagggcagattcgtaatgctgctgccatccagcacacatacaatccctttctacccaaatcctctgcaccctcggccattccctagctctcgcttaccccctggaattattgggggggagtatgaccaaaggccaacactcccctacgtcggcgaccccatctcgagtctgattcctgggccaggggagaccccatcacagtttcctcccctccggcctcggtttgaccccgtgggtccccttccaggccctaacccgattttacccggacgtgggggacctaacgaccgcttccctttcagaccatcccggggtcggccaacagacgggagactgtccttcatgtag

SEQ ID NO: 187660 - DNA, 1227 bp, Artificial Sequence
  Description of Artificial Sequence: Synthetic coding sequence
atgcaggacgagcagcccagcgacagcttccagggccaggccgcccaatccggggtatggaacgatgattcaatgcttggcccttcccagaactttgaagctgaatccattcaagacaacgcgcacatggccgagggtactggattctaccccagtgaacctatgctctgctctgagtctgttgaaggccaggtccctcatagcctggagaccctgtaccagagtgccgactgttccgacgccaacgacgccctgatagtcctcatccaccttctcatgctggagtcaggctatattccccaggggacagaggctaaagccctgtcaatgccagaaaagtggaagctgtctggcgtgtacaaactccaatatatgcatcccctgtgtgaaggaagcagcgcgactctcacatgtgtcccgctcgggaatttgattgtcgtgaacgctaccttgaaaatcaataatgagatacggagcgtgaagcgattgcagttactgcctgagagtttcatttgtaaggagaagctgggggaaaatgtggctaatatttacaaggacctccaaaagcttagtagactctttaaagaccagctcgtatatcccttgcttgcgttcactaggcaggcccttaatttaccagacgtctttgggctggtcgtgctcccattggagcttaagctgaggatcttcagactcctggacgtaaggtccgttcttagcctctcagctgtttgtcgggatctgttcaccgcctccaatgacccacttttatggcggtttctgtatctcagagattttcgcgacaacaccgtgcgggtacaagatacagattggaaggagctctaccgcaagcggcatatccagcggaaagaatcgcccaagggacggttcgtaatgctgttgccatcttctactcataccattccattctacccaaatccgctccatcccagacctttcccttcctctcgtctgccccctggcattatcggtggcgagtatgaccagaggcctacactgccctacgtcggagaccccatttcatctctgattccgggacctggagagacaccttctcaattccctccattgcgacctcgcttcgatcctgttggtcccttgccaggtcctaacccaatactgcccggcagaggcggccctaacgatagatttcccttccgtcctagccgcggacgcccaacagacggccggttgagcttcatgtag

SEQ ID NO: 187661 - DNA, 699 bp, Artificial Sequence
  Description of Artificial Sequence: Synthetic coding sequence
atgcagctgaccttcgcctggctgcacgtgttcggccggaccctgagaatgatgaatttttctggaaaaggatgcgctaatccttggggccattgttctatttacaataagaaccccccactgggtttctcctttcgcaagctttatatgcagctggatgagggatctcttacgttcaatgctaatcctgatgaaggggtaaattactttatgtccaaaggaatcttagatgactcacctaaagagatagcaaaatttatcttttgcacccggactttaaattggaaaaagctgcgtatttatctggacgagcggcgcgacgtgctggacgatctcgtgaccctccataacttccggaaccaattcctccccaacgcactgcgggaattctttaggcacatacacgctcctgaagaaaggggtgaatatctggagaccctgatcaccaaattcagtcataggttctgtgcgtgtaacccggatctgatgagggagttaggtcttagcccagacgctgtctacgtcctctgctattcgctcatattgctcagcatcgatctgacatccccccatgtgaagaataagatgtccaaaagggagtttattcgtaacacccgaagggctgcccagaacatctccgaggattttgtgggccacctctatgataacatctacctgatcggccacgtggctgcatag

SEQ ID NO: 187662 - DNA, 960 bp, Artificial Sequence
  Description of Artificial Sequence: Synthetic coding sequence
atgggccagggcctgtggcgggtggtgcggaaccagcagctgcagcaagaaggctacagcgaacaggggtatttgacaagggagcaatccaggcggatggctgctagcaatatatctaacacaaaccacaggaagcaggttcagggagggatcgacatctatcatttactgaaggctaggaagtctaaggagcaagagggtttcatcaatctcgaaatgctgcccccagagctcagtttcacgattctgtcatatctgaatgctacagatttgtgtctggcctcctgcgtttggcaggaccttgccaatgacgagctgctgtggcaaggcctgtgtaagtcaacttggggacattgcagcatctataataagaatccgcctttaggcttctccttcagaaagctctatatgcagctggatgagggtagcctcacattcaacgccaacccggatgaaggagttaattattttatgtcaaagggcatactcgatgattctccgaaggaaatcgctaagttcatattttgcactcgaaccctcaactggaaaaaactgaggatatacctcgacgagaggagggatgtacttgacgacctggtgacccttcacaatttcagaaaccagttcttgccaaacgctctgcgagaattcttccgacacatacatgcccctgaagaaagaggagagtacctggaaacactgattaccaagttttcccatcgtttttgtgcttgcaatcccgatttaatgcgtgaactgggactatcgcccgatgccgtgtacgttctatgttattccttgattctactgtctatagatctcacctctccgcacgtgaaaaacaaaatgtccaagcgcgagttcattagaaatactcgcagagcagctcagaatatttccgaggacttcgtgggccatctgtacgacaatatctatcttatcggacacgtcgcagcctag

SEQ ID NO: 187663 - DNA, 555 bp, Artificial Sequence
  Description of Artificial Sequence: Synthetic coding sequence
atgggccagggcctgtggcgggtggtgcggaaccagcagctgcagcaggagggatattcagaacaggggtacctgacccgggagcaaagtagacgcatggcggccagtaacatttcaaacaccaatcaccgcaaacaggtgcagggtggtatagatatataccatcttctgaaggcccggaaatcaaaggagcaggaaggcttcattaatttggagatgctaccaccagagctgtcctttacaattctgtcttatctgaacgcgacagacttgtgcctggcatcttgcgtgtggcaggatttagccaatgacgagctcctgtggcagggcctgtgcaaatccacttggggccattgcagcatctacaacaaaaatcccccactgggattctcttttagaaagttgtatatgcagctggatgaaggttccctgaccttcaatgcgaacccagatgaaggtgttaactatttcatgtccaaaggaatattggacgactccccgaaagagatcgctaaattcatattttgtactagaaccctgaattggaagaaatag

SEQ ID NO: 187664 - DNA, 1344 bp, Artificial Sequence
  Description of Artificial Sequence: Synthetic coding sequence
atgcccgacatcatctgggtgttccccccccaggccgaggccgaggaggactgccacagcgatacggtcagggccgacgatgatgaggagaacgagtcaccggccgagaccgatcttcaagcacagctgcagatgtttcgggcccagtggatgtttgagttagcccccggggtgagctcatccaatctggagaatagaccatgccgggcagcccgggggtccctgcagaagacttctgccgatactaaaggtaagcaggaacaggccaaggaagaaaaggctcgagaactctttttgaaagctgtagaggaggagcagaacggcgctctctacgaggccattaaattctatcgaagagccatgcagttggtccccgacattgagtttaagataacctacactcgtagcccggatggggacggtgtcgggaatagctatatagaagataatgatgatgattctaagatggctgacctgctgtcctacttccagcagcagctcactttccaggagagtgtgcttaagctttgccagcccgagttagaaagtagtcaaattcatatttccgttctgcccatggaagttctgatgtacattttccgctgggttgtctcatctgacctggacctgaggtcactcgagcagctcagcctagtatgcaggggtttctacatatgcgctcgggatcccgaaatctggaggttagcctgcctgaaggtgtggggacggagttgcatcaagttggtaccgtacacaagttggagggaaatgtttctcgaaaggcctagggtgcgcttcgatggcgtgtacatttccaagactacctatattcggcagggagagcagagcctggacgggttctaccgggcctggcaccaggtggaatactataggtatatcagattttttcccgacggccatgtgatgatgctgaccacaccggaagaaccgcagagtatcgtgcctcgacttagaactcgcaacaccagaaccgacgccatcttgctaggccattatagactgtcccaggacacagacaaccagacaaaagtctttgcagtgatcacaaagaagaaggaagaaaagccactggactataaatatagatactttcggcgggttcccgtgcaggaggccgatcagtcatttcacgtgggactgcagctgtgttcgagcggccaccaacggtttaacaagctgatctggatacatcatagttgccatattacgtataaatcaactggtgagactgctgtatcagctttcgagatagacaagatgtacacgcccttgttcttcgcaagggttcgctcgtacacagcattctctgagaggcccctgtag

SEQ ID NO: 187665 - DNA, 1314 bp, Artificial Sequence
  Description of Artificial Sequence: Synthetic coding sequence
atggccgaggccgaggaggactgccacagcgacaccgtgcgggccgatgatgatgaagaaaatgagtctccagcggaaaccgacttgcaagcccagctacaaatgtttagagcgcagtggatgttcgaactcgcgcccggagtgtcatcctccaatcttgaaaatcgcccgtgccgagccgcgcgaggatctttacagaaaacatcagctgataccaagggaaagcaagagcaagcaaaggaggaaaaggctcgcgagctgtttttgaaagcagttgaagaggaacaaaacggcgcactgtacgaggcaatcaagttctatagaagggctatgcagcttgtgccagacattgaattcaagatcacctatactcggtccccggacggcgatggagtaggcaattcctacatcgaagacaacgatgatgattcaaagatggccgacttgcttagctactttcagcaacagttgacatttcaggagtctgtgttgaagctgtgtcagccagagctcgaatctagccaaatccacattagtgtcctaccaatggaagtcctcatgtacatctttcgctgggtggtttccagcgatctggacttacgaagtctcgagcagctgtctcttgtgtgccgaggtttctatatctgcgcacgcgatcccgaaatttggcgcctggcctgcctgaaggtatggggacgaagttgcataaagctagttccatacaccagttggagggagatgttcttggagcgcccaagggtaaggtttgacggagtgtacattagcaaaactacttacattagacagggtgaacaatcattggacggcttttacagggcatggcaccaggtggagtactatcgttatattcggtttttcccagacggtcacgtgatgatgctcactacccctgaggagcctcagtccatagttcctcgccttcgtacacgtaacacccgtactgacgctatcctgctgggccactacagactgtctcaggatactgataatcaaacgaaggttttcgccgtcattaccaaaaagaaagaagagaagcccttggactataagtaccggtacttcagacgcgttcccgttcaggaagcagaccagtcattccacgtcggtctgcagctgtgtagctcaggccatcaacgtttcaataagctgatatggattcaccatagctgccacataacctacaaatcgactggggagacagctgtgtccgctttcgagattgacaaaatgtacactcctctcttctttgcacgggtccggtcttatacggcattttctgagcgtcctctgtag

SEQ ID NO: 187666 - DNA, 1212 bp, Artificial Sequence
  Description of Artificial Sequence: Synthetic coding sequence
atgttccgggcccagtggatgttcgagctggcccccggcgtgagctccagcaatttagagaatagaccctgccgggccgcacgagggagcctgcagaagactagcgccgacactaaagggaagcaagagcaggccaaagaggagaaagctcgtgagctcttcttaaaggcagtggaggaagaacagaatggagccctctatgaggctattaagttttatcgcagagctatgcagctcgtcccagatatcgaatttaagatcacatatactagaagtccagacggcgatggtgttgggaactcatatatcgaggacaatgatgacgacagcaaaatggccgacctcctatcatatttccagcagcagttgacattccaagagtcagtgctaaagctgtgccagcccgagcttgagagctcacaaatacacatttccgtgttgccaatggaggtgcttatgtacatcttcaggtgggttgtgtctagtgatctggatcttcgctctctagagcaactgtcgttggtttgtagggggttctacatttgtgcacgcgaccctgaaatttggagacttgcatgcctgaaagtgtggggacgatcctgcatcaaactggtgccctatacgtcttggcgggagatgttcctcgaacgacctcgggtgcgtttcgacggagtctatatttctaaaacaacatatatccgacagggtgaacagagcttggacggtttctatcgtgcctggcatcaggttgagtactacagatatattcgctttttcccggatggccatgtgatgatgctgacaacccctgaggaacctcagtccattgtgcctcgtctacggactcggaatacacgtaccgatgcgatactactcggacattacagactttcccaggatactgacaatcagacaaaggtgtttgcagtgatcacaaaaaaaaaggaagaaaagcctttggactataaataccgttacttccgtagagtgcctgtgcaggaggccgatcagagctttcatgtgggccttcagctttgcagttctggtcaccaacgctttaacaagctcatatggatccatcactcatgccacattacttataagtctacaggtgaaacggccgttagtgctttcgagatcgataagatgtatacacccttgttttttgcccgggtgcggtcatacacagcctttagcgagagacccctatag

SEQ ID NO: 187667 - DNA, 147 bp, Artificial Sequence
  Description of Artificial Sequence: Synthetic coding sequence
atgttccgggcccagtggatgttcgagctggcccccggcgtgagcagctccaacctagaaaacagaccatgcagggccgctcgcggctcgttgcaaaagacttctgccgacaccaaaggaaaacaggagcaggctaaggaggaatag

SEQ ID NO: 187668 - DNA, 357 bp, Artificial Sequence
  Description of Artificial Sequence: Synthetic coding sequence
atgttccgggcccagtggatgttcgagctggcccccggcgtgagcagctctaatttggagaatcgaccttgtcgagctgccagaggttctttacagaagaccagcgccgacactaagggaaaacaggagcaggctaaagaggagaaggctagggaactctttctgaaagcagtggaagaggagcagaacggtgcactgtacgaagcaataaaattctatagacgagctatgcagctagtgcctgacatagaattcaaaatcacttatacaaggtcacctgacggggacggagtgggaaatagttacatagaagacaacgacgacgatagcaaaatggccgacctcctttcatactag

SEQ ID NO: 187669 - DNA, 438 bp, Artificial Sequence
  Description of Artificial Sequence: Synthetic coding sequence
atgttccgggcccagtggatgttcgagctggcccccggcgtgagcagctccaacctggaaaatcgcccctgcagggccgccagggggtcgctacaaaaaacttccgcagatactaaagggaaacaagagcaggccaaggaagaaaaggcaagggaactctttttaaaggctgtcgaagaagaacagaacggtgctctttacgaggctattaagttttatcggcgggctatgcagcttgtgcccgatatagaattcaagattacttacacgaggtctccagacggtgacggggttgggaacagctatatagaagacaacgacgatgacagcaaaatggctgacttgctgtcctactttcagcagcagttgaccttccaagaatccgtgctgaagctatgccaacccgaactggaatcatcgcagattcatatttcttag

SEQ ID NO: 187670 - DNA, 3132 bp, Artificial Sequence
  Description of Artificial Sequence: Synthetic coding sequence
atgcggcggttcaagcggaagcacctgaccgccatcgactgccagcacctagccaggagccacctagctgtcactcaaccttttggacagagatggacgaatagggatcccaaccacggactctaccccaaacctaggaccaaaaggggctctaggggccagggctcccagcgttgtattccagagtttttcctggccggcaagcagccgtgtacgaatgacatggccaagagtaattcagtcgggcaggattcctgtcaagactccgaaggagacatgatctttcctgctgaatcctcctgtgcgcttcctcaggagggctcagctggaccggggtcccctggatccgcgcccccaagccgaaagaggtcctggagtagcgaggaggagtctaatcaggctaccggaactagtaggtgggatggagtgtccaaaaaggccccacggcaccacctgtccgtaccatgtactagacccagagaggcacggcaggaagccgaagattcaacctctagactctcagctgaaagcggtgaaaccgatcaagacgccggggacgtgggcccggacccgatacctgattcctactacgggcttctcggtacccttccctgccaagaggccttatcccacatctgtagccttccatcagaggtgctcagacacgtgtttgcgtttctgcccgtggaagacttgtattggaatctgagcctcgtctgccatctctggcgggagattattagtgaccccctgtttattccttggaagaagctgtaccaccgctacctgatgaacgaagaacaagcagtcagcaaagtggacggcatcctgagcaattgcggcattgagaaagagtccgacctgtgcgtgttgaatctcattagatacaccgcgaccacaaagtgcagtccgtccgtggatccggaaagagtgctctggtccctgcgggaccatcctcttctcccagaagccgaggcctgtgtgaggcagcatctgccggacctctatgccgcagccgggggcgtcaatatttgggcactagtggccgctgtggtccttctcagttcaagcgtaaacgatattcagcgccttttgttctgcctgagacgcccttcatccaccgttaccatgccagacgttaccgagaccctgtattgtatcgccgtgcttctctacgctatgcgggaaaagggaattaatatcagcaacaggatccattacaatattttctactgcctttatctgcaggagaatagctgcacgcaagcgactaaggttaaagaagagccctctgtatggcccggaaagaaaacgatccagctaacgcacgaacaacaactcatattgaaccacaagatggaacctctccaggtagtcaagataatggcctttgccggaacagggaagacatctacactggtgaagtacgccgaaaaatggtcgcaatcccgatttctctacgtcacctttaacaagtcaattgccaaacaggccgagagagtatttccttcaaacgtgatctgtaagacttttcattcaatggcctacggccacattgggcggaagtaccagagcaagaaaaagttaaacctgttcaagctgaccccattcatggtgaacagtgttctggctgaaggcaaaggaggattcataagggctaaactggtctgtaagacgcttgagaacttctttgcctcagcagatgaagaactgacaatagatcacgtaccgatctggtgcaaaaactcacaggggcagagggtgatggtagaacagtcagaaaagctgaatggcgttctggaggctagccggctctgggacaatatgcggaagctgggagagtgtacagaagaagcgcaccagatgacgcatgacgggtacctcaaactttggcagctttccaagcctagtctcgcctctttcgacgcaattttcgtcgacgaggcacaggactgtacaccagctataatgaatattgttctcagccagccctgtggcaagatctttgtgggagacccacaccagcagatatataccttccggggcgcggtgaacgccctattcaccgttccacacactcacgtgttctacctgacccaatcattcaggtttggggttgagatagcatatgtgggagctaccatcctggatgtctgtaagcgcgtgagaaagaagaccctcgtggggggaaaccaccagagcggcattcggggagatgccaaagggcaggtcgcactgttaagccgcacgaacgccaacgtgttcgatgaagctgttcgcgtcacggaaggcgagttcccttctagaatacacttgataggaggcatcaaatcattcggcctggatcgaatcattgatatctggattctgttgcagccagaagaggaaaggagaaaacagaatctcgtgatcaaggataaattcatcagaaggtgggtccataaggaaggcttctccggattcaagcgttacgtgaccgctgccgaagataaagaactcgaagccaagatagcagtagtggaaaagtataatatccggatcccggagcttgtccagagaatagagaaatgccacattgaggaccttgattttgcagagtacatccttggcacagtgcacaaggcgaagggacttgaattcgatacggtgcatgtgctggacgattttgtgaaggtgccttgcgcaaggcacaacttgccccagttgccacactttcgcgtggaatcgttctccgaagatgaatggaacctgctatacgtggccgtcacacgcgccaagaagaggctcattatgacgaagtcattagagaacattctgacgctggcgggagaatacttcttgcaagcggagctcacatccaatgtcttgaagacaggggtcgtccgttgctgcgtgggccaatgtaacaacgcaatccctgtggatactgtgctaacaatgaagaaacttcctattacgtactccaacaggaaggagaacaagggcggctatctatgccacagttgtgccgagcagagaatcggccccctggcctttttgactgcttctccagaacaggtgcgggcaatggaacgcactgtggaaaatattgttttgcctaggcacgaggctctgctgttcctcgtattttag

SEQ ID NO: 187671 - DNA, 1215 bp, Artificial Sequence
  Description of Artificial Sequence: Synthetic coding sequence
atgaacgaggagcaggccgtgagcaaggtggacggcatcctgagcaactgcggaattgagaaggaatcggatctttgtgttctcaaccttattagatacacagccacaactaagtgttccccctcggtggaccccgagcgtgtgctttggtcccttagggaccacccactgctccctgaggccgaggcctgcgtgcgtcagcacctgcctgacctgtatgcagcggctggcggtgtgaacatttgggcactggttgcagcggttgtactgctatcctcttcggtgaacgatatccaaaggttgctattttgcttgaggcggccatccagcacagttaccatgcccgacgttacagagactctgtattgtatcgctgtactgctgtacgctatgagagagaaggggatcaacatcagcaatcgcattcactacaacattttctattgtctgtacctgcaggaaaattcgtgtacacaggcaaccaaggtgaaggaagagccatccgtgtggcccggcaagaaaaccatacagttgacgcatgagcagcagctcatcttaaaccacaaaatggaacccttgcaggttgtcaaaatcatggcctttgccggcacaggcaagaccagcaccctcgtgaagtacgctgaaaaatggtcacagtctaggttcttgtatgtgacctttaacaagtcgatcgcgaagcaagctgaacgggtattcccatccaacgtaatctgcaagacttttcattctatggcttacggtcacattggtaggaagtaccagtccaaaaaaaagttgaacctttttaagctaacaccctttatggtaaattcagtcctggccgagggcaagggtgggtttatacgagccaaactcgtgtgcaagacattggagaatttcttcgcatccgccgacgaagagcttaccatagatcatgtaccgatctggtgtaaaaattctcagggccagcgcgtcatggtggagcagtccgagaaattaaacggagttctggaggcgtcccgcctgtgggataatatgagaaagttgggagagtgcaccgaggaggctcaccagatgacccacgacggatacctgaaattgtggcagctgagtaagccgagtttggcaagtttcgacgctatcttcgtagacgaggcgcaagccggtgctcgacatggcgcccactgtggtgagcatagaaccgctcccgcatag

SEQ ID NO: 187672 - DNA, 3285 bp, Artificial Sequence
  Description of Artificial Sequence: Synthetic coding sequence
atgagctacgaggtgaccagcggctgccactggacctgccaggtgcctgaatcttgtgataacggcctacattgtgctgggcctctgggtcatttacacaggcgctgtcagagaacctctgctcatttacttgtatttactgaacatgcagagatgaggaggtttaaacgaaagcacctgacagctatcgactgccagcacctcgcgcggagccacctggctgtgacacaaccattcgggcagagatggaccaatcgcgaccccaaccacgggctctacccgaagccccgcaccaagcgtggctcccggggccaaggctcacagcggtgtatccccgagttctttttggcaggcaaacagccatgcaccaacgacatggcaaaaagtaacagtgtgggccaggatagctgtcaagattccgaaggcgatatgatctttccagccgagagctcatgcgctctaccccaggagggcagtgccgggcccggctctccaggatccgctccaccatcccgtaaacgatcgtggtcctccgaagaagagtccaaccaggccactggtacaagtcgatgggatggcgtgtccaaaaaagctcccagacaccatttgagcgtgccatgtacacgcccacgagaagcacggcaggaagccgaagattctacctcccgtctttccgccgagtccggcgagaccgatcaggatgctggggacgtgggcccagacccgattcccgacagttactatggtctgctgggtactttaccgtgtcaggaagccctgagtcatatctgctccctaccttctgaggtgctccggcacgtattcgcattcctgccagttgaagatctgtactggaacctctctcttgtgtgtcacctttggcgagaaatcatttccgaccctctgttcatcccctggaagaagctatatcataggtatctgatgaatgaagaacaggctgtctcgaaggttgacggcatacttagtaactgtggcatcgagaaagaatccgatttgtgcgtcttgaatttgatacggtatacggcaaccaccaagtgctcccctagcgttgatccagagagggtactttggtccctacgcgatcacccattgctccctgaagcagaggcatgcgtacgccagcacctgccggatctgtatgcagctgcaggcggagttaatatatgggcgttggtagcggctgtggtcttgctgtcatcctccgttaacgatatacaacgcctacttttttgcctgagaaggccaagtagcaccgtgacgatgccagatgtgactgaaaccctgtactgtatcgcagtgctactgtacgctatgcgcgaaaaaggcattaacatctccaataggatccattataatattttctactgtctgtatcttcaagaaaatagttgtactcaagccacaaaagtgaaagaagaaccttccgtgtggccgggtaaaaaaactatccaactcacccatgagcagcagctgattctgaaccacaaaatggagccgctccaggtcgttaaaataatggcgtttgccggtactggtaagacctccacactggtcaagtatgcggagaaatggtcccaatcgcgcttcctgtacgttacctttaataaaagcatcgcaaaacaggccgagcgagtctttcctagcaacgtgatctgtaaaaccttccatagtatggcatatgggcacatcggcagaaagtaccagtctaagaaaaaattaaacttgttcaagctcacgcctttcatggtgaattctgtccttgcagaaggaaaaggaggtttcatcagagccaaactggtctgtaagactttggagaatttctttgcatctgctgacgaggagctcactatcgatcatgtgcctatttggtgtaagaacagtcagggacagcgggtcatggttgaacagtcggaaaaactgaatggagttctcgaagcatctaggttgtgggacaacatgcggaagttgggtgaatgcaccgaggaagctcatcagatgactcatgatggttatctgaaactttggcagctgagtaaaccctccttggcctcctttgatgctatcttcgtagatgaggcacaggactgcacccctgccataatgaatatcgtcctgagtcagccttgcggcaaaattttcgtcggggacccccaccagcaaatctacacctttcggggcgccgtgaatgccttgttcacagtcccacatacacatgtgttctacttgacccagtcatttcgcttcggggtcgaaattgcatacgttggggctaccatcctagatgtgtgtaagagagtgcgaaaaaagaccctcgttggggggaatcaccagtccggcattcggggagacgccaagggccaggtggctctcctgagcagaaccaatgctaatgtgttcgacgaggccgttcgagtaaccgagggggagttccctagtcgtatccacttgattgggggcatcaaaagctttggattggacaggatcatcgacatctggattttgttgcaacctgaggaagagcggagaaagcagaacctggtgatcaaagataagttcattagaagatgggtccataaagagggctttagtggattcaaaagatacgtcacggccgctgaggacaaggagctcgaagctaaaattgcggtggtcgaaaaatacaacatccgtattcccgaactcgttcagaggattgagaagtgtcacattgaggacttggatttcgccgaatacatcctgggaaccgtacataaggcgaaggggcttgagtttgatacggtgcacgtcctggacgacttcgtcaaggtcccttgcgcaagacacaatttgccacagctgccccacttccgggtcgagagttttagtgaggatgagtggaatctgctctatgtggccgtcaccagggccaagaaacggcttattatgaccaagtcattggaaaacattttaactctcgccggtgagtattttctgcaggccgagcttacctcaaatgtgctgaagacaggggtggtcagatgctgcgttggccaatgcaacaacgctatacctgttgacaccgtactgactatgaaaaaactgcctatcacctattcgaacagaaaagagaataaagggggctatctgtgccactcctgcgccgagcagagaatcggacctttagctttcctgacagcttcgccagagcaggtcagagccatggaacggactgttgagaacattgttctgccacggcacgaagcgttactttttctcgtgttctag

SEQ ID NO: 187673 - DNA, 1644 bp, Artificial Sequence
  Description of Artificial Sequence: Synthetic coding sequence
atggcctacggccacatcggccggaagtaccagagcaagaagaagttgaacttgtttaagctgacccctttcatggtgaattcagttctcgctgaagggaagggcggatttatccgcgccaagctggtgtgcaaaaccctggagaactttttcgccagcgctgacgaggaactgactatcgaccacgtcccaatctggtgcaagaattctcagggccagagagttatggtcgaacagagcgagaagttgaacggtgtcttggaagcctcacggttatgggacaatatgaggaaattgggtgagtgcacagaggaagcccaccaaatgacacatgatgggtatcttaaactctggcagctgtccaaaccctcactggcatcctttgacgccatttttgtggacgaggcacaggattgtacaccagccattatgaacatcgtcctctcgcagccctgtggcaaaatttttgtgggagacccacatcagcagatctacacattccgcggcgccgtgaacgctttatttaccgtgccacacacccacgtcttttatctaacccaatcatttcgattcggcgttgagatagcttacgtaggggccaccatcctggatgtatgtaaaagggtccgcaaaaagacgcttgttggggggaaccatcagtctgggattcgcggcgacgcaaaagggcaagtcgctttgctgtccagaaccaatgcaaacgtgtttgacgaagctgtgcgagttacggagggagaatttccctctcgcattcacctcataggcgggatcaagagttttggactagacaggatcatcgacatatggatacttctccagccagaggaggaaaggagaaagcaaaacctggtcatcaaggataaattcattcggcgttgggtccacaaggaaggtttcagtggattcaagcggtatgttacggctgccgaagataaagagttggaagctaagatagctgttgtagaaaagtacaacatccgcatccctgaactcgtgcaacgcatagagaaatgtcacatcgaagacctggacttcgccgaaatggagagccatcatgtaggccaggctggactggaacttcccaccagcgaatacatcctggggaccgtccacaaagcaaaggggctggagtttgataccgtgcacgttttggacgacttcgtgaaagtcccttgtgcacgacacaacttgccacagctcccacacttcagagtagagtcattttcagaagatgagtggaatctactctatgtggccgtgaccagagcgaaaaagcgtctgatcatgactaaaagcctggagaacatcctcactctggcaggggagtactttctgcaggcagaattgactagtaatgttcttaagaccggtgtggtgcggtgttgcgttggccaatgcaacaatgctatccctgtggacaccgtgttgaccatgaagaaactcccaatcacttactccaaccgcaaagagaacaagggaggctacctctgccattcttgtgccgaacaacgaattggcccgctggctttcctgacggcatcaccggaacaggtgagagcaatggaacgtacagtcgaaaacatcgtactcccgagacacgaggctctgcttttcctggtgttttag

SEQ ID NO: 187674 - DNA, 1215 bp, Artificial Sequence
  Description of Artificial Sequence: Synthetic coding sequence
atgaacgaggagcaggccgtgagcaaggtggacggcatcctgagcaactgtggcattgagaaggagtcagatttatgtgtgttaaatctcatcagatatactgccactacaaaatgtagcccaagcgtcgacccagaacgtgtcctttggagccttagagaccatccacttttgcccgaagccgaagcctgtgtgcggcagcacctacccgacctgtacgcagctgcaggcggcgttaacatctgggccttggtggctgcagtggtgctcctgtctagcagcgttaatgacatccaacggctgctgttctgcctccggaggccatcaagcacggtaacgatgcccgacgttactgagacactatattgcatagcggtcctgctgtatgccatgagggaaaaggggatcaacatatctaacagaatacattataacattttctactgtctctacctccaggagaattcttgcacccaggccactaaagtcaaagaggaaccctccgtgtggccaggaaagaagacaatccagcttacccatgagcagcagctgattctgaaccacaaaatggaaccactacaggtagtgaaaataatggcttttgcgggtactgggaagactagcacactcgtcaagtacgccgaaaagtggagtcagagccgctttctctacgtcacctttaacaaatcgatcgccaagcaggcggaacgagtgttcccctcgaacgtgatatgcaagacgtttcactctatggcgtacgggcatattgggcgaaagtaccagtcgaaaaagaaactgaacttgttcaagttgactcccttcatggtcaattctgtgcttgccgaaggtaagggcggatttatacgtgccaaactggtttgtaagactctagagaatttttttgcttctgccgatgaggaactcaccattgaccacgtgcctatctggtgcaaaaatagccaggggcaaagagtgatggtcgagcagagcgaaaagctcaacggggtgttggaagcttctaggctgtgggataatatgaggaagctgggagagtgcacggaggaggcgcatcagatgactcatgacggttatctcaagctgtggcagttgagcaaaccctccctggcctcatttgacgctatctttgtcgatgaagcccaggccggcgcccgacacggggctcactgtggcgaacacaggaccgccccggcctag

SEQ ID NO: 187675 - DNA, 576 bp, Artificial Sequence
  Description of Artificial Sequence: Synthetic coding sequence
atggaccccaagcagaccaccctgctgtgcctggtgctgtgcctgggccagcggatccaggcacaggagggagacttccctatgccattcatctcagccaaaagcagccccgttatccctctcgatgggtccgtcaagatacagtgtcaagcaatacgagaagcctacctaacgcagctcatgatcatcaagaatagcacatatcgagaaattggcaggcgcctcaaattttggaacgagactgatcctgaatttgtgatcgaccatatggacgccaacaaggccggacgataccagtgtcagtatcgcattgggcattaccgtttcaggtattccgataccctcgagctcgttgtgactgactctattcaccaggactacacaactcagaatctgataaggatggctgtcgccggccttgtgctggtggcgctactcgcaatcctggtcgagaattggcattcacacaccgcccttaacaaggaggcttccgctgacgtagccgaacccagttggtcccagcagatgtgtcagccagggttgacattcgcacgcacccccagcgtgtgtaaatag

SEQ ID NO: 187676 - DNA, 537 bp, Artificial Sequence
  Description of Artificial Sequence: Synthetic coding sequence
atggaccccaagcagaccaccctgctgtgcctgggcctgtacggcaagccttttctctcggccgaccggggcctggttttgatgcctggggaaaacataagtctcacctgcagcagcgcacacattccttttgatcgcttctcccttgctaaggagggggagctcagccttccccagcaccagtcaggggaacatcctgccaatttctcccttggacctgtagatttaaatgtgtcaggcatctacaggtgctacggatggtacaatagaagcccttatctatggagttttccatccaacgcgctggaattggtcgtgaccgacagtattcaccaggattacactacccagaacctgataaggatggcagtcgccggtcttgtgctggttgctcttctggcgatcctggttgaaaattggcactcccataccgctctgaacaaggaggccagcgcagatgtcgctgagccatcctggagtcagcaaatgtgtcagccggggttgaccttcgctcgcactcctagtgtgtgtaagtag

SEQ ID NO: 187677 - DNA, 864 bp, Artificial Sequence
  Description of Artificial Sequence: Synthetic coding sequence
atggaccccaagcagaccaccctgctgtgcctggtgctgtgcctgggtcaacgcattcaggcccaagaaggggactttccgatgccctttatctcagccaaatccagcccagttatcccgttagacggctctgtcaaaattcaatgccaggcaatccgggaagcttacttaacacagctcatgatcatcaagaactctacctatcgggaaattgggcggcgattaaagttctggaatgagacggatcctgaatttgtcatcgaccacatggatgcaaacaaggccggcaggtaccagtgccagtaccgcatcggccattatcgtttcaggtatagcgacacactggaattggtggtcacaggtttgtacggcaaacctttcctttctgcggatagagggttggtgctaatgcccggcgaaaacatctctcttacctgctcgagcgctcatatcccctttgatcggttcagtctggccaaggaaggcgaactcagcctgccccagcaccagtccggcgagcatcccgcaaatttcagcttgggacctgtagaccttaacgtaagtgggatctaccggtgctatgggtggtacaataggagcccttatctgtggtctttcccaagtaacgccctggagcttgtcgtgaccgacagcatacaccaagactatactacacaaaacctgatcagaatggctgtggcaggactggtcctggtggcactgctcgccatacttgtagaaaattggcatagtcacacagccctgaataaagaagcttccgccgatgtcgctgagccctcttggagccagcaaatgtgccagcctggactgacttttgcacgcaccccttcagtgtgtaaatag

SEQ ID NO: 187678 - DNA, 828 bp, Artificial Sequence
  Description of Artificial Sequence: Synthetic coding sequence
atggaccccaagcagaccaccctgctgtgcctgggcgacttccccatgccatttatcagcgccaagtcttccccggtgatacctttggacgggtctgtcaagatccaatgtcaagccattagggaagcataccttactcagttgatgattattaaaaacagtacttatcgagagattggacggcggctaaagttttggaacgaaaccgatccagagttcgtgattgaccacatggatgcaaacaaggcaggaaggtatcagtgccagtaccgcataggtcactaccgatttcggtattcagatacactcgagctcgttgtgacgggcctctatggtaaaccatttctctctgccgaccgcgggcttgtgctgatgcccggagagaacatttctctgacatgtagctcagcacatattccctttgaccgctttagcctggccaaagagggggagctcagcctgccacaacatcagagcggcgaacacccagccaatttctccctggggcccgtcgacctgaacgtctcaggcatttacagatgttacggatggtacaaccgcagcccatatttatggagcttcccatccaatgctctggagctcgtagttaccgactccattcatcaggattacactacccagaatctgatccgaatggcggtggcaggcctagtgctagtagctctactggctattcttgtggagaattggcatagtcacacagctctgaacaaggaggccagcgcagatgtagccgagccttcatggtctcaacagatgtgccagccaggtctgacctttgcgcggactccctccgtgtgcaagtag

SEQ ID NO: 187679 - DNA, 630 bp, Artificial Sequence
  Description of Artificial Sequence: Synthetic coding sequence
atggaccccaagcagaccaccctgctgtgcctgggcgacttccccatgcccttcatctccgcaaagagctcccctgtcatcccacttgacggatccgtgaagatacaatgtcaggcaatccgcgaggcctatctgacacagctgatgatcattaagaattctacatatagagaaatcggtcggaggttgaagttttggaacgaaaccgaccccgagttcgtaatcgatcacatggacgctaataaagctgggaggtatcagtgtcagtatcgcattggacactaccggttcaggtattcggacacactggaactggtagtgaccggtctgtatggcaaaccctttctatctgcagaccgaggtctggtgctgatgcctggggaaaatatctcccttacctgtagcagtgcccacattcccttcgaccgattctccttggcaaaggagggagaactctccctgcctcagcaccaaagcggagagcacccagcaaacttttccctaggccctgttgacttgaacgtctcaggtatctatagactccacccgccccgactccacgatgccgagctcgaccctcacgggaggggaagaaccgggcctagaggatcactggggcatacagggtag

SEQ ID NO: 187680 - DNA, 762 bp, Artificial Sequence
  Description of Artificial Sequence: Synthetic coding sequence
atggaccccaagcagaccaccctgctgtgcctgggcgacttccccatgccttttataagcgccaagtccagtcctgtgattcccctcgatggctctgtcaagattcagtgtcaggcaattcgcgaggcttatctaacacagttaatgataatcaagaacagcacctacagagaaattgggagacgactcaagttttggaacgagactgaccctgaatttgtgatcgatcatatggacgctaataaggcggggaggtaccagtgtcaatatagaattggacactacagattccgctacagtgacaccttggagttggtggtgactggcctgtatggaaagcccttcctctccgccgatagaggcctggtgctcatgccgggcgagaacatcagcctgacttgtagcagtgcccatatcccttttgatagattttccctggcgaaagaaggggagctttcgttacctcagcatcagtctggcgagcatcccgccaacttcagcctgggccctgtggatttgaacgtgtcaggtatttacaggtgttacgacagtatccatcaggactatacaactcagaacctgatacgcatggctgtggccgggttagtcctggtggcacttctggcgatcctggtggagaactggcattctcacacagctcttaacaaggaagctagcgctgatgtggcagagcctagctggtcccaacagatgtgccagcctgggttgacattcgccagaacaccttccgtgtgcaagtag

SEQ ID NO: 187681 - DNA, 798 bp, Artificial Sequence
  Description of Artificial Sequence: Synthetic coding sequence
atggaccccaagcagaccaccctgctgtgcctggtgctgtgcctgggccagagaattcaggctcaagaaggcgactttcctatgccatttatttccgcaaagtcatcccctgtcataccactggatggctctgtgaaaatccagtgccaagctattagagaagcctaccttacacagcttatgatcattaagaacagtacctaccgtgagatcggtcgacgcctcaagttctggaatgaaaccgaccccgagtttgtaattgaccacatggatgcgaacaaagcagggcgctaccagtgtcagtaccgcatagggcattatagatttcggtattccgacactctggaactggtcgttaccgggctgtacggcaaaccgtttctgtccgcagaccgagggttggtgttgatgccgggggagaacattagcctcacctgctcatccgcccatatcccttttgataggttcagtctggctaaagagggtgaactgtcactgccccagcaccagagcggcgaacacccagcgaacttctctctcggtcccgtcgacctcaacgtgtctggcatttatcgctgctatgattcaatccatcaggattacaccacacaaaacctgatcagaatggccgtcgccgggctggttctggttgcactcctagcaattctcgtagaaaactggcactcacacactgccctcaacaaagaagcttctgctgacgtagcagaaccgagctggtcccagcagatgtgccagcctgggttgacatttgctcgaaccccttctgtctgcaagtag

SEQ ID NO: 187682 - DNA, 540 bp, Artificial Sequence
  Description of Artificial Sequence: Synthetic coding sequence
atggaccccaagcagaccaccctgctgtgcctgggcgacttccccatgccctttataagcgcaaaatcctcgcctgtgatcccactggatggctccgttaagatccaatgccaagctatcagagaggcatatctcacacagttaatgatcataaaaaacagcacctaccgggagatcgggaggcggctcaaattttggaacgagaccgatccagagtttgtgattgaccatatggatgccaacaaggccgggcgctaccagtgtcaataccgtattggccattaccggtttaggtactcagatacattggagcttgtggtcactgattcaatccatcaagattacacaacccagaatctgattaggatggccgtcgcgggtctggtcttggtggctctgcttgccatccttgtggaaaattggcacagtcacacggctctgaataaggaagcaagtgccgatgtcgcagagccttcctggtcacagcagatgtgccagcccgggctcacctttgcaagaaccccttctgtgtgcaaatag

SEQ ID NO: 187683 - DNA, 720 bp, Artificial Sequence
  Description of Artificial Sequence: Synthetic coding sequence
atggaccccaagcagaccaccctgctgtgcctggtgctgtgcctgggtcaacgcattcaggcacaggagggggacttccctatgcctttcatttcagctaagtcttctcccgttattcctctggacggaagcgtgaagatacagtgccaggctattagagaagcctacctaacgcagctgatgattattaagaacagtacataccgcgagataggaaggcgcctgaaattctggaacgagactgatccagagtttgtcattgaccacatggacgccaacaaggctggaaggtaccagtgccaatatcggatcggtcattataggtttcgctattctgataccctggagttggtcgtgacaggactgtatggaaagccattcctatctgccgaccgggggttggtactgatgccaggcgagaacatcagcctaacttgcagtagcgctcacatcccttttgatcgattttccctggccaaagagggagaattatccttgccccagcaccaaagcggcgaacacccagccaacttctctttaggacctgtagacctgaatgtgtccggcatctaccggtgctatggctggtacaaccggtctccatacctgtggtcttttcctagtaacgcgctcgaactggtcgtgacaggtagatatagaccagtgcagccgtgcgtgtgggtgggatgtccaggcccctgtcaccgagccggaatctag

SEQ ID NO: 187684 - DNA, 774 bp, Artificial Sequence
  Description of Artificial Sequence: Synthetic coding sequence
atggcccccgccatggagagccccaccctgctgtgcgtggccctgctgttttttgctcctgacggcgtactcgcagtgcctcagaaaccaaaggtgtcacttaaccctccctggaatagaatatttaagggcgagaacgtgacactgacttgtaacgggaataacttcttcgaggtgagctcaacaaagtggttccacaatggatctcttagcgaggagacgaacagtagcctgaatatcgtgaatgccaaattcgaggactccggcgagtacaaatgccagcatcagcaggtgaacgagtctgaaccagtctacctggaggtgttttccgactggctgttgctgcaggcttctgccgaagtggtcatggagggccagcccctgtttctgcggtgtcacggttggaggaactgggacgtgtataaagttatatattacaaggacggcgaggcccttaaatattggtacgaaaatcacaatattagtattaccaatgccacagtggaggacagcggaacctattactgcaccggaaaggtatggcaactggattatgagagtgagccactcaacataaccgtcatcaaggccccaagggagaagtattggcttcaattttttatccccttattggtcgtcatactgtttgccgtggatactggcctgttcatttcgactcaacagcaggtgacatttctgttaaagattaagaggaccagaaagggattccgcttgctaaatcctcatcccaaacctaatccaaaaaataattag

SEQ ID NO: 187685 - DNA, 261 bp, Artificial Sequence
  Description of Artificial Sequence: Synthetic coding sequence
atgatccccgccgtggtgctgctgctgctgctgctggtggagcaggcggccgccctaggagaacctcaattgtgctacatcttagacgccatccttttcctgtacggcatcgtgctcactttgctctattgccgcctgaaaatacaggtccgaaaggctgccatcacctcatacgagaaatccgacggcgtctatactggcctgagcacacgaaaccaagagacctatgaaactctgaagcatgaaaaaccaccccagtag

SEQ ID NO: 187686 - DNA, 339 bp, Artificial Sequence
  Description of Artificial Sequence: Synthetic coding sequence
atgatccccgccgtggtgctgctgctgctgctgctggtggagcaggccgccgcattgggcgagccccagctctgttacatcctcgacgccatcctgttcctatatggcatcgtgctgacacttctctactgtcgcctcaagatccaagtgcgaaaggcagctatcacctcctacgaaaaatctgatggagtgtatactatggagtcgcctagcataacacgactggagtgttctggcatgatctgggcccactgtaatttgtgtctcttgggctctcgcgatagtagagcctcccctagtcgggtcgccaaaacaacgggcaccaccatgccgagttag

SEQ ID NO: 187687 - DNA, 792 bp, Artificial Sequence
  Description of Artificial Sequence: Synthetic coding sequence
tgatgcagcttcggcgtgcagctgatgggcaagtgggtgccctgggtctcggtgttccaagaagagacggtgaccctgcattgtgaagtgctgcacctgcccggatcaagctccactcaatggttcctaaatggcacggcgacacagacctctacccccagttaccgtataactagtgctagcgttaacgattccggggagtatcgctgccagagaggcctctccggtaggagtgaccccatccagctggaaatccaccgtgggtggcttttacttcaggtgtcctcccgggtgttcatggagggtgagccacttgcactgaggtgccacgcctggaaggataagcttgtgtacaatgtcctctactatagaaatggcaaggccttcaagttcttccattggaactccaacctgacgatccttaaaaccaacatatcccacaacggcacttatcactgcagtggtatggggaaacatcgatatactagtgccggtatctcccagtataccgtgaaaggcttacagctccctacgcctgtttggttccatgtccttttctatctggcagtgggcattatgtttttggtgaacaccgtgttgtgggtcacaatccggaaggagctgaagcgcaaaaaaaagtggaaccttgaaattagcttggactcaggacacgagaagaaggtgatcagtagtctccaggaggatcgtcacttggaggaggaactgaagtgccaggaacagaaagaggaacagcttcaagaaggtgtgcatcggaaggaaccccagggatag

SEQ ID NO: 187688 - DNA, 567 bp, Artificial Sequence
  Description of Artificial Sequence: Synthetic coding sequence
atgtggttcctgaccaccctgctgctgtggggctggctgctgctgcaggtctctagtcgggtttttatggagggcgagccacttgccctgagatgccatgcctggaaggacaagctggtgtataacgtgctctactaccgtaatggaaaggcattcaaatttttccactggaacagtaaccttacaatccttaagactaatatttctcacaatggcacttaccattgttcagggatggggaagcaccgatacacctcggcgggcatatctcagtatacagtgaagggactacagctgcctacccctgtctggtttcatgtgttattctacctcgctgtcggtattatgttcctggtgaatacagttctttgggtgaccatccgcaaagagctgaaacgcaagaagaaatggaatcttgagatttccctggacagcggacacgaaaagaaagttatttcctccctgcaggaggaccggcatttagaagaagagctgaaatgccaagagcagaaggaagagcagctgcaagaaggagtgcacagaaaagaacctcaaggcgcaacatag

SEQ ID NO: 187689 - DNA, 843 bp, Artificial Sequence
  Description of Artificial Sequence: Synthetic coding sequence
atgtggttcctgaccaccctgctgctgtgggtgcccgtggacggccaagtggatactactaaagctgtgatcaccctgcagcctccatgggtttctgtgttccaggaagagaccgttaccctgcactgcgaggtccttcacctgccaggctccagctcaacacagtggttcctgaacggaactgctacccaaacgtcgacacccagctatcggattactagcgcctcggtgaacgactcaggtgaatacaggtgtcagagaggcctgagcggtaggagcgatcccatacagctcgagatacacagagggtggttgctgctccaggtctcttccagagtttttatggagggagagcctctcgctcttcggtgccatgcctggaaggacaagctggtgtataacgtcctttactacaggaacggcaaggcattcaaattcttccactggaacagcaacctcacaatccttaagactaatatctctcacaatgggacttaccattgcagcgggatgggtaagcacaggtacacaagcgccggaatctcccagtataccgtgaagggattacagcttcccaccccagtgtggttccacgtgctgttctatctggcggtgggcatcatgttcctggtgaataccgttctgtgggtcaccatacggaaagaactaaagagaaaaaagaaatggaacctcgagatcagcttggatagcggccacgagaaaaaggtgataagttcactccaggaggacagacatctcgaagaggagttgaaatgccaagagcaaaaagaggagcagctccaagagggggtgcacagaaaagagccacaaggcgcgacgtag

SEQ ID NO: 187690 - DNA, 954 bp, Artificial Sequence
  Description of Artificial Sequence: Synthetic coding sequence
atgaccatggagacccagatgagccagaacgtgtgcccccggaacctgtggctcctccaacctctgacagtgttgctcctgcttgcatctgccgattctcaggcagcagctccaccgaaagctgtgctgaagcttgagcccccttggataaatgtgctgcaggaggactcagtaaccctgacttgccagggtgccaggagtcccgaatcagattctatccaatggtttcacaatgggaatttaatacccacccatacccaaccttcctatcggttcaaggccaataataatgatagcggagagtacacctgtcagacaggccagacgagtctgtcagatcctgtgcacctgaccgtcttgtctgagtggctggttctgcaaacgccacatttggaatttcaggagggagaaacaatcatgctgcggtgtcacagttggaaggataagcccctcgttaaggtcactttttttcagaatggtaaaagccaaaaattcagtcatttagatcctaccttttctattccacaggcaaatcattcacattcgggagattatcattgtactgggaacatcggctacacattgtttagcagcaaaccagtgactatcacagtgcaagtccccagcatgggatcgtcttccccaatgggtattatcgtggctgtggtgatagccacagctgtagctgctattgttgccgccgtggtagccctgatctactgtcgaaagaagcgaatctccgcaaatagcaccgaccccgtcaaggctgctcagtttgagcctcctggccgtcagatgatcgctatccgcaaacgccaactagaagaaaccaataatgattatgagactgccgatggaggttacatgacgcttaatccgagagcaccaactgatgatgataaaaacatctatcttacgttgcctcccaacgatcatgtcaacagcaacaactag

SEQ ID NO: 187691 - DNA, 951 bp, Artificial Sequence
  Description of Artificial Sequence: Synthetic coding sequence
atgaccatggagacccagatgagccagaacgtgtgcccccggaacttatggctcctgcagcctcttacagtattgctcctgctggcttcagccgactctcaggcagctcccccaaaggcagtcttgaagctggagccaccatggattaatgtcttacaggaggactctgtaacactaacatgtcaaggagcaagatcaccagagagtgacagcatccaatggttccataatggtaacttaatcccaacccatactcagcctagctaccgcttcaaagcgaacaataacgatagcggggaatacacatgccagactggacagacatcccttagcgacccagtgcatctcacggtgctctccgaatggcttgtgctccagacaccacacctggaattccaggagggcgaaacaattatgcttcgctgtcactcttggaaagacaaacccctggtgaaggtgacgttcttccaaaatggcaagtcccagaagtttagccacctcgaccccacgttttccattcctcaggctaatcatagtcacagtggtgattatcattgtaccggcaacattgggtacaccctctttagttcaaagcccgttaccatcacagttcaggtaccctccatgggtagttcatctcccatgggaataatagtggccgtggtgattgccacagcggtagcggctatcgtggccgcggtggtagctctgatttactgccgaaagaaaagaatttcagcaaatagcactgatcccgtgaaagcagctcagttcgaaccacccgggagacagatgatcgccatcagaaaacgccagctggaagagacaaataatgattatgagaccgcagatgggggttacatgactttaaatcctcgggccccaacagatgacgataagaacatctatctgaccctccccccgaacgatcacgtgaatagcaacaattag

SEQ ID NO: 187692 - DNA, 876 bp, Artificial Sequence
  Description of Artificial Sequence: Synthetic coding sequence
atgggcatcctgagcttcctgcccgtgctggccaccgagagcgactgggccgactgtaagtcaccccagccctggggccatatgcttctgtggaccgcagtgctcttcctggcgcccgtagcaggaacacccgctgcacccccaaaggccgtgctcaaactggagccgcagtggatcaatgtcctgcaagaagactccgtgactctgacctgtagagggactcactcaccagagagtgattctattcagtggtttcacaacggcaacctgattccaactcacacacagccatcttatcgcttcaaggcaaacaacaacgatagcggcgagtatacgtgccaaaccggacagacgagtctcagcgacccggtgcacttgaccgtgctgtccgagtggttggtgctgcaaaccccacacttggagtttcaggagggagagaccatcgtgttgcggtgccacagctggaaggacaaaccgctagtcaaggtgactttcttccagaacgggaaaagcaagaagttttcccggtctgatccaaacttcagcattccccaagctaatcactcccattcgggcgattatcactgtacaggcaatatcgggtacacgctgtacagtagcaaaccagtcactatcacagtgcaagccccgtccagctcaccgatgggcatcattgtagctgtcgtgactggcattgccgtggctgcaatcgtggccgccgtcgtggctttgatctactgcaggaaaaagcgcatctctgcaaaccccacaaacccagatgaagcagataaagtgggtgcagagaacacaattacatattctcttctgatgcatcccgacgcgctggaggaaccagacgaccagaaccggatctag

SEQ ID NO: 187693 - DNA, 933 bp, Artificial Sequence
  Description of Artificial Sequence: Synthetic coding sequence
atgggcatcctgagcttcctgcccgtgctggccaccgagagcgactgggctgattgtaaatcaccccagccctggggacacatgctcctatggactgcggtgctcttcctggccccagtggcaggtacccctgccgcgccaccaaaggccgtgcttaaactcgaaccgcagtggatcaacgtactccaggaagacagcgtcaccctgacatgcaggggcacccatagtccagaatccgactcaattcagtggttccacaatggaaatctcattcctacacatactcagccttcctacaggttcaaggctaataataatgattctggcgagtacacgtgccagaccgggcaaacctccctgtccgatcctgtacacctcaccgtgctgagcgagtggctagtcctgcagacacctcatttggaattccaagagggagagactattgtcctgaggtgtcattcgtggaaagacaaacccctggtgaaggtcactttctttcaaaacggcaagtcaaagaaattttctcggagcgatcccaacttttccattcctcaggctaatcattcgcattcaggtgactatcattgcacaggaaacattggatatacactgtattcctccaaaccggttaccatcactgtacaggcaccgagctcttctcctatgggaatcattgtggctgtcgtcaccggcattgcagtggctgccattgtggcggccgtggtcgcacttatctactgcagaaagaagagaatcagcgccctgcctggctaccctgagtgcagagagatgggggagaccctcccggagaagcccgccaatccaacaaatcccgatgaggccgataaagttggagcggagaacaccattacttattccctgctgatgcatccagatgccctcgaagagcctgacgaccagaaccgcatctag

SEQ ID NO: 187694 - DNA, 912 bp, Artificial Sequence
  Description of Artificial Sequence: Synthetic coding sequence
atgggcatcctgagcttcctgcccgtgctggccaccgagagcgactgggcagattgtaaaagtccacagccctggggacatatgttgctgtggacagccgtgcttttcctggccgctccccccaaggcagttctaaaactagagccccagtggatcaacgtgctccaggaggacagtgtgactctgacatgtcgtggaacgcactcacccgaatccgattctatccagtggtttcataacggaaacctgataccaacccacactcagcctagctatcgttttaaggcgaacaacaatgacagcggcgaatatacgtgtcagaccggtcaaacctctctcagtgatcccgtgcatttaactgtcctgagcgaatggctggtcctgcaaaccccgcatctggagttccaagagggggaaactatagtcctacgctgtcacagctggaaggataaaccattggttaaagtgaccttcttccagaacggaaaatctaaaaaattttccagatccgacccaaatttctccattccacaggctaatcactctcactcgggagactaccactgcaccggtaacattggttacacgctctactcatccaaacccgtgaccatcacggtacaggctccatcttcttccccaatgggcattatcgtcgctgtcgtgaccgggatcgctgtcgccgccatcgttgctgcagttgtggcccttatttattgccggaagaaaaggattagcgcactgcctgggtaccctgaatgcagggaaatgggtgagacactgccagaaaaaccggccaatcctaccaatccggacgaggctgataaggtcggtgcagagaatacgattacctactcccttctgatgcacccggacgccctcgaggaacctgatgaccagaatcggatatag

SEQ ID NO: 187695 - DNA, 912 bp, Artificial Sequence
  Description of Artificial Sequence: Synthetic coding sequence
atgggcatcctgagcttcctgcccgtgctggccaccgagagcgactgggctgactgcaaaagtccccagccgtggggccacatgctcctgtggacggccgtcctgttcctggccgcccctcctaaagctgtgctgaagctggagccccagtggatcaacgtgctgcaggaagatagcgttaccctcacatgtaggggaacacacagtcctgagtcagacagcattcagtggttccacaatggaaatctgattccaactcatactcagccctcttataggttcaaggctaacaataacgatagcggcgaatacacttgtcagacgggacaaacttccctgagcgatcccgtgcacctgaccgtgctgtccgaatggctggtgctgcaaaccccccacctggaattccaggagggcgagaccattgtcctaagatgtcacagttggaaagacaagcccttagtaaaagtgaccttttttcagaatgggaagagcaaaaagttctcaagatctgaccccaactttagtattccccaagcgaaccacagccatagtggggactaccactgtaccggcaacatcggatatacactttattcctctaaacccgtgacaatcactgtacaggcaccaagcagctctcccatgggaataattgttgccgtggttaccggcatagctgtcgccgctattgttgccgccgtggtggctctgatttattgcagaaagaagaggatcagtgccctgccgggttacccagaatgtcgggagatgggggaaaccctgccagagaaaccagctaatcccacgaatcccgatgaggccgacaaggtcggagctgaaaacacaatcacgtattctttactgatgcacccagatgccctggaagagccagatgatcagaatagaatctag

SEQ ID NO: 187696 - DNA, 933 bp, Artificial Sequence
  Description of Artificial Sequence: Synthetic coding sequence
atgggcatcctgagcttcctgcccgtgctggccaccgagagcgactgggctgactgcaagtccccgcagccttggggccacatgctcctctggaccgcagtccttttcctggccccagtcgcagggaccccagcagcgcccccgaaagcagtacttaaattggagcctcagtggattaacgtgcttcaggaagacagcgtgaccctgacatgccgaggaacacatagtcctgagtccgactccattcaatggttccataacggaaatctaattcccactcacacccagccatcgtaccgatttaaggcgaataacaacgactctggtgaatacacttgccagaccggacagactagtctctccgacccagtgcacctgacagttctgagcgaatggcttgtgctccagacccctcacttagaattccaggagggcgaaaccatagtgctgcgctgccatagctggaaggataaacctttggttaaggtcacattcttccagaacggtaagagtaagaaattctcaaggtcagacccaaatttctcaatccctcaggctaatcactctcatagtggcgattaccactgtactggtaatataggatacacgctgtacagctccaagcctgtgaccatcacagtacaagcccccagtagttcgccaatgggaattatagtagctgtcgtgaccggcattgctgtggcagctatcgttgccgctgtggtagctctgatctattgcaggaaaaagagaatctccgcactgcccggataccctgaatgccgtgagatgggcgaaaccctgccagagaaaccagcaaatcccacaaacccagatgaggctgataaggtgggcgccgaaaatacaataacatactccctgttgatgcatcccgatgctcttgaagagccagacgatcagaacaggatctag

SEQ ID NO: 187697 - DNA, 876 bp, Artificial Sequence
  Description of Artificial Sequence: Synthetic coding sequence
atgggcatcctgagcttcctgcccgtgctggccaccgagagcgactgggcagactgcaagagcccccagccgtggggccacatgctgctctggacggcggtgctctttctggctcctgttgccggaacacccgcggcgcctccgaaagccgtgctcaaattggaaccccaatggattaacgtgctgcaggaggactccgtgacgctcacttgtcgcggtacgcactcccccgaatctgatagtatacagtggtttcataacggaaatctgatcccaacccatacccaaccatcttatcgatttaaggctaacaacaacgattctggggagtacacttgccaaactggccagacatccctgagcgatcccgtgcacctcaccgtgttatccgagtggctcgtgctgcaaaccccccacctcgagttccaggagggtgaaacgatagttctgcgctgtcactcctggaaagataaaccactggtgaaagtcaccttcttccagaacggcaagtcgaaaaagttcagcagaagtgacccaaacttttccattcctcaggcaaaccactcacactcaggggactaccactgtaccggaaatataggttatacgctgtatagttcgaaacccgtcaccataactgtccaggctccctcgagtagccccatgggaattattgtggccgttgtgacagggatagctgtagccgccatcgtagcagccgtggttgcgcttatttactgtcgcaagaagcgcatcagcgccaatccaacaaaccccgacgaggccgacaaagttggcgctgaaaacacaatcacatacagtctcctcatgcacccagatgcattagaggagccagacgaccagaatcggatatag

SEQ ID NO: 187698 - DNA, 705 bp, Artificial Sequence
  Description of Artificial Sequence: Synthetic coding sequence
atgggcatcctgagcttcctgcccgtgctggccaccgagagcgactgggccgactgtaagtcaccgcagccttggggacacatgcttctgtggacagcggtactgttcctggcaccagttgctggtactcccgccgccccacccaaggcagtgttgaaactcgaacctcagtggataaacgtactccaagaggactctgtcacactgacctgtcgtggaacccactcacccgaaagcgattccattcagtggttccacaatgggaatctgatcccgacccacacacagccctcatataggttcaaagccaacaataatgactccggagaatatacctgtcagacaggtcagacatcactatcagatcctgtgcatctgaccgtgctctcggaatggctcgtactacagacaccacacctcgagtttcaggagggtgaaacgatagttctgcgctgtcatagttggaaagacaagcccctagtgaaagtgacattcttccagaacggaaagtccaagaaattcagtaggtctgacccaaactttagcataccccaggccaaccattcccactcgggggattatcactgcacaggcaacattgggtatactctctactccagcaaaccagtgacaattactgtacagggtccaaggctgcgaactgcggccaaacagagctctctcgtcggcgcagaggttccatag

SEQ ID NO: 187699 - DNA, 771 bp, Artificial Sequence
  Description of Artificial Sequence: Synthetic coding sequence
atgggcatcctgagcttcctgcccgtgctggccaccgagagcgactgggccgattgcaaaagccctcagccgtgggggcatatgttgctgtggacagccgttctgttcctgggagagtctgggccccctgccgcccctcccaaagccgtgctgaagctggagcctcagtggatcaatgtactgcaggaagacagtgtgaccctgacctgtcggggcacccacagcccggaatccgactctattcagtggtttcacaatggtaatctcatcccgacccatacacagccgtcttatcgtttcaaagccaataacaatgattcgggggaatacacctgccaaactgggcagacctcactctcagatcccgttcacttgacagtgctgagcgagtggctggtgctgcagaccccgcaccttgagttccaggaaggcgagaccatcgtactgaggtgccactcctggaaggacaagcccttggtgaaggttactttttttcagaacgggaagtccaaaaaattctcccggagtgacccaaacttttccattccccaggccaatcattcacatagtggtgattaccattgcaccgggaatattggatacaccctgtattctagtaaaccagtaaccatcaccgttcaggctccttcctcttccccgatggggattatcgtggcagtagtgaccggcatcgccgttgctgccattgtcgctgcggtcgttgctctgatttactgcaggaaaaagcgcatcagcgtttcaacttggtag

SEQ ID NO: 187700 - DNA, 765 bp, Artificial Sequence
  Description of Artificial Sequence: Synthetic coding sequence
atgtggcagctgctgctgcccaccgccctgctgctgctggtgagcgcagggatgcggactgaggacttacctaaagctgtcgtgttcctggagccccaatggtaccgggtgctggagaaggactcagtgaccctgaagtgccagggtgcatatagccctgaggacaacagtactcagtggtttcataatgagagcttgatctccagccaggctagctcatatttcatcgatgctgccacagtggatgactcaggcgagtatagatgccagacaaaccttagtaccctgagtgaccccgttcaattagaggttcatataggctggctactcctccaggcccctaggtgggtttttaaggaggaggaccctatccacctccggtgtcatagctggaaaaatacagccctgcacaaagtgacatacctacagaacgggaaagggcgcaagtacttccaccataactctgatttttatatcccaaaagcaactctcaaagactctggctcctacttttgtcggggactgtttggaagcaaaaacgtctcaagcgaaactgtcaatatcacaataactcagggcctggctgtgtctactatcagcagtttcttcccccctgggtatcaggtgtccttttgtcttgtcatggtacttttgttcgctgtggacacagggctttatttttccgttaaaaccaacattcggtctagcacaagggattggaaggaccacaaatttaagtggcgtaaggatccccaggacaaatag

SEQ ID NO: 187701 - DNA, 873 bp, Artificial Sequence
  Description of Artificial Sequence: Synthetic coding sequence
atgggcggcggcgccggcgagcggctgttcaccagcagctgcctggtgggactggtgccgctcgggcttaggatctctcttgttacttgcccgcttcaatgtggtattatgtggcagctgctcctgcctacagccttgcttcttttggtctccgccggaatgagaacagaagacctacccaaggccgtcgtgtttcttgaaccccagtggtatcgcgtcttggagaaagatagcgtaactctgaaatgtcagggcgcatactcccctgaagacaactccacacagtggttccataatgaatccctgatatcttctcaggctagtagctacttcatagatgctgcgaccgtggatgacagcggtgaatatcgttgccagaccaatctgagtactctgagcgatcccgtgcaacttgaagtacacattggctggctcctattgcaagccccaagatgggtgttcaaggaagaagatcccatccatctcaggtgccatagctggaagaataccgctttgcataaagtcacatacctgcagaacggcaaaggccgaaagtattttcaccataactctgacttttacatcccaaaggccacactgaaagattctggctcatacttttgccgcggactattcggaagtaagaacgtgtcttcagagactgtcaacatcaccatcacacagggcttggccgtgtccaccatctcgagcttcttcccccccggctatcaagtctcgttttgcctcgtgatggtactcctgttcgcagttgacaccggactgtatttctccgtgaagaccaacatcaggtcttctaccagagactggaaggaccataaatttaaatggcgaaaggacccgcaggataagtag

SEQ ID NO: 187702 - DNA, 816 bp, Artificial Sequence
  Description of Artificial Sequence: Synthetic coding sequence
tgacccctgggcctgcggatcagcctggtgacctgccccctgcagtgcggcataatgtggcaattgttactgccgactgcacttctgctgcttgtatccgcgggcatgcgcactgatctgcctaaggcagtcgtgtttctcgaaccccagtggtatagagtactggagaaggacagcgtaacacttaagtgccagggtgcatattctcctgaagacaattctactcagtggttccataacgagtctttaatttcctcccaggcctctagctacttcattgatgcggctacggtcgacgactctggggaatatcgatgtcagactaacctgagtaccctgtcggaccccgtacagctagaggtccacattggctggctgttgcttcaagcgccccgttgggtttttaaggaagaagacccaatccaccttagatgccacagttggaaaaacactgccctccataaagtaacctaccttcagaacggcaaaggacgaaagtacttccatcacaacagtgatttttacattcctaaagctactctgaaggattccggatcctatttttgtaggggcctgttcggttcaaaaaacgtctcttccgagacagtgaatataactattactcagggcttggccgtgagtacaatctcctcgttcttcccgccagggtaccaagtcagtttctgtctcgtgatggttctcctgttcgctgtggacactgggctttattttagtgtgaagaccaacatacggtcctcgaccagagactggaaggaccataaatttaagtggcggaaggatccgcaagataaatag

SEQ ID NO: 187703 - DNA, 765 bp, Artificial Sequence
  Description of Artificial Sequence: Synthetic coding sequence
atgtggcagctgctgctgcccaccgccctgctgctgctggtgagcgccgggatgagaactgaggacctgcctaaagccgttgtgttcctagagcctcaatggtacagagtactggagaaggactcagtcactctgaaatgccagggtgcctatagcccggaggataactccacccaatggtttcataacgaaagcttaatatccagtcaggcctcttcctatttcattgacgctgcaacggtagacgacagcggcgaatatagatgccagactaatttgagtactctttctgaccccgtgcagcttgaagtccacataggctggttactattgcaagccccgcgctgggtctttaaagaggaagaccctattcacctgagatgccattcttggaagaacacagctctgcacaaggtcacatatcttcagaacggcaaaggtaggaagtatttccatcataattcggatttttacatccctaaggctaccttgaaggacagcggttcttacttctgccgggggctgtttgggagcaagaacgtttcaagcgaaactgtgaacatcacaatcacacagggccttgccgttagtacgattagctccttcttcccccctggttatcaggtgtctttttgcctggttatggtcctcctgtttgccgtggacaccgggctttatttctccgtgaagacaaacatcaggagtagcacgcgcgattggaaggatcacaagttcaagtggaggaaagatccacaggataagtag

SEQ ID NO: 187704 - DNA, 318 bp, Artificial Sequence
  Description of Artificial Sequence: Synthetic coding sequence
atgtggcagctgctgctgcccaccgccctgctgctgctggtgagcgctggaatgcgtactgacctgccgaaggcagtcgtcttcctggagccacagtggtacagggtgctggagaaggatagtgtcacactcaaatgtcagggggcgtactctcctgaggacaatagcactcagtggtttcacaatgaaagtctgatatctagccaagcctcatcgtactttattgatgccgccacggtcgacgatagtggtgagtatagatgccaaaccaacttgagcactctgagcgacccagtccagctcgaagtccacatatag

SEQ ID NO: 187705 - DNA, 870 bp, Artificial Sequence
  Description of Artificial Sequence: Synthetic coding sequence
atgggcggcggcgccggcgagcggctgttcaccagcagctgcctggtcgggctggtgcccctggggttgcgcattagccttgttacttgccctctgcagtgtgggataatgtggcaactactccttcccaccgctctgctgctgctggtaagtgccggtatgcgaaccgatctgccgaaagcagtggtgtttctggagccacaatggtacagggttctggaaaaggacagtgtgactttaaagtgtcagggtgcttacagccccgaggacaactccacacagtggttccacaatgaatccctgatatccagtcaagcgagtagctatttcattgatgctgccacagtggatgactccggagaatatagatgtcagacgaacctcagtaccctctcagatcccgtgcagctggaggtccatatcggctggctcctcctgcaagcgccgcgatgggtcttcaaagaggaggaccctatccacctccggtgccactcctggaagaatacagccctgcacaaggtgacttacctgcaaaatgggaaaggccgcaagtactttcatcataattctgatttctatattccaaaagccacattaaaggattctgggtcctacttctgccggggcctcttcggttcgaaaaacgttagctccgaaaccgtgaatatcaccatcacacagggcctcgccgtctcaacgatctcttccttcttcccgcctggctatcaggtgtcattctgcctggtaatggtactgctcttcgccgtggacaccggcctgtactttagtgttaaaactaacattagatcctccacccgggactggaaagaccacaagtttaagtggcgcaaggacccccaggacaaatag

SEQ ID NO: 187706 - DNA, 765 bp, Artificial Sequence
  Description of Artificial Sequence: Synthetic coding sequence
atgtggcagctgctgctgcccaccgccctgctgctgctggtgagcgcaggcatgagaacagaagatctccctaaagcagttgtttttctggaaccgcagtggtatcgcgtcctggagaaggatagcgttacattaaaatgccagggggcatattcccctgaagacaattcaacccagtggtttcacaacgaaagcctgatctcctcccaggcaagctcatactttattgatgcggccacggtggacgacagcggcgagtacagatgtcagacaaatctgtccactcttagcgaccccgtgcagttggaagtccatatcggctggttgctgctgcaggcgccccggtgggttttcaaggaggaagaccccatccatttacgttgtcactcgtggaagaacaccgccctgcacaaggttacctacctacagaatggcaaaggtagaaaatattttcatcacaactccgatttttacatacctaaggccacactcaaggacagcggatcatacttctgtcgcggcctgttcggaagtaagaacgtttccagcgaaacggtgaatattactattacgcaggggctggctgtctccaccatctcatcattttttccacccggataccaggtctcattttgtctcgtgatggtactcctgttcgccgtggacaccggcctctacttttctgtgaagactaacatcagatctagtactcgtgattggaaagatcacaagttcaagtggaggaaggacccccaggataagtag

SEQ ID NO: 187707 - DNA, 702 bp, Artificial Sequence
  Description of Artificial Sequence: Synthetic coding sequence
atgtggcagctgctgctgcccaccgccctgctgctgctggtgagcgccggaatgaggaccgaagatctgcccaaggcggtggtgttccttgagccccagtggtatagcgttcttgaaaaggatagcgtgaccctgaagtgtcagggagcatatagccccgaggacaattctacacagtggtttcataacgagaatctgatctccagtcaagcctcctcgtactttatagatgccgctactgtgaatgattcaggagagtaccgatgtcagaccaatctctccaccctcagcgacccagtgcaactggaggtccatatcggctggttgttactgcaagcacccagatgggtttttaaggaggaggaccccattcacctgagatgccattcgtggaaaaacaccgctctgcataaggtcacatatctccagaatggcaaagatcggaaatactttcaccataatagcgacttccacatccccaaagcaaccctgaaggattccggctcatacttttgcagaggcctggtcggcagtaaaaatgtaagttccgagactgtcaacattaccataactcaaggacttgcggttagcaccatctccagcttctcgccccctggttatcaggtgagtttttgcctcgtgatggtgctattattcgccgttgacacgggtttgtatttttccgtgaagactaatatctag

SEQ ID NO: 187708 - DNA, 702 bp, Artificial Sequence
  Description of Artificial Sequence: Synthetic coding sequence
atgtggcagctgctgctgcccaccgccctgctgctgctggtgagcgccgggatgagaactgaagacttacccaaggccgtggtgtttctggaacctcagtggtatagtgttctagaaaaagattccgtgaccttgaagtgtcagggagcctactctccagaggacaactccactcagtggttccacaacgaaaatctcattagttctcaggcatcctcatattttatcgacgcagctacagtgaatgacagcggcgaataccgctgccagaccaacctgtccacactgtccgaccccgtgcagttggaggtgcacattggttggttactcctgcaggcccccaggtgggtcttcaaggaagaagacccaatacatctccggtgccattcctggaaaaacaccgcactccacaaggtcacatacttgcagaacggcaaggaccggaaatactttcatcacaattcagactttcacatccccaaagctaccttgaaagattccgggagctatttctgcaggggactggtgggctcaaagaacgtgtcttcggagacagtgaacatcaccatcacccagggcctggctgtgagcacaattagctccttttcccctcctggctaccaggtctccttttgcctggtaatggtgttgctattcgccgtagacactggactctacttctccgtgaagacgaacatatag

SEQ ID NO: 187709 - DNA, 2076 bp, Artificial Sequence
  Description of Artificial Sequence: Synthetic coding sequence
atggagatcgccccccaggaggccccccccgtgcccggcgccgacggtgatattgaggaagccccggccgaagcgggctccccgtctccggcctcgccccctgccgatgggcggttgaaagcggcagcaaagcgggttacattcccctccgacgaagatatagtcagtggcgctgtagagccaaaagacccctggcgccacgcccagaatgtgacggtagacgaggtgataggcgcctataagcaggcttgtcaaaaactgaactgtaggcaaattcccaagcttctccgacagcttcaggagtttacggatctagggcacagactcgactgcctggatctcaaaggcgaaaagttagattataagacatgcgaagccctggaggaagtcttcaagcgcctgcagtttaaggtcgtggatctggaacaaaccaacctggatgaagacggcgcctcagccctctttgatatgatagaatattatgagagtgctacccatctgaacatcagcttcaataaacacattgggactcgtgggtggcaggccgccgctcacatgatgaggaagacctcctgtctgcagtatctggatgcgagaaatactcccctcctggaccacagtgcccccttcgtggctcgggcactgagaattaggtcaagtctggccgttttgcacctcgagaatgccagccttagcggaagacccctgatgttgctcgctaccgctttgaaaatgaacatgaacctgagagaactgtacctggccgataacaaactgaacggtttgcaggactctgctcagctgggcaacttgctgaagttcaactgttctttgcagattcttgatctcaggaataatcacgtgctggatagcggtttagcctacatatgcgagggtttaaaagagcagcgcaaggggcttgttactttagtattgtggaacaaccagctaacccatactgggatggctttccttggcatgaccctgccacacacccaaagcctggaaaccctcaatctaggacacaaccccatcgggaacgaaggcgtgagacaccttaaaaatgggttaatcagcaatagaagtgtcctaagactcggcctggctagtactaagcttacatgtgagggcgccgtagcggtcgcggagttcatcgcggagtccccccgcttgttgagactcgatctgagggagaatgagatcaaaaccgggggcttgatggcgctgtcactggctctcaaggtgaaccactctctgttgaggctggacctcgaccgtgagcccaagaaggaggccgtgaaatccttcattgaaacgcagaaagccttgctggctgaaattcagaatggttgcaaacgcaatctcgtgctcgcacgagaacgagaagaaaaggaacaacccccccaacttagcgcctctatgcctgagactacagcgacagaacctcaaccagacgacgaacctgctgccggcgtccagaatggggcgccctccccagccccatcccccgacagcgattctgattctgattccgacggcgaggaggaagaggaggaggaaggagagagagatgagactccatgtccagctcttgtgcccccaacagactcactgggccccggcgatcgcagtccgcctggtagtccttctacccctaccgagcagcgcatctctgtaagcagccctggtaggggacacaaagttttcgtggtgacgagggtcgaaagtcccccggaaagagccgaacctccggcctcaccgacgcccccaagccctcccccgccccccagtcctccagcgagcccctccctgcctccggctggagccatagacacccgggacacaggttcatcggagccacaaccccctccagagccacccaggtcaggcccacctctgcctaacggcctcaagcccgagttcgctctcgcattgccacccgagccaccccctgggcctgaggtcaaagggggatcctgcggtcttgagcacgagctcagctgtagcaagaacgagaaagaactggaggagctcctgctggaggccagtcaggaaagcggacaagagactctgtag

SEQ ID NO: 187710 - DNA, 459 bp, Artificial Sequence
  Description of Artificial Sequence: Synthetic coding sequence
atgggcgtgccccggccccagccctgggccctgggcctgctgctgttccttctcccgggaagcctgggagccgaatcacacctatccctcctctatcatttaaccgcggtaagcagtccagcacctggaacccccgcgttttgggtctccggatggttaggcccacagcagtacttaagctacaactccctccgtggcgaggctgaaccctgtggggcctgggtctgggaaaatcaggtgagttggtattgggagaaagagactacggatctcagaatcaaagagaaactgttcttggaggcatttaaggccctcgggggaaaggggccttacacattacagggccttctcgggtgtgagctgggccctgacaatacttcggtccccactgcgtgcggtagcacttggcgaggcgccgcagagacctggtccgggagatctccacctccgtgcgcctag

SEQ ID NO: 187711 - DNA, 1098 bp, Artificial Sequence
  Description of Artificial Sequence: Synthetic coding sequence
atgggcgtgccccggccccagccctgggccctgggcctgctgctgttcctgttaccaggaagtttgggcgccgagagtcacctgagcttgctttaccacctgaccgcggtatcatcaccagcccccggcactccggcattctgggtatccgggtggctggggccacagcagtacttgtcctataactcattgcggggcgaagctgagccctgcggcgcttgggtgtgggagaaccaagtgagctggtactgggaaaaggagactaccgatctgcggataaaggaaaagctttttctggaggcctttaaagctcttgggggaaaggggccatataccctgcagggcctcctcggctgtgaacttggaccagacaatacatccgttcccactgctaaatttgcactgaatggtgaggagtttatgaactttgatttaaaacagggcacttggggcggggattggcctgaagccctggcaattagccagaggtggcagcagcaggataaagctgcaaataaagagctgacatttctcctgttttcttgccctcacaggctgcgagaacacttagagcgaggacgtggcaacttagaatggaaggagcctccatccatgagacttaaagcaaggcctagttctcctgggtttagcgtgctgacgtgttcggcattctccttttatccgcccgagctgcaattacggtttctacgcaacggcttggctgccggaactggtcagggtgattttggaccgaacagcgacggttcgttccatgcatcgtccagtttgactgtgaaaagcggggacgaacatcactattgctgcatcgtccagcatgcagggctagcccagcccttaagggtggagctggaatcacctgcaaagagttccgtgctggtggtgggaatcgtgatcggagtattgctgctaacggcagcagccgtcggcggagcactgctatggaggaggatgcgctctggtctccccgcaccatggatatcactcagaggggacgacacaggcgtcttgttacccacccctggtgaggctcaggatgcggatctcaaggatgtgaacgtcatacccgccacagcctag

SEQ ID NO: 187712 - DNA, 708 bp, Artificial Sequence
  Description of Artificial Sequence: Synthetic coding sequence
atgggcgtgccccggccccagccctgggccctgggcctgctgctgtttctgctgccgggaagcctgggtgctgaatcccatttatccctgttgtatcacctcaccgcagttagcagccctgctccagggacaccagcattttgggtcagtgggtggctggggcctcagcagtatctatcatacaacagtctgcggggtgaggcggagccatgcggtgcttgggtatgggagaatcaggtcagttggtactgggaaaaagagaccaccgacctccgaataaaggagaagctgttcctcgaggccttcaaagcattggggggaaagggcccttatactctccagggcctcttaggttgtgagctcggccctgataatacctctgtgcctacggccaagttcgccctgaatggcgaggaatttatgaattttgacctcaagcaagggacatggggaggggattggcccgaggccctggccataagtcagcgatggcaacagcaggacaaggctgcaaataaagaacttacattcctgctcttttcatgcccacatcgcctaagggaacatttagagagaggcaggggaaatctggaatggaaaggctgctggactaagatagataccagttggggatgcgcccagatcttcataccttcagctacaaaggagaagctaaggctgaaccagtctcctcctccctgcgcctag

SEQ ID NO: 187713 - DNA, 1734 bp, Artificial Sequence
  Description of Artificial Sequence: Synthetic coding sequence
atggacggcgaggccaccgtgaagcccggcgagcagaaggaggtggtgcgccggggccgggaggtcgattatagtaggctgatcgctgggacattaccgcagtcccacgtgacctctcgacgcgcaggctggaagatgcccctgtttttaatactgtgcctgctccagggtagcagttttgcactcccccaaaagcgaccccatccacgatggctttgggagggctctctcccatccagaactcaccttagagccatggggacattacgtccttctagccctctgtgttggagagaggaatcctccttcgctgctcctaattctctcaaggggtcccggttggtgagtggcgagcctgggggagcggtcacgattcagtgccattatgcacccagttcagtgaaccggcaccagcggaaatattggtgccggcttggacccccaaggtggatctgtcagaccattgtgagtacaaaccagtatacccatcatcgatatcgggatagggtagcattaaccgatttcccacagaggggtctcttcgtggtcagacttagccagctgagtccggatgatattggttgttacctttgcggaatcggcagcgaaaataatatgcttttcctgtccatgaacctcactatctcagctgggcctgcttcaacactgcccacagctacgcccgctgcaggcgagctaacgatgcgtagctacggtaccgcctcacccgtcgcaaacaggtggactccagggaccactcagacactcgggcaaggaaccgcctgggacaccgtggctagtactcctggtacgagcaagaccactgcaagcgctgagggacggaggacacccggagccacaaggcctgccgcccctggaactggaagctgggccgagggttccgtgaaggctcccgcacctatccctgagtcccctccgtcaaaatctcggagcatgagcaatacgactgagggggtctgggaagggaccagaagtagcgtgaccaatcgagctcgggcgagcaaggacagacgggaaatgactacgacgaaggccgaccggccccgggaagacatcgagggtgtgaggatcgctcttgacgctgctaagaaagtattggggacaatcggtcctcctgctctagttagcgaaactctcgcgtgggaaattctgcctcaggccacgcccgtgagcaagcagcagagtcaggggagcataggagagactaccccagccgcaggtatgtggaccctcggcactcccgcagcagacgtgtggattctggggacccccgctgctgatgtctggacctccatggaggcggcttccggcgaaggctccgccgctggggacctcgatgcagctacaggagaccgcggcccccaagcaacgctatctcagacaccagccgtggggccctggggcccccctgggaaggagtccagcgtcaaacgcacctttcctgaggacgagtcaagttcgaggacactggcgccggtctctacaatgctggcccttttcatgctgatggctctcgtcctgctccaaaggaagctatggcgtaggagaaccagccaggaggcagagcgcgtaacccttattcagatgacacacttcctggaggtgaatccacaggccgaccagttgccccatgtcgagcgcaagatgctccaggatgatagcctgcctgctggggcgtccttgacggcccccgaacggaatccaggcccctag

SEQ ID NO: 187714 - DNA, 1608 bp, Artificial Sequence
  Description of Artificial Sequence: Synthetic coding sequence
atggacggcgaggccaccgtgaagcccggcgagcagaaggtgcccctctggacccacggatggccgcctgacgatccatccccgtcattcgctgcgggatccagttttgctcttccacaaaagcgaccccacccacggtggctttgggagggtagtctgccaagcagaacacacctaagagccatgggcaccctgcgaccgtcatcccccctgtgctggcgggaggagtccagcttcgctgcccccaacagtctgaaaggttctcggctggtgtccggcgagcctggaggggcagtaactatccaatgtcactacgcaccatcaagtgtcaatagacaccagcgcaaatactggtgcaggctggggccacctagatggatctgtcaaacaatcgtttctactaaccagtatacccaccaccgatacagggaccgcgtggcccttacagacttcccacagagaggactgttcgtcgtgcggttgtctcagctatctcccgacgacatcgggtgctatctctgcggcatcggaagtgaaaacaatatgttgtttctgtctatgaacctgactatctcagctggacctgcctccaccctgccaaccgcaacacctgccgccggagaattaaccatgaggtcgtacgggaccgcatcacctgtggccaatagatggacaccagggacaactcaaaccctcggccagggaaccgcatgggacacggttgcctccactcccgggacctcaaaaacaacagcctctgctgagggccggagaacccctggcgccactaggccagccgcgcctgggacagggtcatgggctgaggggtccgtaaaagccccggcccctatcccagaatctcccccatctaagtctaggagtatgtcaaacactaccgaaggcgtgtgggagggaaccagatcttctgttacaaatcgcgcacgtgcttccaaggatcggagggaaatgaccactaccaaagccgaccgcccacgcgaggatatcgagggagtgcgcatagccctcgatgccgcgaagaaggtcctaggaacaatcggcccacctgcattggttagcgagacactcgcatgggagattctcccccaagctacacctgtttccaagcagcagagccaggggtccattggcgagaccacaccagcagcagggatgtggactctgggaacacccgccgccgatgtctggattaccagcatggaggccgcgtccggcgagggctccgccgcgggcgaccttgatgcagccacaggtgacagaggaccgcaggcgaccctgtcccaaactcctgccgtgggcccctggggccctcccgggaaagaatcaagcgtgaagcgcgctacttgtccgggattaagcactcttaaggagatcaaggttagcgcggtcttgactcagaacccccatagcctcctgtgtgtgtcagctgctcaagaagcggagagagtgacactaattcagatgactcacttcctggaggtgaacccccaggcagaccagctcccgcacgtcgagagaaaaatgttgcaggacgactctctccctgccggtgccagtctgaccgctcctgaacgcaatcctggaccctag

SEQ ID NO: 187715 - DNA, 798 bp, Artificial Sequence
  Description of Artificial Sequence: Synthetic coding sequence
atggacggcgaggccaccgtgaagcccggcgagcagaaggaggtggtgaggcgaggacgcgaagtagactattcgcgactgatcgccgggaccctgccacaaagccacgtgacttctcgaagagccggctggaagatgccccttttcctaatcctgtgtttgctgcaggggagcagctttgcgcttccccagaagagaccacacccccgatggctgtgggagggttccctcccaagccggactcacctgcgtgcaatggggacgcttcgcccctcgagccctctttgttggagggaagagagctcatttgctgccccaaacagcctgaaaggaagccggctggtgtcgggtgagccaggtggcgcagtaacaatccagtgccattacgcaccttcttcagtgaatagacaccagcgcaagtattggtgtcggctgggtccacctcgctggatatgtcagacgatcgtgagcaccaaccagtacacacatcaccgatatagagatcgggtggctctcacggactttccacagcgagggctctttgtggtgcggctcagtcagctttccccagatgatattggctgctacctctgcggtattggttctgaaaataatatgctgtttctttctatgaacctcaccatcagtgccgtgctctttcaaaaaatgaaggctgccctggggccatggctgttgtctctgccctgctggccctgtctgtgtctctggctgtggttctattgtaaaggatccagcggggaagggggccccttgcgcaggcagaaaggcagcccctag

SEQ ID NO: 187716 - DNA, 798 bp, Artificial Sequence
  Description of Artificial Sequence: Synthetic coding sequence
atggacggcgaggccaccgtgaagcccggcgagcagaaggaggtggtcagaagaggccgggaagtagactacagtaggctgatcgcaggaaccttaccacagtcacacgtcacctctcgccgagccgggtggaagatgcccctctttctgattctttgccttctccaggggagcagcttcgcgctacctcagaagcgtccgcaccccagatggctgtgggaaggttccctcccctcacgcactcatctgcgggccatgggtacgctccgcccaagctcacccctgtgctggagggaggagtcctcatttgccgctccgaattctctgaagggatccaggctggtgagcggcgagccaggcggagcagtgacgattcagtgccattatgccccttctagtgtgaaccgccaccagagaaaatattggtgtagactggggcctcctaggtggatttgccagaccatagtttccacaaaccagtatactcaccatcgatatcgcgacagggtggccctgactgacttccctcagcggggcctgttcgtcgtgcgcctgtctcagttatccccagacgatattggctgctatctttgtggtataggctctgagaacaacatgctctttttgtccatgaatctaactatctcagcggtgctgttccagaaaatgaaagccgccctcgggccgtggctgctctccctgccctgttggccctgtctgtgtctatggctgtggttctactgtaaaggctcatcaggcgaaggtggacccctccggcgccagaaagggtccccctag

SEQ ID NO: 187717 - DNA, 1101 bp, Artificial Sequence
  Description of Artificial Sequence: Synthetic coding sequence
atgctgccccggctgctgctgctgatctgcgcccccctgtgcgagcctgccgagctgtttctgatagcctctccctcacaccccactgaaggcagccctgtcaccctcacctgtaagatgccttttctccagtcgtcggacgcgcaattccaattttgcttttttcgagacactcgcgctcttggccctggctggtccagttctccgaagctgcagatcgcggctatgtggaaagaagacacaggttcgtattggtgcgaggctcagaccatggcttcaaaggtgctgcggtcacgccggtcgcagattaatgttcaccgcgttccagtcgctgatgtatcactcgaaacgcaacctcctggtggccaggtcatggagggtgaccgtctggtcttgatttgttcagtcgccatgggcactggagacatcacatttctgtggtataagggtgctgttggcttgaacctacaatccaaaacccagagaagcctaaccgccgaatacgagattccaagcgtccgtgagtctgacgctgaacagtattactgcgtggccgaaaatggatatgggcccagtccctcaggtctggtctccatcacagtccgtattcctgtaagcaggcccatcctgatgttgagggcgccccgagcgcaagccgcagtcgaggacgtcctcgagctgcactgtgaggccctacgagggagcccacccatactctactggttttatcacgaagatatcaccctcggctcccggtcagccccttccggcggaggtgccagttttaatctttctcttacagaggaacactcagggaattactcatgtgaagcaaataacgggttgggcgcacagagatccgaggccgttacccttaactttacgggcaggagatccgcccgggacccccttagaagtcttccctcgcccctgccacaggagtttacatatctgaactccccaacccctggtcagctacaaccgatctatgagaatgagccccgcgagcagagcgtagctgtacatgggcgacaacagcactccagcgagcaaaaggctcagaagccatggggacacatatggcgaacccgtttcccttag

SEQ ID NO: 187718 - DNA, 1290 bp, Artificial Sequence
  Description of Artificial Sequence: Synthetic coding sequence
atgctgccccggctgctgctgctgatctgcgcccccctgtgcgagcccgccgagctgttcctaatcgcaagccccagccacccgaccgaaggctctcctgtaaccctcacttgtaaaatgccttttttacaaagtagcgatgcccagttccagttttgtttctttagagacactagggccctgggtcctggctggtccagcagccctaagttacagatcgccgccatgtggaaagaagacactggaagctactggtgtgaggcccagaccatggcaagcaaggtgttgcgcagtaggagaagccaaatcaatgtacaccgtgtgccagtggccgatgtctcactggagacacagcctcccgggggccaggttatggaaggtgaccgcctggtgcttatctgctccgtggccatgggcactggggatatcaccttcctgtggtataaaggggccgtcgggctgaatctgcaatctaagacacagagatccctgacagccgagtatgaaattccctctgtgagagaaagcgatgctgaacagtactactgcgtggctgagaatgggtacggtccgagccccagtggcctggtgagtatcactgtgcggataccagttagccggccgattcttatgttgagagcccctagggcccaggcagctgtggaagatgtccttgaacttcactgcgaggccttgcgcggcagccccccaatactttactggttctaccatgaggacattactctgggctcaagatcggctcccagcggaggtggcgccagttttaacctgagtctgacagaagagcattctggcaattattcctgcgaagctaataatggacttggcgcccaacgctcagaggccgtgactttgaacttcacggtgccaaccggagctcggtccaaccacctcactagtggcgtgatagagggcctactctccacccttggccccgcaacagtcgcactcctattttgctacggtctcaaaagaaagatcggaaggcggtccgcgcgggaccctctgaggtctcttcccagtcccctgccgcaggagttcacttacctgaactcaccgaccccagggcagttgcaacctatctacgagaatgtgaatgtggtgagtggcgatgaagtgtattccctcgcatattacaatcagccggagcaagagtccgttgccgctgagacacttggtacccacatggaagacaaagtgtccctggacatctatagtcgccttcggaaggctaacatcactgacgtggactatgaggatgctatgtag

SEQ ID NO: 187719 - DNA, 1287 bp, Artificial Sequence
  Description of Artificial Sequence: Synthetic coding sequence
atgctgccccggctgctgctgctgatctgcgcccccctgtgcgagcccgctgagctcttcctcattgcctctccttcccacccaaccgaaggcagccctgtgacactgacgtgcaaaatgccgttcttgcagtcatccgacgcccaatttcaattctgcttcttcagagacactagagcactcgggcctggttggtcttcatcccctaaactgcagattgctgcaatgtggaaggaagacactggaagttactggtgcgaagctcagaccatggcatccaaagtgctacgttccaggcgctcccagattaacgtgcatcgcgtgcccgtcgccgacgtctccttagagactcagcccccagggggacaagttatggaaggcgacaggcttgtcctgatctgctcggttgccatgggaactggcgacataacatttctgtggtacaaaggcgcagtgggcctaaaccttcagtcaaaaactcagaggtccttgactgccgagtatgagatcccatctgtccgagaaagtgatgccgaacaatactactgtgttgctgagaacggctacggaccctccccaagtggtttggtgtctatcacggttcggatcccggtaagtaggccaattcttatgttacgtgcacccagagcccaggcagccgtcgaagacgtgttggagctccactgtgaagctctgaggggaagtccgcccattctgtactggttctaccatgaggacatcaccttaggctctaggagcgcacccagtggtggcggggctagcttcaacctgtcgttgacagaagaacatagcggtaattattcctgtgaagctaataacggcttgggggctcagcggagtgaggcggtgactctcaacttcactgtcccaactggagccaggagtaaccacctgacctctggcgtcattgagggcctgctcagtaccctcggacctgcgacagttgctcttctcttttgctacggcctaaagcgcaagatagggagaaggagcgcgagagaccctttacgatcattgccaagtcccctcccgcaggaattcacctacctgaactctcccacaccaggccaactgcaacccatctatgagaacgtgaatgtcgtctccggtgacgaagtgtattctctggcctactacaaccagcccgagcaagaatcagtggccgaaaccttaggcactcatatggaagacaaagtatctctggatatctattcccgactgcgaaaagccaacatcacagatgttgattacgaagacgccatgtag

SEQ ID NO: 187720 - DNA, 2670 bp, Artificial Sequence
  Description of Artificial Sequence: Synthetic coding sequence
atgagctacttcggcgagcacttctggggcgagaagaaccacggctttgaagtgctctatcacagtgtcaaacaagggcccatctctacgaaggaactggcagattttattcgtgagagagccacaattgaggagacttacagcaaggcaatggctaaactctctaagctagcgagcaacgggacaccaatgggaaccttcgctccgctctgggaggtgttccgagtatcctcagataaactggcactgtgtcacctcgagttgaccagaaagcttcaggacctgataaaagacgttctgaggtatggagaggaacagcttaaaacccataagaagtgtaaagaggaagtggtgtccacactggatgccgtgcaggtgctgagcggggtgagccagctgctgcccaagtccagagagaactacttgaaccgctgtatggaccaggaaaggttacggcgtgagtccacgagccagaaggagatggacaaagccgagaccaagacaaagaaagctgcagagtctttgcggcgcagtgtcgagaaatacaactccgcgcgggcggactttgagcaaaaaatgctggacagcgcattgaggtttcaggcaatggaggagacacatttgagacacatgaaagccctcctgggcagctacgctcactcagtcgaagacactcatgtacagatcggccaggtccatgaagaattcaaacagaacattgaaaatgtctccgtcgaaatgttactgcggaagtttgcggagtccaaggggacgggcagagaaaaacccggcccccttgattttgaggcttattcagcggccgcactccaagaagccatgaaacgcctgcggggcgcaaaggcatttaggctgccaggtctcagtagacgtgagagggagcccgaacccccagctgccgtggactttctcgaacccgactctggaacttgccctgaagtggatgaagagggcttcacagttcgtcccgacgtaacccagaactctacagctgagccttccaggttctcctcaagtgacagtgacttcgacgacgaagaaccgagaaagttttacgtccatattaagcctgctcccgcaagagccccagcttgttcccctgaggccgccgccgctcagttaagggctaccgccggcagcctgatcttgccccccggtccaggtgggaccatgaagcggcactcaagcagagacgccgccggcaagccccaacgaccccgaagcgctccacgaacatcatcctgcgcagaacggctgcaaagcgaggaacaggttagcaagaacctttttggccctccactggagtctgcgttcgaccacgaagactttaccgggagtagtagtctgggattcacatcttcgccctcacccttttcaagttccagcccagagaatgtcgaggatagcggtctggacagtccgtcgcacgctgcaccaggcccaagccccgatagctgggtccctcggcctggaaccccccagtcaccgccgtcctgtagggctcccccccctgaagctagggggatacgtgctccacccttaccggactctccacagcccctggctagcagtcccgggccctggggcctggaagccctggcaggcggggatctgatgccagccccagccgaccccaccgcccgcgaaggtttagccgcccccccccggcggttacgttcgaggaaggtttcttgcccacttaccagatctaatggcgatttgtcacggtctttaagtccgtcaccccttggttcaagtgcggctagcactgcactggagaggccatcattcctgagccaaactgggcacggtgtcagtagaggaccatcccctgtagtattaggaagccaagacgctctgccgatcgctaccgcatttaccgagtacgttcacgcatactttcgcggccactccccttcctgcctcgcccgcgtcactggcgaactgacgatgacgtttccagcaggaatagttcgggtattcagcggcacacccccccctcccgtcctcagctttaggcttgtccatacaacagctatcgagcatttccagccgaacgctgatttgttattcagtgatccatctcagtcagacccagagacaaaagatttttggcttaatatggccgccctgactgaggccttgcagcggcaggccgagcagaaccccacagcgtcatattacaatgtagtgttactgcggtaccagtttagtcgcccaggcccccagtcagttcctttgcaactcagcgcacactggcagtgcggagctacacttacacaggtctccgtggaatacgggtaccgtcccggcgctacagcagtgccaacgcctctaaccaatgtacagatcctgttgcctgtcggggaacccgtcacaaacgtacgtctgcagccagccgccacttggaatctggaagagaaacggctgacttggaggctgcctgacgtctccgaggcaggcgggtctgggagattgtccgcatcttgggagccgctaagtggaccatccaccccaagtcctgttgccgcacagtttacatcggaaggcacaactctcagtggcgtcgatctggagttagttggatcaggctacaggatgtccttagtgaagagaagattcgctacaggcatgtatttggtcagctgctag

SEQ ID NO: 187721 - DNA, 2670 bp, Artificial Sequence
  Description of Artificial Sequence: Synthetic coding sequence
atgagctacttcggcgagcacttctggggcgagaagaaccacggcttcgaggttctgtaccatagtgtgaaacaagggcccatcagtactaaagaacttgccgactttataagggagagagccacaatcgaggagacatattcaaaagctatggccaagctctccaaactggccagcaacggaaccccaatgggtacatttgcgccgttgtgggaggtcttcagagttagcagcgacaagcttgccctgtgtcacttagagctcacccggaagctgcaggacctgattaaggacgtcctgaggtatggtgaggagcagttaaaaacacacaagaaatgcaaagaggaggtggtctccaccctggatgccgttcaggttcttagcggggtgagccagctgttacccaaatcacgcgagaactatctgaaccgatgtatggatcaggagaggctccgccgcgaaagcacttctcagaaggagatggataaagccgagacgaagactaaaaaggcggcagagtctctgcgacggagcgtcgaaaagtacaacagtgccagggctgacttcgagcagaaaatgctcgattctgccctgaggttccaagcgatggaagagacccacttgcggcacatgaaggctttgctgggtagctacgctcattcggtggaagatacacacgttcagatcggccaagtccacgaagaatttaagcaaaatatcgaaaacgtatccgtggaaatgttattaagaaagttcgcggagagcaaggggaccggtagagaaaaaccgggcccgctggattttgaagcctattctgcggctgccctgcaggaagccatgaaaagacttcgtggagcaaaggcatttcgactaccaggcctgagtcgtagagagagggaaccggagccccctgccgccgtggatttcctagaaccagattctgggacttgccctgaggtcgacgaggaagggttcacagtgagacccgatgtgacccagaattcgacagcggaaccctcaaggttctctagcagtgattctgacttcgatgacgaagaacccagaaagttttatgtccacattaagcccgctccagccagggctcccgcctgcagtcccgaagccgcggcagctcaacttagagccaccgcgggatccctgatcctgccaccagggcctgggggcactatgaaacggcactctagcagagacgccgccggaaagccccagagacctagatcagctcctagaacctcaagctgcgccgaacgcctgcaatccgaagagcaagttagcaagaatctgtttggacctcctctggagagtgcatttgaccacgaagatttcaccgggtcaagttctctgggttttacaagctcgcctagtccattctcctcttcctcccccgaaaatgtcgaggacagcggccttgacagccccagtcacgcggcaccagggccatcacctgactcgtgggtgccccggccaggtacgcctcagtctccccctagctgtcgcgcccctcctccagaagcacgaggcatcagagcgcctcctttgccagactccccgcagcctctcgccagttctccgggcccctggggtttggaggccctggccggcggagatctgatgccagcacccgcagaccctaccgcccgcgaaggactggctgccccccctagacgattgaggtcaagaaaagtctcttgtccgttgaccaggagcaacggtgatctatcacgttctttgagtcccagtccgctgggctccagcgctgcctccaccgccctcgaaaggccaagctttctgagccaaacagggcacggtgtaagcaggggcccctcccctgttgtcttgggatcccaggatgctctgcccattgccaccgctttcacagagtacgtgcatgcatactttaggggccacagcccctcatgtctggcgagggtcacgggggaactaaccatgacattccctgccggcatcgtgagggtgtttagtggaacaccccccccgcctgtgctgagcttcagactcgtccataccacagctatcgaacacttccaaccgaatgcagatctcctgtttagtgacccatcgcaaagcgaccctgagaccaaggatttttggctgaacatggccgccctgaccgaggctctccagcgacaggcagaacaaaatcccactgccagttactataatgtcgtcctgctccgctaccaattttctcggcccggcccccagagcgtccctttgcaactgtccgctcattggcagtgcggtgcgactctcacccaggtttcagtggagtacggctatcgacccggcgctactgcggtacctacacctctcaccaacgtgcagattctcctgccagtaggggagcctgtcacaaacgtccgtctgcagcccgcagctacgtggaatctcgaggagaaacggttgacttggaggcttcctgacgtgtcggaggccgggggctctggccgcctgagcgcatcttgggagcctctgagcggcccatcaactccatcgcccgtggccgctcagttcacttcagaggggacaacactgagtggcgtagatttagagctggtcggaagcgggtaccggatgtccctggtcaagcggcgattcgctacggggatgtaccttgtgtcttgttag

SEQ ID NO: 187722 - DNA, 2670 bp, Artificial Sequence
  Description of Artificial Sequence: Synthetic coding sequence
atgagctacttcggcgagcacttctggggcgagaagaaccacggcttcgaggtgctttaccacagcgtgaagcagggaccaatctctacaaaagagctcgctgactttatccgcgaaagggccacaatagaggaaacatacagcaaagctatggccaagctctccaagctcgcaagcaatggcacgccaatgggcacgtttgccccactatgggaagtgtttcgtgtgtcatccgacaagctagcgttatgtcacctcgagctcacaagaaagctccaggacttgatcaaagacgtccttaggtacggagaagagcagttaaaaacacacaagaagtgcaaagaggaagtggtgagcaccctagatgcagtgcaagtgctgtcaggggtcagccagcttctgcctaaatccagagagaattatctgaatcgctgtatggatcaagaaaggctgcggagggagagcacatcacagaaggagatggataaggccgagaccaaaactaaaaaggcggcagagtccttacgccgttctgtggaaaaatacaatagcgcacgggccgactttgagcagaaaatgcttgattccgccctgaggttccaggctatggaggaaacgcatttacgccacatgaaggccctgctcggatcatatgcacattcggtggaggatacacacgtccagataggccaggttcacgaggaattcaagcaaaacattgaaaatgtatcagtcgagatgttgttacgtaaatttgccgaatctaagggtaccggtagggaaaaacccggtccgctagatttcgaagcctacagtgcagccgctctccaggaagctatgaagcggttgcggggagccaaagcctttcgattgcccggactgtctcgacgcgaacgagagccagaacctcctgcagctgtcgacttcctggagccggacagcggcacctgccccgaagtcgacgaagagggctttacggtgcggccggacgtgacccaaaattccaccgctgagccaagccgtttctctagtagcgattctgacttcgacgacgaggagccaaggaaattctacgtccacattaaaccagcccctgcacgggcgcccgcctgcagtcccgaagccgccgccgcacagctcagagcgactgccggttctctgatcctgcctccgggccccggggggaccatgaagcgacactctagccgtgatgccgcaggcaaaccccagagaccgcgttctgccccacgcacgagctcatgcgctgagcgcctccagtccgaggagcaggtatctaagaatctgtttggtcccccacttgaatcagcattcgaccacgaagattttactgggtcctcctcacttgggttcacgagtagtccaagccccttctccagcagctccccagagaatgtggaggattccggtctcgatagtcccagccatgcagcgcctggcccgtccccagatagctgggtcccccgacctggcaccccccagtctcctccctcgtgtcgggctccaccaccagaggctcgcggcattcgtgcgcccccactgccggactcacctcagcccctggcgtcctctccaggaccctggggactggaagccctggccggaggggacctgatgccggcgcctgctgaccccaccgctagggaggggctggctgcccccccacggcggttgcggagtcggaaagtgtcttgccctctgaccagaagcaacggtgacctttcgcgctcactgagcccctccccactggggagttctgcagctagcacagctctggagcgaccttccttcttatcccagaccggccacggcgtcagccgcggaccctctccggttgtcctcggttcccaggatgcactgccaattgctactgccttcacagaatatgtccacgcttactttcgaggccacagcccatcttgcctagccagagtgaccggggaactcactatgacgttccccgcaggaatcgtgcgagtgtttagcggcacgccccctccccctgtgctcagctttcgcctagtgcatacgactgcaatcgaacactttcagcctaacgccgacctgctgttcagtgatcctagccagtccgacccagaaacaaaagatttctggctgaacatggctgccctgaccgaagcgctgcagcgccaggccgagcagaatcctacagcttcgtactacaacgtggttctcttgcgatatcagttcagccgtcctggacctcagtctgttccgctgcaattatctgcgcattggcagtgcggcgccacattgacccaggtgtccgtggaatatggctaccgccccggtgctaccgctgtgcccacccctctgacaaatgtccagatactgttgccagttggggaaccagtaaccaacgtgagattgcagccagccgccacttggaacctcgaggaaaaaaggctgacatggcggctgcccgatgtgtccgaggcaggtggtagcggcagactcagtgctagttgggaacctctatctggaccatctaccccctcaccggtcgcagcacagttcaccagcgaggggacaactctcagcggcgttgatctcgaactcgtgggctcgggctacaggatgtcactggtaaagcgccgattcgcaaccggaatgtacctcgtcagttgctag

SEQ ID NO: 187723 - DNA, 2676 bp, Artificial Sequence
  Description of Artificial Sequence: Synthetic coding sequence
atgagctacttcggcgagcacttctggggcgagaagaaccacggctttgaagtcctttatcacagcgtgaagcagggtcctatatcaacaaaagagctagctgattttatcagggaaagagccaccatcgaagagacttattccaaagctatggccaaactgagcaagttagccagcaacgggacccctatggggacattcgcacctctctgggaagtctttcgtgtctcatccgacaagttggccctgtgtcaccttgagctgactcgcaaactgcaggacctgatcaaggacgtcctgaggtacggggaggagcagctcaaaacacacaaaaagtgcaaggaagaagtcgtctcaactttagatgccgtgcaagtgctttcgggagtgtctcagctgttaccaaagagtcgggagaattatctcaacaggtgcatggatcaggagagactgcggcgcgagtccacaagccagaaagaaatggataaggccgaaactaaaaccaagaaggctgcagaatcactgcgtcggtcagtagaaaagtacaactccgctagggcagatttcgagcagaaaatgctggacagcgccctgagatttcaggcaatggaagagacccaccttaggcacatgaaggccctacttgggtcctatgctcattcggtcgaagatacacacgttcagattggccaagtgcacgaggaattcaaacagaacatagaaaacgtgagcgtcgagatgctactccgcaagtttgcagaatccaaaggcactgggcgcgagaaaccaggaccattagattttgaggcttactcagccgccgcccttcaggaggccatgaagcggctcaggggtgccaaggcgtttaggcttccaggactatcacggcgggaacgggagcccgaacctccagcagccgtggattttctggaacccgatagtggcacctgtcccgaggtggatgaggaagggtttactgttcgcccagatgtcacccagaactctacagcagaaccctcccgattcagcagctctgattccgacttcgacgatgaggagccaagaaaattttatgttcatataaaacccgcacctgcacgcgccccagcttgctcccctgaagccgccgccgcgcagctaagagccacggctggaagcctaatcctgcctccaggccctgggggaacaatgaaaagacactcatcgagggacgccgccgggaaacctcaacggcctcgatcagctccccgcacatcaagttgcgcggagagactccagtctgaggagcaagttagtaaaaacctgttcggtccccccctcgagagcgctttcgatcatgaagacttcactggtagtagttctctcggcttcacaagcagtccctctccttttagctcatccagccctgagaatgttgaggatagcggcttggacagccccagccacgccgctccagggccttcccccgattcgtgggtcccacgtcctggcaccccgcaaagtcctccctcttgtagagctcctccccctgaagccaggggtatccgcgcgccacctctgccagactctccccagcctctagctagcagccctggcccttggggactagaggccctagctggtggagaccttatgcccgcccccgccgaccccacagcacgcgagggcctcgctgccccgccccggaggcttagatctaggaaagtgtcatgtcccctgactagaagtaatggggacttaagccgatccctgagtccctcacctctggggtcctccgccgcgtctactgcccttgaacggccgtcattcctgagccagaccggacatggagtcagccgcggcccttcgcctgtcgttcttggaagccaggatgccctgcccattgccacagcatttaccgagtacgtacacgcctacttcaggggacacagtccctcatgcctcgctcgcgtgacaggggaactgacaatgaccttcccagccggcatcgttagggtattcagcggcacaccaccccctcccgtcctctcatttcgtctcgtgcacacaaccgcaattgagcacttccagccaaatgccgacctgcttttctccgatccatcccaatccgacccggagacaaaagatttctggctcaacatggccgcccttaccgaggctttacagaggcaggccgaacagaatccaactgcatcctactataatgtagtcctgcttcgctaccagttctcacggccgggccctcagtccgtgccgttgcagctttctgctcattggcagtgcggggcaacactcactcaggtgtctgttgagtatggatacaggcccggggccaccgccgtacctactccactgaccaacgtgcagatcctgttacccgttggggaacctgtgacgaatgtcagacttcagccagcggccacgtggaatttagaggagaagcgcctgacgtggcggctgcccgacgtcagcgaagcaggtggtagtggaaggttatcggccagctgggagcctctgagtggcccatcaacaccgagccctgtggccgcccagtttacaagcgaaggcacaactctaagtggtgtggatttggagttggttgggagcgggtacagaatgtccctggttaaaaggcgattcgccacagctgctccgccacagggatgtacatggtag

SEQ ID NO: 187724 - DNA, 2520 bp, Artificial Sequence
  Description of Artificial Sequence: Synthetic coding sequence
atggccaagctgagcaagctggccagcaacggcacccccatgggcacattcgccccactgtgggaggttttccgcgtgtctagtgacaaacttgcactttgccatttagagctgactagaaaacttcaagatctgatcaaagacgtactgcgatacggagaggagcagctcaagacccacaaaaagtgtaaggaggaggtggtatctacactcgatgccgtgcaggttctcagtggagtgagccaactgttgcccaagagcagggaaaactatctgaacaggtgtatggatcaggagcgacttaggagagaaagtacatcccaaaaagagatggataaagcagagactaagacaaaaaaggctgctgagtcactgcgtcggtccgtcgaaaagtacaatagtgcaagagccgactttgaacaaaagatgcttgattccgctttgcggttccaggcgatggaagaaacccaccttaggcacatgaaagccctgctgggctcttatgcacatagcgtggaggacactcacgtgcaaattggccaggttcacgaggaattcaaacagaacattgaaaatgtgagcgtagagatgttgctgagaaagtttgccgagagcaaagggacaggacgcgagaagccgggacctctggacttcgaggcatattcagcggctgccttgcaggaggccatgaagcggctgcgtggtgctaaggcctttaggctgcctggcttgtctcggcgggaacgcgagccagagcctcctgccgcagtggatttcctcgagcctgacagcggcacctgccccgaagtagatgaggagggattcacagtcaggccggacgtaactcagaacagcactgccgagccctcacgcttcagctcaagcgacagtgattttgacgatgaggagccgcggaagttctatgtgcatataaagccggcaccggctcgtgctcccgcctgttctcctgaagcggccgcggcccagctgagagcaaccgcaggctccctgatcctgccccctggccctggcggtactatgaagcgccactcctcccgcgatgccgcaggcaaaccgcagagacctcgctccgcccctcgcacgagcagctgcgctgaaaggttacagtcagaggagcaggttagtaaaaacctatttggcccacctctggagagcgcttttgaccatgaggattttactggttcttccagcctcggctttaccagttctccttctcccttttcttcctcaagtcccgagaatgtggaagactcaggccttgatagtccttcacacgctgctcctggaccgagccctgatagctgggtgcctaggcccggtacgccacagtcacctccttcctgtcgcgccccaccacctgaagctcgtgggatccgcgcccctcccctgcccgactctcctcagccactggcgtcttcccccggcccttggggcctggaagcactggcaggaggtgacttaatgcccgccccggcagacccgactgctcgcgagggcctggccgcccctcctagacgcctgcgcagccgcaaagtgtcgtgtccattaacgagaagcaatggcgacctcagccgcagcctcagtccaagccccttgggcagctcagcggcatccactgccttagagcgaccctcatttctgagccagaccgggcacggggtcagccgcggccccagtcctgtagtccttgggtctcaggacgcactccccattgccactgcattcactgaatatgtacatgcctatttccgcggacatagtccttcctgcttagccagggttacaggagagcttacaatgaccttcccagctggaatagtaagggtcttctctgggactcctccaccccctgtcctgagttttcgactggttcatactacggctatcgagcattttcagcccaacgccgatttgctgttcagtgacccgtctcagtccgaccccgagactaaagatttctggcttaacatggccgctttaaccgaagccctacagaggcaggccgaacagaatccaaccgcttcttattataatgtggtactacttagatatcagttttctaggccgggcccacagtctgtgcccctacaactgtcagcacattggcaatgtggagcaactctgacgcaggtcagtgtggaatatggatatagaccaggagctaccgcagtaccaacaccgctgacgaatgtgcaaatcctcctgccggtgggcgagcctgtcacaaacgtccgcctacaacccgctgccacctggaacctcgaagaaaagcgactgacatggagactgcctgacgtttctgaggctggtggcagcggacgtctgtctgcttcatgggagcctctgagtggaccgagcacaccatcacccgttgctgcacagtttacaagtgagggcacgaccctctcaggcgtagatttagaactcgtcggctcaggatacaggatgagtttggtcaagcgaaggttcgccacagggatgtacctggtgtcctgctag

SEQ ID NO: 187725 - DNA, 2670 bp, Artificial Sequence
  Description of Artificial Sequence: Synthetic coding sequence
atgagctacttcggcgagcacttctggggcgagaagaaccacggctttgaagtgctttaccattctgtcaaacaaggtcctatcagcacaaaggagcttgcagactttattagggagcgggccactatcgaggaaacctactccaaagccatggccaagctttctaagcttgcttctaatgggacacctatgggcacctttgctcccctatgggaagtgttccgggtgtccagtgacaagcttgccctgtgccatctcgagctcactagaaaactccaggatctgattaaggatgtgctcagatatggggaagaacagctcaagacacacaagaagtgcaaagaggaggtcgtttccaccctggatgctgtgcaagtcctgagtggggtctctcagttgttgcccaagagtagagaaaattacctgaacaggtgtatggatcaggagagactgagacgtgaatcaactagtcagaaggagatggacaaggccgagactaagactaagaaggctgctgaaagcctgaggagaagcgtggagaagtataattccgcgagagccgacttcgagcagaaaatgttggactccgccctgcggttccaggcaatggaagagactcacttacggcacatgaaggcactcctgggcagttacgcacactcagtggaagatacccacgtgcagattggtcaggtgcacgaagaatttaagcagaacatagagaacgtctctgtggaaatgctcctgaggaaatttgccgaaagtaagggaactggaagggagaaacccgggcccttggactttgaagcctattctgcagctgcattgcaggaagcgatgaaaagactgcggggagcgaaagcattccgattacccggactctctaggagagagagagaaccagagccaccagctgctgtggatttcttagagccagacagcggcacttgccccgaggtggacgaggaaggctttacagttcggccagatgtgacccagaattctactgcagagcccagcaggtttagtagcagtgactctgactttgatgatgaagaaccgcgcaagttttatgtgcatattaagcctgctcccgctcgcgctccagcttgcagccccgaagccgccgccgcccagctcagagctacagccggcagtcttatactcccacctggcccaggtgggaccatgaagcgccattcttctagggacgccgcagggaagccgcagcggccccgcagcgctcctcgtacaagttcttgcgccgaaagactacagtcggaggaacaggtgtctaaaaacctgttcggcccacctctcgaatctgccttcgatcatgaggactttacgggttctagtagtctgggatttacgagcagcccatcacccttttctagctccagtcctgaaaacgttgaagatagtggactggatagcccttcccacgcggcgcccggtccatcgccggactcttgggttcctaggccgggaactccgcagtctcccccctcttgtagagcgcccccccctgaagctagagggatccgggccccccctttgcccgactcgcctcaacctctagcttcctcaccaggaccttgggggctggaggcacttgctggcggggacctgatgcctgcccctgccgacccaacagctcgagagggcctggccgctcctcccaggcgtctccgaagtcggaaggtgtcctgcccattgacacgatctaacggggacctcagcaggagccttagcccttccccacttggtagcagtgccgctagcaccgcgctcgagcggccttcattcttgagccaaactgggcacggcgtatcccggggaccctcccctgtggtcttggggtctcaggatgccttgcccatcgccaccgccttcacagaatatgtccacgcatacttccgtgggcacagcccctcttgtctggctagagtaactggtgaacttaccatgacattcccggccggcatagtccgcgtgttctctggcacccctcccccacccgttctgtcctttaggctcgttcatactaccgccatcgagcactttcaaccaaacgctgacctcttgttttccgatcctagccagagcgacccagagactaaggacttttggttgaatatggctgcgctgaccgaggctctccaacgtcaggccgaacaaaatccaacagcctcctattataatgtggtgcttctgcgatatcagttttctagacccgggccgcagtcggtgcccctccagctgtcagcacattggcagtgcggcgcaacattgacgcaggtgagtgtagaatatggatatagacccggagctactgctgtccctaccccgttaacaaatgtccagattttgctgcccgtgggagagccagtcaccaacgtgaggctgcagcccgccgcaacttggaacctggaagagaagagacttacatggcgtctgcctgacgtttctgaggccggagggagtgggcggctgtctgcatcctgggagccactttccggaccaagtacaccatcacccgtagctgcacagtttacatccgaagggaccactctcagcggggtcgacctggaactggtcgggtctggctatcgcatgtccctcgtcaagagaaggttcgcaacaggcatgtacctcgtctcctgttag

SEQ ID NO: 187726 - DNA, 2670 bp, Artificial Sequence
  Description of Artificial Sequence: Synthetic coding sequence
atgagctacttcggcgagcacttctggggcgagaagaaccacggcttcgaggtcttataccattccgtgaaacagggaccaatttctacaaaggagctggccgactttattagggaacgcgccacgatagaggaaacatacagcaaagccatggccaaactctccaagctggcctccaacggtacccctatgggcacatttgctccactgtgggaggtgtttcgcgtcagttctgataaactggccctgtgtcacttagagctcactaggaagctacaggacttgattaaggacgtactcaggtatggggaagagcagctaaaaacacacaagaagtgtaaggaagaagtggtttccaccctcgacgcagtacaggtgctctccggggtttcacagctgctgcccaaatcacgagaaaactacctcaaccgctgcatggatcaagaaaggttgcgacgtgagagtaccagtcaaaaagagatggataaggcagaaacgaagacaaaaaaagcggcagagtccctacggcgctcagttgagaagtacaattcagctcgcgctgactttgaacagaaaatgctggattccgctttgaggtttcaagcgatggaggagactcacttacgccatatgaaagcactgctggggtcatatgcccactccgttgaggatacccatgtgcagatcggtcaggtgcacgaggagttcaaacagaacattgaaaatgtgagtgttgaaatgctactgcgaaaattcgcagagtccaagggcacagggagggagaaaccaggccctctcgatttcgaggcttattccgcggctgctctgcaggaggcaatgaagagactgcgcggcgctaaggcctttcggttgccagggcttagccgcagggagcgagaaccagagccgccagctgccgtggatttcctggaacccgacagtggcacctgtcccgaggtcgatgaggagggctttacagttcgacccgacgttacgcagaattccaccgcagagcctagtaggttctccagttctgattccgattttgacgacgaggaaccacgaaaattctacgtgcatataaagccagcccccgcccgagcaccggcctgttccccagaagctgccgcggcgcagcttcgggccactgccggcagcctgatactgccacccggccctggagggaccatgaaacgccatagctcccgggacgcggcagggaaaccccagaggccgcgatccgcccctaggacgagttcatgcgcggaacggctccaatcagaggagcaagtgagcaagaacctatttggccccccactggaaagcgcatttgaccacgaggacttcaccggatcctcatccctcggatttacctccagcccttccccctttagcagttctagccccgagaatgtggaggactccggccttgacagccctagccatgccgcccctggtccttctcctgatagctgggtgcctcgcccaggcaccccacagtctcctcccagttgcagggctccacccccagaagctaggggcatcagagcccccccgctgcccgatagtcctcaaccactcgctagtagccctggaccatggggcctggaggctttggctggtggagaccttatgcccgcaccggcagaccccacggcaagggagggactcgccgcacctccgcggaggttacgctccaggaaggtgagttgtcccctgaccagaagcaatggggaccttagtcggagcctctcaccaagccctctcggtagtagtgcagcctctactgcactggaacgcccgtcatttcttagtcagactggccacggagtatcccgcggaccctcaccagtggtgctcgggtcacaagacgccctgcccatcgctaccgccttcacagaatatgtgcatgcatatttccggggacactctccatcatgcctggctagggtgacaggcgaactcaccatgacatttccagctggcatcgtccgcgtgttctcaggaactcctcctcctccagtgcttagttttagactagtgcacacgaccgctatagaacacttccagcccaatgcggatctgttgttctctgatccctcccagtccgaccctgagaccaaggacttctggttaaacatggccgctttaactgaagctctccagcgtcaggccgagcagaacccgactgccagttactacaatgttgtgttactccggtaccagttcagcaggccaggaccccagtcggttccactccaactgtcggcccattggcagtgtggcgctacacttactcaggttagcgtcgagtatgggtatagacccggggcgactgccgtccctaccccactcaccaacgtacagatcctcctgcccgtgggcgagccggttaccaacgtacgcctacaacctgcagcaacctggaatctggaggaaaagcgtttaacctggcgactgcctgacgtgagtgaggctggcggctcaggtcgcctgtccgccagttgggaacccctttccggcccctcaactccatcaccagtggcggcccagttcacttccgagggaaccaccctctccggggtggaccttgaactcgttgggagcggataccgtatgtccttggtcaaacgcaggtttgcaaccggcatgtacttggtgagctgctag

SEQ ID NO: 187727 - DNA, 1137 bp, Artificial Sequence
  Description of Artificial Sequence: Synthetic coding sequence
atggtgatggcctacttcgtggagaacttctggggcgagaagaactccggctttgatgtgctgtatcacaacatgaagcacgggcagattagtactaaagagctggccgacttcgtgcgagaaagggcgaccatagaggaagcatatagcaggtccatgactaagctcgctaaatcggcttctaattactcacagctaggcacatttgcgccagtctgggatgtctttaagacatctaccgaaaagttagccaactgtcaccttgatctggtgcgcaaactgcaggagctaattaaagaagtccagaagtatggtgaggagcaggttaagtcacataaaaagaccaaagaggaggttgccggaaccctggaagccgttcagactatacagtccataacccaggctctgcagaaatctaaggagaattataacgccaaatgtgtggaacaagaaaggttgaagaaggaaggtgccacacagcgggagatcgaaaaggccgccgtgaagtccaaaaaggccaccgacacgtacaaattgtacgtcgagaagtatgccctggccaaggctgacttcgaacagaagatgaccgagactgctcagaagttccaggatattgaagagactcacctgattcacattaaagaaatcattgggagcttgagtaacgccattaaggaaatacacctccagattggacaggtccatgaggaattcatcaataatatggctaacaccactgttgagtcgctgatccagaagttcgccgagtcaaagggtaccggaaaagagcgccctggtctgatcgaattcgaggaatgcgatacagcctctgcagtggagggcataaaaccacgcaagcgcaaaactttcgctctcccgggtattataaaaaaggagaaggacgccgaaagcgtgtggtctttcactgtggtggcccaagtgggaatgcagtggcgcgacctgggcctgctgcatagtcctccccccaggttcaagcgttttagttcctacctgtccttaccgagtagctggaattatggggcacatcaccacatctggcttatcttttgcatattcagccgagacagagtgagcccttactggccaggttggtctcgcactcccgacctgcgatag

SEQ ID NO: 187728 - DNA, 2433 bp, Artificial Sequence
  Description of Artificial Sequence: Synthetic coding sequence
atggtgatggcctacttcgtggagaacttctggggcgagaagaacagtgggttcgatgtgctctaccataatatgaaacacggtcagattagtactaaagaattagcagactttgtgagggagagagcaacaatcgaagaagcttactcccgatctatgaccaagctggcgaaatctgcatccaactatagccagctcggcaccttcgctcctgtgtgggatgtgttcaagacaagtaccgagaaactcgccaattgccacctggacctggtcagaaaactacaggagctcatcaaggaggtccagaagtatggggaagagcaagttaagagtcacaagaagacaaaagaagaagtggccggaactctggaagcagtgcaaaccatccagagcatcacccaagcgctccagaagagcaaggagaactataatgcaaagtgtgtggaacaggaaaggctcaagaaggagggagccacccagagagaaattgaaaaggccgccgttaagtcaaagaaggccaccgatacatacaagctctatgtcgaaaaatacgctctggctaaggccgacttcgagcagaagatgaccgagacagcgcagaaattccaggatatagaagagacacacttaatccacattaaagagatcatcggtagcctgtcaaacgcaatcaaggagatccatctgcagatcgggcaagtgcacgaagagtttattaataatatggcgaacacaaccgtggagagccttatccagaagttcgccgagagcaagggtactgggaaggaacgccctggactgattgagtttgaggagtgtgacacagcctctgcagtggaggggataaaacctcggaaaagaaaaacctttgcccttcccggtatcataaaaaaagagaaagacgccgagagtgtggagtgtcccgacgctgacagcctgaacattcctgacgtcgacgaagaagggtatagcatcaaacccgagacgaaccagaacgacacaaaggaaaaccacttttactctagcagcgatagcgattcggaagacgaggagccaaaaaaatacaggatcgaaattaaacccatgcatccgaacaactcacatcacacaatggcttcactggatgagctgaaggtcagtatcgggaatattaccctgagccctgccatcagcgtcagtaccaatacccgcctcaataggaattttaacgacgaagaattgaccaaaagcaagccatccgccccgcccaacgaaaagggcacatcggacctcctagcctgggatccactgttcgggccctcgctggatagctctagctcctctagtctgaccagttcttctagcgcacgccccacaaccccactgagcgtgggaacgatagtgcctccccccaggcctgcctctagacccaaacttacgagcggcaagctgagcggcataaatgagatccctcgtcccttcagtccaccagtcaccagtaacacgtctccaccacctgccgcccctctggcacgggctgaatcctcatcctctatttctagctccgctagcttgagtgccgccaatactccgaccgtgggggtgagtcgtggtccatcccccgtttcactgggtaaccaggatacactgcccgtcgctgtggctttgaccgagagtgtgaatgcctacttcaagggggccgacccaacgaagtgtatcgtaaaaattaccggtgatatgactatgagcttcccttcaggcatcataaaagtgttcacaagtaatcctacacctgcggtcttatgtttcagggtgaaaaacatcagcagactggagcagatcctgcctaacgctcagctcgtgttctccgacccttctcagtgcgacagcaacacgaaggacttttggatgaacatgcaagcggttaccgtgtacctgaaaaaactctcggagcagaatcccgcagcatcctattacaatgttgacgtgcttaagtatcaagtctctagcaatgggattcagtccacacctttaaacctggccacctattggaagtgtagtgctagcaccactgacctgcgtgttgattacaagtataatccagaagccatggtggccccttcagtgctgtcaaatatccaggtggtggtccccgttgacggaggcgtgacaaacatgcagtcactgccccccgctatttggaatgctgaacagatgaaggcattctggaagttatcaagtatctctgagaagagcgagaacgggggctcagggagcttaagagcaaagttcgatctgagcgaggggccatccaaaccaactacactcgccgttcagttcctgtcagaaggatcaactctgtctggagtggacttcgaacttgtgggaaccgggtaccggctgtctttaatcaaaaaacgttttgccacgggcaggtatcttgctgattgttag

SEQ ID NO: 187729 - DNA, 2433 bp, Artificial Sequence
  Description of Artificial Sequence: Synthetic coding sequence
atggtgatggcctacttcgtggagaacttctggggcgagaagaactccgggtttgacgtcctctatcacaacatgaaacatggacagatttctactaaggagctggccgatttcgtccgggaacgcgctaccattgaggaggcgtactcccggagcatgactaagctggccaagagcgcctcaaactattctcagctgggtacctttgcccccgtgtgggacgtatttaagacttcaacagagaaactcgcaaactgccatctcgacttagttcgaaaacttcaggaattgatcaaggaggtccaaaaatatggcgaggagcaggttaagtcgcataaaaaaactaaagaagaggtcgctggtaccctggaggcagtccagaccatccagtcaatcacacaagctctgcagaagtctaaggagaattataacgccaagtgcgtcgagcaggagcgactgaagaaagaaggcgccacgcagcgagagatagaaaaggccgctgtgaagagtaagaaggctacagatacatacaaactgtatgtggagaaatacgcgctggctaaagccgattttgagcagaaaatgaccgaaaccgcccagaaattccaggacatcgaggagactcacctgatccacatcaaagaaattattggttccctgtctaatgccataaaggaaattcacctgcagataggacaggtccacgaagagttcatcaataatatggctaacaccacagtggaaagcttaattcagaaattcgctgagtctaagggcacaggaaaggaaagacccggcctgatcgaattcgaagagtgtgacacagccagcgcagtggaaggcattaagcctcgcaaaaggaagacgttcgctctcccaggtataattaagaaagaaaaggacgctgaaagcgtcgaatgtccagatgcggattcactcaatattcctgatgtggatgaggagggttacagcattaaaccagagactaatcaaaatgacacaaaagaaaaccatttttactcctccagcgacagtgactcagaagatgaagaacccaagaagtaccgaattgagatcaagcctatgcacccaaataactctcaccataccatggcctccctagatgagcttaaggttagcataggtaatatcacgttgtctccagctatttcacgtcactcacccgtccaaatgaaccgaaacctctccaatgaagagctgaccaagagcaaaccttccgcccctcctaacgagaaggggacaagcgatctgttggcttgggatccactattcggcccgtccctggacagtagctcatcaagctctctgactagttcaagctctgctcgccccactactccactctctgtgggcacgatcgttcccccaccacggcccgcttctaggcctaaactgacttcaggcaagctttccgggattaacgagatcccgcgccctttcagtcctcctgttacctctaacacgagccctccccccgccgcccctttagcccgcgcggagtcatcttcttccatcagtagttcagctagcctcagcgcagctaacactcccacggtcggagtcagccgtggccccagtccagtctcattaggcaaccaggacaccttgcccgtcgctgtcgctctaacagaaagtgtgaatgcctactttaaaggcgctgacccaaccaaatgtatcgtgaagatcaccggagacatgaccatgtcttttccgtctgggatcatcaaggtgtttacaagtaacccaacacccgccgtactgtgctttagggtcaagaacatttccagactggagcaaatcttgcccaacgcgcagctggttttcagcgacccctcccagtgcgatagcaataccaaggacttctggatgaacatgcaggctgtgaccgtttacttgaagaagctgtctgagcagaacccggcagcaagctactataatgtggatgtactgaagtaccaggtctcttccaacggcattcagagcaccccgctgaatttggctacgtactggaagtgttctgcatccaccacagacctgagggtcgactacaaatacaatccggaggctatggtcgctccctccgtcctatcaaacatccaggtggtagttccagtcgacggaggagtcacaaacatgcaatctctgccaccggctatatggaacgcagagcagatgaaagccttctggaaacttagcagcattagcgaaaagtctgaaaatgggggctctgggtcactgagagctaagttcgacctgtcagaggggccaagcaagcctaccaccctggctgtgcagtttctgtcagagggaagcaccttgagtggagttgatttcgaactagttggcaccggttataggctatctttaatcaagaaacgctttgccactgggcgttatttggcggactgttag

SEQ ID NO: 187730 - DNA, 2334 bp, Artificial Sequence
  Description of Artificial Sequence: Synthetic coding sequence
atggtgatggcctacttcgtggagaacttctggggcgagaagaactccggattcgatgttctgtaccacaatatgaagcacggtcagatttccacgaaagaactagctgacttcgtgagggaaagggctactatcgaagaggcttatagccggtcaatgacaaagctcgctaaatccgccagcaattacagtcaactcggcacattcgcgcctgtgtgggacgtgttcaagacatccacagagaagctggccaattgccacctggacttagtaaggaagttacaggagttaatcaaggaagtacagaaatacggagaggaacaagtgaaaagccataagaaaacaaaggaagaggtagctgggacattggaagctgttcagactatccaatctatcacccaagctctgcagaaaagcaaggaaaactacaatgcaaagtgtgttgagcaggaaaggctcaaaaaggagggggctacccagagagagatagagaaagctgcggtgaagtccaagaaagcgacggacacttacaagttatacgtggagaagtatgcccttgctaaagccgacttcgagcagaagatgacagagaccgctcaggttcatgaggagttcattaacaatatggctaatactacagtggaatcactgatccagaagttcgctgaatcgaaaggaactgggaaggagcgccctggcctgattgaattcgaggagtgtgacaccgcttctgccgttgagggcatcaaacccagaaagcggaagaccttcgcactgcctgggatcatcaagaaggagaaggatgccgagagcgtcgaatgtccggatgctgattcactgaatatacccgacgttgacgaggaaggttactctattaagccagagacgaaccaaaacgacacgaaggagaaccacttctattcgagctctgattccgacagcgaggatgaggagccaaagaaatatcgcattgaaatcaaaccgatgcatcctaacaactcccatcacacaatggcctccctggatgagctgaaggttagcattggtaacatcaccctgtccccggccatctccagacacagccccgttcagatgaataggaacctttctaacgaggagttgacgaagagtaagccaagcgctccacctaatgagaagggtacctcagacctactggcctgggaccccctgttcgggcctagtctcgacagcagcagcagtagctcactgacaagttccagctctgccagacctaccacacccctatcagttggtacgattgtgcctcctccacggccagctagcagacccaagcttacaagtggaaaactgtctgggattaatgagatacctagacccttctcaccacccgtaacctccaatacatcccccccaccggctgccccgctcgctagggcagaatcatccagcagtatcagcagttcagcctccctttctgctgccaatacacccacagttggcgtctcaagagggcccagcccggtctccctcggtaaccaggatacattgcctgtggctgttgccctaacagaatctgtgaatgcatacttcaaaggagccgaccctaccaagtgtattgttaagatcacaggagatatgaccatgtccttccccagcggaatcattaaagtatttacatctaaccccacacccgccgtactctgtttccgggtcaagaatatttcaagacttgagcagatactgcccaacgcacaactcgtttttagcgacccttcccagtgtgacagtaacacgaaagacttttggatgaacatgcaagcagtcacagtctacctcaaaaagctttctgaacagaacccggccgctagttactataacgtagatgttctcaaatatcaagtgtcctcaaatggcatccaatccacaccccttaatctggctacatattggaaatgtagtgcctctaccacagacttacgagtagattacaagtataaccctgaggcaatggtggccccaagcgtcctctcaaatatccaggtcgtcgttcctgtggacggcggggttaccaacatgcagagtctgccccctgctatttggaatgccgaacagatgaaggcgttttggaaattgtcttcaatctcggaaaagagcgaaaacggcgggagcggcagtttaagagctaagtttgacctctctgagggccccagcaagcccaccacccttgccgtgcagtttctgtcagaaggcagtacactgtcaggtgtcgactttgagctggtgggcactggatatcgcctctctctcatcaaaaaacggttcgccacgggccgctatctagccgactgctag

SEQ ID NO: 187731 - DNA, 1668 bp, Artificial Sequence
  Description of Artificial Sequence: Synthetic coding sequence
atggcccggcccgacgacgaggagggcgccgccgtggcccccggccatccactggctaagggatacctgcctctgccgaggggggcccctgtagggaaagaatcggtggaattacaaaatgggcctaaagctggcacgttcccggttaatggtgccccccgtgatagcctggcagctgcaagcggcgtcctcgggggcccacagactccactggctcccgaggaagagacccaggccaggctcctgccagcgggagctggtgctgagacccccggggccgaaagctcccccctgccgctaacagccctttctccgcgccgctttgtggtgttgcttattttttcactttattcactggtcaatgcattccagtggatccagtatagcattatatcaaacgtgtttgagggcttttacggcgtcactctgctgcacattgactggttgagcatggtttacatgctggcctacgtgccgttgatctttcctgcaacttggctgttggatacccgtgggctccgcctcacagcccttctggggagcggactgaattgcctgggtgcctggatcaaatgtggttcagtacagcagcatttgttctgggtaaccatgttggggcagtgcctttgctctgtggcacaggtttttatacttggactcccctctcgaattgccagtgtctggttcggccctaaggaagtgagcacagcctgtgctacagctgtcttgggcaatcagctcggaaccgcagtgggctttctgcttcctccagttctggtgcctaatacgcagaacgacacaaatctgctggcctgtaatataagcactatgttctacggtacgtctgctgtagccactttactcttcatcctcactgctatagcatttaaggagaaaccacggtatcctcccagtcaggcccaagcagccctccaggattcaccaccagaggaatactcttataagaagagcatcaggaacctgttcaagaacatcccctttgtgctgcttcttattacctacgggatcatgacgggtgccttctattccgtgtccactctgctgaaccagatgatccttacctactatgagggagaggaggtcaatgctggacgaatcggcttgaccctagtggtcgcgggcatggtcgggtccattctgtgtggcctatggctggattacacaaagacctacaagcagacaactttgatcgtctacatattgagttttatcgggatggtgatcttcacgttcacactggatctgaggtacatcataatagtttttgttacaggtggtgtcctgggatttttcatgaccggttatttgcctttagggttcgagtttgcagtagagattacgtatcccgaaagcgaggggactagttctggactgctgaacgccagtgcacagatcttcggcatactgtttacactggcccagggaaagctgacttccgattacgggcctaaggctggaaacattttcctgtgcgtatggatgttcattggcattattctgacagcattgattaaatctgatctgcgccgccacaatatcaacatagggatcaccaatgttgacgtgaaagctattcccgcggattcccccactgaccaggagcctaagactgtgatgctcagcaaacagtcagagagtgcgatatag

SEQ ID NO: 187732 - DNA, 2469 bp, Artificial Sequence
  Description of Artificial Sequence: Synthetic coding sequence
atgggcttcggcagcgacctgaagaacagccacgaggccgtgctgaagctgcaggattgggagctccgtctgctcgaaacagttaaaaagttcatggccctgagaattaagagcgacaaagagtatgcctccacgctacaaaacttgtgcaatcaagtagacaaggaaagtacagtgcagatgaactacgtgtccaatgtgtcgaaaagctggttgctgatgatccaacaaactgagcagctgagccgaattatgaaaacccacgctgaggacctgaattctggaccccttcaccggttgaccatgatgattaaggacaaacagcaggtgaagaaaagctatataggggtccatcagcaaatagaagccgagatgatcaaggttactaaaacagagctggaaaaactgaagtgtagctatcggcaattaattaaagaaatgaactcagctaaggagaaatacaaggaggcacttgccaaggggaaagagacggaaaaagcaaaggagcgatacgataaggccactatgaagcttcatatgctgcataatcagtatgtcctggccttgaaaggggcacaattacaccagaaccaatactacgacattaccctcccactgctgctggacagtctgcaaaaaatgcaggaggaaatgatcaaggcactgaaagggatatttgacgaatattctcagatcaccagtctggttaccgaggagattgtcaatgttcataaggagattcagatgtctgtggagcagatcgaccccagcactgaatacaacaattttatcgatgtccatcgaacaaccgccgccaaggagcaggaaattgaatttgacacctcgcttctggaagagaatgagaacttgcaggcaaacgagatcatgtggaacaatctcaccgccgaaagccttcaggttatgctgaagacgttggccgaagaactaatgcaaacacagcaaatgttgcttaataaggaagaagcggtattagagctggagaagcggatcgaagaaagcagtgagacatgtgagaagaagtctgacattgttctgctgctatctcagaagcaagcactagaggaactgaagcaaagcgtccagcagctcagatgtaccgaagcaaagtttagcgcccaaaaggagttattagaacagaaggttcaggagaatgatggcaaagaacccccacctgtggtcaattatgaggaggacgcgcgttctgttaccagtatggaaaggaaagagcggctatcgaaatttgagagtattaggcactccattgctggaattatcagaagccctaagtccgctcttggatcttctgccctatcggatatgatttccatctcggagaagccactcgctgagcaggactggtatcacggggctataccccgtatcgaggcacaggaactcctcaaaaagcagggggatttccttgtacgcgagtctcatggaaaaccaggagaatacgtccttagtgtttattctgatggccagcgcaggcacttcattattcaatacgttgacaacatgtacagattcgaagggaccggtttctctaatatcccacagctgatcgaccaccactatacaaccaaacaagtgatcactaagaagtcgggcgtggtcctgttgaaccccatcccaaaagacaaaaagtggatcctgtcccacgaagatgtcatcctgggggagcttctcggtaagggcaactttggggaagtgtataaagggaccttgaaagataagacatctgtagcagtgaaaacttgcaaagaagacttgcctcaagagctgaaaatcaaatttctgcaggaggccaagatacttaaacagtacgaccaccccaacatcgtgaagctgattggagtctgtacacagaggcagccagtttacattatcatggaacttgtctcaggcggcgatttcctgacatttctgagacgaaagaaagatgagttgaaactgaaacagttggtgaagttctctctggacgccgctgccggtatgctgtacctggagagcaaaaactgcatccacagagaccttgccgctcgcaattgtctcgttggcgagaacaatgttttaaaaattagtgacttcggaatgagccgtcaggaggacggcggagtttattcctcatctggcctgaaacagatcccgatcaaatggaccgccccggaagcattgaactacggcagatactcaagcgagtctgatgtctggtcctttggcatcctcttatgggaaactttttctctaggcgtctgcccatacccaggcatgacgaaccagcaggccagggagcaggtggaacgagggtaccgcatgtccgcaccccagcactgtcctgaagatatcagcaagatcatgatgaaatgttgggattataagccagaaaatcgtccaaagttctcagagcttcagaaagagcttaccattatcaagcgtaaactgacttag

SEQ ID NO: 187733 - DNA, 1944 bp, Artificial Sequence
  Description of Artificial Sequence: Synthetic coding sequence
atgaagctgcacatgctgcacaaccagtacgtgctggccctgaagggtgctcagcttcaccagaaccagtactacgacatcaccctgcctctactgctggattcccttcagaaaatgcaggaggagatgatcaaggcactgaaaggaattttcgatgaatacagtcagattacgagtcttgtaacggaagagatagtcaatgtgcacaaggagatccagatgtcagttgagcagatcgatccatctacggaatacaacaattttatcgacgtccataggacaacagccgctaaagaacaggaaatcgaattcgatacctcactgctggaagaaaatgaaaacctgcaggccaacgagattatgtggaataacttgaccgccgaaagtctgcaggtcatgcttaagacgctggctgaagagctcatgcagacccagcaaatgctcctgaacaaagaagaggcagtactggagttagagaagcgaatagaggagtcatctgaaacctgcgagaaaaaatccgatatcgtactgctgttgtcacaaaagcaggccctggaagaactgaagcagagtgttcagcaactcagatgcacagaagccaaatttagtgctcagaaagaactgttggagcagaaggtgcaggaaaacgatggaaaagagcccccgcctgtcgttaactacgaagaggacgccagatcagtgaccagtatggagaggaaggaacgtctaagcaagttcgagtccatacgccactcgatcgccggcattatccggtcccctaaaagcgcactcggctccagcgctcttagtgacatgatctccattagcgaaaagcctttagccgagcaagactggtaccatggcgcaattccccgcatcgaagcacaggaactcctcaaaaaacagggggatttcctggtaagggaaagccacggcaaacctggtgagtacgtactgtcagtgtattccgacggacagcgccgccattttatcatacagtacgtggacaatatgtatcgctttgagggcactggtttctccaacatacctcagcttatcgaccatcattacacaacaaagcaagtcatcaccaagaaatctggagtggtgctgttaaatcccattcccaaagataaaaagtggatcctgagccacgaagacgtgatattaggcgagctactgggaaagggcaattttggagaagtgtacaaagggactcttaaggacaaaaccagcgtcgcagttaaaacctgcaaggaagacttgcctcaggaactaaagataaagttcctgcaggaagcaaagatcctgaaacagtacgatcatcctaatatcgttaagttgattggcgtatgcacccagcgacaaccagtgtacatcatcatggagctggtttctggcggagactttctcacctttttgcggcggaaaaaggatgaattaaagctcaagcaactggtcaagttcagcctcgatgccgcggccggaatgctatacttggagtccaaaaactgtatacacagagacttggccgcacgaaattgtctggtgggggagaacaacgtcttgaaaatctcggactttggtatgtctagacaggaagacggcggtgtgtattctagtagcgggttgaaacagatccccattaaatggacagcgcccgaggctctaaactacggacgatactcatcagaaagtgatgtgtggtcttttgggatcctgctgtgggaaactttctctctgggggtgtgtccatatccaggaatgaccaatcagcaggctagagaacaggtggagcgaggctataggatgtccgctcctcagcattgcccagaggatatcagcaagattatgatgaaatgctgggactacaaacccgagaaccgacctaagttctctgaactccagaaggaactaaccattatcaagagaaaattgacctag

SEQ ID NO: 187734 - DNA, 981 bp, Artificial Sequence
  Description of Artificial Sequence: Synthetic coding sequence
atgggcttcggcagcgacctgaagaacagccacgaggccgtgctgaagctgcaagattgggagctccgcttactggagactgtgaagaagtttatggccctgagaatcaagagcgataaagaatacgccagtaccctgcagaatctttgtaatcaagtggataaggaatccactgttcagatgaactatgtctccaatgttagcaagagttggctacttatgatccaacaaactgagcagctcagtcgcatcatgaaaactcatgccgaggatctcaactcgggtcctctccatcgactcacgatgatgatcaaggataaacaacaagtgaaaaagtcctatataggggttcatcagcagatcgaagcagagatgattaaagtgacgaagactgaactcgagaagctgaagtgcagctaccgccagctgattaaagaaatgaacagtgctaaggagaagtataaggaagctctggccaagggaaaagaaaccgagaaggcaaaggagagatatgataaggcaacaatgaaactgcatatgttacacaatcaatacgttctggcactcaagggggcacaattacaccagaaccaatattacgatatcacgctgcctctgcttctcgattctctgcaaaaaatgcaagaagagatgattaaagctctgaaaggcatctttgacgagtattctcagattaccagcttagtaacagaggaaattgtcaatgtccacaaagagatacagatgtcagttgagcaaattgatccttccaccgagtataataacttcattgatgttcacagaactacagccgcaaaagaacaggagatagaatttgataccagtctgctcgaagaaaatgaaaatctccaggccaacgagataatgtggaataacttaacggctgaatctttgcaagtcatgaaagagcgccgcgggtatccgaatctgaatttattcgtgatacagctcctggaatag

SEQ ID NO: 187735 - DNA, 3855 bp, Artificial Sequence
  Description of Artificial Sequence: Synthetic coding sequence
atgcacgtgttcatcgtgggcatgagcctgagcagcgtgaccctggcctctgcccttcaggttaggggggaggctctgtcagaggaggaaatctggtctctgctctttctcgccgctgaacagctgctcgaagacctgagaaatgactcaagcgactacgtagtctgtccttggagcgctttattgagcgctgcaggatccctctcattccagggccgagtttcacatatcgaggcagctccattcaaagcacctgagctcttgcaaggccagtctgaggacgagcagcctgacgcttcgcaaccactgcagctgtgtgaacctctacatagtatccttctaacaatgtgcgaggaccagccccaccgacgatgcaccctccagtcggttctagaggcttgccgggtacacgaaaaagaagtgtcggtttaccccgcccccgctggacttcacattaggaggttggtgggcctcgtcctggggaccatttccgaagtcgaaaagagggtggtggaagagtcatctagtgtccagcagaacaggtcatatctcttacgtaagcgattgcgcggcactagtagtgaaagtcccgcggcccaggcaccagaatgtctgcacccatgccgcgtgagcgaaaggtctacagagacccagtcttctcccgagccacattggagcacattaacacacagccactgctcactgcttgtgaaccgtgccctgcccggggccgatcctcaggatcagcaggcaggacgacgcctaagttctggctccgtccacagcgccgccgattccagttggccaacgacaccttcacagcgggggttcctccaacgaaggagcaagttctctagacctgagtttatactgttagccggggaagctcctatgaccctgcacctcccagggagcgtggtgactaaaaagggcaagagctacctggcactgagagacctgtgtgtggtccttctgaacgggcaacacctcgaagttaaatgtgacgtggaaagcacggtgggagcagtgtttaatgctgtcactagcttcgctaatctggaggagctcacctattttgggttggcctacatgaagtccaaggaattttttttcctggattcagagacgcgcctctgtaagatagccccggagggatggagagagcagcctcagaagaccagtatgaataccttcaccttatttctgcgcattaagttcttcgtttcccactatggcctactacaacacagtttgaccagacatcagttctacctgcaactcaggaaagatattctggaagagagactctattgcaatgaggaaatcttattacaattaggagtgctcgccctccaggcagagttcggcaactacccaaaagaggttgaatccaagccctacttccatgtcgaggactatatccccgcttcacttatagagagaatgaccgcgctaagagtgcaggttgaggtgagcgagatgcacagattatcttctgccctgtggggagaagatgctgaactgaagttcctacgggttactcagcagttgcccgaatacggggtactcgtacatcaggtgttctccgagaagcgacgccccgaagaggagatggcactgggaatatgcgccaagggtgtgatcgtttacgaagttaagaacaattcacggatagccatgctgcgctttcagtggcgggagacaggcaaaatttcaacttatcagaaaaagttcaccatcacatcctcagtgacgggaaaaaagcacacctttgtgacagactccgctaagacttccaaatatctgctggacctttgcagtgcgcagcatggcttcaatgcgcagatgggatctggtcaaccttcccatgtgctctttgaccacgacaagtttgtgcaaatggctaacttatctccagctcatcaggcacgttctaagcccctcatctggattcagagactgagttgctccgaaaacgaacttttcgtgtctagactgcagggggctgccgggggcctgctttccacgtctatggataactttaatgtggatgggtctaaagaggctggcgcagaagggataggccggtctccatgtactgggcgggaacagttgaagagcgcttgcgttatccagaaacccatgacatgggactcactgtctggccctcccgtgcagtctatgcacgccggttcaaagaataaccgcagaaaaagctttatcgctgaaccaggtcgtgagatcgttagggtcacactgaaaagggacccccaccgaggttttgggttcgtgataaacgaaggcgaatactctggccaggccgatccaggcatattcatctcctcaatcattccaggcggacctgccgaaaaggccaaaaccatcaagcctggcggacagatcttggcattgaatcacattagcctggagggattcactttcaacatggcggtccggatgatccagaattctccagataacattgagttaattattagccagtcgaaaggggtgggggggaacaatccagatgaggagaagaatagcactgctaattcaggcgtctcatcaactgatattttgagctttggttaccaggggtcattattgtcccatacacaggaccaggatcggaacaccgaggagctggacatggccggtgttcaatcactggtcccccgcctgagacatcagctgtcattcttgcccttaaagggcgccggatcatcctgccccccttctccgccagaaattagcgccggcgagatctacttcgtggaactcgtgaaagaggacggaacactgggcttctcagtaactggggggattaatacatctgttccctacggaggcatctacgtcaagtcaattgtgcccggaggcccagccgcaaaggaaggacagatattacagggggaccgtctgctgcaagttgatggagttatcctttgcgggctaacccataagcaggccgtccagtgcctcactggacctgggcaagtggccagactggtcctggaacgcagagttccgcggagtacccaacaatgtcccagcgccaatgactcgatgggggatgaaagaacagctgtgagcctcgttaccgcattgcccggcaggcctagcagctgcgtatccgtcactgatgggccgaagttcgaggtaaagttaaaaaagaatgccaatgggctgggtttctccttcgtgcagatggaaaaagagtcctgctcacacctgaagagcgatctcgtccggattaaaagacttttccctgggcagcccgccgaagagaatggcgctatcgccgctggggacatcatcctggccgtcaacgggcgctctaccgaaggacttattttccaggaagtactgcatctgctccgtggcgcaccgcaggaggtgacactgctactctgtcggccaccaccgggcgcgttgccagaactggaacaagagtggcagacgccagagctttccgctgataaggaattcactagagctacttgcaccgattcctgtacctcaccaattctggaccaggaagatagctggagagattccgcttcgcccgacgccggcgaagggctcggactcagaccggagtcttctcaaaaagccatccgcgaggctcagtgggggcaaaaccgcgagagaccttgggcgagttcactcacgcactctcccgagagccatccccatttgtgcaaactccatcaagagcgcgatgaatcgacactggctacctctcttgaaaaggacgtaagacaaaattgttatagtgtttgtgacatcatgcggctaggcagatattctttctcctctcctttgaccagattgagcacagacatcttctag

SEQ ID NO: 187736 - DNA, 3930 bp, Artificial Sequence
  Description of Artificial Sequence: Synthetic coding sequence
atgcagcccctgaccaaggacgccggcatgagcctgagcagcgtgacactggctagcgcgctacaggtaagaggggaagccttgtctgaggaagaaatctggagtctcctgtttctcgctgccgaacagctgcttgaagacctcagaaatgattcatccgattacgtggtttgtccatggtctgcactcctgagcgcggcgggaagcctctctttccagggacgagtctcgcatattgaggccgcgccttttaaggctcctgaattactgcaggggcaatccgaggatgagcagcccgatgcatctcagatgcatgtctacagtctcgggatgacactgtactggagcgccggatttcacgtgcccccccaccagccattgcaattatgcgagcccctccactccattctactgactatgtgtgaagaccagccacaccggcgctgcactctgcagtcagttctggaagcatgtcgggtacacgaaaaagaggtttcagtctaccccgcacccgccggcctgcatattagaaggctcgtcggtcttgtgctcggaacaattagcgaagtcgagaagagagtggtggaggagagctcctcagtacagcagaatcgctcctatctgctgcggaaacggctgcggggaacaagtagtgagagtcctgctgctcaggctcctgagtgtctgcacccgtgcagggttagcgaaaggtctactgagacacagagcagccccgaaccccactggtctacactgacgcactctcattgttctctgctggttaatcgtgcacttccaggtgcagaccctcaggatcaacaggcaggaagacggctgagcagcgggtcagtgcactccgccgccgactcctcgtggcctactactcctagtcagcgcggcttccttcagcggaggagtaaattctcccgcccagaattcattctgctggctggagaggcaccaatgaccctccacctcccaggctcagtggtcacaaagaagggcaagagctatctagcccttcgcgatctgtgtgtggtgctgcttaatgggcagcatctagaggttaagtgcgatgttgaaagcacagtgggagccgtgtttaatgcagtcacttccttcgccaacctggaggagctgacctattttggacttgcctacatgaagagtaaggagttttttttcctagactcggagacgcgcctgtgtaagattgccccagagggatggcgcgaacagccccagaagacctccatgaatacctttacactcttcctcagaattaagttctttgttagccactacgggttgctacagcattccctaacaagacatcagttttaccttcagctaaggaaggatatattggaggaaaggctctattgtaatgaggagattctgttgcaattgggagtgttagctctccaagccgagtttggaaactatcctaaagagcaagtggaaagcaagccttacttccacgttgaagactacatacctgcttcacttatcgaaaggatgacagccttgcgcgtgcaggttgaagtctcagagatgcaccggctcagcagcgctctctggggggaagacgccgaactcaagtttctgagggtgacgcagcaactgcccgagtatggcgtgctggtccatcaggtttttagtgagaaacgacggccagaggaagaaatggccctgggcatctgcgcaaaaggagtgatcgtgtacgaagtcaagaataactctcgtatcgcaatgttgcgctttcaatggagagagacgggaaagatttccacttaccaaaaaaagtttacaatcacctcttccgtgacggggaaaaagcacacgtttgtgacagacagcgcaaagacctctaaatacctgcttgatctgtgctctgcgcagcacggcttcaatgctcagatggggtctgggcagccctctcacgtgctgttcgaccacgacaaatttgtgcagatggctaaccttagccccgcccatcaggccagatcgaaaccactcatttggatccagcgtctatcatgtagtgaaaacgagctgttcgtcagcagactgcagggagctgccggggggctgttgtcaacatccatggacaatttcaatgtggatggctcgaaggaagcaggggctgaagggataggcagaagcccgtgcactggacgagaacagttaaagtcagcctgcgtgatccagaagccaatgacatgggatagtctgtctggaccccccgtccagagtatgcatgcaggctcaaagaacaatagacggaaatcttttatagcagagcctggcagggagattgtgcgggtcactctgaagcgtgacccccaccggggtttcggttttgtgattaatgagggcgaatatagtgggcaagccgatccagggatattcatttcttcgatcattcctgggggtccggccgaaaaagccaagacgataaaacctggggggcagatcctagccttaaatcatattagtttggaaggattcactttcaatatggcagtgcggatgatccaaaattcacctgacaatatcgaactcattatcagccagtctaagggggtcggcggtaacaatcctgacgaggagaagaattcaacagcaaactcaggcgtttccagcacggatattctgtcctttggttaccaggggtcccttttgtcacatacccaggatcaggaccggaacacggaggagttggacatggcaggcgtccagtccctggtcccccggctgcgtcatcagctgtcgttcctcccactgaaaggggccggctcatcgtgtcccccgagcccccccgagatctcagctggtgaaatttactttgtagaattagtgaaagaggacgggacactgggcttttccgtcacagggggcattaacacctccgttccctatggaggcatctacgttaaatccatcgtaccaggtgggcccgctgcaaaggagggacagattctccagggcgataggttgctacaggtggatggtgtaatcctctgcggcctcacccacaaacaagcagttcaatgcttgactggccctggccaggtcgctcggctggtgctcgaacgaagggtacctaggtctactcagcagtgcccatcagccaacgattccatgggagacgagagaaccgctgttagcctggtcacagcccttcccgggaggccatcctcttgtgtgagcgtcaccgacggacctaagttcgaggtgaagctgaagaagaacgccaatggcctgggtttttctttcgttcagatggaaaaggagtcctgctcccatttaaaatccgatttggtccgcattaagcggctattccctggccaaccggccgaagaaaatggtgctattgccgccggagacatcatcttagccgttaatggacgcagcaccgagggattgattttccaggaagttctgcacctgcttcgcggcgcccctcaagaggtgactttactcctatgccggccaccacctggagccctccctgagctcgagcaggaatggcaaaccccagaactctcagcagacaaagagttcacccgggccacctgcactgattcctgtacaagccccatcctagaccaggaagacagttggcgcgattcggccagtcccgatgccggggaaggtttggggctgcggccggaatcctctcaaaaagcaattagagaggcacagtgggggcagaatcgcgagcgcccttgggccagttcattgactcattccccggagagtcatccccatctgtgcaaacttcaccaggagcgtgacgagtccacactggctacttccctggagaaggatgtgaggcagaattgctacagcgtgtgtgacataatgcggctggggcggtatagcttcagttcgcctctgacgaggctgtctacagatatcttttag

SEQ ID NO: 187737 - DNA, 3834 bp, Artificial Sequence
  Description of Artificial Sequence: Synthetic coding sequence
atgagcctgagcagcgtgaccctggccagcgccctgcaggtgcggggagaggcactgagcgaagaggaaatctggagcctattattcctcgccgccgaacaactgctggaagatctcaggaacgacagttctgactatgttgtatgtccttggagcgcactcctgtccgcagccggttccctctcgtttcaggggagggtgagtcacatcgaggcagctccatttaaggctcccgaactgctgcagggtcagagtgaggacgagcagccggatgcctcacagcctttgcaactgtgcgagcccctgcacagtatactgctgaccatgtgcgaggaccagccacacagacgctgtactttgcagtcagtactcgaagcatgtagggtccatgaaaaggaggtctctgtgtaccccgcacctgccggtctgcatatccgacggctcgttggccttgtgcttggcacgatttcagaggtggagaagcgggttgtggaagagagcagcagcgtgcagcagaacaggagctatttgctccgcaaaagacttaggggcacatcttccgagagtccagccgcgcaggccccagaatgtctccacccttgcagagtatccgaaaggtctaccgagacacagagcagccctgaaccacactggtctacactgacccacagccattgttctctgctggtgaacagagccctgcctggagcggacccccaggaccagcaagccggacgacggctgtcttccggtagcgtgcactctgccgccgattcctcatggcccacaacaccaagccagagggggtttctccagagaagatccaagtttagtcgcccagagtttatactcctggcaggcgaggcccctatgaccctccatcttcccgggtctgtggtgactaaaaaaggcaagagctacctagccctaagggacctctgtgtggtgttattgaacgggcagcatttagaggtgaaatgcgatgtggagagtacagttggagctgtgttcaacgctgtcacgagcttcgcaaaccttgaagaactaacgtattttggtctcgcttacatgaagagcaaggagttttttttcctggatagcgagaccaggttatgcaaaatagctcccgagggatggagggagcagcctcagaaaacttctatgaacaccttcacccttttcctaagaatcaagtttttcgtgtcccactacggtctgttgcagcattccctgacaaggcatcaattctatctgcaactcaggaaggatattctggaggaacgtttatattgtaacgaagaaatcctcttgcagctgggcgttctcgcattacaggccgagtttggaaactaccctaaggaagtggagtctaaaccgtatttccacgtagaagattacatacccgcaagtttgattgaacgcatgaccgctctgagggtgcaggtagaggtctctgagatgcatcgcctctcatccgctttatggggcgaagatgcagagcttaagttcctccgcgtcacacagcagctgccagaatacggtgtgttggtgcaccaggtgttcagcgaaaagcggagacctgaggaagagatggcattagggatttgtgctaaaggtgttattgtgtatgaagtcaagaataatagcagaatagcgatgcttcgcttccaatggagagaaacgggaaagatttccacctaccagaagaagttcaccattacatcttctgtgacaggcaaaaaacatacctttgtgaccgattcagcgaaaacttctaagtacttgctagacctgtgttctgcacagcacggttttaatgcacagatggggtccggacaaccatcccacgtcttgtttgaccatgataagttcgtgcagatggcaaacctgtcacccgcccaccaggcccgttccaagccccttatctggatacagcgtctgagctgtagtgagaatgagctgtttgtatcacgcctgcagggcgcagctgggggcctgctgagcacgagcatggacaattttaatgtagacggcagcaaggaggcaggggcagaaggcatcggaagaagtccatgtaccgggcgggagcagttgaaaagcgcgtgcgttattcagaagccaatgacttgggatagcctgagcggccctcccgttcagtcaatgcacgcaggctctaagaataaccgcagaaaatcctttatcgctgaacccgggagagagattgtgcgtgtcaccctgaagcgggaccctcatcgcggcttcggcttcgtgatcaatgagggcgagtattccggccaggctgatccaggaatatttatttcctcaattatccccggagggccggccgagaaagcaaaaacgattaagcccggcggccagatcctggctcttaaccacatctccctggaggggttcaccttcaacatggcggtgcggatgatccagaacagtcccgacaacatcgaactaattatcagtcaatccaaaggagttggcggcaataaccctgatgaggagaagaactctaccgcaaactccggcgtgagtagcactgatatcttatccttcgggtatcagggtagcctgctttctcatacccaggaccaggaccggaacactgaggagctggatatggccggcgtgcagtcgctcgtgccccgactcagacaccaactatcttttctcccactaaaaggagccggctctagttgccccccaagtcctccagagatcagcgccggcgaaatctacttcgtggaattggttaaagaggacggcacattgggctttagcgtaaccggcggtattaacacctcagttccttatggaggcatctacgtgaagtccatcgtgccaggcggcccagctgctaaggagggccagatcctacagggcgacaggctcctacaagttgacggtgtgatactgtgcggcctgacacataaacaggcggtccaatgcctgactgggcccggacaggtggctcggctagttctggaacgtcgggttccacgatcaacacagcagtgtccatctgccaacgatagcatgggtgacgagaggactgcggtcagcctggtgaccgctctgccaggaaggccttcatcctgcgtttccgtgacagacggacccaagtttgaagtgaagctgaagaagaacgcgaacggactaggcttttctttcgtgcagatggaaaaagagtcgtgcagccacttgaaaagcgatctggtgcggatcaagcgacttttccctggccagccagcagaggaaaatggtgcgatcgcagctggcgacatcattctcgctgtgaatgggaggtctactgagggactaattttccaggaggtgttacacctcttgagaggggctccgcaggaggtgacactactcctctgtcgccccccaccaggagcgcttcccgaacttgaacaggagtggcaaacccctgagttgtcggctgataaagaattcacaagggccacctgcacagactcctgcacctcacccatcttagaccaagaagattcttggcgggactccgcgtcccctgatgcaggcgagggcctaggccttcgaccggagagctctcaaaaggccatcagggaggctcagtggggacaaaaccgagaaagaccctgggcctccagtcttacacactcccccgaaagtcaccctcatctgtgtaaattgcaccaggaaagagacgagtccacattggcaacttccctcgagaaggatgtgagacaaaattgttacagcgtctgtgacatcatgcgccttggccgctacagcttttcaagtccgctgaccagactgagtaccgacatcttctag

SEQ ID NO: 187738 - DNA, 786 bp, Artificial Sequence
  Description of Artificial Sequence: Synthetic coding sequence
atgggcgacgagcggaccgccgtgagcctggtgaccgccctgcccggacgaccaagctcctgcgtgagtgtgacagacggaccaaagttcgaggtgaagctgaagaagaacgccaacggcctcggatttagctttgttcagatggaaaaagaatcttgctcccacctgaagtctgatttagttcgaattaagagactgttccctgggcagcctgccgaagagaatggagccattgccgcaggcgacatcattctggccgtcaacgggcgtagtaccgaaggattaatcttccaagaagtgttacacctcttgcggggcgcgccgcaggaagtgaccctgttactgtgccggcctccccctggggcactccccgaattggagcaggagtggcagactcccgagttgagcgcagacaaggagtttacaagagcgacttgcactgatagctgcacatcccctatccttgaccaagaggacagctggcgagatagtgccagtcccgatgcgggtgagggcttgggtcttcggcctgaatcttcccagaaggccattagagaggcacagtggggccaaaaccgagagaggccctgggctagctccctgacacactcaccagaatcacaccctcacctgtgcaagctccatcaagagagagatgaatcaaccttagctacctccctggaaaaagacgtccgtcagaattgttattcagtatgcgacatcatgagactgggacggtactctttctcttcacctcttactcggctttccactgacatcttttag

SEQ ID NO: 187739 - DNA, 3936 bp, Artificial Sequence
  Description of Artificial Sequence: Synthetic coding sequence
ttcagcagccaccggaccaagagcagcggctggcccccccccagcggaacttggggactttcccaggtgccaccttacggatgggaaatgaccgccaaccgagatgggagagactactttattaatcacatgacgcaggcaattccattcgatgaccctagactggaaagttgccaaattattcctccagctccaagaaaagtcgagatgcggagggatccagttctggggtttgggtttgttgctggctccgaaaagcctgtcgtggtgcggtccgtcaccccaggcggtccttctgaaggtaagttgatccccggtgatcagatagtcatgataaacgacgagcccgtcagtgctgccccccgagagcgggtaatcgacctggtaagatcgtgcaaggaaagcatcctcctaacagtcatacaaccctacccgtcccccaaaagtgcgtttatctctgctgccaaaaaagcacgattgaagtcaaatccagtgaaagtacgcttcagcgaagaggttatcatcaacggccaggtctctgagactgtgaaagataatagtttgttattcatgccaaacgtgctgaaggtgtacctagagaacggccagaccaagagctttcggttcgattgctccacctctatcaaggacgtgatcctgacattgcaagaaaagctctccatcaaaggcattgagcacttcagcttaatgcttgagcagcgaactgagggcgccggcacaaaactgctgctactgcatgagcaggaaacattaactcaggttacgcagcgccccagcagccataagatgagatgtctcttccggatcagcttcgtgcccaaggaccccatagacttgcttagaagagacccggtcgcatttgagtatttgtatgtccagtcttgtaacgatgtagtgcaggaaaggttcggccctgaacttaagtacgatattgcactccgacttgccgccctacaaatgtacattgccaccgtcacaaccaaacagacccagaagatctcactgaaatacatcgagaaggagtgggggcttgagacttttctgccttccgctgtcttacagtcaatgaaggaaaagaatatcaaaaaagcgttgtcacacttagtgaaagcaaatcagaatctggttcctcctggaaaaaagctgtctgcactccaggccaaagtgcactacctaaaattcctctctgatttgagactctacggaggtagagtgttcaaagctactttagtgcaggctgaaaagaggtcagaagtgaccctactggtcgggccccggtatgggatctcccatgtgattaacactaaaaccaatttggtggccctcctggcagacttctcccacgtcaatcggatagagatgttcagtgaggaagagtccctggtcagggtagagctgcatgtactcgatgtaaaacctattactctcctgatggaaagctccgacgctatgaatctggcctgccttacagctggctactacagacttttggtggacagcagacgctccatctttaacatggccaacaaaaagaatactgccacccaagaaaccgggccagaaaataaaggtaagcacaacctgttgggacctgactggaattgtatccctcaaatgacaacatttatcggcgagggtgaacaggaagcacagataacctatattgactctaagcagaagactgtggagatcactgattcaaccatgtgtcccaaagaacataggcatctttatattgataacgcatattcatccgatggacttaatcagcagctgtcccaaccgggagaggcaccctgcgaggccgattaccgcagtctggctcagagaagtttactgactctgagtggccctgaaactctgaagaaagctcaggagagcccccgcggagctaaggtttcatttattttcggggacttcgctctggatgacgggatttctcctccaacgcttggatacgagacactactggacgaggggccagagatgctcgaaaaacaaagaaatctgtacatcggtagtgctaatgatatgaaaggactggatctgacgccagaggcagaaggtatccagttcgtggagaatagcgtctatgcgaatataggcgacgtgaagagcttccaagccgctgaggggatcgaggagccgcttcttcacgacatctgctatgccgaaaacactgacgatgccgaggacgaggacgaggtgtcctgtgaggaagacctggtggtgggggagatgaaccaaccagccattctaaacttatcaggcagttctgatgacatcatagaccttaccagcctcccacctcccgaaggggatgacaacgaggatgactttctgctgagatccctgaatatggcaattgcagcccccccaccgggctttagggacagcagtgatgaggaggattcccaatcccaggcagcaagctttcctgaggataaagagaagggatcctccttacagaatgacgaaatacccgtgtccttaattgatgcagtgccaacttccgcagaaggaaaatgcgagaaagggttggacaatgcggtggtctctactcttggagcgctggaagccctctccgtcagcgaggaacagcagacaagcgacaattcaggagtggccatacttcgcgcctactctcccgaaagctcctcagactctggcaacgagaccaattcatctgaaatgactgagagcagcgagctcgcaacggcccaaaagcagagtgagaatctgtctaggatgtttctggcgacccacgaggggtatcatcctcttgctgaggagcagactgagtttcccgcctccaagacccccgcaggcggcctgcctccgaagtccagccatgcacttgccgcccgcccagccaccgaccttccgcccaaagttgtgccaagtaagcaattactgcactctgaccatatggagatggagccggaaactatggaaaccaaatccgtgacggattacttttctaagctgcatatgggctctgtggcgtattcatgcaccagtaaacggaagtccaaactcgcagatggtgaagggaaagcacctccaaacggcaacacgaccgggaagaaacagcagggcacgaagaccgctgaaatggaggaggaagcgtccgggaagtttggaacagtctcatcaagagactctcaacatctgagtacattcaatctggagcggactgctttccgtaaagattcacaaaggtggtacgtcgctaccgaaggcggcatggccgagaagagcggcctggaggcagctactggtaagacattccccagggccagcggtctcggagccagggaagcggaagggaaagaggagggggcccccgatggggaaacaagtgacggaagcggcctcggccagggagatagattcctcaccgacgtgacctgtgcttcgtccgcgaaggacttggacaacccagaggacgctgactcatccacatgtgaccacccaagtaagctgcccgaagccgacgagtccgtggcacgactgtgtgactatcatctggcgaagagaatgagtagcctgcagagtgaggggcacttctccctgcagtcttcacagggcagctccgtggatgccggttgcggtacggggtcttctgggagcgcatgtgcgactccagttgagtcccccttgtgtcccagcttaggtaaacacctcatccctgatgcatctggcaaaggcgtgaactatatcccttctgaggagagagcacccgggttgccaaaccacggggctactttcaaggaattgcatccccaaacagaggggatgtgcccccgtatgacagtgcccgcacttcacaccgcaattaatacagagcccttatttggcactctgagagatggatgccacagactcccgaaaataaaggagactacggtgtag

SEQ ID NO: 187740 - DNA, 3969 bp, Artificial Sequence
  Description of Artificial Sequence: Synthetic coding sequence
atggacgtgttcagcttcgtgaagatcgccaagctgagcagccacagaaccaaaagcagtggttggcctccacctagcggtacctgggggctgagccaagtgcccccttacggctgggaaatgactgctaatagagacggacgggattactttatcaaccatatgacacaggcgatcccttttgatgaccctcgacttgagtcgtgtcaaatcattccccccgctccccgtaaagtggaaatgcgacgggatcctgttctcggctttgggtttgtggccggttcagagaagccagttgtagtcagatcagttaccccgggggggccaagtgaaggcaagcttatccccggcgatcagattgtgatgattaatgatgagccagtatccgccgccccccgcgagcgtgtcattgatctcgtcaggagttgtaaggagagcatactgttgacggttatacaaccataccctagccccaagtctgcctttatttcagcggccaagaaagcccgccttaaatccaacccagtcaaggtgaggttctctgaggaggtcattataaacgggcaggtttccgaaactgtaaaagataacagcttactgtttatgcctaacgttctgaaagtctatttggaaaatggccagacaaaaagtttccgtttcgactgcagcacaagtatcaaggatgtaatcctgacactacaggagaagctctccataaaggggatcgaacacttttctctgatgctcgaacagcgcaccgagggcgccggaaccaagctgctcctgctgcacgaacaggagaccctaacccaggtaactcagcgcccttcttctcacaagatgcgctgtctgtttcggattagctttgttccaaaggaccctatcgacttgctgcggcgtgaccctgtggccttcgagtatctgtatgtacagtcctgcaatgatgtggttcaggaacggttcgggcctgaactgaaatatgatatcgcacttcgtctcgcggcccttcagatgtatatcgcaaccgtgacgactaaacagacccagaaaataagtttaaagtacatcgaaaaggaatggggcctggaaacctttctaccttctgcagtgctgcagtcaatgaaagagaagaacatcaagaaggcactgtcgcatctggtgaaggctaaccagaatttggtgccgcctggcaagaaactcagtgctctacaagcaaaggttcattacctcaagtttcttagtgacctgcgcctctatggcggccgcgtgtttaaggcaacattggtgcaggccgaaaagcggtccgaggtgacgctgcttgtcggtccccgatacggaatcagccatgtgattaacactaaaaccaatttggtcgctctgctggcagatttcagccatgtcaaccgtatcgagatgtttagtgaagaggagagtctcgtgagggtggagttgcacgtgttggatgtgaagcccatcacactgctgatggaatcaagtgatgccatgaatcttgcctgtctgactgccggatactaccgtctattagtcgactcccgtaggtcaatcttcaatatggcgaataagaaaaacaccgctactcaggaaactggacctgaaaacaagggaaagcacaatctgctggggccggattggaactgtattcctcaaatgactacttttatcggggaaggggaacaggaagcacagatcacgtacatcgattccaagcagaagactgttgagattaccgattccacgatgtgccccaaagagcaccggcacctgtacatcgataacgcttatagcagcgatggcctgaaccagcaattaagtcagccgggggaggctccttgtgaggctgattacaggagcttagcccagcgctctctgcttacactaagcggccccgagacactaaaaaaagcccaggagtccccacgtggagccaaggtaagtttcatctttggggattttgcgctggatgatggcattagtccccccaccctgggatatgagacactgctggatgagggcccagaaatgctggaaaaacagcgcaatctgtatatcggttcagctaatgacatgaagggcttagacctgacccctgaagcagaaggtatacaattcgtcgagaactccgtgtatgcgaacattggtgatgtgaaaagcttccaagccgccgagggaatagaggagcccctactgcacgatatctgttacgctgagaatacagatgacgcagaggacgaggacgaagtatcttgcgaagaagacttggttgttggggagatgaaccaacctgcaattctgaatcttagtggaagttccgacgacattattgatctaaccagtctgccaccccctgaaggcgacgataatgaagacgactttcttctcaggagcctcaacatggcgattgccgcccccccccctgggtttcgcgactcgtctgacgaagaagacagccaaagccaagccgcctcctttcctgaagacaaagagaaggggtcgtccctacaaaatgacgaaatccccgtgagcctgattgatgcagtgcctacgagtgccgaggggaagtgcgaaaagggtcttgacaacgccgtggtcagcactttaggtgccttagaggcactgtctgtctcagaagaacagcagacctctgataactccggcgtggcaattctccgcgcatatagcccagaatcatccagcgacagtggtaatgagacgaattcctcggagatgacagagagtagcgaactggccaccgcccaaaagcagagcgaaaatctaagcagaatgtttttggctacacacgagggataccacccactggctgaagagcagacagaattccctgctagcaaaaccccagccggaggactccctcccaaaagctctcatgccctggcggcaaggcccgcaactgatctgccccccaaagtggttccctctaaacaactgctacactcagaccatatggagatggagcctgaaactatggagactaaaagcgttacagattattttagcaaactgcatatgggaagtgtggcttatagttgcacatccaagcgcaaaagtaagctggcagacggcgaaggaaaggcacctcctaatggcaacaccaccggcaagaaacagcagggcactaagacagcagaaatggaggaagaggccagcgggaaatttggtaccgtatcaagtcgagatagtcagcatttgtctactttcaacctggagcggacggctttcaggaaagactcccagcgatggtatgttgctaccgagggcggcatggcagaaaagagcggactcgaagccgccactggaaagacattcccccgcgcaagcggcctcggtgcgcgcgaagctgaaggcaaggaggaaggagcccctgatggggagacctcagacggaagtgggctgggccagggagacaggttcctcacagacgtgacctgcgcctcatctgcgaaggacttagacaatccggaggatgccgatagtagcacttgcgatcacccttccaaactgcctgaggccgacgagtctgtggcgcgtctctgtgactaccacctcgccaaacggatgagcagtctgcaaagcgaaggacatttttcactgcagtcctcacagggaagctccgtggacgctggatgtgggacaggctcatccggctcggcctgcgccacccctgtggaatcaccactgtgcccatcactcggaaagcacctgattccagatgcttctgggaaaggggtaaactacatccccagtgaggagcgagcccccggtctacccaatcatggcgcaacctttaaagagcttcatcctcagacagaaggcatgtgcccgaggatgactgtgccagccctccataccgctatcaatacagaaccactgtttggcacactgcgggacggctgccatcgattgccaaagattaaagagactaccgtctag

SEQ ID NO: 187741 - DNA, 3942 bp, Artificial Sequence
  Description of Artificial Sequence: Synthetic coding sequence
aagagccacagcccccaccggaccaagagcagcggctggccccccccttctgggacttgggggttgagccaagtgccaccgtacggctgggagatgacagcaaatcgggatgggagggactatttcattaatcacatgacacaagctattcccttcgatgaccctcgactggagagttgccagattattccaccggcacctaggaaagtggagatgaggagggacccagtgcttggatttggctttgtggccggctcggagaaacctgtagtggtccggagtgtcacaccaggcggtccgtcggaaggaaagcttatcccgggggaccagatcgtcatgatcaatgatgagcccgtgtctgctgcccccagggagagggtcattgatctcgtacgaagttgcaaagagagcatcctcctcaccgtgattcagccttatccatctcctaagtccgcctttatctctgctgccaagaaggccagactcaaatccaatcccgttaaggtgagatttagcgaggaagtgattatcaatggacaagtcagtgagaccgtcaaagacaacagcttgctttttatgccaaatgtgctgaaggtgtacctcgagaacgggcaaacaaaaagctttcggtttgattgttccacttcgatcaaggatgtaatccttacactgcaggaaaagctctcaataaaaggaatcgaacacttctccctaatgctcgagcagagaactgagggcgccggaacaaagttactattactccatgaacaggagacactgactcaggtgactcagcgaccgtcatctcacaagatgagatgcctgttccgtatcagctttgttcccaaggatcctatcgatcttctccgcagagatccagtggcatttgaatatctgtacgtacagagctgcaatgatgtggtccaggaaaggttcggcccggaacttaagtacgatattgctctccgcctggccgcgttacaaatgtatatcgctacggtcactactaagcagactcagaagatctccctgaagtacattgaaaaggaatggggcttggagacatttctaccctccgccgtattacagagtatgaaggaaaaaaatattaagaaggccttgagccatctggtgaaagccaaccagaacctggtcccaccaggtaagaagttaagcgcccttcaagcgaaagttcactatttgaagtttctgtctgatcttcgcctgtacggcggacgcgttttcaaagcgacacttgtgcaagccgagaaacgcagcgaggtgactctgctggtcgggccacggtacgggattagccacgttatcaacaccaaaaccaaccttgtggcattgctggcagattttagccacgtcaacaggattgaaatgttctcagaggaggaatctctggttcgtgttgaacttcatgtcctggacgtgaaaccaattacgctactgatggaaagtagtgacgcaatgaacctcgcctgtttaactgcgggctactatcggctgttagtggactcccggaggtcgattttcaacatggctaataagaaaaacacggcgacacaggaaacaggtcccgagaacaaaggaaaacacaatctgctggggccagattggaactgtatcccacagatgactaccttcatcggcgaaggagagcaagaggcgcagattacctacatcgactctaagcagaaaacagtagagattactgatagcacaatgtgtcctaaagaacataggcacctgtacatcgataacgcctactcatccgatggtcttaatcagcaattatcacaaccaggggaggcaccgtgtgaggcggattatcgatctctggctcaacgaagcctcctaacactgtcgggacccgaaactctgaagaaggcccaagagtcccctcgcggtgccaaggtaagctttatctttggagatttcgccttggacgatggtatctccccaccaaccctcggatacgagacgctgctggatgaagggccggagatgttggaaaagcagcgaaacctgtacataggcagcgccaatgatatgaaggggctagatttgacccccgaagctgaagggatacagtttgtggaaaactccgtgtatgcaaacatcggagatgtcaaatccttccaggccgctgaaggcattgaagaacctttactgcatgacatatgttacgccgaaaacacagacgatgccgaagacgaggacgaggtgtcttgcgaggaagacttagtggtgggagagatgaaccaaccagcaatcctcaacctgagcgggtccagcgacgacatcatcgatcttacaagcctacccccccctgaaggagacgacaatgaagatgacttcctcctccgtagtctaaacatggccatcgccgcccccccgcctggctttagagacagctcagacgaggaagattcacagtcccaggccgcatcctttcctgaagacaaggaaaaaggaagcagtctgcaaaatgacgagattcctgtgtcccttatcgatgcagtgcccacaagcgctgagggtaaatgtgaaaaaggacttgataatgctgttgtttcaaccctgggcgctctagaggcattgtccgtcagtgaagaacagcaaacgtccgataacagcggcgtggccatactcagagcctattctccagaatctagctcagatagcggaaacgagactaattcttctgaaatgaccgaatcaagcgaactggccaccgcgcagaaacaaagtgaaaatctctctagaatgttcttggccactcacgagggatatcaccctctggccgaagaacagactgagttccccgctagcaagacacctgccggggggctgccaccgaaatcctctcacgccttagccgctagacctgcgacagaccttcccccgaaggtggtgccaagcaaacaactgctgcatagcgaccatatggaaatggagccagaaaccatggagacaaagtctgtgactgattacttcagtaagctgcacatgggctccgtcgcatacagttgtacttctaaaagaaagtctaagctcgcagatggagaaggtaaggcacctccaaacggaaatacaaccggaaaaaagcaacagggaaccaaaaccgctgaaatggaagaggaggcctcagggaagttcgggacggtgagcagtagggactcacagcatttgtctacctttaatctggagcgcaccgctttccgaaaggatagtcagcggtggtacgttgccacggaggggggcatggccgaaaagtctggacttgaggcagctacaggtaagacttttccccgggcttctggtctcggagcaagggaggccgaggggaaggaggagggtgctcccgacggagagacatcagacgggtccgggctgggccagggagacaggtttctcacggatgtgacctgtgcaagctccgctaaagacctggacaaccctgaagacgcggattctagcacatgtgatcacccttctaagctaccagaggccgatgagagtgtggcacggttgtgcgattatcacctggctaagcgcatgtcgtctctgcagtcggaaggccatttctcactgcagtcatctcagggctcctccgtggatgcagggtgtggaaccggctctagtgggtccgcctgcgctacccccgtagagagcccactgtgccctagtctggggaagcaccttatcccagacgcttcaggaaaaggggtgaattatatcccatcggaggagcgagccccaggcctgcccaatcacggtgctaccttcaaggaattgcacccacagacagagggcatgtgtccacgcatgaccgttccagcattgcacacggctataaatacagagcctcttttcggtactctgagggatggctgccatagactgccgaaaattaaggaaaccacgggctag

SEQ ID NO: 187742 - DNA, 1794 bp, Artificial Sequence
  Description of Artificial Sequence: Synthetic coding sequence
atgttcgccagctgccactgcgtgccccggggccggcggaccatgaaaatgattcactttcggagcagcagtgtcaagtctctgtcccaagaaatgagatgtacaatcaggcttctcgacgactccgagatcagttgtcatattcaaagggagaccaaaggtcagttcctgatcgaccacatttgtaattactacagtctgctggaaaaggattactttggcataagatatgtggaccccgagaagcagcgtcattggctagaaccaaacaagagcatctttaaacagatgaagacacatcctccatacaccatgtgtttcagagtcaaattttatccacacgaacctctcaaaatcaaggaagagctcaccagatacctgttatatcttcagatcaagcgagacatctttcacggtcgacttttgtgcagtttcagtgacgcagcataccttggcgcttgtatcgtccaggctgaattaggcgactatgatcctgacgaacaccctgaaaactacatttctgagtttgaaatatttccaaagcagagtcaaaaactggagcgtaaaatagtggaaattcacaaaaacgagctccggggccaatctccaccggtggctgaattcaacctattgctcaaagctcataccttggaaacctacggggtggacccacatccatgtaaagatagcacggggacgaccacattcctcggctttactgccgccggattcgttgtgttccagggcaacaaacgcatccacctgattaaatggcccgacgtctgcaaactcaagttcgagggtaaaacattctatgtgatcggcacccagaaggaaaagaaggcaatgttagccttccatacgagtacgccagccgcctgcaagcacctgtggaaatgcggagtcgagaatcaagcattctataagtacgctaagagctcacaaataaaaacagtgtctagttcaaagattttctttaagggctctagatttaggtatagcggcaaagtagctaaagaggtggtggaggcatcctccaaaatccagcgggagccacccgaggtacatcgagcaaacattactcaatcgaggtccagccactctctgaataaacagctcattattaatatggaaccccttcagccattactgccaagcccaagcgagcaagaagaggaactacctctcggggagggagtacctctgccaaaggaagagaacatatccgcccccctcatcagctccagcccagttaaagccgcgcgtgagtacgaagaccctccatcggaggaagaagataagataaaagaggagccactgaccatatccgagctagtgtacaatcctagtgcttccttgctgccaacgcctgtagacgatgacgagattgacatgttattcgactgccctagtcgcctcgagctggagcgggaagataccgattcatttgaagatttggaagccgatgaaaacgcttttttgatcgctgaagaagaagaactgaaggaggctcgacgggccctctcttggtcgtatgatatactaaccgggcacattcgggtcaatccgctcgtcaagagtttcagtcggttgctggtcgtgggcctcgggctgctattgtttgttttcccacttttgctgctgcttctggagtctggcatagacttatcatttctctgcgagatcagacaaacccccgagtttgaacaatttcactatgagtactactgcccacttaaagaatgggtcgccgggaaagttcatttgatcctgtatatgctcggttgttcttag

SEQ ID NO: 187743 - DNA, 642 bp, Artificial Sequence
  Description of Artificial Sequence: Synthetic coding sequence
atgcaggccgaggagaccaagggcatcggcatcaccagcatggccaagtgcctggttaagatccaaactagacgatctctccaattgcatatggtcaaccactgtaacagtaatgtcttcgtccgtctgctgcggttgggcagtaaagtgaccgcccggaatactggcgtacccctgcccaaggaggaaaacatttcagccccgttgattagttcttctccagtgaaagcagcccgagaatacgaggatcccccaagcgaagaagaggataagataaaagaagaacccctgactatttccgagttagtatataacccttctgcaagcctgcttcccacacccgttgacgatgatgaaatcgatatgctttttgattgcccctctagactcgaattggaacgtgaagacactgactcttttgaggatctggaagctgatgagaacgccttcctaattgccgaagaagaggaactgaaggaggcccgtagagctctgtcgtggtcctacgatattctaacgggacacataagggtaaatccgttggtgaagtccttttccaggctgctagtggtcgggttggggcttcttctttttgtgtttcccctgctcttgctgctgttggaatccgtgtccatgcaatag

SEQ ID NO: 187744 - DNA, 804 bp, Artificial Sequence
  Description of Artificial Sequence: Synthetic coding sequence
atgtgcttccgggtgaagttctacccccacgagcccctgaagatcaaggaggagctgacccgttatctattgtacctgcaaataaaaagagatatatttcacgggaggctcctgtgctccttctctgatgcagcctacctgggcgcctgtattgtccaggcggagctcggggactatgatcccgatgagcacccggaaaattatattagtgagtttgagattttccccaagcagtcccagaaactggagcgcaagatagtggagattcataaaaatgagctgagaggacagagcccgcccgttgcagagttcaacctgctgctgaaggcccacacattggagacctacggggttgatccccatccttgtaaagacagcactggaaccacgacgtttctgggatttacagccgccggattcgttgtcttccaggggaacaaacgaattcacctgattaaatggcccgacgtgtgcaagttgaaatttgagggcaaaaccttctatgtgatcggcacacagaaggagaaaaaagctatgctggccttccatacatcgacacccgctgcctgtaaacatttatggaaatgcggcgtggaaaatcaggccttctataagtatgccaagagctctcagataaaaacggtgtcctcgagtaagatcttcttcaaaggtagtaggtttcggtacagcggaaaagtggctaaagaggtggtggaggcttcctcaaagatccagcgagagccgccagaagtgcatcggtgcgttcaaaagaaaatctgttcatgctttggggttacgtggtag

SEQ ID NO: 187745 - DNA, 1089 bp, Artificial Sequence
  Description of Artificial Sequence: Synthetic coding sequence
atggtgttccggcggggccagagcccccccgtggccgagttcaacctgttgctaaaagcccacacgctggagacgtacggtgtggatccccatccctgtaaggattctaccgggactacaaccttcctggggttcacagccgcaggcttcgttgtctttcaggggaacaaacggatccatctgatcaagtggccagatgtctgcaagctcaagtttgagggcaagactttttacgtgatcggtacgcaaaaggagaaaaaggccatgttggcattccacacaagcaccccagccgcctgtaaacatttatggaaatgcggggtggagaatcaggcattctataagtatgccaagtccagtcagataaagacggtgagttctagcaaaatcttctttaagggcagcaggtttaggtacagcggcaaagtcgccaaagaggtggtagaggccagcagtaagatccagcgggagccacctgaagtccatagagccaatattactcagagtcgttcaagccactccctcaataagcagctcatcattaatatggagccactgcagccattgcttccatcgccttccgaacaggaagaagaacttcccctgggtgaaggggtcccattaccgaaggaggagaacatctccgccccactcatcagcagcagccctgtgaaagctgcccgcgagtacgaagaccctccatcggaggaggaggacaagatcaaggaagaaccactgactatttccgagcttgtttataacccttccgctagccttctgccgacaccagtggacgacgacgagatcgatatgctgtttgattgcccttctcgacttgagctagaacgcgaggataccgattctttcgaagatctagaggccgacgagaacgcctttctgatcgccgaggaggaggaattgaaggaagcaagacgggccctcagttggtcttatgatatacttaccggccacatcagagttaatcctttggtcaagagcttttccaggctgctggttgtcgggctgggcctgttattgttcgtgtttcccctgctgttgttgctgctggagtccgtgtcaatgcagtag

SEQ ID NO: 187746 - DNA, 1671 bp, Artificial Sequence
  Description of Artificial Sequence: Synthetic coding sequence
atgttcgccagctgccactgcgtgccccggggccggcggaccatgaaaatgatacactttaggtcctcctcagttaaaagccttagccaagagatgaggtgtactattcgcctgctggatgatagtgaaatatcttgccatattcaaagagaaacaaagggccagtttctcattgatcacatttgcaattactatagtttattagaaaaagattattttggaattcggtacgtagatcctgagaaacaaagacactggctcgagcccaataagtctatcttcaagcaaatgaaaacacaccccccctacacaatgtgctttagggtgaagttttatccccatgagcccctcaaaatcaaggaggaactgactcgctatcttttgtacctgcagatcaagcgcgacattttccacggaaggctgctatgtagcttcagcgacgcagcctatctcggtgcttgtattgtgcaggcagagctgggggattacgatcctgatgaacaccccgaaaactacatcagcgagtttgaaatctttcctaagcagtcccaaaagctggagcgcaagatagttgagatccacaagaacgagcttcgagggcagagtcctcccgtagctgaattcaatcttctccttaaggcacatacacttgaaacctatggggtcgacccacacccttgcaaagattcaaccggaaccacgacctttctgggattcaccgccgccggattcgtggtcttccaaggcaacaagaggatccacctgatcaagtggccagatgtgtgtaaactgaaatttgagggcaaaaccttttacgtcatcggaacacagaaagagaaaaaggccatgctggcattccacacctctacacccgctgcctgtaagcacctgtggaaatgcggcgtggagaatcaagcattttacaaatacgctaaaagttcccagataaagactgtgtctagctccaagatctttttcaaagggtcacgattccgctactccggaaaggtggcgaaggaagttgtagaagcttctagcaaaatccagcgcgaacctcccgaggtacaccgcgcaaacattactcagagccgaagcagccattcattaaataagcagctgataatcaacatggaacctctgcaacctttattaccttctcctagtgagcaagaagaagaattgccccttggagaaggggttccactgccgaaggaggagaatatctccgctccgctgatctcaagttcccccgttaaagccgcccgagagtacgaggaccctccatccgaggaggaggacaaaatcaaggaggagcctctaacaatttcagaacttgtgtataatccatccgcctcgctgctgcccacacctgtggatgacgatgagatcgacatgctcttcgactgtccgtcccgtctggagctagaaagggaagacacggacagttttgaggatctggaggccgacgagaatgctttcctgatcgctgaggaggaggagctgaaagaggcgagaagggccctctcctggtcatatgacattcttacagggcacatcagagtaaaccccctagtaaagtcattctccaggttgctggtggtgggcctgggcctgctgctttttgtgttcccactcctgctcttactgctagagtcggtgtctatgcagtag

SEQ ID NO: 187747 - DNA, 423 bp, Artificial Sequence
  Description of Artificial Sequence: Synthetic coding sequence
ggcaccaccaccttcctgggcttcaccgccgccggcttcgtggtgtttcaaggcaataaaagaatccacctgatcaaatggcctgacgtatgtaaactgaaatttgagggaaagactttttacgtaatcgggacgcagaaggagaagaaagccatgctggccttccacacttctactcctgctgcctgcaagcatctctggaaatgtggggtcgaaaatcaggccttttacaagtacgcaaaatccagccagattaaaacagtgagctcctcaaagattttcttcaagggctctagatttcggtactccggtaaggttgccaaggaggtggtggaagccagtagcaagattcagagagaaccgcctgaggttcaccgctgtgttcagaaaaagatttgctcttgttttggggtaacttggtag

SEQ ID NO: 187748 - DNA, 2145 bp, Artificial Sequence
  Description of Artificial Sequence: Synthetic coding sequence
atgctgcacctgaaggtgcagttcctggacgacagccagaagatcttcgtcgtcgaccagaagagctctggaaaggcactgtttaatctcagctgcagtcacttgaacctcgcagaaaaggagtatttcggcttagaattttgtagccattctggaaacaatgtctggcttgagttgctgaagcctattactaaacaggtgaagaacccgaaggaaattgtgtttaagtttatggtgaaattctttccggtagacccgggccacctgagggaagaattgacacgctatctattcacgctgcagatcaagaaagacctggctctcggacgcctaccctgtagtgacaattgtacagcactgatggtctcccacattctgcaatctgagctgggggactttcacgaggagacggaccgtaaacacttagcccaaacccgctacctgcccaatcaggattgtctcgagggcaaaatcatgcacttccaccagaagcacatcggccgatctcccgccgaatccgacattctgctcctggacatcgcgcgaaagctggacatgtatggaatccgacctcatcctgcgtccgacggggagggaatgcagatacacttggcagtggcccacatgggagtcttggtgctgcgcggcaacacgaaaatcaatacattcaattgggccaaaattagaaagctgtcttttaagcgcaaacatttcctaattaagctccacgctaacattctagttctgtgcaaggacactctggaatttacgatggccagtcgcgacgcgtgtaaggctttctggaagacatgtgtggaatatcacgcctttttccgcttatctgaggagcccaaatcgaaaccaaagaccctgctctgtagcaagggctctagtttcaggtacagcgggagaacacaacgccagcttcttgaatacggcagaaaaggtcggctcaaaagcctgcccttcgagcggaaacactacccaagccagtaccacgagcggcagtgtcgaagctcccccgatctgctgtcggacgtgagcaagcaggtggaagacttgagactggcctatggaggcggatattaccagaacgttaacggtgtacacgccagcgagcctgtccttgagtccagacgacgtaactccgccctcgaagtaactttcgcgactgaactggaacactcaaagccagaggcagatccaacgctcctgcatcagtcccagtcatcgtccagttttccattcatttatatggatcccgtgttcaacaccgaacctaatcccaatccggatcccagggacatattttccgagcgctctagtctgagctcattccaaacgtcctgcaagtttagcggaaatcatatgtctatctactcagggctcaccagcaaggtaagaccagctaagcagctcacatacactgatgtgccctacatcccctgtacaggacaacaagtgggcataatgcccccccaggtgttcttctatgtagacaagcctccccaagtacctcgctggagtccaatacgcgccgaagaacgtacctccccacactcatatgtggagccaaccgcgatgaaaccagccgaaaggagcccaaggaacatcaggatgaagtcattccagcaggaccttcaggtgctgcaggaggcaattgcccggacctccggaagatctaacattaatgtagggttggaggaagaagaccctaacctggaagacgcattcgtatgcaacatccaggagcagacccccaaaaggagccagagccagtcggatatgaagaccatccgttttccctttgggtctgagtttagacctttgggcccatgtcctgccctttcacacaaggccgatctgttcacagacatgttcgccgagcaggaactgcccgccgttctgatggatcagtccactgccgagagatatgtggcttccgagagcagcgattcagagtctgagatcctgaaacccgattattacgccctttatgggaaagaaatcagaagtcctatggcccgaatacggttaagttcagggagcctgcaactggacgaggaggatgaagacgcctactttaacaccccaactgctgaggatcgcacatctctgaagccatgcaattactttctagcatag

SEQ ID NO: 187749 - DNA, 1785 bp, Artificial Sequence
  Description of Artificial Sequence: Synthetic coding sequence
atggtgagccacatcctgcagagcgagctgggcgacttccacgaggagaccgatcggaagcacctggcccagacccgttacttgccaaaccaggactgcctcgaaggcaagattatgcatttccaccagaaacacatcggtcgatcacccgcggagagcgatattctgctgttagatatcgcaaggaaactggacatgtatggaatccgaccccaccccgccagcgatggcgagggtatgcaaatccacctcgctgtcgcacatatgggcgtgctggtgctccgcggcaacactaagatcaacacatttaattgggcgaaaatccgcaagctttcgtttaaacggaagcacttcctcattaaactacacgcaaacattttagtgctgtgtaaggacactttggagttcaccatggccagcagagatgcatgcaaggctttctggaagacgtgtgttgagtaccatgcattcttccgtttgagcgaggagccaaaatccaagccgaaaaccctgctctgctcaaagggtagctcctttcgctattctgggagaactcagagacaacttttggagtacgggaggaaaggcaggctgaaatcactgccttttgagagaaagcattacccgtctcagtatcatgagagacagtgcaggagctctcccgacctcttgagtgacgtttctaagcaagtcgaagacttaaggctcgcctatggcggaggatactatcaaaacgtgaacggtgttcatgcctccgaaccagttttagagtcccgtcggcggaattccgctctggaggtcacatttgcgactgagcttgaacatagtaagcctgaggctgatcctacacttctgcatcagtcacagagctcttccagcttcccattcatttatatggatccagtgttcaatacggagcctaatcctaatcccgacccgagggacatcttttccgagcgtagctcacttagtagctttcagaccagttgcaaatttagcggaaaccacatgagcatctactctggccttacctccaaggttcgcccagccaagcagcttacatatacagatgtcccctacattccatgtactggacaacaggtcgggataatgcccccccaagtgtttttctatgtggacaaaccaccccaagtgccgcgctggtctccaattcgggcagaagaacgcacttcccctcactcctatgtggaacccaccgccatgaagcctgcagagaggagcccccggaacattcggatgaagagctttcaacaggacctgcaagtcctgcaggaggctatcgcccgtacctctggccgatccaatatcaatgttggtctggaggaagaagacccgaatctcgaggatgcctttgtgtgtaatatccaagagcagacgccgaagagatcccagagccagtctgatatgaagacaatccgtttccccttcgggtctgagttcaggccattgggcccctgccccgcactcagtcataaagcagatttgtttacagacatgtttgctgagcaggaactgcctgctgtcttgatggatcagagcaccgcggagcgctatgtggcatcggagtcatcggattccgagtctgaaatactgaaacccgactattatgcgctgtatggcaaggaaatacgatctcctatggctagaatccggctaagcagcggaagcttgcagttagacgaggaagacgaagatgcatactttaacactccgaccgccgaagaccggactagcctgaagccatgcaattattttctggcctag

SEQ ID NO: 187750 - DNA, 2043 bp, Artificial Sequence
  Description of Artificial Sequence: Synthetic coding sequence
atggccctggacggcatccggatgcccgacggctgctacgccgacggaacctgggagctgtccgtgcacgtgacagatctgaaccgcgatgtgaccctgcgggtcacaggggaagtgcatattggcggagtcatgctaaagctggttgagaaactggacgtaaagaaagattggtctgatcacgcattatggtgggagaaaaagcgaacctggttgttaaagactcattggaccctggacaaatatggtattcaggctgacgcaaaactgcagttcactcctcagcataagctgctgagactgcagttaccaaatatgaaatatgtaaaggttaaggttaacttctctgatcgggtctttaaggctgtttcggacatttgcaagaccttcaacatccgccaccctgaggagctgtcgttgcttaagaaacccagggatccgacaaaaaaaaaaaagaagaagctggatgaccagtctgaggacgaagccctggagttggaaggccctctgatcacacctgggtctggttctatttattcctctcctggtttgtactccaaaaccatgacaccgacctacgatgctcacgacggatcaccactgtcacccacctcggcctggttcggtgactctgccctatcagaagggaatcctggcattctcgcggtcagtcaacccattaccagccccgaaatcctggctaaaatgttcaaaccccaggccttgctggacaaggctaagatcaatcagggctggttggattcatccaggtcattgatggagcaagacgtaaaggagaacgaggcactgttgcttaggtttaagtattattcattcttcgatctcaatccaaaatatgatgcaatacggatcaaccagctctacgagcaggctaaatgggccatcctgctcgaggagatagaatgtactgaggaggaaatgatgatgttcgcggccctccagtaccatattaacaaactgagtatcatgacttcggagaatcacctgaataacagcgacaaggaggtagacgaggtggacgccgcacttagcgatttagagatcactctcgaaggagggaaaacttctaccatacttggggacattacaagcattccagaactggccgactatataaaggtgtttaaacccaagaagctgaccttgaagggttacaagcaatattggtgcaccttcaaagacactagcatatcctgctacaagtctaaagaagagagctccggtactcccgcccaccagatgaatctgaggggctgtgaggtcacacctgacgtcaatatcagcgggcaaaaattcaacattaaactcttaattcctgtcgccgagggtatgaatgagatatggttgcggtgtgataacgagaagcagtacgctcattggatggctgcctgcaggcttgcttcgaagggcaagactatggcagacagcagttacaatctcgaggttcagaacatcctcagctttttgaagatgcaacatctcaatcccgatccccaacttatcccggagcaaataacaactgatattaccccagaatgcttggtttccccccggtatctgaaaaagtacaaaaataagcagatcaccgctcgaatcctcgaggctcaccagaatgtagcgcagatgagcctcatagaggcaaaaatgcgcttcatacaagcctggcagtcgttgcctgaatttggcataacccacttcatcgcccggttccagggcgggaaaaaagaagaattaatcggaattgcatacaaccgtcttatccgcatggatgccagtacgggcgacgcaatcaaaacgtggaggttctccaatatgaaacagtggaatgtgaactgggagatcaaaatggtcaccgtcgaattcgcagacgaggttaggttgtctttcatttgcaccgaagtggactgtaaggtcgtgcacgagtttatcgggggatatattttcctgtctacgcgggccaaggaccagaatgaatccctggatgaggaaatgttctataaactgacctctgggtgggtctag

SEQ ID NO: 187751 - DNA, 2064 bp, Artificial Sequence
  Description of Artificial Sequence: Synthetic coding sequence
atggccctggacggcatccggatgcccgacggctgctacgccgacgggacgtgggagctttccgtgcatgtcactgatctgaatcgggatgtgactctccgggtgacgggcgaagtccacataggcggcgtaatgctgaagctggtagagaaactggacgtgaaaaaagattggtctgatcacgctctgtggtgggagaagaagcgcacctggctgctgaaaacacactggacattagacaagtacggaatccaagccgacgctaagcttcagtttactcctcagcacaagttactgaggctgcaactgccgaacatgaagtacgtgaaagtgaaggtgaacttcagcgaccgagtctttaaagcggttagcgatatctgcaagaccttcaatattcggcacccggaggagctttcgttactcaaaaagccacgggatcccacgaaaaagaagaagaaaaagctcgatgaccagtccgaggatgaggccctggaactggagggaccccttattacccccggctctggttcaatctactcgtcccccggcctttattctaagacaatgacaccaacctacgacgcccatgatggctctcccctgagtccaacatctgcctggtttggtgattctgctttgtcagagggaaatcccggaattctggcggtgagccagcctattacaagccccgagatcttggcaaagatgttcaagccacaggctcttctggataaggctaaaatcaaccaggggtggctggatagcagcaggagcctgatggaacaagacgtgaaggagaatgaagccctgctgctgcggtttaagtattatagcttttttgaccttaacccgaagtatgacgccatccgcattaaccaactctacgagcaggccaagtgggcaatcctcctggaggaaatcgagtgtacagaggaggagatgatgatgtttgccgccctgcagtaccacataaacaaactgtccatcatgacctccgagaatcacttgaataactctgataaagaggtcgatgaagtagatgccgcccttagcgacctagaaataaccctcgagggtggcaagacaagcacgatcctgggggatattacttccatcccagagttggccgattatatcaaggtgtttaagcccaaaaagttgactctgaaaggttacaaacaatactggtgcacttttaaagataccagcattagctgttataaaagcaaggaggagtcttccggcacgcctgcccaccagatgaatctacgtggttgcgaggtcaccccggatgtgaatataagcggtcagaaatttaacattaagctgctgattccagtggccgaggggatgaatgagatctggctgcgctgcgacaacgaaaagcagtatgcccattggatggcagcatgtcgacttgccagtaagggtaaaactatggccgattccagctacaatttagaggtgcagaatattttgagcttcctgaagatgcagcacctgaatccagacccacagctcattccagagcagataactacggatattactcccgagtgcctggtgtccccgaggtacctgaagaaatataaaaataaacagccaggatacatccgggacttgatcaccgcccgcatcctagaggcacaccaaaatgtcgcccaaatgagcctgatcgaagcgaagatgaggtttattcaggcgtggcagtcgctccctgaatttggtattacccatttcatcgctaggttccagggcgggaaaaaggaagagctgatcggcatagcttacaaccggctgattagaatggacgcttcgaccggagatgcgattaagacctggagattttctaacatgaaacaatggaatgttaactgggagataaagatggtgacagttgaattcgccgatgaggtacggctgagttttatctgcactgaggtggattgtaaagttgtgcatgaattcatcggtggttacattttcctgagcacaagggccaaggaccagaatgaatcattggatgaggagatgttttataagctgacctcaggttgggtatag

SEQ ID NO: 187752 - DNA, 2043 bp, Artificial Sequence
  Description of Artificial Sequence: Synthetic coding sequence
atggccctggacggcatccggatgcccgacggctgctacgccgacggcacttgggagcttagcgttcacgtgaccgacctgaaccgggatgtgacattgcgcgtgaccggagaggtgcatatcgggggggtgatgctgaagctggtcgaaaagctggacgtgaagaaagactggtccgatcacgctctatggtgggagaaaaaaaggacttggctgctcaaaacgcattggaccctggacaaatatgggattcaagccgacgcaaagctccaatttaccccccagcataagttattaagacttcaactccctaacatgaaatatgtcaaggtgaaggtcaacttcagcgaccgcgtgtttaaagctgtgagtgacatatgtaagacgtttaatatcagacaccccgaagaactaagtctcttaaagaagcctcgcgatccaacaaaaaagaagaaaaagaaactcgacgatcagagcgaggacgaggccttagagctggaaggccctctaattacgccaggctccggcagcatctactcatctccgggactgtattcaaagactatgactcccacatacgacgcccacgatggatctccattgagccccaccagcgcatggttcggagattcagccctcagtgagggaaatcccggcatactcgctgtttctcagcccataacatcccctgagatccttgcaaagatgtttaaaccacaggctctgctggacaaggcaaagatcaaccaggggtggctggactctagccggagcctgatggagcaggatgtgaaagagaacgaggccctcctgctccggttcaaatactactcgtttttcgatttgaatcccaaatacgacgcgattagaattaatcagctgtacgagcaggccaaatgggctatactgttagaagaaatcgaatgcacagaagaggagatgatgatgtttgccgcactgcaatatcatattaataaattgagtattatgacctccgaaaaccacctgaacaactcagacaaagaggtggacgaggtcgacgctgcactctccgacctggaaataacactcgaaggcggcaagacatcgactatcctgggtgatatcacgtcaatcccggagctcgccgactatatcaaggtgttcaagcccaagaagcttacacttaagggctataagcagtactggtgtacttttaaagacacatccatcagctgctataagtcgaaggaggagtcttcagggacacctgcgcatcagatgaatttgcgcggatgcgaagtcaccccggacgttaacattagcggtcaaaaatttaacattaagctcctcattcccgtcgctgaaggaatgaacgagatctggttgcgttgcgacaacgagaaacaatacgctcattggatggctgcatgtagattggcctctaagggcaaaacaatggccgactcttcctataatttagaggtacaaaatatcctgtctttcttgaaaatgcagcacttaaatcccgacccccagctgataccagaacagattaccactgatattaccccagagtgtctggtgagtccaagatatctaaagaaatataagaacaagcagataacagccaggatcttagaagcacaccagaacgtggcgcaaatgagtcttatcgaagccaagatgcggttcatccaagcatggcagagcctcccggaattcgggatcacccacttcattgctcgtttccagggtggaaagaaggaggagctgatcggcatcgcttataatcgcctgatcaggatggacgcatcgactggagacgccatcaaaacctggcggttcagtaacatgaagcagtggaatgtcaattgggaaattaaaatggttacagtggagttcgcagacgaggtccggttgagctttatttgcaccgaggttgactgcaaggtagtgcacgaatttattggaggctatatatttctgagcacaagggccaaggaccagaatgagtcccttgatgaagaaatgttttacaaattgacctcgggctgggtgtag

SEQ ID NO: 187753 - DNA, 1902 bp, Artificial Sequence
  Description of Artificial Sequence: Synthetic coding sequence
atggccctggacggcatccggatgcccgacggctgctacgccgacggtacctgggagctgtcagtgcatgtaacggacctgaaccgcgatgtgactcttcgagttacgggcgaagtgcatatcggaggagttatgctcaagctggtcgaaaaactggacgtgaagaaagactggagcgaccatgccctgtggtgggagaagaaacgtacatggctcctgaagactcattggacccttgataagtacggtatacaggcagacgctaaactgcaattcacaccgcagcacaaactcttgcgcttgcaactgcctaatatgaaatatgttaaggtcaaggttaattttagcgatagagtgtttaaggctgtgtcagacatatgtaaaacatttaacatccgacatcctgaggaactcagtctgcttaagaaaccaagagaccctaccaaaaaaaaaaaaaaaaaacttgacgatcaaagcgaggacgaggccctcgagcttgaggggcccctcattactcctggcagcggcagcatttactcctcgcctggcctttatagcaagactatgactcctacctacgatgcacacgatggttcacctctgagccccacgtcagcctggtttggtgacagcgctttaagtgagggtaaccccggtatcctggctgtcagccagcctattaccagccctgaaattcttgctaaaatgttcaagccacaagcactgctagataaggccaaaattaatcaaggttggctggattcatcccgatcattaatggagcaggatgtaaaggagaacgaagcgttactgttgcgattcaagtattacagcttcttcgatcttaatcccaagtacgacgcaattaggattaaccaattgtatgaacaggcgaagtgggccatccttttggaagagatcgagtgtacggaagaagaaatgatgatgttcgcagcgctccaatatcatattaacaaactgtccatcatgacaagcgaaaatcacctgaacaactcagataaagaggtagacgaggtcgatgccgctctgtcagatctggaaattactttggagggcgggaaaacgagtaccattctgggtgatataacgtccattccggaacttgcagattatatcaaagtgtttaagcccaaaaaacttacactaaagggctacaagcaatactggtgtaccttcaaagatacatcaatcagctgctataaaagcaaagaagagagttccggcaccccagcgcatcagatgaatctcaggggttgcgaggtcacccccgatgtgaatatcagcggtcagaaatttaacatcaaattgctgatacccgtcgctgaagggatgaacgagatctggttaagatgcgataacgaaaaacagtacgcacactggatggcagcttgccggctggcatccaagggcaaaacaatggcggatagttcttacaatcttgaggtgcaaaacatactgtctttcttaaagatgcaacatctgaatccggatccacaactgattcccgagcaaatcacaacagacatcacaccggaatgtctcgtctctcccaggtacctcaaaaagtacaaaaacaagcagccagggtacattcgggacctaatcacagctagaatcttggaagcacaccagaatgtggctcaaatgagtctcattgaagcaaagatgcggttcattcaagcctggcagagcctacccgagttcgggatcactcatttcattgccaggttccagggtggcaagaaggaagagctgattgggatcgcctacaaccgtttgattcggatggacgcgtccactggagacgccattaagacttggaggttttcgaatatgaagcaatggaatgttaactgggagatcaaaatggtgaattcttag

SEQ ID NO: 187754 - DNA, 2064 bp, Artificial Sequence
  Description of Artificial Sequence: Synthetic coding sequence
atggccctggacggcatccggatgcccgacggctgctacgccgacggcacctgggagctgtcagtccacgtgaccgacctgaaccgggatgtgaccctgcgcgtgacgggcgaagtgcacataggaggcgtcatgttaaagctggtcgaaaaactcgatgtgaagaaggactggagtgaccacgccctttggtgggagaaaaagcggacttggcttctcaagacgcactggacgctagataagtacggcattcaggctgacgcaaagctgcagttcactcctcagcacaaattgttgcgcttgcagctgcctaacatgaagtacgttaaggtgaaagtcaactttagcgatcgcgtttttaaagccgtaagtgatatttgtaagactttcaatataaggcacccagaggaactgtcccttcttaagaaaccaagggatcctaccaagaaaaaaaaaaagaagctggacgaccagagtgaagatgaagctttggagctggaagggcccctgataacaccgggtagcggatccatctatagcagcccaggactgtatagtaaaaccatgactcctacttacgatgcccatgatggctctcccctatcccccacgtcagcttggtttggagatagcgccctgtccgagggaaatcccggcatccttgcagtctctcaaccaattacgtcgcctgagattctggccaagatgttcaagccgcaagcactgctggacaaggccaagatcaatcagggttggctcgacagcagcagaagcctcatggaacaagacgttaaagagaacgaggccctgttgcttaggtttaagtactactctttctttgatctgaacccaaaatacgatgctattagaattaatcaactgtacgagcaggctaaatgggcaatcctactcgaggaaatcgaatgtactgaagaggagatgatgatgtttgctgcattgcaataccatatcaacaaacttagtattatgacttcagagaaccatctcaacaacagtgacaaagaagttgatgaggtggacgccgccctgagtgacctcgagattacgctcgaaggtggaaagacatcaacaatattgggtgacattacatcaatcccagaattagcagattatattaaggtctttaagcccaaaaaacttaccctgaaaggctataaacaatactggtgtacattcaaagacacaagcatttcctgttacaagtccaaggaggagtcctctggtactcccgcccatcaaatgaacttacgcggttgcgaggtgactccagacgtcaatatctccggacagaagtttaatatcaagttgctcattccggtggctgagggaatgaatgagatctggctcaggtgtgacaacgagaagcagtacgcgcattggatggcagcgtgtagactggctagtaagggcaagaccatggccgactcgagctataacttagaggtacaaaatatcttgtcttttctcaagatgcaacatctcaatccagatccccagctgatccctgagcagatcacaactgatataacccccgagtgtctagtaagcccccgctacttaaaaaaatacaagaataaacagcccggctatattcgggacctgatcacagccaggattttggaggcacaccagaacgtggcccaaatgtctctgattgaagctaagatgaggtttattcaggcctggcagtctctgccagaattcgggattacacacttcatcgcccgctttcaaggcggaaagaaagaagaattaatcgggatagcttataatcgactgattaggatggacgcctctactggcgacgcgatcaagacctggaggttctccaatatgaagcagtggaatgtcaattgggaaattaagatggtgaccgtcgagttcgcggatgaggttcgactaagcttcatctgtactgaagtggactgtaaggtggttcacgagtttatcggcggatacatattcttgtctactcgcgcaaaagaccagaatgaaagcctggatgaagaaatgttctataaactcactagcggatgggtgtag

SEQ ID NO: 187755 - DNA, 462 bp, Artificial Sequence
  Description of Artificial Sequence: Synthetic coding sequence
atggccctggacggcatccggatgcccgacggctgctacgccgacggtacctgggaattgtcagtccatgttaccgatctgaatagggatgttaccctccgggttacaggggaagtgcatatcggaggagtgatgctgaaactggtcgagaagctagatgtgaaaaaggattggtctgaccacgctctgtggtgggaaaaaaagcgaacatggttacttaagacccattggactctggacaagtacggaatccaagccgacgcaaagttacaattcacgccgcagcacaaattgttgcggctgcagttgcccaatatgaagtacgtgaaagtaaaagtgaacttttccgatcgggtgttcaaggccgtctctgacatatgcaaaacgttcaatatcagacaccctgaggagctgtctctgctgaagaaaccacgtgatccaactaaaaagaaaaaaaagtag

SEQ ID NO: 187756 - DNA, 2004 bp, Artificial Sequence
  Description of Artificial Sequence: Synthetic coding sequence
atggccggcatgaagaccgccagcggcgactacatcgacagcagctgggagctgcgtgtcttcgtcggtgaggaggacccagaggcagagtccgttacactccgcgtgacaggagagagtcacattggcggggttttactgaagatcgtggagcagatcaatagaaagcaggattggtcagaccatgctatttggtgggagcaaaaacggcagtggctactgcagacacactggaccttggataaatatgggatcctggccgatgcccggctgttcttcggcccccagcatcgcccagtcatcctgaggttgccgaacagacgggctctcaggctgcgggcttcgttctcacagcctctgttccaggctgtagctgccatctgtagactcctatcaataagacaccccgaggaactttcacttctcagggcccccgagaagaaggagaaaaagaagaaagaaaaagaacctgaagaagagctttacgacctctcaaaggtggttctcgccggcggcgtggcgccagctctgtttagggggatgccggcccatttctcggactctgcccaaacagaagcatgctaccatatgttatcccgaccacaaccgccccccgacccattgctgctgcagaggctccctcgcccttcatctctctccgataagacacagttgcattccaggtggctcgattcaagtagatgcctaatgcagcaggggatcaaagctggggacgcactgtggttaagatttaagtactattcttttttcgacctcgatccaaaaaccgaccctgtgcggctaacccagctgtacgagcaggcacggtgggatctgctcttggaggagattgattgcaccgaggaggagatgatggtctttgctgccctgcagtaccacattaacaaactgagccagagcggggaagttggagagcccgccggcaccgatccaggcctcgatgatttagacgtcgccctctcaaacctggaggttaaactggagggcagcgcccctaccgatgtcctagatagcctcacaaccatacctgagctgaaagaccatctaagaattttcagaatcccaagacgcccacgtaaactgaccctgaagggctatcggcagcattgggtcgtgttcaaagagacaactctgtcctactacaagtcacaggatgaagcccctggtgatccaatacagcaactcaatctgaaggggtgtgaggtggtgccggacgtaaatgtcagcggccagaagttctgtatcaagctgttggttccatcacccgaaggcatgagcgaaatctatctgaggtgtcaggacgagcagcaatacgcgaggtggatggctggctgccggttggccagtaaagggcgcaccatggcagatagcagctacacttcggaggtccaggcaatactggcattcctctccctccaaaggactgggtccggcgggcccggcaatcatccacatggcccagatgcttctgccgaaggcctgaatccctacggcttggtcgcccctagattccagaggaagttcaaagctaaacaactgactccccggattctggaggctcatcagaatgtggcccagctttcgctggccgaagcccaactcagattcattcaggcatggcaaagtcttcccgactttggaataagctacgtcatggtaagattcaagggtagcagaaaagacgagattttgggtatagccaacaaccgacttataaggatagatttagctgtgggagatgtagtaaagacctggcggttcagtaatatgcgtcagtggaatgtcaactgggacatcagacaggtggctattgagttcgatgagcacattaatgtggccttctcttgcgtgagtgctagctgcagaatagttcacgagtatataggaggatatattttcctgagcacgagagagcgagccaggggggaggagctcgatgaggacttgtttctccagcttactggaggccatgaagctttctag

SEQ ID NO: 187757 - DNA, 1992 bp, Artificial Sequence
  Description of Artificial Sequence: Synthetic coding sequence
atggccggcatgaagaccgccagcggcgactacatcgacagcagctgggaactccgggtgttcgtaggcgaggaggatcccgaggccgagagcgtgactctgcgggtcaccggcgaatcccacatcggcggggtgctattgaaaattgttgaacagatcaacaggaagcaggactggagcgatcatgctatatggtgggaacagaagcgccaatggctgctacagacacactggactctagataagtatggcattctcgccgatgcccggctctttttcggtccacaacatagacccgttattctgaggctgcctaaccggcgggctctgcggctcagagctagcttttcccagcccttgttccaggccgtcgctgctatctgtcgtcttctttcaattcgccatccggaggaactgtctctgctaagagctcctgagaaaaaagaaaaaaagaagaaggagaaggagcccgaggaggagctgtatgatctatccaaggtcgttctggccgggggagtggcacccgctctgtttcggggtatgcccgcacacttttcagactctgcacagaccgaggcctgttaccacatgctgagcaggccgcagcctcctccggacccactgctgttgcagcggcttccccggccttcaagtctctccgacaaaacccagctgcattctcgatggcttgacagctctcgctgtttgatgcaacagggaattaaagccggggatgcattgtggctgaggttcaagtattactcattcttcgatctggatcctaaaactgaccccgtacggctgactcagctctacgagcaggcgcgctgggacttgttgttggaggagatcgactgtactgaggaagaaatgatggtttttgcggcactccagtatcacataaacaagcttagccaatccggcgaagtcggcgagccagccgggactgaccccggcctggacgacctagatgtggccctatcaaacctagaggtgaagttggagggctccgcgcctaccgatgtgctcgatagcctgacaactattcctgagctcaaggaccacttgaggatcttcagaccacggaagctgaccctgaaggggtatagacagcattgggtggtcttcaaagaaacaaccctgtcctactacaagtcacaggacgaggctccaggagaccctatccagcaactcaatctcaaagggtgcgaggtggtgcctgacgtgaacgtgtctggccagaagttctgtataaagctgctggtcccaagcccggaagggatgagcgagatctacctcaggtgccaggacgagcagcagtatgcccgctggatggctgggtgcaggcttgcaagcaaaggtaggaccatggctgactccagctatacttcagaggtgcaggccatcctggcatttctcagcttgcagcgcacaggaagcggaggaccaggaaaccacccacatggacccgatgccagtgccgaaggactgaatccttatggactggtcgcccctcgcttccagcggaagtttaaggctaagcagttaacacctcgcattcttgaggcccatcagaacgttgcacagttgtctctggccgaggcccagctgcgtttcatccaagcatggcagtctctgccagacttcggtatcagctacgtgatggtacgctttaaaggcagtcgtaaggatgagatcctggggatagccaacaacaggttgataagaatagacctggcagttggcgacgtggtgaaaacatggcgcttttcaaatatgagacagtggaacgtgaactgggacataagacaggtggcgatcgagtttgacgaacatattaatgtggcttttagctgcgtctccgcctcttgtagaattgtccacgaatacatcggtggatatattttcctctcaacacgagagagggcccgcggcgaggaacttgatgaggatctcttcctacagctgactggcgggcacgaggcattctag

SEQ ID NO: 187758 - DNA, 861 bp, Artificial Sequence
  Description of Artificial Sequence: Synthetic coding sequence
atggccggcatgaagaccgccagcggcgactacatcgacagcagctgggagctcagggtattcgttggcgaggaagatcccgaggccgaatctgtaacgctgagagtgacaggcgagagccacattggaggagtcttacttaaaattgtggagcagatcaatcgcaagcaggactggtcagatcatgccatatggtgggagcagaaaagacaatggcttttgcaaacacactggacgctcgacaagtacggaatccttgctgatgccaggttgttctttggtccacagcatcgacccgtgattctgagactgcctaatagacgcgctctcaggctgcgagctagcttctcgcagcccctttttcaggcggttgcagcaatctgcaggctgctgagtattcgccacccagaagagctgtcgctgttgcgggcccctgagaaaaaggaaaagaaaaaaaaagagaaagagcccgaagaagagctgtacgatctttccaaggtggtcctggctggaggggtcgccccggcactctttagggggatgccagcccacttctcagactccgcacagactgaagcttgttaccatatgctcagccggcctcaacctcccccagatcccctcctgctgcaaagactgccacgaccctcttctttaagtgataaaacacagctccacagtcgatggctggacagttcgagatgcttgatgcaacagggaatcaaggcaggggacgctctgtggcttcggtttaaatattactctttctttgatctagatccaaagacagaccctgtgcgccttactcagttatacgaacaagcccgctgggatctactcctagaggaaattgattgttag

SEQ ID NO: 187759 - DNA, 555 bp, Artificial Sequence
  Description of Artificial Sequence: Synthetic coding sequence
atggccgccgccggcggcgcccggctgctgcgggccgccagcgccgttctgggagggccagccggccgctggttgcatcacgcgggctcccgcgccggctcttcagggcttcttcgtaaccggggaccggggggatctgctgaggccagcaggagtttgtccgtgagtgctcgagctcggagctcctctgaagataaaatcactgttcacttcattaaccgcgacggggaaacactaactacgaaagggaaggtaggggactcactcctagacgtcgtggtggagaataatttggacatagacggttttggagcgtgcgagggtaccctggcgtgttccacctgtcatctaatttttgaggatcatatctatgagaagctggatgccatcactgacgaagagaacgacatgttagacctcgcctatggccttaccgatcggtcccgcctcggctgtcaaatttgtctgacaaagtctatggacaatatgaccgttcgcgtccccgagacagtggccgatgcccggcagagtatcgacgtcggcaagacttcatag

SEQ ID NO: 187760 - DNA, 1494 bp, Artificial Sequence
  Description of Artificial Sequence: Synthetic coding sequence
atggccagccggtgctggcggtggtggggctggagcgcctggccccgcaccaggcttccccccgctgggagcaccccaagcttctgccatcatttttcaacccaggagaagactcctcagatctgtgtcgtcggatcaggcccagccgggttttatacagcacaacatctgctaaaacatccacaggctcatgtcgacatatatgagaagcagcccgtgccttttggactggtcagattcggtgtcgctcctgaccaccctgaagtgaagaatgtgattaacactttcacgcagactgcacattccggtcgctgcgctttttgggggaacgtcgaggtggggcgtgatgtgacagtgcccgagctgcgcgaagcttaccacgccgtggttctgtcatatggggctgaagaccacagggccctcgagatacccggcgaggaattacctggggtgtgctctgctagggcgttcgtgggatggtacaacggcctccccgaaaatcaagaattagagcccgacctgagctgcgacaccgcagttatattgggtcaggggaacgttgctctagatgtggctaggatcctcctcacaccaccagagcacctggaagctcttttactgtgtcaaagaacagatatcaccaaggccgcgctgggagtcctgcgccagtccagagtgaagacagtatggttggtaggtaggcgaggccccctgcaggttgcgttcaccatcaaggagctgcgggaaatgattcagctgcctggagcaagacctattctcgaccctgtggattttctaggcctccaggacaaaataaaggaggtgccacgcccccgaaaacggctgaccgagcttctgctgcgaacggccacagaaaagcctgggcccgcggaggcggcacggcaagcttcggcttcacgcgcctggggccttcggtttttccgatctcctcagcaggtgctgcccagccctgatgggcgcagggctgccggtgtgaggttggctgtcacacgtctcgaaggagtggacgaagctactcgcgctgttcccactggcgacatggaagacctgccatgtggtttggttcttagctctatcggctataagtctcggcccgtagacccttctgtgccttttgatagcaaactcggagtgattcctaatgtagaaggaagagtcatggacgtgcctggcctttattgtagcggatgggttaagcggggccccaccggtgtaatcgccacaacaatgacagacagctttctgacaggtcaaatgctgctgcaggacttgaaggcggggttgctcccctctggcccacgccccggctacgcagccatccaagcacttctctcttcacgcggggttcggccagtatcatttagcgactgggaaaagctggatgcagaggaggttgcccggggacaaggcactggtaaaccccgcgagaaattagtcgatccccaggagatgcttcgtcttctcggccactag

SEQ ID NO: 187761 - DNA, 1569 bp, Artificial Sequence
  Description of Artificial Sequence: Synthetic coding sequence
atggccagccggtgctggcggtggtggggctggagcgcctggcccaggactcggctgccgcctgctggatccactccaacttttggtggttcagacgaggtgagggaccctgccaatgcaaaggctctgcggaataagagacggcggatgcaggtgcgcgtaaaattaggcaagttccagctgctgttagatattcaggaaaaaaccccccagatttgcgtggttgggagcggccctgcagggttctacactgcgcagcacctcctgaagcatccacaagcccatgtcgatatatacgagaagcagcccgtcccgtttggcctggtgcgattcggcgtggcaccagatcacccggaggttaaaaatgttattaatacattcacccagacagctcacagtggccgctgcgcattttgggggaatgtggaggtagggcgcgatgtgaccgttccagaattgcgggaggcttatcatgccgtagtgctgtcttacggagcagaagaccaccgggcgttggagatcccgggagaagaactgcctggagtatgcagtgcgcgggcctttgtgggctggtacaatgggctgcccgaaaatcaagagttggagcctgaccttagctgcgatacggccgtgatccttgggcagggaaacgtggcactcgatgtggcacgaattttgttaaccccacccgaacacttggagcgtaccgatattaccaaggctgccctcggagttctgagacagagtcgagtcaagaccgtgtggctggtgggaaggcgtgggcctctgcaagtggcctttaccattaaagagctgcgcgagatgattcagctgcctggggcgcggcccattctagatccggtggactttctgggtctgcaagataagattaaggaagtgcccaggcctaggaaaagactgaccgagctgttactacggaccgcgaccgaaaagcctggtccggcagaggccgctcggcaggcctcagcctctcgcgcatggggactgaggttttttcggagccctcaacaagtgcttccaagccctgatgggcgccgcgctgcgggggtgcgtctcgccgtcactcggctggagggagttgatgaggcaactagagcggtccccaccggagacatggaagacctgccttgcgggctggttttgagtagcatcgggtacaaaagtagacccgtcgacccgagcgtccctttcgactcaaaattaggggtgatcccaaacgtcgaaggaagggttatggatgttccgggactttattgctctggctgggtgaagcgcgggcctactggggtcatagccaccaccatgactgattcctttctgactggccagatgctgctgcaggacctgaaagcggggcttctcccttcgggcccccgacccggttacgccgctattcaggctctgttgtcatctaggggcgtgcggccagtgtcctttagtgattgggagaagctagacgccgaagaagttgctcggggccagggcaccggcaaaccaagggagaagctggttgacccccaggagatgctgcgcttgctggggcattag

SEQ ID NO: 187762 - DNA, 1356 bp, Artificial Sequence
  Description of Artificial Sequence: Synthetic coding sequence
atggccagccggtgctggcggtggtggggctggagcgcctggcccagaactaggttaccccctgccggaagtacaccctcattttgccaccactttagtacacaggaaaaaacaccccagatctgcgttgttggaagcggcccagctggattttatacggcacagcacctgctgaaacagcacccccaggcacacgttgacatctatgaaaagcagccagtgccattcgggttagtgcgattcggggtggctccggatcaccctgaagtgaagtcctacggagcagaggaccatcgagccctcgagatcccgggcgaagagctcccaggcgtgtgtagcgccagggcattcgtaggatggtataatgggctaccagaaaaccaggagctggaaccagatctctcatgcgacacagccgtgattttaggtcaggggaatgtcgctctcgatgtggcccgaatacttctgaccccacccgaacacctcgagcgcaccgatataacaaaagctgctctgggcgttttaaggcagtccagagtgaagactgtttggcttgtgggcagaagaggacctctgcaagtcgcctttacaatcaaggagctcagggagatgattcaacttccgggagcccgccccatccttgaccctgtcgacttccttgggttgcaagacaaaattaaggaagtaccacgccccaggaagcgccttaccgaactcctgcttagaacggctaccgaaaagccaggccctgcagaggcagcccggcaggccagcgcctcgcgagcatggggcctccgcttcttcagaagtccacagcaggtgttaccctcccccgatggccggagagctgctggggtccgcctggctgtaaccagactggaaggtgtagacgaagcgaccagagcagtgccaactggcgatatggaagacctgccttgcggccttgtcctgtccagcatcggttataaatccagacctgtggaccctagtgtcccctttgattcaaaactcggcgtcatccctaacgtcgagggccgagtcatggacgtgcccgggttatactgttccgggtgggtcaagaggggtcccacgggcgtcattgcaacaaccatgaccgacagttttctgaccggacagatgcttctgcaggatcttaaggctggcctacttccaagcggcccaaggcctgggtacgccgcaatacaggcccttttgtctagccggggagtgaggccagtcagctttagcgattgggaaaaactcgatgccgaagaggtggcccgcgggcaaggcaccggcaagccccgcgagaaacttgtggatccacaagagatgcttcgcttgcttggacattag

SEQ ID NO: 187763 - DNA, 1605 bp, Artificial Sequence
  Description of Artificial Sequence: Synthetic coding sequence
atggccagccggtgctggcggtggtggggctggagcgcctggcccaggacgcgtttgccccccgctgggagcacaccgagtttttgtcaccatttctctactcaggaaaaaacgccccagatttgtgtcgtgggaagcggtccagctgggttttatacagcgcagcatcttctgaaacgcgtggaagctctgtgctctcaaccaagggtactaaattctcctgcactctctggggaaggcgaagatctcggtgcctcccagcctctctcacttgatccaacctcctgccatccagtccctcagcagcaccctcaggcccacgtggacatttatgaaaaacaaccagttccgtttggtctagttaggttcggtgttgccccggaccatccagaggttaagaatgtgatcaacactttcacgcagacagcccactccggccgatgcgccttttgggggaacgtagaggtcgggcgagatgtgactgtgccagaactgcgggaggcctaccacgctgtggtactctcttacggggctgaggatcatagagctttggaaatcccgggagaggagcttccaggcgtgtgctctgctcgcgcatttgtcggctggtataatggactgcctgagaatcaggagctggagcccgatctgagctgtgacactgcggttattctgggccagggtaacgttgcacttgatgtggccagaattcttctgacccccccagaacacctcgagcgcaccgacatcacaaaagctgccctgggcgtattacggcagtccagagttaaaacagtgtggttagttggtagacgtgggcccctccaggtggctttcactattaaagaactacgggaaatgatccagctgccaggagctcggcctatcctggatccagttgactttcttggactgcaggacaaaatcaaggaagtgcccagacctagaaagcgacttacagagctattgctgcggaccgcaacggagaagcctggacccgccgaagctgcgaggcaggcgagcgcatctcgcgcctggggactgcggttcttccggagtccccagcaggtgcttccctcaccagatggaaggcgcgccgcaggtgtgcggctggcagtgaccaggctggaaggggtggatgaagctacaagggctgtgcccaccggcgatatggaagatcttccctgcggactcgtgctgtcatccattgggtataagagtagaccggttgacccaagcgtaccatttgactcaaaactgggagtaattcccaacgtcgaaggccgggtgatggacgtccccgggctgtattgtagtggatgggtgaagcgtgggccaactggtgtgatcgccacaactatgacagattctttcctaaccggacagatgttgctgcaggatctaaaggcggggctcctcccttctggccctaggccaggttatgccgccatccaggcattgctgtcctcccggggagtgaggcccgtatctttttccgattgggaaaaactggatgcagaggaagtagcaaggggccagggaaccggaaaacccagggagaagctggttgatcctcaggaaatgctccgcttgcttggccactag

SEQ ID NO: 187764 - DNA, 1146 bp, Artificial Sequence
  Description of Artificial Sequence: Synthetic coding sequence
atgaccacctgcaaggccggcgtggtgcccctggccagccagcagcacccgcaggcacacgtggatatttatgagaagcagcctgtgccattcgggttagtccggttcggagtagcccccgaccatccagaagtcaagaacgttatcaacacctttacacagaccgcacactcaggccggtgcgcgttttgggggaatgtcgaggtggggcgggacgtgactgtgccagagctgcgggaggcatatcacgccgttgtcttgagttacggagcagaggaccacagggctttggaaattcccggggaggaacttcctggcgtctgcagcgctagggcctttgttggctggtacaatggccttcccgagaaccaggagctagagcctgatctttcatgtgacacagccgtgatactagggcagggcaatgtggcccttgacgtcgcaaggattctcctcactccccccgagcatctggagcgaaccgacataaccaaggccgctttgggtgtgttgagacagtcccgagtgaagacagtatggttggtgggacggagaggaccgttgcaggttgccttcaccattaaagagctgcgagaaatgattcagctccctggagccaggccaattctcgatccagttgatttcctgggacttcaggacaaaatcaaagaagtcccacggcccagaaagcgactgaccgagttgctgctccgaacggcgaccgaaaagccgggaccggctgaggccgcccggcaggcctcagccagtcgggcctggggtcttaggttcttcagatcgcctcagcaggtcctcccttcgcccgacggacggcgagcagccggagtgcgattggccgtcacgcgcttagaggtgtcactcatgttcctcaaggacaccccctttccaggactgtgccatcctcccggcgttgcccataccctgcccaaccgcgtatcgatgcggccccccgtgcagtgccctcgagaaacttggaagacttcactcgttgggtggtgtagcgctgccctcggtattcgcgccgcccttagtacacaggcctgtccactgactccaagcctaggttcgagtcctatgtggcgggcagggctgtggatgtgccaggcctctacagctgccgccggatag

SEQ ID NO: 187765 - DNA, 1320 bp, Artificial Sequence
  Description of Artificial Sequence: Synthetic coding sequence
atggaggacaaggaccgggagcacccccaggcccacgtggacatctacgagaagcaaccagtcccctttggactggtccgctttggagtggcaccagatcaccctgaagtcaaaaacgtgattaacacattcactcaaactgcgcacagcggccgttgcgctttctgggggaacgtcgaagtggggagagacgtgactgttcccgaactgcgagaggcgtatcacgctgtggtcctctcatacggcgcagaagatcaccgcgccctagagatacccggagaagagttgccaggtgtgtgttctgccagagctttcgtggggtggtacaacggccttcccgaaaaccaggagcttgagcccgatctctcctgcgatactgcagtaatcttgggacagggcaacgtagctttggatgtcgcaaggattctgctgactcctccagagcatctagagagaacagacatcacgaaggcagccctgggcgtgcttcgccaatcccgtgtcaaaacagtttggctggtgggccgtaggggtcccctgcaagtcgcattcaccattaaggagcttcgcgagatgattcagctccctggagctcgacccatactggatccagtcgatttcttgggcctccaggataagattaaagaggtgccgagaccaagaaaaaggctcacagaactattgctcaggactgccactgaaaagcccggaccagctgaagcagccaggcaagcttctgccagtcgggcttgggggctgagattctttcgttctcctcagcaggtgttaccttcacccgatggccgaagggccgccggggtaagactcgctgtcacaaggcttgaaggcgtagacgaagccaccagagccgtgccaactggggacatggaagatctgccatgtggccttgtgctatcttctattggctacaagtctcgtccagtggatccctccgttccattcgacagtaaattgggagtcatcccaaacgtcgaggggcgcgtgatggatgttcctggattatactgctctggctgggtaaagcgcggacctactggagtgatagccacaactatgacagatagcttcttaacaggccagatgcttctccaggaccttaaggcaggcctgctgccaagcggtccacgacccggatacgccgctatacaggctcttctgagttcccgcggagttaggcccgtaagctttagtgactgggaaaagctcgatgccgaagaggtggcaagagggcagggaactggtaagccgcgggaaaagctggtggacccacaggagatgttaagactgctaggccactag

SEQ ID NO: 187766 - DNA, 1494 bp, Artificial Sequence
  Description of Artificial Sequence: Synthetic coding sequence
atggccagccggtgctggcggtggtggggctggagcgcctggcccagaaccagactccctccagctggctctaccccatctttctgccatcacttctcaacccaggagaagaccccccagatctgtgttgtgggatccggcccagcgggcttctatacagcgcagcacctgcttaagcacccacaggctcatgtggatatttacgagaagcagcccgtcccttttggactggtgcgattcggagtggccccagatcatccagaggtgaaaaatgtgattaacaccttcactcagaccgctcatagtggtagatgtgctttttggggcaatgtcgaagtgggacgagatgttacggtgccggagctgagagaggcttatcatgccgtggtcctgagctacggggcagaagaccatagagcactggagatcccaggcgaagaactgccaggggtctgctctgcacgggcctttgtcggctggtacaacggactgcctgagaatcaggagcttgaaccggacctaagctgtgacactgctgtgatactcgggcagggcaatgtggccttagacgtcgctagaatcctgctcaccccgcccgagcacctagaggcactcctgttgtgccaacggaccgatattaccaaagccgcactgggagttctgaggcaaagtagggtcaaaactgtgtggttagtagggaggagggggcctttgcaagtggcattcacaatcaaagagttgcgggagatgattcaactgcctggggcccgtcctatcctcgaccccgtggatttcctggggctgcaggataaaatcaaggaagtgcccagaccacgcaaacgtcttactgagcttctcctgaggacagcaactgagaaaccaggacccgcagaggcagcgcgccaagcttccgcatctagagcatgggggctgcgcttctttcggagtcctcagcaggtcctgccaagtccagacgggagacgagcagcaggcgtcaggctcgccgtcacaaggttggagggcgtggacgaggctactcgtgccgtcccaacaggcgacatggaggatcttccatgtgggctagtgctctcaagcattggatataaaagccggcccgtcgatccatctgtcccttttgattcgaaactgggcgtgatcccaaacgtggagggaagagtcatggacgtgcccggtctgtattgctccgggtgggtaaagagaggccccaccggggtgatcgctacaacaatgaccgactcattcctcacggggcagatgctgttgcaagatctgaaggccggactactaccctcgggacccagaccaggctacgccgccattcaggccttactgtctagcagaggggtgaggcccgttagttttagtgactgggagaagctggatgccgaggaagtggcacgtggccaggggaccgggaagcctcgcgaaaagcttgtggacccacaggaaatgctccgcctgctggggcattag

SEQ ID NO: 187767 - DNA, 1452 bp, Artificial Sequence
  Description of Artificial Sequence: Synthetic coding sequence
atggccagccggtgctggcggtggtggggctggagcgcctggccccgaaccaggctgccacctgcaggctccaccccatccttttgccaccatttttccacccaagagaaaacccctcaaatctgcgtggtgggcagcggcccagctggattctatacggcccaacacctcctcaaacaccctcaagctcatgtggacatctacgagaagcaacctgtgccgtttgggctggtgaggttcggggtggccccggatcatcctgaagtgaagactgctcattcaggtagatgcgctttctggggaaacgtggaggtggggcgtgacgttactgtgcctgagctgagagaagcttatcacgctgtcgtcctctcttacggtgccgaggaccatagggccctggagatacctggggaggagcttcccggtgtctgttccgctagggccttcgtagggtggtacaacggcctgcctgagaaccaggaactggaacccgatctgtcatgtgatactgccgtgatcctgggtcagggcaatgtggccctggacgttgcccggatcctccttactccccctgaacacctggaaaggactgatatcacgaaggccgctctgggagttctgcggcagtctcgagtgaagactgtctggctcgtgggtaggcgggggcccctacaggttgctttcacaatcaaggagctccgcgaaatgattcagctgcccggtgcgagaccaattcttgatcctgtggatttcttggggctgcaggacaaaatcaaggaggttcccagacctcgaaaacgtctgaccgaactcctcctgagaacagctaccgagaaaccaggaccagccgaagcagctaggcaagcttcagcctcccgtgcatggggtctgagattctttaggtccccgcagcaggtgctgccatctccggacggccggagagctgccggcgtccgattagccgtcacacgcctggaaggcgtagacgaagccactcgggcggtgccaacgggggacatggaggacttgccctgtggtctggttttatcctcaattgggtataaaagcaggccagtagatcccagtgtgcccttcgatagtaagttgggtgtcattccaaacgtggaagggagggttatggacgtacccggactctattgtagtggctgggtaaaacggggcccgactggggttattgccactaccatgactgactcgttcttgactggccagatgttgctgcaagacctcaaggctggtctgctgccgagtggccccagacctggctacgctgctattcaggctctactatcttccagaggcgtgcgtcctgttagcttctctgattgggaaaagctggacgcagaagaggtagcccgtgggcagggaaccggcaagccccgagagaaacttgtggacccacaagaaatgcttaggctgcttggccattag

SEQ ID NO: 187768 - DNA, 1881 bp, Artificial Sequence
  Description of Artificial Sequence: Synthetic coding sequence
atggccgtgagcggcttcaccctgggcacctgcatcctgctgctgcacatttcatatgtagctaactacccgaacggcaaagtgacccagtcctgccacgggatgatccctgagcacggccattcccctcagtctgtgccagtccacgacatctatgtgagtcagatgaccttccgaccaggcgaccagattgaggtcactctgtccgggcacccatttaaaggcttcctgttagaagcaagaaatgcggaggatctgaatgggcctcccatcggttctttcacgttaattgacagtgaggtcagccagctgctgacttgtgaggacatccagggatcagcagtgtctcaccgaagcgcttctaagaagactgagataaaagtatactggaatgccccctcctccgcacccaaccatacacagtttctcgttaccgtggtcgaaaagtataaaatctactgggtcaagataccaggccccattatttctcaaccgaacgccttcccctttacgactccaaaggctacagtggtcccattaccgacactgccccctgtgtcgcaccttacaaagcctttctcagccagcgattgtggcaataaaaagttttgtataaggtccccgctgaattgcgatcccgaaaaggaagcctcttgcgtcttcctgtcattcactcgggacgaccagtccgtaatggtggaaatgtcaggcccatctaaaggatacctgtccttcgctctgtcgcatgatcagtggatgggtgatgatgatgcttacctctgtatacacgaggatcagacagtgtacatccagccatcacacctgactggccgttcccaccccgtgatggatagccgtgatacgttagaggacatggcctggcgactggccgacggggttatgcagtgctccttcagacgcaatatcaccctaccaggtgtgaagaaccggtttgacctgaacacttcgtactacattttcctggccgacggcgctgcaaatgatggacgaatttacaaacactctcaacagccactaatcacctatgagaaatatgatgtcacagattctcctaagaatattgggggttcacactccgtgttattactgaaagtacacggagccctgatgttcgtggcatggatgaccacagtgagtataggggtgcttgttgctcgattcttcaagcctgtgtggagcaaagccttcctccttggcgaagcggcatggttccaggtccaccgcatgctcatgttcaccacaaccgtgctcacttgcattgcatttgtaatgcctttcatatatagagggggctggagccgacacgcagggtatcatccttatctgggttgcatcgtgatgacacttgctgtgctgcagccccttttagctgtcttccgtccacccttgcacgacccccggcggcagatgtttaattggacgcactggagtatgggaaccgccgctcgcatcattgccgttgccgcgatgtttttaggcatggacctgccaggactgaacctgcctgatagttggaagacgtacgccatgacaggctttgtggcatggcatgtaggcactgaggtcgttctggaactcaaatactggatgatgacagaatttcgctccttctctcacttactgcagtggaagcagcgagtcatgctcttaaaaagacagtgttggcagtttatgtcggtgggcatgcttctgtttagcagctatttctatctgcaatctactatttacgaacaggcgaaaacccttgcctttgcaggtcaggtcatcatcataattaaaccaaagaagctcgaagcttgcccggattgcctcgagcacatttgtgagttttccctcggtaggcttgggtcatgcttgtag

SEQ ID NO: 187769 - DNA, 1779 bp, Artificial Sequence
  Description of Artificial Sequence: Synthetic coding sequence
atggccgtgagcggcttcaccctgggcacctgcatcctgctgctgcatatttcctatgtagccaattacccaaacggcaaggtaactcagagctgtcacggtatgatacccgaacatggccactctccccagagtgtccccgtgcatgacatttacgtgtcacagatgacatttcggccaggggaccagatagaggtgacactctcaggtcatccctttaaggggtttctccttgaagcaaggaacgctgaagacctcaatggtcccccaataggctccttcacgctgatcgactccgaagtgtctcagttgctgacatgcgaagacatacaaggctctgccgttagtcatcgctccgcctccaaaaagaccgaaataaaagtttactggaatgcccctagttccgctcctaatcacacccagtttctggtgactgtggtggagaagtacaaaatttactgggtgaaaatccctgggcccattatctctcagccaaatgctttcccatttacgacacccaaggcgacagtcgttccattacctacattgccaccggtctcccatctaactaagccattcagtgcttcagactgtggcaacaaaaaattctgcattcgaagccctttaaattgcgatcccgagaaagaggcctcttgcgtcttcctttcatttaccagggatgatcagtccgtgatggtcgaaatgtctgggccctccaaaggttatctgtcctttgcgctgtcccacgaccagtggatgggcgatgatgatgcgtatctctgtattcatgaggatcagacggtttacatccagcccagtcatttaacgggaaggtcacacccagtcatggattctcgggacactctcgaggacatggcatggcgactagctgacggtgtgatgcagtgctccttcaggagaaacattactctgccaggggtgaagaatagattcgatctcaacaccagctattacatatttttggccgacggcgctgctaacgatggtaggatttataagcacagccaacagcccctcatcacctatgaaaaatacgatgttaccgatagcccaaagaatattggtgggtctcattctgtgctgctacttaaagtgcatggcgccctcatgtttgtggcttggatgactacggtgagcatcggcgtactggtagcacggttttttaaaccggtgtggtccaaagctttcctgctgggggaggcggcctggttccaggtccacagaatgctgatgttcacaactacagtgctgacatgcattgccttcgtgatgccgttcatttaccggggggggtggtcaagacatgccgggtaccatccttacctggggtgcattgtcatgaccctggccgtgctccagccccttctggctgtgtttcgccctcctctccacgacccgaggaggcagatgttcaattggacgcactggagcatgggaacagcagctagaataatcgccgttgcagcaatgtttctaggaatggatcttccagggctgaatctgcccgattcctggaagacgtacgcaatgaccggcttcgtggcttggcacgtcggcactgaagtcgtgttggaagttcatgcctacagactgtcacgaaaggtcgagattctagatgacgataggatccaaattctccagtctttcactgctgtggagacggagggccatgcctttaagaaggccgtgctggcaatatacgtgtgcggtaacgtgacatttctcatcattttcctgtccgctataaaccacctgtag

SEQ ID NO: 187770 - DNA, 729 bp, Artificial Sequence
  Description of Artificial Sequence: Synthetic coding sequence
atgctgagctgcttccggctgctgagccggcacatcagccccagcctggccagcttgagacctgtccgctgctgcttcgccctgccactgagatgggcccccggccgaccactggacccccgccagatcgctccaaggaggcctctcgcagccgcggcctctagccgtgaccccacaggccctgcagccggccccagccgggtccgtcagaatttccatccagacagcgaggccgccataaaccgccaaatcaacttagagctttatgcttcctacgtatatctgtccatggcctactacttctcccgagacgacgtagctttgaacaatttcagcaggtactttctccatcagagcagggaagagacggagcacgccgagaagctgatgcgcctgcaaaaccagcgcggcggtagaatcaggctccaggacatcaaaaagcccgagcaggacgactgggagagcggactgcacgcgatggagtgcgcactgttgctggagaagaatgtaaaccagagcttgctggagctgcatgcgctggcttccgacaaaggagatccccacctctgtgactttcttgagacctattacctcaatgaacaggttaagagtattaaagagctaggagatcatgtccacaatcttgtgaaaatgggagccccagatgctggactggccgagtacctctttgacacacatacactgggaaacgagaacaaacagaactag

SEQ ID NO: 187771 - DNA, 552 bp, Artificial Sequence
  Description of Artificial Sequence: Synthetic coding sequence
atgaccaccgccagcaccagccaggtgcggcagaactaccaccaggactctgaggcggctataaatcgacaaataaatcttgagttatacgcctcttacgtctacctaagcatgtcttactatttcgatcgcgacgacgttgcgctgaaaaacttcgctaaatatttcctgcatcagagccatgaagagagagaacatgctgagaagctgatgaaacttcagaaccagaggggtggacgtattttcctccaggacattaagaaaccggattgcgatgactgggagtctggcctaaatgccatggagtgcgctctccacttggagaagaacgttaaccagtcactcttagaactccataaactggcaaccgacaagaacgatccacatctgtgcgacttcatcgagacacattatctgaacgagcaggtgaaggcaattaaggaacttggggatcacgtgaccaatctacgaaaaatgggagccccggaaagtgggctggcagagtacttattcgataagcatactttgggagactcggataacgaaagttag

SEQ ID NO: 187772 - DNA, 699 bp, Artificial Sequence
  Description of Artificial Sequence: Synthetic coding sequence
agcggcttccccgccagcaccgtgctgggccggaaccccgccctggtgccccaccccgggaggcctcccattgcgtcaccaccatctcctctgcacagaaccttggggctgcctcagggccccaggcggctcagtctcgtggccgccatgactactgcctctacatcccaggtgcgccagaactaccaccaggattcagaagccgcaatcaacagacagattaatctcgaactgtacgcctcatacgtgtacctttctatgtcctactactttgacagggacgatgtcgccctgaagaattttgctaagtactttcttcatcagagccatgaggaacgcgagcacgcagagaagttgatgaagctccagaaccaaagaggaggccgaattttcctgcaggatataaaaaaaccagactgtgacgactgggaatcaggtttgaacgctatggagtgcgctctgcatctggaaaagaatgtcaaccaatctttgttagaactccataagttggccactgacaagaacgatcctcatttgtgcgattttatcgagactcactatctgaacgagcaggtgaaagccattaaggaactgggtgaccacgtgactaacctaagaaagatgggtgctccggaaagtgggctggccgaatatcttttcgacaaacacaccctgggtgattcagacaatgaaagctag
